United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 139

SEQ ID NO: 5897172 - DNA, 19 bp, Homo sapiens
cttttcacctccttcaatt

SEQ ID NO: 5897173 - DNA, 15 bp, Homo sapiens
cttttcacctgaaat

SEQ ID NO: 5897174 - DNA, 22 bp, Homo sapiens
cttttcacgttttctttacaca

SEQ ID NO: 5897175 - DNA, 16 bp, Homo sapiens
cttttcactgcctgta

SEQ ID NO: 5897176 - DNA, 12 bp, Homo sapiens
cttttcactgct

SEQ ID NO: 5897177 - DNA, 18 bp, Homo sapiens
cttttcactgctggctgc

SEQ ID NO: 5897178 - DNA, 20 bp, Homo sapiens
cttttcactgctgttatatt

SEQ ID NO: 5897179 - DNA, 20 bp, Homo sapiens
cttttcacttcctctccaca

SEQ ID NO: 5897180 - DNA, 19 bp, Homo sapiens
cttttcactttattgctat

SEQ ID NO: 5897181 - DNA, 23 bp, Homo sapiens
cttttcagaagatggtgaagaca

SEQ ID NO: 5897182 - DNA, 11 bp, Homo sapiens
cttttcagata

SEQ ID NO: 5897183 - DNA, 15 bp, Homo sapiens
cttttcagataatga

SEQ ID NO: 5897184 - DNA, 13 bp, Homo sapiens
cttttcagccctt

SEQ ID NO: 5897185 - DNA, 17 bp, Homo sapiens
cttttcagctgagccct

SEQ ID NO: 5897186 - DNA, 18 bp, Homo sapiens
cttttcagctgagccctg

SEQ ID NO: 5897187 - DNA, 16 bp, Homo sapiens
cttttcagcttctgct

SEQ ID NO: 5897188 - DNA, 18 bp, Homo sapiens
cttttcagcttgtttcta

SEQ ID NO: 5897189 - DNA, 20 bp, Homo sapiens
cttttcagcttgtttctata

SEQ ID NO: 5897190 - DNA, 20 bp, Homo sapiens
cttttcagggctggctcctg

SEQ ID NO: 5897191 - DNA, 20 bp, Homo sapiens
cttttcataaagggttgaaa

SEQ ID NO: 5897192 - DNA, 23 bp, Homo sapiens
cttttcataaagggttgaaaatg

SEQ ID NO: 5897193 - DNA, 20 bp, Homo sapiens
cttttcataacctagcctta

SEQ ID NO: 5897194 - DNA, 15 bp, Homo sapiens
cttttcatatcattt

SEQ ID NO: 5897195 - DNA, 18 bp, Homo sapiens
cttttcatatctcttgcc

SEQ ID NO: 5897196 - DNA, 18 bp, Homo sapiens
cttttcatatttgcacta

SEQ ID NO: 5897197 - DNA, 18 bp, Homo sapiens
cttttcatcaaaaagcct

SEQ ID NO: 5897198 - DNA, 14 bp, Homo sapiens
cttttcatcaattc

SEQ ID NO: 5897199 - DNA, 21 bp, Homo sapiens
cttttcatcaccgtcccgcac

SEQ ID NO: 5897200 - DNA, 21 bp, Homo sapiens
cttttcatctccagtgtgaat

SEQ ID NO: 5897201 - DNA, 13 bp, Homo sapiens
cttttcatgcaaa

SEQ ID NO: 5897202 - DNA, 14 bp, Homo sapiens
cttttcatgcaaac

SEQ ID NO: 5897203 - DNA, 16 bp, Homo sapiens
cttttcatgcccatcc

SEQ ID NO: 5897204 - DNA, 22 bp, Homo sapiens
cttttcatgtacagcattaaaa

SEQ ID NO: 5897205 - DNA, 18 bp, Homo sapiens
cttttcattagcagttgc

SEQ ID NO: 5897206 - DNA, 19 bp, Homo sapiens
cttttcattgtgtatcagt

SEQ ID NO: 5897207 - DNA, 22 bp, Homo sapiens
cttttcatttaggtgaggaagc

SEQ ID NO: 5897208 - DNA, 19 bp, Homo sapiens
cttttcatttatcaagcag

SEQ ID NO: 5897209 - DNA, 13 bp, Homo sapiens
cttttcatttgtg

SEQ ID NO: 5897210 - DNA, 16 bp, Homo sapiens
cttttccaaataaaca

SEQ ID NO: 5897211 - DNA, 22 bp, Homo sapiens
cttttccaaataaacatttttt

SEQ ID NO: 5897212 - DNA, 15 bp, Homo sapiens
cttttccaacccatg

SEQ ID NO: 5897213 - DNA, 13 bp, Homo sapiens
cttttccaaccct

SEQ ID NO: 5897214 - DNA, 16 bp, Homo sapiens
cttttccaagcccttt

SEQ ID NO: 5897215 - DNA, 11 bp, Homo sapiens
cttttccaatg

SEQ ID NO: 5897216 - DNA, 16 bp, Homo sapiens
cttttccacatggcag

SEQ ID NO: 5897217 - DNA, 18 bp, Homo sapiens
cttttccactcctatgga

SEQ ID NO: 5897218 - DNA, 16 bp, Homo sapiens
cttttccagaaagaaa

SEQ ID NO: 5897219 - DNA, 21 bp, Homo sapiens
cttttccagagcattccagtc

SEQ ID NO: 5897220 - DNA, 18 bp, Homo sapiens
cttttccaggagttctga

SEQ ID NO: 5897221 - DNA, 16 bp, Homo sapiens
cttttccaggatcctg

SEQ ID NO: 5897222 - DNA, 14 bp, Homo sapiens
cttttccagtattt

SEQ ID NO: 5897223 - DNA, 17 bp, Homo sapiens
cttttccagtctgtaca

SEQ ID NO: 5897224 - DNA, 13 bp, Homo sapiens
cttttccatcatc

SEQ ID NO: 5897225 - DNA, 20 bp, Homo sapiens
cttttccatcccactccact

SEQ ID NO: 5897226 - DNA, 18 bp, Homo sapiens
cttttccattctgggtgt

SEQ ID NO: 5897227 - DNA, 22 bp, Homo sapiens
cttttcccaaaatgttgaaata

SEQ ID NO: 5897228 - DNA, 23 bp, Homo sapiens
cttttcccaacccccagccccca

SEQ ID NO: 5897229 - DNA, 18 bp, Homo sapiens
cttttcccactgtttaag

SEQ ID NO: 5897230 - DNA, 21 bp, Homo sapiens
cttttcccagagaccttctga

SEQ ID NO: 5897231 - DNA, 13 bp, Homo sapiens
cttttcccatcac

SEQ ID NO: 5897232 - DNA, 17 bp, Homo sapiens
cttttcccatttgtaat

SEQ ID NO: 5897233 - DNA, 13 bp, Homo sapiens
cttttccccagga

SEQ ID NO: 5897234 - DNA, 19 bp, Homo sapiens
cttttcccccattaatcag

SEQ ID NO: 5897235 - DNA, 16 bp, Homo sapiens
cttttcccccttccca

SEQ ID NO: 5897236 - DNA, 14 bp, Homo sapiens
cttttccccgcctg

SEQ ID NO: 5897237 - DNA, 16 bp, Homo sapiens
cttttcccctacagaa

SEQ ID NO: 5897238 - DNA, 18 bp, Homo sapiens
cttttcccctcattgcat

SEQ ID NO: 5897239 - DNA, 22 bp, Homo sapiens
cttttcccctcattgcatttat

SEQ ID NO: 5897240 - DNA, 14 bp, Homo sapiens
cttttcccctgtcc

SEQ ID NO: 5897241 - DNA, 14 bp, Homo sapiens
cttttcccctgtta

SEQ ID NO: 5897242 - DNA, 16 bp, Homo sapiens
cttttcccctgttaaa

SEQ ID NO: 5897243 - DNA, 12 bp, Homo sapiens
cttttccctctt

SEQ ID NO: 5897244 - DNA, 18 bp, Homo sapiens
cttttccctgcttccagg

SEQ ID NO: 5897245 - DNA, 20 bp, Homo sapiens
cttttccctgcttccaggaa

SEQ ID NO: 5897246 - DNA, 15 bp, Homo sapiens
cttttccctgggtgg

SEQ ID NO: 5897247 - DNA, 16 bp, Homo sapiens
cttttccctgggtgga

SEQ ID NO: 5897248 - DNA, 22 bp, Homo sapiens
cttttcccttacaaggtgggga

SEQ ID NO: 5897249 - DNA, 11 bp, Homo sapiens
cttttcccttc

SEQ ID NO: 5897250 - DNA, 15 bp, Homo sapiens
cttttcccttgctgt

SEQ ID NO: 5897251 - DNA, 22 bp, Homo sapiens
cttttccggggcacaagttttt

SEQ ID NO: 5897252 - DNA, 22 bp, Homo sapiens
cttttccgttctgttctgctgg

SEQ ID NO: 5897253 - DNA, 12 bp, Homo sapiens
cttttcctatcc

SEQ ID NO: 5897254 - DNA, 16 bp, Homo sapiens
cttttcctcaagcaat

SEQ ID NO: 5897255 - DNA, 13 bp, Homo sapiens
cttttcctccaga

SEQ ID NO: 5897256 - DNA, 18 bp, Homo sapiens
cttttcctctctcccgga

SEQ ID NO: 5897257 - DNA, 22 bp, Homo sapiens
cttttcctctctctccctcttt

SEQ ID NO: 5897258 - DNA, 21 bp, Homo sapiens
cttttcctggacttaaagaaa

SEQ ID NO: 5897259 - DNA, 16 bp, Homo sapiens
cttttcctggcagctg

SEQ ID NO: 5897260 - DNA, 17 bp, Homo sapiens
cttttcctggcagctgc

SEQ ID NO: 5897261 - DNA, 19 bp, Homo sapiens
cttttcctgggaatggaat

SEQ ID NO: 5897262 - DNA, 21 bp, Homo sapiens
cttttcctgggccttctcagc

SEQ ID NO: 5897263 - DNA, 22 bp, Homo sapiens
cttttcctgggccttctcagct

SEQ ID NO: 5897264 - DNA, 23 bp, Homo sapiens
cttttcctgggtgctcagggcat

SEQ ID NO: 5897265 - DNA, 22 bp, Homo sapiens
cttttcctgggtttcctgcagg

SEQ ID NO: 5897266 - DNA, 11 bp, Homo sapiens
cttttcctgtc

SEQ ID NO: 5897267 - DNA, 23 bp, Homo sapiens
cttttcctgtcagtgtttttgaa

SEQ ID NO: 5897268 - DNA, 13 bp, Homo sapiens
cttttcctgtgtt

SEQ ID NO: 5897269 - DNA, 16 bp, Homo sapiens
cttttcctgttgtatt

SEQ ID NO: 5897270 - DNA, 18 bp, Homo sapiens
cttttcctgtttttgtta

SEQ ID NO: 5897271 - DNA, 13 bp, Homo sapiens
cttttccttacca

SEQ ID NO: 5897272 - DNA, 20 bp, Homo sapiens
cttttccttagctgtaaaat

SEQ ID NO: 5897273 - DNA, 21 bp, Homo sapiens
cttttccttcagagtgaatca

SEQ ID NO: 5897274 - DNA, 15 bp, Homo sapiens
cttttccttcattca

SEQ ID NO: 5897275 - DNA, 19 bp, Homo sapiens
cttttccttcattcatagg

SEQ ID NO: 5897276 - DNA, 15 bp, Homo sapiens
cttttccttcccaaa

SEQ ID NO: 5897277 - DNA, 22 bp, Homo sapiens
cttttccttcccttttctgttc

SEQ ID NO: 5897278 - DNA, 20 bp, Homo sapiens
cttttccttgcatacaaaca

SEQ ID NO: 5897279 - DNA, 15 bp, Homo sapiens
cttttccttggcatt

SEQ ID NO: 5897280 - DNA, 20 bp, Homo sapiens
cttttccttggggcaggcag

SEQ ID NO: 5897281 - DNA, 11 bp, Homo sapiens
cttttccttta

SEQ ID NO: 5897282 - DNA, 15 bp, Homo sapiens
cttttcctttatcca

SEQ ID NO: 5897283 - DNA, 16 bp, Homo sapiens
cttttcctttctggcc

SEQ ID NO: 5897284 - DNA, 12 bp, Homo sapiens
ctttttaaaaaa

SEQ ID NO: 5897285 - DNA, 13 bp, Homo sapiens
ctttttaaaaaac

SEQ ID NO: 5897286 - DNA, 14 bp, Homo sapiens
ctttttaaaaaata

SEQ ID NO: 5897287 - DNA, 12 bp, Homo sapiens
ctttttaaaata

SEQ ID NO: 5897288 - DNA, 15 bp, Homo sapiens
ctttttaaaatagac

SEQ ID NO: 5897289 - DNA, 23 bp, Homo sapiens
ctttttaaaatatatgtatttaa

SEQ ID NO: 5897290 - DNA, 23 bp, Homo sapiens
ctttttaaagcttttgatgtggt

SEQ ID NO: 5897291 - DNA, 16 bp, Homo sapiens
ctttttaaagtgtttc

SEQ ID NO: 5897292 - DNA, 18 bp, Homo sapiens
ctttttaaagttcaaact

SEQ ID NO: 5897293 - DNA, 13 bp, Homo sapiens
ctttttaaatgtg

SEQ ID NO: 5897294 - DNA, 23 bp, Homo sapiens
ctttttaaccaagttgtttattc

SEQ ID NO: 5897295 - DNA, 16 bp, Homo sapiens
ctttttaagagatact

SEQ ID NO: 5897296 - DNA, 19 bp, Homo sapiens
ctttttaagcttatttaat

SEQ ID NO: 5897297 - DNA, 15 bp, Homo sapiens
ctttttaagtaatgt

SEQ ID NO: 5897298 - DNA, 18 bp, Homo sapiens
ctttttaagtaatgtgga

SEQ ID NO: 5897299 - DNA, 19 bp, Homo sapiens
ctttttaagtaatgtggaa

SEQ ID NO: 5897300 - DNA, 14 bp, Homo sapiens
ctttttaataaaaa

SEQ ID NO: 5897301 - DNA, 14 bp, Homo sapiens
ctttttaattgttg

SEQ ID NO: 5897302 - DNA, 15 bp, Homo sapiens
ctttttaattgttgt

SEQ ID NO: 5897303 - DNA, 17 bp, Homo sapiens
ctttttacagcagcaat

SEQ ID NO: 5897304 - DNA, 19 bp, Homo sapiens
ctttttacagcagcaatat

SEQ ID NO: 5897305 - DNA, 14 bp, Homo sapiens
ctttttacagcatt

SEQ ID NO: 5897306 - DNA, 17 bp, Homo sapiens
ctttttacagcattgtc

SEQ ID NO: 5897307 - DNA, 16 bp, Homo sapiens
ctttttacattacaga

SEQ ID NO: 5897308 - DNA, 19 bp, Homo sapiens
ctttttacattcatatctt

SEQ ID NO: 5897309 - DNA, 20 bp, Homo sapiens
ctttttaccgttcacttccc

SEQ ID NO: 5897310 - DNA, 16 bp, Homo sapiens
ctttttagaaagcatt

SEQ ID NO: 5897311 - DNA, 23 bp, Homo sapiens
ctttttaggccacctccaaggac

SEQ ID NO: 5897312 - DNA, 16 bp, Homo sapiens
ctttttagtaatttct

SEQ ID NO: 5897313 - DNA, 14 bp, Homo sapiens
ctttttatacacaa

SEQ ID NO: 5897314 - DNA, 12 bp, Homo sapiens
ctttttatactc

SEQ ID NO: 5897315 - DNA, 14 bp, Homo sapiens
ctttttatatatat

SEQ ID NO: 5897316 - DNA, 20 bp, Homo sapiens
ctttttatatttaaaaaatt

SEQ ID NO: 5897317 - DNA, 14 bp, Homo sapiens
ctttttatcttgag

SEQ ID NO: 5897318 - DNA, 18 bp, Homo sapiens
ctttttattaaaatattt

SEQ ID NO: 5897319 - DNA, 17 bp, Homo sapiens
ctttttattccctgccc

SEQ ID NO: 5897320 - DNA, 14 bp, Homo sapiens
ctttttattgaatc

SEQ ID NO: 5897321 - DNA, 17 bp, Homo sapiens
ctttttattgaatctat

SEQ ID NO: 5897322 - DNA, 11 bp, Homo sapiens
ctttttattgc

SEQ ID NO: 5897323 - DNA, 12 bp, Homo sapiens
ctttttattgca

SEQ ID NO: 5897324 - DNA, 23 bp, Homo sapiens
ctttttattgccttctcaccagc

SEQ ID NO: 5897325 - DNA, 13 bp, Homo sapiens
ctttttatttata

SEQ ID NO: 5897326 - DNA, 16 bp, Homo sapiens
ctttttatttctgcat

SEQ ID NO: 5897327 - DNA, 15 bp, Homo sapiens
ctttttatttgcatg

SEQ ID NO: 5897328 - DNA, 21 bp, Homo sapiens
ctttttcaaaaaccagccagg

SEQ ID NO: 5897329 - DNA, 22 bp, Homo sapiens
ctttttcaaaaaccagccaggc

SEQ ID NO: 5897330 - DNA, 16 bp, Homo sapiens
ctttttcaacttggaa

SEQ ID NO: 5897331 - DNA, 17 bp, Homo sapiens
ctttttcaacttggaaa

SEQ ID NO: 5897332 - DNA, 15 bp, Homo sapiens
ctttttcaataactg

SEQ ID NO: 5897333 - DNA, 20 bp, Homo sapiens
ctttttcaatgaattttata

SEQ ID NO: 5897334 - DNA, 19 bp, Homo sapiens
ctttttcaccctattttca

SEQ ID NO: 5897335 - DNA, 23 bp, Homo sapiens
ctttttcaccctattttcagata

SEQ ID NO: 5897336 - DNA, 14 bp, Homo sapiens
ctttttcactctgt

SEQ ID NO: 5897337 - DNA, 15 bp, Homo sapiens
ctttttcactctgtg

SEQ ID NO: 5897338 - DNA, 16 bp, Homo sapiens
ctttttcactttgaaa

SEQ ID NO: 5897339 - DNA, 22 bp, Homo sapiens
ctttttcagaaacagggcagca

SEQ ID NO: 5897340 - DNA, 21 bp, Homo sapiens
ctttttcagagttgctttaaa

SEQ ID NO: 5897341 - DNA, 14 bp, Homo sapiens
ctttttcaggctcg

SEQ ID NO: 5897342 - DNA, 18 bp, Homo sapiens
ctttttcataaattattt

SEQ ID NO: 5897343 - DNA, 12 bp, Homo sapiens
ctttttcataat

SEQ ID NO: 5897344 - DNA, 12 bp, Homo sapiens
ctttttcatcaa

SEQ ID NO: 5897345 - DNA, 13 bp, Homo sapiens
ctttttcattatt

SEQ ID NO: 5897346 - DNA, 14 bp, Homo sapiens
ctttttcattattt

SEQ ID NO: 5897347 - DNA, 13 bp, Homo sapiens
ctttttcatttat

SEQ ID NO: 5897348 - DNA, 15 bp, Homo sapiens
ctttttcatttatct

SEQ ID NO: 5897349 - DNA, 23 bp, Homo sapiens
ctttttcatttatctataattta

SEQ ID NO: 5897350 - DNA, 12 bp, Homo sapiens
ctttttcatttg

SEQ ID NO: 5897351 - DNA, 17 bp, Homo sapiens
ctttttcatttgcctat

SEQ ID NO: 5897352 - DNA, 22 bp, Homo sapiens
ctttttcatttttttctctctg

SEQ ID NO: 5897353 - DNA, 23 bp, Homo sapiens
ctttttccaaacaatttagccag

SEQ ID NO: 5897354 - DNA, 15 bp, Homo sapiens
ctttttccaaatgct

SEQ ID NO: 5897355 - DNA, 17 bp, Homo sapiens
ctttttccagcaaaatg

SEQ ID NO: 5897356 - DNA, 12 bp, Homo sapiens
ctttttccatca

SEQ ID NO: 5897357 - DNA, 14 bp, Homo sapiens
ctttttccatcatt

SEQ ID NO: 5897358 - DNA, 19 bp, Homo sapiens
ctttttccatcattttaca

SEQ ID NO: 5897359 - DNA, 20 bp, Homo sapiens
ctttttccatttcttcagag

SEQ ID NO: 5897360 - DNA, 20 bp, Homo sapiens
ctttttcccaactttggaaa

SEQ ID NO: 5897361 - DNA, 17 bp, Homo sapiens
ctttttcccaataaatt

SEQ ID NO: 5897362 - DNA, 21 bp, Homo sapiens
ctttttcccagccctttccag

SEQ ID NO: 5897363 - DNA, 20 bp, Homo sapiens
ctttttccccattggaacta

SEQ ID NO: 5897364 - DNA, 19 bp, Homo sapiens
ctttttccccgattttcca

SEQ ID NO: 5897365 - DNA, 22 bp, Homo sapiens
ctttttcccctatcctgttctt

SEQ ID NO: 5897366 - DNA, 17 bp, Homo sapiens
ctttttcccctgcaatg

SEQ ID NO: 5897367 - DNA, 18 bp, Homo sapiens
ctttttcccctgcaatgc

SEQ ID NO: 5897368 - DNA, 18 bp, Homo sapiens
ctttttcctagcctgttt

SEQ ID NO: 5897369 - DNA, 11 bp, Homo sapiens
ctttttcctcc

SEQ ID NO: 5897370 - DNA, 21 bp, Homo sapiens
ctttttcctctaatatgccta

SEQ ID NO: 5897371 - DNA, 17 bp, Homo sapiens
ctttttccttatttcaa

SEQ ID NO: 5897372 - DNA, 15 bp, Homo sapiens
ctttttccttcctga

SEQ ID NO: 5897373 - DNA, 19 bp, Homo sapiens
ctttttccttcctgagaaa

SEQ ID NO: 5897374 - DNA, 20 bp, Homo sapiens
ctttttccttcctgccctgt

SEQ ID NO: 5897375 - DNA, 16 bp, Homo sapiens
ctttttccttctgaaa

SEQ ID NO: 5897376 - DNA, 21 bp, Homo sapiens
ctttttccttcttcagcagga

SEQ ID NO: 5897377 - DNA, 15 bp, Homo sapiens
ctttttcctttataa

SEQ ID NO: 5897378 - DNA, 22 bp, Homo sapiens
ctttttcgccaaactgtctctg

SEQ ID NO: 5897379 - DNA, 12 bp, Homo sapiens
ctttttctaatg

SEQ ID NO: 5897380 - DNA, 13 bp, Homo sapiens
ctttttctaatga

SEQ ID NO: 5897381 - DNA, 20 bp, Homo sapiens
ctttttctaatgaggagaga

SEQ ID NO: 5897382 - DNA, 12 bp, Homo sapiens
ctttttctacat

SEQ ID NO: 5897383 - DNA, 13 bp, Homo sapiens
ctttttctacatg

SEQ ID NO: 5897384 - DNA, 16 bp, Homo sapiens
ctttttctacatgtga

SEQ ID NO: 5897385 - DNA, 21 bp, Homo sapiens
ctttttctaccttgttgtgtt

SEQ ID NO: 5897386 - DNA, 14 bp, Homo sapiens
ctttttctaccttt

SEQ ID NO: 5897387 - DNA, 22 bp, Homo sapiens
ctttttctcactatctgaaaat

SEQ ID NO: 5897388 - DNA, 13 bp, Homo sapiens
ctttttctcagat

SEQ ID NO: 5897389 - DNA, 21 bp, Homo sapiens
ctttttctccagctgggctct

SEQ ID NO: 5897390 - DNA, 14 bp, Homo sapiens
ctttttctccctct

SEQ ID NO: 5897391 - DNA, 17 bp, Homo sapiens
ctttttctccctctgga

SEQ ID NO: 5897392 - DNA, 11 bp, Homo sapiens
ctttttctgac

SEQ ID NO: 5897393 - DNA, 16 bp, Homo sapiens
ctttttctgattagct

SEQ ID NO: 5897394 - DNA, 18 bp, Homo sapiens
ctttttctgattagcttt

SEQ ID NO: 5897395 - DNA, 21 bp, Homo sapiens
ctttttctgattagctttgtg

SEQ ID NO: 5897396 - DNA, 20 bp, Homo sapiens
ctttttctgcactatatgca

SEQ ID NO: 5897397 - DNA, 16 bp, Homo sapiens
ctttttctgcgcttca

SEQ ID NO: 5897398 - DNA, 12 bp, Homo sapiens
ctttttctgcta

SEQ ID NO: 5897399 - DNA, 14 bp, Homo sapiens
ctttttctggaaat

SEQ ID NO: 5897400 - DNA, 19 bp, Homo sapiens
ctttttctggaaattttgt

SEQ ID NO: 5897401 - DNA, 17 bp, Homo sapiens
ctttttctgtgtgaggt

SEQ ID NO: 5897402 - DNA, 13 bp, Homo sapiens
ctttttctgttga

SEQ ID NO: 5897403 - DNA, 12 bp, Homo sapiens
ctttttcttaat

SEQ ID NO: 5897404 - DNA, 18 bp, Homo sapiens
ctttttctttataaactt

SEQ ID NO: 5897405 - DNA, 17 bp, Homo sapiens
ctttttctttctttgtt

SEQ ID NO: 5897406 - DNA, 13 bp, Homo sapiens
ctttttcttttct

SEQ ID NO: 5897407 - DNA, 14 bp, Homo sapiens
ctttttcttttcta

SEQ ID NO: 5897408 - DNA, 16 bp, Homo sapiens
ctttttcttttgtaag

SEQ ID NO: 5897409 - DNA, 18 bp, Homo sapiens
ctttttctttttctttct

SEQ ID NO: 5897410 - DNA, 21 bp, Homo sapiens
ctttttcttttttgagacagg

SEQ ID NO: 5897411 - DNA, 22 bp, Homo sapiens
ctttttcttttttgagtgtgca

SEQ ID NO: 5897412 - DNA, 19 bp, Homo sapiens
ctttttctttttttgcata

SEQ ID NO: 5897413 - DNA, 17 bp, Homo sapiens
ctttttctttttttggt

SEQ ID NO: 5897414 - DNA, 18 bp, Homo sapiens
ctttttgaaaaaagtata

SEQ ID NO: 5897415 - DNA, 17 bp, Homo sapiens
ctttttgaaatgaaatt

SEQ ID NO: 5897416 - DNA, 14 bp, Homo sapiens
ctttttgaaatgtc

SEQ ID NO: 5897417 - DNA, 22 bp, Homo sapiens
ctttttgaacttttcattccct

SEQ ID NO: 5897418 - DNA, 11 bp, Homo sapiens
ctttttgaagt

SEQ ID NO: 5897419 - DNA, 12 bp, Homo sapiens
ctttttgaagtg

SEQ ID NO: 5897420 - DNA, 23 bp, Homo sapiens
ctttttgaagtgtaggcagacac

SEQ ID NO: 5897421 - DNA, 13 bp, Homo sapiens
ctttttgaatctt

SEQ ID NO: 5897422 - DNA, 21 bp, Homo sapiens
ctttttgaatgtcataaagaa

SEQ ID NO: 5897423 - DNA, 18 bp, Homo sapiens
ctttttgaccctcattct

SEQ ID NO: 5897424 - DNA, 17 bp, Homo sapiens
ctttttgactgattgtt

SEQ ID NO: 5897425 - DNA, 19 bp, Homo sapiens
ctttttgataagcacatta

SEQ ID NO: 5897426 - DNA, 16 bp, Homo sapiens
ctttttgatcctctac

SEQ ID NO: 5897427 - DNA, 22 bp, Homo sapiens
ctttttgattacagtgtagctt

SEQ ID NO: 5897428 - DNA, 14 bp, Homo sapiens
ctttttgcagcaat

SEQ ID NO: 5897429 - DNA, 21 bp, Homo sapiens
ctttttgccagttttccctgg

SEQ ID NO: 5897430 - DNA, 22 bp, Homo sapiens
ctttttgccagttttccctgga

SEQ ID NO: 5897431 - DNA, 23 bp, Homo sapiens
ctttttgctcccccattttaact

SEQ ID NO: 5897432 - DNA, 21 bp, Homo sapiens
ctttttggaaaagagctggga

SEQ ID NO: 5897433 - DNA, 24 bp, Homo sapiens
ctttttggaaaagagctgggatcc

SEQ ID NO: 5897434 - DNA, 18 bp, Homo sapiens
ctttttggaattgtcttg

SEQ ID NO: 5897435 - DNA, 21 bp, Homo sapiens
ctttttggattgcatctcccc

SEQ ID NO: 5897436 - DNA, 20 bp, Homo sapiens
ctttttggcataacataaat

SEQ ID NO: 5897437 - DNA, 22 bp, Homo sapiens
ctttttggcataacataaatct

SEQ ID NO: 5897438 - DNA, 19 bp, Homo sapiens
ctttttgggagagacttgt

SEQ ID NO: 5897439 - DNA, 14 bp, Homo sapiens
ctttttgggtccag

SEQ ID NO: 5897440 - DNA, 21 bp, Homo sapiens
ctttttgggtttatttggaaa

SEQ ID NO: 5897441 - DNA, 18 bp, Homo sapiens
ctttttggtaatatatat

SEQ ID NO: 5897442 - DNA, 22 bp, Homo sapiens
ctttttggtaatatatatattt

SEQ ID NO: 5897443 - DNA, 23 bp, Homo sapiens
ctttttggtcgaggagtaacaat

SEQ ID NO: 5897444 - DNA, 17 bp, Homo sapiens
ctttttggtggatgtaa

SEQ ID NO: 5897445 - DNA, 15 bp, Homo sapiens
ctttttgtaaatgct

SEQ ID NO: 5897446 - DNA, 23 bp, Homo sapiens
ctttttgtaaatgctgtaaatat

SEQ ID NO: 5897447 - DNA, 16 bp, Homo sapiens
ctttttgtacctggtg

SEQ ID NO: 5897448 - DNA, 18 bp, Homo sapiens
ctttttgtactttggaac

SEQ ID NO: 5897449 - DNA, 22 bp, Homo sapiens
ctttttgtataaatgacaaagt

SEQ ID NO: 5897450 - DNA, 16 bp, Homo sapiens
ctttttgtatgtgaac

SEQ ID NO: 5897451 - DNA, 17 bp, Homo sapiens
ctttttgtatgtgaaca

SEQ ID NO: 5897452 - DNA, 17 bp, Homo sapiens
ctttttgtattttttcc

SEQ ID NO: 5897453 - DNA, 20 bp, Homo sapiens
ctttttgtattttttcctta

SEQ ID NO: 5897454 - DNA, 24 bp, Homo sapiens
ctttttgtgtgcaggctgtctcat

SEQ ID NO: 5897455 - DNA, 23 bp, Homo sapiens
ctttttgttccctcattctgcat

SEQ ID NO: 5897456 - DNA, 21 bp, Homo sapiens
ctttttgttgtaaaacaaaat

SEQ ID NO: 5897457 - DNA, 22 bp, Homo sapiens
ctttttgttgttgttgttcttt

SEQ ID NO: 5897458 - DNA, 12 bp, Homo sapiens
ctttttgtttca

SEQ ID NO: 5897459 - DNA, 12 bp, Homo sapiens
ctttttgtttct

SEQ ID NO: 5897460 - DNA, 23 bp, Homo sapiens
ctttttgtttgtactggttcatt

SEQ ID NO: 5897461 - DNA, 14 bp, Homo sapiens
ctttttgtttgttt

SEQ ID NO: 5897462 - DNA, 16 bp, Homo sapiens
gaaaaaaattggcatt

SEQ ID NO: 5897463 - DNA, 23 bp, Homo sapiens
gaaaaaacaactaaaaaaatttt

SEQ ID NO: 5897464 - DNA, 19 bp, Homo sapiens
gaaaaaacacctagcttta

SEQ ID NO: 5897465 - DNA, 14 bp, Homo sapiens
gaaaaaactggaaa

SEQ ID NO: 5897466 - DNA, 23 bp, Homo sapiens
gaaaaaagaaattccctggacca

SEQ ID NO: 5897467 - DNA, 13 bp, Homo sapiens
gaaaaaagaatgt

SEQ ID NO: 5897468 - DNA, 10 bp, Homo sapiens
gaaaaaagag

SEQ ID NO: 5897469 - DNA, 12 bp, Homo sapiens
gaaaaaagcaca

SEQ ID NO: 5897470 - DNA, 20 bp, Homo sapiens
gaaaaaagcacatacattaa

SEQ ID NO: 5897471 - DNA, 20 bp, Homo sapiens
gaaaaaagggtttatgctta

SEQ ID NO: 5897472 - DNA, 13 bp, Homo sapiens
gaaaaaagtcacc

SEQ ID NO: 5897473 - DNA, 16 bp, Homo sapiens
gaaaaaagtccttcag

SEQ ID NO: 5897474 - DNA, 12 bp, Homo sapiens
gaaaaaagtgtt

SEQ ID NO: 5897475 - DNA, 14 bp, Homo sapiens
gaaaaaagttgtag

SEQ ID NO: 5897476 - DNA, 15 bp, Homo sapiens
gaaaaaatacatttt

SEQ ID NO: 5897477 - DNA, 14 bp, Homo sapiens
gaaaaaatactacc

SEQ ID NO: 5897478 - DNA, 22 bp, Homo sapiens
gaaaaaatcaaggtacaggaaa

SEQ ID NO: 5897479 - DNA, 14 bp, Homo sapiens
gaaaaaatcagaac

SEQ ID NO: 5897480 - DNA, 14 bp, Homo sapiens
gaaaaaatgctgag

SEQ ID NO: 5897481 - DNA, 18 bp, Homo sapiens
gaaaaaatgctgagccag

SEQ ID NO: 5897482 - DNA, 21 bp, Homo sapiens
gaaaaaatggcaagagatcat

SEQ ID NO: 5897483 - DNA, 16 bp, Homo sapiens
gaaaaaatggtataaa

SEQ ID NO: 5897484 - DNA, 12 bp, Homo sapiens
gaaaaaatgtag

SEQ ID NO: 5897485 - DNA, 14 bp, Homo sapiens
gaaaaaatgttcta

SEQ ID NO: 5897486 - DNA, 23 bp, Homo sapiens
gaaaaaatgttctatatgcattt

SEQ ID NO: 5897487 - DNA, 14 bp, Homo sapiens
gaaaaaatgttgga

SEQ ID NO: 5897488 - DNA, 12 bp, Homo sapiens
gaaaaaattaac

SEQ ID NO: 5897489 - DNA, 20 bp, Homo sapiens
gaaaaaattaagagatacat

SEQ ID NO: 5897490 - DNA, 21 bp, Homo sapiens
gaaaaaattaagagatacatt

SEQ ID NO: 5897491 - DNA, 22 bp, Homo sapiens
gaaaaaattaagagatacattc

SEQ ID NO: 5897492 - DNA, 14 bp, Homo sapiens
gaaaaaattttaaa

SEQ ID NO: 5897493 - DNA, 19 bp, Homo sapiens
gaaaaacaaattcatcaaa

SEQ ID NO: 5897494 - DNA, 12 bp, Homo sapiens
gaaaaacaacaa

SEQ ID NO: 5897495 - DNA, 15 bp, Homo sapiens
gaaaaacaacaaata

SEQ ID NO: 5897496 - DNA, 16 bp, Homo sapiens
gaaaaacaacatcatt

SEQ ID NO: 5897497 - DNA, 19 bp, Homo sapiens
gaaaaacaagtttgctagt

SEQ ID NO: 5897498 - DNA, 12 bp, Homo sapiens
gaaaaacaataa

SEQ ID NO: 5897499 - DNA, 13 bp, Homo sapiens
gaaaaacaatctt

SEQ ID NO: 5897500 - DNA, 17 bp, Homo sapiens
gaaaaacaattttctgt

SEQ ID NO: 5897501 - DNA, 15 bp, Homo sapiens
gaaaaacacgagaaa

SEQ ID NO: 5897502 - DNA, 22 bp, Homo sapiens
gaaaaacagcagagtaaaatta

SEQ ID NO: 5897503 - DNA, 12 bp, Homo sapiens
gaaaaacatgtc

SEQ ID NO: 5897504 - DNA, 15 bp, Homo sapiens
gaaaaacatttcctc

SEQ ID NO: 5897505 - DNA, 16 bp, Homo sapiens
gaaaaaccacagatac

SEQ ID NO: 5897506 - DNA, 18 bp, Homo sapiens
gaaaaaccagaggcagct

SEQ ID NO: 5897507 - DNA, 14 bp, Homo sapiens
gaaaaacctgtggg

SEQ ID NO: 5897508 - DNA, 23 bp, Homo sapiens
gaaaaactctgggaaataagaga

SEQ ID NO: 5897509 - DNA, 17 bp, Homo sapiens
gaaaaactggcaacatt

SEQ ID NO: 5897510 - DNA, 16 bp, Homo sapiens
gaaaaactggcttttt

SEQ ID NO: 5897511 - DNA, 22 bp, Homo sapiens
gaaaaactggctttttcccagc

SEQ ID NO: 5897512 - DNA, 12 bp, Homo sapiens
gaaaaactgttg

SEQ ID NO: 5897513 - DNA, 21 bp, Homo sapiens
gaaaaacttttaggttgttac

SEQ ID NO: 5897514 - DNA, 9 bp, Homo sapiens
gaaaaagaa

SEQ ID NO: 5897515 - DNA, 13 bp, Homo sapiens
gaaaaagaaaaaa

SEQ ID NO: 5897516 - DNA, 17 bp, Homo sapiens
gaaaaagaaaaaagggt

SEQ ID NO: 5897517 - DNA, 14 bp, Homo sapiens
gaaaaagaaagaac

SEQ ID NO: 5897518 - DNA, 21 bp, Homo sapiens
gaaaaagaaagaactgtccgt

SEQ ID NO: 5897519 - DNA, 13 bp, Homo sapiens
gaaaaagaaatgc

SEQ ID NO: 5897520 - DNA, 14 bp, Homo sapiens
gaaaaagaaattct

SEQ ID NO: 5897521 - DNA, 21 bp, Homo sapiens
gaaaaagaacatgcagtttga

SEQ ID NO: 5897522 - DNA, 14 bp, Homo sapiens
gaaaaagaagaaaa

SEQ ID NO: 5897523 - DNA, 12 bp, Homo sapiens
gaaaaagaagca

SEQ ID NO: 5897524 - DNA, 23 bp, Homo sapiens
gaaaaagaaggactgaactccat

SEQ ID NO: 5897525 - DNA, 18 bp, Homo sapiens
gaaaaagaataaaaactt

SEQ ID NO: 5897526 - DNA, 11 bp, Homo sapiens
gaaaaagacat

SEQ ID NO: 5897527 - DNA, 21 bp, Homo sapiens
gaaaaagacataaaacagaat

SEQ ID NO: 5897528 - DNA, 13 bp, Homo sapiens
gaaaaagagaaaa

SEQ ID NO: 5897529 - DNA, 13 bp, Homo sapiens
gaaaaagagagag

SEQ ID NO: 5897530 - DNA, 16 bp, Homo sapiens
gaaaaagcaaaaggca

SEQ ID NO: 5897531 - DNA, 19 bp, Homo sapiens
gaaaaagcatgatgggaaa

SEQ ID NO: 5897532 - DNA, 14 bp, Homo sapiens
gaaaaagcatgtac

SEQ ID NO: 5897533 - DNA, 16 bp, Homo sapiens
gaaaaagcatgtacag

SEQ ID NO: 5897534 - DNA, 16 bp, Homo sapiens
gaaaaagcattaaaaa

SEQ ID NO: 5897535 - DNA, 16 bp, Homo sapiens
gaaaaagccctcttca

SEQ ID NO: 5897536 - DNA, 17 bp, Homo sapiens
gaaaaagcctaagaaaa

SEQ ID NO: 5897537 - DNA, 20 bp, Homo sapiens
gaaaaagctccatgtgcctc

SEQ ID NO: 5897538 - DNA, 14 bp, Homo sapiens
gaaaaagctttact

SEQ ID NO: 5897539 - DNA, 11 bp, Homo sapiens
gaaaaaggaaa

SEQ ID NO: 5897540 - DNA, 13 bp, Homo sapiens
gaaaaaggaaaaa

SEQ ID NO: 5897541 - DNA, 14 bp, Homo sapiens
gaaaaaggaaaaat

SEQ ID NO: 5897542 - DNA, 13 bp, Homo sapiens
gaaaaaggaaata

SEQ ID NO: 5897543 - DNA, 21 bp, Homo sapiens
gaaaaaggacaaataaaacat

SEQ ID NO: 5897544 - DNA, 18 bp, Homo sapiens
gaaaaaggacaggcagaa

SEQ ID NO: 5897545 - DNA, 21 bp, Homo sapiens
gaaaaaggagcttacctccca

SEQ ID NO: 5897546 - DNA, 14 bp, Homo sapiens
gaaaaaggatggaa

SEQ ID NO: 5897547 - DNA, 22 bp, Homo sapiens
gaaaaaggatggaagaaagaag

SEQ ID NO: 5897548 - DNA, 12 bp, Homo sapiens
gaaaaaggcagt

SEQ ID NO: 5897549 - DNA, 13 bp, Homo sapiens
gaaaaaggcagtg

SEQ ID NO: 5897550 - DNA, 13 bp, Homo sapiens
gaaaaaggctggt

SEQ ID NO: 5897551 - DNA, 14 bp, Homo sapiens
gaaaaaggtgatta

SEQ ID NO: 5897552 - DNA, 15 bp, Homo sapiens
gaaaaagtagaaaaa

SEQ ID NO: 5897553 - DNA, 23 bp, Homo sapiens
gaaaaagtaggctgccgccacca

SEQ ID NO: 5897554 - DNA, 22 bp, Homo sapiens
gaaaaagtatcatggaaatatt

SEQ ID NO: 5897555 - DNA, 15 bp, Homo sapiens
gaaaaagtcactctt

SEQ ID NO: 5897556 - DNA, 15 bp, Homo sapiens
gaaaaagtgtacatg

SEQ ID NO: 5897557 - DNA, 18 bp, Homo sapiens
gaaaaagtgtttttacat

SEQ ID NO: 5897558 - DNA, 19 bp, Homo sapiens
gaaaaagttaaacattgaa

SEQ ID NO: 5897559 - DNA, 16 bp, Homo sapiens
gaaaaataaaaaccat

SEQ ID NO: 5897560 - DNA, 13 bp, Homo sapiens
gaaaaataaagaa

SEQ ID NO: 5897561 - DNA, 17 bp, Homo sapiens
gaaaaataaagaaaaga

SEQ ID NO: 5897562 - DNA, 22 bp, Homo sapiens
gaaaaataaagacacctggttg

SEQ ID NO: 5897563 - DNA, 16 bp, Homo sapiens
gaaaaataaaggaaat

SEQ ID NO: 5897564 - DNA, 18 bp, Homo sapiens
gaaaaataaatctgttct

SEQ ID NO: 5897565 - DNA, 15 bp, Homo sapiens
gaaaaataacaacta

SEQ ID NO: 5897566 - DNA, 17 bp, Homo sapiens
gaaaaataataaagtca

SEQ ID NO: 5897567 - DNA, 21 bp, Homo sapiens
gaaaaataataaagtcagaag

SEQ ID NO: 5897568 - DNA, 23 bp, Homo sapiens
gaaaaataatcaagattttaggg

SEQ ID NO: 5897569 - DNA, 22 bp, Homo sapiens
gaaaaataccatgtctctaagc

SEQ ID NO: 5897570 - DNA, 15 bp, Homo sapiens
gaaaaatactaagag

SEQ ID NO: 5897571 - DNA, 15 bp, Homo sapiens
gaaaaatactttgat

SEQ ID NO: 5897572 - DNA, 16 bp, Homo sapiens
gaaaaatagcaacttg

SEQ ID NO: 5897573 - DNA, 17 bp, Homo sapiens
gaaaaatagcaacttgt

SEQ ID NO: 5897574 - DNA, 15 bp, Homo sapiens
gaaaaatagtaaaca

SEQ ID NO: 5897575 - DNA, 16 bp, Homo sapiens
gaaaaatataaaatta

SEQ ID NO: 5897576 - DNA, 19 bp, Homo sapiens
gaaaaatatatactaaaca

SEQ ID NO: 5897577 - DNA, 19 bp, Homo sapiens
gaaaaatatatattttaag

SEQ ID NO: 5897578 - DNA, 14 bp, Homo sapiens
gaaaaatatgagag

SEQ ID NO: 5897579 - DNA, 15 bp, Homo sapiens
gaaaaatatgatatt

SEQ ID NO: 5897580 - DNA, 12 bp, Homo sapiens
gaaaaatatgtg

SEQ ID NO: 5897581 - DNA, 14 bp, Homo sapiens
gaaaaatatgtgaa

SEQ ID NO: 5897582 - DNA, 10 bp, Homo sapiens
gaaaaatatt

SEQ ID NO: 5897583 - DNA, 20 bp, Homo sapiens
gaaaaatattcaagtaacac

SEQ ID NO: 5897584 - DNA, 21 bp, Homo sapiens
gaaaaatattcaagtaacact

SEQ ID NO: 5897585 - DNA, 20 bp, Homo sapiens
gaaaaatatttaatgttgaa

SEQ ID NO: 5897586 - DNA, 20 bp, Homo sapiens
gaaaaatcaagtattataaa

SEQ ID NO: 5897587 - DNA, 18 bp, Homo sapiens
gaaaaatcaggcagaaat

SEQ ID NO: 5897588 - DNA, 16 bp, Homo sapiens
gaaaaatcagtttttg

SEQ ID NO: 5897589 - DNA, 17 bp, Homo sapiens
gaaaaatccagaaagaa

SEQ ID NO: 5897590 - DNA, 18 bp, Homo sapiens
gaaaaatccagaaagaaa

SEQ ID NO: 5897591 - DNA, 19 bp, Homo sapiens
gaaaaatcgcgagtgtttc

SEQ ID NO: 5897592 - DNA, 16 bp, Homo sapiens
gaaaaatctaagtgat

SEQ ID NO: 5897593 - DNA, 11 bp, Homo sapiens
gaaaaatctca

SEQ ID NO: 5897594 - DNA, 21 bp, Homo sapiens
gaaaaatctcattatttcaaa

SEQ ID NO: 5897595 - DNA, 15 bp, Homo sapiens
gaaaaatctgaattt

SEQ ID NO: 5897596 - DNA, 16 bp, Homo sapiens
gaaaaatctgaatttc

SEQ ID NO: 5897597 - DNA, 20 bp, Homo sapiens
gaaaaatctgaatttctaaa

SEQ ID NO: 5897598 - DNA, 22 bp, Homo sapiens
gaaaaatcttaagtaccaatgg

SEQ ID NO: 5897599 - DNA, 14 bp, Homo sapiens
gaaaaatcttgtgc

SEQ ID NO: 5897600 - DNA, 17 bp, Homo sapiens
gaaaaatgaaaactttt

SEQ ID NO: 5897601 - DNA, 21 bp, Homo sapiens
gaaaaatgaaaacttttgtaa

SEQ ID NO: 5897602 - DNA, 23 bp, Homo sapiens
gaaaaatgaaaacttttgtaaat

SEQ ID NO: 5897603 - DNA, 16 bp, Homo sapiens
gaaaaatgaaaagcaa

SEQ ID NO: 5897604 - DNA, 16 bp, Homo sapiens
gaaaaatgacaattgt

SEQ ID NO: 5897605 - DNA, 20 bp, Homo sapiens
gaaaaatgagaattttatat

SEQ ID NO: 5897606 - DNA, 18 bp, Homo sapiens
gaaaaatgagcttgtaaa

SEQ ID NO: 5897607 - DNA, 19 bp, Homo sapiens
gaaaaatgaggaatccaaa

SEQ ID NO: 5897608 - DNA, 17 bp, Homo sapiens
gaaaaatgccactccct

SEQ ID NO: 5897609 - DNA, 18 bp, Homo sapiens
gaaaaatgcctgctgctg

SEQ ID NO: 5897610 - DNA, 16 bp, Homo sapiens
gaaaaatgctccccac

SEQ ID NO: 5897611 - DNA, 12 bp, Homo sapiens
gaaaaatgctgc

SEQ ID NO: 5897612 - DNA, 17 bp, Homo sapiens
gaaaaatgctgttcaga

SEQ ID NO: 5897613 - DNA, 22 bp, Homo sapiens
gaaaaatgctgttcagaaatat

SEQ ID NO: 5897614 - DNA, 13 bp, Homo sapiens
gaaaaatggaaaa

SEQ ID NO: 5897615 - DNA, 11 bp, Homo sapiens
gaaaaatggag

SEQ ID NO: 5897616 - DNA, 14 bp, Homo sapiens
gaaaaatggccatg

SEQ ID NO: 5897617 - DNA, 18 bp, Homo sapiens
gaaaaatgggagccagga

SEQ ID NO: 5897618 - DNA, 18 bp, Homo sapiens
gaaaaatggttgatggaa

SEQ ID NO: 5897619 - DNA, 20 bp, Homo sapiens
gaaaaatggttgatggaaaa

SEQ ID NO: 5897620 - DNA, 23 bp, Homo sapiens
gaaaaatggttgatggaaaataa

SEQ ID NO: 5897621 - DNA, 14 bp, Homo sapiens
gaaaaatgtaggag

SEQ ID NO: 5897622 - DNA, 15 bp, Homo sapiens
gaaaaatgtcactga

SEQ ID NO: 5897623 - DNA, 16 bp, Homo sapiens
gaaaaattaattagga

SEQ ID NO: 5897624 - DNA, 20 bp, Homo sapiens
gaaaaattagatgactgaat

SEQ ID NO: 5897625 - DNA, 21 bp, Homo sapiens
gaaaaattattagaacattca

SEQ ID NO: 5897626 - DNA, 17 bp, Homo sapiens
gaaaaattattcccatg

SEQ ID NO: 5897627 - DNA, 17 bp, Homo sapiens
gaaaaattatttgtgtt

SEQ ID NO: 5897628 - DNA, 20 bp, Homo sapiens
gaaaaattatttgtgttggg

SEQ ID NO: 5897629 - DNA, 22 bp, Homo sapiens
gaaaaattcaatagtaatataa

SEQ ID NO: 5897630 - DNA, 22 bp, Homo sapiens
gaaaaattgcattcattgactt

SEQ ID NO: 5897631 - DNA, 16 bp, Homo sapiens
gaaaaattggggagga

SEQ ID NO: 5897632 - DNA, 19 bp, Homo sapiens
gaaaaattggggaggaggg

SEQ ID NO: 5897633 - DNA, 14 bp, Homo sapiens
gaaaaattgtttcc

SEQ ID NO: 5897634 - DNA, 21 bp, Homo sapiens
gaaaaattgtttccaaagtgc

SEQ ID NO: 5897635 - DNA, 20 bp, Homo sapiens
gaaaaatttaagcattgttt

SEQ ID NO: 5897636 - DNA, 16 bp, Homo sapiens
gaaaaatttataagcc

SEQ ID NO: 5897637 - DNA, 15 bp, Homo sapiens
gaaaaatttctggca

SEQ ID NO: 5897638 - DNA, 16 bp, Homo sapiens
gaaaacaaaaaacttt

SEQ ID NO: 5897639 - DNA, 17 bp, Homo sapiens
gaaaacaaaagttttaa

SEQ ID NO: 5897640 - DNA, 14 bp, Homo sapiens
gaaaacaaatctat

SEQ ID NO: 5897641 - DNA, 15 bp, Homo sapiens
gaaaacaacaaaaaa

SEQ ID NO: 5897642 - DNA, 17 bp, Homo sapiens
gaaaagactaagatcgg

SEQ ID NO: 5897643 - DNA, 18 bp, Homo sapiens
gaaaagactccaaagaaa

SEQ ID NO: 5897644 - DNA, 18 bp, Homo sapiens
gaaaagactcctcctggg

SEQ ID NO: 5897645 - DNA, 15 bp, Homo sapiens
gaaaagactgtgggt

SEQ ID NO: 5897646 - DNA, 16 bp, Homo sapiens
gaaaagactgtgggtg

SEQ ID NO: 5897647 - DNA, 18 bp, Homo sapiens
gaaaagactgtgggtggg

SEQ ID NO: 5897648 - DNA, 14 bp, Homo sapiens
gaaaagagaaaaaa

SEQ ID NO: 5897649 - DNA, 15 bp, Homo sapiens
gaaaagagaaacact

SEQ ID NO: 5897650 - DNA, 22 bp, Homo sapiens
gaaaagagaagaaagaagcact

SEQ ID NO: 5897651 - DNA, 13 bp, Homo sapiens
gaaaagagagaaa

SEQ ID NO: 5897652 - DNA, 21 bp, Homo sapiens
gaaaagagatattttaaaatg

SEQ ID NO: 5897653 - DNA, 21 bp, Homo sapiens
gaaaagagatggcctgagaag

SEQ ID NO: 5897654 - DNA, 20 bp, Homo sapiens
gaaaagaggacagaaaaatt

SEQ ID NO: 5897655 - DNA, 18 bp, Homo sapiens
gaaaagaggagaggaaaa

SEQ ID NO: 5897656 - DNA, 12 bp, Homo sapiens
gaaaagaggagt

SEQ ID NO: 5897657 - DNA, 20 bp, Homo sapiens
gaaaagaggagtttcgaggt

SEQ ID NO: 5897658 - DNA, 18 bp, Homo sapiens
gaaaagagggagagatga

SEQ ID NO: 5897659 - DNA, 21 bp, Homo sapiens
gaaaagagtatcaaaggcaga

SEQ ID NO: 5897660 - DNA, 13 bp, Homo sapiens
gaaaagataaaga

SEQ ID NO: 5897661 - DNA, 22 bp, Homo sapiens
gaaaagataaagaccagaaatt

SEQ ID NO: 5897662 - DNA, 20 bp, Homo sapiens
gaaaagatacgactttattt

SEQ ID NO: 5897663 - DNA, 16 bp, Homo sapiens
gaaaagatccccaaga

SEQ ID NO: 5897664 - DNA, 22 bp, Homo sapiens
gaaaagatgcactttgctttaa

SEQ ID NO: 5897665 - DNA, 17 bp, Homo sapiens
gaaaagatgtagattta

SEQ ID NO: 5897666 - DNA, 21 bp, Homo sapiens
gaaaagatgtagatttatttc

SEQ ID NO: 5897667 - DNA, 21 bp, Homo sapiens
gaaaagattaaaattagtgag

SEQ ID NO: 5897668 - DNA, 14 bp, Homo sapiens
gaaaagattccatt

SEQ ID NO: 5897669 - DNA, 15 bp, Homo sapiens
gaaaagattcttctg

SEQ ID NO: 5897670 - DNA, 15 bp, Homo sapiens
gaaaagattgcaaag

SEQ ID NO: 5897671 - DNA, 13 bp, Homo sapiens
gaaaagattttaa

SEQ ID NO: 5897672 - DNA, 23 bp, Homo sapiens
gaaaagattttaatcaagttgaa

SEQ ID NO: 5897673 - DNA, 17 bp, Homo sapiens
gaaaagattttatttat

SEQ ID NO: 5897674 - DNA, 19 bp, Homo sapiens
gaaaagcaattgccctgta

SEQ ID NO: 5897675 - DNA, 12 bp, Homo sapiens
gaaaagcacaga

SEQ ID NO: 5897676 - DNA, 17 bp, Homo sapiens
gaaaagcacctcttgaa

SEQ ID NO: 5897677 - DNA, 17 bp, Homo sapiens
gaaaagcacctgccgac

SEQ ID NO: 5897678 - DNA, 15 bp, Homo sapiens
gaaaagcacttttgt

SEQ ID NO: 5897679 - DNA, 18 bp, Homo sapiens
gaaaagcacttttgttat

SEQ ID NO: 5897680 - DNA, 10 bp, Homo sapiens
gaaaagcata

SEQ ID NO: 5897681 - DNA, 19 bp, Homo sapiens
gaaaagcatacatgcaaaa

SEQ ID NO: 5897682 - DNA, 23 bp, Homo sapiens
gaaaagcatggcttgaataagga

SEQ ID NO: 5897683 - DNA, 16 bp, Homo sapiens
gaaaagcattttcagt

SEQ ID NO: 5897684 - DNA, 22 bp, Homo sapiens
gaaaagccagatgacagggagc

SEQ ID NO: 5897685 - DNA, 11 bp, Homo sapiens
gaaaagccata

SEQ ID NO: 5897686 - DNA, 17 bp, Homo sapiens
gaaaagccatgtttaag

SEQ ID NO: 5897687 - DNA, 18 bp, Homo sapiens
gaaaagccatgtttaaga

SEQ ID NO: 5897688 - DNA, 19 bp, Homo sapiens
gaaaagccatgtttaagat

SEQ ID NO: 5897689 - DNA, 11 bp, Homo sapiens
gaaaagcccag

SEQ ID NO: 5897690 - DNA, 17 bp, Homo sapiens
gaaaagccctcatcttc

SEQ ID NO: 5897691 - DNA, 15 bp, Homo sapiens
gaaaagccgaaaggg

SEQ ID NO: 5897692 - DNA, 21 bp, Homo sapiens
gaaaagcctaatcacagtttt

SEQ ID NO: 5897693 - DNA, 13 bp, Homo sapiens
gaaaagcctctgt

SEQ ID NO: 5897694 - DNA, 15 bp, Homo sapiens
gaaaagcctctgtgt

SEQ ID NO: 5897695 - DNA, 20 bp, Homo sapiens
gaaaagcctgggtttggtgt

SEQ ID NO: 5897696 - DNA, 14 bp, Homo sapiens
gaaaagcgcagaga

SEQ ID NO: 5897697 - DNA, 18 bp, Homo sapiens
gaaaagcgtctttaagag

SEQ ID NO: 5897698 - DNA, 23 bp, Homo sapiens
gaaaagctagaattgagtgttta

SEQ ID NO: 5897699 - DNA, 22 bp, Homo sapiens
gaaaagctagtgtacctcctct

SEQ ID NO: 5897700 - DNA, 14 bp, Homo sapiens
gaaaagctattagc

SEQ ID NO: 5897701 - DNA, 14 bp, Homo sapiens
gaaaagctcagagt

SEQ ID NO: 5897702 - DNA, 14 bp, Homo sapiens
gaaaagctgaatcc

SEQ ID NO: 5897703 - DNA, 23 bp, Homo sapiens
gaaaagctggaccttttcccttg

SEQ ID NO: 5897704 - DNA, 13 bp, Homo sapiens
gaaaagcttccta

SEQ ID NO: 5897705 - DNA, 14 bp, Homo sapiens
gaaaagcttcctag

SEQ ID NO: 5897706 - DNA, 22 bp, Homo sapiens
gaaaagctttgtttgttcttgt

SEQ ID NO: 5897707 - DNA, 16 bp, Homo sapiens
gaaaaggaaaagaaaa

SEQ ID NO: 5897708 - DNA, 11 bp, Homo sapiens
gaaaaggaaat

SEQ ID NO: 5897709 - DNA, 15 bp, Homo sapiens
gaaaaggaagactag

SEQ ID NO: 5897710 - DNA, 19 bp, Homo sapiens
gaaaaggaagggcaggaaa

SEQ ID NO: 5897711 - DNA, 23 bp, Homo sapiens
gaaaaggaatcacgttagaggaa

SEQ ID NO: 5897712 - DNA, 22 bp, Homo sapiens
gaaaaggaatgcaagagaagga

SEQ ID NO: 5897713 - DNA, 13 bp, Homo sapiens
gaaaaggaggagg

SEQ ID NO: 5897714 - DNA, 22 bp, Homo sapiens
gaaaaggaggggacgggacaga

SEQ ID NO: 5897715 - DNA, 19 bp, Homo sapiens
gaaaaggatattatctacc

SEQ ID NO: 5897716 - DNA, 19 bp, Homo sapiens
gaaaaggatcgaggcatgg

SEQ ID NO: 5897717 - DNA, 17 bp, Homo sapiens
gaaaaggatttaagcaa

SEQ ID NO: 5897718 - DNA, 18 bp, Homo sapiens
gaaaaggcaaaagaatgg

SEQ ID NO: 5897719 - DNA, 18 bp, Homo sapiens
gaaaaggcagcatttgaa

SEQ ID NO: 5897720 - DNA, 16 bp, Homo sapiens
gaaaaggcagccagat

SEQ ID NO: 5897721 - DNA, 15 bp, Homo sapiens
gaaaaggcaggtgct

SEQ ID NO: 5897722 - DNA, 16 bp, Homo sapiens
gaaaaggccaagaggt

SEQ ID NO: 5897723 - DNA, 14 bp, Homo sapiens
gaaaaggcctgggg

SEQ ID NO: 5897724 - DNA, 16 bp, Homo sapiens
gaaaaggcctggggtg

SEQ ID NO: 5897725 - DNA, 17 bp, Homo sapiens
gaaaaggccttcttccc

SEQ ID NO: 5897726 - DNA, 21 bp, Homo sapiens
gaaaaggctaagaaaaaggaa

SEQ ID NO: 5897727 - DNA, 22 bp, Homo sapiens
gaaaaggcttggtgtctgcggg

SEQ ID NO: 5897728 - DNA, 17 bp, Homo sapiens
gaaaagggaaaaaagaa

SEQ ID NO: 5897729 - DNA, 18 bp, Homo sapiens
gaaaagggaatcattttt

SEQ ID NO: 5897730 - DNA, 17 bp, Homo sapiens
gaaaagggagtttaaaa

SEQ ID NO: 5897731 - DNA, 16 bp, Homo sapiens
gaaaagggatgatggg

SEQ ID NO: 5897732 - DNA, 22 bp, Homo sapiens
gaaaagggcactcccaaccctg

SEQ ID NO: 5897733 - DNA, 13 bp, Homo sapiens
gaaaagggcagga

SEQ ID NO: 5897734 - DNA, 21 bp, Homo sapiens
gaaaagggcaggagcctagag

SEQ ID NO: 5897735 - DNA, 22 bp, Homo sapiens
gaaaagggcggaagagttacaa

SEQ ID NO: 5897736 - DNA, 14 bp, Homo sapiens
gaaaagggctcaga

SEQ ID NO: 5897737 - DNA, 20 bp, Homo sapiens
gaaaaggtccttgcctcctg

SEQ ID NO: 5897738 - DNA, 19 bp, Homo sapiens
gaaaaggtgataaaatcat

SEQ ID NO: 5897739 - DNA, 21 bp, Homo sapiens
gaaaaggttatgttcattttt

SEQ ID NO: 5897740 - DNA, 21 bp, Homo sapiens
gaaaaggttctgaataatgaa

SEQ ID NO: 5897741 - DNA, 23 bp, Homo sapiens
gaaaaggttcttcttgggagtat

SEQ ID NO: 5897742 - DNA, 13 bp, Homo sapiens
gaaaaggttgaat

SEQ ID NO: 5897743 - DNA, 23 bp, Homo sapiens
gaaaaggtttatgaaaaagaaga

SEQ ID NO: 5897744 - DNA, 18 bp, Homo sapiens
gaaaaggttttattttgt

SEQ ID NO: 5897745 - DNA, 16 bp, Homo sapiens
gaaaagtaaattgcct

SEQ ID NO: 5897746 - DNA, 21 bp, Homo sapiens
gaaaagtaagggaataaattt

SEQ ID NO: 5897747 - DNA, 16 bp, Homo sapiens
gaaaagtaatatttat

SEQ ID NO: 5897748 - DNA, 17 bp, Homo sapiens
gaaaagtaatatttatt

SEQ ID NO: 5897749 - DNA, 20 bp, Homo sapiens
gaaaagtaatatttattaaa

SEQ ID NO: 5897750 - DNA, 14 bp, Homo sapiens
gaaaagtaatgaag

SEQ ID NO: 5897751 - DNA, 23 bp, Homo sapiens
gaaaagtaattttgtcacattat

SEQ ID NO: 5897752 - DNA, 15 bp, Homo sapiens
gaaaagtagaattat

SEQ ID NO: 5897753 - DNA, 23 bp, Homo sapiens
gaaaagtagacaatcattgtttt

SEQ ID NO: 5897754 - DNA, 14 bp, Homo sapiens
gaaaagtagagaaa

SEQ ID NO: 5897755 - DNA, 20 bp, Homo sapiens
gaaaagtatgttagtgcaaa

SEQ ID NO: 5897756 - DNA, 15 bp, Homo sapiens
gaaaagtatgttcta

SEQ ID NO: 5897757 - DNA, 18 bp, Homo sapiens
gaaaagtattttgaagtt

SEQ ID NO: 5897758 - DNA, 19 bp, Homo sapiens
gaaaagtattttgaagttt

SEQ ID NO: 5897759 - DNA, 13 bp, Homo sapiens
gaaaagtcaaact

SEQ ID NO: 5897760 - DNA, 20 bp, Homo sapiens
gaaaagtcacacagacacac

SEQ ID NO: 5897761 - DNA, 16 bp, Homo sapiens
gaaaagtcgttttcca

SEQ ID NO: 5897762 - DNA, 13 bp, Homo sapiens
gaaaagtcttcct

SEQ ID NO: 5897763 - DNA, 12 bp, Homo sapiens
gaaaagtgaagg

SEQ ID NO: 5897764 - DNA, 15 bp, Homo sapiens
gaaaagtgagagtta

SEQ ID NO: 5897765 - DNA, 12 bp, Homo sapiens
gaaaagtgatgt

SEQ ID NO: 5897766 - DNA, 17 bp, Homo sapiens
gaaaagtgatgtatttt

SEQ ID NO: 5897767 - DNA, 16 bp, Homo sapiens
gaaaagtgcaagtcca

SEQ ID NO: 5897768 - DNA, 14 bp, Homo sapiens
gaaaagtgctgttt

SEQ ID NO: 5897769 - DNA, 19 bp, Homo sapiens
gaaaagtggcaagaccaaa

SEQ ID NO: 5897770 - DNA, 23 bp, Homo sapiens
gaaaagtggcgtgggagccagcc

SEQ ID NO: 5897771 - DNA, 19 bp, Homo sapiens
gaaaagtgtgtatctagct

SEQ ID NO: 5897772 - DNA, 21 bp, Homo sapiens
gaaaagttagtattaaaatct

SEQ ID NO: 5897773 - DNA, 22 bp, Homo sapiens
gaaaagttagtattaaaatcta

SEQ ID NO: 5897774 - DNA, 12 bp, Homo sapiens
gaaaagttattt

SEQ ID NO: 5897775 - DNA, 10 bp, Homo sapiens
gaaaagttca

SEQ ID NO: 5897776 - DNA, 23 bp, Homo sapiens
gaaaagttcaatactcttgaaat

SEQ ID NO: 5897777 - DNA, 16 bp, Homo sapiens
gaaaagttcagggacc

SEQ ID NO: 5897778 - DNA, 12 bp, Homo sapiens
gaaaagttcata

SEQ ID NO: 5897779 - DNA, 19 bp, Homo sapiens
gaaaagttcttaaaacact

SEQ ID NO: 5897780 - DNA, 14 bp, Homo sapiens
gaaaagttggaagg

SEQ ID NO: 5897781 - DNA, 21 bp, Homo sapiens
gaaaagtttaacctaaataat

SEQ ID NO: 5897782 - DNA, 19 bp, Homo sapiens
gaaaagtttaatattaaag

SEQ ID NO: 5897783 - DNA, 23 bp, Homo sapiens
gaaaagtttaatattaaagccat

SEQ ID NO: 5897784 - DNA, 13 bp, Homo sapiens
gaaaagtttataa

SEQ ID NO: 5897785 - DNA, 23 bp, Homo sapiens
gaaaagtttcgacttatttctta

SEQ ID NO: 5897786 - DNA, 18 bp, Homo sapiens
gaaaagtttgttttactt

SEQ ID NO: 5897787 - DNA, 11 bp, Homo sapiens
gaaaataaaaa

SEQ ID NO: 5897788 - DNA, 16 bp, Homo sapiens
gaaaataaaaaaaaga

SEQ ID NO: 5897789 - DNA, 18 bp, Homo sapiens
gaaaataaaaaaaagaaa

SEQ ID NO: 5897790 - DNA, 19 bp, Homo sapiens
gaaaataaaaaaaagaaaa

SEQ ID NO: 5897791 - DNA, 22 bp, Homo sapiens
gaaaataaaaaaaagaaaaaag

SEQ ID NO: 5897792 - DNA, 13 bp, Homo sapiens
gaaaataaaaagt

SEQ ID NO: 5897793 - DNA, 13 bp, Homo sapiens
gaaaataaaacac

SEQ ID NO: 5897794 - DNA, 13 bp, Homo sapiens
gaaaataaaataa

SEQ ID NO: 5897795 - DNA, 22 bp, Homo sapiens
gaaaataaaataaattatggct

SEQ ID NO: 5897796 - DNA, 18 bp, Homo sapiens
gaaaataaaatattcact

SEQ ID NO: 5897797 - DNA, 21 bp, Homo sapiens
gaaaataaaatattcactctc

SEQ ID NO: 5897798 - DNA, 17 bp, Homo sapiens
gaaaataaaattaagaa

SEQ ID NO: 5897799 - DNA, 17 bp, Homo sapiens
gaaaataaacagacaaa

SEQ ID NO: 5897800 - DNA, 12 bp, Homo sapiens
gaaaataaacat

SEQ ID NO: 5897801 - DNA, 17 bp, Homo sapiens
gaaaataaacatcagtt

SEQ ID NO: 5897802 - DNA, 17 bp, Homo sapiens
gaaaataaaccaacaat

SEQ ID NO: 5897803 - DNA, 15 bp, Homo sapiens
gaaaataaagaatgg

SEQ ID NO: 5897804 - DNA, 22 bp, Homo sapiens
gaaaataaatatcacagtatta

SEQ ID NO: 5897805 - DNA, 22 bp, Homo sapiens
gaaaataaatcttagtgttcaa

SEQ ID NO: 5897806 - DNA, 23 bp, Homo sapiens
gaaaataaatcttagtgttcaaa

SEQ ID NO: 5897807 - DNA, 19 bp, Homo sapiens
gaaaataactgaaccaaat

SEQ ID NO: 5897808 - DNA, 15 bp, Homo sapiens
gaaaataactgaatt

SEQ ID NO: 5897809 - DNA, 15 bp, Homo sapiens
gaaaataagaaagaa

SEQ ID NO: 5897810 - DNA, 17 bp, Homo sapiens
gaaaataagacttctgg

SEQ ID NO: 5897811 - DNA, 19 bp, Homo sapiens
gaaaataagacttctggtg

SEQ ID NO: 5897812 - DNA, 17 bp, Homo sapiens
gaaaataagattccaga

SEQ ID NO: 5897813 - DNA, 19 bp, Homo sapiens
gaaaataagccatgagaat

SEQ ID NO: 5897814 - DNA, 13 bp, Homo sapiens
gaaaataagtgaa

SEQ ID NO: 5897815 - DNA, 17 bp, Homo sapiens
gaaaataagtgaaattt

SEQ ID NO: 5897816 - DNA, 16 bp, Homo sapiens
gaaaataataaaagaa

SEQ ID NO: 5897817 - DNA, 18 bp, Homo sapiens
gaaaataataaaagaatc

SEQ ID NO: 5897818 - DNA, 12 bp, Homo sapiens
gaaaataatatc

SEQ ID NO: 5897819 - DNA, 19 bp, Homo sapiens
gaaaataatcaaaccaaag

SEQ ID NO: 5897820 - DNA, 23 bp, Homo sapiens
gaaaccagccgaccggccctgcc

SEQ ID NO: 5897821 - DNA, 21 bp, Homo sapiens
gaaaccagctcgtgggctggg

SEQ ID NO: 5897822 - DNA, 17 bp, Homo sapiens
gaaaccagcttccttca

SEQ ID NO: 5897823 - DNA, 19 bp, Homo sapiens
gaaaccagcttccttcaga

SEQ ID NO: 5897824 - DNA, 23 bp, Homo sapiens
gaaaccagcttccttcagagagc

SEQ ID NO: 5897825 - DNA, 22 bp, Homo sapiens
gaaaccagcttttactgttttt

SEQ ID NO: 5897826 - DNA, 14 bp, Homo sapiens
gaaaccagtatgga

SEQ ID NO: 5897827 - DNA, 15 bp, Homo sapiens
gaaaccagtatggaa

SEQ ID NO: 5897828 - DNA, 20 bp, Homo sapiens
gaaaccagtatggaagggag

SEQ ID NO: 5897829 - DNA, 13 bp, Homo sapiens
gaaaccagtattt

SEQ ID NO: 5897830 - DNA, 21 bp, Homo sapiens
gaaaccagtatttaagcttta

SEQ ID NO: 5897831 - DNA, 22 bp, Homo sapiens
gaaaccatcctctcccttctta

SEQ ID NO: 5897832 - DNA, 20 bp, Homo sapiens
gaaaccattttcccatcatc

SEQ ID NO: 5897833 - DNA, 14 bp, Homo sapiens
gaaacccaagctcc

SEQ ID NO: 5897834 - DNA, 17 bp, Homo sapiens
gaaacccaagctcctcc

SEQ ID NO: 5897835 - DNA, 18 bp, Homo sapiens
gaaacccaagctcctcct

SEQ ID NO: 5897836 - DNA, 15 bp, Homo sapiens
gaaacccaaggaaca

SEQ ID NO: 5897837 - DNA, 13 bp, Homo sapiens
gaaacccacagtt

SEQ ID NO: 5897838 - DNA, 18 bp, Homo sapiens
gaaacccacagttttagt

SEQ ID NO: 5897839 - DNA, 21 bp, Homo sapiens
gaaacccaccagcctaagaag

SEQ ID NO: 5897840 - DNA, 17 bp, Homo sapiens
gaaacccacctctctgg

SEQ ID NO: 5897841 - DNA, 23 bp, Homo sapiens
gaaacccagagatgcctgatttc

SEQ ID NO: 5897842 - DNA, 15 bp, Homo sapiens
gaaacccagctctgg

SEQ ID NO: 5897843 - DNA, 18 bp, Homo sapiens
gaaacccagctctggtcc

SEQ ID NO: 5897844 - DNA, 19 bp, Homo sapiens
gaaaccccccaatgtctgt

SEQ ID NO: 5897845 - DNA, 14 bp, Homo sapiens
gaaacccctgggga

SEQ ID NO: 5897846 - DNA, 19 bp, Homo sapiens
gaaacccctggggaccatg

SEQ ID NO: 5897847 - DNA, 15 bp, Homo sapiens
gaaacccgagggttg

SEQ ID NO: 5897848 - DNA, 15 bp, Homo sapiens
gaaacccgccctcag

SEQ ID NO: 5897849 - DNA, 14 bp, Homo sapiens
gaaaccctccaaat

SEQ ID NO: 5897850 - DNA, 21 bp, Homo sapiens
gaaaccctgcacccattagca

SEQ ID NO: 5897851 - DNA, 14 bp, Homo sapiens
gaaaccctggacca

SEQ ID NO: 5897852 - DNA, 15 bp, Homo sapiens
gaaaccctggtctcc

SEQ ID NO: 5897853 - DNA, 23 bp, Homo sapiens
gaaacccttcagtgctacatttt

SEQ ID NO: 5897854 - DNA, 17 bp, Homo sapiens
gaaacccttgactgtta

SEQ ID NO: 5897855 - DNA, 22 bp, Homo sapiens
gaaacccttgactgttatctcg

SEQ ID NO: 5897856 - DNA, 15 bp, Homo sapiens
gaaaccgaaactgac

SEQ ID NO: 5897857 - DNA, 12 bp, Homo sapiens
gaaaccgaggcg

SEQ ID NO: 5897858 - DNA, 17 bp, Homo sapiens
gaaacctacaagatttc

SEQ ID NO: 5897859 - DNA, 21 bp, Homo sapiens
gaaacctacacactgtcatgc

SEQ ID NO: 5897860 - DNA, 18 bp, Homo sapiens
gaaacctaggaagcccct

SEQ ID NO: 5897861 - DNA, 18 bp, Homo sapiens
gaaacctagtactgcccc

SEQ ID NO: 5897862 - DNA, 17 bp, Homo sapiens
gaaacctatctcaggga

SEQ ID NO: 5897863 - DNA, 20 bp, Homo sapiens
gaaacctattaagtcatcat

SEQ ID NO: 5897864 - DNA, 15 bp, Homo sapiens
gaaacctccatcctg

SEQ ID NO: 5897865 - DNA, 21 bp, Homo sapiens
gaaacctccatcctgccagga

SEQ ID NO: 5897866 - DNA, 16 bp, Homo sapiens
gaaacctctgacttgc

SEQ ID NO: 5897867 - DNA, 15 bp, Homo sapiens
gaaacctcttcctag

SEQ ID NO: 5897868 - DNA, 12 bp, Homo sapiens
gaaacctgagat

SEQ ID NO: 5897869 - DNA, 13 bp, Homo sapiens
gaaacctgccctg

SEQ ID NO: 5897870 - DNA, 18 bp, Homo sapiens
gaaacctgcctttgtatg

SEQ ID NO: 5897871 - DNA, 19 bp, Homo sapiens
gaaacctgcctttgtatgt

SEQ ID NO: 5897872 - DNA, 21 bp, Homo sapiens
gaaacctgtataaccctgtta

SEQ ID NO: 5897873 - DNA, 23 bp, Homo sapiens
gaaacctgtatctttctatgctg

SEQ ID NO: 5897874 - DNA, 18 bp, Homo sapiens
gaaacctgtcattgtatt

SEQ ID NO: 5897875 - DNA, 17 bp, Homo sapiens
gaaacctgttatgccaa

SEQ ID NO: 5897876 - DNA, 18 bp, Homo sapiens
gaaacctgttctaccaat

SEQ ID NO: 5897877 - DNA, 13 bp, Homo sapiens
gaaaccttatttt

SEQ ID NO: 5897878 - DNA, 15 bp, Homo sapiens
gaaaccttccaccca

SEQ ID NO: 5897879 - DNA, 17 bp, Homo sapiens
gaaaccttccagagaac

SEQ ID NO: 5897880 - DNA, 20 bp, Homo sapiens
gaaaccttccagagaacaca

SEQ ID NO: 5897881 - DNA, 15 bp, Homo sapiens
gaaaccttgcagcat

SEQ ID NO: 5897882 - DNA, 16 bp, Homo sapiens
gaaaccttgcagcatt

SEQ ID NO: 5897883 - DNA, 15 bp, Homo sapiens
gaaaccttgctctcc

SEQ ID NO: 5897884 - DNA, 19 bp, Homo sapiens
gaaaccttggagaggagag

SEQ ID NO: 5897885 - DNA, 18 bp, Homo sapiens
gaaaccttgtttgtttta

SEQ ID NO: 5897886 - DNA, 16 bp, Homo sapiens
gaaacctttaagaaaa

SEQ ID NO: 5897887 - DNA, 20 bp, Homo sapiens
gaaacctttgcttaccttgt

SEQ ID NO: 5897888 - DNA, 13 bp, Homo sapiens
gaaacctttttct

SEQ ID NO: 5897889 - DNA, 21 bp, Homo sapiens
gaaacctttttctagttatta

SEQ ID NO: 5897890 - DNA, 14 bp, Homo sapiens
gaaaccttttttaa

SEQ ID NO: 5897891 - DNA, 14 bp, Homo sapiens
gaaacgaaaaggac

SEQ ID NO: 5897892 - DNA, 23 bp, Homo sapiens
gaaacgaacccactgtgcttaca

SEQ ID NO: 5897893 - DNA, 20 bp, Homo sapiens
gaaacgaagccatctttctt

SEQ ID NO: 5897894 - DNA, 19 bp, Homo sapiens
gaaacgaatgtttcaaatc

SEQ ID NO: 5897895 - DNA, 18 bp, Homo sapiens
gaaacgagatttgccaaa

SEQ ID NO: 5897896 - DNA, 21 bp, Homo sapiens
gaaacgcagttgtgtggccca

SEQ ID NO: 5897897 - DNA, 23 bp, Homo sapiens
gaaacgcagttgtgtggcccagc

SEQ ID NO: 5897898 - DNA, 20 bp, Homo sapiens
gaaacgccccgggcaaaggg

SEQ ID NO: 5897899 - DNA, 18 bp, Homo sapiens
gaaacgctacctctctgt

SEQ ID NO: 5897900 - DNA, 21 bp, Homo sapiens
gaaacgctacctctctgtccc

SEQ ID NO: 5897901 - DNA, 20 bp, Homo sapiens
gaaacggaagctgacataat

SEQ ID NO: 5897902 - DNA, 18 bp, Homo sapiens
gaaacgggctccttcccc

SEQ ID NO: 5897903 - DNA, 22 bp, Homo sapiens
gaaacggtatcctccctgccca

SEQ ID NO: 5897904 - DNA, 20 bp, Homo sapiens
gaaacgtatgtgtgcaggag

SEQ ID NO: 5897905 - DNA, 14 bp, Homo sapiens
gaaacgtctcccag

SEQ ID NO: 5897906 - DNA, 15 bp, Homo sapiens
gaaacgtctcccaga

SEQ ID NO: 5897907 - DNA, 22 bp, Homo sapiens
gaaactaaagcaatagaaacaa

SEQ ID NO: 5897908 - DNA, 14 bp, Homo sapiens
gaaactaacttggt

SEQ ID NO: 5897909 - DNA, 15 bp, Homo sapiens
gaaactaagcattgt

SEQ ID NO: 5897910 - DNA, 23 bp, Homo sapiens
gaaactaagccaggcctggctgg

SEQ ID NO: 5897911 - DNA, 14 bp, Homo sapiens
gaaactaataaaat

SEQ ID NO: 5897912 - DNA, 20 bp, Homo sapiens
gaaactaataaaatattttc

SEQ ID NO: 5897913 - DNA, 23 bp, Homo sapiens
gaaactaataaaatattttctgt

SEQ ID NO: 5897914 - DNA, 21 bp, Homo sapiens
gaaactaattgactttagaaa

SEQ ID NO: 5897915 - DNA, 13 bp, Homo sapiens
gaaactacaaata

SEQ ID NO: 5897916 - DNA, 22 bp, Homo sapiens
gaaactacaccacactaaaaca

SEQ ID NO: 5897917 - DNA, 20 bp, Homo sapiens
gaaactaccagtgggcatgt

SEQ ID NO: 5897918 - DNA, 14 bp, Homo sapiens
gaaactactaatct

SEQ ID NO: 5897919 - DNA, 22 bp, Homo sapiens
gaaactactaatctcaatttaa

SEQ ID NO: 5897920 - DNA, 23 bp, Homo sapiens
gaaactactaatctcaatttaag

SEQ ID NO: 5897921 - DNA, 22 bp, Homo sapiens
gaaactagacttgaggaaacca

SEQ ID NO: 5897922 - DNA, 21 bp, Homo sapiens
gaaactagctgtttaaagttt

SEQ ID NO: 5897923 - DNA, 20 bp, Homo sapiens
gaaactagcttacatgagaa

SEQ ID NO: 5897924 - DNA, 20 bp, Homo sapiens
gaaactaggtgcatatttat

SEQ ID NO: 5897925 - DNA, 21 bp, Homo sapiens
gaaactagtatctctggcctc

SEQ ID NO: 5897926 - DNA, 21 bp, Homo sapiens
gaaactatgcacctataaata

SEQ ID NO: 5897927 - DNA, 13 bp, Homo sapiens
gaaactatgtgtt

SEQ ID NO: 5897928 - DNA, 20 bp, Homo sapiens
gaaactatgtgtttttctca

SEQ ID NO: 5897929 - DNA, 21 bp, Homo sapiens
gaaactatgtgtttttctcat

SEQ ID NO: 5897930 - DNA, 20 bp, Homo sapiens
gaaactcaccatgtaaaaga

SEQ ID NO: 5897931 - DNA, 18 bp, Homo sapiens
gaaactcacctgctggcc

SEQ ID NO: 5897932 - DNA, 19 bp, Homo sapiens
gaaactcacctgctggccc

SEQ ID NO: 5897933 - DNA, 23 bp, Homo sapiens
gaaactcataatagacttcccac

SEQ ID NO: 5897934 - DNA, 22 bp, Homo sapiens
gaaactcatacagtctctattt

SEQ ID NO: 5897935 - DNA, 15 bp, Homo sapiens
gaaactccaaagtcc

SEQ ID NO: 5897936 - DNA, 21 bp, Homo sapiens
gaaactccaccttgcggggat

SEQ ID NO: 5897937 - DNA, 16 bp, Homo sapiens
gaaactcccaccctac

SEQ ID NO: 5897938 - DNA, 15 bp, Homo sapiens
gaaactcccttgtgt

SEQ ID NO: 5897939 - DNA, 20 bp, Homo sapiens
gaaactcccttgtgttcctt

SEQ ID NO: 5897940 - DNA, 21 bp, Homo sapiens
gaaactcccttgtgttccttc

SEQ ID NO: 5897941 - DNA, 19 bp, Homo sapiens
gaaactccgaagaaaagaa

SEQ ID NO: 5897942 - DNA, 19 bp, Homo sapiens
gaaactcctgtttctcctt

SEQ ID NO: 5897943 - DNA, 16 bp, Homo sapiens
gaaactctacatttaa

SEQ ID NO: 5897944 - DNA, 19 bp, Homo sapiens
gaaactctggagagcctgc

SEQ ID NO: 5897945 - DNA, 13 bp, Homo sapiens
gaaactctggctc

SEQ ID NO: 5897946 - DNA, 14 bp, Homo sapiens
gaaactctggctca

SEQ ID NO: 5897947 - DNA, 11 bp, Homo sapiens
gaaactctggt

SEQ ID NO: 5897948 - DNA, 16 bp, Homo sapiens
gaaactcttatctcag

SEQ ID NO: 5897949 - DNA, 20 bp, Homo sapiens
gaaactcttatctcagtcat

SEQ ID NO: 5897950 - DNA, 22 bp, Homo sapiens
gaaactcttgctattgaattga

SEQ ID NO: 5897951 - DNA, 23 bp, Homo sapiens
gaaactgaaaactgtaaatacaa

SEQ ID NO: 5897952 - DNA, 18 bp, Homo sapiens
gaaactgaaagtgtttta

SEQ ID NO: 5897953 - DNA, 16 bp, Homo sapiens
gaaactgacacatgct

SEQ ID NO: 5897954 - DNA, 15 bp, Homo sapiens
gaaactgaggcccac

SEQ ID NO: 5897955 - DNA, 16 bp, Homo sapiens
gaaactgaggcccaga

SEQ ID NO: 5897956 - DNA, 23 bp, Homo sapiens
gaaactgaggcccagagagggaa

SEQ ID NO: 5897957 - DNA, 15 bp, Homo sapiens
gaaactgagggcaga

SEQ ID NO: 5897958 - DNA, 16 bp, Homo sapiens
gaaactgagtcactca

SEQ ID NO: 5897959 - DNA, 23 bp, Homo sapiens
gaaactgagtcactcacattgag

SEQ ID NO: 5897960 - DNA, 13 bp, Homo sapiens
gaaactgatgcca

SEQ ID NO: 5897961 - DNA, 17 bp, Homo sapiens
gaaactgatgccaaggg

SEQ ID NO: 5897962 - DNA, 22 bp, Homo sapiens
gaaactgatgccaaggggctga

SEQ ID NO: 5897963 - DNA, 13 bp, Homo sapiens
gaaactgatttct

SEQ ID NO: 5897964 - DNA, 15 bp, Homo sapiens
gaaactgcagggaaa

SEQ ID NO: 5897965 - DNA, 13 bp, Homo sapiens
gaaactgctaaat

SEQ ID NO: 5897966 - DNA, 21 bp, Homo sapiens
gaaactgctaaattctatgtt

SEQ ID NO: 5897967 - DNA, 15 bp, Homo sapiens
gaaactgctgcagat

SEQ ID NO: 5897968 - DNA, 16 bp, Homo sapiens
gaaactgctttatttt

SEQ ID NO: 5897969 - DNA, 21 bp, Homo sapiens
gaaactgctttatttttataa

SEQ ID NO: 5897970 - DNA, 13 bp, Homo sapiens
gaaactgctttga

SEQ ID NO: 5897971 - DNA, 22 bp, Homo sapiens
gaaactggaaatactagatttg

SEQ ID NO: 5897972 - DNA, 17 bp, Homo sapiens
gaaactggattaaactt

SEQ ID NO: 5897973 - DNA, 13 bp, Homo sapiens
gaaactggccagg

SEQ ID NO: 5897974 - DNA, 19 bp, Homo sapiens
gaaactggccatggcctgc

SEQ ID NO: 5897975 - DNA, 15 bp, Homo sapiens
gaaactggccccgga

SEQ ID NO: 5897976 - DNA, 18 bp, Homo sapiens
gaaactggccccggaaaa

SEQ ID NO: 5897977 - DNA, 23 bp, Homo sapiens
gaaactggcgatctcccagggct

SEQ ID NO: 5897978 - DNA, 19 bp, Homo sapiens
gaaactggggcttgcaaga

SEQ ID NO: 5897979 - DNA, 16 bp, Homo sapiens
gaaactgggtttctca

SEQ ID NO: 5897980 - DNA, 18 bp, Homo sapiens
gaaactggtttataataa

SEQ ID NO: 5897981 - DNA, 22 bp, Homo sapiens
gaaactgtctagcacttccttg

SEQ ID NO: 5897982 - DNA, 13 bp, Homo sapiens
gaaactgtgaatg

SEQ ID NO: 5897983 - DNA, 20 bp, Homo sapiens
gaaactgtgaatgcttctga

SEQ ID NO: 5897984 - DNA, 22 bp, Homo sapiens
gaaactgtggggcttacagaaa

SEQ ID NO: 5897985 - DNA, 18 bp, Homo sapiens
gaaactgtgtattatttg

SEQ ID NO: 5897986 - DNA, 21 bp, Homo sapiens
gaaactgttcccacctgctgg

SEQ ID NO: 5897987 - DNA, 17 bp, Homo sapiens
gaaactgttgccagaga

SEQ ID NO: 5897988 - DNA, 23 bp, Homo sapiens
gaaactgttgccagagatggagg

SEQ ID NO: 5897989 - DNA, 21 bp, Homo sapiens
gaaacttaaatgttattatct

SEQ ID NO: 5897990 - DNA, 14 bp, Homo sapiens
gaaacttaagatga

SEQ ID NO: 5897991 - DNA, 16 bp, Homo sapiens
gaaacttaagatgaat

SEQ ID NO: 5897992 - DNA, 16 bp, Homo sapiens
gaaacttacactgttt

SEQ ID NO: 5897993 - DNA, 16 bp, Homo sapiens
gaaacttagaggaaaa

SEQ ID NO: 5897994 - DNA, 19 bp, Homo sapiens
gaaacttagcttttgatgt

SEQ ID NO: 5897995 - DNA, 18 bp, Homo sapiens
gaaagcaaaggtgcactc

SEQ ID NO: 5897996 - DNA, 20 bp, Homo sapiens
gaaagcaaaggtgcactcca

SEQ ID NO: 5897997 - DNA, 16 bp, Homo sapiens
gaaagcaacagctgga

SEQ ID NO: 5897998 - DNA, 20 bp, Homo sapiens
gaaagcaacttcatcccagc

SEQ ID NO: 5897999 - DNA, 22 bp, Homo sapiens
gaaagcaagaccttgattgcac

SEQ ID NO: 5898000 - DNA, 17 bp, Homo sapiens
gaaagcacaagactggc

SEQ ID NO: 5898001 - DNA, 15 bp, Homo sapiens
gaaagcacaggtggg

SEQ ID NO: 5898002 - DNA, 20 bp, Homo sapiens
gaaagcaccgcagcatgtgg

SEQ ID NO: 5898003 - DNA, 22 bp, Homo sapiens
gaaagcaccgcagcatgtgggg

SEQ ID NO: 5898004 - DNA, 18 bp, Homo sapiens
gaaagcactacaatcatg

SEQ ID NO: 5898005 - DNA, 23 bp, Homo sapiens
gaaagcactcctccctgatgtac

SEQ ID NO: 5898006 - DNA, 13 bp, Homo sapiens
gaaagcagaacag

SEQ ID NO: 5898007 - DNA, 18 bp, Homo sapiens
gaaagcagaactgaagcc

SEQ ID NO: 5898008 - DNA, 19 bp, Homo sapiens
gaaagcagaactgaagcca

SEQ ID NO: 5898009 - DNA, 15 bp, Homo sapiens
gaaagcagaatcaac

SEQ ID NO: 5898010 - DNA, 16 bp, Homo sapiens
gaaagcagagcctcct

SEQ ID NO: 5898011 - DNA, 22 bp, Homo sapiens
gaaagcagagcctcctgggaac

SEQ ID NO: 5898012 - DNA, 18 bp, Homo sapiens
gaaagcagaggctggcct

SEQ ID NO: 5898013 - DNA, 22 bp, Homo sapiens
gaaagcagcagctaggactgag

SEQ ID NO: 5898014 - DNA, 16 bp, Homo sapiens
gaaagcatcacctcag

SEQ ID NO: 5898015 - DNA, 17 bp, Homo sapiens
gaaagcatcacctcagg

SEQ ID NO: 5898016 - DNA, 16 bp, Homo sapiens
gaaagcatcactgcct

SEQ ID NO: 5898017 - DNA, 23 bp, Homo sapiens
gaaagcatcactgccttggcccc

SEQ ID NO: 5898018 - DNA, 24 bp, Homo sapiens
gaaagcatccattaattaatgaga

SEQ ID NO: 5898019 - DNA, 21 bp, Homo sapiens
gaaagcatgtctctgcttcca

SEQ ID NO: 5898020 - DNA, 22 bp, Homo sapiens
gaaagcatgtggcatgttcatc

SEQ ID NO: 5898021 - DNA, 20 bp, Homo sapiens
gaaagccaacaactctgcct

SEQ ID NO: 5898022 - DNA, 23 bp, Homo sapiens
gaaagccaaggagtcactgagac

SEQ ID NO: 5898023 - DNA, 19 bp, Homo sapiens
gaaagccacctctccctca

SEQ ID NO: 5898024 - DNA, 15 bp, Homo sapiens
gaaagccaccttgtt

SEQ ID NO: 5898025 - DNA, 17 bp, Homo sapiens
gaaagccaccttgttac

SEQ ID NO: 5898026 - DNA, 16 bp, Homo sapiens
gaaagccacgccctcc

SEQ ID NO: 5898027 - DNA, 20 bp, Homo sapiens
gaaagccacgccctccctgc

SEQ ID NO: 5898028 - DNA, 17 bp, Homo sapiens
gaaagccagcaaagcct

SEQ ID NO: 5898029 - DNA, 14 bp, Homo sapiens
gaaagccagcctgg

SEQ ID NO: 5898030 - DNA, 20 bp, Homo sapiens
gaaagccagcctgggggctg

SEQ ID NO: 5898031 - DNA, 14 bp, Homo sapiens
gaaagccaggagca

SEQ ID NO: 5898032 - DNA, 20 bp, Homo sapiens
gaaagccaggagcagccctg

SEQ ID NO: 5898033 - DNA, 17 bp, Homo sapiens
gaaagccagtgactcca

SEQ ID NO: 5898034 - DNA, 14 bp, Homo sapiens
gaaagccatattcc

SEQ ID NO: 5898035 - DNA, 14 bp, Homo sapiens
gaaagccatttgtt

SEQ ID NO: 5898036 - DNA, 13 bp, Homo sapiens
gaaagcccacctg

SEQ ID NO: 5898037 - DNA, 20 bp, Homo sapiens
gaaagcccagaaaaggacag

SEQ ID NO: 5898038 - DNA, 12 bp, Homo sapiens
gaaagcccagac

SEQ ID NO: 5898039 - DNA, 13 bp, Homo sapiens
gaaagcccagact

SEQ ID NO: 5898040 - DNA, 18 bp, Homo sapiens
gaaagccccacccaggcc

SEQ ID NO: 5898041 - DNA, 15 bp, Homo sapiens
gaaagccccagaaat

SEQ ID NO: 5898042 - DNA, 14 bp, Homo sapiens
gaaagcccctgccc

SEQ ID NO: 5898043 - DNA, 21 bp, Homo sapiens
gaaagccctcccccttcccct

SEQ ID NO: 5898044 - DNA, 17 bp, Homo sapiens
gaaagccctcttggggg

SEQ ID NO: 5898045 - DNA, 15 bp, Homo sapiens
gaaagccctgtgctt

SEQ ID NO: 5898046 - DNA, 16 bp, Homo sapiens
gaaagccctgtgcttt

SEQ ID NO: 5898047 - DNA, 15 bp, Homo sapiens
gaaagccgggggagg

SEQ ID NO: 5898048 - DNA, 17 bp, Homo sapiens
gaaagccgggggagggg

SEQ ID NO: 5898049 - DNA, 18 bp, Homo sapiens
gaaagcctccgctgggct

SEQ ID NO: 5898050 - DNA, 19 bp, Homo sapiens
gaaagcctcctctggagaa

SEQ ID NO: 5898051 - DNA, 20 bp, Homo sapiens
gaaagcctcctctggagaat

SEQ ID NO: 5898052 - DNA, 17 bp, Homo sapiens
gaaagcctctctctccc

SEQ ID NO: 5898053 - DNA, 20 bp, Homo sapiens
gaaagcctctctctccctcc

SEQ ID NO: 5898054 - DNA, 16 bp, Homo sapiens
gaaagcctctgctgcc

SEQ ID NO: 5898055 - DNA, 14 bp, Homo sapiens
gaaagcctctggcc

SEQ ID NO: 5898056 - DNA, 22 bp, Homo sapiens
gaaagcctgtaagcctgcaagc

SEQ ID NO: 5898057 - DNA, 15 bp, Homo sapiens
gaaagcctgtctctt

SEQ ID NO: 5898058 - DNA, 20 bp, Homo sapiens
gaaagcctgtctctttccac

SEQ ID NO: 5898059 - DNA, 21 bp, Homo sapiens
gaaagcctgtctctttccact

SEQ ID NO: 5898060 - DNA, 24 bp, Homo sapiens
gaaagcctgttcccctcactggat

SEQ ID NO: 5898061 - DNA, 19 bp, Homo sapiens
gaaagccttaagctgcagg

SEQ ID NO: 5898062 - DNA, 21 bp, Homo sapiens
gaaagcctttcattttgcttt

SEQ ID NO: 5898063 - DNA, 20 bp, Homo sapiens
gaaagcgcggacgtgctggg

SEQ ID NO: 5898064 - DNA, 18 bp, Homo sapiens
gaaagcgggcagccccgt

SEQ ID NO: 5898065 - DNA, 17 bp, Homo sapiens
gaaagcgtttctgtgta

SEQ ID NO: 5898066 - DNA, 15 bp, Homo sapiens
gaaagctaaagtgat

SEQ ID NO: 5898067 - DNA, 13 bp, Homo sapiens
gaaagctagagat

SEQ ID NO: 5898068 - DNA, 16 bp, Homo sapiens
gaaagctatgaatgtt

SEQ ID NO: 5898069 - DNA, 13 bp, Homo sapiens
gaaagctctagaa

SEQ ID NO: 5898070 - DNA, 21 bp, Homo sapiens
gaaagctgacttggctggtgt

SEQ ID NO: 5898071 - DNA, 19 bp, Homo sapiens
gaaagctgagaactcctga

SEQ ID NO: 5898072 - DNA, 22 bp, Homo sapiens
gaaagctgagaactcctgactg

SEQ ID NO: 5898073 - DNA, 18 bp, Homo sapiens
gaaagctgaggaacaggt

SEQ ID NO: 5898074 - DNA, 23 bp, Homo sapiens
gaaagctgattactgtcaataaa

SEQ ID NO: 5898075 - DNA, 18 bp, Homo sapiens
gaaagctgccagagccgg

SEQ ID NO: 5898076 - DNA, 23 bp, Homo sapiens
gaaagctgcttctgggggatttc

SEQ ID NO: 5898077 - DNA, 22 bp, Homo sapiens
gaaagctgctttcgaataaagt

SEQ ID NO: 5898078 - DNA, 17 bp, Homo sapiens
gaaagctggactgacca

SEQ ID NO: 5898079 - DNA, 13 bp, Homo sapiens
gaaagctgtggct

SEQ ID NO: 5898080 - DNA, 15 bp, Homo sapiens
gaaagctgtgtttat

SEQ ID NO: 5898081 - DNA, 15 bp, Homo sapiens
gaaagcttacatttt

SEQ ID NO: 5898082 - DNA, 15 bp, Homo sapiens
gaaagcttgaaaaga

SEQ ID NO: 5898083 - DNA, 22 bp, Homo sapiens
gaaagcttgaaaagattctgaa

SEQ ID NO: 5898084 - DNA, 21 bp, Homo sapiens
gaaagcttgccctggtgcctc

SEQ ID NO: 5898085 - DNA, 22 bp, Homo sapiens
gaaagctttgaacaattgtgtt

SEQ ID NO: 5898086 - DNA, 21 bp, Homo sapiens
gaaagctttggaaaaatcttt

SEQ ID NO: 5898087 - DNA, 15 bp, Homo sapiens
gaaagctttggcagt

SEQ ID NO: 5898088 - DNA, 21 bp, Homo sapiens
gaaaggaaaaaagaaaaaagc

SEQ ID NO: 5898089 - DNA, 14 bp, Homo sapiens
gaaaggaaaaacag

SEQ ID NO: 5898090 - DNA, 23 bp, Homo sapiens
gaaaggaaaaacagaacatttct

SEQ ID NO: 5898091 - DNA, 21 bp, Homo sapiens
gaaaggaaaaatttttttgtt

SEQ ID NO: 5898092 - DNA, 18 bp, Homo sapiens
gaaaggaaaaccagggat

SEQ ID NO: 5898093 - DNA, 17 bp, Homo sapiens
gaaaggaaaagattcct

SEQ ID NO: 5898094 - DNA, 13 bp, Homo sapiens
gaaaggaaaagtc

SEQ ID NO: 5898095 - DNA, 15 bp, Homo sapiens
gaaaggaaacctttt

SEQ ID NO: 5898096 - DNA, 13 bp, Homo sapiens
gaaaggaaagaag

SEQ ID NO: 5898097 - DNA, 22 bp, Homo sapiens
gaaaggaaagtagtccaggctg

SEQ ID NO: 5898098 - DNA, 15 bp, Homo sapiens
gaaaggaaatagact

SEQ ID NO: 5898099 - DNA, 15 bp, Homo sapiens
gaaaggaacactggc

SEQ ID NO: 5898100 - DNA, 16 bp, Homo sapiens
gaaaggaacctgggat

SEQ ID NO: 5898101 - DNA, 16 bp, Homo sapiens
gaaaggaagctgtgcg

SEQ ID NO: 5898102 - DNA, 22 bp, Homo sapiens
gaaaggacacgccgtctgtcct

SEQ ID NO: 5898103 - DNA, 15 bp, Homo sapiens
gaaaggactcagtgt

SEQ ID NO: 5898104 - DNA, 16 bp, Homo sapiens
gaaaggagaaattttg

SEQ ID NO: 5898105 - DNA, 12 bp, Homo sapiens
gaaaggagacat

SEQ ID NO: 5898106 - DNA, 14 bp, Homo sapiens
gaaaggagaggaaa

SEQ ID NO: 5898107 - DNA, 22 bp, Homo sapiens
gaaaggagccggaccaagatgg

SEQ ID NO: 5898108 - DNA, 17 bp, Homo sapiens
gaaaggaggcatgcctc

SEQ ID NO: 5898109 - DNA, 22 bp, Homo sapiens
gaaaggaggccctgttccctgg

SEQ ID NO: 5898110 - DNA, 15 bp, Homo sapiens
gaaaggaggtggggg

SEQ ID NO: 5898111 - DNA, 14 bp, Homo sapiens
gaaaggatatttaa

SEQ ID NO: 5898112 - DNA, 21 bp, Homo sapiens
gaaaggatatttaagaaaata

SEQ ID NO: 5898113 - DNA, 23 bp, Homo sapiens
gaaaggatctgtgattggctggt

SEQ ID NO: 5898114 - DNA, 17 bp, Homo sapiens
gaaaggatgagcagagc

SEQ ID NO: 5898115 - DNA, 20 bp, Homo sapiens
gaaaggatggcagcctcagg

SEQ ID NO: 5898116 - DNA, 21 bp, Homo sapiens
gaaaggatggcagcctcaggg

SEQ ID NO: 5898117 - DNA, 15 bp, Homo sapiens
gaaaggatgtggaag

SEQ ID NO: 5898118 - DNA, 20 bp, Homo sapiens
gaaaggatgtggaagagcat

SEQ ID NO: 5898119 - DNA, 14 bp, Homo sapiens
gaaaggattttacc

SEQ ID NO: 5898120 - DNA, 20 bp, Homo sapiens
gaaaggattttaccaaagca

SEQ ID NO: 5898121 - DNA, 22 bp, Homo sapiens
gaaaggcaagagctcaaggtca

SEQ ID NO: 5898122 - DNA, 19 bp, Homo sapiens
gaaaggcaatttttgagta

SEQ ID NO: 5898123 - DNA, 14 bp, Homo sapiens
gaaaggcacatatt

SEQ ID NO: 5898124 - DNA, 16 bp, Homo sapiens
gaaaggcagaaacaca

SEQ ID NO: 5898125 - DNA, 14 bp, Homo sapiens
gaaaggcagacaca

SEQ ID NO: 5898126 - DNA, 20 bp, Homo sapiens
gaaaggcagagattgggggg

SEQ ID NO: 5898127 - DNA, 20 bp, Homo sapiens
gaaaggcagggcaagaacag

SEQ ID NO: 5898128 - DNA, 17 bp, Homo sapiens
gaaaggcagggccctga

SEQ ID NO: 5898129 - DNA, 11 bp, Homo sapiens
gaaaggcaggt

SEQ ID NO: 5898130 - DNA, 13 bp, Homo sapiens
gaaaggcatctaa

SEQ ID NO: 5898131 - DNA, 23 bp, Homo sapiens
gaaaggcatctaagacattcacc

SEQ ID NO: 5898132 - DNA, 19 bp, Homo sapiens
gaaaggccccaatcttgcc

SEQ ID NO: 5898133 - DNA, 20 bp, Homo sapiens
gaaaggccccaatcttgccc

SEQ ID NO: 5898134 - DNA, 14 bp, Homo sapiens
gaaaggcctcaaga

SEQ ID NO: 5898135 - DNA, 13 bp, Homo sapiens
gaaaggcctgcac

SEQ ID NO: 5898136 - DNA, 14 bp, Homo sapiens
gaaaggcctgcaca

SEQ ID NO: 5898137 - DNA, 15 bp, Homo sapiens
gaaaggcctgcacac

SEQ ID NO: 5898138 - DNA, 16 bp, Homo sapiens
gaaaggcctgtgggga

SEQ ID NO: 5898139 - DNA, 16 bp, Homo sapiens
gaaaggcgcccccgcc

SEQ ID NO: 5898140 - DNA, 18 bp, Homo sapiens
gaaaggcgcccccgcccc

SEQ ID NO: 5898141 - DNA, 15 bp, Homo sapiens
gaaaggctaaacact

SEQ ID NO: 5898142 - DNA, 18 bp, Homo sapiens
gaaaggctattttcagat

SEQ ID NO: 5898143 - DNA, 19 bp, Homo sapiens
gaaaggctcagtctcagga

SEQ ID NO: 5898144 - DNA, 21 bp, Homo sapiens
gaaaggctcagtctcaggagc

SEQ ID NO: 5898145 - DNA, 12 bp, Homo sapiens
gaaaggctccag

SEQ ID NO: 5898146 - DNA, 13 bp, Homo sapiens
gaaaggctccagg

SEQ ID NO: 5898147 - DNA, 16 bp, Homo sapiens
gaaaggctccaggagc

SEQ ID NO: 5898148 - DNA, 20 bp, Homo sapiens
gaaaggctccaggagcagcc

SEQ ID NO: 5898149 - DNA, 17 bp, Homo sapiens
gaaaggctctgaaagcc

SEQ ID NO: 5898150 - DNA, 18 bp, Homo sapiens
gaaaggctgctgtactga

SEQ ID NO: 5898151 - DNA, 10 bp, Homo sapiens
gaaagggaaa

SEQ ID NO: 5898152 - DNA, 14 bp, Homo sapiens
gaaagggaaactgg

SEQ ID NO: 5898153 - DNA, 19 bp, Homo sapiens
gaaagggacccgaagccca

SEQ ID NO: 5898154 - DNA, 22 bp, Homo sapiens
gaaagggacttggaagctccgc

SEQ ID NO: 5898155 - DNA, 21 bp, Homo sapiens
gaaagggagacagccaggtgg

SEQ ID NO: 5898156 - DNA, 17 bp, Homo sapiens
gaaagggagcagagaag

SEQ ID NO: 5898157 - DNA, 19 bp, Homo sapiens
gaaagggagggcccctcat

SEQ ID NO: 5898158 - DNA, 19 bp, Homo sapiens
gaaagggagggctctgagg

SEQ ID NO: 5898159 - DNA, 18 bp, Homo sapiens
gaaagggatggccacaag

SEQ ID NO: 5898160 - DNA, 21 bp, Homo sapiens
gaaagggatggtcaggcccag

SEQ ID NO: 5898161 - DNA, 22 bp, Homo sapiens
gaaagggatggtcaggcccagt

SEQ ID NO: 5898162 - DNA, 12 bp, Homo sapiens
gaaagggatttt

SEQ ID NO: 5898163 - DNA, 20 bp, Homo sapiens
gaaagggcagcccctcccca

SEQ ID NO: 5898164 - DNA, 13 bp, Homo sapiens
gaaagggcagctt

SEQ ID NO: 5898165 - DNA, 22 bp, Homo sapiens
gaaagggcagcttcagtctctg

SEQ ID NO: 5898166 - DNA, 13 bp, Homo sapiens
gaaagggccagga

SEQ ID NO: 5898167 - DNA, 18 bp, Homo sapiens
gaaagggccaggagatgg

SEQ ID NO: 5898168 - DNA, 15 bp, Homo sapiens
gaaagggcccagaga

SEQ ID NO: 5898169 - DNA, 16 bp, Homo sapiens
gaaagggcccagagag

SEQ ID NO: 5898170 - DNA, 21 bp, Homo sapiens
gaaagggccctgggcctgcct

SEQ ID NO: 5898171 - DNA, 17 bp, Homo sapiens
gaaagggcccttcccct

SEQ ID NO: 5898172 - DNA, 21 bp, Homo sapiens
gaaatcatcaaaaagaaaaat

SEQ ID NO: 5898173 - DNA, 19 bp, Homo sapiens
gaaatcatgttatgataaa

SEQ ID NO: 5898174 - DNA, 19 bp, Homo sapiens
gaaatcattgttataaaga

SEQ ID NO: 5898175 - DNA, 17 bp, Homo sapiens
gaaatccagaagtttta

SEQ ID NO: 5898176 - DNA, 11 bp, Homo sapiens
gaaatccagga

SEQ ID NO: 5898177 - DNA, 13 bp, Homo sapiens
gaaatccagggtg

SEQ ID NO: 5898178 - DNA, 11 bp, Homo sapiens
gaaatccagta

SEQ ID NO: 5898179 - DNA, 19 bp, Homo sapiens
gaaatccagtttcccacca

SEQ ID NO: 5898180 - DNA, 23 bp, Homo sapiens
gaaatccataaactaagagaaac

SEQ ID NO: 5898181 - DNA, 19 bp, Homo sapiens
gaaatccatatatatgaaa

SEQ ID NO: 5898182 - DNA, 20 bp, Homo sapiens
gaaatccatatatatgaaat

SEQ ID NO: 5898183 - DNA, 14 bp, Homo sapiens
gaaatccattcaca

SEQ ID NO: 5898184 - DNA, 18 bp, Homo sapiens
gaaatccattgtttaaag

SEQ ID NO: 5898185 - DNA, 17 bp, Homo sapiens
gaaatcccatcaggtca

SEQ ID NO: 5898186 - DNA, 16 bp, Homo sapiens
gaaatcccctaactga

SEQ ID NO: 5898187 - DNA, 19 bp, Homo sapiens
gaaatccctgctcactgca

SEQ ID NO: 5898188 - DNA, 21 bp, Homo sapiens
gaaatccctgtttaatattta

SEQ ID NO: 5898189 - DNA, 23 bp, Homo sapiens
gaaatccctgtttaatatttaaa

SEQ ID NO: 5898190 - DNA, 13 bp, Homo sapiens
gaaatcccttcat

SEQ ID NO: 5898191 - DNA, 14 bp, Homo sapiens
gaaatcccttcata

SEQ ID NO: 5898192 - DNA, 15 bp, Homo sapiens
gaaatcccttcatac

SEQ ID NO: 5898193 - DNA, 22 bp, Homo sapiens
gaaatccgagcggctacaaagc

SEQ ID NO: 5898194 - DNA, 22 bp, Homo sapiens
gaaatcctagtttcctctcctt

SEQ ID NO: 5898195 - DNA, 19 bp, Homo sapiens
gaaatcctcaattcatcaa

SEQ ID NO: 5898196 - DNA, 21 bp, Homo sapiens
gaaatcctcagccgagaaatt

SEQ ID NO: 5898197 - DNA, 15 bp, Homo sapiens
gaaatcctggttcct

SEQ ID NO: 5898198 - DNA, 19 bp, Homo sapiens
gaaatccttgactggacct

SEQ ID NO: 5898199 - DNA, 22 bp, Homo sapiens
gaaatcctttcataaagcacca

SEQ ID NO: 5898200 - DNA, 19 bp, Homo sapiens
gaaatcgccttatgagaac

SEQ ID NO: 5898201 - DNA, 20 bp, Homo sapiens
gaaatcgcttatatgtcctt

SEQ ID NO: 5898202 - DNA, 20 bp, Homo sapiens
gaaatctaagtttcgagaga

SEQ ID NO: 5898203 - DNA, 20 bp, Homo sapiens
gaaatctatgattccaggtg

SEQ ID NO: 5898204 - DNA, 16 bp, Homo sapiens
gaaatctattttcagt

SEQ ID NO: 5898205 - DNA, 21 bp, Homo sapiens
gaaatctcagatacttatgaa

SEQ ID NO: 5898206 - DNA, 17 bp, Homo sapiens
gaaatctccagtgtgcg

SEQ ID NO: 5898207 - DNA, 18 bp, Homo sapiens
gaaatctgctctgtacat

SEQ ID NO: 5898208 - DNA, 22 bp, Homo sapiens
gaaatctggcttctggccagga

SEQ ID NO: 5898209 - DNA, 23 bp, Homo sapiens
gaaatctggcttctggccaggaa

SEQ ID NO: 5898210 - DNA, 16 bp, Homo sapiens
gaaatctgtaaagcca

SEQ ID NO: 5898211 - DNA, 12 bp, Homo sapiens
gaaatctgtatt

SEQ ID NO: 5898212 - DNA, 14 bp, Homo sapiens
gaaatctgtcctgt

SEQ ID NO: 5898213 - DNA, 16 bp, Homo sapiens
gaaatctgtgcaataa

SEQ ID NO: 5898214 - DNA, 19 bp, Homo sapiens
gaaatcttacagctgggtg

SEQ ID NO: 5898215 - DNA, 13 bp, Homo sapiens
gaaatcttcccag

SEQ ID NO: 5898216 - DNA, 15 bp, Homo sapiens
gaaatcttcccagta

SEQ ID NO: 5898217 - DNA, 19 bp, Homo sapiens
gaaatcttgtaagtattta

SEQ ID NO: 5898218 - DNA, 13 bp, Homo sapiens
gaaatcttgtctt

SEQ ID NO: 5898219 - DNA, 14 bp, Homo sapiens
gaaatcttgtctta

SEQ ID NO: 5898220 - DNA, 13 bp, Homo sapiens
gaaatctttcaac

SEQ ID NO: 5898221 - DNA, 15 bp, Homo sapiens
gaaatctttcaagtt

SEQ ID NO: 5898222 - DNA, 15 bp, Homo sapiens
gaaatcttttacatt

SEQ ID NO: 5898223 - DNA, 18 bp, Homo sapiens
gaaatcttttacattttt

SEQ ID NO: 5898224 - DNA, 11 bp, Homo sapiens
gaaatgaaaaa

SEQ ID NO: 5898225 - DNA, 19 bp, Homo sapiens
gaaatgaaaaaaaaaaaca

SEQ ID NO: 5898226 - DNA, 20 bp, Homo sapiens
gaaatgaaaaaaaaaaacaa

SEQ ID NO: 5898227 - DNA, 20 bp, Homo sapiens
gaaatgaaaacagtgtgtaa

SEQ ID NO: 5898228 - DNA, 23 bp, Homo sapiens
gaaatgaaaacagtgtgtaaaca

SEQ ID NO: 5898229 - DNA, 21 bp, Homo sapiens
gaaatgaaaatggctgaagaa

SEQ ID NO: 5898230 - DNA, 12 bp, Homo sapiens
gaaatgaaaggg

SEQ ID NO: 5898231 - DNA, 13 bp, Homo sapiens
gaaatgaaattta

SEQ ID NO: 5898232 - DNA, 17 bp, Homo sapiens
gaaatgaaatttaaaca

SEQ ID NO: 5898233 - DNA, 17 bp, Homo sapiens
gaaatgaaattttacca

SEQ ID NO: 5898234 - DNA, 16 bp, Homo sapiens
gaaatgaacaaaagat

SEQ ID NO: 5898235 - DNA, 16 bp, Homo sapiens
gaaatgaacattccaa

SEQ ID NO: 5898236 - DNA, 18 bp, Homo sapiens
gaaatgaagagctgttga

SEQ ID NO: 5898237 - DNA, 17 bp, Homo sapiens
gaaatgaagcagaggaa

SEQ ID NO: 5898238 - DNA, 15 bp, Homo sapiens
gaaatgaatgattct

SEQ ID NO: 5898239 - DNA, 13 bp, Homo sapiens
gaaatgaatgtgt

SEQ ID NO: 5898240 - DNA, 21 bp, Homo sapiens
gaaatgaatttatctgaatat

SEQ ID NO: 5898241 - DNA, 22 bp, Homo sapiens
gaaatgacagaatgctgtttta

SEQ ID NO: 5898242 - DNA, 15 bp, Homo sapiens
gaaatgacatttcac

SEQ ID NO: 5898243 - DNA, 23 bp, Homo sapiens
gaaatgacggtgttaattttgct

SEQ ID NO: 5898244 - DNA, 19 bp, Homo sapiens
gaaatgactaaaaaacaaa

SEQ ID NO: 5898245 - DNA, 22 bp, Homo sapiens
gaaatgactgccggtcatttga

SEQ ID NO: 5898246 - DNA, 17 bp, Homo sapiens
gaaatgagaaggcagcc

SEQ ID NO: 5898247 - DNA, 18 bp, Homo sapiens
gaaatgagaaggcagcca

SEQ ID NO: 5898248 - DNA, 18 bp, Homo sapiens
gaaatgagatcaggctct

SEQ ID NO: 5898249 - DNA, 15 bp, Homo sapiens
gaaatgaggaggatg

SEQ ID NO: 5898250 - DNA, 21 bp, Homo sapiens
gaaatgaggtctgtttaaagt

SEQ ID NO: 5898251 - DNA, 23 bp, Homo sapiens
gaaatgaggtctgtttaaagtgg

SEQ ID NO: 5898252 - DNA, 14 bp, Homo sapiens
gaaatgaggtgcca

SEQ ID NO: 5898253 - DNA, 13 bp, Homo sapiens
gaaatgaggtttt

SEQ ID NO: 5898254 - DNA, 17 bp, Homo sapiens
gaaatgatagatttgac

SEQ ID NO: 5898255 - DNA, 21 bp, Homo sapiens
gaaatgattaaaatgtttgag

SEQ ID NO: 5898256 - DNA, 15 bp, Homo sapiens
gaaatgattcatctt

SEQ ID NO: 5898257 - DNA, 21 bp, Homo sapiens
gaaatgattgagagcagcctc

SEQ ID NO: 5898258 - DNA, 14 bp, Homo sapiens
gaaatgcaaaaatc

SEQ ID NO: 5898259 - DNA, 17 bp, Homo sapiens
gaaatgcaaaaatctct

SEQ ID NO: 5898260 - DNA, 15 bp, Homo sapiens
gaaatgcaagctctg

SEQ ID NO: 5898261 - DNA, 15 bp, Homo sapiens
gaaatgcaaggggga

SEQ ID NO: 5898262 - DNA, 16 bp, Homo sapiens
gaaatgcacaatgtct

SEQ ID NO: 5898263 - DNA, 14 bp, Homo sapiens
gaaatgcacaattt

SEQ ID NO: 5898264 - DNA, 13 bp, Homo sapiens
gaaatgcactgta

SEQ ID NO: 5898265 - DNA, 22 bp, Homo sapiens
gaaatgcataccagtaattggc

SEQ ID NO: 5898266 - DNA, 21 bp, Homo sapiens
gaaatgcatttatagatcatt

SEQ ID NO: 5898267 - DNA, 19 bp, Homo sapiens
gaaatgcattttattcttt

SEQ ID NO: 5898268 - DNA, 23 bp, Homo sapiens
gaaatgcattttgctagacagtt

SEQ ID NO: 5898269 - DNA, 21 bp, Homo sapiens
gaaatgccaagactctatgct

SEQ ID NO: 5898270 - DNA, 19 bp, Homo sapiens
gaaatgccagtggtggagg

SEQ ID NO: 5898271 - DNA, 16 bp, Homo sapiens
gaaatgccttactttg

SEQ ID NO: 5898272 - DNA, 14 bp, Homo sapiens
gaaatgctaaactt

SEQ ID NO: 5898273 - DNA, 15 bp, Homo sapiens
gaaatgctaatgtaa

SEQ ID NO: 5898274 - DNA, 20 bp, Homo sapiens
gaaatgctatgtcatttcat

SEQ ID NO: 5898275 - DNA, 22 bp, Homo sapiens
gaaatgctatgtcatttcatgt

SEQ ID NO: 5898276 - DNA, 16 bp, Homo sapiens
gaaatgctcttttgca

SEQ ID NO: 5898277 - DNA, 17 bp, Homo sapiens
gaaatgctgcattttaa

SEQ ID NO: 5898278 - DNA, 13 bp, Homo sapiens
gaaatgctgctgg

SEQ ID NO: 5898279 - DNA, 23 bp, Homo sapiens
gaaatgctggtttttcagttttc

SEQ ID NO: 5898280 - DNA, 13 bp, Homo sapiens
gaaatgcttagtt

SEQ ID NO: 5898281 - DNA, 14 bp, Homo sapiens
gaaatggaaatttt

SEQ ID NO: 5898282 - DNA, 14 bp, Homo sapiens
gaaatggaatcagg

SEQ ID NO: 5898283 - DNA, 17 bp, Homo sapiens
gaaatggagggtggggc

SEQ ID NO: 5898284 - DNA, 20 bp, Homo sapiens
gaaatggatagattgtttta

SEQ ID NO: 5898285 - DNA, 17 bp, Homo sapiens
gaaatggatgcaaagta

SEQ ID NO: 5898286 - DNA, 18 bp, Homo sapiens
gaaatggattggtaagat

SEQ ID NO: 5898287 - DNA, 12 bp, Homo sapiens
gaaatggctggg

SEQ ID NO: 5898288 - DNA, 18 bp, Homo sapiens
gaaatggcttgaagccaa

SEQ ID NO: 5898289 - DNA, 23 bp, Homo sapiens
gaaatggcttttcccaaccccca

SEQ ID NO: 5898290 - DNA, 19 bp, Homo sapiens
gaaatgggaaaaaacttaa

SEQ ID NO: 5898291 - DNA, 21 bp, Homo sapiens
gaaatgggaattgcgctcagg

SEQ ID NO: 5898292 - DNA, 14 bp, Homo sapiens
gaaatgggactctg

SEQ ID NO: 5898293 - DNA, 15 bp, Homo sapiens
gaaatgggagatggt

SEQ ID NO: 5898294 - DNA, 15 bp, Homo sapiens
gaaatgggcagagca

SEQ ID NO: 5898295 - DNA, 16 bp, Homo sapiens
gaaatgggcagagcag

SEQ ID NO: 5898296 - DNA, 20 bp, Homo sapiens
gaaatgggcagagcagagac

SEQ ID NO: 5898297 - DNA, 16 bp, Homo sapiens
gaaatgggcagttctc

SEQ ID NO: 5898298 - DNA, 14 bp, Homo sapiens
gaaatggggaaagc

SEQ ID NO: 5898299 - DNA, 17 bp, Homo sapiens
gaaatggggagctggcc

SEQ ID NO: 5898300 - DNA, 23 bp, Homo sapiens
gaaatggggagctggcctaggtg

SEQ ID NO: 5898301 - DNA, 17 bp, Homo sapiens
gaaatggtatccagaat

SEQ ID NO: 5898302 - DNA, 23 bp, Homo sapiens
gaaatggtccgctttcctggagc

SEQ ID NO: 5898303 - DNA, 19 bp, Homo sapiens
gaaatggtttcctctggat

SEQ ID NO: 5898304 - DNA, 14 bp, Homo sapiens
gaaatgtaaatgtt

SEQ ID NO: 5898305 - DNA, 12 bp, Homo sapiens
gaaatgtaacat

SEQ ID NO: 5898306 - DNA, 18 bp, Homo sapiens
gaaatgtaacatgaagca

SEQ ID NO: 5898307 - DNA, 13 bp, Homo sapiens
gaaatgtaagcat

SEQ ID NO: 5898308 - DNA, 12 bp, Homo sapiens
gaaatgtaatgc

SEQ ID NO: 5898309 - DNA, 16 bp, Homo sapiens
gaaatgtacactacca

SEQ ID NO: 5898310 - DNA, 13 bp, Homo sapiens
gaaatgtacactt

SEQ ID NO: 5898311 - DNA, 15 bp, Homo sapiens
gaaatgtacactttt

SEQ ID NO: 5898312 - DNA, 21 bp, Homo sapiens
gaaatgtacactttttacagc

SEQ ID NO: 5898313 - DNA, 14 bp, Homo sapiens
gaaatgtacttttg

SEQ ID NO: 5898314 - DNA, 18 bp, Homo sapiens
gaaatgtacttttggata

SEQ ID NO: 5898315 - DNA, 22 bp, Homo sapiens
gaaatgtagaattgaaaatgca

SEQ ID NO: 5898316 - DNA, 14 bp, Homo sapiens
gaaatgtagcactt

SEQ ID NO: 5898317 - DNA, 12 bp, Homo sapiens
gaaatgtagcag

SEQ ID NO: 5898318 - DNA, 15 bp, Homo sapiens
gaaatgtagccctgg

SEQ ID NO: 5898319 - DNA, 14 bp, Homo sapiens
gaaatgtatgtgtg

SEQ ID NO: 5898320 - DNA, 20 bp, Homo sapiens
gaaatgtattaatgtatgta

SEQ ID NO: 5898321 - DNA, 15 bp, Homo sapiens
gaaatgtattcacct

SEQ ID NO: 5898322 - DNA, 18 bp, Homo sapiens
gaaatgtattcctgaaaa

SEQ ID NO: 5898323 - DNA, 17 bp, Homo sapiens
gaaatgtcatgattgcc

SEQ ID NO: 5898324 - DNA, 22 bp, Homo sapiens
gaaatgtcccctcaaactcatt

SEQ ID NO: 5898325 - DNA, 15 bp, Homo sapiens
gaaatgtctggagaa

SEQ ID NO: 5898326 - DNA, 15 bp, Homo sapiens
gaaatgtgaaggaaa

SEQ ID NO: 5898327 - DNA, 21 bp, Homo sapiens
gaaatgtgaatttttattgtt

SEQ ID NO: 5898328 - DNA, 18 bp, Homo sapiens
gaaatgtgactggttcag

SEQ ID NO: 5898329 - DNA, 13 bp, Homo sapiens
gaaatgtgagaaa

SEQ ID NO: 5898330 - DNA, 21 bp, Homo sapiens
gaaatgtgatttgtcttccct

SEQ ID NO: 5898331 - DNA, 13 bp, Homo sapiens
gaaatgtggagaa

SEQ ID NO: 5898332 - DNA, 21 bp, Homo sapiens
gaaatgtggagaagagtgccc

SEQ ID NO: 5898333 - DNA, 18 bp, Homo sapiens
gaaatgtggatgtgattg

SEQ ID NO: 5898334 - DNA, 13 bp, Homo sapiens
gaaatgtgtatct

SEQ ID NO: 5898335 - DNA, 22 bp, Homo sapiens
gaaatgtgtatctatttatata

SEQ ID NO: 5898336 - DNA, 16 bp, Homo sapiens
gaaatgtgtgtgatgt

SEQ ID NO: 5898337 - DNA, 20 bp, Homo sapiens
gaaatgtgtgtgatgtgaca

SEQ ID NO: 5898338 - DNA, 23 bp, Homo sapiens
gaaatgtgtgttgtaacaaatat

SEQ ID NO: 5898339 - DNA, 14 bp, Homo sapiens
gaaatgtgtttctg

SEQ ID NO: 5898340 - DNA, 21 bp, Homo sapiens
gaaatgttaaaggttcacagg

SEQ ID NO: 5898341 - DNA, 15 bp, Homo sapiens
gaaatgttaagaaag

SEQ ID NO: 5898342 - DNA, 15 bp, Homo sapiens
gaaatgttactgtct

SEQ ID NO: 5898343 - DNA, 18 bp, Homo sapiens
gaaatgttataaagtaga

SEQ ID NO: 5898344 - DNA, 15 bp, Homo sapiens
gaaatgttctgttca

SEQ ID NO: 5898345 - DNA, 19 bp, Homo sapiens
gaaatgtttaataaagctt

SEQ ID NO: 5898346 - DNA, 21 bp, Homo sapiens
gaaatgtttatacaataattt

SEQ ID NO: 5898347 - DNA, 13 bp, Homo sapiens
gaaatgtttccag

SEQ ID NO: 5898348 - DNA, 15 bp, Homo sapiens
gaaatgttttaaggc

SEQ ID NO: 5898349 - DNA, 20 bp, Homo sapiens
gaaatgttttgtaaacattt

SEQ ID NO: 5898350 - DNA, 18 bp, Homo sapiens
gaacagacaggagaaatg

SEQ ID NO: 5898351 - DNA, 15 bp, Homo sapiens
gaacagaccagtgac

SEQ ID NO: 5898352 - DNA, 16 bp, Homo sapiens
gaacagaccggggtgg

SEQ ID NO: 5898353 - DNA, 13 bp, Homo sapiens
gaacagacctgag

SEQ ID NO: 5898354 - DNA, 15 bp, Homo sapiens
gaacagactggcctg

SEQ ID NO: 5898355 - DNA, 11 bp, Homo sapiens
gaacagagact

SEQ ID NO: 5898356 - DNA, 12 bp, Homo sapiens
gaacagagactc

SEQ ID NO: 5898357 - DNA, 16 bp, Homo sapiens
gaacagagactctgga

SEQ ID NO: 5898358 - DNA, 12 bp, Homo sapiens
gaacagagagaa

SEQ ID NO: 5898359 - DNA, 21 bp, Homo sapiens
gaacagagagacccttgtggg

SEQ ID NO: 5898360 - DNA, 12 bp, Homo sapiens
gaacagagctag

SEQ ID NO: 5898361 - DNA, 14 bp, Homo sapiens
gaacagagtatata

SEQ ID NO: 5898362 - DNA, 17 bp, Homo sapiens
gaacagataatccctgt

SEQ ID NO: 5898363 - DNA, 18 bp, Homo sapiens
gaacagataatccctgta

SEQ ID NO: 5898364 - DNA, 17 bp, Homo sapiens
gaacagatcttgttctt

SEQ ID NO: 5898365 - DNA, 18 bp, Homo sapiens
gaacagatcttgttcttt

SEQ ID NO: 5898366 - DNA, 18 bp, Homo sapiens
gaacagatggctgtgaaa

SEQ ID NO: 5898367 - DNA, 13 bp, Homo sapiens
gaacagatgtaaa

SEQ ID NO: 5898368 - DNA, 21 bp, Homo sapiens
gaacagatgtttcttttgtat

SEQ ID NO: 5898369 - DNA, 21 bp, Homo sapiens
gaacagattgctacacacaca

SEQ ID NO: 5898370 - DNA, 14 bp, Homo sapiens
gaacagattttatt

SEQ ID NO: 5898371 - DNA, 15 bp, Homo sapiens
gaacagcagaaaccc

SEQ ID NO: 5898372 - DNA, 21 bp, Homo sapiens
gaacagcagactcagctctga

SEQ ID NO: 5898373 - DNA, 14 bp, Homo sapiens
gaacagcaggccca

SEQ ID NO: 5898374 - DNA, 21 bp, Homo sapiens
gaacagcaggcccacctacct

SEQ ID NO: 5898375 - DNA, 19 bp, Homo sapiens
gaacagcagtgttctcaca

SEQ ID NO: 5898376 - DNA, 18 bp, Homo sapiens
gaacagcatggcactccc

SEQ ID NO: 5898377 - DNA, 19 bp, Homo sapiens
gaacagcatggcactccct

SEQ ID NO: 5898378 - DNA, 19 bp, Homo sapiens
gaacagccaaagaaactca

SEQ ID NO: 5898379 - DNA, 22 bp, Homo sapiens
gaacagccaaatgcatggtgca

SEQ ID NO: 5898380 - DNA, 23 bp, Homo sapiens
gaacagccagttttactgtgatt

SEQ ID NO: 5898381 - DNA, 15 bp, Homo sapiens
gaacagccatatctg

SEQ ID NO: 5898382 - DNA, 11 bp, Homo sapiens
gaacagcccag

SEQ ID NO: 5898383 - DNA, 16 bp, Homo sapiens
gaacagccccggggcc

SEQ ID NO: 5898384 - DNA, 18 bp, Homo sapiens
gaacagccccggggcccc

SEQ ID NO: 5898385 - DNA, 21 bp, Homo sapiens
gaacagccccggggccccctg

SEQ ID NO: 5898386 - DNA, 18 bp, Homo sapiens
gaacagcccgccagaggc

SEQ ID NO: 5898387 - DNA, 13 bp, Homo sapiens
gaacagccctctc

SEQ ID NO: 5898388 - DNA, 20 bp, Homo sapiens
gaacagccctctctctcact

SEQ ID NO: 5898389 - DNA, 14 bp, Homo sapiens
gaacagccctgcac

SEQ ID NO: 5898390 - DNA, 13 bp, Homo sapiens
gaacagcctgagc

SEQ ID NO: 5898391 - DNA, 17 bp, Homo sapiens
gaacagccttttccctt

SEQ ID NO: 5898392 - DNA, 22 bp, Homo sapiens
gaacagcgggagacctgtgcta

SEQ ID NO: 5898393 - DNA, 17 bp, Homo sapiens
gaacagctaacaataaa

SEQ ID NO: 5898394 - DNA, 23 bp, Homo sapiens
gaacagctatcacgttgaaccac

SEQ ID NO: 5898395 - DNA, 23 bp, Homo sapiens
gaacagctatgggagccccaggg

SEQ ID NO: 5898396 - DNA, 16 bp, Homo sapiens
gaacagctctgagatc

SEQ ID NO: 5898397 - DNA, 20 bp, Homo sapiens
gaacagctctgagatcctgg

SEQ ID NO: 5898398 - DNA, 21 bp, Homo sapiens
gaacagctctgagatcctgga

SEQ ID NO: 5898399 - DNA, 20 bp, Homo sapiens
gaacagctcttcactcagcc

SEQ ID NO: 5898400 - DNA, 15 bp, Homo sapiens
gaacagctgtaatct

SEQ ID NO: 5898401 - DNA, 16 bp, Homo sapiens
gaacagctgtgagcca

SEQ ID NO: 5898402 - DNA, 12 bp, Homo sapiens
gaacagctgtgt

SEQ ID NO: 5898403 - DNA, 15 bp, Homo sapiens
gaacagctgtgtctg

SEQ ID NO: 5898404 - DNA, 16 bp, Homo sapiens
gaacagctgttcctgt

SEQ ID NO: 5898405 - DNA, 17 bp, Homo sapiens
gaacagctgttcctgtg

SEQ ID NO: 5898406 - DNA, 12 bp, Homo sapiens
gaacagctgttg

SEQ ID NO: 5898407 - DNA, 16 bp, Homo sapiens
gaacagcttcaggtta

SEQ ID NO: 5898408 - DNA, 22 bp, Homo sapiens
gaacaggaaaataaaatattta

SEQ ID NO: 5898409 - DNA, 23 bp, Homo sapiens
gaacaggaatccttactgatatt

SEQ ID NO: 5898410 - DNA, 21 bp, Homo sapiens
gaacaggaggaactggtccag

SEQ ID NO: 5898411 - DNA, 18 bp, Homo sapiens
gaacaggaggtgtgaatg

SEQ ID NO: 5898412 - DNA, 21 bp, Homo sapiens
gaacaggaggtgtgaatgcac

SEQ ID NO: 5898413 - DNA, 22 bp, Homo sapiens
gaacaggaggtgtgaatgcacg

SEQ ID NO: 5898414 - DNA, 22 bp, Homo sapiens
gaacaggatgtataatatgcaa

SEQ ID NO: 5898415 - DNA, 15 bp, Homo sapiens
gaacaggcagaaata

SEQ ID NO: 5898416 - DNA, 17 bp, Homo sapiens
gaacaggccccacgccc

SEQ ID NO: 5898417 - DNA, 21 bp, Homo sapiens
gaacaggccgcacatctcact

SEQ ID NO: 5898418 - DNA, 12 bp, Homo sapiens
gaacaggctggg

SEQ ID NO: 5898419 - DNA, 14 bp, Homo sapiens
gaacaggctgggct

SEQ ID NO: 5898420 - DNA, 15 bp, Homo sapiens
gaacaggctggggcc

SEQ ID NO: 5898421 - DNA, 18 bp, Homo sapiens
gaacaggctggggccttt

SEQ ID NO: 5898422 - DNA, 20 bp, Homo sapiens
gaacagggaaaataggcagg

SEQ ID NO: 5898423 - DNA, 12 bp, Homo sapiens
gaacagggacca

SEQ ID NO: 5898424 - DNA, 14 bp, Homo sapiens
gaacagggcccagg

SEQ ID NO: 5898425 - DNA, 15 bp, Homo sapiens
gaacagggcccagga

SEQ ID NO: 5898426 - DNA, 19 bp, Homo sapiens
gaacagggtgcaggagagg

SEQ ID NO: 5898427 - DNA, 16 bp, Homo sapiens
gaacagggtttctcag

SEQ ID NO: 5898428 - DNA, 17 bp, Homo sapiens
gaacaggtcaaagatgt

SEQ ID NO: 5898429 - DNA, 20 bp, Homo sapiens
gaacaggtcccacgccaggc

SEQ ID NO: 5898430 - DNA, 21 bp, Homo sapiens
gaacaggtcccacgccaggcc

SEQ ID NO: 5898431 - DNA, 15 bp, Homo sapiens
gaacaggtgtttttc

SEQ ID NO: 5898432 - DNA, 12 bp, Homo sapiens
gaacagtaaaca

SEQ ID NO: 5898433 - DNA, 13 bp, Homo sapiens
gaacagtaaacat

SEQ ID NO: 5898434 - DNA, 18 bp, Homo sapiens
gaacagtcacccttctgg

SEQ ID NO: 5898435 - DNA, 21 bp, Homo sapiens
gaacagtcatgaggcagcttt

SEQ ID NO: 5898436 - DNA, 15 bp, Homo sapiens
gaacagtctgaaata

SEQ ID NO: 5898437 - DNA, 22 bp, Homo sapiens
gaacagtgaaagtcaattcagt

SEQ ID NO: 5898438 - DNA, 16 bp, Homo sapiens
gaacagtgctctgcct

SEQ ID NO: 5898439 - DNA, 15 bp, Homo sapiens
gaacagtggctgggt

SEQ ID NO: 5898440 - DNA, 18 bp, Homo sapiens
gaacagtggctgggtggg

SEQ ID NO: 5898441 - DNA, 20 bp, Homo sapiens
gaacagtggttgcctggggg

SEQ ID NO: 5898442 - DNA, 21 bp, Homo sapiens
gaacagtgtgcaaggcagccg

SEQ ID NO: 5898443 - DNA, 21 bp, Homo sapiens
gaacagtgtggcctcttctga

SEQ ID NO: 5898444 - DNA, 18 bp, Homo sapiens
gaacagtgtttcccataa

SEQ ID NO: 5898445 - DNA, 20 bp, Homo sapiens
gaacagtgtttgatttttat

SEQ ID NO: 5898446 - DNA, 16 bp, Homo sapiens
gaacagttaagcagcc

SEQ ID NO: 5898447 - DNA, 20 bp, Homo sapiens
gaacagttaagcagccgcca

SEQ ID NO: 5898448 - DNA, 22 bp, Homo sapiens
gaacagttgcatttagcttctt

SEQ ID NO: 5898449 - DNA, 20 bp, Homo sapiens
gaacagttgtgtttgaagca

SEQ ID NO: 5898450 - DNA, 23 bp, Homo sapiens
gaacagtttatgcagtgctgctt

SEQ ID NO: 5898451 - DNA, 17 bp, Homo sapiens
gaacagtttcatcagga

SEQ ID NO: 5898452 - DNA, 18 bp, Homo sapiens
gaacataaaaaggacatc

SEQ ID NO: 5898453 - DNA, 15 bp, Homo sapiens
gaacataaaatacaa

SEQ ID NO: 5898454 - DNA, 19 bp, Homo sapiens
gaacataaaccctccaagg

SEQ ID NO: 5898455 - DNA, 22 bp, Homo sapiens
gaacataaagcaaatagacaca

SEQ ID NO: 5898456 - DNA, 21 bp, Homo sapiens
gaacataaaggtaaaacaaaa

SEQ ID NO: 5898457 - DNA, 12 bp, Homo sapiens
gaacataatgaa

SEQ ID NO: 5898458 - DNA, 14 bp, Homo sapiens
gaacataattctta

SEQ ID NO: 5898459 - DNA, 17 bp, Homo sapiens
gaacatacaaatgcatc

SEQ ID NO: 5898460 - DNA, 22 bp, Homo sapiens
gaacatacaaatgcatctttga

SEQ ID NO: 5898461 - DNA, 18 bp, Homo sapiens
gaacatacactgtgaact

SEQ ID NO: 5898462 - DNA, 14 bp, Homo sapiens
gaacatacatgata

SEQ ID NO: 5898463 - DNA, 18 bp, Homo sapiens
gaacatactggctggtga

SEQ ID NO: 5898464 - DNA, 15 bp, Homo sapiens
gaacatactgttctc

SEQ ID NO: 5898465 - DNA, 15 bp, Homo sapiens
gaacatacttcaaaa

SEQ ID NO: 5898466 - DNA, 19 bp, Homo sapiens
gaacatacttcaaaaataa

SEQ ID NO: 5898467 - DNA, 13 bp, Homo sapiens
gaacatacttcag

SEQ ID NO: 5898468 - DNA, 18 bp, Homo sapiens
gaacatagactagagaaa

SEQ ID NO: 5898469 - DNA, 21 bp, Homo sapiens
gaacatagactagagaaaccg

SEQ ID NO: 5898470 - DNA, 14 bp, Homo sapiens
gaacatatcatttg

SEQ ID NO: 5898471 - DNA, 17 bp, Homo sapiens
gaacatatcatttgtga

SEQ ID NO: 5898472 - DNA, 18 bp, Homo sapiens
gaacatatcatttgtgaa

SEQ ID NO: 5898473 - DNA, 19 bp, Homo sapiens
gaacatatcatttgtgaag

SEQ ID NO: 5898474 - DNA, 14 bp, Homo sapiens
gaacatattcatga

SEQ ID NO: 5898475 - DNA, 12 bp, Homo sapiens
gaacatattgtt

SEQ ID NO: 5898476 - DNA, 18 bp, Homo sapiens
gaacatattgttgaaagg

SEQ ID NO: 5898477 - DNA, 19 bp, Homo sapiens
gaacatcataaaattttta

SEQ ID NO: 5898478 - DNA, 20 bp, Homo sapiens
gaacatcatcaaggcactgc

SEQ ID NO: 5898479 - DNA, 19 bp, Homo sapiens
gaacatccaaaatcttgat

SEQ ID NO: 5898480 - DNA, 12 bp, Homo sapiens
gaacatccaagg

SEQ ID NO: 5898481 - DNA, 21 bp, Homo sapiens
gaacatcccttattagttaca

SEQ ID NO: 5898482 - DNA, 17 bp, Homo sapiens
gaacatccctttttcaa

SEQ ID NO: 5898483 - DNA, 13 bp, Homo sapiens
gaacatccttcct

SEQ ID NO: 5898484 - DNA, 20 bp, Homo sapiens
gaacatcctttgcagggcag

SEQ ID NO: 5898485 - DNA, 21 bp, Homo sapiens
gaacatctcactttgccccag

SEQ ID NO: 5898486 - DNA, 17 bp, Homo sapiens
gaacatctcttgaaacc

SEQ ID NO: 5898487 - DNA, 18 bp, Homo sapiens
gaacatctgagtcctgga

SEQ ID NO: 5898488 - DNA, 23 bp, Homo sapiens
gaacatctgcactcctgaacaca

SEQ ID NO: 5898489 - DNA, 18 bp, Homo sapiens
gaacatctgccttgctgc

SEQ ID NO: 5898490 - DNA, 19 bp, Homo sapiens
gaacatctgccttgctgca

SEQ ID NO: 5898491 - DNA, 17 bp, Homo sapiens
gaacatctgtcctgtga

SEQ ID NO: 5898492 - DNA, 16 bp, Homo sapiens
gaacatcttcatataa

SEQ ID NO: 5898493 - DNA, 21 bp, Homo sapiens
gaacatctttgacactctgca

SEQ ID NO: 5898494 - DNA, 22 bp, Homo sapiens
gaacatctttgacactctgcag

SEQ ID NO: 5898495 - DNA, 16 bp, Homo sapiens
gaacatgaaatgccct

SEQ ID NO: 5898496 - DNA, 20 bp, Homo sapiens
gaacatgaactatgcctatg

SEQ ID NO: 5898497 - DNA, 21 bp, Homo sapiens
gaacatgaactcatcattttt

SEQ ID NO: 5898498 - DNA, 14 bp, Homo sapiens
gaacatgaatcaaa

SEQ ID NO: 5898499 - DNA, 14 bp, Homo sapiens
gaacatgaccaaaa

SEQ ID NO: 5898500 - DNA, 18 bp, Homo sapiens
gaacatgacccagcctga

SEQ ID NO: 5898501 - DNA, 19 bp, Homo sapiens
gaacatgacccagcctgaa

SEQ ID NO: 5898502 - DNA, 20 bp, Homo sapiens
gaacatgacccgtacacacc

SEQ ID NO: 5898503 - DNA, 15 bp, Homo sapiens
gaacatgatgggcct

SEQ ID NO: 5898504 - DNA, 15 bp, Homo sapiens
gaacatgatttattt

SEQ ID NO: 5898505 - DNA, 19 bp, Homo sapiens
gaacatgcaagaatttctg

SEQ ID NO: 5898506 - DNA, 19 bp, Homo sapiens
gaacatgcaattggggaag

SEQ ID NO: 5898507 - DNA, 21 bp, Homo sapiens
gaacatgcagttcattatttt

SEQ ID NO: 5898508 - DNA, 23 bp, Homo sapiens
gaacatgcagtttgaaattctga

SEQ ID NO: 5898509 - DNA, 15 bp, Homo sapiens
gaacatgcataagaa

SEQ ID NO: 5898510 - DNA, 13 bp, Homo sapiens
gaacatgccccct

SEQ ID NO: 5898511 - DNA, 14 bp, Homo sapiens
gaacatgcctgcca

SEQ ID NO: 5898512 - DNA, 16 bp, Homo sapiens
gaacatgcctgccaaa

SEQ ID NO: 5898513 - DNA, 16 bp, Homo sapiens
gaacatgctggaaata

SEQ ID NO: 5898514 - DNA, 17 bp, Homo sapiens
gaacatgctggaaataa

SEQ ID NO: 5898515 - DNA, 21 bp, Homo sapiens
gaacatgctggaaataaaaca

SEQ ID NO: 5898516 - DNA, 22 bp, Homo sapiens
gaacatgcttttactttattgc

SEQ ID NO: 5898517 - DNA, 22 bp, Homo sapiens
gaacatggacttgtatatttgt

SEQ ID NO: 5898518 - DNA, 17 bp, Homo sapiens
gaacatggagctgtcat

SEQ ID NO: 5898519 - DNA, 18 bp, Homo sapiens
gaacatggagctgtcatc

SEQ ID NO: 5898520 - DNA, 20 bp, Homo sapiens
gaacatggcatgtgaaaagt

SEQ ID NO: 5898521 - DNA, 14 bp, Homo sapiens
gaacatggtcaccc

SEQ ID NO: 5898522 - DNA, 20 bp, Homo sapiens
gaacatggtgtgtgtctctg

SEQ ID NO: 5898523 - DNA, 19 bp, Homo sapiens
gaacatgtgcttcatctgt

SEQ ID NO: 5898524 - DNA, 22 bp, Homo sapiens
gaacatgtgttttcatcatttc

SEQ ID NO: 5898525 - DNA, 21 bp, Homo sapiens
gaacatgttacgtgtgcaaca

SEQ ID NO: 5898526 - DNA, 20 bp, Homo sapiens
gaacatgttggtatttatct

SEQ ID NO: 5898527 - DNA, 23 bp, Homo sapiens
gaacattacattgccatttttaa

SEQ ID NO: 5898528 - DNA, 18 bp, Homo sapiens
gaacattaggaattgttt

SEQ ID NO: 5898529 - DNA, 16 bp, Homo sapiens
gaacattaggccccag

SEQ ID NO: 5898530 - DNA, 20 bp, Homo sapiens
gaacattaggccccagcaac

SEQ ID NO: 5898531 - DNA, 17 bp, Homo sapiens
gaacattagttgcacta

SEQ ID NO: 5898532 - DNA, 12 bp, Homo sapiens
gaacattattca

SEQ ID NO: 5898533 - DNA, 14 bp, Homo sapiens
gaacattcaagaga

SEQ ID NO: 5898534 - DNA, 19 bp, Homo sapiens
gaacattcaagagagctcg

SEQ ID NO: 5898535 - DNA, 20 bp, Homo sapiens
gaacattcaatcttgccgtc

SEQ ID NO: 5898536 - DNA, 17 bp, Homo sapiens
gaacattcacttttgtt

SEQ ID NO: 5898537 - DNA, 14 bp, Homo sapiens
gaacattcagctct

SEQ ID NO: 5898538 - DNA, 16 bp, Homo sapiens
gaacattcagctctgg

SEQ ID NO: 5898539 - DNA, 17 bp, Homo sapiens
gaacattccatttgctt

SEQ ID NO: 5898540 - DNA, 17 bp, Homo sapiens
gaacattccctggaatt

SEQ ID NO: 5898541 - DNA, 11 bp, Homo sapiens
gaacattccta

SEQ ID NO: 5898542 - DNA, 19 bp, Homo sapiens
gaacattcgaatctctgcc

SEQ ID NO: 5898543 - DNA, 23 bp, Homo sapiens
gaacattcgaggtgtcaccctgc

SEQ ID NO: 5898544 - DNA, 13 bp, Homo sapiens
gaacattctctca

SEQ ID NO: 5898545 - DNA, 15 bp, Homo sapiens
gaacattgcaataga

SEQ ID NO: 5898546 - DNA, 22 bp, Homo sapiens
gaacattggaatgttctcagat

SEQ ID NO: 5898547 - DNA, 17 bp, Homo sapiens
gaacattgggaaggaag

SEQ ID NO: 5898548 - DNA, 14 bp, Homo sapiens
gaacattggggatt

SEQ ID NO: 5898549 - DNA, 20 bp, Homo sapiens
gaacattggggattgaaaat

SEQ ID NO: 5898550 - DNA, 16 bp, Homo sapiens
gaacattgttctgaac

SEQ ID NO: 5898551 - DNA, 20 bp, Homo sapiens
gaacatttaaaattaaataa

SEQ ID NO: 5898552 - DNA, 17 bp, Homo sapiens
gaacatttaataatgta

SEQ ID NO: 5898553 - DNA, 13 bp, Homo sapiens
gaacatttatatc

SEQ ID NO: 5898554 - DNA, 18 bp, Homo sapiens
gaacatttattttatgag

SEQ ID NO: 5898555 - DNA, 10 bp, Homo sapiens
gaacatttct

SEQ ID NO: 5898556 - DNA, 22 bp, Homo sapiens
gaacatttctaactaaggacag

SEQ ID NO: 5898557 - DNA, 23 bp, Homo sapiens
gaacatttctaactaaggacagg

SEQ ID NO: 5898558 - DNA, 14 bp, Homo sapiens
gaacatttctagaa

SEQ ID NO: 5898559 - DNA, 15 bp, Homo sapiens
gaacatttctcatgt

SEQ ID NO: 5898560 - DNA, 15 bp, Homo sapiens
gaacattttgtggag

SEQ ID NO: 5898561 - DNA, 22 bp, Homo sapiens
gaaccaaacccaccctttctac

SEQ ID NO: 5898562 - DNA, 19 bp, Homo sapiens
gaaccaaactcctatttca

SEQ ID NO: 5898563 - DNA, 21 bp, Homo sapiens
gaaccaaagagactggagcat

SEQ ID NO: 5898564 - DNA, 15 bp, Homo sapiens
gaaccaaagcctctt

SEQ ID NO: 5898565 - DNA, 23 bp, Homo sapiens
gaaccaaagcgaattttaaaaga

SEQ ID NO: 5898566 - DNA, 16 bp, Homo sapiens
gaaccaaagtctaaac

SEQ ID NO: 5898567 - DNA, 15 bp, Homo sapiens
gaaccaaatacctca

SEQ ID NO: 5898568 - DNA, 16 bp, Homo sapiens
gaaccaaatacctcaa

SEQ ID NO: 5898569 - DNA, 19 bp, Homo sapiens
gaaccaaatacctcaattt

SEQ ID NO: 5898570 - DNA, 17 bp, Homo sapiens
gaaccaaatctggaagc

SEQ ID NO: 5898571 - DNA, 17 bp, Homo sapiens
gaaccaaattgcactga

SEQ ID NO: 5898572 - DNA, 20 bp, Homo sapiens
gaaccaaattgcactgaagt

SEQ ID NO: 5898573 - DNA, 21 bp, Homo sapiens
gaaccaaattgcactgaagtt

SEQ ID NO: 5898574 - DNA, 19 bp, Homo sapiens
gaaccaacaagtaaatatt

SEQ ID NO: 5898575 - DNA, 15 bp, Homo sapiens
gaaccaacactaaca

SEQ ID NO: 5898576 - DNA, 21 bp, Homo sapiens
gaaccaacgggtctgtgggac

SEQ ID NO: 5898577 - DNA, 17 bp, Homo sapiens
gaaccaagcaggagacg

SEQ ID NO: 5898578 - DNA, 20 bp, Homo sapiens
gaaccaagcaggagacgaca

SEQ ID NO: 5898579 - DNA, 14 bp, Homo sapiens
gaaccaagcttcag

SEQ ID NO: 5898580 - DNA, 16 bp, Homo sapiens
gaaccaagcttcagag

SEQ ID NO: 5898581 - DNA, 17 bp, Homo sapiens
gaaccaagcttcagagc

SEQ ID NO: 5898582 - DNA, 18 bp, Homo sapiens
gaaccaagcttcagagcc

SEQ ID NO: 5898583 - DNA, 14 bp, Homo sapiens
gaaccaagcttgtc

SEQ ID NO: 5898584 - DNA, 21 bp, Homo sapiens
gaaccaaggcagcctccagag

SEQ ID NO: 5898585 - DNA, 21 bp, Homo sapiens
gaaccaagggccctcactcag

SEQ ID NO: 5898586 - DNA, 13 bp, Homo sapiens
gaaccaatatttg

SEQ ID NO: 5898587 - DNA, 14 bp, Homo sapiens
gaaccacaaaaaaa

SEQ ID NO: 5898588 - DNA, 20 bp, Homo sapiens
gaaccacaagagatcagcag

SEQ ID NO: 5898589 - DNA, 21 bp, Homo sapiens
gaaccacaagagatcagcagt

SEQ ID NO: 5898590 - DNA, 13 bp, Homo sapiens
gaaccacagcaga

SEQ ID NO: 5898591 - DNA, 15 bp, Homo sapiens
gaaccacagggccag

SEQ ID NO: 5898592 - DNA, 19 bp, Homo sapiens
gaaccacagggccagaggg

SEQ ID NO: 5898593 - DNA, 20 bp, Homo sapiens
gaaccacagggccagaggga

SEQ ID NO: 5898594 - DNA, 20 bp, Homo sapiens
gaaccacatcttgctctgct

SEQ ID NO: 5898595 - DNA, 19 bp, Homo sapiens
gaaccacattgaagaatgt

SEQ ID NO: 5898596 - DNA, 21 bp, Homo sapiens
gaaccacatttcctctgttct

SEQ ID NO: 5898597 - DNA, 21 bp, Homo sapiens
gaaccaccaaaattatagctt

SEQ ID NO: 5898598 - DNA, 18 bp, Homo sapiens
gaaccaccacacccagcc

SEQ ID NO: 5898599 - DNA, 23 bp, Homo sapiens
gaaccaccacacccagcccactt

SEQ ID NO: 5898600 - DNA, 13 bp, Homo sapiens
gaaccacctaccc

SEQ ID NO: 5898601 - DNA, 15 bp, Homo sapiens
gaaccacctttgtct

SEQ ID NO: 5898602 - DNA, 16 bp, Homo sapiens
gaaccacgaggctgcc

SEQ ID NO: 5898603 - DNA, 17 bp, Homo sapiens
gaaccacgaggctgccc

SEQ ID NO: 5898604 - DNA, 18 bp, Homo sapiens
gaaccacgaggctgcccc

SEQ ID NO: 5898605 - DNA, 22 bp, Homo sapiens
gaaccacgggttgaggaagtca

SEQ ID NO: 5898606 - DNA, 21 bp, Homo sapiens
gaaccacggtgaaagtgctgc

SEQ ID NO: 5898607 - DNA, 19 bp, Homo sapiens
gaaccacgtgaaactgctg

SEQ ID NO: 5898608 - DNA, 19 bp, Homo sapiens
gaaccactacatctggctt

SEQ ID NO: 5898609 - DNA, 19 bp, Homo sapiens
gaaccactacatgcagccc

SEQ ID NO: 5898610 - DNA, 20 bp, Homo sapiens
gaaccacttcctgctacagg

SEQ ID NO: 5898611 - DNA, 13 bp, Homo sapiens
gaaccacttgtag

SEQ ID NO: 5898612 - DNA, 14 bp, Homo sapiens
gaaccacttgtaga

SEQ ID NO: 5898613 - DNA, 17 bp, Homo sapiens
gaaccagaagtgcagcc

SEQ ID NO: 5898614 - DNA, 18 bp, Homo sapiens
gaaccagaagtgcagccc

SEQ ID NO: 5898615 - DNA, 11 bp, Homo sapiens
gaaccagactc

SEQ ID NO: 5898616 - DNA, 17 bp, Homo sapiens
gaaccagactcttgcct

SEQ ID NO: 5898617 - DNA, 12 bp, Homo sapiens
gaaccagagcca

SEQ ID NO: 5898618 - DNA, 13 bp, Homo sapiens
gaaccagagccac

SEQ ID NO: 5898619 - DNA, 23 bp, Homo sapiens
gaaccagagccatggactctaca

SEQ ID NO: 5898620 - DNA, 15 bp, Homo sapiens
gaaccagagggcatg

SEQ ID NO: 5898621 - DNA, 19 bp, Homo sapiens
gaaccagcactaaggtgga

SEQ ID NO: 5898622 - DNA, 16 bp, Homo sapiens
gaaccagcactcccag

SEQ ID NO: 5898623 - DNA, 19 bp, Homo sapiens
gaaccagcactcccagggc

SEQ ID NO: 5898624 - DNA, 22 bp, Homo sapiens
gaaccagcagaagccagagggt

SEQ ID NO: 5898625 - DNA, 12 bp, Homo sapiens
gaaccagcccag

SEQ ID NO: 5898626 - DNA, 14 bp, Homo sapiens
gaaccagcccagcc

SEQ ID NO: 5898627 - DNA, 13 bp, Homo sapiens
gaaccagccctcc

SEQ ID NO: 5898628 - DNA, 17 bp, Homo sapiens
gaaccagccctccagag

SEQ ID NO: 5898629 - DNA, 18 bp, Homo sapiens
gaaccagccctccagagc

SEQ ID NO: 5898630 - DNA, 18 bp, Homo sapiens
gaaccagccggggcctta

SEQ ID NO: 5898631 - DNA, 12 bp, Homo sapiens
gaaccagcctca

SEQ ID NO: 5898632 - DNA, 17 bp, Homo sapiens
gaaccagctcatctcca

SEQ ID NO: 5898633 - DNA, 11 bp, Homo sapiens
gaaccaggagg

SEQ ID NO: 5898634 - DNA, 15 bp, Homo sapiens
gaaccaggaggcctg

SEQ ID NO: 5898635 - DNA, 12 bp, Homo sapiens
gaaccaggaggg

SEQ ID NO: 5898636 - DNA, 15 bp, Homo sapiens
gaaccaggcatggaa

SEQ ID NO: 5898637 - DNA, 23 bp, Homo sapiens
gaaccaggccagagcaaacagaa

SEQ ID NO: 5898638 - DNA, 22 bp, Homo sapiens
gaaccaggctgctgcatggcac

SEQ ID NO: 5898639 - DNA, 18 bp, Homo sapiens
gaaccagggagaccgagc

SEQ ID NO: 5898640 - DNA, 15 bp, Homo sapiens
gaaccagggcctccc

SEQ ID NO: 5898641 - DNA, 21 bp, Homo sapiens
gaaccagggcctccctgttca

SEQ ID NO: 5898642 - DNA, 23 bp, Homo sapiens
gaaccagtccaggtggtgaattt

SEQ ID NO: 5898643 - DNA, 19 bp, Homo sapiens
gaaccagtccccccaccct

SEQ ID NO: 5898644 - DNA, 15 bp, Homo sapiens
gaaccagtcctgctg

SEQ ID NO: 5898645 - DNA, 16 bp, Homo sapiens
gaaccagtcctgctgc

SEQ ID NO: 5898646 - DNA, 18 bp, Homo sapiens
gaaccagtcctgctgcct

SEQ ID NO: 5898647 - DNA, 23 bp, Homo sapiens
gaaccagtcctgctgcctggagt

SEQ ID NO: 5898648 - DNA, 21 bp, Homo sapiens
gaaccagtgtaactggctgct

SEQ ID NO: 5898649 - DNA, 15 bp, Homo sapiens
gaaccagtgtctgaa

SEQ ID NO: 5898650 - DNA, 18 bp, Homo sapiens
gaaccagtgtctgaacca

SEQ ID NO: 5898651 - DNA, 19 bp, Homo sapiens
gaaccagtttcaggtgttt

SEQ ID NO: 5898652 - DNA, 19 bp, Homo sapiens
gaaccataaaatgtccagt

SEQ ID NO: 5898653 - DNA, 22 bp, Homo sapiens
gaaccataggactgtggcaaac

SEQ ID NO: 5898654 - DNA, 20 bp, Homo sapiens
gaaccatcattataaacgtg

SEQ ID NO: 5898655 - DNA, 14 bp, Homo sapiens
gaaccatcctctgt

SEQ ID NO: 5898656 - DNA, 15 bp, Homo sapiens
gaaccatccttccca

SEQ ID NO: 5898657 - DNA, 16 bp, Homo sapiens
gaaccatgaagacagg

SEQ ID NO: 5898658 - DNA, 16 bp, Homo sapiens
gaaccatgcttacaaa

SEQ ID NO: 5898659 - DNA, 15 bp, Homo sapiens
gaaccatggaggagg

SEQ ID NO: 5898660 - DNA, 13 bp, Homo sapiens
gaaccatttgcaa

SEQ ID NO: 5898661 - DNA, 20 bp, Homo sapiens
gaacccaaagagacagctct

SEQ ID NO: 5898662 - DNA, 13 bp, Homo sapiens
gaacccaacagtc

SEQ ID NO: 5898663 - DNA, 14 bp, Homo sapiens
gaacccaagcctca

SEQ ID NO: 5898664 - DNA, 16 bp, Homo sapiens
gaacccaagtccaagc

SEQ ID NO: 5898665 - DNA, 17 bp, Homo sapiens
gaacccaagtccaagca

SEQ ID NO: 5898666 - DNA, 20 bp, Homo sapiens
gaacccaatctgcacactcc

SEQ ID NO: 5898667 - DNA, 23 bp, Homo sapiens
gaacccaatctgcacactccagg

SEQ ID NO: 5898668 - DNA, 13 bp, Homo sapiens
gaacccacactgc

SEQ ID NO: 5898669 - DNA, 21 bp, Homo sapiens
gaacccacataaaagccccag

SEQ ID NO: 5898670 - DNA, 17 bp, Homo sapiens
gaacccaccaaccagaa

SEQ ID NO: 5898671 - DNA, 22 bp, Homo sapiens
gaacccacccggctggccggga

SEQ ID NO: 5898672 - DNA, 14 bp, Homo sapiens
gaacccaccctctc

SEQ ID NO: 5898673 - DNA, 13 bp, Homo sapiens
gaacccacctgct

SEQ ID NO: 5898674 - DNA, 16 bp, Homo sapiens
gaacccagaactagga

SEQ ID NO: 5898675 - DNA, 18 bp, Homo sapiens
gaacccagcagttctgtt

SEQ ID NO: 5898676 - DNA, 18 bp, Homo sapiens
gaacccagcccacccccg

SEQ ID NO: 5898677 - DNA, 15 bp, Homo sapiens
gaacccagccctggg

SEQ ID NO: 5898678 - DNA, 16 bp, Homo sapiens
gaacccagctctcagg

SEQ ID NO: 5898679 - DNA, 18 bp, Homo sapiens
gaacccagctctcagggc

SEQ ID NO: 5898680 - DNA, 15 bp, Homo sapiens
gaacccagctgtgcc

SEQ ID NO: 5898681 - DNA, 12 bp, Homo sapiens
gaacccaggaca

SEQ ID NO: 5898682 - DNA, 17 bp, Homo sapiens
gaacccaggacgcttct

SEQ ID NO: 5898683 - DNA, 11 bp, Homo sapiens
gaacccaggag

SEQ ID NO: 5898684 - DNA, 15 bp, Homo sapiens
gaacccaggagagtg

SEQ ID NO: 5898685 - DNA, 14 bp, Homo sapiens
gaacccaggaggca

SEQ ID NO: 5898686 - DNA, 13 bp, Homo sapiens
gaacccaggcagc

SEQ ID NO: 5898687 - DNA, 21 bp, Homo sapiens
gaacccaggcagctggcagga

SEQ ID NO: 5898688 - DNA, 12 bp, Homo sapiens
gaacccagggct

SEQ ID NO: 5898689 - DNA, 13 bp, Homo sapiens
gaacccagggctc

SEQ ID NO: 5898690 - DNA, 18 bp, Homo sapiens
gaacccagggtggagagg

SEQ ID NO: 5898691 - DNA, 13 bp, Homo sapiens
gaacccataggga

SEQ ID NO: 5898692 - DNA, 18 bp, Homo sapiens
gaacccatagggagctga

SEQ ID NO: 5898693 - DNA, 22 bp, Homo sapiens
gaacccatctaaaccagaagga

SEQ ID NO: 5898694 - DNA, 23 bp, Homo sapiens
gaacccattccatttatctttct

SEQ ID NO: 5898695 - DNA, 21 bp, Homo sapiens
gaacccatttgccatgctgct

SEQ ID NO: 5898696 - DNA, 17 bp, Homo sapiens
gaaccccatgggcttgg

SEQ ID NO: 5898697 - DNA, 17 bp, Homo sapiens
gaacccccaaatttaat

SEQ ID NO: 5898698 - DNA, 12 bp, Homo sapiens
gaacccccactc

SEQ ID NO: 5898699 - DNA, 22 bp, Homo sapiens
gaacccccaggtggcctgcgtc

SEQ ID NO: 5898700 - DNA, 13 bp, Homo sapiens
gaaccccccactc

SEQ ID NO: 5898701 - DNA, 15 bp, Homo sapiens
gaaccccccaggccc

SEQ ID NO: 5898702 - DNA, 14 bp, Homo sapiens
gaacccccctcccc

SEQ ID NO: 5898703 - DNA, 16 bp, Homo sapiens
gaacccccctccccaa

SEQ ID NO: 5898704 - DNA, 19 bp, Homo sapiens
gaaccccgtcgaggggctc

SEQ ID NO: 5898705 - DNA, 20 bp, Homo sapiens
gaacccctagaaaggagaga

SEQ ID NO: 5898706 - DNA, 15 bp, Homo sapiens
gaactgaattaagtt

SEQ ID NO: 5898707 - DNA, 18 bp, Homo sapiens
gaactgaattaagttatt

SEQ ID NO: 5898708 - DNA, 16 bp, Homo sapiens
gaactgacaaaggagc

SEQ ID NO: 5898709 - DNA, 15 bp, Homo sapiens
gaactgaccctcagg

SEQ ID NO: 5898710 - DNA, 16 bp, Homo sapiens
gaactgaccctcaggc

SEQ ID NO: 5898711 - DNA, 22 bp, Homo sapiens
gaactgagaaggcaggcctccg

SEQ ID NO: 5898712 - DNA, 13 bp, Homo sapiens
gaactgagactgc

SEQ ID NO: 5898713 - DNA, 13 bp, Homo sapiens
gaactgagccaaa

SEQ ID NO: 5898714 - DNA, 16 bp, Homo sapiens
gaactgagccaaacac

SEQ ID NO: 5898715 - DNA, 21 bp, Homo sapiens
gaactgagccaaacacactgt

SEQ ID NO: 5898716 - DNA, 19 bp, Homo sapiens
gaactgagccccagcgggc

SEQ ID NO: 5898717 - DNA, 20 bp, Homo sapiens
gaactgagccccagcgggct

SEQ ID NO: 5898718 - DNA, 17 bp, Homo sapiens
gaactgagccgtgcagc

SEQ ID NO: 5898719 - DNA, 19 bp, Homo sapiens
gaactgagctcctctgggc

SEQ ID NO: 5898720 - DNA, 24 bp, Homo sapiens
gaactgaggagcggactcacttga

SEQ ID NO: 5898721 - DNA, 11 bp, Homo sapiens
gaactgaggcc

SEQ ID NO: 5898722 - DNA, 19 bp, Homo sapiens
gaactgagggctctgtttg

SEQ ID NO: 5898723 - DNA, 15 bp, Homo sapiens
gaactgagtatgtgt

SEQ ID NO: 5898724 - DNA, 18 bp, Homo sapiens
gaactgagtcacgctggg

SEQ ID NO: 5898725 - DNA, 13 bp, Homo sapiens
gaactgatagtta

SEQ ID NO: 5898726 - DNA, 21 bp, Homo sapiens
gaactgattcacatctcattt

SEQ ID NO: 5898727 - DNA, 23 bp, Homo sapiens
gaactgattgctcccaggatctc

SEQ ID NO: 5898728 - DNA, 12 bp, Homo sapiens
gaactgatttta

SEQ ID NO: 5898729 - DNA, 15 bp, Homo sapiens
gaactgcaaagcttt

SEQ ID NO: 5898730 - DNA, 23 bp, Homo sapiens
gaactgcaactccagcgtcctca

SEQ ID NO: 5898731 - DNA, 17 bp, Homo sapiens
gaactgcaactgaatga

SEQ ID NO: 5898732 - DNA, 13 bp, Homo sapiens
gaactgcaatgaa

SEQ ID NO: 5898733 - DNA, 17 bp, Homo sapiens
gaactgcaatttccatt

SEQ ID NO: 5898734 - DNA, 14 bp, Homo sapiens
gaactgcacaatga

SEQ ID NO: 5898735 - DNA, 21 bp, Homo sapiens
gaactgcacaatgaccagcag

SEQ ID NO: 5898736 - DNA, 18 bp, Homo sapiens
gaactgcacactcagtgg

SEQ ID NO: 5898737 - DNA, 17 bp, Homo sapiens
gaactgcacatgaagaa

SEQ ID NO: 5898738 - DNA, 11 bp, Homo sapiens
gaactgcacca

SEQ ID NO: 5898739 - DNA, 19 bp, Homo sapiens
gaactgcagacctgtcctc

SEQ ID NO: 5898740 - DNA, 14 bp, Homo sapiens
gaactgcagatagc

SEQ ID NO: 5898741 - DNA, 19 bp, Homo sapiens
gaactgcagatagcccagg

SEQ ID NO: 5898742 - DNA, 20 bp, Homo sapiens
gaactgcagatagcccagga

SEQ ID NO: 5898743 - DNA, 22 bp, Homo sapiens
gaactgcagatagcccaggagc

SEQ ID NO: 5898744 - DNA, 12 bp, Homo sapiens
gaactgcagcaa

SEQ ID NO: 5898745 - DNA, 20 bp, Homo sapiens
gaactgcagcaatctttgaa

SEQ ID NO: 5898746 - DNA, 21 bp, Homo sapiens
gaactgcagcaatctttgaaa

SEQ ID NO: 5898747 - DNA, 14 bp, Homo sapiens
gaactgcaggccct

SEQ ID NO: 5898748 - DNA, 17 bp, Homo sapiens
gaactgcaggccctggc

SEQ ID NO: 5898749 - DNA, 21 bp, Homo sapiens
gaactgcaggccctggcctcc

SEQ ID NO: 5898750 - DNA, 15 bp, Homo sapiens
gaactgcagggttca

SEQ ID NO: 5898751 - DNA, 14 bp, Homo sapiens
gaactgcagtgatg

SEQ ID NO: 5898752 - DNA, 15 bp, Homo sapiens
gaactgcatgctgct

SEQ ID NO: 5898753 - DNA, 15 bp, Homo sapiens
gaactgcatggacct

SEQ ID NO: 5898754 - DNA, 16 bp, Homo sapiens
gaactgcatggggagt

SEQ ID NO: 5898755 - DNA, 20 bp, Homo sapiens
gaactgcatgtataaatgaa

SEQ ID NO: 5898756 - DNA, 11 bp, Homo sapiens
gaactgccacc

SEQ ID NO: 5898757 - DNA, 18 bp, Homo sapiens
gaactgccccatctcctc

SEQ ID NO: 5898758 - DNA, 20 bp, Homo sapiens
gaactgcccttgctgcccgc

SEQ ID NO: 5898759 - DNA, 18 bp, Homo sapiens
gaactgccgccgccgtgg

SEQ ID NO: 5898760 - DNA, 12 bp, Homo sapiens
gaactgctgcca

SEQ ID NO: 5898761 - DNA, 23 bp, Homo sapiens
gaactgctgctgacccctgtgtg

SEQ ID NO: 5898762 - DNA, 17 bp, Homo sapiens
gaactgctgctggtcac

SEQ ID NO: 5898763 - DNA, 21 bp, Homo sapiens
gaactgctgctggtcaccccc

SEQ ID NO: 5898764 - DNA, 11 bp, Homo sapiens
gaactgctggg

SEQ ID NO: 5898765 - DNA, 17 bp, Homo sapiens
gaactgctgggcttggc

SEQ ID NO: 5898766 - DNA, 19 bp, Homo sapiens
gaactgctggggctggtga

SEQ ID NO: 5898767 - DNA, 23 bp, Homo sapiens
gaactgctggggctggtgaggcc

SEQ ID NO: 5898768 - DNA, 15 bp, Homo sapiens
gaactgcttcatgtg

SEQ ID NO: 5898769 - DNA, 14 bp, Homo sapiens
gaactgcttgcatt

SEQ ID NO: 5898770 - DNA, 18 bp, Homo sapiens
gaactgcttgcatttctt

SEQ ID NO: 5898771 - DNA, 20 bp, Homo sapiens
gaactgcttgcatttcttta

SEQ ID NO: 5898772 - DNA, 13 bp, Homo sapiens
gaactgcttttcc

SEQ ID NO: 5898773 - DNA, 18 bp, Homo sapiens
gaactggaccctgttgct

SEQ ID NO: 5898774 - DNA, 23 bp, Homo sapiens
gaactggaccctgttgctaagcc

SEQ ID NO: 5898775 - DNA, 15 bp, Homo sapiens
gaactggactcagga

SEQ ID NO: 5898776 - DNA, 21 bp, Homo sapiens
gaactggactcaggatgccca

SEQ ID NO: 5898777 - DNA, 23 bp, Homo sapiens
gaactggactcaggatgcccagg

SEQ ID NO: 5898778 - DNA, 16 bp, Homo sapiens
gaactggaggcaggga

SEQ ID NO: 5898779 - DNA, 15 bp, Homo sapiens
gaactggcaggagcc

SEQ ID NO: 5898780 - DNA, 15 bp, Homo sapiens
gaactggccccagct

SEQ ID NO: 5898781 - DNA, 19 bp, Homo sapiens
gaactggctcctttgcctc

SEQ ID NO: 5898782 - DNA, 12 bp, Homo sapiens
gaactggctgca

SEQ ID NO: 5898783 - DNA, 22 bp, Homo sapiens
gaactggctgggcccctgggga

SEQ ID NO: 5898784 - DNA, 18 bp, Homo sapiens
gaactgggaaaacagtga

SEQ ID NO: 5898785 - DNA, 17 bp, Homo sapiens
gaactgggaagatgctg

SEQ ID NO: 5898786 - DNA, 11 bp, Homo sapiens
gaactgggcac

SEQ ID NO: 5898787 - DNA, 14 bp, Homo sapiens
gaactgggccagca

SEQ ID NO: 5898788 - DNA, 16 bp, Homo sapiens
gaactgggccagcaga

SEQ ID NO: 5898789 - DNA, 11 bp, Homo sapiens
gaactgggctg

SEQ ID NO: 5898790 - DNA, 13 bp, Homo sapiens
gaactgggctggc

SEQ ID NO: 5898791 - DNA, 21 bp, Homo sapiens
gaactgggctggcgcttggat

SEQ ID NO: 5898792 - DNA, 16 bp, Homo sapiens
gaactggggctttgcc

SEQ ID NO: 5898793 - DNA, 20 bp, Homo sapiens
gaactggggttcaagcccag

SEQ ID NO: 5898794 - DNA, 19 bp, Homo sapiens
gaactgggtaaatgcaaag

SEQ ID NO: 5898795 - DNA, 18 bp, Homo sapiens
gaactgggtgactggagg

SEQ ID NO: 5898796 - DNA, 20 bp, Homo sapiens
gaactggtcaccatgaaact

SEQ ID NO: 5898797 - DNA, 16 bp, Homo sapiens
gaactggtccaggcca

SEQ ID NO: 5898798 - DNA, 17 bp, Homo sapiens
gaactggtccaggccag

SEQ ID NO: 5898799 - DNA, 18 bp, Homo sapiens
gaactggtgatataaaga

SEQ ID NO: 5898800 - DNA, 20 bp, Homo sapiens
gaactggttcaagagacact

SEQ ID NO: 5898801 - DNA, 23 bp, Homo sapiens
gaactggtttttctgttccctgc

SEQ ID NO: 5898802 - DNA, 14 bp, Homo sapiens
gaactgtacattgt

SEQ ID NO: 5898803 - DNA, 15 bp, Homo sapiens
gaactgtactgtttt

SEQ ID NO: 5898804 - DNA, 22 bp, Homo sapiens
gaactgtactgttttctgggcc

SEQ ID NO: 5898805 - DNA, 14 bp, Homo sapiens
gaactgtagggcca

SEQ ID NO: 5898806 - DNA, 18 bp, Homo sapiens
gaactgtcaccctgaggt

SEQ ID NO: 5898807 - DNA, 22 bp, Homo sapiens
gaactgtccagagagcaactct

SEQ ID NO: 5898808 - DNA, 18 bp, Homo sapiens
gaactgtcccacaaaata

SEQ ID NO: 5898809 - DNA, 20 bp, Homo sapiens
gaactgtcccacaaaatatt

SEQ ID NO: 5898810 - DNA, 17 bp, Homo sapiens
gaactgtcccagctacc

SEQ ID NO: 5898811 - DNA, 18 bp, Homo sapiens
gaactgtcccagctacca

SEQ ID NO: 5898812 - DNA, 12 bp, Homo sapiens
gaactgtcccat

SEQ ID NO: 5898813 - DNA, 17 bp, Homo sapiens
gaactgtctgtgaacag

SEQ ID NO: 5898814 - DNA, 23 bp, Homo sapiens
gaactgtcttagtcataccatcc

SEQ ID NO: 5898815 - DNA, 12 bp, Homo sapiens
gaactgtctttc

SEQ ID NO: 5898816 - DNA, 21 bp, Homo sapiens
gaactgtgatggggtgggcag

SEQ ID NO: 5898817 - DNA, 12 bp, Homo sapiens
gaactgtgcagt

SEQ ID NO: 5898818 - DNA, 14 bp, Homo sapiens
gaactgtgccacaa

SEQ ID NO: 5898819 - DNA, 15 bp, Homo sapiens
gaactgtgctcccac

SEQ ID NO: 5898820 - DNA, 18 bp, Homo sapiens
gaactgtgctcccacggg

SEQ ID NO: 5898821 - DNA, 21 bp, Homo sapiens
gaactgtggcacttaggggag

SEQ ID NO: 5898822 - DNA, 14 bp, Homo sapiens
gaactgtggccacc

SEQ ID NO: 5898823 - DNA, 18 bp, Homo sapiens
gaactgtgtgtaattgtt

SEQ ID NO: 5898824 - DNA, 21 bp, Homo sapiens
gaactgtgtttcaaatggact

SEQ ID NO: 5898825 - DNA, 20 bp, Homo sapiens
gaactgtgtttcaagttcaa

SEQ ID NO: 5898826 - DNA, 11 bp, Homo sapiens
gaactgttaca

SEQ ID NO: 5898827 - DNA, 14 bp, Homo sapiens
gaactgttagatgc

SEQ ID NO: 5898828 - DNA, 17 bp, Homo sapiens
gaactgttagatgctga

SEQ ID NO: 5898829 - DNA, 17 bp, Homo sapiens
gaactgttcacactgca

SEQ ID NO: 5898830 - DNA, 16 bp, Homo sapiens
gaactgttctcatgga

SEQ ID NO: 5898831 - DNA, 17 bp, Homo sapiens
gaactgttgcccttctg

SEQ ID NO: 5898832 - DNA, 18 bp, Homo sapiens
gaactgttgcctaattgg

SEQ ID NO: 5898833 - DNA, 22 bp, Homo sapiens
gaactgttgcctaattggaaag

SEQ ID NO: 5898834 - DNA, 14 bp, Homo sapiens
gaactgttgtataa

SEQ ID NO: 5898835 - DNA, 20 bp, Homo sapiens
gaactgttgtttgatgtgta

SEQ ID NO: 5898836 - DNA, 14 bp, Homo sapiens
gaacttaaaacata

SEQ ID NO: 5898837 - DNA, 16 bp, Homo sapiens
gaacttaaaacatatg

SEQ ID NO: 5898838 - DNA, 17 bp, Homo sapiens
gaacttaaataatgtga

SEQ ID NO: 5898839 - DNA, 20 bp, Homo sapiens
gaacttaacatgctgtgtaa

SEQ ID NO: 5898840 - DNA, 22 bp, Homo sapiens
gaacttaacatgctgtgtaagc

SEQ ID NO: 5898841 - DNA, 19 bp, Homo sapiens
gaacttaagtctcgaatgt

SEQ ID NO: 5898842 - DNA, 15 bp, Homo sapiens
gaacttactattcat

SEQ ID NO: 5898843 - DNA, 20 bp, Homo sapiens
gaacttactgtgtaaataaa

SEQ ID NO: 5898844 - DNA, 19 bp, Homo sapiens
gaacttagatgttaaatgt

SEQ ID NO: 5898845 - DNA, 20 bp, Homo sapiens
gaacttagatgttaaatgtt

SEQ ID NO: 5898846 - DNA, 16 bp, Homo sapiens
gaacttagattttaca

SEQ ID NO: 5898847 - DNA, 20 bp, Homo sapiens
gaacttagattttacatgaa

SEQ ID NO: 5898848 - DNA, 13 bp, Homo sapiens
gaacttataatga

SEQ ID NO: 5898849 - DNA, 15 bp, Homo sapiens
gaacttattctgtag

SEQ ID NO: 5898850 - DNA, 22 bp, Homo sapiens
gaacttcaagaagtaagagcta

SEQ ID NO: 5898851 - DNA, 20 bp, Homo sapiens
gaacttcaagatgagcctgg

SEQ ID NO: 5898852 - DNA, 22 bp, Homo sapiens
gaacttcaagatgagcctgggc

SEQ ID NO: 5898853 - DNA, 15 bp, Homo sapiens
gaacttcacaagaat

SEQ ID NO: 5898854 - DNA, 15 bp, Homo sapiens
gaacttcatctgcca

SEQ ID NO: 5898855 - DNA, 13 bp, Homo sapiens
gaacttcatggat

SEQ ID NO: 5898856 - DNA, 20 bp, Homo sapiens
gaacttccaggaaagtgtga

SEQ ID NO: 5898857 - DNA, 22 bp, Homo sapiens
gaacttcccacacgattagctt

SEQ ID NO: 5898858 - DNA, 17 bp, Homo sapiens
gaacttccccacggatg

SEQ ID NO: 5898859 - DNA, 21 bp, Homo sapiens
gaacttcgaccctttctctga

SEQ ID NO: 5898860 - DNA, 17 bp, Homo sapiens
gaacttctaaacacttc

SEQ ID NO: 5898861 - DNA, 19 bp, Homo sapiens
gaacttctaaacacttcat

SEQ ID NO: 5898862 - DNA, 17 bp, Homo sapiens
gaacttctagctcattt

SEQ ID NO: 5898863 - DNA, 13 bp, Homo sapiens
gaacttgaaaaaa

SEQ ID NO: 5898864 - DNA, 13 bp, Homo sapiens
gaacttgaaattt

SEQ ID NO: 5898865 - DNA, 22 bp, Homo sapiens
gaacttgaaatttgaattttgt

SEQ ID NO: 5898866 - DNA, 16 bp, Homo sapiens
gaacttgaagcctgct

SEQ ID NO: 5898867 - DNA, 19 bp, Homo sapiens
gaacttgaagcctgctcct

SEQ ID NO: 5898868 - DNA, 21 bp, Homo sapiens
gaacttgaagcctgctccttc

SEQ ID NO: 5898869 - DNA, 17 bp, Homo sapiens
gaacttgaatgtgtcag

SEQ ID NO: 5898870 - DNA, 12 bp, Homo sapiens
gaacttgacaat

SEQ ID NO: 5898871 - DNA, 16 bp, Homo sapiens
gaacttgagctctgta

SEQ ID NO: 5898872 - DNA, 16 bp, Homo sapiens
gaacttgaggacacat

SEQ ID NO: 5898873 - DNA, 21 bp, Homo sapiens
gaacttgaggacacatgtcca

SEQ ID NO: 5898874 - DNA, 18 bp, Homo sapiens
gaacttgatttgcatgga

SEQ ID NO: 5898875 - DNA, 16 bp, Homo sapiens
gaacttgcaggcaagc

SEQ ID NO: 5898876 - DNA, 15 bp, Homo sapiens
gaacttgcattgtga

SEQ ID NO: 5898877 - DNA, 12 bp, Homo sapiens
gaacttgcctct

SEQ ID NO: 5898878 - DNA, 22 bp, Homo sapiens
gaacttgcctgcctttccatcc

SEQ ID NO: 5898879 - DNA, 19 bp, Homo sapiens
gaacttgcgagtccaaggc

SEQ ID NO: 5898880 - DNA, 14 bp, Homo sapiens
gaacttgctgcctc

SEQ ID NO: 5898881 - DNA, 13 bp, Homo sapiens
gaacttgctgctg

SEQ ID NO: 5898882 - DNA, 14 bp, Homo sapiens
gaacttgctgctgt

SEQ ID NO: 5898883 - DNA, 18 bp, Homo sapiens
gaacttgctgctgtcttg

SEQ ID NO: 5898884 - DNA, 23 bp, Homo sapiens
gaagagcaggactccaggcccaa

SEQ ID NO: 5898885 - DNA, 18 bp, Homo sapiens
gaagagccaaagaatatt

SEQ ID NO: 5898886 - DNA, 12 bp, Homo sapiens
gaagagccacct

SEQ ID NO: 5898887 - DNA, 17 bp, Homo sapiens
gaagagccacctgcaag

SEQ ID NO: 5898888 - DNA, 17 bp, Homo sapiens
gaagagccacctggcag

SEQ ID NO: 5898889 - DNA, 12 bp, Homo sapiens
gaagagccagcc

SEQ ID NO: 5898890 - DNA, 19 bp, Homo sapiens
gaagagccccactctcaga

SEQ ID NO: 5898891 - DNA, 23 bp, Homo sapiens
gaagagccccactctcagaggcc

SEQ ID NO: 5898892 - DNA, 14 bp, Homo sapiens
gaagagccctgagc

SEQ ID NO: 5898893 - DNA, 21 bp, Homo sapiens
gaagagccctgagctcaggct

SEQ ID NO: 5898894 - DNA, 16 bp, Homo sapiens
gaagagccggagcctc

SEQ ID NO: 5898895 - DNA, 15 bp, Homo sapiens
gaagagcctgactgt

SEQ ID NO: 5898896 - DNA, 12 bp, Homo sapiens
gaagagctcccc

SEQ ID NO: 5898897 - DNA, 16 bp, Homo sapiens
gaagagctcccctcca

SEQ ID NO: 5898898 - DNA, 19 bp, Homo sapiens
gaagagctcccctccacag

SEQ ID NO: 5898899 - DNA, 20 bp, Homo sapiens
gaagagctcccctccacagc

SEQ ID NO: 5898900 - DNA, 14 bp, Homo sapiens
gaagagctcttggc

SEQ ID NO: 5898901 - DNA, 22 bp, Homo sapiens
gaagagctcttggcccggcagg

SEQ ID NO: 5898902 - DNA, 15 bp, Homo sapiens
gaagagctggggaga

SEQ ID NO: 5898903 - DNA, 13 bp, Homo sapiens
gaagagctgggta

SEQ ID NO: 5898904 - DNA, 23 bp, Homo sapiens
gaagagctgttcacagccagact

SEQ ID NO: 5898905 - DNA, 20 bp, Homo sapiens
gaagagctgttgatgggatg

SEQ ID NO: 5898906 - DNA, 17 bp, Homo sapiens
gaagaggaaaaggctgg

SEQ ID NO: 5898907 - DNA, 15 bp, Homo sapiens
gaagaggaaaatgaa

SEQ ID NO: 5898908 - DNA, 16 bp, Homo sapiens
gaagaggaagcaagaa

SEQ ID NO: 5898909 - DNA, 13 bp, Homo sapiens
gaagaggacttcg

SEQ ID NO: 5898910 - DNA, 14 bp, Homo sapiens
gaagaggagaaaaa

SEQ ID NO: 5898911 - DNA, 19 bp, Homo sapiens
gaagaggagattggccagt

SEQ ID NO: 5898912 - DNA, 23 bp, Homo sapiens
gaagaggagattggccagtgaga

SEQ ID NO: 5898913 - DNA, 13 bp, Homo sapiens
gaagaggagcctc

SEQ ID NO: 5898914 - DNA, 21 bp, Homo sapiens
gaagaggagcctcagaagaaa

SEQ ID NO: 5898915 - DNA, 20 bp, Homo sapiens
gaagaggagcctgtttttgt

SEQ ID NO: 5898916 - DNA, 20 bp, Homo sapiens
gaagaggaggagggattctg

SEQ ID NO: 5898917 - DNA, 15 bp, Homo sapiens
gaagaggagggacct

SEQ ID NO: 5898918 - DNA, 18 bp, Homo sapiens
gaagaggaggggaagagg

SEQ ID NO: 5898919 - DNA, 20 bp, Homo sapiens
gaagaggatgagcagaggga

SEQ ID NO: 5898920 - DNA, 16 bp, Homo sapiens
gaagaggcagattcaa

SEQ ID NO: 5898921 - DNA, 18 bp, Homo sapiens
gaagaggcatcctgcctg

SEQ ID NO: 5898922 - DNA, 20 bp, Homo sapiens
gaagaggcatcctgcctggg

SEQ ID NO: 5898923 - DNA, 23 bp, Homo sapiens
gaagaggcatcctgcctgggtgg

SEQ ID NO: 5898924 - DNA, 17 bp, Homo sapiens
gaagaggccgctgcagg

SEQ ID NO: 5898925 - DNA, 22 bp, Homo sapiens
gaagaggccgctgcagggtggc

SEQ ID NO: 5898926 - DNA, 15 bp, Homo sapiens
gaagaggcgggccag

SEQ ID NO: 5898927 - DNA, 18 bp, Homo sapiens
gaagaggcgggccagcca

SEQ ID NO: 5898928 - DNA, 13 bp, Homo sapiens
gaagagggagaag

SEQ ID NO: 5898929 - DNA, 20 bp, Homo sapiens
gaagagggagaagcatgaaa

SEQ ID NO: 5898930 - DNA, 14 bp, Homo sapiens
gaagagggagacag

SEQ ID NO: 5898931 - DNA, 18 bp, Homo sapiens
gaagagggaggggccctg

SEQ ID NO: 5898932 - DNA, 16 bp, Homo sapiens
gaagagggctgagctg

SEQ ID NO: 5898933 - DNA, 22 bp, Homo sapiens
gaagaggggaagtctcttcctg

SEQ ID NO: 5898934 - DNA, 21 bp, Homo sapiens
gaagaggggaggggcctaggg

SEQ ID NO: 5898935 - DNA, 11 bp, Homo sapiens
gaagaggggca

SEQ ID NO: 5898936 - DNA, 17 bp, Homo sapiens
gaagaggggcagccctt

SEQ ID NO: 5898937 - DNA, 14 bp, Homo sapiens
gaagaggggcagct

SEQ ID NO: 5898938 - DNA, 20 bp, Homo sapiens
gaagaggggcagctttttca

SEQ ID NO: 5898939 - DNA, 17 bp, Homo sapiens
gaagaggggccagatga

SEQ ID NO: 5898940 - DNA, 20 bp, Homo sapiens
gaagaggggcgctgccccca

SEQ ID NO: 5898941 - DNA, 22 bp, Homo sapiens
gaagaggggcgctgcccccaca

SEQ ID NO: 5898942 - DNA, 18 bp, Homo sapiens
gaagagggggctggccat

SEQ ID NO: 5898943 - DNA, 21 bp, Homo sapiens
gaagaggggtataggacaagg

SEQ ID NO: 5898944 - DNA, 20 bp, Homo sapiens
gaagaggggtgcagaggctg

SEQ ID NO: 5898945 - DNA, 19 bp, Homo sapiens
gaagagggtgaaaggcagg

SEQ ID NO: 5898946 - DNA, 20 bp, Homo sapiens
gaagagggtgaaaggcaggg

SEQ ID NO: 5898947 - DNA, 15 bp, Homo sapiens
gaagaggtggcccca

SEQ ID NO: 5898948 - DNA, 19 bp, Homo sapiens
gaagaggttctcagcaagt

SEQ ID NO: 5898949 - DNA, 20 bp, Homo sapiens
gaagaggttctgattttctt

SEQ ID NO: 5898950 - DNA, 22 bp, Homo sapiens
gaagaggttgggcttccatgcc

SEQ ID NO: 5898951 - DNA, 22 bp, Homo sapiens
gaagaggttttatttacatttt

SEQ ID NO: 5898952 - DNA, 17 bp, Homo sapiens
gaagagtaaacaggaaa

SEQ ID NO: 5898953 - DNA, 19 bp, Homo sapiens
gaagagtaacacttgaaaa

SEQ ID NO: 5898954 - DNA, 23 bp, Homo sapiens
gaagagtaagtcaacctgcctga

SEQ ID NO: 5898955 - DNA, 22 bp, Homo sapiens
gaagagtagaacccaggtctga

SEQ ID NO: 5898956 - DNA, 14 bp, Homo sapiens
gaagagtcctctga

SEQ ID NO: 5898957 - DNA, 22 bp, Homo sapiens
gaagagtccttttagcacatca

SEQ ID NO: 5898958 - DNA, 17 bp, Homo sapiens
gaagagtctattgtctc

SEQ ID NO: 5898959 - DNA, 16 bp, Homo sapiens
gaagagtgaaatacca

SEQ ID NO: 5898960 - DNA, 15 bp, Homo sapiens
gaagagtgaagagca

SEQ ID NO: 5898961 - DNA, 20 bp, Homo sapiens
gaagagtgccctgctttgca

SEQ ID NO: 5898962 - DNA, 22 bp, Homo sapiens
gaagagtgccctgctttgcaaa

SEQ ID NO: 5898963 - DNA, 15 bp, Homo sapiens
gaagagtggaaatgg

SEQ ID NO: 5898964 - DNA, 20 bp, Homo sapiens
gaagagttacaataaagttt

SEQ ID NO: 5898965 - DNA, 23 bp, Homo sapiens
gaagagttctatccccaagctgg

SEQ ID NO: 5898966 - DNA, 14 bp, Homo sapiens
gaagagttgtgcac

SEQ ID NO: 5898967 - DNA, 19 bp, Homo sapiens
gaagagttgtttataatgt

SEQ ID NO: 5898968 - DNA, 20 bp, Homo sapiens
gaagagtttaaaagcatgaa

SEQ ID NO: 5898969 - DNA, 18 bp, Homo sapiens
gaagagtttaaagagaaa

SEQ ID NO: 5898970 - DNA, 21 bp, Homo sapiens
gaagagtttaaagagaaaagg

SEQ ID NO: 5898971 - DNA, 23 bp, Homo sapiens
gaagagtttaaagagaaaaggga

SEQ ID NO: 5898972 - DNA, 19 bp, Homo sapiens
gaagagtttaactttgggc

SEQ ID NO: 5898973 - DNA, 22 bp, Homo sapiens
gaagagtttaactttgggccca

SEQ ID NO: 5898974 - DNA, 15 bp, Homo sapiens
gaagagtttcttaac

SEQ ID NO: 5898975 - DNA, 14 bp, Homo sapiens
gaagagtttgcaaa

SEQ ID NO: 5898976 - DNA, 15 bp, Homo sapiens
gaagagtttgtaaat

SEQ ID NO: 5898977 - DNA, 15 bp, Homo sapiens
gaagagttttagaga

SEQ ID NO: 5898978 - DNA, 20 bp, Homo sapiens
gaagagtttttgtgatgggg

SEQ ID NO: 5898979 - DNA, 21 bp, Homo sapiens
gaagataaatgctttaaatag

SEQ ID NO: 5898980 - DNA, 20 bp, Homo sapiens
gaagataatgtaaaggtttt

SEQ ID NO: 5898981 - DNA, 23 bp, Homo sapiens
gaagatacacattacagccaggt

SEQ ID NO: 5898982 - DNA, 12 bp, Homo sapiens
gaagatactttg

SEQ ID NO: 5898983 - DNA, 13 bp, Homo sapiens
gaagatagaagaa

SEQ ID NO: 5898984 - DNA, 21 bp, Homo sapiens
gaagataggacgtatttataa

SEQ ID NO: 5898985 - DNA, 13 bp, Homo sapiens
gaagataggctct

SEQ ID NO: 5898986 - DNA, 20 bp, Homo sapiens
gaagataggctctgcacaga

SEQ ID NO: 5898987 - DNA, 16 bp, Homo sapiens
gaagataggtttagca

SEQ ID NO: 5898988 - DNA, 21 bp, Homo sapiens
gaagatagtcttggaagctgt

SEQ ID NO: 5898989 - DNA, 16 bp, Homo sapiens
gaagatagttgtaaag

SEQ ID NO: 5898990 - DNA, 21 bp, Homo sapiens
gaagatataactattgcccag

SEQ ID NO: 5898991 - DNA, 20 bp, Homo sapiens
gaagatattgggaaggaaat

SEQ ID NO: 5898992 - DNA, 14 bp, Homo sapiens
gaagatatttttcc

SEQ ID NO: 5898993 - DNA, 16 bp, Homo sapiens
gaagatcacagcaggg

SEQ ID NO: 5898994 - DNA, 20 bp, Homo sapiens
gaagatcagagctgcagcca

SEQ ID NO: 5898995 - DNA, 16 bp, Homo sapiens
gaagatcccctcagga

SEQ ID NO: 5898996 - DNA, 22 bp, Homo sapiens
gaagatccgagcgacggctcct

SEQ ID NO: 5898997 - DNA, 22 bp, Homo sapiens
gaagatccgagtgtgatttgaa

SEQ ID NO: 5898998 - DNA, 17 bp, Homo sapiens
gaagatcctaaaacaaa

SEQ ID NO: 5898999 - DNA, 17 bp, Homo sapiens
gaagatcctccttccag

SEQ ID NO: 5899000 - DNA, 20 bp, Homo sapiens
gaagatcctccttccaggcc

SEQ ID NO: 5899001 - DNA, 23 bp, Homo sapiens
gaagatcctccttccaggcccca

SEQ ID NO: 5899002 - DNA, 16 bp, Homo sapiens
gaagatcctgaagcag

SEQ ID NO: 5899003 - DNA, 14 bp, Homo sapiens
gaagatcctgcggg

SEQ ID NO: 5899004 - DNA, 14 bp, Homo sapiens
gaagatcctgtgag

SEQ ID NO: 5899005 - DNA, 15 bp, Homo sapiens
gaagatcctgtgagg

SEQ ID NO: 5899006 - DNA, 17 bp, Homo sapiens
gaagatcggaacagctc

SEQ ID NO: 5899007 - DNA, 20 bp, Homo sapiens
gaagatcggctttcatgtaa

SEQ ID NO: 5899008 - DNA, 14 bp, Homo sapiens
gaagatctaaactt

SEQ ID NO: 5899009 - DNA, 15 bp, Homo sapiens
gaagatctgcaaaca

SEQ ID NO: 5899010 - DNA, 16 bp, Homo sapiens
gaagatctgcaaacat

SEQ ID NO: 5899011 - DNA, 16 bp, Homo sapiens
gaagatcttatgcctt

SEQ ID NO: 5899012 - DNA, 16 bp, Homo sapiens
gaagatcttgagagct

SEQ ID NO: 5899013 - DNA, 17 bp, Homo sapiens
gaagatctttatatttc

SEQ ID NO: 5899014 - DNA, 15 bp, Homo sapiens
gaagatctttgtttt

SEQ ID NO: 5899015 - DNA, 16 bp, Homo sapiens
gaagatctttgttttt

SEQ ID NO: 5899016 - DNA, 19 bp, Homo sapiens
gaagatgaaaccgtccctg

SEQ ID NO: 5899017 - DNA, 17 bp, Homo sapiens
gaagatgaaagaggagg

SEQ ID NO: 5899018 - DNA, 17 bp, Homo sapiens
gaagatgaagagaagct

SEQ ID NO: 5899019 - DNA, 13 bp, Homo sapiens
gaagatgactgag

SEQ ID NO: 5899020 - DNA, 16 bp, Homo sapiens
gaagatgaggttctga

SEQ ID NO: 5899021 - DNA, 20 bp, Homo sapiens
gaagatgaggttctgagacc

SEQ ID NO: 5899022 - DNA, 14 bp, Homo sapiens
gaagatgcagctca

SEQ ID NO: 5899023 - DNA, 23 bp, Homo sapiens
gaagatgcattttaaatgtctat

SEQ ID NO: 5899024 - DNA, 14 bp, Homo sapiens
gaagatgccaaggg

SEQ ID NO: 5899025 - DNA, 17 bp, Homo sapiens
gaagatgccagcttctc

SEQ ID NO: 5899026 - DNA, 16 bp, Homo sapiens
gaagatgcctgttaat

SEQ ID NO: 5899027 - DNA, 24 bp, Homo sapiens
gaagatgcgagcgctatcttcaca

SEQ ID NO: 5899028 - DNA, 12 bp, Homo sapiens
gaagatgctgcc

SEQ ID NO: 5899029 - DNA, 19 bp, Homo sapiens
gaagatgctgcctgtattt

SEQ ID NO: 5899030 - DNA, 17 bp, Homo sapiens
gaagatgctggccccaa

SEQ ID NO: 5899031 - DNA, 16 bp, Homo sapiens
gaagatgctgtaaata

SEQ ID NO: 5899032 - DNA, 15 bp, Homo sapiens
gaagatggagggggc

SEQ ID NO: 5899033 - DNA, 19 bp, Homo sapiens
gaagatggagggggctggg

SEQ ID NO: 5899034 - DNA, 20 bp, Homo sapiens
gaagatggagggggctgggg

SEQ ID NO: 5899035 - DNA, 22 bp, Homo sapiens
gaagatggcactgtccagggcc

SEQ ID NO: 5899036 - DNA, 16 bp, Homo sapiens
gaagatggcatcctgt

SEQ ID NO: 5899037 - DNA, 13 bp, Homo sapiens
gaagatggctgtt

SEQ ID NO: 5899038 - DNA, 16 bp, Homo sapiens
gaagatgggaggtgga

SEQ ID NO: 5899039 - DNA, 17 bp, Homo sapiens
gaagatgggggctggag

SEQ ID NO: 5899040 - DNA, 19 bp, Homo sapiens
gaagatggtccgtgcccag

SEQ ID NO: 5899041 - DNA, 19 bp, Homo sapiens
gaagatggtttcaattcag

SEQ ID NO: 5899042 - DNA, 17 bp, Homo sapiens
gaagatgtagaggagaa

SEQ ID NO: 5899043 - DNA, 21 bp, Homo sapiens
gaagatgtatgctttgaatgc

SEQ ID NO: 5899044 - DNA, 19 bp, Homo sapiens
gaagatgtcatcccattgt

SEQ ID NO: 5899045 - DNA, 22 bp, Homo sapiens
gaagatgtctcctcaagcctgt

SEQ ID NO: 5899046 - DNA, 16 bp, Homo sapiens
gaagatgtgaaattca

SEQ ID NO: 5899047 - DNA, 14 bp, Homo sapiens
gaagatgttctgta

SEQ ID NO: 5899048 - DNA, 23 bp, Homo sapiens
gaagatgttgaagaatacagtta

SEQ ID NO: 5899049 - DNA, 18 bp, Homo sapiens
gaagatgttgagaaacct

SEQ ID NO: 5899050 - DNA, 22 bp, Homo sapiens
gaagatgtttaacttaatcaat

SEQ ID NO: 5899051 - DNA, 19 bp, Homo sapiens
gaagatgtttacattttta

SEQ ID NO: 5899052 - DNA, 21 bp, Homo sapiens
gaagattaaaaccacagaaca

SEQ ID NO: 5899053 - DNA, 12 bp, Homo sapiens
gaagattaacac

SEQ ID NO: 5899054 - DNA, 14 bp, Homo sapiens
gaagattaagacag

SEQ ID NO: 5899055 - DNA, 15 bp, Homo sapiens
gaagattaagacaga

SEQ ID NO: 5899056 - DNA, 20 bp, Homo sapiens
gaagattaccctcaaatgct

SEQ ID NO: 5899057 - DNA, 19 bp, Homo sapiens
gaagattaggcacacagat

SEQ ID NO: 5899058 - DNA, 18 bp, Homo sapiens
gaagattattttttatga

SEQ ID NO: 5899059 - DNA, 22 bp, Homo sapiens
gaagattctaaaacattcttta

SEQ ID NO: 5899060 - DNA, 18 bp, Homo sapiens
gaagccttttgcaaatag

SEQ ID NO: 5899061 - DNA, 22 bp, Homo sapiens
gaagcgaacatcttcatataaa

SEQ ID NO: 5899062 - DNA, 16 bp, Homo sapiens
gaagcgactctcctgt

SEQ ID NO: 5899063 - DNA, 18 bp, Homo sapiens
gaagcgagcagaggctcc

SEQ ID NO: 5899064 - DNA, 23 bp, Homo sapiens
gaagcgcagcagcgggagctagg

SEQ ID NO: 5899065 - DNA, 17 bp, Homo sapiens
gaagcgccgactccctg

SEQ ID NO: 5899066 - DNA, 22 bp, Homo sapiens
gaagcgccgactccctgagtct

SEQ ID NO: 5899067 - DNA, 21 bp, Homo sapiens
gaagcgcctcagttacacagg

SEQ ID NO: 5899068 - DNA, 18 bp, Homo sapiens
gaagcgcggctaacttat

SEQ ID NO: 5899069 - DNA, 14 bp, Homo sapiens
gaagcgctgccctg

SEQ ID NO: 5899070 - DNA, 23 bp, Homo sapiens
gaagcgctgccctgtgagagcca

SEQ ID NO: 5899071 - DNA, 14 bp, Homo sapiens
gaagcggatttcca

SEQ ID NO: 5899072 - DNA, 16 bp, Homo sapiens
gaagcggcatagcacc

SEQ ID NO: 5899073 - DNA, 20 bp, Homo sapiens
gaagcggccctaagggagtg

SEQ ID NO: 5899074 - DNA, 20 bp, Homo sapiens
gaagcgtatatacttaagaa

SEQ ID NO: 5899075 - DNA, 15 bp, Homo sapiens
gaagcgtgagacgcc

SEQ ID NO: 5899076 - DNA, 20 bp, Homo sapiens
gaagcgttgtcctcagcccc

SEQ ID NO: 5899077 - DNA, 14 bp, Homo sapiens
gaagctaaagtcat

SEQ ID NO: 5899078 - DNA, 21 bp, Homo sapiens
gaagctaaagtcatccatcct

SEQ ID NO: 5899079 - DNA, 17 bp, Homo sapiens
gaagctaacagggaagg

SEQ ID NO: 5899080 - DNA, 21 bp, Homo sapiens
gaagctaacagggaaggcagg

SEQ ID NO: 5899081 - DNA, 22 bp, Homo sapiens
gaagctaacagggaaggcaggc

SEQ ID NO: 5899082 - DNA, 15 bp, Homo sapiens
gaagctaatgtgaat

SEQ ID NO: 5899083 - DNA, 13 bp, Homo sapiens
gaagctaattatt

SEQ ID NO: 5899084 - DNA, 17 bp, Homo sapiens
gaagctaattattttaa

SEQ ID NO: 5899085 - DNA, 18 bp, Homo sapiens
gaagctaattattttaat

SEQ ID NO: 5899086 - DNA, 13 bp, Homo sapiens
gaagctaattgta

SEQ ID NO: 5899087 - DNA, 17 bp, Homo sapiens
gaagctaatttgcatta

SEQ ID NO: 5899088 - DNA, 19 bp, Homo sapiens
gaagctacaggttacaaca

SEQ ID NO: 5899089 - DNA, 23 bp, Homo sapiens
gaagctacaggttacaacagatt

SEQ ID NO: 5899090 - DNA, 17 bp, Homo sapiens
gaagctaccagagctct

SEQ ID NO: 5899091 - DNA, 14 bp, Homo sapiens
gaagctagaaacaa

SEQ ID NO: 5899092 - DNA, 22 bp, Homo sapiens
gaagctagacacatgaaggtaa

SEQ ID NO: 5899093 - DNA, 16 bp, Homo sapiens
gaagctagtcttttgc

SEQ ID NO: 5899094 - DNA, 21 bp, Homo sapiens
gaagctattgagaaagacctg

SEQ ID NO: 5899095 - DNA, 22 bp, Homo sapiens
gaagctcacactgatgggctgg

SEQ ID NO: 5899096 - DNA, 12 bp, Homo sapiens
gaagctcagaaa

SEQ ID NO: 5899097 - DNA, 13 bp, Homo sapiens
gaagctcagaaag

SEQ ID NO: 5899098 - DNA, 17 bp, Homo sapiens
gaagctcagcccacccc

SEQ ID NO: 5899099 - DNA, 21 bp, Homo sapiens
gaagctcagcccacccccctc

SEQ ID NO: 5899100 - DNA, 13 bp, Homo sapiens
gaagctcagcctt

SEQ ID NO: 5899101 - DNA, 23 bp, Homo sapiens
gaagctcagccttctcctcccaa

SEQ ID NO: 5899102 - DNA, 18 bp, Homo sapiens
gaagctcagggcctggct

SEQ ID NO: 5899103 - DNA, 20 bp, Homo sapiens
gaagctcaggttccctgcca

SEQ ID NO: 5899104 - DNA, 23 bp, Homo sapiens
gaagctcaggttccctgccacac

SEQ ID NO: 5899105 - DNA, 15 bp, Homo sapiens
gaagctcattcccaa

SEQ ID NO: 5899106 - DNA, 18 bp, Homo sapiens
gaagctcattcccaacgt

SEQ ID NO: 5899107 - DNA, 18 bp, Homo sapiens
gaagctccactgtcaccc

SEQ ID NO: 5899108 - DNA, 11 bp, Homo sapiens
gaagctccagt

SEQ ID NO: 5899109 - DNA, 20 bp, Homo sapiens
gaagctccagtcctgctctc

SEQ ID NO: 5899110 - DNA, 16 bp, Homo sapiens
gaagctcccagatgct

SEQ ID NO: 5899111 - DNA, 20 bp, Homo sapiens
gaagctcctctccccagccc

SEQ ID NO: 5899112 - DNA, 12 bp, Homo sapiens
gaagctccttcc

SEQ ID NO: 5899113 - DNA, 13 bp, Homo sapiens
gaagctccttcct

SEQ ID NO: 5899114 - DNA, 14 bp, Homo sapiens
gaagctccttcctg

SEQ ID NO: 5899115 - DNA, 16 bp, Homo sapiens
gaagctcgccccacct

SEQ ID NO: 5899116 - DNA, 19 bp, Homo sapiens
gaagctcgccccacctcca

SEQ ID NO: 5899117 - DNA, 22 bp, Homo sapiens
gaagctcgccccacctccacct

SEQ ID NO: 5899118 - DNA, 16 bp, Homo sapiens
gaagctctccaggccc

SEQ ID NO: 5899119 - DNA, 19 bp, Homo sapiens
gaagctctccgagctctgg

SEQ ID NO: 5899120 - DNA, 19 bp, Homo sapiens
gaagctctcgggctaggaa

SEQ ID NO: 5899121 - DNA, 17 bp, Homo sapiens
gaagctctcttaaaata

SEQ ID NO: 5899122 - DNA, 13 bp, Homo sapiens
gaagctctgaagt

SEQ ID NO: 5899123 - DNA, 20 bp, Homo sapiens
gaagctctgaagtcacatca

SEQ ID NO: 5899124 - DNA, 19 bp, Homo sapiens
gaagctctggctgaaccct

SEQ ID NO: 5899125 - DNA, 18 bp, Homo sapiens
gaagctcttgaagacact

SEQ ID NO: 5899126 - DNA, 15 bp, Homo sapiens
gaagctcttggacaa

SEQ ID NO: 5899127 - DNA, 20 bp, Homo sapiens
gaagctcttggagctgtgag

SEQ ID NO: 5899128 - DNA, 20 bp, Homo sapiens
gaagctcttttctcctgcag

SEQ ID NO: 5899129 - DNA, 16 bp, Homo sapiens
gaagctgaagagcacg

SEQ ID NO: 5899130 - DNA, 22 bp, Homo sapiens
gaagctgaagtgcatccaaagg

SEQ ID NO: 5899131 - DNA, 13 bp, Homo sapiens
gaagctgaattat

SEQ ID NO: 5899132 - DNA, 17 bp, Homo sapiens
gaagctgacaatttatg

SEQ ID NO: 5899133 - DNA, 12 bp, Homo sapiens
gaagctgagaag

SEQ ID NO: 5899134 - DNA, 22 bp, Homo sapiens
gaagctgagaagaagctgagga

SEQ ID NO: 5899135 - DNA, 22 bp, Homo sapiens
gaagctgagatgaaccctggca

SEQ ID NO: 5899136 - DNA, 16 bp, Homo sapiens
gaagctgagcttttga

SEQ ID NO: 5899137 - DNA, 12 bp, Homo sapiens
gaagctgaggcc

SEQ ID NO: 5899138 - DNA, 13 bp, Homo sapiens
gaagctgaggcct

SEQ ID NO: 5899139 - DNA, 16 bp, Homo sapiens
gaagctgaggctgctg

SEQ ID NO: 5899140 - DNA, 20 bp, Homo sapiens
gaagctgaggctgctgccag

SEQ ID NO: 5899141 - DNA, 15 bp, Homo sapiens
gaagctgatctgatt

SEQ ID NO: 5899142 - DNA, 17 bp, Homo sapiens
gaagctgatgctttgct

SEQ ID NO: 5899143 - DNA, 13 bp, Homo sapiens
gaagctgcaataa

SEQ ID NO: 5899144 - DNA, 15 bp, Homo sapiens
gaagctgcagatctt

SEQ ID NO: 5899145 - DNA, 15 bp, Homo sapiens
gaagctgcagcttgg

SEQ ID NO: 5899146 - DNA, 17 bp, Homo sapiens
gaagctgcaggggcagg

SEQ ID NO: 5899147 - DNA, 21 bp, Homo sapiens
gaagctgccacccctcttctg

SEQ ID NO: 5899148 - DNA, 13 bp, Homo sapiens
gaagctgccagcc

SEQ ID NO: 5899149 - DNA, 16 bp, Homo sapiens
gaagctgccagcccag

SEQ ID NO: 5899150 - DNA, 18 bp, Homo sapiens
gaagctgccagcccagaa

SEQ ID NO: 5899151 - DNA, 21 bp, Homo sapiens
gaagctgccaggtgagaaact

SEQ ID NO: 5899152 - DNA, 23 bp, Homo sapiens
gaagctgccgtagcttcagccag

SEQ ID NO: 5899153 - DNA, 14 bp, Homo sapiens
gaagctgcctgctt

SEQ ID NO: 5899154 - DNA, 18 bp, Homo sapiens
gaagctgcgggggcaggc

SEQ ID NO: 5899155 - DNA, 21 bp, Homo sapiens
gaagctgcgggggcaggccgg

SEQ ID NO: 5899156 - DNA, 14 bp, Homo sapiens
gaagctgctcaact

SEQ ID NO: 5899157 - DNA, 20 bp, Homo sapiens
gaagctgctcaacttgcaaa

SEQ ID NO: 5899158 - DNA, 13 bp, Homo sapiens
gaagctgctccag

SEQ ID NO: 5899159 - DNA, 18 bp, Homo sapiens
gaagctgctccaggcctg

SEQ ID NO: 5899160 - DNA, 20 bp, Homo sapiens
gaagctgctccaggcctgca

SEQ ID NO: 5899161 - DNA, 11 bp, Homo sapiens
gaagctgctga

SEQ ID NO: 5899162 - DNA, 13 bp, Homo sapiens
gaagctgctgacc

SEQ ID NO: 5899163 - DNA, 16 bp, Homo sapiens
gaagctgctgaggccc

SEQ ID NO: 5899164 - DNA, 14 bp, Homo sapiens
gaagctgctgcagc

SEQ ID NO: 5899165 - DNA, 15 bp, Homo sapiens
gaagctgctgcagct

SEQ ID NO: 5899166 - DNA, 12 bp, Homo sapiens
gaagctgctgtg

SEQ ID NO: 5899167 - DNA, 16 bp, Homo sapiens
gaagctgctgtgactg

SEQ ID NO: 5899168 - DNA, 13 bp, Homo sapiens
gaagctgctgtgt

SEQ ID NO: 5899169 - DNA, 15 bp, Homo sapiens
gaagctgctgtgtcc

SEQ ID NO: 5899170 - DNA, 22 bp, Homo sapiens
gaagctggaggctccaggactc

SEQ ID NO: 5899171 - DNA, 14 bp, Homo sapiens
gaagctggcctgag

SEQ ID NO: 5899172 - DNA, 19 bp, Homo sapiens
gaagctggcctgagagggg

SEQ ID NO: 5899173 - DNA, 20 bp, Homo sapiens
gaagctggctgggctggctg

SEQ ID NO: 5899174 - DNA, 12 bp, Homo sapiens
gaagctgggagg

SEQ ID NO: 5899175 - DNA, 18 bp, Homo sapiens
gaagctgggagggagggg

SEQ ID NO: 5899176 - DNA, 19 bp, Homo sapiens
gaagctgggcccaaaggcc

SEQ ID NO: 5899177 - DNA, 23 bp, Homo sapiens
gaagctgggcccaaaggcccagg

SEQ ID NO: 5899178 - DNA, 17 bp, Homo sapiens
gaagctggggacagctt

SEQ ID NO: 5899179 - DNA, 17 bp, Homo sapiens
gaagctgggggaagggt

SEQ ID NO: 5899180 - DNA, 12 bp, Homo sapiens
gaagctgggtga

SEQ ID NO: 5899181 - DNA, 16 bp, Homo sapiens
gaagctgggtgagcca

SEQ ID NO: 5899182 - DNA, 18 bp, Homo sapiens
gaagctgggtgagccaag

SEQ ID NO: 5899183 - DNA, 20 bp, Homo sapiens
gaagctgggtgagccaagga

SEQ ID NO: 5899184 - DNA, 16 bp, Homo sapiens
gaagctgtactcagag

SEQ ID NO: 5899185 - DNA, 19 bp, Homo sapiens
gaagctgtactcagagcag

SEQ ID NO: 5899186 - DNA, 20 bp, Homo sapiens
gaagctgtactcagagcaga

SEQ ID NO: 5899187 - DNA, 23 bp, Homo sapiens
gaagctgtactcagagcagagca

SEQ ID NO: 5899188 - DNA, 12 bp, Homo sapiens
gaagctgtcaga

SEQ ID NO: 5899189 - DNA, 16 bp, Homo sapiens
gaagctgtcctggagg

SEQ ID NO: 5899190 - DNA, 19 bp, Homo sapiens
gaagctgtgcgtgtgtgtg

SEQ ID NO: 5899191 - DNA, 20 bp, Homo sapiens
gaagctgtgtccttgcacct

SEQ ID NO: 5899192 - DNA, 19 bp, Homo sapiens
gaagctgtgttgaaacaga

SEQ ID NO: 5899193 - DNA, 22 bp, Homo sapiens
gaagctgtgttgaaacagaaaa

SEQ ID NO: 5899194 - DNA, 23 bp, Homo sapiens
gaagctgtgttgaaacagaaaaa

SEQ ID NO: 5899195 - DNA, 22 bp, Homo sapiens
gaagctgttctctgcttttcca

SEQ ID NO: 5899196 - DNA, 20 bp, Homo sapiens
gaagctgttgggagaaagca

SEQ ID NO: 5899197 - DNA, 18 bp, Homo sapiens
gaagctgttggggggctg

SEQ ID NO: 5899198 - DNA, 13 bp, Homo sapiens
gaagctgttgtac

SEQ ID NO: 5899199 - DNA, 22 bp, Homo sapiens
gaagctgttgtacatttatgat

SEQ ID NO: 5899200 - DNA, 17 bp, Homo sapiens
gaagcttaacactattt

SEQ ID NO: 5899201 - DNA, 15 bp, Homo sapiens
gaagcttactctctg

SEQ ID NO: 5899202 - DNA, 16 bp, Homo sapiens
gaagcttatgtttctt

SEQ ID NO: 5899203 - DNA, 18 bp, Homo sapiens
gaagcttatgtttcttat

SEQ ID NO: 5899204 - DNA, 17 bp, Homo sapiens
gaagcttattaatgcta

SEQ ID NO: 5899205 - DNA, 13 bp, Homo sapiens
gaagcttcagcag

SEQ ID NO: 5899206 - DNA, 18 bp, Homo sapiens
gaagcttcagcaggaggc

SEQ ID NO: 5899207 - DNA, 22 bp, Homo sapiens
gaagcttccacaaaattagaaa

SEQ ID NO: 5899208 - DNA, 17 bp, Homo sapiens
gaagcttccatgatgca

SEQ ID NO: 5899209 - DNA, 20 bp, Homo sapiens
gaagcttccatgatgcacag

SEQ ID NO: 5899210 - DNA, 13 bp, Homo sapiens
gaagcttctaata

SEQ ID NO: 5899211 - DNA, 19 bp, Homo sapiens
gaagcttctaataaattat

SEQ ID NO: 5899212 - DNA, 23 bp, Homo sapiens
gaagcttcttaaatgagaaggaa

SEQ ID NO: 5899213 - DNA, 23 bp, Homo sapiens
gaagcttggcttcctcttcttgt

SEQ ID NO: 5899214 - DNA, 22 bp, Homo sapiens
gaagcttgtatctgatatcagc

SEQ ID NO: 5899215 - DNA, 12 bp, Homo sapiens
gaagctttacca

SEQ ID NO: 5899216 - DNA, 22 bp, Homo sapiens
gaagctttatttatagaaatga

SEQ ID NO: 5899217 - DNA, 15 bp, Homo sapiens
gaagctttggaagca

SEQ ID NO: 5899218 - DNA, 16 bp, Homo sapiens
gaagctttggaagcag

SEQ ID NO: 5899219 - DNA, 17 bp, Homo sapiens
gaagctttggaagcagc

SEQ ID NO: 5899220 - DNA, 18 bp, Homo sapiens
gaagctttggaagcagca

SEQ ID NO: 5899221 - DNA, 14 bp, Homo sapiens
gaagctttggccct

SEQ ID NO: 5899222 - DNA, 14 bp, Homo sapiens
gaagctttggtgag

SEQ ID NO: 5899223 - DNA, 21 bp, Homo sapiens
gaagctttgtcccctgcttca

SEQ ID NO: 5899224 - DNA, 23 bp, Homo sapiens
gaaggaaaaaattatgtttttca

SEQ ID NO: 5899225 - DNA, 19 bp, Homo sapiens
gaaggaaaaggctggcaag

SEQ ID NO: 5899226 - DNA, 17 bp, Homo sapiens
gaaggaaaatgttcatg

SEQ ID NO: 5899227 - DNA, 16 bp, Homo sapiens
gaaggaaacaaatgtg

SEQ ID NO: 5899228 - DNA, 17 bp, Homo sapiens
gaaggaaacaacaaagg

SEQ ID NO: 5899229 - DNA, 12 bp, Homo sapiens
gaaggaaacata

SEQ ID NO: 5899230 - DNA, 19 bp, Homo sapiens
gaaggaaagaaagaaggaa

SEQ ID NO: 5899231 - DNA, 18 bp, Homo sapiens
gaaggaaagcaaggcaga

SEQ ID NO: 5899232 - DNA, 14 bp, Homo sapiens
gaaggaaataaagg

SEQ ID NO: 5899233 - DNA, 20 bp, Homo sapiens
gaaggaaatcccatcagtga

SEQ ID NO: 5899234 - DNA, 15 bp, Homo sapiens
gaaggaaatgaacca

SEQ ID NO: 5899235 - DNA, 15 bp, Homo sapiens
gaaggaaatgaattt

SEQ ID NO: 5899236 - DNA, 14 bp, Homo sapiens
gaaggaacaaagac

SEQ ID NO: 5899237 - DNA, 13 bp, Homo sapiens
gaaggaacagtta

SEQ ID NO: 5899238 - DNA, 14 bp, Homo sapiens
gaaggcccagcacc

SEQ ID NO: 5899239 - DNA, 17 bp, Homo sapiens
gaaggccccagagagac

SEQ ID NO: 5899240 - DNA, 13 bp, Homo sapiens
gaaggccccaggg

SEQ ID NO: 5899241 - DNA, 19 bp, Homo sapiens
gaaggccccgcccaggctt

SEQ ID NO: 5899242 - DNA, 14 bp, Homo sapiens
gaaggccctgaggc

SEQ ID NO: 5899243 - DNA, 16 bp, Homo sapiens
gaaggccctgctgagt

SEQ ID NO: 5899244 - DNA, 13 bp, Homo sapiens
gaaggccctgtgc

SEQ ID NO: 5899245 - DNA, 19 bp, Homo sapiens
gaaggccgaggcaggagaa

SEQ ID NO: 5899246 - DNA, 17 bp, Homo sapiens
gaaggccgaggtcccat

SEQ ID NO: 5899247 - DNA, 24 bp, Homo sapiens
gaaggcctaggctaggacgttggc

SEQ ID NO: 5899248 - DNA, 19 bp, Homo sapiens
gaaggcctcccctgaggat

SEQ ID NO: 5899249 - DNA, 14 bp, Homo sapiens
gaaggcctccctct

SEQ ID NO: 5899250 - DNA, 15 bp, Homo sapiens
gaaggcctcgcagga

SEQ ID NO: 5899251 - DNA, 18 bp, Homo sapiens
gaaggcctcttggagacc

SEQ ID NO: 5899252 - DNA, 19 bp, Homo sapiens
gaaggcctcttgtgctcac

SEQ ID NO: 5899253 - DNA, 20 bp, Homo sapiens
gaaggcctgacttctgctgg

SEQ ID NO: 5899254 - DNA, 14 bp, Homo sapiens
gaaggcctgagccc

SEQ ID NO: 5899255 - DNA, 13 bp, Homo sapiens
gaaggcctgaggg

SEQ ID NO: 5899256 - DNA, 19 bp, Homo sapiens
gaaggcctgagggaagccc

SEQ ID NO: 5899257 - DNA, 21 bp, Homo sapiens
gaaggcctgagggaagcccac

SEQ ID NO: 5899258 - DNA, 14 bp, Homo sapiens
gaaggcctgccccc

SEQ ID NO: 5899259 - DNA, 19 bp, Homo sapiens
gaaggcctgccccccttcc

SEQ ID NO: 5899260 - DNA, 21 bp, Homo sapiens
gaaggcctgccccccttccca

SEQ ID NO: 5899261 - DNA, 23 bp, Homo sapiens
gaaggcctggaagagctgagacc

SEQ ID NO: 5899262 - DNA, 14 bp, Homo sapiens
gaaggcctggctgg

SEQ ID NO: 5899263 - DNA, 13 bp, Homo sapiens
gaaggcctggtca

SEQ ID NO: 5899264 - DNA, 16 bp, Homo sapiens
gaaggcctggtcagca

SEQ ID NO: 5899265 - DNA, 21 bp, Homo sapiens
gaaggcctggtcagcagagcc

SEQ ID NO: 5899266 - DNA, 15 bp, Homo sapiens
gaaggccttccactg

SEQ ID NO: 5899267 - DNA, 18 bp, Homo sapiens
gaaggccttgctgtcatg

SEQ ID NO: 5899268 - DNA, 16 bp, Homo sapiens
gaaggcctttcttctg

SEQ ID NO: 5899269 - DNA, 17 bp, Homo sapiens
gaaggcctttcttctgt

SEQ ID NO: 5899270 - DNA, 20 bp, Homo sapiens
gaaggcctttcttctgtgtt

SEQ ID NO: 5899271 - DNA, 13 bp, Homo sapiens
gaaggcgaggaga

SEQ ID NO: 5899272 - DNA, 16 bp, Homo sapiens
gaaggcgaggctgccc

SEQ ID NO: 5899273 - DNA, 15 bp, Homo sapiens
gaaggcgagtctggg

SEQ ID NO: 5899274 - DNA, 18 bp, Homo sapiens
gaaggcgagtctggggac

SEQ ID NO: 5899275 - DNA, 22 bp, Homo sapiens
gaaggcgatgtggtgaccccac

SEQ ID NO: 5899276 - DNA, 19 bp, Homo sapiens
gaaggcggcaggcagagaa

SEQ ID NO: 5899277 - DNA, 22 bp, Homo sapiens
gaaggcggggtattcccactca

SEQ ID NO: 5899278 - DNA, 16 bp, Homo sapiens
gaaggctaaaaagcaa

SEQ ID NO: 5899279 - DNA, 19 bp, Homo sapiens
gaaggctacttcggggctg

SEQ ID NO: 5899280 - DNA, 21 bp, Homo sapiens
gaaggctacttcggggctggg

SEQ ID NO: 5899281 - DNA, 22 bp, Homo sapiens
gaaggctctcgggtgggggagc

SEQ ID NO: 5899282 - DNA, 23 bp, Homo sapiens
gaaggctcttctccccagagttc

SEQ ID NO: 5899283 - DNA, 20 bp, Homo sapiens
gaaggctgcctaaggaggag

SEQ ID NO: 5899284 - DNA, 22 bp, Homo sapiens
gaaggctgcctgctatgtattt

SEQ ID NO: 5899285 - DNA, 18 bp, Homo sapiens
gaaggctggggctattta

SEQ ID NO: 5899286 - DNA, 15 bp, Homo sapiens
gaaggctgggttctg

SEQ ID NO: 5899287 - DNA, 22 bp, Homo sapiens
gaaggctgggttctgatcctag

SEQ ID NO: 5899288 - DNA, 14 bp, Homo sapiens
gaaggctgtatcta

SEQ ID NO: 5899289 - DNA, 17 bp, Homo sapiens
gaaggcttaagaactgc

SEQ ID NO: 5899290 - DNA, 21 bp, Homo sapiens
gaaggcttaattgactgaaat

SEQ ID NO: 5899291 - DNA, 16 bp, Homo sapiens
gaaggcttgggatttg

SEQ ID NO: 5899292 - DNA, 17 bp, Homo sapiens
gaaggcttgggatttgc

SEQ ID NO: 5899293 - DNA, 21 bp, Homo sapiens
gaaggcttgggatttgctgtg

SEQ ID NO: 5899294 - DNA, 19 bp, Homo sapiens
gaaggcttgttgtgctttt

SEQ ID NO: 5899295 - DNA, 19 bp, Homo sapiens
gaaggctttagttctgctt

SEQ ID NO: 5899296 - DNA, 23 bp, Homo sapiens
gaagggaaagcgggcagccccgt

SEQ ID NO: 5899297 - DNA, 18 bp, Homo sapiens
gaagggaaatcaatttaa

SEQ ID NO: 5899298 - DNA, 18 bp, Homo sapiens
gaagggaacagcctgagc

SEQ ID NO: 5899299 - DNA, 19 bp, Homo sapiens
gaagggaacagcctgagcc

SEQ ID NO: 5899300 - DNA, 15 bp, Homo sapiens
gaagggaagaaaagg

SEQ ID NO: 5899301 - DNA, 15 bp, Homo sapiens
gaagggaagagacag

SEQ ID NO: 5899302 - DNA, 16 bp, Homo sapiens
gaagggaagcccagcc

SEQ ID NO: 5899303 - DNA, 13 bp, Homo sapiens
gaagggaaggaag

SEQ ID NO: 5899304 - DNA, 13 bp, Homo sapiens
gaagggaagtggg

SEQ ID NO: 5899305 - DNA, 22 bp, Homo sapiens
gaagggaataaggtacaagaag

SEQ ID NO: 5899306 - DNA, 20 bp, Homo sapiens
gaagggaatcctcctccagg

SEQ ID NO: 5899307 - DNA, 17 bp, Homo sapiens
gaagggaattgttttta

SEQ ID NO: 5899308 - DNA, 17 bp, Homo sapiens
gaagggaatttggctca

SEQ ID NO: 5899309 - DNA, 23 bp, Homo sapiens
gaagggaatttggctcaacttca

SEQ ID NO: 5899310 - DNA, 14 bp, Homo sapiens
gaagggacacacac

SEQ ID NO: 5899311 - DNA, 15 bp, Homo sapiens
gaagggacacacaca

SEQ ID NO: 5899312 - DNA, 19 bp, Homo sapiens
gaagggacagctgcattcc

SEQ ID NO: 5899313 - DNA, 17 bp, Homo sapiens
gaagggacagctgctgg

SEQ ID NO: 5899314 - DNA, 20 bp, Homo sapiens
gaagggacagctgctgggac

SEQ ID NO: 5899315 - DNA, 21 bp, Homo sapiens
gaagggacagctgctgggacc

SEQ ID NO: 5899316 - DNA, 21 bp, Homo sapiens
gaagggaccaaggcaaggcag

SEQ ID NO: 5899317 - DNA, 22 bp, Homo sapiens
gaagggaccaaggcaaggcagg

SEQ ID NO: 5899318 - DNA, 15 bp, Homo sapiens
gaagggaccccagat

SEQ ID NO: 5899319 - DNA, 22 bp, Homo sapiens
gaagggacggctgtgggaccag

SEQ ID NO: 5899320 - DNA, 21 bp, Homo sapiens
gaagggactaggagcactgta

SEQ ID NO: 5899321 - DNA, 21 bp, Homo sapiens
gaagggactctgggctgtgcc

SEQ ID NO: 5899322 - DNA, 13 bp, Homo sapiens
gaagggactggtc

SEQ ID NO: 5899323 - DNA, 16 bp, Homo sapiens
gaagggagaagaaagg

SEQ ID NO: 5899324 - DNA, 12 bp, Homo sapiens
gaagggagaagg

SEQ ID NO: 5899325 - DNA, 16 bp, Homo sapiens
gaagggagcattgcag

SEQ ID NO: 5899326 - DNA, 14 bp, Homo sapiens
gaagggagccaagg

SEQ ID NO: 5899327 - DNA, 15 bp, Homo sapiens
gaagggagccaaggg

SEQ ID NO: 5899328 - DNA, 16 bp, Homo sapiens
gaagggagccaaggga

SEQ ID NO: 5899329 - DNA, 20 bp, Homo sapiens
gaagggagccaagggatgga

SEQ ID NO: 5899330 - DNA, 14 bp, Homo sapiens
gaagggagctgagg

SEQ ID NO: 5899331 - DNA, 15 bp, Homo sapiens
gaagggaggcctgag

SEQ ID NO: 5899332 - DNA, 18 bp, Homo sapiens
gaagggaggcctgagggg

SEQ ID NO: 5899333 - DNA, 20 bp, Homo sapiens
gaagggaggcctgaggggca

SEQ ID NO: 5899334 - DNA, 15 bp, Homo sapiens
gaagggagggagctg

SEQ ID NO: 5899335 - DNA, 14 bp, Homo sapiens
gaagggagggcaga

SEQ ID NO: 5899336 - DNA, 17 bp, Homo sapiens
gaagggagggcagagct

SEQ ID NO: 5899337 - DNA, 20 bp, Homo sapiens
gaagggagggcagagctggt

SEQ ID NO: 5899338 - DNA, 17 bp, Homo sapiens
gaagggaggggaagaga

SEQ ID NO: 5899339 - DNA, 16 bp, Homo sapiens
gaagggaggggaaggg

SEQ ID NO: 5899340 - DNA, 16 bp, Homo sapiens
gaagggaggggctgtg

SEQ ID NO: 5899341 - DNA, 12 bp, Homo sapiens
gaagggagggtg

SEQ ID NO: 5899342 - DNA, 17 bp, Homo sapiens
gaagggagggtggccag

SEQ ID NO: 5899343 - DNA, 10 bp, Homo sapiens
gaagggaggt

SEQ ID NO: 5899344 - DNA, 13 bp, Homo sapiens
gaagggaggtggc

SEQ ID NO: 5899345 - DNA, 17 bp, Homo sapiens
gaagggagtgaaaacct

SEQ ID NO: 5899346 - DNA, 18 bp, Homo sapiens
gaagggagtgaggggctg

SEQ ID NO: 5899347 - DNA, 18 bp, Homo sapiens
gaagggagttgctcactc

SEQ ID NO: 5899348 - DNA, 20 bp, Homo sapiens
gaagggagttgctcactcag

SEQ ID NO: 5899349 - DNA, 13 bp, Homo sapiens
gaagggatctgag

SEQ ID NO: 5899350 - DNA, 13 bp, Homo sapiens
gaagggcaagaaa

SEQ ID NO: 5899351 - DNA, 19 bp, Homo sapiens
gaagggcagggctgaggcc

SEQ ID NO: 5899352 - DNA, 13 bp, Homo sapiens
gaagggccaccct

SEQ ID NO: 5899353 - DNA, 15 bp, Homo sapiens
gaagggccaccctga

SEQ ID NO: 5899354 - DNA, 19 bp, Homo sapiens
gaagggccaccctgctgca

SEQ ID NO: 5899355 - DNA, 21 bp, Homo sapiens
gaagggccaccctgctgcact

SEQ ID NO: 5899356 - DNA, 13 bp, Homo sapiens
gaagggccagagc

SEQ ID NO: 5899357 - DNA, 15 bp, Homo sapiens
gaagggccagagcca

SEQ ID NO: 5899358 - DNA, 12 bp, Homo sapiens
gaagggccagga

SEQ ID NO: 5899359 - DNA, 18 bp, Homo sapiens
gaagggccaggagagaga

SEQ ID NO: 5899360 - DNA, 19 bp, Homo sapiens
gaagggccagtcctgcctg

SEQ ID NO: 5899361 - DNA, 20 bp, Homo sapiens
gaagggccagtcctgcctgg

SEQ ID NO: 5899362 - DNA, 17 bp, Homo sapiens
gaagggcctcccagccc

SEQ ID NO: 5899363 - DNA, 19 bp, Homo sapiens
gaagggcctgctctgcttt

SEQ ID NO: 5899364 - DNA, 19 bp, Homo sapiens
gaagggctagaacctggag

SEQ ID NO: 5899365 - DNA, 20 bp, Homo sapiens
gaagggctagaacctggagg

SEQ ID NO: 5899366 - DNA, 20 bp, Homo sapiens
gaagggctcagagaggacaa

SEQ ID NO: 5899367 - DNA, 22 bp, Homo sapiens
gaagggctgcatgatgtttgcc

SEQ ID NO: 5899368 - DNA, 11 bp, Homo sapiens
gaagggctggg

SEQ ID NO: 5899369 - DNA, 12 bp, Homo sapiens
gaagggctgggc

SEQ ID NO: 5899370 - DNA, 15 bp, Homo sapiens
gaagggctgggccac

SEQ ID NO: 5899371 - DNA, 19 bp, Homo sapiens
gaagggctgggccaccagg

SEQ ID NO: 5899372 - DNA, 22 bp, Homo sapiens
gaagggctgggccaccagggat

SEQ ID NO: 5899373 - DNA, 13 bp, Homo sapiens
gaagggctgggtg

SEQ ID NO: 5899374 - DNA, 20 bp, Homo sapiens
gaagggcttacaggcatgga

SEQ ID NO: 5899375 - DNA, 15 bp, Homo sapiens
gaagggcttcttctt

SEQ ID NO: 5899376 - DNA, 19 bp, Homo sapiens
gaagggcttgaattgaagc

SEQ ID NO: 5899377 - DNA, 23 bp, Homo sapiens
gaagggctttgagggtggaagga

SEQ ID NO: 5899378 - DNA, 12 bp, Homo sapiens
gaaggggacagg

SEQ ID NO: 5899379 - DNA, 18 bp, Homo sapiens
gaaggggactgccacctc

SEQ ID NO: 5899380 - DNA, 15 bp, Homo sapiens
gaaggggaggagggc

SEQ ID NO: 5899381 - DNA, 15 bp, Homo sapiens
gaaggggaggcacac

SEQ ID NO: 5899382 - DNA, 23 bp, Homo sapiens
gaaggggatgggaaataaagaaa

SEQ ID NO: 5899383 - DNA, 16 bp, Homo sapiens
gaaggggatggtgttg

SEQ ID NO: 5899384 - DNA, 22 bp, Homo sapiens
gaaggggcacgcctgcccagcc

SEQ ID NO: 5899385 - DNA, 18 bp, Homo sapiens
gaaggggcagcaggagga

SEQ ID NO: 5899386 - DNA, 17 bp, Homo sapiens
gaaggggccagaggctc

SEQ ID NO: 5899387 - DNA, 12 bp, Homo sapiens
gaaggggccatc

SEQ ID NO: 5899388 - DNA, 17 bp, Homo sapiens
gaaggggcccaagagag

SEQ ID NO: 5899389 - DNA, 19 bp, Homo sapiens
gaaggggcccaagagagac

SEQ ID NO: 5899390 - DNA, 19 bp, Homo sapiens
gaaggggccccggggctgg

SEQ ID NO: 5899391 - DNA, 23 bp, Homo sapiens
gaaggggccctggtccttccagg

SEQ ID NO: 5899392 - DNA, 16 bp, Homo sapiens
gaaggggcctccctcc

SEQ ID NO: 5899393 - DNA, 16 bp, Homo sapiens
gaaggggcctgggctg

SEQ ID NO: 5899394 - DNA, 17 bp, Homo sapiens
gaaggggcctgggctgt

SEQ ID NO: 5899395 - DNA, 20 bp, Homo sapiens
gaaggggcctgggctgtgag

SEQ ID NO: 5899396 - DNA, 22 bp, Homo sapiens
gaaggggcctgggctgtgagga

SEQ ID NO: 5899397 - DNA, 13 bp, Homo sapiens
gaaggggccttgc

SEQ ID NO: 5899398 - DNA, 20 bp, Homo sapiens
gaaggggcgctcctcccagc

SEQ ID NO: 5899399 - DNA, 23 bp, Homo sapiens
gaaggggcgctcctcccagctgt

SEQ ID NO: 5899400 - DNA, 22 bp, Homo sapiens
gaaggggcggggagaagcctgg

SEQ ID NO: 5899401 - DNA, 19 bp, Homo sapiens
gaaggggctggactggctg

SEQ ID NO: 5899402 - DNA, 20 bp, Homo sapiens
gaaggggctggactggctgt

SEQ ID NO: 5899403 - DNA, 15 bp, Homo sapiens
gaaggggcttctaat

SEQ ID NO: 5899404 - DNA, 16 bp, Homo sapiens
gaaggggcttctaatg

SEQ ID NO: 5899405 - DNA, 16 bp, Homo sapiens
gaagggggaagtctct

SEQ ID NO: 5899406 - DNA, 15 bp, Homo sapiens
gaagggggacactcc

SEQ ID NO: 5899407 - DNA, 13 bp, Homo sapiens
gaagggggagaca

SEQ ID NO: 5899408 - DNA, 12 bp, Homo sapiens
gaagggggagga

SEQ ID NO: 5899409 - DNA, 16 bp, Homo sapiens
gaagggggatatgaat

SEQ ID NO: 5899410 - DNA, 16 bp, Homo sapiens
gaagggggatgcaggc

SEQ ID NO: 5899411 - DNA, 22 bp, Homo sapiens
gaagggggccatgaggcctcag

SEQ ID NO: 5899412 - DNA, 15 bp, Homo sapiens
gaagggggccctgct

SEQ ID NO: 5899413 - DNA, 14 bp, Homo sapiens
gaagggggccgcca

SEQ ID NO: 5899414 - DNA, 15 bp, Homo sapiens
gaagggggctctgcc

SEQ ID NO: 5899415 - DNA, 13 bp, Homo sapiens
gaagggggctggg

SEQ ID NO: 5899416 - DNA, 19 bp, Homo sapiens
gaagtcaaataaatgtttc

SEQ ID NO: 5899417 - DNA, 20 bp, Homo sapiens
gaagtcaaatgtcacatagg

SEQ ID NO: 5899418 - DNA, 16 bp, Homo sapiens
gaagtcaatatgtgga

SEQ ID NO: 5899419 - DNA, 20 bp, Homo sapiens
gaagtcacagggcagtacct

SEQ ID NO: 5899420 - DNA, 22 bp, Homo sapiens
gaagtcacccctttctgtccca

SEQ ID NO: 5899421 - DNA, 23 bp, Homo sapiens
gaagtcacccctttctgtcccac

SEQ ID NO: 5899422 - DNA, 16 bp, Homo sapiens
gaagtcacctttctgg

SEQ ID NO: 5899423 - DNA, 15 bp, Homo sapiens
gaagtcactgcacag

SEQ ID NO: 5899424 - DNA, 20 bp, Homo sapiens
gaagtcagaatttttaactg

SEQ ID NO: 5899425 - DNA, 22 bp, Homo sapiens
gaagtcagaatttttaactgta

SEQ ID NO: 5899426 - DNA, 20 bp, Homo sapiens
gaagtcagagaaaacacttt

SEQ ID NO: 5899427 - DNA, 13 bp, Homo sapiens
gaagtcagagaga

SEQ ID NO: 5899428 - DNA, 14 bp, Homo sapiens
gaagtcagccacac

SEQ ID NO: 5899429 - DNA, 22 bp, Homo sapiens
gaagtcagccacactgggcctg

SEQ ID NO: 5899430 - DNA, 17 bp, Homo sapiens
gaagtcaggagccagca

SEQ ID NO: 5899431 - DNA, 22 bp, Homo sapiens
gaagtcaggtgtcatcatcaga

SEQ ID NO: 5899432 - DNA, 16 bp, Homo sapiens
gaagtcagtcaacatt

SEQ ID NO: 5899433 - DNA, 18 bp, Homo sapiens
gaagtcagttggagaaaa

SEQ ID NO: 5899434 - DNA, 18 bp, Homo sapiens
gaagtcataaacagcatt

SEQ ID NO: 5899435 - DNA, 18 bp, Homo sapiens
gaagtcataccaatgaaa

SEQ ID NO: 5899436 - DNA, 12 bp, Homo sapiens
gaagtcatatgt

SEQ ID NO: 5899437 - DNA, 15 bp, Homo sapiens
gaagtcatcttgcta

SEQ ID NO: 5899438 - DNA, 15 bp, Homo sapiens
gaagtcatgaagccc

SEQ ID NO: 5899439 - DNA, 20 bp, Homo sapiens
gaagtcattgtcgctcagca

SEQ ID NO: 5899440 - DNA, 21 bp, Homo sapiens
gaagtcattgtcgctcagcaa

SEQ ID NO: 5899441 - DNA, 23 bp, Homo sapiens
gaagtccaagcatttagatgtat

SEQ ID NO: 5899442 - DNA, 13 bp, Homo sapiens
gaagtccaggact

SEQ ID NO: 5899443 - DNA, 21 bp, Homo sapiens
gaagtccagtgaccctggagc

SEQ ID NO: 5899444 - DNA, 18 bp, Homo sapiens
gaagtcccaccagggacc

SEQ ID NO: 5899445 - DNA, 17 bp, Homo sapiens
gaagtccccaggtcatg

SEQ ID NO: 5899446 - DNA, 23 bp, Homo sapiens
gaagtcccctctcctccacattt

SEQ ID NO: 5899447 - DNA, 22 bp, Homo sapiens
gaagtccccttccatcccagag

SEQ ID NO: 5899448 - DNA, 18 bp, Homo sapiens
gaagtccctaggagggaa

SEQ ID NO: 5899449 - DNA, 15 bp, Homo sapiens
gaagtccctcagagg

SEQ ID NO: 5899450 - DNA, 18 bp, Homo sapiens
gaagtccctcagaggcct

SEQ ID NO: 5899451 - DNA, 22 bp, Homo sapiens
gaagtccctgttctcagctccg

SEQ ID NO: 5899452 - DNA, 23 bp, Homo sapiens
gaagtcctctgtggccagctgca

SEQ ID NO: 5899453 - DNA, 16 bp, Homo sapiens
gaagtcctgggaggat

SEQ ID NO: 5899454 - DNA, 21 bp, Homo sapiens
gaagtcctgggaggatcctga

SEQ ID NO: 5899455 - DNA, 18 bp, Homo sapiens
gaagtcctgtatgtctgt

SEQ ID NO: 5899456 - DNA, 14 bp, Homo sapiens
gaagtccttatgtt

SEQ ID NO: 5899457 - DNA, 21 bp, Homo sapiens
gaagtccttcagtgagcccct

SEQ ID NO: 5899458 - DNA, 18 bp, Homo sapiens
gaagtcgagcactctaat

SEQ ID NO: 5899459 - DNA, 20 bp, Homo sapiens
gaagtcgcttttggtgcctg

SEQ ID NO: 5899460 - DNA, 22 bp, Homo sapiens
gaagtcggaatgtcatagtctt

SEQ ID NO: 5899461 - DNA, 16 bp, Homo sapiens
gaagtcggatgtcaga

SEQ ID NO: 5899462 - DNA, 22 bp, Homo sapiens
gaagtcgtccttactcctgtgg

SEQ ID NO: 5899463 - DNA, 23 bp, Homo sapiens
gaagtcgtccttactcctgtggg

SEQ ID NO: 5899464 - DNA, 19 bp, Homo sapiens
gaagtcgtttcaggacatg

SEQ ID NO: 5899465 - DNA, 15 bp, Homo sapiens
gaagtctagaatcat

SEQ ID NO: 5899466 - DNA, 20 bp, Homo sapiens
gaagtctaggagctgggagg

SEQ ID NO: 5899467 - DNA, 12 bp, Homo sapiens
gaagtctcagcc

SEQ ID NO: 5899468 - DNA, 22 bp, Homo sapiens
gaagtctccccgcagccctctc

SEQ ID NO: 5899469 - DNA, 11 bp, Homo sapiens
gaagtctgaaa

SEQ ID NO: 5899470 - DNA, 15 bp, Homo sapiens
gaagtctgatccctg

SEQ ID NO: 5899471 - DNA, 16 bp, Homo sapiens
gaagtctgatccctgc

SEQ ID NO: 5899472 - DNA, 18 bp, Homo sapiens
gaagtctgatccctgcca

SEQ ID NO: 5899473 - DNA, 21 bp, Homo sapiens
gaagtctgatccctgccaaaa

SEQ ID NO: 5899474 - DNA, 16 bp, Homo sapiens
gaagtctggccatttt

SEQ ID NO: 5899475 - DNA, 18 bp, Homo sapiens
gaagtctggctttgctct

SEQ ID NO: 5899476 - DNA, 18 bp, Homo sapiens
gaagtctgtctttctata

SEQ ID NO: 5899477 - DNA, 19 bp, Homo sapiens
gaagtcttaattgtgttta

SEQ ID NO: 5899478 - DNA, 12 bp, Homo sapiens
gaagtcttgtat

SEQ ID NO: 5899479 - DNA, 17 bp, Homo sapiens
gaagtctttcaagaatg

SEQ ID NO: 5899480 - DNA, 16 bp, Homo sapiens
gaagtctttgtacaga

SEQ ID NO: 5899481 - DNA, 16 bp, Homo sapiens
gaagtcttttctgtca

SEQ ID NO: 5899482 - DNA, 14 bp, Homo sapiens
gaagtcttttgttc

SEQ ID NO: 5899483 - DNA, 15 bp, Homo sapiens
gaagtgaaaaagttt

SEQ ID NO: 5899484 - DNA, 14 bp, Homo sapiens
gaagtgaacatttc

SEQ ID NO: 5899485 - DNA, 19 bp, Homo sapiens
gaagtgaacccatatttta

SEQ ID NO: 5899486 - DNA, 15 bp, Homo sapiens
gaagtgaagaatgca

SEQ ID NO: 5899487 - DNA, 15 bp, Homo sapiens
gaagtgaaggagaaa

SEQ ID NO: 5899488 - DNA, 23 bp, Homo sapiens
gaagtgaatacatggtagcaggg

SEQ ID NO: 5899489 - DNA, 16 bp, Homo sapiens
gaagtgaatgctggga

SEQ ID NO: 5899490 - DNA, 17 bp, Homo sapiens
gaagtgaatgctgggac

SEQ ID NO: 5899491 - DNA, 17 bp, Homo sapiens
gaagtgaatgggaaagg

SEQ ID NO: 5899492 - DNA, 14 bp, Homo sapiens
gaagtgacagggaa

SEQ ID NO: 5899493 - DNA, 20 bp, Homo sapiens
gaagtgacagggaagctaca

SEQ ID NO: 5899494 - DNA, 21 bp, Homo sapiens
gaagtgaccccagctccaggc

SEQ ID NO: 5899495 - DNA, 23 bp, Homo sapiens
gaagtgaccccagctccaggcag

SEQ ID NO: 5899496 - DNA, 22 bp, Homo sapiens
gaagtgacggttcctacacagg

SEQ ID NO: 5899497 - DNA, 15 bp, Homo sapiens
gaagtgactgttgta

SEQ ID NO: 5899498 - DNA, 13 bp, Homo sapiens
gaagtgacttgaa

SEQ ID NO: 5899499 - DNA, 22 bp, Homo sapiens
gaagtgacttgaatgtacaaag

SEQ ID NO: 5899500 - DNA, 23 bp, Homo sapiens
gaagtgagcagtcgcctgcctgc

SEQ ID NO: 5899501 - DNA, 18 bp, Homo sapiens
gaagtgagctttgctgct

SEQ ID NO: 5899502 - DNA, 16 bp, Homo sapiens
gaagtgaggaagccag

SEQ ID NO: 5899503 - DNA, 14 bp, Homo sapiens
gaagtgaggcattg

SEQ ID NO: 5899504 - DNA, 20 bp, Homo sapiens
gaagtgagtttgtaaatatt

SEQ ID NO: 5899505 - DNA, 20 bp, Homo sapiens
gaagtgataacactggagtg

SEQ ID NO: 5899506 - DNA, 22 bp, Homo sapiens
gaagtgatactatccagttact

SEQ ID NO: 5899507 - DNA, 20 bp, Homo sapiens
gaagtgatatcataaaagta

SEQ ID NO: 5899508 - DNA, 13 bp, Homo sapiens
gaagtgatgttca

SEQ ID NO: 5899509 - DNA, 14 bp, Homo sapiens
gaagtgattgaaag

SEQ ID NO: 5899510 - DNA, 17 bp, Homo sapiens
gaagtgcacaggagcca

SEQ ID NO: 5899511 - DNA, 14 bp, Homo sapiens
gaagtgcagagctt

SEQ ID NO: 5899512 - DNA, 18 bp, Homo sapiens
gaagtgcagctcaggaga

SEQ ID NO: 5899513 - DNA, 14 bp, Homo sapiens
gaagtgcatccaaa

SEQ ID NO: 5899514 - DNA, 13 bp, Homo sapiens
gaagtgcatgtta

SEQ ID NO: 5899515 - DNA, 16 bp, Homo sapiens
gaagtgcatttctgaa

SEQ ID NO: 5899516 - DNA, 16 bp, Homo sapiens
gaagtgccacatgaca

SEQ ID NO: 5899517 - DNA, 14 bp, Homo sapiens
gaagtgccatctca

SEQ ID NO: 5899518 - DNA, 18 bp, Homo sapiens
gaagtgcccagcccctgc

SEQ ID NO: 5899519 - DNA, 20 bp, Homo sapiens
gaagtgcccagcccctgccc

SEQ ID NO: 5899520 - DNA, 22 bp, Homo sapiens
gaagtgcccctgctgcctcccc

SEQ ID NO: 5899521 - DNA, 20 bp, Homo sapiens
gaagtgcctctgattctatg

SEQ ID NO: 5899522 - DNA, 22 bp, Homo sapiens
gaagtgcctgctgggtgccagg

SEQ ID NO: 5899523 - DNA, 13 bp, Homo sapiens
gaagtgccttctc

SEQ ID NO: 5899524 - DNA, 23 bp, Homo sapiens
gaagtgccttctccttccccagg

SEQ ID NO: 5899525 - DNA, 21 bp, Homo sapiens
gaagtgcgtgaatgtatgtaa

SEQ ID NO: 5899526 - DNA, 17 bp, Homo sapiens
gaagtgctacagaaagc

SEQ ID NO: 5899527 - DNA, 12 bp, Homo sapiens
gaagtgctcccc

SEQ ID NO: 5899528 - DNA, 14 bp, Homo sapiens
gaagtgctccccac

SEQ ID NO: 5899529 - DNA, 16 bp, Homo sapiens
gaagtgctccccacac

SEQ ID NO: 5899530 - DNA, 19 bp, Homo sapiens
gaagtgctcccctctgaaa

SEQ ID NO: 5899531 - DNA, 14 bp, Homo sapiens
gaagtgctccctgg

SEQ ID NO: 5899532 - DNA, 15 bp, Homo sapiens
gaagtgctccctgga

SEQ ID NO: 5899533 - DNA, 20 bp, Homo sapiens
gaagtgctccctggaggcac

SEQ ID NO: 5899534 - DNA, 22 bp, Homo sapiens
gaagtgctcttggctgacccct

SEQ ID NO: 5899535 - DNA, 18 bp, Homo sapiens
gaagtgctgtttattaat

SEQ ID NO: 5899536 - DNA, 20 bp, Homo sapiens
gaagtgctgtttattaatct

SEQ ID NO: 5899537 - DNA, 21 bp, Homo sapiens
gaagtgcttagtgtacttgga

SEQ ID NO: 5899538 - DNA, 14 bp, Homo sapiens
gaagtgcttattct

SEQ ID NO: 5899539 - DNA, 13 bp, Homo sapiens
gaagtgcttggaa

SEQ ID NO: 5899540 - DNA, 16 bp, Homo sapiens
gaagtggaccaggaca

SEQ ID NO: 5899541 - DNA, 17 bp, Homo sapiens
gaagtggactggcccct

SEQ ID NO: 5899542 - DNA, 21 bp, Homo sapiens
gaagtggcagttctttactcg

SEQ ID NO: 5899543 - DNA, 13 bp, Homo sapiens
gaagtggccaggg

SEQ ID NO: 5899544 - DNA, 20 bp, Homo sapiens
gaagtggcccctcgtgacct

SEQ ID NO: 5899545 - DNA, 13 bp, Homo sapiens
gaagtggctcaga

SEQ ID NO: 5899546 - DNA, 18 bp, Homo sapiens
gaagtggctggaaagagt

SEQ ID NO: 5899547 - DNA, 15 bp, Homo sapiens
gaagtggctggtaga

SEQ ID NO: 5899548 - DNA, 15 bp, Homo sapiens
gaagtggctggtctg

SEQ ID NO: 5899549 - DNA, 19 bp, Homo sapiens
gaagtggctggtctggagt

SEQ ID NO: 5899550 - DNA, 17 bp, Homo sapiens
gaagtgggaaaaaatag

SEQ ID NO: 5899551 - DNA, 17 bp, Homo sapiens
gaagtgggagcagcttc

SEQ ID NO: 5899552 - DNA, 19 bp, Homo sapiens
gaagtgggattcaggaatg

SEQ ID NO: 5899553 - DNA, 19 bp, Homo sapiens
gaagtgggccaggacaggc

SEQ ID NO: 5899554 - DNA, 20 bp, Homo sapiens
gaagtgggccagtcctggtt

SEQ ID NO: 5899555 - DNA, 16 bp, Homo sapiens
gaagtggggacagatt

SEQ ID NO: 5899556 - DNA, 14 bp, Homo sapiens
gaagtggggagagg

SEQ ID NO: 5899557 - DNA, 18 bp, Homo sapiens
gaagtgggggccgctggc

SEQ ID NO: 5899558 - DNA, 20 bp, Homo sapiens
gaagtgggggccgctggccc

SEQ ID NO: 5899559 - DNA, 23 bp, Homo sapiens
gaagtggggggaacgcctctgtt

SEQ ID NO: 5899560 - DNA, 18 bp, Homo sapiens
gaagtggggtgttcttct

SEQ ID NO: 5899561 - DNA, 13 bp, Homo sapiens
gaagtgggtgggg

SEQ ID NO: 5899562 - DNA, 15 bp, Homo sapiens
gaagtgggtggggac

SEQ ID NO: 5899563 - DNA, 19 bp, Homo sapiens
gaagtgggtggggacagac

SEQ ID NO: 5899564 - DNA, 24 bp, Homo sapiens
gaagtgggtggggacagaccagcc

SEQ ID NO: 5899565 - DNA, 18 bp, Homo sapiens
gaagtggtaggaaagcct

SEQ ID NO: 5899566 - DNA, 21 bp, Homo sapiens
gaagtggtgacattttgcatg

SEQ ID NO: 5899567 - DNA, 16 bp, Homo sapiens
gaagtgtaacagctga

SEQ ID NO: 5899568 - DNA, 17 bp, Homo sapiens
gaagtgtaacagctgag

SEQ ID NO: 5899569 - DNA, 15 bp, Homo sapiens
gaagtgtaggcagac

SEQ ID NO: 5899570 - DNA, 17 bp, Homo sapiens
gaagtgtataatataaa

SEQ ID NO: 5899571 - DNA, 13 bp, Homo sapiens
gaagtgtatatag

SEQ ID NO: 5899572 - DNA, 20 bp, Homo sapiens
gaagtgtattggtttctgtt

SEQ ID NO: 5899573 - DNA, 17 bp, Homo sapiens
gaagtgtcaccctgtgg

SEQ ID NO: 5899574 - DNA, 13 bp, Homo sapiens
gaagtgtcatgtt

SEQ ID NO: 5899575 - DNA, 20 bp, Homo sapiens
gaagtgtccgagaactaaag

SEQ ID NO: 5899576 - DNA, 15 bp, Homo sapiens
gaagtgtcttctgtt

SEQ ID NO: 5899577 - DNA, 15 bp, Homo sapiens
gaagtgtgagcgcct

SEQ ID NO: 5899578 - DNA, 16 bp, Homo sapiens
gaagtgtgagcgcctt

SEQ ID NO: 5899579 - DNA, 19 bp, Homo sapiens
gaagtgtgagcgccttggt

SEQ ID NO: 5899580 - DNA, 23 bp, Homo sapiens
gaagtgtgattgggaataaatat

SEQ ID NO: 5899581 - DNA, 15 bp, Homo sapiens
gaagtgtgctgaggt

SEQ ID NO: 5899582 - DNA, 14 bp, Homo sapiens
gaagtgtggaaaaa

SEQ ID NO: 5899583 - DNA, 15 bp, Homo sapiens
gaagtgtggctggtg

SEQ ID NO: 5899584 - DNA, 18 bp, Homo sapiens
gaagtgtggctggtgtcc

SEQ ID NO: 5899585 - DNA, 15 bp, Homo sapiens
gaagtgtggggcggg

SEQ ID NO: 5899586 - DNA, 18 bp, Homo sapiens
gaagtgtgggtctgtgtg

SEQ ID NO: 5899587 - DNA, 15 bp, Homo sapiens
gaagtgtgtccatcc

SEQ ID NO: 5899588 - DNA, 21 bp, Homo sapiens
gaagtgtgtccatcctgacct

SEQ ID NO: 5899589 - DNA, 18 bp, Homo sapiens
gaagtgtgtgccaagagc

SEQ ID NO: 5899590 - DNA, 14 bp, Homo sapiens
gaagtgtgttctga

SEQ ID NO: 5899591 - DNA, 14 bp, Homo sapiens
gaagtgtgtttgcc

SEQ ID NO: 5899592 - DNA, 13 bp, Homo sapiens
gaagtgtgttttg

SEQ ID NO: 5899593 - DNA, 22 bp, Homo sapiens
gaataatgtctagattttgaaa

SEQ ID NO: 5899594 - DNA, 21 bp, Homo sapiens
gaataatgtgggaagaaacaa

SEQ ID NO: 5899595 - DNA, 14 bp, Homo sapiens
gaataattacagtg

SEQ ID NO: 5899596 - DNA, 16 bp, Homo sapiens
gaataattatttcaga

SEQ ID NO: 5899597 - DNA, 21 bp, Homo sapiens
gaataattgctttttcacagt

SEQ ID NO: 5899598 - DNA, 21 bp, Homo sapiens
gaataatttatagtaatgagt

SEQ ID NO: 5899599 - DNA, 14 bp, Homo sapiens
gaataatttcccaa

SEQ ID NO: 5899600 - DNA, 22 bp, Homo sapiens
gaataatttccttcaggcagct

SEQ ID NO: 5899601 - DNA, 14 bp, Homo sapiens
gaataatttgtaaa

SEQ ID NO: 5899602 - DNA, 18 bp, Homo sapiens
gaataatttgtaaatgat

SEQ ID NO: 5899603 - DNA, 13 bp, Homo sapiens
gaataattttatt

SEQ ID NO: 5899604 - DNA, 13 bp, Homo sapiens
gaataattttcta

SEQ ID NO: 5899605 - DNA, 16 bp, Homo sapiens
gaataattttggaata

SEQ ID NO: 5899606 - DNA, 12 bp, Homo sapiens
gaatacaaaagg

SEQ ID NO: 5899607 - DNA, 15 bp, Homo sapiens
gaatacaaacatttc

SEQ ID NO: 5899608 - DNA, 22 bp, Homo sapiens
gaatacaagatattatgtataa

SEQ ID NO: 5899609 - DNA, 15 bp, Homo sapiens
gaatacaattaaagg

SEQ ID NO: 5899610 - DNA, 18 bp, Homo sapiens
gaatacacatataaaaac

SEQ ID NO: 5899611 - DNA, 19 bp, Homo sapiens
gaatacacatataaaaaca

SEQ ID NO: 5899612 - DNA, 14 bp, Homo sapiens
gaatacactggaat

SEQ ID NO: 5899613 - DNA, 21 bp, Homo sapiens
gaatacagtaagctgctctat

SEQ ID NO: 5899614 - DNA, 13 bp, Homo sapiens
gaatacagtgtta

SEQ ID NO: 5899615 - DNA, 20 bp, Homo sapiens
gaatacagtgttattttctt

SEQ ID NO: 5899616 - DNA, 14 bp, Homo sapiens
gaatacataaacaa

SEQ ID NO: 5899617 - DNA, 12 bp, Homo sapiens
gaatacatatta

SEQ ID NO: 5899618 - DNA, 19 bp, Homo sapiens
gaatacatattacaagaaa

SEQ ID NO: 5899619 - DNA, 19 bp, Homo sapiens
gaatacatcagaaaataaa

SEQ ID NO: 5899620 - DNA, 19 bp, Homo sapiens
gaatacatcttgtttctga

SEQ ID NO: 5899621 - DNA, 19 bp, Homo sapiens
gaatacatggtagcagggt

SEQ ID NO: 5899622 - DNA, 21 bp, Homo sapiens
gaatacattaacggtgctaaa

SEQ ID NO: 5899623 - DNA, 13 bp, Homo sapiens
gaatacattttat

SEQ ID NO: 5899624 - DNA, 18 bp, Homo sapiens
gaatacattttataattt

SEQ ID NO: 5899625 - DNA, 14 bp, Homo sapiens
gaatacattttatt

SEQ ID NO: 5899626 - DNA, 18 bp, Homo sapiens
gaatacattttattctgt

SEQ ID NO: 5899627 - DNA, 18 bp, Homo sapiens
gaatacattttgcacaaa

SEQ ID NO: 5899628 - DNA, 16 bp, Homo sapiens
gaataccacatcaaat

SEQ ID NO: 5899629 - DNA, 15 bp, Homo sapiens
gaataccactctgta

SEQ ID NO: 5899630 - DNA, 16 bp, Homo sapiens
gaataccactctgtaa

SEQ ID NO: 5899631 - DNA, 21 bp, Homo sapiens
gaataccactctgtaattgca

SEQ ID NO: 5899632 - DNA, 19 bp, Homo sapiens
gaataccaggatagcttta

SEQ ID NO: 5899633 - DNA, 16 bp, Homo sapiens
gaatacccaggaagac

SEQ ID NO: 5899634 - DNA, 21 bp, Homo sapiens
gaataccccaagactcccatg

SEQ ID NO: 5899635 - DNA, 16 bp, Homo sapiens
gaatacccccagagac

SEQ ID NO: 5899636 - DNA, 18 bp, Homo sapiens
gaatacccccagagacct

SEQ ID NO: 5899637 - DNA, 19 bp, Homo sapiens
gaatacccccagagacctt

SEQ ID NO: 5899638 - DNA, 19 bp, Homo sapiens
gaatacctctttgaaagaa

SEQ ID NO: 5899639 - DNA, 13 bp, Homo sapiens
gaatacctgctca

SEQ ID NO: 5899640 - DNA, 17 bp, Homo sapiens
gaataccttagtgcagt

SEQ ID NO: 5899641 - DNA, 21 bp, Homo sapiens
gaataccttagtgcagttatt

SEQ ID NO: 5899642 - DNA, 15 bp, Homo sapiens
gaatacgaacttaaa

SEQ ID NO: 5899643 - DNA, 21 bp, Homo sapiens
gaatacgctaagcctggaagc

SEQ ID NO: 5899644 - DNA, 14 bp, Homo sapiens
gaatactaataaaa

SEQ ID NO: 5899645 - DNA, 18 bp, Homo sapiens
gaatactaataaaataca

SEQ ID NO: 5899646 - DNA, 20 bp, Homo sapiens
gaatactaataaaatacata

SEQ ID NO: 5899647 - DNA, 20 bp, Homo sapiens
gaatactatccatgtaataa

SEQ ID NO: 5899648 - DNA, 19 bp, Homo sapiens
gaatactcagggaaagcat

SEQ ID NO: 5899649 - DNA, 20 bp, Homo sapiens
gaatactcttatatctatat

SEQ ID NO: 5899650 - DNA, 13 bp, Homo sapiens
gaatactcttgaa

SEQ ID NO: 5899651 - DNA, 16 bp, Homo sapiens
gaatactcttgaaagg

SEQ ID NO: 5899652 - DNA, 13 bp, Homo sapiens
gaatactgaacat

SEQ ID NO: 5899653 - DNA, 17 bp, Homo sapiens
gaatactgccaaaacat

SEQ ID NO: 5899654 - DNA, 15 bp, Homo sapiens
gaatactgggttctt

SEQ ID NO: 5899655 - DNA, 16 bp, Homo sapiens
gaatactgggttctta

SEQ ID NO: 5899656 - DNA, 14 bp, Homo sapiens
gaatactgtctgta

SEQ ID NO: 5899657 - DNA, 15 bp, Homo sapiens
gaatactgtctgtat

SEQ ID NO: 5899658 - DNA, 19 bp, Homo sapiens
gaatactgtctgtatcttt

SEQ ID NO: 5899659 - DNA, 15 bp, Homo sapiens
gaatactgttttatc

SEQ ID NO: 5899660 - DNA, 17 bp, Homo sapiens
gaatacttactataatt

SEQ ID NO: 5899661 - DNA, 13 bp, Homo sapiens
gaatacttatttt

SEQ ID NO: 5899662 - DNA, 15 bp, Homo sapiens
gaatacttattttca

SEQ ID NO: 5899663 - DNA, 15 bp, Homo sapiens
gaatacttcctgaaa

SEQ ID NO: 5899664 - DNA, 15 bp, Homo sapiens
gaatacttgaaccat

SEQ ID NO: 5899665 - DNA, 20 bp, Homo sapiens
gaatactttgaatgtgtttc

SEQ ID NO: 5899666 - DNA, 19 bp, Homo sapiens
gaatactttgaatgttgtg

SEQ ID NO: 5899667 - DNA, 20 bp, Homo sapiens
gaatactttgaatgttgtgt

SEQ ID NO: 5899668 - DNA, 20 bp, Homo sapiens
gaatactttgatgattgcca

SEQ ID NO: 5899669 - DNA, 24 bp, Homo sapiens
gaatactttgcagcacagctgaga

SEQ ID NO: 5899670 - DNA, 19 bp, Homo sapiens
gaatacttttgccctttga

SEQ ID NO: 5899671 - DNA, 14 bp, Homo sapiens
gaatactttttaca

SEQ ID NO: 5899672 - DNA, 13 bp, Homo sapiens
gaatagaaagaaa

SEQ ID NO: 5899673 - DNA, 15 bp, Homo sapiens
gaatagaaagaaagt

SEQ ID NO: 5899674 - DNA, 14 bp, Homo sapiens
gaatagaacttgaa

SEQ ID NO: 5899675 - DNA, 15 bp, Homo sapiens
gaatagaagaaagaa

SEQ ID NO: 5899676 - DNA, 12 bp, Homo sapiens
gaatagaaggaa

SEQ ID NO: 5899677 - DNA, 13 bp, Homo sapiens
gaatagaaggaaa

SEQ ID NO: 5899678 - DNA, 14 bp, Homo sapiens
gaatagaaggaaac

SEQ ID NO: 5899679 - DNA, 18 bp, Homo sapiens
gaatagaaggaaactagc

SEQ ID NO: 5899680 - DNA, 13 bp, Homo sapiens
gaatagaataaat

SEQ ID NO: 5899681 - DNA, 20 bp, Homo sapiens
gaatagacagaggtttcatt

SEQ ID NO: 5899682 - DNA, 16 bp, Homo sapiens
gaatagacataaattg

SEQ ID NO: 5899683 - DNA, 13 bp, Homo sapiens
gaatagagcctcg

SEQ ID NO: 5899684 - DNA, 13 bp, Homo sapiens
gaatagagctgcc

SEQ ID NO: 5899685 - DNA, 15 bp, Homo sapiens
gaatagagctgccac

SEQ ID NO: 5899686 - DNA, 14 bp, Homo sapiens
gaatagaggaagaa

SEQ ID NO: 5899687 - DNA, 15 bp, Homo sapiens
gaatagaggaagaaa

SEQ ID NO: 5899688 - DNA, 16 bp, Homo sapiens
gaatagaggccaaatt

SEQ ID NO: 5899689 - DNA, 23 bp, Homo sapiens
gaatagagggagtagaaagcttc

SEQ ID NO: 5899690 - DNA, 16 bp, Homo sapiens
gaatagataaattttg

SEQ ID NO: 5899691 - DNA, 16 bp, Homo sapiens
gaatagatatgaaagc

SEQ ID NO: 5899692 - DNA, 20 bp, Homo sapiens
gaatagatcagtatttcact

SEQ ID NO: 5899693 - DNA, 12 bp, Homo sapiens
gaatagatgtct

SEQ ID NO: 5899694 - DNA, 12 bp, Homo sapiens
gaatagatttta

SEQ ID NO: 5899695 - DNA, 20 bp, Homo sapiens
gaatagattttctctggaaa

SEQ ID NO: 5899696 - DNA, 23 bp, Homo sapiens
gaatagcacagccagacttgctt

SEQ ID NO: 5899697 - DNA, 22 bp, Homo sapiens
gaatagcagtggcaaaatatta

SEQ ID NO: 5899698 - DNA, 14 bp, Homo sapiens
gaatagcagtttca

SEQ ID NO: 5899699 - DNA, 20 bp, Homo sapiens
gaatagcatctgtacaaagg

SEQ ID NO: 5899700 - DNA, 18 bp, Homo sapiens
gaatagcatgttgtagat

SEQ ID NO: 5899701 - DNA, 23 bp, Homo sapiens
gaatagccacatttggaatactt

SEQ ID NO: 5899702 - DNA, 18 bp, Homo sapiens
gaatagccagagaggagc

SEQ ID NO: 5899703 - DNA, 23 bp, Homo sapiens
gaatagccatatttgtaaaatga

SEQ ID NO: 5899704 - DNA, 14 bp, Homo sapiens
gaatagcctggcca

SEQ ID NO: 5899705 - DNA, 15 bp, Homo sapiens
gaatagcctgtggcc

SEQ ID NO: 5899706 - DNA, 13 bp, Homo sapiens
gaatagcgacagg

SEQ ID NO: 5899707 - DNA, 14 bp, Homo sapiens
gaatagctgatgtg

SEQ ID NO: 5899708 - DNA, 19 bp, Homo sapiens
gaatagctgttttgtgtat

SEQ ID NO: 5899709 - DNA, 21 bp, Homo sapiens
gaatagctgttttgtgtatat

SEQ ID NO: 5899710 - DNA, 19 bp, Homo sapiens
gaatagctttaaaagggaa

SEQ ID NO: 5899711 - DNA, 12 bp, Homo sapiens
gaataggaaaac

SEQ ID NO: 5899712 - DNA, 14 bp, Homo sapiens
gaataggaaaacat

SEQ ID NO: 5899713 - DNA, 17 bp, Homo sapiens
gaataggaaataaaatt

SEQ ID NO: 5899714 - DNA, 22 bp, Homo sapiens
gaataggaaattgaacctgggg

SEQ ID NO: 5899715 - DNA, 19 bp, Homo sapiens
gaataggcattaaatgcaa

SEQ ID NO: 5899716 - DNA, 16 bp, Homo sapiens
gaataggcgatcacaa

SEQ ID NO: 5899717 - DNA, 22 bp, Homo sapiens
gaataggcgatcacaacgtgca

SEQ ID NO: 5899718 - DNA, 23 bp, Homo sapiens
gaataggcgatcacaacgtgcat

SEQ ID NO: 5899719 - DNA, 19 bp, Homo sapiens
gaatagggcccatgggagg

SEQ ID NO: 5899720 - DNA, 18 bp, Homo sapiens
gaataggggaaagaaatt

SEQ ID NO: 5899721 - DNA, 15 bp, Homo sapiens
gaataggtcattttc

SEQ ID NO: 5899722 - DNA, 16 bp, Homo sapiens
gaataggtgcaaacaa

SEQ ID NO: 5899723 - DNA, 15 bp, Homo sapiens
gaatagtatagacaa

SEQ ID NO: 5899724 - DNA, 16 bp, Homo sapiens
gaatagtatcctccag

SEQ ID NO: 5899725 - DNA, 17 bp, Homo sapiens
gaatagtatcctccagg

SEQ ID NO: 5899726 - DNA, 19 bp, Homo sapiens
gaatagtatcctccaggtt

SEQ ID NO: 5899727 - DNA, 21 bp, Homo sapiens
gaatagtatcctccaggtttt

SEQ ID NO: 5899728 - DNA, 14 bp, Homo sapiens
gaatagtattgtgt

SEQ ID NO: 5899729 - DNA, 16 bp, Homo sapiens
gaatagtcctaaaaag

SEQ ID NO: 5899730 - DNA, 18 bp, Homo sapiens
gaatagtcgcgcaagcat

SEQ ID NO: 5899731 - DNA, 16 bp, Homo sapiens
gaatagtctgtgtgca

SEQ ID NO: 5899732 - DNA, 20 bp, Homo sapiens
gaatagtgcctaaagtgctg

SEQ ID NO: 5899733 - DNA, 16 bp, Homo sapiens
gaatagtgcctcagcg

SEQ ID NO: 5899734 - DNA, 14 bp, Homo sapiens
gaatagtgcttgct

SEQ ID NO: 5899735 - DNA, 17 bp, Homo sapiens
gaatagtgcttgctggc

SEQ ID NO: 5899736 - DNA, 21 bp, Homo sapiens
gaatagttaaaaattaaatat

SEQ ID NO: 5899737 - DNA, 19 bp, Homo sapiens
gaatagttcaggagacttt

SEQ ID NO: 5899738 - DNA, 14 bp, Homo sapiens
gaatagttgtcaga

SEQ ID NO: 5899739 - DNA, 15 bp, Homo sapiens
gaatagtttatttct

SEQ ID NO: 5899740 - DNA, 14 bp, Homo sapiens
gaatagttttctcc

SEQ ID NO: 5899741 - DNA, 14 bp, Homo sapiens
gaatataaaacagt

SEQ ID NO: 5899742 - DNA, 21 bp, Homo sapiens
gaatataaacactatatggca

SEQ ID NO: 5899743 - DNA, 21 bp, Homo sapiens
gaatataaacatatacagaaa

SEQ ID NO: 5899744 - DNA, 18 bp, Homo sapiens
gaatataaagcttaataa

SEQ ID NO: 5899745 - DNA, 18 bp, Homo sapiens
gaatataaagttaaaaaa

SEQ ID NO: 5899746 - DNA, 14 bp, Homo sapiens
gaatataaatagct

SEQ ID NO: 5899747 - DNA, 14 bp, Homo sapiens
gaatataaatattt

SEQ ID NO: 5899748 - DNA, 13 bp, Homo sapiens
gaatataaatgtg

SEQ ID NO: 5899749 - DNA, 17 bp, Homo sapiens
gaatataacatgtaaaa

SEQ ID NO: 5899750 - DNA, 13 bp, Homo sapiens
gaatataagaaaa

SEQ ID NO: 5899751 - DNA, 22 bp, Homo sapiens
gaatataagaaaagtaatgaag

SEQ ID NO: 5899752 - DNA, 12 bp, Homo sapiens
gaatataatctg

SEQ ID NO: 5899753 - DNA, 14 bp, Homo sapiens
gaatataatgggaa

SEQ ID NO: 5899754 - DNA, 12 bp, Homo sapiens
gaatataattat

SEQ ID NO: 5899755 - DNA, 19 bp, Homo sapiens
gaatataattgttttatct

SEQ ID NO: 5899756 - DNA, 18 bp, Homo sapiens
gaatatacacattttgta

SEQ ID NO: 5899757 - DNA, 19 bp, Homo sapiens
gaatatacacattttgtaa

SEQ ID NO: 5899758 - DNA, 22 bp, Homo sapiens
gaatatacagcaggtgctcaat

SEQ ID NO: 5899759 - DNA, 16 bp, Homo sapiens
gaatataccttattta

SEQ ID NO: 5899760 - DNA, 18 bp, Homo sapiens
gaatatactgtcttgtct

SEQ ID NO: 5899761 - DNA, 16 bp, Homo sapiens
gaatatacttagaaaa

SEQ ID NO: 5899762 - DNA, 15 bp, Homo sapiens
gaatatagacagtgc

SEQ ID NO: 5899763 - DNA, 20 bp, Homo sapiens
gaatatagcatctttcatat

SEQ ID NO: 5899764 - DNA, 13 bp, Homo sapiens
gaatatagcctgc

SEQ ID NO: 5899765 - DNA, 16 bp, Homo sapiens
gaatatagcctgcctc

SEQ ID NO: 5899766 - DNA, 14 bp, Homo sapiens
gaatataggaagca

SEQ ID NO: 5899767 - DNA, 20 bp, Homo sapiens
gaatataggtctcttctccc

SEQ ID NO: 5899768 - DNA, 22 bp, Homo sapiens
gaatataggtctcttctcccag

SEQ ID NO: 5899769 - DNA, 14 bp, Homo sapiens
gaatatagttctgt

SEQ ID NO: 5899770 - DNA, 17 bp, Homo sapiens
gaatatagttctgtgta

SEQ ID NO: 5899771 - DNA, 23 bp, Homo sapiens
gaatatataaacgatatatgtaa

SEQ ID NO: 5899772 - DNA, 22 bp, Homo sapiens
gaatgaaaatgcagtcctgagg

SEQ ID NO: 5899773 - DNA, 21 bp, Homo sapiens
gaatgaaacccccacacacac

SEQ ID NO: 5899774 - DNA, 17 bp, Homo sapiens
gaatgaaagagagctct

SEQ ID NO: 5899775 - DNA, 12 bp, Homo sapiens
gaatgaaagagt

SEQ ID NO: 5899776 - DNA, 14 bp, Homo sapiens
gaatgaaagagtaa

SEQ ID NO: 5899777 - DNA, 14 bp, Homo sapiens
gaatgaaagctcct

SEQ ID NO: 5899778 - DNA, 14 bp, Homo sapiens
gaatgaaaggcctt

SEQ ID NO: 5899779 - DNA, 14 bp, Homo sapiens
gaatgaaagggccc

SEQ ID NO: 5899780 - DNA, 22 bp, Homo sapiens
gaatgaaatataaactgtgaga

SEQ ID NO: 5899781 - DNA, 19 bp, Homo sapiens
gaatgaaatatagatgtta

SEQ ID NO: 5899782 - DNA, 23 bp, Homo sapiens
gaatgaaatcctgcttcagtgta

SEQ ID NO: 5899783 - DNA, 11 bp, Homo sapiens
gaatgaaatga

SEQ ID NO: 5899784 - DNA, 22 bp, Homo sapiens
gaatgaaattcttttataaata

SEQ ID NO: 5899785 - DNA, 22 bp, Homo sapiens
gaatgaaccacatcttgctctg

SEQ ID NO: 5899786 - DNA, 19 bp, Homo sapiens
gaatgaacccctggctcct

SEQ ID NO: 5899787 - DNA, 12 bp, Homo sapiens
gaatgaactgtg

SEQ ID NO: 5899788 - DNA, 18 bp, Homo sapiens
gaatgaagacctaaatga

SEQ ID NO: 5899789 - DNA, 19 bp, Homo sapiens
gaatgaagataagtaattt

SEQ ID NO: 5899790 - DNA, 21 bp, Homo sapiens
gaatgaagataccatcagcaa

SEQ ID NO: 5899791 - DNA, 19 bp, Homo sapiens
gaatgaagatactgaaata

SEQ ID NO: 5899792 - DNA, 16 bp, Homo sapiens
gaatgaagcttgtgta

SEQ ID NO: 5899793 - DNA, 14 bp, Homo sapiens
gaatgaagttctgc

SEQ ID NO: 5899794 - DNA, 17 bp, Homo sapiens
gaatgaagttgtacttc

SEQ ID NO: 5899795 - DNA, 14 bp, Homo sapiens
gaatgaataactaa

SEQ ID NO: 5899796 - DNA, 21 bp, Homo sapiens
gaatgaatgggatattttgaa

SEQ ID NO: 5899797 - DNA, 22 bp, Homo sapiens
gaatgaatgggatattttgaaa

SEQ ID NO: 5899798 - DNA, 11 bp, Homo sapiens
gaatgaatgtc

SEQ ID NO: 5899799 - DNA, 17 bp, Homo sapiens
gaatgaatttatcttta

SEQ ID NO: 5899800 - DNA, 12 bp, Homo sapiens
gaatgaatttca

SEQ ID NO: 5899801 - DNA, 14 bp, Homo sapiens
gaatgacagccttt

SEQ ID NO: 5899802 - DNA, 20 bp, Homo sapiens
gaatgaccacgggcctcagt

SEQ ID NO: 5899803 - DNA, 22 bp, Homo sapiens
gaatgaccacgggcctcagttt

SEQ ID NO: 5899804 - DNA, 16 bp, Homo sapiens
gaatgaccagcatgat

SEQ ID NO: 5899805 - DNA, 13 bp, Homo sapiens
gaatgaccctgtc

SEQ ID NO: 5899806 - DNA, 19 bp, Homo sapiens
gaatgaccctgtcaagctt

SEQ ID NO: 5899807 - DNA, 17 bp, Homo sapiens
gaatgacctggccgcag

SEQ ID NO: 5899808 - DNA, 18 bp, Homo sapiens
gaatgaccttgttgcatg

SEQ ID NO: 5899809 - DNA, 20 bp, Homo sapiens
gaatgactatgtccagattg

SEQ ID NO: 5899810 - DNA, 17 bp, Homo sapiens
gaatgactccaggaaga

SEQ ID NO: 5899811 - DNA, 16 bp, Homo sapiens
gaatgactgaaagaag

SEQ ID NO: 5899812 - DNA, 21 bp, Homo sapiens
gaatgactgaaagaagaacag

SEQ ID NO: 5899813 - DNA, 20 bp, Homo sapiens
gaatgacttccccaatatct

SEQ ID NO: 5899814 - DNA, 14 bp, Homo sapiens
gaatgagaaagaaa

SEQ ID NO: 5899815 - DNA, 16 bp, Homo sapiens
gaatgagaaagaaaag

SEQ ID NO: 5899816 - DNA, 12 bp, Homo sapiens
gaatgagaaatc

SEQ ID NO: 5899817 - DNA, 16 bp, Homo sapiens
gaatgagaaatcatgt

SEQ ID NO: 5899818 - DNA, 20 bp, Homo sapiens
gaatgagaagtaaattattt

SEQ ID NO: 5899819 - DNA, 17 bp, Homo sapiens
gaatgagaatgtgccat

SEQ ID NO: 5899820 - DNA, 21 bp, Homo sapiens
gaatgagaatgtgccatgtat

SEQ ID NO: 5899821 - DNA, 22 bp, Homo sapiens
gaatgagagacacactgaagaa

SEQ ID NO: 5899822 - DNA, 12 bp, Homo sapiens
gaatgagagagt

SEQ ID NO: 5899823 - DNA, 17 bp, Homo sapiens
gaatgagagcgacacag

SEQ ID NO: 5899824 - DNA, 18 bp, Homo sapiens
gaatgagagcgacacaga

SEQ ID NO: 5899825 - DNA, 19 bp, Homo sapiens
gaatgagagcgacacagac

SEQ ID NO: 5899826 - DNA, 16 bp, Homo sapiens
gaatgagatgatttaa

SEQ ID NO: 5899827 - DNA, 17 bp, Homo sapiens
gaatgagcattctgcag

SEQ ID NO: 5899828 - DNA, 13 bp, Homo sapiens
gaatgagcccaga

SEQ ID NO: 5899829 - DNA, 19 bp, Homo sapiens
gaatgagcccagagaacag

SEQ ID NO: 5899830 - DNA, 11 bp, Homo sapiens
gaatgagcctc

SEQ ID NO: 5899831 - DNA, 23 bp, Homo sapiens
gaatgaggaataataagttaaac

SEQ ID NO: 5899832 - DNA, 23 bp, Homo sapiens
gaatgaggcacttatcagcatga

SEQ ID NO: 5899833 - DNA, 19 bp, Homo sapiens
gaatgaggcggagctccag

SEQ ID NO: 5899834 - DNA, 17 bp, Homo sapiens
gaatgaggcttgctgag

SEQ ID NO: 5899835 - DNA, 12 bp, Homo sapiens
gaatgagggagg

SEQ ID NO: 5899836 - DNA, 13 bp, Homo sapiens
gaatgagggaggc

SEQ ID NO: 5899837 - DNA, 19 bp, Homo sapiens
gaatgagggcgtgaaacac

SEQ ID NO: 5899838 - DNA, 12 bp, Homo sapiens
gaatgagggggc

SEQ ID NO: 5899839 - DNA, 16 bp, Homo sapiens
gaatgaggtcccaggc

SEQ ID NO: 5899840 - DNA, 18 bp, Homo sapiens
gaatgaggtcccaggcag

SEQ ID NO: 5899841 - DNA, 19 bp, Homo sapiens
gaatgaggtcccaggcaga

SEQ ID NO: 5899842 - DNA, 15 bp, Homo sapiens
gaatgaggtctgggc

SEQ ID NO: 5899843 - DNA, 14 bp, Homo sapiens
gaatgaggtgggag

SEQ ID NO: 5899844 - DNA, 19 bp, Homo sapiens
gaatgagtcaatcagcctt

SEQ ID NO: 5899845 - DNA, 19 bp, Homo sapiens
gaatgagtgggctgtagtt

SEQ ID NO: 5899846 - DNA, 16 bp, Homo sapiens
gaatgagttgaggcca

SEQ ID NO: 5899847 - DNA, 16 bp, Homo sapiens
gaatgatcatctgtaa

SEQ ID NO: 5899848 - DNA, 19 bp, Homo sapiens
gaatgatcatctgtaatct

SEQ ID NO: 5899849 - DNA, 18 bp, Homo sapiens
gaatgatcattgaaagta

SEQ ID NO: 5899850 - DNA, 13 bp, Homo sapiens
gaatgatctattc

SEQ ID NO: 5899851 - DNA, 13 bp, Homo sapiens
gaatgatctgatt

SEQ ID NO: 5899852 - DNA, 22 bp, Homo sapiens
gaatgatcttgtgtaaggtttt

SEQ ID NO: 5899853 - DNA, 23 bp, Homo sapiens
gaatgatgctcaaaatctttcca

SEQ ID NO: 5899854 - DNA, 22 bp, Homo sapiens
gaatgatgggcttttgttctga

SEQ ID NO: 5899855 - DNA, 18 bp, Homo sapiens
gaatgatgtatataaaat

SEQ ID NO: 5899856 - DNA, 22 bp, Homo sapiens
gaatgatgttttaaaaaaattt

SEQ ID NO: 5899857 - DNA, 16 bp, Homo sapiens
gaatgattaaattatg

SEQ ID NO: 5899858 - DNA, 16 bp, Homo sapiens
gaatgattaatcaaag

SEQ ID NO: 5899859 - DNA, 21 bp, Homo sapiens
gaatgattaatcataaagaaa

SEQ ID NO: 5899860 - DNA, 22 bp, Homo sapiens
gaatgattatgaattacatttg

SEQ ID NO: 5899861 - DNA, 15 bp, Homo sapiens
gaatgattcagtgtt

SEQ ID NO: 5899862 - DNA, 20 bp, Homo sapiens
gaatgattggtagcaaagga

SEQ ID NO: 5899863 - DNA, 20 bp, Homo sapiens
gaatgattggttaaaatgtg

SEQ ID NO: 5899864 - DNA, 20 bp, Homo sapiens
gaatgatttaaatagaactt

SEQ ID NO: 5899865 - DNA, 14 bp, Homo sapiens
gaatgatttcatgc

SEQ ID NO: 5899866 - DNA, 14 bp, Homo sapiens
gaatgatttttctt

SEQ ID NO: 5899867 - DNA, 18 bp, Homo sapiens
gaatgatttttctttaca

SEQ ID NO: 5899868 - DNA, 15 bp, Homo sapiens
gaatgcaaaaagata

SEQ ID NO: 5899869 - DNA, 15 bp, Homo sapiens
gaatgcaagagaagg

SEQ ID NO: 5899870 - DNA, 18 bp, Homo sapiens
gaatgcaagagaaggaga

SEQ ID NO: 5899871 - DNA, 19 bp, Homo sapiens
gaatgcaatataaaaatgt

SEQ ID NO: 5899872 - DNA, 22 bp, Homo sapiens
gaatgcaatataaaaatgtgaa

SEQ ID NO: 5899873 - DNA, 21 bp, Homo sapiens
gaatgcacaaacagaggccgc

SEQ ID NO: 5899874 - DNA, 20 bp, Homo sapiens
gaatgcacaagaatggatca

SEQ ID NO: 5899875 - DNA, 21 bp, Homo sapiens
gaatgcacaagaatggatcac

SEQ ID NO: 5899876 - DNA, 22 bp, Homo sapiens
gaatgcacaccaaaaaaatact

SEQ ID NO: 5899877 - DNA, 21 bp, Homo sapiens
gaatgcacattggaagctccc

SEQ ID NO: 5899878 - DNA, 22 bp, Homo sapiens
gaatgcacattggaagctccca

SEQ ID NO: 5899879 - DNA, 22 bp, Homo sapiens
gaatgcaccacggcagctctcc

SEQ ID NO: 5899880 - DNA, 14 bp, Homo sapiens
gaatgcacctcccc

SEQ ID NO: 5899881 - DNA, 14 bp, Homo sapiens
gaatgcagaaaaca

SEQ ID NO: 5899882 - DNA, 18 bp, Homo sapiens
gaatgcagaggtctccaa

SEQ ID NO: 5899883 - DNA, 19 bp, Homo sapiens
gaatgcagattcctgggcc

SEQ ID NO: 5899884 - DNA, 20 bp, Homo sapiens
gaatgcagattcctgggcct

SEQ ID NO: 5899885 - DNA, 21 bp, Homo sapiens
gaatgcagattcctgggcctg

SEQ ID NO: 5899886 - DNA, 23 bp, Homo sapiens
gaatgcagattcctgggcctgtc

SEQ ID NO: 5899887 - DNA, 23 bp, Homo sapiens
gaatgcagcactgctgcctcagc

SEQ ID NO: 5899888 - DNA, 16 bp, Homo sapiens
gaatgcagcaggaagg

SEQ ID NO: 5899889 - DNA, 13 bp, Homo sapiens
gaatgcagcccac

SEQ ID NO: 5899890 - DNA, 18 bp, Homo sapiens
gaatgcagcccaccagga

SEQ ID NO: 5899891 - DNA, 18 bp, Homo sapiens
gaatgcaggccccgcccc

SEQ ID NO: 5899892 - DNA, 21 bp, Homo sapiens
gaatgcagggaagagggcagt

SEQ ID NO: 5899893 - DNA, 22 bp, Homo sapiens
gaatgcagggaatgcaatcctt

SEQ ID NO: 5899894 - DNA, 11 bp, Homo sapiens
gaatgcagtgg

SEQ ID NO: 5899895 - DNA, 14 bp, Homo sapiens
gaatgcagtgggtg

SEQ ID NO: 5899896 - DNA, 17 bp, Homo sapiens
gaatgcataatgtttaa

SEQ ID NO: 5899897 - DNA, 15 bp, Homo sapiens
gaatgcatggggcgg

SEQ ID NO: 5899898 - DNA, 15 bp, Homo sapiens
gaatgcattaaaaaa

SEQ ID NO: 5899899 - DNA, 16 bp, Homo sapiens
gaatgcattaaaaaaa

SEQ ID NO: 5899900 - DNA, 12 bp, Homo sapiens
gaatgcattgat

SEQ ID NO: 5899901 - DNA, 21 bp, Homo sapiens
gaatgcattgatattgtgaac

SEQ ID NO: 5899902 - DNA, 14 bp, Homo sapiens
gaatgcattttgtt

SEQ ID NO: 5899903 - DNA, 14 bp, Homo sapiens
gaatgccataaaat

SEQ ID NO: 5899904 - DNA, 21 bp, Homo sapiens
gaatgccatagtcaaagagag

SEQ ID NO: 5899905 - DNA, 22 bp, Homo sapiens
gaatgccatttagaatctagaa

SEQ ID NO: 5899906 - DNA, 23 bp, Homo sapiens
gaatgccatttagaatctagaaa

SEQ ID NO: 5899907 - DNA, 13 bp, Homo sapiens
gaatgccatttct

SEQ ID NO: 5899908 - DNA, 17 bp, Homo sapiens
gaatgccatttctcacg

SEQ ID NO: 5899909 - DNA, 22 bp, Homo sapiens
gaatgcccacaggcaaatgcat

SEQ ID NO: 5899910 - DNA, 19 bp, Homo sapiens
gaatgcccaggaagtaatt

SEQ ID NO: 5899911 - DNA, 20 bp, Homo sapiens
gaatgcccctgttcatgttt

SEQ ID NO: 5899912 - DNA, 15 bp, Homo sapiens
gaatgccctgaaact

SEQ ID NO: 5899913 - DNA, 18 bp, Homo sapiens
gaatgccgcgatgggtca

SEQ ID NO: 5899914 - DNA, 15 bp, Homo sapiens
gaatgcctaggtccc

SEQ ID NO: 5899915 - DNA, 21 bp, Homo sapiens
gaatgcctcaatgtgaccagg

SEQ ID NO: 5899916 - DNA, 14 bp, Homo sapiens
gaatgcctcctgtg

SEQ ID NO: 5899917 - DNA, 17 bp, Homo sapiens
gaatgcctcctgtgggg

SEQ ID NO: 5899918 - DNA, 16 bp, Homo sapiens
gaatgcctcgctccct

SEQ ID NO: 5899919 - DNA, 20 bp, Homo sapiens
gaatgcctcgctcccttcaa

SEQ ID NO: 5899920 - DNA, 16 bp, Homo sapiens
gaatgcctgagtgcct

SEQ ID NO: 5899921 - DNA, 12 bp, Homo sapiens
gaatgcctggag

SEQ ID NO: 5899922 - DNA, 12 bp, Homo sapiens
gaatgcctgtgc

SEQ ID NO: 5899923 - DNA, 14 bp, Homo sapiens
gaatgcctgtgcca

SEQ ID NO: 5899924 - DNA, 14 bp, Homo sapiens
gaatgccttatttt

SEQ ID NO: 5899925 - DNA, 22 bp, Homo sapiens
gaatgccttatttttgaattct

SEQ ID NO: 5899926 - DNA, 13 bp, Homo sapiens
gaatgccttggaa

SEQ ID NO: 5899927 - DNA, 23 bp, Homo sapiens
gaatgcgctcttcaccaggaaga

SEQ ID NO: 5899928 - DNA, 20 bp, Homo sapiens
gaatgcgctttattgcccat

SEQ ID NO: 5899929 - DNA, 23 bp, Homo sapiens
gaatgcggcaagaaggaattgac

SEQ ID NO: 5899930 - DNA, 21 bp, Homo sapiens
gaatgcggccgcattccctga

SEQ ID NO: 5899931 - DNA, 20 bp, Homo sapiens
gaatgcgggggagcaggcag

SEQ ID NO: 5899932 - DNA, 14 bp, Homo sapiens
gaatgctaagtcca

SEQ ID NO: 5899933 - DNA, 16 bp, Homo sapiens
gaatgctatttcactt

SEQ ID NO: 5899934 - DNA, 17 bp, Homo sapiens
gaatgctcaatgtgctg

SEQ ID NO: 5899935 - DNA, 12 bp, Homo sapiens
gaatgctcaggg

SEQ ID NO: 5899936 - DNA, 13 bp, Homo sapiens
gaatgctcccagc

SEQ ID NO: 5899937 - DNA, 20 bp, Homo sapiens
gaatgctcccccatcctccc

SEQ ID NO: 5899938 - DNA, 22 bp, Homo sapiens
gaatgctcccccatcctcccct

SEQ ID NO: 5899939 - DNA, 23 bp, Homo sapiens
gaatgctcccccatcctcccctt

SEQ ID NO: 5899940 - DNA, 15 bp, Homo sapiens
gaatgctgaaaccaa

SEQ ID NO: 5899941 - DNA, 19 bp, Homo sapiens
gaatgctgaactccttgtt

SEQ ID NO: 5899942 - DNA, 19 bp, Homo sapiens
gaatgctgacaatgctgcc

SEQ ID NO: 5899943 - DNA, 17 bp, Homo sapiens
gaatgctgcaacttttt

SEQ ID NO: 5899944 - DNA, 11 bp, Homo sapiens
gaatgctgcca

SEQ ID NO: 5899945 - DNA, 12 bp, Homo sapiens
gaatgctgccag

SEQ ID NO: 5899946 - DNA, 18 bp, Homo sapiens
gaatgctggactggaggc

SEQ ID NO: 5899947 - DNA, 19 bp, Homo sapiens
gaatgctgggactcagcct

SEQ ID NO: 5899948 - DNA, 12 bp, Homo sapiens
gaatgctgggcc

SEQ ID NO: 5899949 - DNA, 19 bp, Homo sapiens
gaatgttaacaggtatttt

SEQ ID NO: 5899950 - DNA, 13 bp, Homo sapiens
gaatgttaacatg

SEQ ID NO: 5899951 - DNA, 15 bp, Homo sapiens
gaatgttaatttatt

SEQ ID NO: 5899952 - DNA, 22 bp, Homo sapiens
gaatgttaattttttggtacaa

SEQ ID NO: 5899953 - DNA, 16 bp, Homo sapiens
gaatgttaccagactt

SEQ ID NO: 5899954 - DNA, 20 bp, Homo sapiens
gaatgttaccagacttcaag

SEQ ID NO: 5899955 - DNA, 16 bp, Homo sapiens
gaatgttactttggaa

SEQ ID NO: 5899956 - DNA, 23 bp, Homo sapiens
gaatgttagaagaggcctttgga

SEQ ID NO: 5899957 - DNA, 22 bp, Homo sapiens
gaatgttatatcatcaatactt

SEQ ID NO: 5899958 - DNA, 14 bp, Homo sapiens
gaatgttatcagta

SEQ ID NO: 5899959 - DNA, 20 bp, Homo sapiens
gaatgttcatatagccaggg

SEQ ID NO: 5899960 - DNA, 16 bp, Homo sapiens
gaatgttccctgcacc

SEQ ID NO: 5899961 - DNA, 22 bp, Homo sapiens
gaatgttcctgcctccttgata

SEQ ID NO: 5899962 - DNA, 16 bp, Homo sapiens
gaatgttctgacatta

SEQ ID NO: 5899963 - DNA, 13 bp, Homo sapiens
gaatgttctttct

SEQ ID NO: 5899964 - DNA, 14 bp, Homo sapiens
gaatgttgggactg

SEQ ID NO: 5899965 - DNA, 23 bp, Homo sapiens
gaatgttgggactgctaaataaa

SEQ ID NO: 5899966 - DNA, 22 bp, Homo sapiens
gaatgttggtttactttcaaat

SEQ ID NO: 5899967 - DNA, 23 bp, Homo sapiens
gaatgttggttttaatacttgat

SEQ ID NO: 5899968 - DNA, 16 bp, Homo sapiens
gaatgttgtacttgaa

SEQ ID NO: 5899969 - DNA, 18 bp, Homo sapiens
gaatgttgtcctgtgtca

SEQ ID NO: 5899970 - DNA, 15 bp, Homo sapiens
gaatgttgttaaatg

SEQ ID NO: 5899971 - DNA, 21 bp, Homo sapiens
gaatgtttaaagatcatgaca

SEQ ID NO: 5899972 - DNA, 14 bp, Homo sapiens
gaatgtttattcct

SEQ ID NO: 5899973 - DNA, 20 bp, Homo sapiens
gaatgtttcagctgcagttg

SEQ ID NO: 5899974 - DNA, 12 bp, Homo sapiens
gaatgtttcagt

SEQ ID NO: 5899975 - DNA, 13 bp, Homo sapiens
gaatgtttccggg

SEQ ID NO: 5899976 - DNA, 19 bp, Homo sapiens
gaatgtttcctgtggaaat

SEQ ID NO: 5899977 - DNA, 15 bp, Homo sapiens
gaatgtttctatttc

SEQ ID NO: 5899978 - DNA, 23 bp, Homo sapiens
gaatgtttcttaactataaatat

SEQ ID NO: 5899979 - DNA, 19 bp, Homo sapiens
gaatgtttgcctctgcctc

SEQ ID NO: 5899980 - DNA, 17 bp, Homo sapiens
gaatgtttgtgtctgtg

SEQ ID NO: 5899981 - DNA, 20 bp, Homo sapiens
gaatgtttgtttcagtgcca

SEQ ID NO: 5899982 - DNA, 15 bp, Homo sapiens
gaatgttttaaattc

SEQ ID NO: 5899983 - DNA, 18 bp, Homo sapiens
gaatgttttatttatcaa

SEQ ID NO: 5899984 - DNA, 16 bp, Homo sapiens
gaatgttttgcactga

SEQ ID NO: 5899985 - DNA, 21 bp, Homo sapiens
gaatgtttttccctccccaga

SEQ ID NO: 5899986 - DNA, 14 bp, Homo sapiens
gaatgtttttctaa

SEQ ID NO: 5899987 - DNA, 16 bp, Homo sapiens
gaattaaaaagaagat

SEQ ID NO: 5899988 - DNA, 12 bp, Homo sapiens
gaattaaaacaa

SEQ ID NO: 5899989 - DNA, 18 bp, Homo sapiens
gaattaaaacaaaacaaa

SEQ ID NO: 5899990 - DNA, 13 bp, Homo sapiens
gaattaaaacaat

SEQ ID NO: 5899991 - DNA, 11 bp, Homo sapiens
gaattaaaact

SEQ ID NO: 5899992 - DNA, 13 bp, Homo sapiens
gaattaaaactca

SEQ ID NO: 5899993 - DNA, 14 bp, Homo sapiens
gaattaaaacttct

SEQ ID NO: 5899994 - DNA, 15 bp, Homo sapiens
gaattaaaactttgt

SEQ ID NO: 5899995 - DNA, 15 bp, Homo sapiens
gaattaaaataacag

SEQ ID NO: 5899996 - DNA, 12 bp, Homo sapiens
gaattaaaatgg

SEQ ID NO: 5899997 - DNA, 11 bp, Homo sapiens
gaattaaaatt

SEQ ID NO: 5899998 - DNA, 13 bp, Homo sapiens
gaattaaaattta

SEQ ID NO: 5899999 - DNA, 18 bp, Homo sapiens
gaattaaactaaaataca

SEQ ID NO: 5900000 - DNA, 22 bp, Homo sapiens
gaattaaagtggaccaataggg

SEQ ID NO: 5900001 - DNA, 21 bp, Homo sapiens
gaattaacacagtgtttcaat

SEQ ID NO: 5900002 - DNA, 22 bp, Homo sapiens
gaattaacacagtgtttcaatt

SEQ ID NO: 5900003 - DNA, 15 bp, Homo sapiens
gaattaaccattgct

SEQ ID NO: 5900004 - DNA, 18 bp, Homo sapiens
gaattaaccatttaataa

SEQ ID NO: 5900005 - DNA, 21 bp, Homo sapiens
gaattaactataacaatcact

SEQ ID NO: 5900006 - DNA, 15 bp, Homo sapiens
gaattaagaaagatt

SEQ ID NO: 5900007 - DNA, 13 bp, Homo sapiens
gaattaagaatat

SEQ ID NO: 5900008 - DNA, 14 bp, Homo sapiens
gaattaagttattg

SEQ ID NO: 5900009 - DNA, 14 bp, Homo sapiens
gaattaatatttat

SEQ ID NO: 5900010 - DNA, 17 bp, Homo sapiens
gaattaatggtcatttg

SEQ ID NO: 5900011 - DNA, 15 bp, Homo sapiens
gaattaatttctaaa

SEQ ID NO: 5900012 - DNA, 23 bp, Homo sapiens
gaattacaattactccttttatt

SEQ ID NO: 5900013 - DNA, 15 bp, Homo sapiens
gaattacaatttctt

SEQ ID NO: 5900014 - DNA, 18 bp, Homo sapiens
gaattacaccacaagtat

SEQ ID NO: 5900015 - DNA, 22 bp, Homo sapiens
gaattacactcaaggaaaagat

SEQ ID NO: 5900016 - DNA, 14 bp, Homo sapiens
gaattacagaaaat

SEQ ID NO: 5900017 - DNA, 20 bp, Homo sapiens
gaattacagggaagaaatca

SEQ ID NO: 5900018 - DNA, 13 bp, Homo sapiens
gaattacatttgt

SEQ ID NO: 5900019 - DNA, 20 bp, Homo sapiens
gaattacatttgtataaaat

SEQ ID NO: 5900020 - DNA, 19 bp, Homo sapiens
gaattaccaagaatatcct

SEQ ID NO: 5900021 - DNA, 15 bp, Homo sapiens
gaattaccaagagaa

SEQ ID NO: 5900022 - DNA, 17 bp, Homo sapiens
gaattaccaagagaagg

SEQ ID NO: 5900023 - DNA, 18 bp, Homo sapiens
gaattaccaagagaaggg

SEQ ID NO: 5900024 - DNA, 18 bp, Homo sapiens
gaattaccatagagtaat

SEQ ID NO: 5900025 - DNA, 20 bp, Homo sapiens
gaattaccattaattacata

SEQ ID NO: 5900026 - DNA, 15 bp, Homo sapiens
gaattacgtgctctg

SEQ ID NO: 5900027 - DNA, 19 bp, Homo sapiens
gaattacgtgctctgtggg

SEQ ID NO: 5900028 - DNA, 23 bp, Homo sapiens
gaattactaacttctaaaactgt

SEQ ID NO: 5900029 - DNA, 12 bp, Homo sapiens
gaattactccaa

SEQ ID NO: 5900030 - DNA, 20 bp, Homo sapiens
gaattactccaaaaagacaa

SEQ ID NO: 5900031 - DNA, 15 bp, Homo sapiens
gaattactgtatata

SEQ ID NO: 5900032 - DNA, 18 bp, Homo sapiens
gaattactttcctcctcc

SEQ ID NO: 5900033 - DNA, 15 bp, Homo sapiens
gaattactttgtgtt

SEQ ID NO: 5900034 - DNA, 20 bp, Homo sapiens
gaattagaaaagttaacatt

SEQ ID NO: 5900035 - DNA, 17 bp, Homo sapiens
gaattagaagtctttca

SEQ ID NO: 5900036 - DNA, 21 bp, Homo sapiens
gaattagacctttatttttct

SEQ ID NO: 5900037 - DNA, 18 bp, Homo sapiens
gaattagagaagctgaaa

SEQ ID NO: 5900038 - DNA, 16 bp, Homo sapiens
gaattagagggccttg

SEQ ID NO: 5900039 - DNA, 21 bp, Homo sapiens
gaattagagggccttgcttct

SEQ ID NO: 5900040 - DNA, 22 bp, Homo sapiens
gaattagagggccttgcttctc

SEQ ID NO: 5900041 - DNA, 13 bp, Homo sapiens
gaattagatgttt

SEQ ID NO: 5900042 - DNA, 15 bp, Homo sapiens
gaattagatgtttat

SEQ ID NO: 5900043 - DNA, 15 bp, Homo sapiens
gaattagattatatt

SEQ ID NO: 5900044 - DNA, 18 bp, Homo sapiens
gaattagattatttctgt

SEQ ID NO: 5900045 - DNA, 14 bp, Homo sapiens
gaattagtatttca

SEQ ID NO: 5900046 - DNA, 15 bp, Homo sapiens
gaattagtttgcact

SEQ ID NO: 5900047 - DNA, 15 bp, Homo sapiens
gaattataaatgtgt

SEQ ID NO: 5900048 - DNA, 20 bp, Homo sapiens
gaattataaatgtgtttata

SEQ ID NO: 5900049 - DNA, 13 bp, Homo sapiens
gaattataacagt

SEQ ID NO: 5900050 - DNA, 19 bp, Homo sapiens
gaattataacagttatatt

SEQ ID NO: 5900051 - DNA, 20 bp, Homo sapiens
gaattatacagacctaatat

SEQ ID NO: 5900052 - DNA, 13 bp, Homo sapiens
gaattatacagta

SEQ ID NO: 5900053 - DNA, 12 bp, Homo sapiens
gaattatactcc

SEQ ID NO: 5900054 - DNA, 19 bp, Homo sapiens
gaattatactttgttgttt

SEQ ID NO: 5900055 - DNA, 17 bp, Homo sapiens
gaattatatctaattta

SEQ ID NO: 5900056 - DNA, 18 bp, Homo sapiens
gaattatatctaatttat

SEQ ID NO: 5900057 - DNA, 18 bp, Homo sapiens
gaattatcagcaaagaaa

SEQ ID NO: 5900058 - DNA, 20 bp, Homo sapiens
gaattatcagcaaagaaaaa

SEQ ID NO: 5900059 - DNA, 22 bp, Homo sapiens
gaattatccattacgtgcattt

SEQ ID NO: 5900060 - DNA, 23 bp, Homo sapiens
gaattatccctgctggctttctt

SEQ ID NO: 5900061 - DNA, 14 bp, Homo sapiens
gaattatctaattt

SEQ ID NO: 5900062 - DNA, 14 bp, Homo sapiens
gaattatctcaagt

SEQ ID NO: 5900063 - DNA, 16 bp, Homo sapiens
gaattatctcaagtaa

SEQ ID NO: 5900064 - DNA, 21 bp, Homo sapiens
gaattatctcaagtaaaacaa

SEQ ID NO: 5900065 - DNA, 17 bp, Homo sapiens
gaattatcttggatgag

SEQ ID NO: 5900066 - DNA, 14 bp, Homo sapiens
gaattatgaaactt

SEQ ID NO: 5900067 - DNA, 14 bp, Homo sapiens
gaattatgaggcat

SEQ ID NO: 5900068 - DNA, 14 bp, Homo sapiens
gaattatgggaaac

SEQ ID NO: 5900069 - DNA, 23 bp, Homo sapiens
gaattatgtaatatattgtacaa

SEQ ID NO: 5900070 - DNA, 15 bp, Homo sapiens
gaattatgttttgac

SEQ ID NO: 5900071 - DNA, 16 bp, Homo sapiens
gaattattacatcttt

SEQ ID NO: 5900072 - DNA, 19 bp, Homo sapiens
gaattattagcaccagctt

SEQ ID NO: 5900073 - DNA, 20 bp, Homo sapiens
gaattattagcaccagcttg

SEQ ID NO: 5900074 - DNA, 20 bp, Homo sapiens
gaattattcaatttatttga

SEQ ID NO: 5900075 - DNA, 15 bp, Homo sapiens
gaattattcagtgaa

SEQ ID NO: 5900076 - DNA, 21 bp, Homo sapiens
gaattattcagtgaatttgtc

SEQ ID NO: 5900077 - DNA, 20 bp, Homo sapiens
gaattattctgattcttttt

SEQ ID NO: 5900078 - DNA, 19 bp, Homo sapiens
gaattatttctttattaac

SEQ ID NO: 5900079 - DNA, 13 bp, Homo sapiens
gaattattttgaa

SEQ ID NO: 5900080 - DNA, 19 bp, Homo sapiens
gaattattttgataaatta

SEQ ID NO: 5900081 - DNA, 15 bp, Homo sapiens
gaattattttgttac

SEQ ID NO: 5900082 - DNA, 21 bp, Homo sapiens
gaattatttttgagcaggagc

SEQ ID NO: 5900083 - DNA, 22 bp, Homo sapiens
gaattatttttgagcaggagca

SEQ ID NO: 5900084 - DNA, 20 bp, Homo sapiens
gaattatttttgtgtttcta

SEQ ID NO: 5900085 - DNA, 19 bp, Homo sapiens
gaattatttttttaaagtg

SEQ ID NO: 5900086 - DNA, 22 bp, Homo sapiens
gaattcaaactggggcctccag

SEQ ID NO: 5900087 - DNA, 16 bp, Homo sapiens
gaattcaaagcttgtg

SEQ ID NO: 5900088 - DNA, 17 bp, Homo sapiens
gaattcaaagcttgtga

SEQ ID NO: 5900089 - DNA, 18 bp, Homo sapiens
gaattcaaattttatctg

SEQ ID NO: 5900090 - DNA, 19 bp, Homo sapiens
gaattcacacaactacttt

SEQ ID NO: 5900091 - DNA, 14 bp, Homo sapiens
gaattcacacctta

SEQ ID NO: 5900092 - DNA, 23 bp, Homo sapiens
gaattcaccagtgttcctgaagc

SEQ ID NO: 5900093 - DNA, 14 bp, Homo sapiens
gaattcacccctcc

SEQ ID NO: 5900094 - DNA, 22 bp, Homo sapiens
gaattcacccctcccacctctt

SEQ ID NO: 5900095 - DNA, 17 bp, Homo sapiens
gaattcagcaccctggg

SEQ ID NO: 5900096 - DNA, 18 bp, Homo sapiens
gaattcagcaccctgggt

SEQ ID NO: 5900097 - DNA, 19 bp, Homo sapiens
gaattcagcaccctgggtg

SEQ ID NO: 5900098 - DNA, 16 bp, Homo sapiens
gaattcagtagcattt

SEQ ID NO: 5900099 - DNA, 22 bp, Homo sapiens
gaattcagttgctttgcccaag

SEQ ID NO: 5900100 - DNA, 17 bp, Homo sapiens
gaattcatactctgttg

SEQ ID NO: 5900101 - DNA, 15 bp, Homo sapiens
gaattcatcccctcc

SEQ ID NO: 5900102 - DNA, 17 bp, Homo sapiens
gaattcatcccctcccc

SEQ ID NO: 5900103 - DNA, 12 bp, Homo sapiens
gaattcattcat

SEQ ID NO: 5900104 - DNA, 21 bp, Homo sapiens
gaattcattctggaggggcag

SEQ ID NO: 5900105 - DNA, 21 bp, Homo sapiens
gaattcattgtctcagtgaag

SEQ ID NO: 5900106 - DNA, 14 bp, Homo sapiens
gaattccaaagcaa

SEQ ID NO: 5900107 - DNA, 15 bp, Homo sapiens
gaattccaactcact

SEQ ID NO: 5900108 - DNA, 13 bp, Homo sapiens
gaattccaaggag

SEQ ID NO: 5900109 - DNA, 16 bp, Homo sapiens
gaattccaagtgtatt

SEQ ID NO: 5900110 - DNA, 16 bp, Homo sapiens
gaattccacagggacc

SEQ ID NO: 5900111 - DNA, 18 bp, Homo sapiens
gaattccacagggaccag

SEQ ID NO: 5900112 - DNA, 19 bp, Homo sapiens
gaattccagtcccctttct

SEQ ID NO: 5900113 - DNA, 14 bp, Homo sapiens
gaattcccagactc

SEQ ID NO: 5900114 - DNA, 14 bp, Homo sapiens
gaattccctcactc

SEQ ID NO: 5900115 - DNA, 15 bp, Homo sapiens
gaattccctccccct

SEQ ID NO: 5900116 - DNA, 21 bp, Homo sapiens
gaattcccttgaattgtgtat

SEQ ID NO: 5900117 - DNA, 15 bp, Homo sapiens
gaattcccttttaat

SEQ ID NO: 5900118 - DNA, 12 bp, Homo sapiens
gaattcctcttt

SEQ ID NO: 5900119 - DNA, 17 bp, Homo sapiens
gaattcctctttaacaa

SEQ ID NO: 5900120 - DNA, 19 bp, Homo sapiens
gaattcctctttaacaagg

SEQ ID NO: 5900121 - DNA, 13 bp, Homo sapiens
gaattcctctttt

SEQ ID NO: 5900122 - DNA, 21 bp, Homo sapiens
gaattcctcttttgcttaaat

SEQ ID NO: 5900123 - DNA, 23 bp, Homo sapiens
gaattcctcttttgcttaaatca

SEQ ID NO: 5900124 - DNA, 17 bp, Homo sapiens
gaattcctgaagccaga

SEQ ID NO: 5900125 - DNA, 13 bp, Homo sapiens
gaattccttcgaa

SEQ ID NO: 5900126 - DNA, 19 bp, Homo sapiens
gaattccttcgaaaggcct

SEQ ID NO: 5900127 - DNA, 19 bp, Homo sapiens
gaatttctgtgccctcctg

SEQ ID NO: 5900128 - DNA, 20 bp, Homo sapiens
gaatttcttcactgttgaaa

SEQ ID NO: 5900129 - DNA, 21 bp, Homo sapiens
gaatttcttggtaagaagccg

SEQ ID NO: 5900130 - DNA, 22 bp, Homo sapiens
gaatttgaaaaatgcataataa

SEQ ID NO: 5900131 - DNA, 15 bp, Homo sapiens
gaatttgaagacttc

SEQ ID NO: 5900132 - DNA, 11 bp, Homo sapiens
gaatttgagaa

SEQ ID NO: 5900133 - DNA, 16 bp, Homo sapiens
gaatttgagaaccttg

SEQ ID NO: 5900134 - DNA, 14 bp, Homo sapiens
gaatttgaggtcta

SEQ ID NO: 5900135 - DNA, 20 bp, Homo sapiens
gaatttgatatgtgaacagt

SEQ ID NO: 5900136 - DNA, 22 bp, Homo sapiens
gaatttgatgattttcatttca

SEQ ID NO: 5900137 - DNA, 13 bp, Homo sapiens
gaatttgcaaagt

SEQ ID NO: 5900138 - DNA, 15 bp, Homo sapiens
gaatttgcaaagtac

SEQ ID NO: 5900139 - DNA, 21 bp, Homo sapiens
gaatttgctaaatacaacact

SEQ ID NO: 5900140 - DNA, 14 bp, Homo sapiens
gaatttggaaatcc

SEQ ID NO: 5900141 - DNA, 16 bp, Homo sapiens
gaatttggcccagaga

SEQ ID NO: 5900142 - DNA, 19 bp, Homo sapiens
gaatttggcctgcactaat

SEQ ID NO: 5900143 - DNA, 21 bp, Homo sapiens
gaatttgggatactaaagtag

SEQ ID NO: 5900144 - DNA, 17 bp, Homo sapiens
gaatttgggatggaagc

SEQ ID NO: 5900145 - DNA, 14 bp, Homo sapiens
gaatttggtacaca

SEQ ID NO: 5900146 - DNA, 18 bp, Homo sapiens
gaatttggtacacatgtg

SEQ ID NO: 5900147 - DNA, 19 bp, Homo sapiens
gaatttggtacacatgtgt

SEQ ID NO: 5900148 - DNA, 20 bp, Homo sapiens
gaatttggtctgcctctgag

SEQ ID NO: 5900149 - DNA, 16 bp, Homo sapiens
gaatttgtaacctcag

SEQ ID NO: 5900150 - DNA, 20 bp, Homo sapiens
gaatttgtaagcaacttgct

SEQ ID NO: 5900151 - DNA, 20 bp, Homo sapiens
gaatttgtaatgtcttgagc

SEQ ID NO: 5900152 - DNA, 13 bp, Homo sapiens
gaatttgtacttc

SEQ ID NO: 5900153 - DNA, 14 bp, Homo sapiens
gaatttgtacttct

SEQ ID NO: 5900154 - DNA, 19 bp, Homo sapiens
gaatttgtccaattgtgta

SEQ ID NO: 5900155 - DNA, 16 bp, Homo sapiens
gaatttgttcttaaaa

SEQ ID NO: 5900156 - DNA, 22 bp, Homo sapiens
gaatttgttcttaaaaaaataa

SEQ ID NO: 5900157 - DNA, 18 bp, Homo sapiens
gaatttgtttcatctatt

SEQ ID NO: 5900158 - DNA, 23 bp, Homo sapiens
gaatttgtttcatctattttatt

SEQ ID NO: 5900159 - DNA, 15 bp, Homo sapiens
gaattttaaaaatga

SEQ ID NO: 5900160 - DNA, 15 bp, Homo sapiens
gaattttaaaagatg

SEQ ID NO: 5900161 - DNA, 21 bp, Homo sapiens
gaattttaaaagatgcaatgt

SEQ ID NO: 5900162 - DNA, 23 bp, Homo sapiens
gaattttaaaatctgagggaaat

SEQ ID NO: 5900163 - DNA, 13 bp, Homo sapiens
gaattttaaaatg

SEQ ID NO: 5900164 - DNA, 22 bp, Homo sapiens
gaattttaaaatgtagaagaaa

SEQ ID NO: 5900165 - DNA, 16 bp, Homo sapiens
gaattttagcttttgt

SEQ ID NO: 5900166 - DNA, 15 bp, Homo sapiens
gaattttattgaaag

SEQ ID NO: 5900167 - DNA, 15 bp, Homo sapiens
gaattttattttgct

SEQ ID NO: 5900168 - DNA, 16 bp, Homo sapiens
gaattttattttgctg

SEQ ID NO: 5900169 - DNA, 18 bp, Homo sapiens
gaattttattttgctgag

SEQ ID NO: 5900170 - DNA, 15 bp, Homo sapiens
gaattttcaaggcct

SEQ ID NO: 5900171 - DNA, 11 bp, Homo sapiens
gaattttcatt

SEQ ID NO: 5900172 - DNA, 20 bp, Homo sapiens
gaattttcattttacagtta

SEQ ID NO: 5900173 - DNA, 22 bp, Homo sapiens
gaattttcattttacagttact

SEQ ID NO: 5900174 - DNA, 17 bp, Homo sapiens
gaattttccaagaacat

SEQ ID NO: 5900175 - DNA, 18 bp, Homo sapiens
gaattttccaagaacata

SEQ ID NO: 5900176 - DNA, 19 bp, Homo sapiens
gaattttccacgcagttct

SEQ ID NO: 5900177 - DNA, 19 bp, Homo sapiens
gaattttccgggaactttg

SEQ ID NO: 5900178 - DNA, 17 bp, Homo sapiens
gaattttctaaaagcca

SEQ ID NO: 5900179 - DNA, 15 bp, Homo sapiens
gaattttctgcagct

SEQ ID NO: 5900180 - DNA, 19 bp, Homo sapiens
gaattttctgcagctgttt

SEQ ID NO: 5900181 - DNA, 15 bp, Homo sapiens
gaattttgcaatgta

SEQ ID NO: 5900182 - DNA, 14 bp, Homo sapiens
gaattttgcttcct

SEQ ID NO: 5900183 - DNA, 15 bp, Homo sapiens
gaattttggaaaaat

SEQ ID NO: 5900184 - DNA, 21 bp, Homo sapiens
gaattttgggtattgtaatct

SEQ ID NO: 5900185 - DNA, 21 bp, Homo sapiens
gaattttggtgatgtaaaaca

SEQ ID NO: 5900186 - DNA, 12 bp, Homo sapiens
gaattttgtaag

SEQ ID NO: 5900187 - DNA, 20 bp, Homo sapiens
gaattttgtgcccccatgta

SEQ ID NO: 5900188 - DNA, 22 bp, Homo sapiens
gaattttgtgttagagattttt

SEQ ID NO: 5900189 - DNA, 22 bp, Homo sapiens
gaattttgtttggacttctttt

SEQ ID NO: 5900190 - DNA, 12 bp, Homo sapiens
gaatttttaagc

SEQ ID NO: 5900191 - DNA, 19 bp, Homo sapiens
gaatttttattatgcataa

SEQ ID NO: 5900192 - DNA, 15 bp, Homo sapiens
gaatttttattgttg

SEQ ID NO: 5900193 - DNA, 21 bp, Homo sapiens
gaatttttatttctttttaat

SEQ ID NO: 5900194 - DNA, 21 bp, Homo sapiens
gaatttttcccctttgattca

SEQ ID NO: 5900195 - DNA, 24 bp, Homo sapiens
gaatttttccctccactccatccc

SEQ ID NO: 5900196 - DNA, 14 bp, Homo sapiens
gaatttttcctatg

SEQ ID NO: 5900197 - DNA, 22 bp, Homo sapiens
gaatttttcctatgctattgac

SEQ ID NO: 5900198 - DNA, 13 bp, Homo sapiens
gaatttttctgta

SEQ ID NO: 5900199 - DNA, 22 bp, Homo sapiens
gaatttttctgtacttcagtat

SEQ ID NO: 5900200 - DNA, 13 bp, Homo sapiens
gaatttttcttcc

SEQ ID NO: 5900201 - DNA, 16 bp, Homo sapiens
gaatttttgcaataat

SEQ ID NO: 5900202 - DNA, 21 bp, Homo sapiens
gaatttttgcaataatgcagt

SEQ ID NO: 5900203 - DNA, 15 bp, Homo sapiens
gaatttttgcctatc

SEQ ID NO: 5900204 - DNA, 15 bp, Homo sapiens
gaatttttgtttgga

SEQ ID NO: 5900205 - DNA, 17 bp, Homo sapiens
gaattttttattcttgt

SEQ ID NO: 5900206 - DNA, 22 bp, Homo sapiens
gaattttttattcttgtgaata

SEQ ID NO: 5900207 - DNA, 22 bp, Homo sapiens
gaattttttgaaatgggcattt

SEQ ID NO: 5900208 - DNA, 16 bp, Homo sapiens
gaatttttttcatctt

SEQ ID NO: 5900209 - DNA, 21 bp, Homo sapiens
gaatttttttctgcacagctt

SEQ ID NO: 5900210 - DNA, 17 bp, Homo sapiens
gaatttttttgtcttta

SEQ ID NO: 5900211 - DNA, 17 bp, Homo sapiens
gaattttttttaacatt

SEQ ID NO: 5900212 - DNA, 19 bp, Homo sapiens
gaattttttttaatgctta

SEQ ID NO: 5900213 - DNA, 21 bp, Homo sapiens
gaattttttttgttgtttcag

SEQ ID NO: 5900214 - DNA, 23 bp, Homo sapiens
gaattttttttgttgtttcagtg

SEQ ID NO: 5900215 - DNA, 22 bp, Homo sapiens
gaatttttttttcctagccctc

SEQ ID NO: 5900216 - DNA, 23 bp, Homo sapiens
gacaaaaaaaaaatagagagaga

SEQ ID NO: 5900217 - DNA, 18 bp, Homo sapiens
gacaaaaaatgttttaaa

SEQ ID NO: 5900218 - DNA, 16 bp, Homo sapiens
gacaaaaacagcctca

SEQ ID NO: 5900219 - DNA, 20 bp, Homo sapiens
gacaaaaacagcctcacaga

SEQ ID NO: 5900220 - DNA, 15 bp, Homo sapiens
gacaaaaagaacaaa

SEQ ID NO: 5900221 - DNA, 21 bp, Homo sapiens
gacaaaaagccttgaagaaaa

SEQ ID NO: 5900222 - DNA, 18 bp, Homo sapiens
gacaaaaagtttccatat

SEQ ID NO: 5900223 - DNA, 15 bp, Homo sapiens
gacaaaaataacact

SEQ ID NO: 5900224 - DNA, 21 bp, Homo sapiens
gacaaaaatactctaattcta

SEQ ID NO: 5900225 - DNA, 23 bp, Homo sapiens
gacaaaaatataaagttattaat

SEQ ID NO: 5900226 - DNA, 22 bp, Homo sapiens
gacaaaaatcaaagaacagatg

SEQ ID NO: 5900227 - DNA, 18 bp, Homo sapiens
gacaaaaatgtttgtact

SEQ ID NO: 5900228 - DNA, 21 bp, Homo sapiens
gacaaaaattcaactcagact

SEQ ID NO: 5900229 - DNA, 18 bp, Homo sapiens
gacaaaacctaacttgcg

SEQ ID NO: 5900230 - DNA, 15 bp, Homo sapiens
gacaaaactagagac

SEQ ID NO: 5900231 - DNA, 14 bp, Homo sapiens
gacaaaagaaaaaa

SEQ ID NO: 5900232 - DNA, 13 bp, Homo sapiens
gacaaaagaaact

SEQ ID NO: 5900233 - DNA, 14 bp, Homo sapiens
gacaaaagtctgtc

SEQ ID NO: 5900234 - DNA, 23 bp, Homo sapiens
gacaaaagtttcacaacagattt

SEQ ID NO: 5900235 - DNA, 21 bp, Homo sapiens
gacaaaatagcccagcctttt

SEQ ID NO: 5900236 - DNA, 18 bp, Homo sapiens
gacaaaatcatctttgtg

SEQ ID NO: 5900237 - DNA, 13 bp, Homo sapiens
gacaaaatgggag

SEQ ID NO: 5900238 - DNA, 16 bp, Homo sapiens
gacaaaatgggaggag

SEQ ID NO: 5900239 - DNA, 17 bp, Homo sapiens
gacaaaatgggaggagg

SEQ ID NO: 5900240 - DNA, 18 bp, Homo sapiens
gacaaaatgggaggagga

SEQ ID NO: 5900241 - DNA, 22 bp, Homo sapiens
gacaaaatgttgataaatggat

SEQ ID NO: 5900242 - DNA, 14 bp, Homo sapiens
gacaaaattccagt

SEQ ID NO: 5900243 - DNA, 20 bp, Homo sapiens
gacaaaattggccagagagt

SEQ ID NO: 5900244 - DNA, 15 bp, Homo sapiens
gacaaaattgtaagc

SEQ ID NO: 5900245 - DNA, 20 bp, Homo sapiens
gacaaaattgtaagccagag

SEQ ID NO: 5900246 - DNA, 23 bp, Homo sapiens
gacaaaattgtaagccagagtca

SEQ ID NO: 5900247 - DNA, 22 bp, Homo sapiens
gacaaaattttagtccaaataa

SEQ ID NO: 5900248 - DNA, 17 bp, Homo sapiens
gacaaacaagggagaag

SEQ ID NO: 5900249 - DNA, 16 bp, Homo sapiens
gacaaacacctcccag

SEQ ID NO: 5900250 - DNA, 21 bp, Homo sapiens
gacaaacactgccatattgtg

SEQ ID NO: 5900251 - DNA, 23 bp, Homo sapiens
gacaaacactgccatattgtgta

SEQ ID NO: 5900252 - DNA, 17 bp, Homo sapiens
gacaaacagcccttcct

SEQ ID NO: 5900253 - DNA, 17 bp, Homo sapiens
gacaaacagtagagaac

SEQ ID NO: 5900254 - DNA, 19 bp, Homo sapiens
gacaaaccactgtacatat

SEQ ID NO: 5900255 - DNA, 21 bp, Homo sapiens
gacaaaccaggggtaccaggc

SEQ ID NO: 5900256 - DNA, 22 bp, Homo sapiens
gacaaaccaggggtaccaggca

SEQ ID NO: 5900257 - DNA, 19 bp, Homo sapiens
gacaaaccataactgacaa

SEQ ID NO: 5900258 - DNA, 13 bp, Homo sapiens
gacaaacctagct

SEQ ID NO: 5900259 - DNA, 19 bp, Homo sapiens
gacaaacctagcttttaaa

SEQ ID NO: 5900260 - DNA, 23 bp, Homo sapiens
gacaaacctagcttttaaaaaat

SEQ ID NO: 5900261 - DNA, 15 bp, Homo sapiens
gacaaactaaacttt

SEQ ID NO: 5900262 - DNA, 18 bp, Homo sapiens
gacaaactggagtctgga

SEQ ID NO: 5900263 - DNA, 15 bp, Homo sapiens
gacaaactttgcatc

SEQ ID NO: 5900264 - DNA, 13 bp, Homo sapiens
gacaaagaaaacg

SEQ ID NO: 5900265 - DNA, 21 bp, Homo sapiens
gacaaagaattccaaagcaaa

SEQ ID NO: 5900266 - DNA, 14 bp, Homo sapiens
gacaaagactcctc

SEQ ID NO: 5900267 - DNA, 17 bp, Homo sapiens
gacaaagactcctctgg

SEQ ID NO: 5900268 - DNA, 23 bp, Homo sapiens
gacaaagatgatttaaaagggaa

SEQ ID NO: 5900269 - DNA, 14 bp, Homo sapiens
gacaaagatttctt

SEQ ID NO: 5900270 - DNA, 15 bp, Homo sapiens
gacaaagcaatttac

SEQ ID NO: 5900271 - DNA, 20 bp, Homo sapiens
gacaaagccaaactctgcca

SEQ ID NO: 5900272 - DNA, 20 bp, Homo sapiens
gacaaagccagaggagaaga

SEQ ID NO: 5900273 - DNA, 20 bp, Homo sapiens
gacaaagctgctaaatctcc

SEQ ID NO: 5900274 - DNA, 17 bp, Homo sapiens
gacaaaggacatttgtt

SEQ ID NO: 5900275 - DNA, 15 bp, Homo sapiens
gacaaaggagccttg

SEQ ID NO: 5900276 - DNA, 18 bp, Homo sapiens
gacaaaggagccttgata

SEQ ID NO: 5900277 - DNA, 23 bp, Homo sapiens
gacaaaggaggaatttactttct

SEQ ID NO: 5900278 - DNA, 15 bp, Homo sapiens
gacaaaggatgaaga

SEQ ID NO: 5900279 - DNA, 15 bp, Homo sapiens
gacaaaggccacagg

SEQ ID NO: 5900280 - DNA, 16 bp, Homo sapiens
gacaaaggccacaggc

SEQ ID NO: 5900281 - DNA, 14 bp, Homo sapiens
gacaaaggcccaga

SEQ ID NO: 5900282 - DNA, 15 bp, Homo sapiens
gacaaaggcccagaa

SEQ ID NO: 5900283 - DNA, 18 bp, Homo sapiens
gacaaagggaaggctgct

SEQ ID NO: 5900284 - DNA, 19 bp, Homo sapiens
gacaaagggaaggctgctg

SEQ ID NO: 5900285 - DNA, 12 bp, Homo sapiens
gacaaaggtggt

SEQ ID NO: 5900286 - DNA, 22 bp, Homo sapiens
gacaaaggtggtaaattcagac

SEQ ID NO: 5900287 - DNA, 12 bp, Homo sapiens
gacaaagtgcct

SEQ ID NO: 5900288 - DNA, 14 bp, Homo sapiens
gacaaagttatata

SEQ ID NO: 5900289 - DNA, 13 bp, Homo sapiens
gacaaataaaaca

SEQ ID NO: 5900290 - DNA, 14 bp, Homo sapiens
gacaaataaagcaa

SEQ ID NO: 5900291 - DNA, 18 bp, Homo sapiens
gacaaataaagcaatgaa

SEQ ID NO: 5900292 - DNA, 14 bp, Homo sapiens
gacaaatacacata

SEQ ID NO: 5900293 - DNA, 17 bp, Homo sapiens
gacaaatactcatgtgt

SEQ ID NO: 5900294 - DNA, 17 bp, Homo sapiens
gacaaatagaaaatggt

SEQ ID NO: 5900295 - DNA, 18 bp, Homo sapiens
gacaaatagaaaatggtc

SEQ ID NO: 5900296 - DNA, 14 bp, Homo sapiens
gacaaatagtaggc

SEQ ID NO: 5900297 - DNA, 22 bp, Homo sapiens
gacaaatagtaggctaaaaaca

SEQ ID NO: 5900298 - DNA, 15 bp, Homo sapiens
gacaaatcaaagcag

SEQ ID NO: 5900299 - DNA, 13 bp, Homo sapiens
gacaaatcaacag

SEQ ID NO: 5900300 - DNA, 20 bp, Homo sapiens
gacaaatcaagagcattgct

SEQ ID NO: 5900301 - DNA, 20 bp, Homo sapiens
gacaaatcaagtttccaagc

SEQ ID NO: 5900302 - DNA, 16 bp, Homo sapiens
gacaaatcacatattt

SEQ ID NO: 5900303 - DNA, 19 bp, Homo sapiens
gacaccaggagtccctggt

SEQ ID NO: 5900304 - DNA, 22 bp, Homo sapiens
gacaccatccaagaatgttgtt

SEQ ID NO: 5900305 - DNA, 15 bp, Homo sapiens
gacaccatcctgagc

SEQ ID NO: 5900306 - DNA, 17 bp, Homo sapiens
gacaccatcctgagcca

SEQ ID NO: 5900307 - DNA, 19 bp, Homo sapiens
gacaccatgttcccagctc

SEQ ID NO: 5900308 - DNA, 20 bp, Homo sapiens
gacaccatgttcccagctca

SEQ ID NO: 5900309 - DNA, 18 bp, Homo sapiens
gacacccaccctgtgcca

SEQ ID NO: 5900310 - DNA, 13 bp, Homo sapiens
gacacccaggact

SEQ ID NO: 5900311 - DNA, 12 bp, Homo sapiens
gacacccaggcc

SEQ ID NO: 5900312 - DNA, 18 bp, Homo sapiens
gacacccagtgtccttcc

SEQ ID NO: 5900313 - DNA, 17 bp, Homo sapiens
gacacccatgccagaga

SEQ ID NO: 5900314 - DNA, 15 bp, Homo sapiens
gacaccccacttagc

SEQ ID NO: 5900315 - DNA, 23 bp, Homo sapiens
gacaccccagaatcccctgggga

SEQ ID NO: 5900316 - DNA, 19 bp, Homo sapiens
gacaccccagacctgcgaa

SEQ ID NO: 5900317 - DNA, 14 bp, Homo sapiens
gacacccccagctg

SEQ ID NO: 5900318 - DNA, 21 bp, Homo sapiens
gacaccccccttctgaatgaa

SEQ ID NO: 5900319 - DNA, 17 bp, Homo sapiens
gacacccctacacacac

SEQ ID NO: 5900320 - DNA, 13 bp, Homo sapiens
gacacccctgctc

SEQ ID NO: 5900321 - DNA, 17 bp, Homo sapiens
gacaccccttatccagg

SEQ ID NO: 5900322 - DNA, 18 bp, Homo sapiens
gacaccccttatccagga

SEQ ID NO: 5900323 - DNA, 19 bp, Homo sapiens
gacaccccttatccaggac

SEQ ID NO: 5900324 - DNA, 21 bp, Homo sapiens
gacaccccttatccaggactc

SEQ ID NO: 5900325 - DNA, 16 bp, Homo sapiens
gacaccccttcctgct

SEQ ID NO: 5900326 - DNA, 23 bp, Homo sapiens
gacaccctaactcttgctcactc

SEQ ID NO: 5900327 - DNA, 24 bp, Homo sapiens
gacaccctaactcttgctcactcc

SEQ ID NO: 5900328 - DNA, 22 bp, Homo sapiens
gacaccctacacaaaatacagc

SEQ ID NO: 5900329 - DNA, 15 bp, Homo sapiens
gacaccctccactct

SEQ ID NO: 5900330 - DNA, 18 bp, Homo sapiens
gacaccctccactctgag

SEQ ID NO: 5900331 - DNA, 19 bp, Homo sapiens
gacaccctccactctgagg

SEQ ID NO: 5900332 - DNA, 18 bp, Homo sapiens
gacaccctcctgcccccc

SEQ ID NO: 5900333 - DNA, 14 bp, Homo sapiens
gacaccctctgggg

SEQ ID NO: 5900334 - DNA, 14 bp, Homo sapiens
gacaccctggcctg

SEQ ID NO: 5900335 - DNA, 12 bp, Homo sapiens
gacaccctgtga

SEQ ID NO: 5900336 - DNA, 16 bp, Homo sapiens
gacaccgccacatggc

SEQ ID NO: 5900337 - DNA, 18 bp, Homo sapiens
gacaccgctcagtattac

SEQ ID NO: 5900338 - DNA, 22 bp, Homo sapiens
gacaccggagtatgtgcagtgt

SEQ ID NO: 5900339 - DNA, 23 bp, Homo sapiens
gacaccggagtatgtgcagtgtg

SEQ ID NO: 5900340 - DNA, 19 bp, Homo sapiens
gacaccggctggcagggct

SEQ ID NO: 5900341 - DNA, 23 bp, Homo sapiens
gacaccgggaagtgcagcgggcc

SEQ ID NO: 5900342 - DNA, 19 bp, Homo sapiens
gacaccgggccagtatcta

SEQ ID NO: 5900343 - DNA, 22 bp, Homo sapiens
gacaccgggccagtatctatat

SEQ ID NO: 5900344 - DNA, 20 bp, Homo sapiens
gacaccggggtggtgggaac

SEQ ID NO: 5900345 - DNA, 15 bp, Homo sapiens
gacaccgtccctcag

SEQ ID NO: 5900346 - DNA, 17 bp, Homo sapiens
gacaccgtccctcagtg

SEQ ID NO: 5900347 - DNA, 18 bp, Homo sapiens
gacaccgtcgaccaggaa

SEQ ID NO: 5900348 - DNA, 17 bp, Homo sapiens
gacaccgtttgtccccc

SEQ ID NO: 5900349 - DNA, 16 bp, Homo sapiens
gacacctaaccccagg

SEQ ID NO: 5900350 - DNA, 17 bp, Homo sapiens
gacacctaaccccaggg

SEQ ID NO: 5900351 - DNA, 18 bp, Homo sapiens
gacacctaaccccagggc

SEQ ID NO: 5900352 - DNA, 23 bp, Homo sapiens
gacacctaactcttttctatttt

SEQ ID NO: 5900353 - DNA, 19 bp, Homo sapiens
gacacctacagcagcacgc

SEQ ID NO: 5900354 - DNA, 19 bp, Homo sapiens
gacacctaccatgctgctt

SEQ ID NO: 5900355 - DNA, 17 bp, Homo sapiens
gacacctactgagtggc

SEQ ID NO: 5900356 - DNA, 17 bp, Homo sapiens
gacacctcagtcatatt

SEQ ID NO: 5900357 - DNA, 12 bp, Homo sapiens
gacacctcccag

SEQ ID NO: 5900358 - DNA, 16 bp, Homo sapiens
gacacctcccagggga

SEQ ID NO: 5900359 - DNA, 21 bp, Homo sapiens
gacacctccccctacccatat

SEQ ID NO: 5900360 - DNA, 15 bp, Homo sapiens
gacacctcccccttt

SEQ ID NO: 5900361 - DNA, 23 bp, Homo sapiens
gacacctccccctttcacactgg

SEQ ID NO: 5900362 - DNA, 17 bp, Homo sapiens
gacacctgaaccctcca

SEQ ID NO: 5900363 - DNA, 13 bp, Homo sapiens
gacacctgcacct

SEQ ID NO: 5900364 - DNA, 15 bp, Homo sapiens
gacacctgcacctcc

SEQ ID NO: 5900365 - DNA, 16 bp, Homo sapiens
gacacctgcacctccc

SEQ ID NO: 5900366 - DNA, 22 bp, Homo sapiens
gacacctgcacctccccccact

SEQ ID NO: 5900367 - DNA, 11 bp, Homo sapiens
gacacctgccc

SEQ ID NO: 5900368 - DNA, 12 bp, Homo sapiens
gacacctgcccc

SEQ ID NO: 5900369 - DNA, 13 bp, Homo sapiens
gacacctgcccca

SEQ ID NO: 5900370 - DNA, 16 bp, Homo sapiens
gacacctgccctgccc

SEQ ID NO: 5900371 - DNA, 22 bp, Homo sapiens
gacacctgccctgccctgccac

SEQ ID NO: 5900372 - DNA, 14 bp, Homo sapiens
gacacctggactga

SEQ ID NO: 5900373 - DNA, 18 bp, Homo sapiens
gacacctggtgcgggcct

SEQ ID NO: 5900374 - DNA, 22 bp, Homo sapiens
gacacctggtgcgggcctggcc

SEQ ID NO: 5900375 - DNA, 22 bp, Homo sapiens
gacacctgtcttgaataagagt

SEQ ID NO: 5900376 - DNA, 12 bp, Homo sapiens
gacacctgtgca

SEQ ID NO: 5900377 - DNA, 17 bp, Homo sapiens
gacacctgtgcacccca

SEQ ID NO: 5900378 - DNA, 21 bp, Homo sapiens
gacaccttctgagtattctca

SEQ ID NO: 5900379 - DNA, 17 bp, Homo sapiens
gacaccttgacagggca

SEQ ID NO: 5900380 - DNA, 23 bp, Homo sapiens
gacacctttaacacagaccccta

SEQ ID NO: 5900381 - DNA, 17 bp, Homo sapiens
gacacctttgcaggcat

SEQ ID NO: 5900382 - DNA, 22 bp, Homo sapiens
gacaccttttctatttacctcc

SEQ ID NO: 5900383 - DNA, 15 bp, Homo sapiens
gacacgaatattgct

SEQ ID NO: 5900384 - DNA, 13 bp, Homo sapiens
gacacgagccaca

SEQ ID NO: 5900385 - DNA, 19 bp, Homo sapiens
gacacgagccacaagctgc

SEQ ID NO: 5900386 - DNA, 19 bp, Homo sapiens
gacacgatgccgagacctc

SEQ ID NO: 5900387 - DNA, 18 bp, Homo sapiens
gacacgcaagtgtgtgag

SEQ ID NO: 5900388 - DNA, 21 bp, Homo sapiens
gacacgcacttctggggccag

SEQ ID NO: 5900389 - DNA, 23 bp, Homo sapiens
gacacgcacttctggggccagcc

SEQ ID NO: 5900390 - DNA, 18 bp, Homo sapiens
gacacgcccgactctctc

SEQ ID NO: 5900391 - DNA, 21 bp, Homo sapiens
gacacgcgcccccctcccaga

SEQ ID NO: 5900392 - DNA, 16 bp, Homo sapiens
gacacgctcgcgggca

SEQ ID NO: 5900393 - DNA, 19 bp, Homo sapiens
gacacgctcgcgggcagcg

SEQ ID NO: 5900394 - DNA, 23 bp, Homo sapiens
gacacgctcttctattttattcc

SEQ ID NO: 5900395 - DNA, 15 bp, Homo sapiens
gacacgcttctgagc

SEQ ID NO: 5900396 - DNA, 18 bp, Homo sapiens
gacacgcttctgagcagg

SEQ ID NO: 5900397 - DNA, 16 bp, Homo sapiens
gacacggaccctgtgt

SEQ ID NO: 5900398 - DNA, 20 bp, Homo sapiens
gacacggatctgagaatctt

SEQ ID NO: 5900399 - DNA, 18 bp, Homo sapiens
gacacggcctctggggag

SEQ ID NO: 5900400 - DNA, 12 bp, Homo sapiens
gacacggcttca

SEQ ID NO: 5900401 - DNA, 18 bp, Homo sapiens
gacacggcttcactgacc

SEQ ID NO: 5900402 - DNA, 15 bp, Homo sapiens
gacacggggcagtgg

SEQ ID NO: 5900403 - DNA, 20 bp, Homo sapiens
gacacggtaggccaagctga

SEQ ID NO: 5900404 - DNA, 19 bp, Homo sapiens
gacacggtcggggcatctg

SEQ ID NO: 5900405 - DNA, 20 bp, Homo sapiens
gacacggtttaactgtccca

SEQ ID NO: 5900406 - DNA, 22 bp, Homo sapiens
gacacggtttaactgtcccagc

SEQ ID NO: 5900407 - DNA, 24 bp, Homo sapiens
gacacggtttaactgtcccagcga

SEQ ID NO: 5900408 - DNA, 14 bp, Homo sapiens
gacacgtggcctgc

SEQ ID NO: 5900409 - DNA, 18 bp, Homo sapiens
gacacgtgggctcccctc

SEQ ID NO: 5900410 - DNA, 21 bp, Homo sapiens
gacacgtgtggcgggcagtgg

SEQ ID NO: 5900411 - DNA, 15 bp, Homo sapiens
gacacgttctgattt

SEQ ID NO: 5900412 - DNA, 16 bp, Homo sapiens
gacactaaccacgctg

SEQ ID NO: 5900413 - DNA, 18 bp, Homo sapiens
gacactaaccacgctgga

SEQ ID NO: 5900414 - DNA, 20 bp, Homo sapiens
gacactaaccacgctggacc

SEQ ID NO: 5900415 - DNA, 17 bp, Homo sapiens
gacactaagttatagta

SEQ ID NO: 5900416 - DNA, 15 bp, Homo sapiens
gacactaatgcagcc

SEQ ID NO: 5900417 - DNA, 20 bp, Homo sapiens
gacactaattccttaaatga

SEQ ID NO: 5900418 - DNA, 23 bp, Homo sapiens
gacactaattccttaaatgaact

SEQ ID NO: 5900419 - DNA, 14 bp, Homo sapiens
gacactacaaacat

SEQ ID NO: 5900420 - DNA, 15 bp, Homo sapiens
gacactacacccagc

SEQ ID NO: 5900421 - DNA, 19 bp, Homo sapiens
gacactacacccagcaata

SEQ ID NO: 5900422 - DNA, 14 bp, Homo sapiens
gacactagaaaact

SEQ ID NO: 5900423 - DNA, 17 bp, Homo sapiens
gacactaggagactggt

SEQ ID NO: 5900424 - DNA, 13 bp, Homo sapiens
gacactatatctg

SEQ ID NO: 5900425 - DNA, 14 bp, Homo sapiens
gacactcaagagcc

SEQ ID NO: 5900426 - DNA, 23 bp, Homo sapiens
gacactcaagtcccccaagacct

SEQ ID NO: 5900427 - DNA, 14 bp, Homo sapiens
gacactcagaccag

SEQ ID NO: 5900428 - DNA, 13 bp, Homo sapiens
gacactcagacct

SEQ ID NO: 5900429 - DNA, 15 bp, Homo sapiens
gacactcagggcagc

SEQ ID NO: 5900430 - DNA, 20 bp, Homo sapiens
gacactcagggcagctgcct

SEQ ID NO: 5900431 - DNA, 12 bp, Homo sapiens
gacactccagtg

SEQ ID NO: 5900432 - DNA, 13 bp, Homo sapiens
gacactcccaggg

SEQ ID NO: 5900433 - DNA, 23 bp, Homo sapiens
gacactcctcctcggaagagccc

SEQ ID NO: 5900434 - DNA, 14 bp, Homo sapiens
gacactccttcccc

SEQ ID NO: 5900435 - DNA, 17 bp, Homo sapiens
gacactccttccccaag

SEQ ID NO: 5900436 - DNA, 23 bp, Homo sapiens
gacactcgcctactaagtaccct

SEQ ID NO: 5900437 - DNA, 21 bp, Homo sapiens
gacactctataagattccaaa

SEQ ID NO: 5900438 - DNA, 16 bp, Homo sapiens
gacactctcacccccc

SEQ ID NO: 5900439 - DNA, 15 bp, Homo sapiens
gacactctctggaag

SEQ ID NO: 5900440 - DNA, 21 bp, Homo sapiens
gacactctgacaagctggcca

SEQ ID NO: 5900441 - DNA, 13 bp, Homo sapiens
gacactctgctct

SEQ ID NO: 5900442 - DNA, 17 bp, Homo sapiens
gacactctgctctgccc

SEQ ID NO: 5900443 - DNA, 15 bp, Homo sapiens
gacactctggctggt

SEQ ID NO: 5900444 - DNA, 13 bp, Homo sapiens
gacactgaaataa

SEQ ID NO: 5900445 - DNA, 20 bp, Homo sapiens
gacactgaagaagtcactga

SEQ ID NO: 5900446 - DNA, 18 bp, Homo sapiens
gacactgatgggtcctgc

SEQ ID NO: 5900447 - DNA, 22 bp, Homo sapiens
gacactgatgggtcctgctgct

SEQ ID NO: 5900448 - DNA, 23 bp, Homo sapiens
gacactgatgggtcctgctgctc

SEQ ID NO: 5900449 - DNA, 16 bp, Homo sapiens
gacactgcagcagaaa

SEQ ID NO: 5900450 - DNA, 19 bp, Homo sapiens
gacactgccgacatcagca

SEQ ID NO: 5900451 - DNA, 20 bp, Homo sapiens
gacactgccgacatcagcat

SEQ ID NO: 5900452 - DNA, 12 bp, Homo sapiens
gacactgcctta

SEQ ID NO: 5900453 - DNA, 16 bp, Homo sapiens
gacactgccttagcct

SEQ ID NO: 5900454 - DNA, 20 bp, Homo sapiens
gacactgcctttgctgcctt

SEQ ID NO: 5900455 - DNA, 21 bp, Homo sapiens
gacactgctctaacagccctc

SEQ ID NO: 5900456 - DNA, 15 bp, Homo sapiens
gacactgctgcacca

SEQ ID NO: 5900457 - DNA, 20 bp, Homo sapiens
gacactggaagggtccggct

SEQ ID NO: 5900458 - DNA, 12 bp, Homo sapiens
gacactggacat

SEQ ID NO: 5900459 - DNA, 13 bp, Homo sapiens
gacactggacatg

SEQ ID NO: 5900460 - DNA, 24 bp, Homo sapiens
gacactggatcaagttcagccacc

SEQ ID NO: 5900461 - DNA, 12 bp, Homo sapiens
gacactggcccc

SEQ ID NO: 5900462 - DNA, 18 bp, Homo sapiens
gacactggccccacagga

SEQ ID NO: 5900463 - DNA, 15 bp, Homo sapiens
gacactggcccctca

SEQ ID NO: 5900464 - DNA, 12 bp, Homo sapiens
gacactgggaga

SEQ ID NO: 5900465 - DNA, 23 bp, Homo sapiens
gacactgggaggccagtgagcca

SEQ ID NO: 5900466 - DNA, 19 bp, Homo sapiens
gacactgggcagcaaggct

SEQ ID NO: 5900467 - DNA, 20 bp, Homo sapiens
gacactgggggaggagagga

SEQ ID NO: 5900468 - DNA, 19 bp, Homo sapiens
gacactggggtctgtttct

SEQ ID NO: 5900469 - DNA, 13 bp, Homo sapiens
gacactggtctca

SEQ ID NO: 5900470 - DNA, 14 bp, Homo sapiens
gacactggtgggga

SEQ ID NO: 5900471 - DNA, 16 bp, Homo sapiens
gacactggtgtatctc

SEQ ID NO: 5900472 - DNA, 15 bp, Homo sapiens
gacactgtaaaatag

SEQ ID NO: 5900473 - DNA, 19 bp, Homo sapiens
gacactgtaaaatagtttt

SEQ ID NO: 5900474 - DNA, 12 bp, Homo sapiens
gacactgtacaa

SEQ ID NO: 5900475 - DNA, 22 bp, Homo sapiens
gacactgtatgactctcctctc

SEQ ID NO: 5900476 - DNA, 15 bp, Homo sapiens
gacactgtccctctt

SEQ ID NO: 5900477 - DNA, 18 bp, Homo sapiens
gacactgtgacaatgact

SEQ ID NO: 5900478 - DNA, 12 bp, Homo sapiens
gacactgtgaga

SEQ ID NO: 5900479 - DNA, 18 bp, Homo sapiens
gacactgtgcaggcccag

SEQ ID NO: 5900480 - DNA, 15 bp, Homo sapiens
gacaggaaagccctc

SEQ ID NO: 5900481 - DNA, 18 bp, Homo sapiens
gacaggaacacccagccc

SEQ ID NO: 5900482 - DNA, 22 bp, Homo sapiens
gacaggaacacccagccccagc

SEQ ID NO: 5900483 - DNA, 18 bp, Homo sapiens
gacaggaagactggagac

SEQ ID NO: 5900484 - DNA, 20 bp, Homo sapiens
gacaggaagcccaaggcagt

SEQ ID NO: 5900485 - DNA, 15 bp, Homo sapiens
gacaggaaggaagca

SEQ ID NO: 5900486 - DNA, 22 bp, Homo sapiens
gacaggacagtgcttcagcctg

SEQ ID NO: 5900487 - DNA, 23 bp, Homo sapiens
gacaggacagtgcttcagcctga

SEQ ID NO: 5900488 - DNA, 23 bp, Homo sapiens
gacaggaccagggatttccatga

SEQ ID NO: 5900489 - DNA, 15 bp, Homo sapiens
gacaggaccccagct

SEQ ID NO: 5900490 - DNA, 20 bp, Homo sapiens
gacaggaccccagctctgcg

SEQ ID NO: 5900491 - DNA, 15 bp, Homo sapiens
gacaggacctgacta

SEQ ID NO: 5900492 - DNA, 20 bp, Homo sapiens
gacaggacgggcttgggctt

SEQ ID NO: 5900493 - DNA, 24 bp, Homo sapiens
gacaggactaacactcagaagcct

SEQ ID NO: 5900494 - DNA, 17 bp, Homo sapiens
gacaggagaagagagga

SEQ ID NO: 5900495 - DNA, 12 bp, Homo sapiens
gacaggagcctg

SEQ ID NO: 5900496 - DNA, 23 bp, Homo sapiens
gacaggaggaggagatggccata

SEQ ID NO: 5900497 - DNA, 13 bp, Homo sapiens
gacaggaggagtg

SEQ ID NO: 5900498 - DNA, 17 bp, Homo sapiens
gacaggaggattgcctg

SEQ ID NO: 5900499 - DNA, 16 bp, Homo sapiens
gacaggagtcagtgtc

SEQ ID NO: 5900500 - DNA, 19 bp, Homo sapiens
gacaggagtcagtgtctgg

SEQ ID NO: 5900501 - DNA, 22 bp, Homo sapiens
gacaggagtcagtgtctggctt

SEQ ID NO: 5900502 - DNA, 13 bp, Homo sapiens
gacaggatccagg

SEQ ID NO: 5900503 - DNA, 22 bp, Homo sapiens
gacaggatctataggcagcttc

SEQ ID NO: 5900504 - DNA, 17 bp, Homo sapiens
gacaggatgaggacaga

SEQ ID NO: 5900505 - DNA, 21 bp, Homo sapiens
gacaggatgaggacagagggc

SEQ ID NO: 5900506 - DNA, 16 bp, Homo sapiens
gacaggatgaggtctc

SEQ ID NO: 5900507 - DNA, 16 bp, Homo sapiens
gacaggatgggggctg

SEQ ID NO: 5900508 - DNA, 23 bp, Homo sapiens
gacaggatgggggctggcctctg

SEQ ID NO: 5900509 - DNA, 21 bp, Homo sapiens
gacaggatggggttctggaaa

SEQ ID NO: 5900510 - DNA, 18 bp, Homo sapiens
gacaggatgtgtttgctt

SEQ ID NO: 5900511 - DNA, 20 bp, Homo sapiens
gacaggatgtgtttgctttc

SEQ ID NO: 5900512 - DNA, 22 bp, Homo sapiens
gacaggatgttcaacttaatga

SEQ ID NO: 5900513 - DNA, 20 bp, Homo sapiens
gacaggattctgacagagca

SEQ ID NO: 5900514 - DNA, 21 bp, Homo sapiens
gacaggattgtctgctgcctc

SEQ ID NO: 5900515 - DNA, 20 bp, Homo sapiens
gacaggatttggccacactg

SEQ ID NO: 5900516 - DNA, 17 bp, Homo sapiens
gacaggcaatgctggct

SEQ ID NO: 5900517 - DNA, 23 bp, Homo sapiens
gacaggcaatgctggctgttggc

SEQ ID NO: 5900518 - DNA, 24 bp, Homo sapiens
gacaggcaatgctggctgttggct

SEQ ID NO: 5900519 - DNA, 13 bp, Homo sapiens
gacaggcactcca

SEQ ID NO: 5900520 - DNA, 22 bp, Homo sapiens
gacaggcactccaaacctgtct

SEQ ID NO: 5900521 - DNA, 17 bp, Homo sapiens
gacaggcagacacatgc

SEQ ID NO: 5900522 - DNA, 23 bp, Homo sapiens
gacaggcagccacgtctcaacat

SEQ ID NO: 5900523 - DNA, 14 bp, Homo sapiens
gacaggcagcccag

SEQ ID NO: 5900524 - DNA, 21 bp, Homo sapiens
gacaggcagcctcctttgtgt

SEQ ID NO: 5900525 - DNA, 20 bp, Homo sapiens
gacaggcaggccagatggcc

SEQ ID NO: 5900526 - DNA, 23 bp, Homo sapiens
gacaggcaggccagatggcccct

SEQ ID NO: 5900527 - DNA, 18 bp, Homo sapiens
gacaggcagggagggctt

SEQ ID NO: 5900528 - DNA, 22 bp, Homo sapiens
gacaggcatgttctctgaggac

SEQ ID NO: 5900529 - DNA, 18 bp, Homo sapiens
gacaggccatgtgagcca

SEQ ID NO: 5900530 - DNA, 20 bp, Homo sapiens
gacaggccatgtgagccacc

SEQ ID NO: 5900531 - DNA, 14 bp, Homo sapiens
gacaggcccaagag

SEQ ID NO: 5900532 - DNA, 16 bp, Homo sapiens
gacaggcccgcttgct

SEQ ID NO: 5900533 - DNA, 13 bp, Homo sapiens
gacaggccctccc

SEQ ID NO: 5900534 - DNA, 17 bp, Homo sapiens
gacaggccctccctgtc

SEQ ID NO: 5900535 - DNA, 21 bp, Homo sapiens
gacaggcctcacctctaccca

SEQ ID NO: 5900536 - DNA, 20 bp, Homo sapiens
gacaggcctttctggcctgc

SEQ ID NO: 5900537 - DNA, 16 bp, Homo sapiens
gacaggcgaaagaaaa

SEQ ID NO: 5900538 - DNA, 12 bp, Homo sapiens
gacaggcgggct

SEQ ID NO: 5900539 - DNA, 15 bp, Homo sapiens
gacaggcgggctcgg

SEQ ID NO: 5900540 - DNA, 16 bp, Homo sapiens
gacaggcgggctcgga

SEQ ID NO: 5900541 - DNA, 21 bp, Homo sapiens
gacaggctcttctttcccaaa

SEQ ID NO: 5900542 - DNA, 13 bp, Homo sapiens
gacaggctgaaga

SEQ ID NO: 5900543 - DNA, 15 bp, Homo sapiens
gacaggctgcggccc

SEQ ID NO: 5900544 - DNA, 20 bp, Homo sapiens
gacaggctggaatgagggag

SEQ ID NO: 5900545 - DNA, 14 bp, Homo sapiens
gacaggctggcatt

SEQ ID NO: 5900546 - DNA, 12 bp, Homo sapiens
gacaggctggct

SEQ ID NO: 5900547 - DNA, 22 bp, Homo sapiens
gacaggctggctccagatgcag

SEQ ID NO: 5900548 - DNA, 14 bp, Homo sapiens
gacaggctgggtcc

SEQ ID NO: 5900549 - DNA, 21 bp, Homo sapiens
gacaggctgggtcctgccagc

SEQ ID NO: 5900550 - DNA, 13 bp, Homo sapiens
gacaggctggtgc

SEQ ID NO: 5900551 - DNA, 15 bp, Homo sapiens
gacaggctggtgcta

SEQ ID NO: 5900552 - DNA, 22 bp, Homo sapiens
gacaggctgtgactcttctctc

SEQ ID NO: 5900553 - DNA, 18 bp, Homo sapiens
gacaggcttcgtctcaga

SEQ ID NO: 5900554 - DNA, 19 bp, Homo sapiens
gacaggcttcgtctcagaa

SEQ ID NO: 5900555 - DNA, 14 bp, Homo sapiens
gacagggaaaatat

SEQ ID NO: 5900556 - DNA, 15 bp, Homo sapiens
gacagggaaaatata

SEQ ID NO: 5900557 - DNA, 17 bp, Homo sapiens
gacagggaagctacagg

SEQ ID NO: 5900558 - DNA, 19 bp, Homo sapiens
gacagggaatgctgaggcc

SEQ ID NO: 5900559 - DNA, 22 bp, Homo sapiens
gacagggaatgctgaggcctcg

SEQ ID NO: 5900560 - DNA, 21 bp, Homo sapiens
gacagggagaagttgagcagg

SEQ ID NO: 5900561 - DNA, 17 bp, Homo sapiens
gacagggagcagccccc

SEQ ID NO: 5900562 - DNA, 13 bp, Homo sapiens
gacagggaggcca

SEQ ID NO: 5900563 - DNA, 15 bp, Homo sapiens
gacagggaggccaca

SEQ ID NO: 5900564 - DNA, 17 bp, Homo sapiens
gacagggaggccacacg

SEQ ID NO: 5900565 - DNA, 17 bp, Homo sapiens
gacagggagggggacct

SEQ ID NO: 5900566 - DNA, 24 bp, Homo sapiens
gacagggcacaccgggcactcaga

SEQ ID NO: 5900567 - DNA, 15 bp, Homo sapiens
gacagggcagagcag

SEQ ID NO: 5900568 - DNA, 12 bp, Homo sapiens
gacagggccagt

SEQ ID NO: 5900569 - DNA, 19 bp, Homo sapiens
gacagggccagtggggcct

SEQ ID NO: 5900570 - DNA, 21 bp, Homo sapiens
gacagggccagtggggcctgt

SEQ ID NO: 5900571 - DNA, 20 bp, Homo sapiens
gacagggcccccacagggga

SEQ ID NO: 5900572 - DNA, 18 bp, Homo sapiens
gacagggcccccggccac

SEQ ID NO: 5900573 - DNA, 19 bp, Homo sapiens
gacagggcgggggtggcgg

SEQ ID NO: 5900574 - DNA, 14 bp, Homo sapiens
gacagggcgtcctc

SEQ ID NO: 5900575 - DNA, 17 bp, Homo sapiens
gacagggctcatttttg

SEQ ID NO: 5900576 - DNA, 15 bp, Homo sapiens
gacagggctccagcc

SEQ ID NO: 5900577 - DNA, 18 bp, Homo sapiens
gacagggctccagcctgt

SEQ ID NO: 5900578 - DNA, 15 bp, Homo sapiens
gacagggctgagcgt

SEQ ID NO: 5900579 - DNA, 20 bp, Homo sapiens
gacagggctgagcgtggaag

SEQ ID NO: 5900580 - DNA, 12 bp, Homo sapiens
gacagggctggc

SEQ ID NO: 5900581 - DNA, 14 bp, Homo sapiens
gacagggctggccc

SEQ ID NO: 5900582 - DNA, 11 bp, Homo sapiens
gacagggcttc

SEQ ID NO: 5900583 - DNA, 20 bp, Homo sapiens
gacaggggagggggcaaagg

SEQ ID NO: 5900584 - DNA, 18 bp, Homo sapiens
gacaggggcaggaggaag

SEQ ID NO: 5900585 - DNA, 17 bp, Homo sapiens
gacagggggccagaaca

SEQ ID NO: 5900586 - DNA, 13 bp, Homo sapiens
gacagggtcctgc

SEQ ID NO: 5900587 - DNA, 15 bp, Homo sapiens
gacagggtctcactc

SEQ ID NO: 5900588 - DNA, 18 bp, Homo sapiens
gacagggtctcactctgt

SEQ ID NO: 5900589 - DNA, 19 bp, Homo sapiens
gacagggtctcactgtgtt

SEQ ID NO: 5900590 - DNA, 14 bp, Homo sapiens
gacagggtcttgct

SEQ ID NO: 5900591 - DNA, 21 bp, Homo sapiens
gacagggtcttgctctgtccc

SEQ ID NO: 5900592 - DNA, 22 bp, Homo sapiens
gacagggtcttgctctgtcccc

SEQ ID NO: 5900593 - DNA, 22 bp, Homo sapiens
gacagggtgctgatgggaagga

SEQ ID NO: 5900594 - DNA, 15 bp, Homo sapiens
gacagggtgggaggg

SEQ ID NO: 5900595 - DNA, 16 bp, Homo sapiens
gacagggtgggaggga

SEQ ID NO: 5900596 - DNA, 21 bp, Homo sapiens
gacagggtgggcttcctgccc

SEQ ID NO: 5900597 - DNA, 23 bp, Homo sapiens
gacagggtttggctgtgtctaaa

SEQ ID NO: 5900598 - DNA, 17 bp, Homo sapiens
gacagggttttttcatt

SEQ ID NO: 5900599 - DNA, 14 bp, Homo sapiens
gacaggtctctgag

SEQ ID NO: 5900600 - DNA, 17 bp, Homo sapiens
gacaggtcttttcaaat

SEQ ID NO: 5900601 - DNA, 20 bp, Homo sapiens
gacaggtgacagtggctgct

SEQ ID NO: 5900602 - DNA, 21 bp, Homo sapiens
gacaggtgacagtggctgctc

SEQ ID NO: 5900603 - DNA, 19 bp, Homo sapiens
gacaggtgatgctctggct

SEQ ID NO: 5900604 - DNA, 16 bp, Homo sapiens
gacaggtgcctggggc

SEQ ID NO: 5900605 - DNA, 21 bp, Homo sapiens
gacaggtgcctggggctggct

SEQ ID NO: 5900606 - DNA, 15 bp, Homo sapiens
gacaggtggaggcga

SEQ ID NO: 5900607 - DNA, 19 bp, Homo sapiens
gacaggtggaggcgagcca

SEQ ID NO: 5900608 - DNA, 21 bp, Homo sapiens
gacaggtggaggcgagccaga

SEQ ID NO: 5900609 - DNA, 20 bp, Homo sapiens
gacaggtgggagatggaggt

SEQ ID NO: 5900610 - DNA, 15 bp, Homo sapiens
gacaggtgggcctgg

SEQ ID NO: 5900611 - DNA, 22 bp, Homo sapiens
gacaggtgggcctggcggcctg

SEQ ID NO: 5900612 - DNA, 14 bp, Homo sapiens
gacaggtggggcct

SEQ ID NO: 5900613 - DNA, 15 bp, Homo sapiens
gacaggtggggcctc

SEQ ID NO: 5900614 - DNA, 18 bp, Homo sapiens
gacaggtggggcctcagc

SEQ ID NO: 5900615 - DNA, 22 bp, Homo sapiens
gacaggtggggcctcagcctgg

SEQ ID NO: 5900616 - DNA, 23 bp, Homo sapiens
gacaggtggggcctcagcctggg

SEQ ID NO: 5900617 - DNA, 20 bp, Homo sapiens
gacaggtgtgagccactgcg

SEQ ID NO: 5900618 - DNA, 16 bp, Homo sapiens
gacaggtgtgccgaca

SEQ ID NO: 5900619 - DNA, 22 bp, Homo sapiens
gacaggttcccagcagctgggc

SEQ ID NO: 5900620 - DNA, 22 bp, Homo sapiens
gacaggtttgggacccctggtg

SEQ ID NO: 5900621 - DNA, 15 bp, Homo sapiens
gacagtaaaatacta

SEQ ID NO: 5900622 - DNA, 23 bp, Homo sapiens
gacagtaaacactccacattctt

SEQ ID NO: 5900623 - DNA, 21 bp, Homo sapiens
gacagtaacttggttatacat

SEQ ID NO: 5900624 - DNA, 14 bp, Homo sapiens
gacagtaagagttt

SEQ ID NO: 5900625 - DNA, 16 bp, Homo sapiens
gacagtaagagtttac

SEQ ID NO: 5900626 - DNA, 19 bp, Homo sapiens
gacagtaagagtttacaag

SEQ ID NO: 5900627 - DNA, 16 bp, Homo sapiens
gacagtaagattttat

SEQ ID NO: 5900628 - DNA, 20 bp, Homo sapiens
gacagtaagtttattgttaa

SEQ ID NO: 5900629 - DNA, 17 bp, Homo sapiens
gacagtacctgattgta

SEQ ID NO: 5900630 - DNA, 18 bp, Homo sapiens
gacagtagcattgaagtg

SEQ ID NO: 5900631 - DNA, 16 bp, Homo sapiens
gacagtaggatttttc

SEQ ID NO: 5900632 - DNA, 17 bp, Homo sapiens
gacagtatcactgtctt

SEQ ID NO: 5900633 - DNA, 21 bp, Homo sapiens
gacagtatcactgtctttcct

SEQ ID NO: 5900634 - DNA, 21 bp, Homo sapiens
gacagtatcccacatccaact

SEQ ID NO: 5900635 - DNA, 14 bp, Homo sapiens
gacagtatgagaaa

SEQ ID NO: 5900636 - DNA, 14 bp, Homo sapiens
gacagtattaaggg

SEQ ID NO: 5900637 - DNA, 16 bp, Homo sapiens
gacagtattctcagtg

SEQ ID NO: 5900638 - DNA, 18 bp, Homo sapiens
gacagtattgccacctct

SEQ ID NO: 5900639 - DNA, 15 bp, Homo sapiens
gacagtcaaaaccaa

SEQ ID NO: 5900640 - DNA, 22 bp, Homo sapiens
gacagtcaaggagtggcttact

SEQ ID NO: 5900641 - DNA, 18 bp, Homo sapiens
gacagtcacctcatggaa

SEQ ID NO: 5900642 - DNA, 22 bp, Homo sapiens
gacagtcactgccactttgcac

SEQ ID NO: 5900643 - DNA, 15 bp, Homo sapiens
gacagtcagctgtgg

SEQ ID NO: 5900644 - DNA, 20 bp, Homo sapiens
gacagtcagctgtggggaac

SEQ ID NO: 5900645 - DNA, 14 bp, Homo sapiens
gacagtcaggaagc

SEQ ID NO: 5900646 - DNA, 23 bp, Homo sapiens
gacagtcaggaagcctcctgctg

SEQ ID NO: 5900647 - DNA, 13 bp, Homo sapiens
gacagtccacagg

SEQ ID NO: 5900648 - DNA, 18 bp, Homo sapiens
gacagtccacaggggcca

SEQ ID NO: 5900649 - DNA, 17 bp, Homo sapiens
gacagtccagcctggag

SEQ ID NO: 5900650 - DNA, 20 bp, Homo sapiens
gacagtccctgccaatggac

SEQ ID NO: 5900651 - DNA, 21 bp, Homo sapiens
gacagtccgtcaaaacagatt

SEQ ID NO: 5900652 - DNA, 14 bp, Homo sapiens
gacagtcctgggag

SEQ ID NO: 5900653 - DNA, 15 bp, Homo sapiens
gacagtcctgggaga

SEQ ID NO: 5900654 - DNA, 18 bp, Homo sapiens
gacagtcctgggagaacc

SEQ ID NO: 5900655 - DNA, 23 bp, Homo sapiens
gacagtcctgggagaacctcagg

SEQ ID NO: 5900656 - DNA, 15 bp, Homo sapiens
gacagtcctttccca

SEQ ID NO: 5900657 - DNA, 18 bp, Homo sapiens
gacagtcgctcagtctgt

SEQ ID NO: 5900658 - DNA, 22 bp, Homo sapiens
gacagtcgctcagtctgttcac

SEQ ID NO: 5900659 - DNA, 19 bp, Homo sapiens
gacagtcggaaaagcgtct

SEQ ID NO: 5900660 - DNA, 13 bp, Homo sapiens
gacagtctcacca

SEQ ID NO: 5900661 - DNA, 13 bp, Homo sapiens
gacagtctcactt

SEQ ID NO: 5900662 - DNA, 14 bp, Homo sapiens
gacagtctccctga

SEQ ID NO: 5900663 - DNA, 18 bp, Homo sapiens
gacagtctccctgatgga

SEQ ID NO: 5900664 - DNA, 22 bp, Homo sapiens
gacagtctccctgatggaccct

SEQ ID NO: 5900665 - DNA, 12 bp, Homo sapiens
gacagtctgctc

SEQ ID NO: 5900666 - DNA, 22 bp, Homo sapiens
gacagtctggaggtcccagaca

SEQ ID NO: 5900667 - DNA, 17 bp, Homo sapiens
gacagtctgttatgcac

SEQ ID NO: 5900668 - DNA, 19 bp, Homo sapiens
gacagtctttgatcatcat

SEQ ID NO: 5900669 - DNA, 16 bp, Homo sapiens
gacagtgaatattcaa

SEQ ID NO: 5900670 - DNA, 15 bp, Homo sapiens
gacagtgaatttggg

SEQ ID NO: 5900671 - DNA, 23 bp, Homo sapiens
gacagtgacgtgactcagagctt

SEQ ID NO: 5900672 - DNA, 14 bp, Homo sapiens
gacagtgaggaaaa

SEQ ID NO: 5900673 - DNA, 15 bp, Homo sapiens
gacagtgaggtcctg

SEQ ID NO: 5900674 - DNA, 17 bp, Homo sapiens
gacagtgaggtcctggg

SEQ ID NO: 5900675 - DNA, 19 bp, Homo sapiens
gacagtgatattggaactt

SEQ ID NO: 5900676 - DNA, 13 bp, Homo sapiens
gacagtgcacatg

SEQ ID NO: 5900677 - DNA, 16 bp, Homo sapiens
gacagtgcacatgaac

SEQ ID NO: 5900678 - DNA, 12 bp, Homo sapiens
gacagtgccatc

SEQ ID NO: 5900679 - DNA, 14 bp, Homo sapiens
gacagtgccatccc

SEQ ID NO: 5900680 - DNA, 16 bp, Homo sapiens
gacagtgcccatgcaa

SEQ ID NO: 5900681 - DNA, 16 bp, Homo sapiens
gacagtgcctatactg

SEQ ID NO: 5900682 - DNA, 13 bp, Homo sapiens
gacagtgcctggg

SEQ ID NO: 5900683 - DNA, 17 bp, Homo sapiens
gacagtgcctgggaatg

SEQ ID NO: 5900684 - DNA, 21 bp, Homo sapiens
gacagtgcctgggaatgtatt

SEQ ID NO: 5900685 - DNA, 15 bp, Homo sapiens
gacagtgctgacccc

SEQ ID NO: 5900686 - DNA, 21 bp, Homo sapiens
gacagtgctgagattggaaaa

SEQ ID NO: 5900687 - DNA, 18 bp, Homo sapiens
gacagtgctgttgaagat

SEQ ID NO: 5900688 - DNA, 17 bp, Homo sapiens
gacagtgcttcagcctg

SEQ ID NO: 5900689 - DNA, 13 bp, Homo sapiens
gacagtgcttgca

SEQ ID NO: 5900690 - DNA, 15 bp, Homo sapiens
gacagtggatatgac

SEQ ID NO: 5900691 - DNA, 20 bp, Homo sapiens
gacagtggatatgacccaca

SEQ ID NO: 5900692 - DNA, 13 bp, Homo sapiens
gacagtggcagga

SEQ ID NO: 5900693 - DNA, 13 bp, Homo sapiens
gacagtggcctct

SEQ ID NO: 5900694 - DNA, 17 bp, Homo sapiens
gacagtggctgacaagg

SEQ ID NO: 5900695 - DNA, 15 bp, Homo sapiens
gacagtggctgctct

SEQ ID NO: 5900696 - DNA, 19 bp, Homo sapiens
gacagtggctgctctggga

SEQ ID NO: 5900697 - DNA, 21 bp, Homo sapiens
gacagtggctgctctgggaag

SEQ ID NO: 5900698 - DNA, 13 bp, Homo sapiens
gacagtgggaaat

SEQ ID NO: 5900699 - DNA, 23 bp, Homo sapiens
gacagtgggcactaagggtggag

SEQ ID NO: 5900700 - DNA, 23 bp, Homo sapiens
gacagtgggcaggaggccccagg

SEQ ID NO: 5900701 - DNA, 17 bp, Homo sapiens
gacagtgggggtgcctg

SEQ ID NO: 5900702 - DNA, 17 bp, Homo sapiens
gacagtggtgggcgggg

SEQ ID NO: 5900703 - DNA, 12 bp, Homo sapiens
gacagtgtacaa

SEQ ID NO: 5900704 - DNA, 20 bp, Homo sapiens
gacagtgttccccgatacca

SEQ ID NO: 5900705 - DNA, 23 bp, Homo sapiens
gacagtgttgaaaatgttcagaa

SEQ ID NO: 5900706 - DNA, 14 bp, Homo sapiens
gacagtgttttgca

SEQ ID NO: 5900707 - DNA, 14 bp, Homo sapiens
gacagttaagagaa

SEQ ID NO: 5900708 - DNA, 23 bp, Homo sapiens
gacagttacacttgacagacaaa

SEQ ID NO: 5900709 - DNA, 19 bp, Homo sapiens
gacagttagacccctgggt

SEQ ID NO: 5900710 - DNA, 19 bp, Homo sapiens
gacagttcacaccctgcaa

SEQ ID NO: 5900711 - DNA, 21 bp, Homo sapiens
gacagttccagaagtgtgact

SEQ ID NO: 5900712 - DNA, 22 bp, Homo sapiens
gacagttgctggcatgtcttca

SEQ ID NO: 5900713 - DNA, 21 bp, Homo sapiens
gacagttggagggaaagccag

SEQ ID NO: 5900714 - DNA, 13 bp, Homo sapiens
gacagttggcaga

SEQ ID NO: 5900715 - DNA, 24 bp, Homo sapiens
gacagttggcagagaaggcctctt

SEQ ID NO: 5900716 - DNA, 13 bp, Homo sapiens
gacagttgggttt

SEQ ID NO: 5900717 - DNA, 17 bp, Homo sapiens
gacagttgggtttttta

SEQ ID NO: 5900718 - DNA, 23 bp, Homo sapiens
gacagtttatcatgaagcctgtg

SEQ ID NO: 5900719 - DNA, 12 bp, Homo sapiens
gacagtttctta

SEQ ID NO: 5900720 - DNA, 14 bp, Homo sapiens
gacagtttcttagc

SEQ ID NO: 5900721 - DNA, 22 bp, Homo sapiens
gacagtttcttttgtgttccta

SEQ ID NO: 5900722 - DNA, 13 bp, Homo sapiens
gacagtttgtaaa

SEQ ID NO: 5900723 - DNA, 21 bp, Homo sapiens
gacagtttgtttcctgtctga

SEQ ID NO: 5900724 - DNA, 14 bp, Homo sapiens
gacagtttttctgt

SEQ ID NO: 5900725 - DNA, 19 bp, Homo sapiens
gacagtttttgacatttat

SEQ ID NO: 5900726 - DNA, 13 bp, Homo sapiens
gacataaaacaga

SEQ ID NO: 5900727 - DNA, 19 bp, Homo sapiens
gacataaaatttacattta

SEQ ID NO: 5900728 - DNA, 19 bp, Homo sapiens
gacataaacccatctgtaa

SEQ ID NO: 5900729 - DNA, 19 bp, Homo sapiens
gacataaagttgataaaga

SEQ ID NO: 5900730 - DNA, 15 bp, Homo sapiens
gacataaatgttcac

SEQ ID NO: 5900731 - DNA, 16 bp, Homo sapiens
gacataaatgttcact

SEQ ID NO: 5900732 - DNA, 13 bp, Homo sapiens
gacataaattgta

SEQ ID NO: 5900733 - DNA, 15 bp, Homo sapiens
gacataaattgtaat

SEQ ID NO: 5900734 - DNA, 17 bp, Homo sapiens
gacataaccactgcttc

SEQ ID NO: 5900735 - DNA, 22 bp, Homo sapiens
gacataacgtttttcctttaaa

SEQ ID NO: 5900736 - DNA, 19 bp, Homo sapiens
gacataagcaatcatttta

SEQ ID NO: 5900737 - DNA, 20 bp, Homo sapiens
gacataagcaatcattttat

SEQ ID NO: 5900738 - DNA, 23 bp, Homo sapiens
gacataagctggtatcagtggtt

SEQ ID NO: 5900739 - DNA, 22 bp, Homo sapiens
gacataatggggtcctggccat

SEQ ID NO: 5900740 - DNA, 22 bp, Homo sapiens
gacataatgtagtgagtgtaga

SEQ ID NO: 5900741 - DNA, 20 bp, Homo sapiens
gacataatttaaaataaata

SEQ ID NO: 5900742 - DNA, 11 bp, Homo sapiens
gacataatttc

SEQ ID NO: 5900743 - DNA, 21 bp, Homo sapiens
gacatacagagatatacaaat

SEQ ID NO: 5900744 - DNA, 21 bp, Homo sapiens
gacatacatagacatttcaaa

SEQ ID NO: 5900745 - DNA, 19 bp, Homo sapiens
gacatacatgctacttttt

SEQ ID NO: 5900746 - DNA, 18 bp, Homo sapiens
gacataccccactgggca

SEQ ID NO: 5900747 - DNA, 20 bp, Homo sapiens
gacataccccactgggcaca

SEQ ID NO: 5900748 - DNA, 17 bp, Homo sapiens
gacatacgaaacacaaa

SEQ ID NO: 5900749 - DNA, 19 bp, Homo sapiens
gacatactctctgcctggt

SEQ ID NO: 5900750 - DNA, 15 bp, Homo sapiens
gacatacttgaaggg

SEQ ID NO: 5900751 - DNA, 19 bp, Homo sapiens
gacatacttgaagggccag

SEQ ID NO: 5900752 - DNA, 19 bp, Homo sapiens
gacatagaagagccaagag

SEQ ID NO: 5900753 - DNA, 14 bp, Homo sapiens
gacatagatatttt

SEQ ID NO: 5900754 - DNA, 20 bp, Homo sapiens
gacatagcatccaagtggca

SEQ ID NO: 5900755 - DNA, 21 bp, Homo sapiens
gacatagcatccaagtggcat

SEQ ID NO: 5900756 - DNA, 22 bp, Homo sapiens
gacatagccaatggacaagcag

SEQ ID NO: 5900757 - DNA, 18 bp, Homo sapiens
gacatagcccatccctgc

SEQ ID NO: 5900758 - DNA, 19 bp, Homo sapiens
gacatagccgattctctgc

SEQ ID NO: 5900759 - DNA, 21 bp, Homo sapiens
gacatagccgattctctgccc

SEQ ID NO: 5900760 - DNA, 13 bp, Homo sapiens
gacatagcctcat

SEQ ID NO: 5900761 - DNA, 13 bp, Homo sapiens
gacatagcctttg

SEQ ID NO: 5900762 - DNA, 15 bp, Homo sapiens
gacataggccaaggc

SEQ ID NO: 5900763 - DNA, 23 bp, Homo sapiens
gacataggccatgaaaaaaatga

SEQ ID NO: 5900764 - DNA, 23 bp, Homo sapiens
gacataggcttcaattggtggaa

SEQ ID NO: 5900765 - DNA, 16 bp, Homo sapiens
gacatagtatggaagt

SEQ ID NO: 5900766 - DNA, 18 bp, Homo sapiens
gacatagtggatggacag

SEQ ID NO: 5900767 - DNA, 17 bp, Homo sapiens
gacatatatattaaaat

SEQ ID NO: 5900768 - DNA, 15 bp, Homo sapiens
gacatatattatata

SEQ ID NO: 5900769 - DNA, 14 bp, Homo sapiens
gacatatatttatg

SEQ ID NO: 5900770 - DNA, 20 bp, Homo sapiens
gacatatattttttaaaata

SEQ ID NO: 5900771 - DNA, 17 bp, Homo sapiens
gacatatcactgctgct

SEQ ID NO: 5900772 - DNA, 15 bp, Homo sapiens
gacatatcatctgtg

SEQ ID NO: 5900773 - DNA, 18 bp, Homo sapiens
gacatatcatgtgtgaga

SEQ ID NO: 5900774 - DNA, 14 bp, Homo sapiens
gacatatctacact

SEQ ID NO: 5900775 - DNA, 20 bp, Homo sapiens
gacatattcatttggaaata

SEQ ID NO: 5900776 - DNA, 15 bp, Homo sapiens
gacatattcccatgg

SEQ ID NO: 5900777 - DNA, 15 bp, Homo sapiens
gacatatttaactgg

SEQ ID NO: 5900778 - DNA, 16 bp, Homo sapiens
gacatatttaatgttt

SEQ ID NO: 5900779 - DNA, 18 bp, Homo sapiens
gacatatttaatgtttta

SEQ ID NO: 5900780 - DNA, 21 bp, Homo sapiens
gacatatttaatgttttaaat

SEQ ID NO: 5900781 - DNA, 23 bp, Homo sapiens
gacatatttaatgttttaaatgt

SEQ ID NO: 5900782 - DNA, 13 bp, Homo sapiens
gacatatttgcat

SEQ ID NO: 5900783 - DNA, 19 bp, Homo sapiens
gacatcaaactcaatgctt

SEQ ID NO: 5900784 - DNA, 19 bp, Homo sapiens
gacatcaaatttgccacca

SEQ ID NO: 5900785 - DNA, 15 bp, Homo sapiens
gacatcaacatggca

SEQ ID NO: 5900786 - DNA, 23 bp, Homo sapiens
gacatcaactgcatcaagatgtg

SEQ ID NO: 5900787 - DNA, 18 bp, Homo sapiens
gacatcaagatacacttg

SEQ ID NO: 5900788 - DNA, 19 bp, Homo sapiens
gacatcaagcacagaagga

SEQ ID NO: 5900789 - DNA, 14 bp, Homo sapiens
gacatcaagctcaa

SEQ ID NO: 5900790 - DNA, 17 bp, Homo sapiens
gacatcaagctcaaggc

SEQ ID NO: 5900791 - DNA, 18 bp, Homo sapiens
gacatcaagtgtaattag

SEQ ID NO: 5900792 - DNA, 15 bp, Homo sapiens
gacatcacagcagaa

SEQ ID NO: 5900793 - DNA, 16 bp, Homo sapiens
gacatcacagcagaat

SEQ ID NO: 5900794 - DNA, 14 bp, Homo sapiens
gacatcacagcagc

SEQ ID NO: 5900795 - DNA, 18 bp, Homo sapiens
gacatcacagcagcctcc

SEQ ID NO: 5900796 - DNA, 17 bp, Homo sapiens
gacatcacagggcctca

SEQ ID NO: 5900797 - DNA, 13 bp, Homo sapiens
gacatcactggca

SEQ ID NO: 5900798 - DNA, 11 bp, Homo sapiens
gacatcactgt

SEQ ID NO: 5900799 - DNA, 20 bp, Homo sapiens
gacatcagaagtaactccca

SEQ ID NO: 5900800 - DNA, 21 bp, Homo sapiens
gacatcagaagtaactcccac

SEQ ID NO: 5900801 - DNA, 16 bp, Homo sapiens
gacatcagatttctta

SEQ ID NO: 5900802 - DNA, 20 bp, Homo sapiens
gacatcagatttcttaatgt

SEQ ID NO: 5900803 - DNA, 11 bp, Homo sapiens
gacatcagcac

SEQ ID NO: 5900804 - DNA, 13 bp, Homo sapiens
gacatcagcatca

SEQ ID NO: 5900805 - DNA, 15 bp, Homo sapiens
gacatcagccagctg

SEQ ID NO: 5900806 - DNA, 16 bp, Homo sapiens
gacatcagggagtaag

SEQ ID NO: 5900807 - DNA, 16 bp, Homo sapiens
gacatcagtattctgc

SEQ ID NO: 5900808 - DNA, 15 bp, Homo sapiens
gacatcagtgtttgt

SEQ ID NO: 5900809 - DNA, 19 bp, Homo sapiens
gacatcatcattcttgtgg

SEQ ID NO: 5900810 - DNA, 18 bp, Homo sapiens
gacatcatgaattttaca

SEQ ID NO: 5900811 - DNA, 19 bp, Homo sapiens
gacatcattcatgacaaca

SEQ ID NO: 5900812 - DNA, 17 bp, Homo sapiens
gacatcattgtcagcct

SEQ ID NO: 5900813 - DNA, 13 bp, Homo sapiens
gacatcatttgta

SEQ ID NO: 5900814 - DNA, 16 bp, Homo sapiens
gacatccaagcttcct

SEQ ID NO: 5900815 - DNA, 20 bp, Homo sapiens
gacatccacatgcacatgta

SEQ ID NO: 5900816 - DNA, 22 bp, Homo sapiens
gacatccacatgcacatgtatt

SEQ ID NO: 5900817 - DNA, 19 bp, Homo sapiens
gacatccaggatggctgca

SEQ ID NO: 5900818 - DNA, 18 bp, Homo sapiens
gacatccataaagaagca

SEQ ID NO: 5900819 - DNA, 22 bp, Homo sapiens
gacatccatgtttgtaaaacta

SEQ ID NO: 5900820 - DNA, 23 bp, Homo sapiens
gacatccccccgccaaaagctgc

SEQ ID NO: 5900821 - DNA, 19 bp, Homo sapiens
gacatccccctccttgccg

SEQ ID NO: 5900822 - DNA, 20 bp, Homo sapiens
gacatccctcccccagcaga

SEQ ID NO: 5900823 - DNA, 14 bp, Homo sapiens
gacatcccttcctg

SEQ ID NO: 5900824 - DNA, 19 bp, Homo sapiens
gacatcccttcctggaaac

SEQ ID NO: 5900825 - DNA, 20 bp, Homo sapiens
gacatccgtcattgctgctg

SEQ ID NO: 5900826 - DNA, 20 bp, Homo sapiens
gacatccgtcccacatcagg

SEQ ID NO: 5900827 - DNA, 21 bp, Homo sapiens
gacatcctagaggtagagaaa

SEQ ID NO: 5900828 - DNA, 14 bp, Homo sapiens
gacatcctagcccc

SEQ ID NO: 5900829 - DNA, 16 bp, Homo sapiens
gacatcctagccccac

SEQ ID NO: 5900830 - DNA, 18 bp, Homo sapiens
gacatcctagccccaccc

SEQ ID NO: 5900831 - DNA, 19 bp, Homo sapiens
gacatcctgtataagcact

SEQ ID NO: 5900832 - DNA, 19 bp, Homo sapiens
gaccacacagtccccagac

SEQ ID NO: 5900833 - DNA, 20 bp, Homo sapiens
gaccacacagtccccagact

SEQ ID NO: 5900834 - DNA, 19 bp, Homo sapiens
gaccacacccgaagtcctg

SEQ ID NO: 5900835 - DNA, 12 bp, Homo sapiens
gaccacacctcc

SEQ ID NO: 5900836 - DNA, 13 bp, Homo sapiens
gaccacacctccg

SEQ ID NO: 5900837 - DNA, 12 bp, Homo sapiens
gaccacacctgc

SEQ ID NO: 5900838 - DNA, 11 bp, Homo sapiens
gaccacacgct

SEQ ID NO: 5900839 - DNA, 22 bp, Homo sapiens
gaccacactccagctgggatca

SEQ ID NO: 5900840 - DNA, 22 bp, Homo sapiens
gaccacactgcacacagtgact

SEQ ID NO: 5900841 - DNA, 23 bp, Homo sapiens
gaccacacttcctgtccagagag

SEQ ID NO: 5900842 - DNA, 20 bp, Homo sapiens
gaccacactttgagaacctg

SEQ ID NO: 5900843 - DNA, 21 bp, Homo sapiens
gaccacagactcaatgtgctc

SEQ ID NO: 5900844 - DNA, 17 bp, Homo sapiens
gaccacagaggctgtgg

SEQ ID NO: 5900845 - DNA, 20 bp, Homo sapiens
gaccacagcaaggcacctgc

SEQ ID NO: 5900846 - DNA, 21 bp, Homo sapiens
gaccacagcaaggcacctgca

SEQ ID NO: 5900847 - DNA, 20 bp, Homo sapiens
gaccacagctgctggccagg

SEQ ID NO: 5900848 - DNA, 21 bp, Homo sapiens
gaccacagggttcaaaatgtc

SEQ ID NO: 5900849 - DNA, 23 bp, Homo sapiens
gaccacagggttcaaaatgtctg

SEQ ID NO: 5900850 - DNA, 20 bp, Homo sapiens
gaccacaggtgcacgccacc

SEQ ID NO: 5900851 - DNA, 17 bp, Homo sapiens
gaccacataagaaggca

SEQ ID NO: 5900852 - DNA, 24 bp, Homo sapiens
gaccacatagtgtgagaacttcca

SEQ ID NO: 5900853 - DNA, 15 bp, Homo sapiens
gaccacatccacccc

SEQ ID NO: 5900854 - DNA, 18 bp, Homo sapiens
gaccacatctgtcctcac

SEQ ID NO: 5900855 - DNA, 17 bp, Homo sapiens
gaccacatctttatctg

SEQ ID NO: 5900856 - DNA, 17 bp, Homo sapiens
gaccacatgccactgcc

SEQ ID NO: 5900857 - DNA, 22 bp, Homo sapiens
gaccacatgcgctcctggcttt

SEQ ID NO: 5900858 - DNA, 13 bp, Homo sapiens
gaccaccaaagtc

SEQ ID NO: 5900859 - DNA, 13 bp, Homo sapiens
gaccaccaacaca

SEQ ID NO: 5900860 - DNA, 18 bp, Homo sapiens
gaccaccaacacacagga

SEQ ID NO: 5900861 - DNA, 16 bp, Homo sapiens
gaccaccacctcagag

SEQ ID NO: 5900862 - DNA, 14 bp, Homo sapiens
gaccaccagcccca

SEQ ID NO: 5900863 - DNA, 20 bp, Homo sapiens
gaccaccagccccagcaaga

SEQ ID NO: 5900864 - DNA, 19 bp, Homo sapiens
gaccaccagggcatctctg

SEQ ID NO: 5900865 - DNA, 20 bp, Homo sapiens
gaccaccagggcatctctgg

SEQ ID NO: 5900866 - DNA, 22 bp, Homo sapiens
gaccaccagggcatctctgggc

SEQ ID NO: 5900867 - DNA, 23 bp, Homo sapiens
gaccaccagggcatctctgggct

SEQ ID NO: 5900868 - DNA, 14 bp, Homo sapiens
gaccaccagggtcc

SEQ ID NO: 5900869 - DNA, 19 bp, Homo sapiens
gaccaccagggtcccagga

SEQ ID NO: 5900870 - DNA, 21 bp, Homo sapiens
gaccacccaacctcaccctcc

SEQ ID NO: 5900871 - DNA, 16 bp, Homo sapiens
gaccacccatatcatg

SEQ ID NO: 5900872 - DNA, 10 bp, Homo sapiens
gaccaccccc

SEQ ID NO: 5900873 - DNA, 22 bp, Homo sapiens
gaccacccccgagcttgcctca

SEQ ID NO: 5900874 - DNA, 18 bp, Homo sapiens
gaccaccccctgttccct

SEQ ID NO: 5900875 - DNA, 23 bp, Homo sapiens
gaccaccccctgttccctgttct

SEQ ID NO: 5900876 - DNA, 18 bp, Homo sapiens
gaccaccccgcctgccct

SEQ ID NO: 5900877 - DNA, 17 bp, Homo sapiens
gaccacccctgcctcca

SEQ ID NO: 5900878 - DNA, 20 bp, Homo sapiens
gaccacccctgcctccaccc

SEQ ID NO: 5900879 - DNA, 21 bp, Homo sapiens
gaccacccggcattctctgcc

SEQ ID NO: 5900880 - DNA, 19 bp, Homo sapiens
gaccaccctcccctctctt

SEQ ID NO: 5900881 - DNA, 15 bp, Homo sapiens
gaccaccctgagccg

SEQ ID NO: 5900882 - DNA, 12 bp, Homo sapiens
gaccaccctgcc

SEQ ID NO: 5900883 - DNA, 16 bp, Homo sapiens
gaccaccgcgcccctc

SEQ ID NO: 5900884 - DNA, 17 bp, Homo sapiens
gaccaccgcgcccctct

SEQ ID NO: 5900885 - DNA, 22 bp, Homo sapiens
gaccaccgcgcccctctgcgcc

SEQ ID NO: 5900886 - DNA, 24 bp, Homo sapiens
gaccaccgcgcccctctgcgcccc

SEQ ID NO: 5900887 - DNA, 11 bp, Homo sapiens
gaccacctcca

SEQ ID NO: 5900888 - DNA, 22 bp, Homo sapiens
gaccacctcctctgccagcagg

SEQ ID NO: 5900889 - DNA, 15 bp, Homo sapiens
gaccacctgccagcc

SEQ ID NO: 5900890 - DNA, 14 bp, Homo sapiens
gaccacctgcccaa

SEQ ID NO: 5900891 - DNA, 14 bp, Homo sapiens
gaccacctgcttct

SEQ ID NO: 5900892 - DNA, 15 bp, Homo sapiens
gaccacctgcttctg

SEQ ID NO: 5900893 - DNA, 16 bp, Homo sapiens
gaccacctgcttctga

SEQ ID NO: 5900894 - DNA, 20 bp, Homo sapiens
gaccacctgcttctgaactc

SEQ ID NO: 5900895 - DNA, 17 bp, Homo sapiens
gaccaccttcccttcct

SEQ ID NO: 5900896 - DNA, 20 bp, Homo sapiens
gaccaccttctgtccccagc

SEQ ID NO: 5900897 - DNA, 24 bp, Homo sapiens
gaccaccttctgtccccagccctg

SEQ ID NO: 5900898 - DNA, 17 bp, Homo sapiens
gaccacgcccgtcctgc

SEQ ID NO: 5900899 - DNA, 19 bp, Homo sapiens
gaccacgcccgtcctgcct

SEQ ID NO: 5900900 - DNA, 22 bp, Homo sapiens
gaccacgcccgtcctgcctgtg

SEQ ID NO: 5900901 - DNA, 16 bp, Homo sapiens
gaccacgccgccctcc

SEQ ID NO: 5900902 - DNA, 18 bp, Homo sapiens
gaccacgccgccctccat

SEQ ID NO: 5900903 - DNA, 21 bp, Homo sapiens
gaccacgctttctagctgttg

SEQ ID NO: 5900904 - DNA, 14 bp, Homo sapiens
gaccacgggcctca

SEQ ID NO: 5900905 - DNA, 19 bp, Homo sapiens
gaccacgggcctcagtttc

SEQ ID NO: 5900906 - DNA, 20 bp, Homo sapiens
gaccacgggcctcagtttcc

SEQ ID NO: 5900907 - DNA, 20 bp, Homo sapiens
gaccacggtccaatccagcc

SEQ ID NO: 5900908 - DNA, 19 bp, Homo sapiens
gaccacgtctatttcatca

SEQ ID NO: 5900909 - DNA, 22 bp, Homo sapiens
gaccacgtgaaatttgcctctg

SEQ ID NO: 5900910 - DNA, 23 bp, Homo sapiens
gaccacgtgaaatttgcctctgt

SEQ ID NO: 5900911 - DNA, 16 bp, Homo sapiens
gaccacgtttctaaag

SEQ ID NO: 5900912 - DNA, 23 bp, Homo sapiens
gaccactagctaagcaagccagg

SEQ ID NO: 5900913 - DNA, 14 bp, Homo sapiens
gaccactcagagac

SEQ ID NO: 5900914 - DNA, 19 bp, Homo sapiens
gaccactcagagacatgca

SEQ ID NO: 5900915 - DNA, 12 bp, Homo sapiens
gaccactcagcc

SEQ ID NO: 5900916 - DNA, 16 bp, Homo sapiens
gaccactcagccccta

SEQ ID NO: 5900917 - DNA, 23 bp, Homo sapiens
gaccactcctgtccctgtagctc

SEQ ID NO: 5900918 - DNA, 17 bp, Homo sapiens
gaccactcgaggcctgc

SEQ ID NO: 5900919 - DNA, 22 bp, Homo sapiens
gaccactcttctctccaaggaa

SEQ ID NO: 5900920 - DNA, 17 bp, Homo sapiens
gaccactgaattcactc

SEQ ID NO: 5900921 - DNA, 18 bp, Homo sapiens
gaccactgaattcactcc

SEQ ID NO: 5900922 - DNA, 20 bp, Homo sapiens
gaccactgagtaccaggggc

SEQ ID NO: 5900923 - DNA, 22 bp, Homo sapiens
gaccactgagtaccaggggctg

SEQ ID NO: 5900924 - DNA, 18 bp, Homo sapiens
gaccactgcagaagacag

SEQ ID NO: 5900925 - DNA, 16 bp, Homo sapiens
gaccactgggcccctc

SEQ ID NO: 5900926 - DNA, 18 bp, Homo sapiens
gaccactgggcccctcag

SEQ ID NO: 5900927 - DNA, 23 bp, Homo sapiens
gaccactgggcccctcaggggaa

SEQ ID NO: 5900928 - DNA, 19 bp, Homo sapiens
gaccactgtctttttctta

SEQ ID NO: 5900929 - DNA, 14 bp, Homo sapiens
gaccactgttatca

SEQ ID NO: 5900930 - DNA, 21 bp, Homo sapiens
gaccacttacagtgtgataag

SEQ ID NO: 5900931 - DNA, 15 bp, Homo sapiens
gaccacttccagggg

SEQ ID NO: 5900932 - DNA, 19 bp, Homo sapiens
gaccacttccttaacagct

SEQ ID NO: 5900933 - DNA, 17 bp, Homo sapiens
gaccacttgaggcctga

SEQ ID NO: 5900934 - DNA, 22 bp, Homo sapiens
gaccactttggagactggggtg

SEQ ID NO: 5900935 - DNA, 23 bp, Homo sapiens
gaccactttggagactggggtgg

SEQ ID NO: 5900936 - DNA, 17 bp, Homo sapiens
gaccagaaacagggaca

SEQ ID NO: 5900937 - DNA, 18 bp, Homo sapiens
gaccagaacagcatggcc

SEQ ID NO: 5900938 - DNA, 19 bp, Homo sapiens
gaccagaactttttcctct

SEQ ID NO: 5900939 - DNA, 13 bp, Homo sapiens
gaccagaagaaaa

SEQ ID NO: 5900940 - DNA, 14 bp, Homo sapiens
gaccagaagaaaag

SEQ ID NO: 5900941 - DNA, 15 bp, Homo sapiens
gaccagaagaaaaga

SEQ ID NO: 5900942 - DNA, 21 bp, Homo sapiens
gaccagaagacaaaggcccaa

SEQ ID NO: 5900943 - DNA, 16 bp, Homo sapiens
gaccagaagccaaaga

SEQ ID NO: 5900944 - DNA, 15 bp, Homo sapiens
gaccagaagccttgg

SEQ ID NO: 5900945 - DNA, 17 bp, Homo sapiens
gaccagaagccttggaa

SEQ ID NO: 5900946 - DNA, 17 bp, Homo sapiens
gaccagaagctccccca

SEQ ID NO: 5900947 - DNA, 20 bp, Homo sapiens
gaccagaagctcccccagca

SEQ ID NO: 5900948 - DNA, 19 bp, Homo sapiens
gaccagaagggaaacagtc

SEQ ID NO: 5900949 - DNA, 21 bp, Homo sapiens
gaccagaagtgaatgggaaag

SEQ ID NO: 5900950 - DNA, 17 bp, Homo sapiens
gaccagaagtggcagga

SEQ ID NO: 5900951 - DNA, 11 bp, Homo sapiens
gaccagaatgc

SEQ ID NO: 5900952 - DNA, 17 bp, Homo sapiens
gaccagacaagctgttg

SEQ ID NO: 5900953 - DNA, 23 bp, Homo sapiens
gaccagacaccttgacagggcac

SEQ ID NO: 5900954 - DNA, 14 bp, Homo sapiens
gaccagaccaaggc

SEQ ID NO: 5900955 - DNA, 19 bp, Homo sapiens
gaccagacctagacctggg

SEQ ID NO: 5900956 - DNA, 11 bp, Homo sapiens
gaccagactaa

SEQ ID NO: 5900957 - DNA, 18 bp, Homo sapiens
gaccagagcaaaaatgta

SEQ ID NO: 5900958 - DNA, 14 bp, Homo sapiens
gaccagagcagttt

SEQ ID NO: 5900959 - DNA, 23 bp, Homo sapiens
gaccagagccagatgcaggacag

SEQ ID NO: 5900960 - DNA, 11 bp, Homo sapiens
gaccagagctc

SEQ ID NO: 5900961 - DNA, 14 bp, Homo sapiens
gaccagagctctgg

SEQ ID NO: 5900962 - DNA, 15 bp, Homo sapiens
gaccagagctctgga

SEQ ID NO: 5900963 - DNA, 17 bp, Homo sapiens
gaccagagctctggagc

SEQ ID NO: 5900964 - DNA, 14 bp, Homo sapiens
gaccagagctgcca

SEQ ID NO: 5900965 - DNA, 14 bp, Homo sapiens
gaccagagctgtct

SEQ ID NO: 5900966 - DNA, 18 bp, Homo sapiens
gaccagatctttctcttc

SEQ ID NO: 5900967 - DNA, 20 bp, Homo sapiens
gaccagcaacttgtcttttt

SEQ ID NO: 5900968 - DNA, 13 bp, Homo sapiens
gaccagcactcag

SEQ ID NO: 5900969 - DNA, 15 bp, Homo sapiens
gaccagcagacagag

SEQ ID NO: 5900970 - DNA, 20 bp, Homo sapiens
gaccagcagacagagccagg

SEQ ID NO: 5900971 - DNA, 23 bp, Homo sapiens
gaccagcagacagagccaggaga

SEQ ID NO: 5900972 - DNA, 22 bp, Homo sapiens
gaccagcagcaatctgtcttta

SEQ ID NO: 5900973 - DNA, 13 bp, Homo sapiens
gaccagcagcgcc

SEQ ID NO: 5900974 - DNA, 20 bp, Homo sapiens
gaccagcagcgcctttccca

SEQ ID NO: 5900975 - DNA, 16 bp, Homo sapiens
gaccagcaggagggaa

SEQ ID NO: 5900976 - DNA, 16 bp, Homo sapiens
gaccagcaggctcctc

SEQ ID NO: 5900977 - DNA, 17 bp, Homo sapiens
gaccagcatagttctgc

SEQ ID NO: 5900978 - DNA, 18 bp, Homo sapiens
gaccagcatagttctgca

SEQ ID NO: 5900979 - DNA, 17 bp, Homo sapiens
gaccagccaacctgggg

SEQ ID NO: 5900980 - DNA, 18 bp, Homo sapiens
gaccagccactcaaagga

SEQ ID NO: 5900981 - DNA, 12 bp, Homo sapiens
gaccagccagca

SEQ ID NO: 5900982 - DNA, 14 bp, Homo sapiens
gaccagcccacgct

SEQ ID NO: 5900983 - DNA, 16 bp, Homo sapiens
gaccagcccagcctgc

SEQ ID NO: 5900984 - DNA, 15 bp, Homo sapiens
gaccagcccattggc

SEQ ID NO: 5900985 - DNA, 19 bp, Homo sapiens
gaccagcccattggccgag

SEQ ID NO: 5900986 - DNA, 22 bp, Homo sapiens
gaccagccccaccatgcaactt

SEQ ID NO: 5900987 - DNA, 12 bp, Homo sapiens
gaccagcccttc

SEQ ID NO: 5900988 - DNA, 22 bp, Homo sapiens
gaccagccgtgagcatgtttgg

SEQ ID NO: 5900989 - DNA, 22 bp, Homo sapiens
gaccagcctccatgctgcctcc

SEQ ID NO: 5900990 - DNA, 14 bp, Homo sapiens
gaccagcctcgcca

SEQ ID NO: 5900991 - DNA, 14 bp, Homo sapiens
gaccagcctgccag

SEQ ID NO: 5900992 - DNA, 16 bp, Homo sapiens
gaccagcctgccaggc

SEQ ID NO: 5900993 - DNA, 18 bp, Homo sapiens
gaccagcctgccaggccc

SEQ ID NO: 5900994 - DNA, 18 bp, Homo sapiens
gaccagcctggccaacat

SEQ ID NO: 5900995 - DNA, 20 bp, Homo sapiens
gaccagcctggccaacatgg

SEQ ID NO: 5900996 - DNA, 14 bp, Homo sapiens
gaccagcctgtcca

SEQ ID NO: 5900997 - DNA, 15 bp, Homo sapiens
gaccagcctgtccaa

SEQ ID NO: 5900998 - DNA, 18 bp, Homo sapiens
gaccagcctgtccaacat

SEQ ID NO: 5900999 - DNA, 10 bp, Homo sapiens
gaccagcgga

SEQ ID NO: 5901000 - DNA, 19 bp, Homo sapiens
gaccagcggctgctcaagc

SEQ ID NO: 5901001 - DNA, 20 bp, Homo sapiens
gaccagcggctgctcaagcc

SEQ ID NO: 5901002 - DNA, 14 bp, Homo sapiens
gaccagctcaggac

SEQ ID NO: 5901003 - DNA, 13 bp, Homo sapiens
gaccagctccccc

SEQ ID NO: 5901004 - DNA, 18 bp, Homo sapiens
gaccagctccccctccct

SEQ ID NO: 5901005 - DNA, 20 bp, Homo sapiens
gaccagctccccctccctcc

SEQ ID NO: 5901006 - DNA, 14 bp, Homo sapiens
gaccagctctcttc

SEQ ID NO: 5901007 - DNA, 23 bp, Homo sapiens
gaccagctctcttcctgtctttg

SEQ ID NO: 5901008 - DNA, 13 bp, Homo sapiens
gaccccctcacca

SEQ ID NO: 5901009 - DNA, 20 bp, Homo sapiens
gaccccctcaccatccagtg

SEQ ID NO: 5901010 - DNA, 14 bp, Homo sapiens
gaccccctcagcct

SEQ ID NO: 5901011 - DNA, 14 bp, Homo sapiens
gaccccctcccctg

SEQ ID NO: 5901012 - DNA, 17 bp, Homo sapiens
gaccccctcgccagctt

SEQ ID NO: 5901013 - DNA, 19 bp, Homo sapiens
gaccccctcgccagcttgg

SEQ ID NO: 5901014 - DNA, 20 bp, Homo sapiens
gaccccctcgccagcttggc

SEQ ID NO: 5901015 - DNA, 17 bp, Homo sapiens
gaccccctctccctgca

SEQ ID NO: 5901016 - DNA, 13 bp, Homo sapiens
gaccccctgagtc

SEQ ID NO: 5901017 - DNA, 17 bp, Homo sapiens
gaccccctggccctgcc

SEQ ID NO: 5901018 - DNA, 18 bp, Homo sapiens
gaccccctgtcctaggtc

SEQ ID NO: 5901019 - DNA, 20 bp, Homo sapiens
gacccccttgcccaggcctc

SEQ ID NO: 5901020 - DNA, 21 bp, Homo sapiens
gaccccgacctcagagagtac

SEQ ID NO: 5901021 - DNA, 17 bp, Homo sapiens
gaccccgacgccacagc

SEQ ID NO: 5901022 - DNA, 18 bp, Homo sapiens
gaccccgacgccacagcc

SEQ ID NO: 5901023 - DNA, 22 bp, Homo sapiens
gaccccgacgccacagcccagc

SEQ ID NO: 5901024 - DNA, 16 bp, Homo sapiens
gaccccgagaaccctg

SEQ ID NO: 5901025 - DNA, 19 bp, Homo sapiens
gaccccgagaaccctgagc

SEQ ID NO: 5901026 - DNA, 21 bp, Homo sapiens
gaccccgagcacggttgcctg

SEQ ID NO: 5901027 - DNA, 13 bp, Homo sapiens
gaccccgagggct

SEQ ID NO: 5901028 - DNA, 18 bp, Homo sapiens
gaccccgagggctgagga

SEQ ID NO: 5901029 - DNA, 20 bp, Homo sapiens
gaccccgcagcacgcctctc

SEQ ID NO: 5901030 - DNA, 21 bp, Homo sapiens
gaccccgcagcacgcctctcc

SEQ ID NO: 5901031 - DNA, 21 bp, Homo sapiens
gaccccgcaggatccctcctg

SEQ ID NO: 5901032 - DNA, 17 bp, Homo sapiens
gaccccgcccctgggga

SEQ ID NO: 5901033 - DNA, 19 bp, Homo sapiens
gaccccggcttcctttccc

SEQ ID NO: 5901034 - DNA, 18 bp, Homo sapiens
gaccccggggggctggga

SEQ ID NO: 5901035 - DNA, 22 bp, Homo sapiens
gaccccggtggcggccccagca

SEQ ID NO: 5901036 - DNA, 20 bp, Homo sapiens
gaccccgtccacgtcctcca

SEQ ID NO: 5901037 - DNA, 17 bp, Homo sapiens
gacccctaccccctcat

SEQ ID NO: 5901038 - DNA, 18 bp, Homo sapiens
gacccctaccccctcatc

SEQ ID NO: 5901039 - DNA, 15 bp, Homo sapiens
gacccctaccctttc

SEQ ID NO: 5901040 - DNA, 18 bp, Homo sapiens
gacccctaccctttccca

SEQ ID NO: 5901041 - DNA, 17 bp, Homo sapiens
gacccctagttccctct

SEQ ID NO: 5901042 - DNA, 21 bp, Homo sapiens
gacccctatgaagtaaagaac

SEQ ID NO: 5901043 - DNA, 18 bp, Homo sapiens
gacccctcaccaccccca

SEQ ID NO: 5901044 - DNA, 13 bp, Homo sapiens
gacccctcagtgc

SEQ ID NO: 5901045 - DNA, 13 bp, Homo sapiens
gacccctccatgt

SEQ ID NO: 5901046 - DNA, 21 bp, Homo sapiens
gacccctccatgtgggctagt

SEQ ID NO: 5901047 - DNA, 23 bp, Homo sapiens
gacccctcccctcccacccacag

SEQ ID NO: 5901048 - DNA, 14 bp, Homo sapiens
gacccctccctgca

SEQ ID NO: 5901049 - DNA, 19 bp, Homo sapiens
gacccctccctgcaggggc

SEQ ID NO: 5901050 - DNA, 23 bp, Homo sapiens
gacccctcccttgctcagtgcct

SEQ ID NO: 5901051 - DNA, 11 bp, Homo sapiens
gacccctcctc

SEQ ID NO: 5901052 - DNA, 13 bp, Homo sapiens
gacccctcctcac

SEQ ID NO: 5901053 - DNA, 14 bp, Homo sapiens
gacccctcctcact

SEQ ID NO: 5901054 - DNA, 12 bp, Homo sapiens
gacccctcctcc

SEQ ID NO: 5901055 - DNA, 19 bp, Homo sapiens
gacccctcctgcccctctc

SEQ ID NO: 5901056 - DNA, 12 bp, Homo sapiens
gacccctcctgg

SEQ ID NO: 5901057 - DNA, 19 bp, Homo sapiens
gacccctcctggggccagg

SEQ ID NO: 5901058 - DNA, 14 bp, Homo sapiens
gacccctccttgtc

SEQ ID NO: 5901059 - DNA, 16 bp, Homo sapiens
gacccctcgtccaccc

SEQ ID NO: 5901060 - DNA, 13 bp, Homo sapiens
gacccctctggcc

SEQ ID NO: 5901061 - DNA, 16 bp, Homo sapiens
gacccctctggccagg

SEQ ID NO: 5901062 - DNA, 18 bp, Homo sapiens
gacccctctggccaggat

SEQ ID NO: 5901063 - DNA, 20 bp, Homo sapiens
gacccctctggccaggatgg

SEQ ID NO: 5901064 - DNA, 23 bp, Homo sapiens
gacccctgcaccagcccttccct

SEQ ID NO: 5901065 - DNA, 20 bp, Homo sapiens
gacccctgcagttcccctgg

SEQ ID NO: 5901066 - DNA, 12 bp, Homo sapiens
gacccctgccca

SEQ ID NO: 5901067 - DNA, 13 bp, Homo sapiens
gacccctgcccaa

SEQ ID NO: 5901068 - DNA, 16 bp, Homo sapiens
gacccctgcccaagtg

SEQ ID NO: 5901069 - DNA, 23 bp, Homo sapiens
gacccctgcccagatcagccaga

SEQ ID NO: 5901070 - DNA, 17 bp, Homo sapiens
gacccctgccctcggcc

SEQ ID NO: 5901071 - DNA, 13 bp, Homo sapiens
gacccctgccttc

SEQ ID NO: 5901072 - DNA, 17 bp, Homo sapiens
gacccctgccttcctct

SEQ ID NO: 5901073 - DNA, 23 bp, Homo sapiens
gacccctgccttcctctgaggac

SEQ ID NO: 5901074 - DNA, 23 bp, Homo sapiens
gacccctgctcagtaaagcactt

SEQ ID NO: 5901075 - DNA, 21 bp, Homo sapiens
gacccctgctcccagcctgct

SEQ ID NO: 5901076 - DNA, 20 bp, Homo sapiens
gacccctgctttgccccact

SEQ ID NO: 5901077 - DNA, 22 bp, Homo sapiens
gacccctggaccaccagcccca

SEQ ID NO: 5901078 - DNA, 15 bp, Homo sapiens
gacccctggccacag

SEQ ID NO: 5901079 - DNA, 17 bp, Homo sapiens
gacccctggccacagcc

SEQ ID NO: 5901080 - DNA, 18 bp, Homo sapiens
gacccctggccacagcct

SEQ ID NO: 5901081 - DNA, 21 bp, Homo sapiens
gacccctggccacagccttcc

SEQ ID NO: 5901082 - DNA, 16 bp, Homo sapiens
gacccctggcctccgg

SEQ ID NO: 5901083 - DNA, 13 bp, Homo sapiens
gacccctgggagc

SEQ ID NO: 5901084 - DNA, 15 bp, Homo sapiens
gacccctgggagctt

SEQ ID NO: 5901085 - DNA, 18 bp, Homo sapiens
gacccctgggcctcatca

SEQ ID NO: 5901086 - DNA, 14 bp, Homo sapiens
gacccctgggggag

SEQ ID NO: 5901087 - DNA, 18 bp, Homo sapiens
gacccctggggtggccag

SEQ ID NO: 5901088 - DNA, 19 bp, Homo sapiens
gacccctggggtggccagg

SEQ ID NO: 5901089 - DNA, 21 bp, Homo sapiens
gacccctgggtgggccctgcc

SEQ ID NO: 5901090 - DNA, 17 bp, Homo sapiens
gaccccttcctttcctc

SEQ ID NO: 5901091 - DNA, 18 bp, Homo sapiens
gaccccttcctttcctct

SEQ ID NO: 5901092 - DNA, 22 bp, Homo sapiens
gaccccttcctttcctctgcag

SEQ ID NO: 5901093 - DNA, 21 bp, Homo sapiens
gaccccttgttgcactgcccc

SEQ ID NO: 5901094 - DNA, 16 bp, Homo sapiens
gacccctttcccccac

SEQ ID NO: 5901095 - DNA, 18 bp, Homo sapiens
gacccctttcccccaccc

SEQ ID NO: 5901096 - DNA, 20 bp, Homo sapiens
gaccccttttcagcttctgc

SEQ ID NO: 5901097 - DNA, 17 bp, Homo sapiens
gacccgacactctcacc

SEQ ID NO: 5901098 - DNA, 16 bp, Homo sapiens
gacccgacctggccgc

SEQ ID NO: 5901099 - DNA, 19 bp, Homo sapiens
gacccgaggatttctggga

SEQ ID NO: 5901100 - DNA, 13 bp, Homo sapiens
gacccgaggccca

SEQ ID NO: 5901101 - DNA, 15 bp, Homo sapiens
gacccgccagccccg

SEQ ID NO: 5901102 - DNA, 17 bp, Homo sapiens
gacccgccagccccgct

SEQ ID NO: 5901103 - DNA, 13 bp, Homo sapiens
gacccgccaggtc

SEQ ID NO: 5901104 - DNA, 14 bp, Homo sapiens
gacccgctctggac

SEQ ID NO: 5901105 - DNA, 16 bp, Homo sapiens
gacccgctctggacca

SEQ ID NO: 5901106 - DNA, 15 bp, Homo sapiens
gacccgctgggggct

SEQ ID NO: 5901107 - DNA, 18 bp, Homo sapiens
gacccgctgggggctggc

SEQ ID NO: 5901108 - DNA, 14 bp, Homo sapiens
gacccggaggccac

SEQ ID NO: 5901109 - DNA, 19 bp, Homo sapiens
gacccggattggccctgcc

SEQ ID NO: 5901110 - DNA, 21 bp, Homo sapiens
gacccggattggccctgcccc

SEQ ID NO: 5901111 - DNA, 22 bp, Homo sapiens
gacccggattggccctgcccct

SEQ ID NO: 5901112 - DNA, 19 bp, Homo sapiens
gacccggcccccgccctct

SEQ ID NO: 5901113 - DNA, 12 bp, Homo sapiens
gacccggcctct

SEQ ID NO: 5901114 - DNA, 17 bp, Homo sapiens
gacccggcctctctgcc

SEQ ID NO: 5901115 - DNA, 16 bp, Homo sapiens
gacccggcggccctgc

SEQ ID NO: 5901116 - DNA, 17 bp, Homo sapiens
gacccgggaccacagct

SEQ ID NO: 5901117 - DNA, 20 bp, Homo sapiens
gacccgggaccacagctgct

SEQ ID NO: 5901118 - DNA, 14 bp, Homo sapiens
gacccggggcagct

SEQ ID NO: 5901119 - DNA, 16 bp, Homo sapiens
gacccggggcagctgg

SEQ ID NO: 5901120 - DNA, 15 bp, Homo sapiens
gacccggggtctcct

SEQ ID NO: 5901121 - DNA, 21 bp, Homo sapiens
gacccggggtctcctggacct

SEQ ID NO: 5901122 - DNA, 18 bp, Homo sapiens
gacccggttattcgccca

SEQ ID NO: 5901123 - DNA, 22 bp, Homo sapiens
gacccggttattcgcccacccg

SEQ ID NO: 5901124 - DNA, 15 bp, Homo sapiens
gacccggttgcagtc

SEQ ID NO: 5901125 - DNA, 15 bp, Homo sapiens
gaccctacaggagag

SEQ ID NO: 5901126 - DNA, 21 bp, Homo sapiens
gaccctacttcctgcactgac

SEQ ID NO: 5901127 - DNA, 17 bp, Homo sapiens
gaccctaggtgctcata

SEQ ID NO: 5901128 - DNA, 21 bp, Homo sapiens
gaccctagttattttctgaaa

SEQ ID NO: 5901129 - DNA, 18 bp, Homo sapiens
gaccctatgggtctagga

SEQ ID NO: 5901130 - DNA, 16 bp, Homo sapiens
gaccctattgctgctt

SEQ ID NO: 5901131 - DNA, 17 bp, Homo sapiens
gaccctatttgtttcat

SEQ ID NO: 5901132 - DNA, 12 bp, Homo sapiens
gaccctcacctg

SEQ ID NO: 5901133 - DNA, 10 bp, Homo sapiens
gaccctcact

SEQ ID NO: 5901134 - DNA, 19 bp, Homo sapiens
gaccctcactgctggggag

SEQ ID NO: 5901135 - DNA, 12 bp, Homo sapiens
gaccctcacttt

SEQ ID NO: 5901136 - DNA, 14 bp, Homo sapiens
gaccctcagccctg

SEQ ID NO: 5901137 - DNA, 16 bp, Homo sapiens
gaccctcagccctggc

SEQ ID NO: 5901138 - DNA, 17 bp, Homo sapiens
gaccctcagccctggcc

SEQ ID NO: 5901139 - DNA, 18 bp, Homo sapiens
gaccctcagccctggcct

SEQ ID NO: 5901140 - DNA, 23 bp, Homo sapiens
gaccctcagctgtcacctgctca

SEQ ID NO: 5901141 - DNA, 22 bp, Homo sapiens
gaccctcaggaattcagtgcct

SEQ ID NO: 5901142 - DNA, 20 bp, Homo sapiens
gaccctcaggcacaccttgc

SEQ ID NO: 5901143 - DNA, 22 bp, Homo sapiens
gaccctcaggtgtagctgagct

SEQ ID NO: 5901144 - DNA, 19 bp, Homo sapiens
gaccctcatctttcttcca

SEQ ID NO: 5901145 - DNA, 16 bp, Homo sapiens
gaccctcatgctgcca

SEQ ID NO: 5901146 - DNA, 18 bp, Homo sapiens
gaccctcatgctgccaat

SEQ ID NO: 5901147 - DNA, 15 bp, Homo sapiens
gaccctccaaggcca

SEQ ID NO: 5901148 - DNA, 20 bp, Homo sapiens
gaccctccaaggccaggcct

SEQ ID NO: 5901149 - DNA, 22 bp, Homo sapiens
gaccctccaccgcagaaggaag

SEQ ID NO: 5901150 - DNA, 16 bp, Homo sapiens
gaccctccactcactg

SEQ ID NO: 5901151 - DNA, 20 bp, Homo sapiens
gaccctccactcactgctgt

SEQ ID NO: 5901152 - DNA, 13 bp, Homo sapiens
gaccctccagagg

SEQ ID NO: 5901153 - DNA, 14 bp, Homo sapiens
gaccctccagaggt

SEQ ID NO: 5901154 - DNA, 14 bp, Homo sapiens
gaccctcccactcc

SEQ ID NO: 5901155 - DNA, 22 bp, Homo sapiens
gaccctcccactcccatctcct

SEQ ID NO: 5901156 - DNA, 13 bp, Homo sapiens
gaccctcccaggt

SEQ ID NO: 5901157 - DNA, 22 bp, Homo sapiens
gaccctcccagtctcatctcct

SEQ ID NO: 5901158 - DNA, 11 bp, Homo sapiens
gaccctcccca

SEQ ID NO: 5901159 - DNA, 24 bp, Homo sapiens
gaccctccccaaggatgaccacac

SEQ ID NO: 5901160 - DNA, 22 bp, Homo sapiens
gaccctccccacagtgccaccc

SEQ ID NO: 5901161 - DNA, 18 bp, Homo sapiens
gaccctcccctgcctccg

SEQ ID NO: 5901162 - DNA, 22 bp, Homo sapiens
gaccctcccctgcctccgaggc

SEQ ID NO: 5901163 - DNA, 14 bp, Homo sapiens
gaccctccctacct

SEQ ID NO: 5901164 - DNA, 11 bp, Homo sapiens
gaccctccctt

SEQ ID NO: 5901165 - DNA, 21 bp, Homo sapiens
gaccctcctccactccacctc

SEQ ID NO: 5901166 - DNA, 22 bp, Homo sapiens
gaccctcctcctcccccagagg

SEQ ID NO: 5901167 - DNA, 17 bp, Homo sapiens
gaccctcctggccttcc

SEQ ID NO: 5901168 - DNA, 15 bp, Homo sapiens
gaccctcctgtccag

SEQ ID NO: 5901169 - DNA, 21 bp, Homo sapiens
gaccctcctgttgcacccagc

SEQ ID NO: 5901170 - DNA, 15 bp, Homo sapiens
gaccctccttcccca

SEQ ID NO: 5901171 - DNA, 21 bp, Homo sapiens
gaccctccttctattttccct

SEQ ID NO: 5901172 - DNA, 13 bp, Homo sapiens
gaccctcgcagca

SEQ ID NO: 5901173 - DNA, 19 bp, Homo sapiens
gaccctcgctggcccccac

SEQ ID NO: 5901174 - DNA, 20 bp, Homo sapiens
gaccctcgctggcccccact

SEQ ID NO: 5901175 - DNA, 21 bp, Homo sapiens
gaccctcgctggcccccactg

SEQ ID NO: 5901176 - DNA, 19 bp, Homo sapiens
gaccctcggcctctacttt

SEQ ID NO: 5901177 - DNA, 15 bp, Homo sapiens
gaccctcggggcagg

SEQ ID NO: 5901178 - DNA, 14 bp, Homo sapiens
gaccctctcacttt

SEQ ID NO: 5901179 - DNA, 15 bp, Homo sapiens
gaccctctcaggctg

SEQ ID NO: 5901180 - DNA, 23 bp, Homo sapiens
gaccctctgaatggtccagggtt

SEQ ID NO: 5901181 - DNA, 14 bp, Homo sapiens
gaccctctgccacc

SEQ ID NO: 5901182 - DNA, 16 bp, Homo sapiens
gaccctctgctgaaga

SEQ ID NO: 5901183 - DNA, 19 bp, Homo sapiens
gaccctctggaaatatgta

SEQ ID NO: 5901184 - DNA, 14 bp, Homo sapiens
gaccctctgtcccc

SEQ ID NO: 5901185 - DNA, 23 bp, Homo sapiens
gacctgaataccacttacctcaa

SEQ ID NO: 5901186 - DNA, 20 bp, Homo sapiens
gacctgaatgacctgcagtc

SEQ ID NO: 5901187 - DNA, 21 bp, Homo sapiens
gacctgaatgcttctgagagc

SEQ ID NO: 5901188 - DNA, 15 bp, Homo sapiens
gacctgaattgaaag

SEQ ID NO: 5901189 - DNA, 13 bp, Homo sapiens
gacctgacaattt

SEQ ID NO: 5901190 - DNA, 15 bp, Homo sapiens
gacctgacacctgcc

SEQ ID NO: 5901191 - DNA, 22 bp, Homo sapiens
gacctgacacctgccgctgctt

SEQ ID NO: 5901192 - DNA, 19 bp, Homo sapiens
gacctgacgatcttccccc

SEQ ID NO: 5901193 - DNA, 12 bp, Homo sapiens
gacctgactttt

SEQ ID NO: 5901194 - DNA, 24 bp, Homo sapiens
gacctgagactcacactctctgca

SEQ ID NO: 5901195 - DNA, 11 bp, Homo sapiens
gacctgagcct

SEQ ID NO: 5901196 - DNA, 16 bp, Homo sapiens
gacctgagcctgccga

SEQ ID NO: 5901197 - DNA, 13 bp, Homo sapiens
gacctgagcggca

SEQ ID NO: 5901198 - DNA, 19 bp, Homo sapiens
gacctgagcgggagtcagg

SEQ ID NO: 5901199 - DNA, 18 bp, Homo sapiens
gacctgagctccccacca

SEQ ID NO: 5901200 - DNA, 14 bp, Homo sapiens
gacctgagctttcc

SEQ ID NO: 5901201 - DNA, 22 bp, Homo sapiens
gacctgaggacatggcttctga

SEQ ID NO: 5901202 - DNA, 14 bp, Homo sapiens
gacctgaggctgtg

SEQ ID NO: 5901203 - DNA, 15 bp, Homo sapiens
gacctgaggctgtgg

SEQ ID NO: 5901204 - DNA, 16 bp, Homo sapiens
gacctgagtcggcccc

SEQ ID NO: 5901205 - DNA, 17 bp, Homo sapiens
gacctgagtcggcccca

SEQ ID NO: 5901206 - DNA, 15 bp, Homo sapiens
gacctgatcacctct

SEQ ID NO: 5901207 - DNA, 19 bp, Homo sapiens
gacctgatttcagaagaga

SEQ ID NO: 5901208 - DNA, 21 bp, Homo sapiens
gacctgatttcagaagagact

SEQ ID NO: 5901209 - DNA, 14 bp, Homo sapiens
gacctgattttcaa

SEQ ID NO: 5901210 - DNA, 17 bp, Homo sapiens
gacctgcagacgcccag

SEQ ID NO: 5901211 - DNA, 15 bp, Homo sapiens
gacctgcagtcaggg

SEQ ID NO: 5901212 - DNA, 17 bp, Homo sapiens
gacctgcagttggcctc

SEQ ID NO: 5901213 - DNA, 20 bp, Homo sapiens
gacctgcagttggcctcagc

SEQ ID NO: 5901214 - DNA, 21 bp, Homo sapiens
gacctgccagccactgtcacc

SEQ ID NO: 5901215 - DNA, 21 bp, Homo sapiens
gacctgcccatgtccagaggg

SEQ ID NO: 5901216 - DNA, 23 bp, Homo sapiens
gacctgcccccgcatcccctgcc

SEQ ID NO: 5901217 - DNA, 22 bp, Homo sapiens
gacctgccccggacctacctcc

SEQ ID NO: 5901218 - DNA, 15 bp, Homo sapiens
gacctgcccctccct

SEQ ID NO: 5901219 - DNA, 21 bp, Homo sapiens
gacctgcccctcctctctgcc

SEQ ID NO: 5901220 - DNA, 18 bp, Homo sapiens
gacctgccctacatatct

SEQ ID NO: 5901221 - DNA, 21 bp, Homo sapiens
gacctgccgcctgggaatcag

SEQ ID NO: 5901222 - DNA, 11 bp, Homo sapiens
gacctgcctcc

SEQ ID NO: 5901223 - DNA, 20 bp, Homo sapiens
gacctgcctcctgcctgccc

SEQ ID NO: 5901224 - DNA, 19 bp, Homo sapiens
gacctgcctcggcctccca

SEQ ID NO: 5901225 - DNA, 18 bp, Homo sapiens
gacctgctaagtgtggaa

SEQ ID NO: 5901226 - DNA, 23 bp, Homo sapiens
gacctgctcatcatattccaacc

SEQ ID NO: 5901227 - DNA, 16 bp, Homo sapiens
gacctgctccgccagg

SEQ ID NO: 5901228 - DNA, 18 bp, Homo sapiens
gacctgctccgccaggaa

SEQ ID NO: 5901229 - DNA, 20 bp, Homo sapiens
gacctgctccgccaggaaag

SEQ ID NO: 5901230 - DNA, 14 bp, Homo sapiens
gacctgctcctgcc

SEQ ID NO: 5901231 - DNA, 17 bp, Homo sapiens
gacctgctcctgcccac

SEQ ID NO: 5901232 - DNA, 10 bp, Homo sapiens
gacctgctga

SEQ ID NO: 5901233 - DNA, 13 bp, Homo sapiens
gacctgctgaatt

SEQ ID NO: 5901234 - DNA, 18 bp, Homo sapiens
gacctgctgacctgtgca

SEQ ID NO: 5901235 - DNA, 16 bp, Homo sapiens
gacctgctgagctctg

SEQ ID NO: 5901236 - DNA, 17 bp, Homo sapiens
gacctgctgagctctga

SEQ ID NO: 5901237 - DNA, 13 bp, Homo sapiens
gacctgctgctca

SEQ ID NO: 5901238 - DNA, 14 bp, Homo sapiens
gacctgctgctcag

SEQ ID NO: 5901239 - DNA, 13 bp, Homo sapiens
gacctgctgctcc

SEQ ID NO: 5901240 - DNA, 12 bp, Homo sapiens
gacctgctgtgg

SEQ ID NO: 5901241 - DNA, 16 bp, Homo sapiens
gacctgcttcattcaa

SEQ ID NO: 5901242 - DNA, 19 bp, Homo sapiens
gacctgcttcctgaaataa

SEQ ID NO: 5901243 - DNA, 20 bp, Homo sapiens
gacctgcttcctgaaataaa

SEQ ID NO: 5901244 - DNA, 22 bp, Homo sapiens
gacctgcttcctgaaataaaca

SEQ ID NO: 5901245 - DNA, 13 bp, Homo sapiens
gacctgctttttg

SEQ ID NO: 5901246 - DNA, 14 bp, Homo sapiens
gacctgctttttga

SEQ ID NO: 5901247 - DNA, 14 bp, Homo sapiens
gacctggaaccaga

SEQ ID NO: 5901248 - DNA, 16 bp, Homo sapiens
gacctggaactgtagg

SEQ ID NO: 5901249 - DNA, 15 bp, Homo sapiens
gacctggaagagctg

SEQ ID NO: 5901250 - DNA, 16 bp, Homo sapiens
gacctggaagagctgg

SEQ ID NO: 5901251 - DNA, 18 bp, Homo sapiens
gacctggaagagctgggt

SEQ ID NO: 5901252 - DNA, 20 bp, Homo sapiens
gacctggaagggaggtgggc

SEQ ID NO: 5901253 - DNA, 16 bp, Homo sapiens
gacctggacactaggg

SEQ ID NO: 5901254 - DNA, 16 bp, Homo sapiens
gacctggactagggcc

SEQ ID NO: 5901255 - DNA, 17 bp, Homo sapiens
gacctggactagggcct

SEQ ID NO: 5901256 - DNA, 12 bp, Homo sapiens
gacctggagccc

SEQ ID NO: 5901257 - DNA, 15 bp, Homo sapiens
gacctggagcccctg

SEQ ID NO: 5901258 - DNA, 15 bp, Homo sapiens
gacctggagctgcca

SEQ ID NO: 5901259 - DNA, 20 bp, Homo sapiens
gacctggagctgccagcacc

SEQ ID NO: 5901260 - DNA, 20 bp, Homo sapiens
gacctggagcttcagccagg

SEQ ID NO: 5901261 - DNA, 17 bp, Homo sapiens
gacctggataacttagg

SEQ ID NO: 5901262 - DNA, 18 bp, Homo sapiens
gacctggcactggatgca

SEQ ID NO: 5901263 - DNA, 16 bp, Homo sapiens
gacctggcactgggag

SEQ ID NO: 5901264 - DNA, 17 bp, Homo sapiens
gacctggcactgggagg

SEQ ID NO: 5901265 - DNA, 16 bp, Homo sapiens
gacctggcagctctgg

SEQ ID NO: 5901266 - DNA, 16 bp, Homo sapiens
gacctggcccagtgca

SEQ ID NO: 5901267 - DNA, 17 bp, Homo sapiens
gacctggccccaggctg

SEQ ID NO: 5901268 - DNA, 18 bp, Homo sapiens
gacctggctctcagagga

SEQ ID NO: 5901269 - DNA, 20 bp, Homo sapiens
gacctggctgcccctcacct

SEQ ID NO: 5901270 - DNA, 22 bp, Homo sapiens
gacctggctgcccctcaccttg

SEQ ID NO: 5901271 - DNA, 11 bp, Homo sapiens
gacctggctgg

SEQ ID NO: 5901272 - DNA, 15 bp, Homo sapiens
gacctgggaatttca

SEQ ID NO: 5901273 - DNA, 16 bp, Homo sapiens
gacctgggatttgaga

SEQ ID NO: 5901274 - DNA, 15 bp, Homo sapiens
gacctgggccaaaag

SEQ ID NO: 5901275 - DNA, 20 bp, Homo sapiens
gacctgggccaaaagggcag

SEQ ID NO: 5901276 - DNA, 17 bp, Homo sapiens
gacctgggccctggttc

SEQ ID NO: 5901277 - DNA, 23 bp, Homo sapiens
gacctgggctggcactgctgggg

SEQ ID NO: 5901278 - DNA, 14 bp, Homo sapiens
gacctggggcacag

SEQ ID NO: 5901279 - DNA, 15 bp, Homo sapiens
gacctggggcacagt

SEQ ID NO: 5901280 - DNA, 15 bp, Homo sapiens
gacctggggggaggg

SEQ ID NO: 5901281 - DNA, 16 bp, Homo sapiens
gacctggggtcccccc

SEQ ID NO: 5901282 - DNA, 21 bp, Homo sapiens
gacctggggttgtcagctctc

SEQ ID NO: 5901283 - DNA, 21 bp, Homo sapiens
gacctgggttatttattgaca

SEQ ID NO: 5901284 - DNA, 19 bp, Homo sapiens
gacctggtaccctcctggc

SEQ ID NO: 5901285 - DNA, 17 bp, Homo sapiens
gacctggtctggtcagg

SEQ ID NO: 5901286 - DNA, 13 bp, Homo sapiens
gacctggtgctct

SEQ ID NO: 5901287 - DNA, 18 bp, Homo sapiens
gacctggtgggagcacct

SEQ ID NO: 5901288 - DNA, 18 bp, Homo sapiens
gacctggtgtgcggaggc

SEQ ID NO: 5901289 - DNA, 21 bp, Homo sapiens
gacctggtgtgcggaggcagg

SEQ ID NO: 5901290 - DNA, 16 bp, Homo sapiens
gacctggttgtccagg

SEQ ID NO: 5901291 - DNA, 19 bp, Homo sapiens
gacctggttgtccaggtct

SEQ ID NO: 5901292 - DNA, 17 bp, Homo sapiens
gacctgtaacttttgta

SEQ ID NO: 5901293 - DNA, 15 bp, Homo sapiens
gacctgtatcaaact

SEQ ID NO: 5901294 - DNA, 18 bp, Homo sapiens
gacctgtatcaaactgct

SEQ ID NO: 5901295 - DNA, 16 bp, Homo sapiens
gacctgtatttaagca

SEQ ID NO: 5901296 - DNA, 19 bp, Homo sapiens
gacctgtcaccctgcagga

SEQ ID NO: 5901297 - DNA, 15 bp, Homo sapiens
gacctgtcatgcccc

SEQ ID NO: 5901298 - DNA, 21 bp, Homo sapiens
gacctgtcccccactctctca

SEQ ID NO: 5901299 - DNA, 24 bp, Homo sapiens
gacctgtcccccactctctcaccc

SEQ ID NO: 5901300 - DNA, 14 bp, Homo sapiens
gacctgtcctcctg

SEQ ID NO: 5901301 - DNA, 15 bp, Homo sapiens
gacctgtcctcctgg

SEQ ID NO: 5901302 - DNA, 16 bp, Homo sapiens
gacctgtcctcctggt

SEQ ID NO: 5901303 - DNA, 18 bp, Homo sapiens
gacctgtcctctttgtga

SEQ ID NO: 5901304 - DNA, 19 bp, Homo sapiens
gacctgtctataagagaat

SEQ ID NO: 5901305 - DNA, 21 bp, Homo sapiens
gacctgtctgtcgctgggctg

SEQ ID NO: 5901306 - DNA, 23 bp, Homo sapiens
gacctgtgagcccagctgggtca

SEQ ID NO: 5901307 - DNA, 13 bp, Homo sapiens
gacctgtgctttg

SEQ ID NO: 5901308 - DNA, 14 bp, Homo sapiens
gacctgtgctttga

SEQ ID NO: 5901309 - DNA, 19 bp, Homo sapiens
gacctgtggccaagttctt

SEQ ID NO: 5901310 - DNA, 21 bp, Homo sapiens
gacctgtggggatttctccca

SEQ ID NO: 5901311 - DNA, 19 bp, Homo sapiens
gacctgtggggccccagag

SEQ ID NO: 5901312 - DNA, 16 bp, Homo sapiens
gacctgtggtcatgtg

SEQ ID NO: 5901313 - DNA, 19 bp, Homo sapiens
gacctgtggtgcaaaagca

SEQ ID NO: 5901314 - DNA, 18 bp, Homo sapiens
gacctgttagatgtgaca

SEQ ID NO: 5901315 - DNA, 17 bp, Homo sapiens
gacctgttagcagacag

SEQ ID NO: 5901316 - DNA, 15 bp, Homo sapiens
gacctgttctgacct

SEQ ID NO: 5901317 - DNA, 14 bp, Homo sapiens
gacctgttggcctg

SEQ ID NO: 5901318 - DNA, 15 bp, Homo sapiens
gaccttaaaatgtgt

SEQ ID NO: 5901319 - DNA, 14 bp, Homo sapiens
gaccttaaatgcaa

SEQ ID NO: 5901320 - DNA, 23 bp, Homo sapiens
gaccttaaggaaaagtaagggaa

SEQ ID NO: 5901321 - DNA, 23 bp, Homo sapiens
gaccttaataaaggcccccactt

SEQ ID NO: 5901322 - DNA, 18 bp, Homo sapiens
gaccttaatttaactttc

SEQ ID NO: 5901323 - DNA, 16 bp, Homo sapiens
gaccttacaggccctc

SEQ ID NO: 5901324 - DNA, 22 bp, Homo sapiens
gaccttacccctggctgtttgg

SEQ ID NO: 5901325 - DNA, 19 bp, Homo sapiens
gaccttagaaatcattgta

SEQ ID NO: 5901326 - DNA, 13 bp, Homo sapiens
gaccttagcccca

SEQ ID NO: 5901327 - DNA, 17 bp, Homo sapiens
gaccttagcgttctgga

SEQ ID NO: 5901328 - DNA, 23 bp, Homo sapiens
gaccttagcttattgatcccaca

SEQ ID NO: 5901329 - DNA, 15 bp, Homo sapiens
gaccttaggccttcc

SEQ ID NO: 5901330 - DNA, 21 bp, Homo sapiens
gaccttaggccttcctctctc

SEQ ID NO: 5901331 - DNA, 23 bp, Homo sapiens
gaccttagtgtttctgtgcatgg

SEQ ID NO: 5901332 - DNA, 12 bp, Homo sapiens
gaccttatctgt

SEQ ID NO: 5901333 - DNA, 12 bp, Homo sapiens
gaccttcaaatg

SEQ ID NO: 5901334 - DNA, 19 bp, Homo sapiens
gaccttcaccaaacatact

SEQ ID NO: 5901335 - DNA, 14 bp, Homo sapiens
gaccttcaccaagc

SEQ ID NO: 5901336 - DNA, 20 bp, Homo sapiens
gaccttcactctaagatgtt

SEQ ID NO: 5901337 - DNA, 18 bp, Homo sapiens
gaccttcagctcacgctt

SEQ ID NO: 5901338 - DNA, 18 bp, Homo sapiens
gaccttcatgcccttctg

SEQ ID NO: 5901339 - DNA, 17 bp, Homo sapiens
gaccttcatttcatgta

SEQ ID NO: 5901340 - DNA, 16 bp, Homo sapiens
gaccttccaagtttga

SEQ ID NO: 5901341 - DNA, 16 bp, Homo sapiens
gaccttccctccgcct

SEQ ID NO: 5901342 - DNA, 14 bp, Homo sapiens
gaccttcctcatcc

SEQ ID NO: 5901343 - DNA, 18 bp, Homo sapiens
gaccttcctctggggctc

SEQ ID NO: 5901344 - DNA, 12 bp, Homo sapiens
gaccttcctgcc

SEQ ID NO: 5901345 - DNA, 16 bp, Homo sapiens
gaccttcctgccacca

SEQ ID NO: 5901346 - DNA, 22 bp, Homo sapiens
gaccttcggcagtggctggggg

SEQ ID NO: 5901347 - DNA, 19 bp, Homo sapiens
gaccttctagtgagcctgg

SEQ ID NO: 5901348 - DNA, 20 bp, Homo sapiens
gaccttctccttcacctttg

SEQ ID NO: 5901349 - DNA, 13 bp, Homo sapiens
gaccttctgaaga

SEQ ID NO: 5901350 - DNA, 20 bp, Homo sapiens
gaccttctgtcgtccccaga

SEQ ID NO: 5901351 - DNA, 21 bp, Homo sapiens
gaccttctgtcgtccccagac

SEQ ID NO: 5901352 - DNA, 16 bp, Homo sapiens
gaccttgaaaagcagt

SEQ ID NO: 5901353 - DNA, 19 bp, Homo sapiens
gaccttgaagggtaaagaa

SEQ ID NO: 5901354 - DNA, 16 bp, Homo sapiens
gaccttgacagagcag

SEQ ID NO: 5901355 - DNA, 18 bp, Homo sapiens
gaccttgacagagcagct

SEQ ID NO: 5901356 - DNA, 20 bp, Homo sapiens
gaccttgagggtgggccagc

SEQ ID NO: 5901357 - DNA, 21 bp, Homo sapiens
gaccttgagttaacaggacag

SEQ ID NO: 5901358 - DNA, 22 bp, Homo sapiens
gaccttgagttaacaggacagt

SEQ ID NO: 5901359 - DNA, 13 bp, Homo sapiens
gaccttgatgagc

SEQ ID NO: 5901360 - DNA, 14 bp, Homo sapiens
gaccttgatgagct

SEQ ID NO: 5901361 - DNA, 16 bp, Homo sapiens
gaccttgatgtcttga

SEQ ID NO: 5901362 - DNA, 19 bp, Homo sapiens
gaccttgatgtcttgagag

SEQ ID NO: 5901363 - DNA, 15 bp, Homo sapiens
gacggccctgctggg

SEQ ID NO: 5901364 - DNA, 16 bp, Homo sapiens
gacggcctccaggagg

SEQ ID NO: 5901365 - DNA, 20 bp, Homo sapiens
gacggcctccaggaggggcc

SEQ ID NO: 5901366 - DNA, 14 bp, Homo sapiens
gacggcctgcctgc

SEQ ID NO: 5901367 - DNA, 15 bp, Homo sapiens
gacggccttcttggt

SEQ ID NO: 5901368 - DNA, 17 bp, Homo sapiens
gacggcgcccccagtgt

SEQ ID NO: 5901369 - DNA, 17 bp, Homo sapiens
gacggcgctgcctcagg

SEQ ID NO: 5901370 - DNA, 16 bp, Homo sapiens
gacggcggccaggcac

SEQ ID NO: 5901371 - DNA, 17 bp, Homo sapiens
gacggcgtttcaccatg

SEQ ID NO: 5901372 - DNA, 15 bp, Homo sapiens
gacggctcctcagag

SEQ ID NO: 5901373 - DNA, 14 bp, Homo sapiens
gacggctcctcccc

SEQ ID NO: 5901374 - DNA, 20 bp, Homo sapiens
gacggctgccattggtccac

SEQ ID NO: 5901375 - DNA, 19 bp, Homo sapiens
gacggctggcatggtggct

SEQ ID NO: 5901376 - DNA, 18 bp, Homo sapiens
gacggctgggcacacgcc

SEQ ID NO: 5901377 - DNA, 13 bp, Homo sapiens
gacggctggggac

SEQ ID NO: 5901378 - DNA, 14 bp, Homo sapiens
gacggctggggacc

SEQ ID NO: 5901379 - DNA, 21 bp, Homo sapiens
gacggctggggacccacccag

SEQ ID NO: 5901380 - DNA, 23 bp, Homo sapiens
gacggctgggtgtttcagtttga

SEQ ID NO: 5901381 - DNA, 19 bp, Homo sapiens
gacggctgtgacgcagccg

SEQ ID NO: 5901382 - DNA, 18 bp, Homo sapiens
gacggctgtgggaccagg

SEQ ID NO: 5901383 - DNA, 20 bp, Homo sapiens
gacggcttccccatcgcctt

SEQ ID NO: 5901384 - DNA, 11 bp, Homo sapiens
gacgggacaga

SEQ ID NO: 5901385 - DNA, 12 bp, Homo sapiens
gacgggacagcg

SEQ ID NO: 5901386 - DNA, 21 bp, Homo sapiens
gacgggacagcggcccggccc

SEQ ID NO: 5901387 - DNA, 22 bp, Homo sapiens
gacgggacagcggcccggccca

SEQ ID NO: 5901388 - DNA, 12 bp, Homo sapiens
gacgggaccctg

SEQ ID NO: 5901389 - DNA, 15 bp, Homo sapiens
gacgggaggccccag

SEQ ID NO: 5901390 - DNA, 16 bp, Homo sapiens
gacgggaggcctcagt

SEQ ID NO: 5901391 - DNA, 18 bp, Homo sapiens
gacgggaggggaaaggct

SEQ ID NO: 5901392 - DNA, 13 bp, Homo sapiens
gacgggaggggag

SEQ ID NO: 5901393 - DNA, 21 bp, Homo sapiens
gacgggatgacctccagaagt

SEQ ID NO: 5901394 - DNA, 20 bp, Homo sapiens
gacgggcacacagactggag

SEQ ID NO: 5901395 - DNA, 12 bp, Homo sapiens
gacgggcacaga

SEQ ID NO: 5901396 - DNA, 13 bp, Homo sapiens
gacgggcacagac

SEQ ID NO: 5901397 - DNA, 18 bp, Homo sapiens
gacgggcatcgcaggagt

SEQ ID NO: 5901398 - DNA, 13 bp, Homo sapiens
gacgggccaggcc

SEQ ID NO: 5901399 - DNA, 14 bp, Homo sapiens
gacgggccaggccc

SEQ ID NO: 5901400 - DNA, 18 bp, Homo sapiens
gacgggccgcaggaggga

SEQ ID NO: 5901401 - DNA, 21 bp, Homo sapiens
gacgggccgcaggagggaggc

SEQ ID NO: 5901402 - DNA, 23 bp, Homo sapiens
gacgggctgtccgtgtgcctcct

SEQ ID NO: 5901403 - DNA, 19 bp, Homo sapiens
gacggggacacggcctctg

SEQ ID NO: 5901404 - DNA, 22 bp, Homo sapiens
gacggggcagagctgagtcggc

SEQ ID NO: 5901405 - DNA, 16 bp, Homo sapiens
gacggggcgggccctg

SEQ ID NO: 5901406 - DNA, 17 bp, Homo sapiens
gacggggggccccagtc

SEQ ID NO: 5901407 - DNA, 22 bp, Homo sapiens
gacggggggccccagtcagcct

SEQ ID NO: 5901408 - DNA, 13 bp, Homo sapiens
gacgggggtggga

SEQ ID NO: 5901409 - DNA, 18 bp, Homo sapiens
gacgggggttggggtggg

SEQ ID NO: 5901410 - DNA, 20 bp, Homo sapiens
gacgggggttggggtggggc

SEQ ID NO: 5901411 - DNA, 19 bp, Homo sapiens
gacggggtctccctgtgtt

SEQ ID NO: 5901412 - DNA, 22 bp, Homo sapiens
gacgggtgcccgtaatcccagc

SEQ ID NO: 5901413 - DNA, 23 bp, Homo sapiens
gacgggtgcccgtaatcccagct

SEQ ID NO: 5901414 - DNA, 22 bp, Homo sapiens
gacgggttcaccatgttgccca

SEQ ID NO: 5901415 - DNA, 15 bp, Homo sapiens
gacgggttgaaagac

SEQ ID NO: 5901416 - DNA, 18 bp, Homo sapiens
gacgggttgaaagacatc

SEQ ID NO: 5901417 - DNA, 19 bp, Homo sapiens
gacggtattatgcttcttg

SEQ ID NO: 5901418 - DNA, 21 bp, Homo sapiens
gacggtattatgcttcttgga

SEQ ID NO: 5901419 - DNA, 16 bp, Homo sapiens
gacggtcccacactgg

SEQ ID NO: 5901420 - DNA, 18 bp, Homo sapiens
gacggtccccacccctct

SEQ ID NO: 5901421 - DNA, 15 bp, Homo sapiens
gacggtctgtgtgct

SEQ ID NO: 5901422 - DNA, 16 bp, Homo sapiens
gacggtctgtgtgctg

SEQ ID NO: 5901423 - DNA, 12 bp, Homo sapiens
gacggtgccaag

SEQ ID NO: 5901424 - DNA, 17 bp, Homo sapiens
gacggtgccaagggccc

SEQ ID NO: 5901425 - DNA, 18 bp, Homo sapiens
gacggtgccaagggcccc

SEQ ID NO: 5901426 - DNA, 16 bp, Homo sapiens
gacggtgcccaagcca

SEQ ID NO: 5901427 - DNA, 18 bp, Homo sapiens
gacggtgcccaagccaga

SEQ ID NO: 5901428 - DNA, 23 bp, Homo sapiens
gacggtgctcgcttctcctccag

SEQ ID NO: 5901429 - DNA, 18 bp, Homo sapiens
gacggtggaatatttgga

SEQ ID NO: 5901430 - DNA, 21 bp, Homo sapiens
gacggtgggcatttgtgaggc

SEQ ID NO: 5901431 - DNA, 13 bp, Homo sapiens
gacggtgtcttgt

SEQ ID NO: 5901432 - DNA, 15 bp, Homo sapiens
gacggtgtggctgat

SEQ ID NO: 5901433 - DNA, 16 bp, Homo sapiens
gacggtgttgcagaga

SEQ ID NO: 5901434 - DNA, 23 bp, Homo sapiens
gacggtgttttgccatgttggcc

SEQ ID NO: 5901435 - DNA, 17 bp, Homo sapiens
gacggttaacttgtata

SEQ ID NO: 5901436 - DNA, 23 bp, Homo sapiens
gacggttaacttgtatattccac

SEQ ID NO: 5901437 - DNA, 15 bp, Homo sapiens
gacggttcaccagcc

SEQ ID NO: 5901438 - DNA, 17 bp, Homo sapiens
gacggttcaccagcctc

SEQ ID NO: 5901439 - DNA, 19 bp, Homo sapiens
gacggttcctacacaggac

SEQ ID NO: 5901440 - DNA, 22 bp, Homo sapiens
gacggttcctacacaggacagg

SEQ ID NO: 5901441 - DNA, 17 bp, Homo sapiens
gacggtttctagcctct

SEQ ID NO: 5901442 - DNA, 19 bp, Homo sapiens
gacggttttttattattgt

SEQ ID NO: 5901443 - DNA, 16 bp, Homo sapiens
gacgtacaagtagttc

SEQ ID NO: 5901444 - DNA, 19 bp, Homo sapiens
gacgtacaagtagttctgt

SEQ ID NO: 5901445 - DNA, 16 bp, Homo sapiens
gacgtagagcacagcc

SEQ ID NO: 5901446 - DNA, 15 bp, Homo sapiens
gacgtaggggagggg

SEQ ID NO: 5901447 - DNA, 14 bp, Homo sapiens
gacgtcaagtctcc

SEQ ID NO: 5901448 - DNA, 19 bp, Homo sapiens
gacgtcacgctccctgact

SEQ ID NO: 5901449 - DNA, 17 bp, Homo sapiens
gacgtcagcctcttacc

SEQ ID NO: 5901450 - DNA, 20 bp, Homo sapiens
gacgtcagcctcttaccttc

SEQ ID NO: 5901451 - DNA, 13 bp, Homo sapiens
gacgtcaggccct

SEQ ID NO: 5901452 - DNA, 19 bp, Homo sapiens
gacgtcaggccctgactcc

SEQ ID NO: 5901453 - DNA, 23 bp, Homo sapiens
gacgtcaggccctgactcctctg

SEQ ID NO: 5901454 - DNA, 22 bp, Homo sapiens
gacgtcatcggaggctgggccc

SEQ ID NO: 5901455 - DNA, 15 bp, Homo sapiens
gacgtcatgtggctt

SEQ ID NO: 5901456 - DNA, 16 bp, Homo sapiens
gacgtccatagctcct

SEQ ID NO: 5901457 - DNA, 15 bp, Homo sapiens
gacgtccctgcccat

SEQ ID NO: 5901458 - DNA, 14 bp, Homo sapiens
gacgtcctgccacc

SEQ ID NO: 5901459 - DNA, 11 bp, Homo sapiens
gacgtcctgga

SEQ ID NO: 5901460 - DNA, 22 bp, Homo sapiens
gacgtcggccgaccaggctgga

SEQ ID NO: 5901461 - DNA, 16 bp, Homo sapiens
gacgtctccccttctc

SEQ ID NO: 5901462 - DNA, 12 bp, Homo sapiens
gacgtctgccac

SEQ ID NO: 5901463 - DNA, 14 bp, Homo sapiens
gacgtctgccacca

SEQ ID NO: 5901464 - DNA, 21 bp, Homo sapiens
gacgtcttcaagaacttctcg

SEQ ID NO: 5901465 - DNA, 23 bp, Homo sapiens
gacgtcttcaagaacttctcgta

SEQ ID NO: 5901466 - DNA, 15 bp, Homo sapiens
gacgtcttcagagtc

SEQ ID NO: 5901467 - DNA, 14 bp, Homo sapiens
gacgtctttctttt

SEQ ID NO: 5901468 - DNA, 13 bp, Homo sapiens
gacgtgaaagcca

SEQ ID NO: 5901469 - DNA, 11 bp, Homo sapiens
gacgtgaaata

SEQ ID NO: 5901470 - DNA, 18 bp, Homo sapiens
gacgtgaccaattgccct

SEQ ID NO: 5901471 - DNA, 22 bp, Homo sapiens
gacgtgaccggacttttctgca

SEQ ID NO: 5901472 - DNA, 13 bp, Homo sapiens
gacgtgactcaga

SEQ ID NO: 5901473 - DNA, 20 bp, Homo sapiens
gacgtgcacttggtgctgcg

SEQ ID NO: 5901474 - DNA, 22 bp, Homo sapiens
gacgtgccttttgcacccctcc

SEQ ID NO: 5901475 - DNA, 14 bp, Homo sapiens
gacgtgctcccctg

SEQ ID NO: 5901476 - DNA, 13 bp, Homo sapiens
gacgtgctggcct

SEQ ID NO: 5901477 - DNA, 17 bp, Homo sapiens
gacgtgctggccttggt

SEQ ID NO: 5901478 - DNA, 11 bp, Homo sapiens
gacgtgctggg

SEQ ID NO: 5901479 - DNA, 17 bp, Homo sapiens
gacgtggacatgcctca

SEQ ID NO: 5901480 - DNA, 18 bp, Homo sapiens
gacgtgggcatcatttta

SEQ ID NO: 5901481 - DNA, 17 bp, Homo sapiens
gacgtgggccctgcagg

SEQ ID NO: 5901482 - DNA, 19 bp, Homo sapiens
gacgtggtcagggcagggc

SEQ ID NO: 5901483 - DNA, 21 bp, Homo sapiens
gacgtggtggctcacacctgc

SEQ ID NO: 5901484 - DNA, 24 bp, Homo sapiens
gacgtggtgggactccagctcgtg

SEQ ID NO: 5901485 - DNA, 15 bp, Homo sapiens
gacgtgtgtggctgg

SEQ ID NO: 5901486 - DNA, 16 bp, Homo sapiens
gacgtgtgtggctggg

SEQ ID NO: 5901487 - DNA, 17 bp, Homo sapiens
gacgtgtgtggctggga

SEQ ID NO: 5901488 - DNA, 19 bp, Homo sapiens
gacgtgtgtggctgggacc

SEQ ID NO: 5901489 - DNA, 17 bp, Homo sapiens
gacgtgttatgactcca

SEQ ID NO: 5901490 - DNA, 18 bp, Homo sapiens
gacgttaggccaggcctt

SEQ ID NO: 5901491 - DNA, 13 bp, Homo sapiens
gacgttaggcccg

SEQ ID NO: 5901492 - DNA, 22 bp, Homo sapiens
gacgttccagccggcatggctg

SEQ ID NO: 5901493 - DNA, 21 bp, Homo sapiens
gacgttgacctggactgaagt

SEQ ID NO: 5901494 - DNA, 14 bp, Homo sapiens
gacgttgctgagcc

SEQ ID NO: 5901495 - DNA, 18 bp, Homo sapiens
gacgttgctgagccagct

SEQ ID NO: 5901496 - DNA, 22 bp, Homo sapiens
gacgttggcctcagggccagga

SEQ ID NO: 5901497 - DNA, 17 bp, Homo sapiens
gacgtttgactagccat

SEQ ID NO: 5901498 - DNA, 19 bp, Homo sapiens
gacgtttgactagccatct

SEQ ID NO: 5901499 - DNA, 16 bp, Homo sapiens
gacgttttataagcat

SEQ ID NO: 5901500 - DNA, 22 bp, Homo sapiens
gacgttttataagcatcattat

SEQ ID NO: 5901501 - DNA, 17 bp, Homo sapiens
gacgtttttgtgctgtg

SEQ ID NO: 5901502 - DNA, 14 bp, Homo sapiens
gactaaaaatacac

SEQ ID NO: 5901503 - DNA, 22 bp, Homo sapiens
gactaaaacaagtacatctgta

SEQ ID NO: 5901504 - DNA, 12 bp, Homo sapiens
gactaaaagata

SEQ ID NO: 5901505 - DNA, 20 bp, Homo sapiens
gactaaaagatataagtgct

SEQ ID NO: 5901506 - DNA, 23 bp, Homo sapiens
gactaaaagatataagtgctgta

SEQ ID NO: 5901507 - DNA, 18 bp, Homo sapiens
gactaaaatgtttcattt

SEQ ID NO: 5901508 - DNA, 22 bp, Homo sapiens
gactaaaccattgtgcattcta

SEQ ID NO: 5901509 - DNA, 19 bp, Homo sapiens
gactaaactttttttctgt

SEQ ID NO: 5901510 - DNA, 21 bp, Homo sapiens
gactaaagccatttgtctgtg

SEQ ID NO: 5901511 - DNA, 23 bp, Homo sapiens
gactaaaggatccagagagcagc

SEQ ID NO: 5901512 - DNA, 22 bp, Homo sapiens
gactaaaggcatccttgtcttt

SEQ ID NO: 5901513 - DNA, 17 bp, Homo sapiens
gactaaagttgtgccaa

SEQ ID NO: 5901514 - DNA, 20 bp, Homo sapiens
gactaaatttggggacagat

SEQ ID NO: 5901515 - DNA, 12 bp, Homo sapiens
gactaacaaagg

SEQ ID NO: 5901516 - DNA, 14 bp, Homo sapiens
gactaacaaaggca

SEQ ID NO: 5901517 - DNA, 17 bp, Homo sapiens
gactaacaaaggcagct

SEQ ID NO: 5901518 - DNA, 19 bp, Homo sapiens
gactaacactcagaagcct

SEQ ID NO: 5901519 - DNA, 23 bp, Homo sapiens
gactaacactcagaagcctgggg

SEQ ID NO: 5901520 - DNA, 20 bp, Homo sapiens
gactaacataaaatctgtga

SEQ ID NO: 5901521 - DNA, 21 bp, Homo sapiens
gactaacataaaatctgtgaa

SEQ ID NO: 5901522 - DNA, 22 bp, Homo sapiens
gactaacataaaatctgtgaat

SEQ ID NO: 5901523 - DNA, 23 bp, Homo sapiens
gactaaccatgtgttatgttttc

SEQ ID NO: 5901524 - DNA, 18 bp, Homo sapiens
gactaaccccaccacacc

SEQ ID NO: 5901525 - DNA, 17 bp, Homo sapiens
gactaaccctgtggttg

SEQ ID NO: 5901526 - DNA, 13 bp, Homo sapiens
gactaacctttgt

SEQ ID NO: 5901527 - DNA, 16 bp, Homo sapiens
gactaacttgtctttg

SEQ ID NO: 5901528 - DNA, 19 bp, Homo sapiens
gactaagaataagaagcat

SEQ ID NO: 5901529 - DNA, 15 bp, Homo sapiens
gactaagaatgaacc

SEQ ID NO: 5901530 - DNA, 22 bp, Homo sapiens
gactaagatcggttaacaaata

SEQ ID NO: 5901531 - DNA, 23 bp, Homo sapiens
gactaagatcggttaacaaataa

SEQ ID NO: 5901532 - DNA, 14 bp, Homo sapiens
gactaagccaagct

SEQ ID NO: 5901533 - DNA, 23 bp, Homo sapiens
gactaagccctgtcgagacactt

SEQ ID NO: 5901534 - DNA, 15 bp, Homo sapiens
gactaaggggcagct

SEQ ID NO: 5901535 - DNA, 18 bp, Homo sapiens
gactaaggggcagctcct

SEQ ID NO: 5901536 - DNA, 22 bp, Homo sapiens
gactaatataacttgaaaattt

SEQ ID NO: 5901537 - DNA, 17 bp, Homo sapiens
gactaatatattaatat

SEQ ID NO: 5901538 - DNA, 13 bp, Homo sapiens
gactaatgctttt

SEQ ID NO: 5901539 - DNA, 17 bp, Homo sapiens
gactaatgttggacaga

SEQ ID NO: 5901540 - DNA, 16 bp, Homo sapiens
gactcaggcgcctggc

SEQ ID NO: 5901541 - DNA, 17 bp, Homo sapiens
gactcaggcgcctggca

SEQ ID NO: 5901542 - DNA, 18 bp, Homo sapiens
gactcagggaggctaaat

SEQ ID NO: 5901543 - DNA, 19 bp, Homo sapiens
gactcagggccatgcctgc

SEQ ID NO: 5901544 - DNA, 22 bp, Homo sapiens
gactcagggccatgcctgcccc

SEQ ID NO: 5901545 - DNA, 14 bp, Homo sapiens
gactcagggcccca

SEQ ID NO: 5901546 - DNA, 13 bp, Homo sapiens
gactcagggctcc

SEQ ID NO: 5901547 - DNA, 17 bp, Homo sapiens
gactcagggctcctggg

SEQ ID NO: 5901548 - DNA, 19 bp, Homo sapiens
gactcagggctcctgggtt

SEQ ID NO: 5901549 - DNA, 13 bp, Homo sapiens
gactcaggtctgt

SEQ ID NO: 5901550 - DNA, 21 bp, Homo sapiens
gactcaggtctgtaactgccc

SEQ ID NO: 5901551 - DNA, 19 bp, Homo sapiens
gactcaggtggccctactg

SEQ ID NO: 5901552 - DNA, 16 bp, Homo sapiens
gactcaggtgggccct

SEQ ID NO: 5901553 - DNA, 19 bp, Homo sapiens
gactcaggtggtgtccttc

SEQ ID NO: 5901554 - DNA, 20 bp, Homo sapiens
gactcaggtggtgtccttct

SEQ ID NO: 5901555 - DNA, 22 bp, Homo sapiens
gactcaggtggtgtccttcttc

SEQ ID NO: 5901556 - DNA, 15 bp, Homo sapiens
gactcagtgaccagt

SEQ ID NO: 5901557 - DNA, 16 bp, Homo sapiens
gactcagtgagctggg

SEQ ID NO: 5901558 - DNA, 14 bp, Homo sapiens
gactcagtgcagat

SEQ ID NO: 5901559 - DNA, 20 bp, Homo sapiens
gactcagtgcagatggagag

SEQ ID NO: 5901560 - DNA, 15 bp, Homo sapiens
gactcagtggggagg

SEQ ID NO: 5901561 - DNA, 14 bp, Homo sapiens
gactcagtgtattt

SEQ ID NO: 5901562 - DNA, 21 bp, Homo sapiens
gactcagtgtctgcctttaaa

SEQ ID NO: 5901563 - DNA, 22 bp, Homo sapiens
gactcagtgtctgcctttaaat

SEQ ID NO: 5901564 - DNA, 19 bp, Homo sapiens
gactcagttccaggcctga

SEQ ID NO: 5901565 - DNA, 16 bp, Homo sapiens
gactcagttcttggcc

SEQ ID NO: 5901566 - DNA, 12 bp, Homo sapiens
gactcagttttt

SEQ ID NO: 5901567 - DNA, 17 bp, Homo sapiens
gactcatccccacagct

SEQ ID NO: 5901568 - DNA, 20 bp, Homo sapiens
gactcatccgcctggcccgg

SEQ ID NO: 5901569 - DNA, 16 bp, Homo sapiens
gactcatcttatatgg

SEQ ID NO: 5901570 - DNA, 21 bp, Homo sapiens
gactcatctttccctccttgg

SEQ ID NO: 5901571 - DNA, 22 bp, Homo sapiens
gactcatgaggaggggcccccc

SEQ ID NO: 5901572 - DNA, 16 bp, Homo sapiens
gactcatggcagctgt

SEQ ID NO: 5901573 - DNA, 23 bp, Homo sapiens
gactcatggcagctgtttctcat

SEQ ID NO: 5901574 - DNA, 19 bp, Homo sapiens
gactcatggtgtgttacac

SEQ ID NO: 5901575 - DNA, 11 bp, Homo sapiens
gactcattcac

SEQ ID NO: 5901576 - DNA, 14 bp, Homo sapiens
gactcattcccagt

SEQ ID NO: 5901577 - DNA, 16 bp, Homo sapiens
gactcattgctggagg

SEQ ID NO: 5901578 - DNA, 13 bp, Homo sapiens
gactccaaagctg

SEQ ID NO: 5901579 - DNA, 15 bp, Homo sapiens
gactccaaagctgtt

SEQ ID NO: 5901580 - DNA, 17 bp, Homo sapiens
gactccaagaacaattg

SEQ ID NO: 5901581 - DNA, 23 bp, Homo sapiens
gactccaagccctggggcagggt

SEQ ID NO: 5901582 - DNA, 20 bp, Homo sapiens
gactccaatggggccagcac

SEQ ID NO: 5901583 - DNA, 14 bp, Homo sapiens
gactccacccatcc

SEQ ID NO: 5901584 - DNA, 17 bp, Homo sapiens
gactccactcaaagagg

SEQ ID NO: 5901585 - DNA, 13 bp, Homo sapiens
gactccactggac

SEQ ID NO: 5901586 - DNA, 11 bp, Homo sapiens
gactccagaaa

SEQ ID NO: 5901587 - DNA, 22 bp, Homo sapiens
gactccagaaatgtccctttct

SEQ ID NO: 5901588 - DNA, 17 bp, Homo sapiens
gactccagaatctgctg

SEQ ID NO: 5901589 - DNA, 23 bp, Homo sapiens
gactccagaatctgctgttgcca

SEQ ID NO: 5901590 - DNA, 12 bp, Homo sapiens
gactccagagtc

SEQ ID NO: 5901591 - DNA, 14 bp, Homo sapiens
gactccagagtctg

SEQ ID NO: 5901592 - DNA, 15 bp, Homo sapiens
gactccagagtctga

SEQ ID NO: 5901593 - DNA, 17 bp, Homo sapiens
gactccagagtctgagc

SEQ ID NO: 5901594 - DNA, 18 bp, Homo sapiens
gactccagatctgcaccg

SEQ ID NO: 5901595 - DNA, 9 bp, Homo sapiens
gactccagc

SEQ ID NO: 5901596 - DNA, 14 bp, Homo sapiens
gactccagccagcg

SEQ ID NO: 5901597 - DNA, 16 bp, Homo sapiens
gactccagccagcgcc

SEQ ID NO: 5901598 - DNA, 20 bp, Homo sapiens
gactccagccagcgcctccc

SEQ ID NO: 5901599 - DNA, 23 bp, Homo sapiens
gactccagccagcgcctccctcc

SEQ ID NO: 5901600 - DNA, 13 bp, Homo sapiens
gactccagcccct

SEQ ID NO: 5901601 - DNA, 18 bp, Homo sapiens
gactccaggatcctcctg

SEQ ID NO: 5901602 - DNA, 19 bp, Homo sapiens
gactccaggatcctcctgg

SEQ ID NO: 5901603 - DNA, 20 bp, Homo sapiens
gactccaggatcctcctgga

SEQ ID NO: 5901604 - DNA, 11 bp, Homo sapiens
gactccaggcc

SEQ ID NO: 5901605 - DNA, 13 bp, Homo sapiens
gactccaggcccc

SEQ ID NO: 5901606 - DNA, 12 bp, Homo sapiens
gactccaggcct

SEQ ID NO: 5901607 - DNA, 17 bp, Homo sapiens
gactccaggcctgacca

SEQ ID NO: 5901608 - DNA, 18 bp, Homo sapiens
gactccaggggctgggga

SEQ ID NO: 5901609 - DNA, 19 bp, Homo sapiens
gactccaggggctggggac

SEQ ID NO: 5901610 - DNA, 12 bp, Homo sapiens
gactccagggtg

SEQ ID NO: 5901611 - DNA, 18 bp, Homo sapiens
gactccatatcccgggag

SEQ ID NO: 5901612 - DNA, 18 bp, Homo sapiens
gactccatctcttctgca

SEQ ID NO: 5901613 - DNA, 23 bp, Homo sapiens
gactccatgagaagccgtgggtg

SEQ ID NO: 5901614 - DNA, 15 bp, Homo sapiens
gactccatggctaag

SEQ ID NO: 5901615 - DNA, 23 bp, Homo sapiens
gactccattggggtgagaggtga

SEQ ID NO: 5901616 - DNA, 19 bp, Homo sapiens
gactccatttctttcttcc

SEQ ID NO: 5901617 - DNA, 18 bp, Homo sapiens
gactcccaaagagctgcc

SEQ ID NO: 5901618 - DNA, 12 bp, Homo sapiens
gactcccagaac

SEQ ID NO: 5901619 - DNA, 14 bp, Homo sapiens
gactcccagaacct

SEQ ID NO: 5901620 - DNA, 14 bp, Homo sapiens
gactcccagcagag

SEQ ID NO: 5901621 - DNA, 15 bp, Homo sapiens
gactcccagcagagc

SEQ ID NO: 5901622 - DNA, 17 bp, Homo sapiens
gactcccagcagagccc

SEQ ID NO: 5901623 - DNA, 14 bp, Homo sapiens
gactcccatgaagc

SEQ ID NO: 5901624 - DNA, 18 bp, Homo sapiens
gactcccatgaagccttt

SEQ ID NO: 5901625 - DNA, 18 bp, Homo sapiens
gactcccatgagggagat

SEQ ID NO: 5901626 - DNA, 16 bp, Homo sapiens
gactccccagcccagc

SEQ ID NO: 5901627 - DNA, 18 bp, Homo sapiens
gactccccagcccagcac

SEQ ID NO: 5901628 - DNA, 14 bp, Homo sapiens
gactccccatagca

SEQ ID NO: 5901629 - DNA, 19 bp, Homo sapiens
gactcccccaaccaaggaa

SEQ ID NO: 5901630 - DNA, 22 bp, Homo sapiens
gactcccccaaccaaggaagga

SEQ ID NO: 5901631 - DNA, 22 bp, Homo sapiens
gactccccgcccgccctcctct

SEQ ID NO: 5901632 - DNA, 18 bp, Homo sapiens
gactcccgccccgggctg

SEQ ID NO: 5901633 - DNA, 17 bp, Homo sapiens
gactcccgggccacgcc

SEQ ID NO: 5901634 - DNA, 22 bp, Homo sapiens
gactcccggggtccccgccctc

SEQ ID NO: 5901635 - DNA, 15 bp, Homo sapiens
gactccctccccacc

SEQ ID NO: 5901636 - DNA, 19 bp, Homo sapiens
gactccctccccacccaag

SEQ ID NO: 5901637 - DNA, 18 bp, Homo sapiens
gactccctccccacccca

SEQ ID NO: 5901638 - DNA, 12 bp, Homo sapiens
gactccctcctc

SEQ ID NO: 5901639 - DNA, 14 bp, Homo sapiens
gactccctcctcac

SEQ ID NO: 5901640 - DNA, 23 bp, Homo sapiens
gactccctgagtctggacctcca

SEQ ID NO: 5901641 - DNA, 13 bp, Homo sapiens
gactccctgtggg

SEQ ID NO: 5901642 - DNA, 14 bp, Homo sapiens
gactccctgtgggg

SEQ ID NO: 5901643 - DNA, 12 bp, Homo sapiens
gactcccttgct

SEQ ID NO: 5901644 - DNA, 18 bp, Homo sapiens
gactccgagaagctctcg

SEQ ID NO: 5901645 - DNA, 19 bp, Homo sapiens
gactccggaggactgagcc

SEQ ID NO: 5901646 - DNA, 14 bp, Homo sapiens
gactccggccctcc

SEQ ID NO: 5901647 - DNA, 13 bp, Homo sapiens
gactccggcctgt

SEQ ID NO: 5901648 - DNA, 15 bp, Homo sapiens
gactccggctgtgct

SEQ ID NO: 5901649 - DNA, 21 bp, Homo sapiens
gactccggctgtgctgggaga

SEQ ID NO: 5901650 - DNA, 16 bp, Homo sapiens
gactccgttggccact

SEQ ID NO: 5901651 - DNA, 15 bp, Homo sapiens
gactcctaagggact

SEQ ID NO: 5901652 - DNA, 19 bp, Homo sapiens
gactcctagctgtcctttt

SEQ ID NO: 5901653 - DNA, 13 bp, Homo sapiens
gactcctcagcac

SEQ ID NO: 5901654 - DNA, 19 bp, Homo sapiens
gactcctcagcacccctcc

SEQ ID NO: 5901655 - DNA, 13 bp, Homo sapiens
gactcctcccaca

SEQ ID NO: 5901656 - DNA, 14 bp, Homo sapiens
gactcctcccacaa

SEQ ID NO: 5901657 - DNA, 13 bp, Homo sapiens
gactcctccccac

SEQ ID NO: 5901658 - DNA, 14 bp, Homo sapiens
gactcctccctggg

SEQ ID NO: 5901659 - DNA, 21 bp, Homo sapiens
gactcctccctgggggtgggg

SEQ ID NO: 5901660 - DNA, 22 bp, Homo sapiens
gactcctcccttccccactctg

SEQ ID NO: 5901661 - DNA, 16 bp, Homo sapiens
gactcctcctgggggc

SEQ ID NO: 5901662 - DNA, 17 bp, Homo sapiens
gactcctcctttttcca

SEQ ID NO: 5901663 - DNA, 18 bp, Homo sapiens
gactcctcggcctggctc

SEQ ID NO: 5901664 - DNA, 20 bp, Homo sapiens
gactcctcttcccagagtca

SEQ ID NO: 5901665 - DNA, 15 bp, Homo sapiens
gactcctgaaacctc

SEQ ID NO: 5901666 - DNA, 15 bp, Homo sapiens
gactcctgaagggaa

SEQ ID NO: 5901667 - DNA, 20 bp, Homo sapiens
gactcctgaggacagctgtc

SEQ ID NO: 5901668 - DNA, 23 bp, Homo sapiens
gactcctgattgctctggaagcc

SEQ ID NO: 5901669 - DNA, 12 bp, Homo sapiens
gactcctgcagg

SEQ ID NO: 5901670 - DNA, 13 bp, Homo sapiens
gactcctgcaggc

SEQ ID NO: 5901671 - DNA, 14 bp, Homo sapiens
gactcctgcaggca

SEQ ID NO: 5901672 - DNA, 17 bp, Homo sapiens
gactcctgcaggcagcc

SEQ ID NO: 5901673 - DNA, 14 bp, Homo sapiens
gactcctgccctgt

SEQ ID NO: 5901674 - DNA, 12 bp, Homo sapiens
gactcctgctgg

SEQ ID NO: 5901675 - DNA, 17 bp, Homo sapiens
gactcctgctggtacct

SEQ ID NO: 5901676 - DNA, 19 bp, Homo sapiens
gactcctgctggtacctgc

SEQ ID NO: 5901677 - DNA, 17 bp, Homo sapiens
gactcctgggttgagct

SEQ ID NO: 5901678 - DNA, 17 bp, Homo sapiens
gactcctggtctgtgaa

SEQ ID NO: 5901679 - DNA, 17 bp, Homo sapiens
gactcctggtgcccctc

SEQ ID NO: 5901680 - DNA, 21 bp, Homo sapiens
gactcctgtctgtcctggagg

SEQ ID NO: 5901681 - DNA, 18 bp, Homo sapiens
gactcctgttgccatgga

SEQ ID NO: 5901682 - DNA, 19 bp, Homo sapiens
gactccttatctctttcca

SEQ ID NO: 5901683 - DNA, 22 bp, Homo sapiens
gactccttatctctttccacca

SEQ ID NO: 5901684 - DNA, 16 bp, Homo sapiens
gactccttctccccaa

SEQ ID NO: 5901685 - DNA, 16 bp, Homo sapiens
gactcctttcctctga

SEQ ID NO: 5901686 - DNA, 13 bp, Homo sapiens
gactcgactctgt

SEQ ID NO: 5901687 - DNA, 19 bp, Homo sapiens
gactcgagagggctgagcc

SEQ ID NO: 5901688 - DNA, 20 bp, Homo sapiens
gactcgagagggctgagccc

SEQ ID NO: 5901689 - DNA, 19 bp, Homo sapiens
gactcgagtgtttaaatgc

SEQ ID NO: 5901690 - DNA, 13 bp, Homo sapiens
gactcgcagcacc

SEQ ID NO: 5901691 - DNA, 13 bp, Homo sapiens
gactcgccataaa

SEQ ID NO: 5901692 - DNA, 12 bp, Homo sapiens
gactcgccccca

SEQ ID NO: 5901693 - DNA, 21 bp, Homo sapiens
gactcgcccccaggaacgctc

SEQ ID NO: 5901694 - DNA, 17 bp, Homo sapiens
gactcgcgacaatgcaa

SEQ ID NO: 5901695 - DNA, 14 bp, Homo sapiens
gactcgctagtcag

SEQ ID NO: 5901696 - DNA, 17 bp, Homo sapiens
gactcgctcactcccat

SEQ ID NO: 5901697 - DNA, 18 bp, Homo sapiens
gactcggccactgtgtct

SEQ ID NO: 5901698 - DNA, 21 bp, Homo sapiens
gactcggccactgtgtctctg

SEQ ID NO: 5901699 - DNA, 17 bp, Homo sapiens
gactcggcccagggccg

SEQ ID NO: 5901700 - DNA, 18 bp, Homo sapiens
gactcgggagctgcacac

SEQ ID NO: 5901701 - DNA, 22 bp, Homo sapiens
gactcgggctaagtccagctct

SEQ ID NO: 5901702 - DNA, 16 bp, Homo sapiens
gactcgggggtgggga

SEQ ID NO: 5901703 - DNA, 18 bp, Homo sapiens
gactcggggtgcttcctt

SEQ ID NO: 5901704 - DNA, 20 bp, Homo sapiens
gactcgtctgactgtgtgtg

SEQ ID NO: 5901705 - DNA, 16 bp, Homo sapiens
gactcgttacctgccg

SEQ ID NO: 5901706 - DNA, 20 bp, Homo sapiens
gactcgttctcgtgacccag

SEQ ID NO: 5901707 - DNA, 21 bp, Homo sapiens
gactcgttctcgtgacccagt

SEQ ID NO: 5901708 - DNA, 22 bp, Homo sapiens
gactctaaaactatcagcagcg

SEQ ID NO: 5901709 - DNA, 23 bp, Homo sapiens
gactctaaacacacaagtagatt

SEQ ID NO: 5901710 - DNA, 17 bp, Homo sapiens
gactctaaagaccaaac

SEQ ID NO: 5901711 - DNA, 15 bp, Homo sapiens
gactctaaagtctgt

SEQ ID NO: 5901712 - DNA, 22 bp, Homo sapiens
gactctaaatgcagttttaaga

SEQ ID NO: 5901713 - DNA, 18 bp, Homo sapiens
gactctaagctcagtgct

SEQ ID NO: 5901714 - DNA, 19 bp, Homo sapiens
gactctacctcatatcagt

SEQ ID NO: 5901715 - DNA, 15 bp, Homo sapiens
gactctactcccagc

SEQ ID NO: 5901716 - DNA, 17 bp, Homo sapiens
gactctagaagctcagg

SEQ ID NO: 5901717 - DNA, 16 bp, Homo sapiens
gactctagagtccaag

SEQ ID NO: 5901718 - DNA, 18 bp, Homo sapiens
gactctagagtccaaggt

SEQ ID NO: 5901719 - DNA, 19 bp, Homo sapiens
gactgagcagccgccagct

SEQ ID NO: 5901720 - DNA, 21 bp, Homo sapiens
gactgagcagccgccagctgg

SEQ ID NO: 5901721 - DNA, 13 bp, Homo sapiens
gactgagccagat

SEQ ID NO: 5901722 - DNA, 12 bp, Homo sapiens
gactgagccagt

SEQ ID NO: 5901723 - DNA, 17 bp, Homo sapiens
gactgagccagtcccag

SEQ ID NO: 5901724 - DNA, 11 bp, Homo sapiens
gactgagcccc

SEQ ID NO: 5901725 - DNA, 13 bp, Homo sapiens
gactgagccccca

SEQ ID NO: 5901726 - DNA, 14 bp, Homo sapiens
gactgagccctctc

SEQ ID NO: 5901727 - DNA, 23 bp, Homo sapiens
gactgagcctggcccatagaaac

SEQ ID NO: 5901728 - DNA, 17 bp, Homo sapiens
gactgagcgaggaaaaa

SEQ ID NO: 5901729 - DNA, 24 bp, Homo sapiens
gactgagcgaggaaaaacaacaaa

SEQ ID NO: 5901730 - DNA, 18 bp, Homo sapiens
gactgagctctccaggcc

SEQ ID NO: 5901731 - DNA, 21 bp, Homo sapiens
gactgagctctccaggccagg

SEQ ID NO: 5901732 - DNA, 15 bp, Homo sapiens
gactgagctggggga

SEQ ID NO: 5901733 - DNA, 17 bp, Homo sapiens
gactgaggcatccgtga

SEQ ID NO: 5901734 - DNA, 13 bp, Homo sapiens
gactgaggcctga

SEQ ID NO: 5901735 - DNA, 23 bp, Homo sapiens
gactgaggcctgagcgctcctgc

SEQ ID NO: 5901736 - DNA, 13 bp, Homo sapiens
gactgaggccttt

SEQ ID NO: 5901737 - DNA, 21 bp, Homo sapiens
gactgagggactctgaagcct

SEQ ID NO: 5901738 - DNA, 21 bp, Homo sapiens
gactgagggattttagcctct

SEQ ID NO: 5901739 - DNA, 14 bp, Homo sapiens
gactgagggcctgg

SEQ ID NO: 5901740 - DNA, 16 bp, Homo sapiens
gactgaggggagggga

SEQ ID NO: 5901741 - DNA, 19 bp, Homo sapiens
gactgagggggcctggatg

SEQ ID NO: 5901742 - DNA, 15 bp, Homo sapiens
gactgaggtgcctgc

SEQ ID NO: 5901743 - DNA, 18 bp, Homo sapiens
gactgaggtgcctgctca

SEQ ID NO: 5901744 - DNA, 21 bp, Homo sapiens
gactgagtaagaaatgctgcc

SEQ ID NO: 5901745 - DNA, 18 bp, Homo sapiens
gactgagtacgttgtgca

SEQ ID NO: 5901746 - DNA, 22 bp, Homo sapiens
gactgagtacgttgtgcatttg

SEQ ID NO: 5901747 - DNA, 14 bp, Homo sapiens
gactgagtgggaag

SEQ ID NO: 5901748 - DNA, 23 bp, Homo sapiens
gactgataacaaccttttacatt

SEQ ID NO: 5901749 - DNA, 21 bp, Homo sapiens
gactgatagcttacactgagg

SEQ ID NO: 5901750 - DNA, 19 bp, Homo sapiens
gactgatccctggccactg

SEQ ID NO: 5901751 - DNA, 14 bp, Homo sapiens
gactgatgctttca

SEQ ID NO: 5901752 - DNA, 13 bp, Homo sapiens
gactgatgtcatc

SEQ ID NO: 5901753 - DNA, 14 bp, Homo sapiens
gactgatgtcatct

SEQ ID NO: 5901754 - DNA, 15 bp, Homo sapiens
gactgatgtcatctt

SEQ ID NO: 5901755 - DNA, 19 bp, Homo sapiens
gactgatgtcatcttgagc

SEQ ID NO: 5901756 - DNA, 22 bp, Homo sapiens
gactgatgtctcctaagcacct

SEQ ID NO: 5901757 - DNA, 23 bp, Homo sapiens
gactgatgttaggctgggcccag

SEQ ID NO: 5901758 - DNA, 20 bp, Homo sapiens
gactgatgttcatgatagaa

SEQ ID NO: 5901759 - DNA, 21 bp, Homo sapiens
gactgatgttgagggaacaga

SEQ ID NO: 5901760 - DNA, 13 bp, Homo sapiens
gactgattcttca

SEQ ID NO: 5901761 - DNA, 16 bp, Homo sapiens
gactgattcttcagca

SEQ ID NO: 5901762 - DNA, 12 bp, Homo sapiens
gactgattgttt

SEQ ID NO: 5901763 - DNA, 14 bp, Homo sapiens
gactgatttcagag

SEQ ID NO: 5901764 - DNA, 19 bp, Homo sapiens
gactgatttgatgcctctc

SEQ ID NO: 5901765 - DNA, 23 bp, Homo sapiens
gactgatttttcatggcaacatc

SEQ ID NO: 5901766 - DNA, 16 bp, Homo sapiens
gactgcaaactttttt

SEQ ID NO: 5901767 - DNA, 21 bp, Homo sapiens
gactgcaaacttttttatatc

SEQ ID NO: 5901768 - DNA, 12 bp, Homo sapiens
gactgcaacata

SEQ ID NO: 5901769 - DNA, 19 bp, Homo sapiens
gactgcaacatacaggtgc

SEQ ID NO: 5901770 - DNA, 18 bp, Homo sapiens
gactgcaacttctgtccc

SEQ ID NO: 5901771 - DNA, 22 bp, Homo sapiens
gactgcaagagatggaaaaaaa

SEQ ID NO: 5901772 - DNA, 23 bp, Homo sapiens
gactgcaagagatggaaaaaaag

SEQ ID NO: 5901773 - DNA, 18 bp, Homo sapiens
gactgcaagaggctcctg

SEQ ID NO: 5901774 - DNA, 19 bp, Homo sapiens
gactgcaagccccaccctc

SEQ ID NO: 5901775 - DNA, 14 bp, Homo sapiens
gactgcaatatcaa

SEQ ID NO: 5901776 - DNA, 21 bp, Homo sapiens
gactgcaatttctccaaagct

SEQ ID NO: 5901777 - DNA, 19 bp, Homo sapiens
gactgcaccattgctgctc

SEQ ID NO: 5901778 - DNA, 17 bp, Homo sapiens
gactgcacccagctcca

SEQ ID NO: 5901779 - DNA, 21 bp, Homo sapiens
gactgcacccagctccagggg

SEQ ID NO: 5901780 - DNA, 18 bp, Homo sapiens
gactgcacccaggagggg

SEQ ID NO: 5901781 - DNA, 14 bp, Homo sapiens
gactgcaccttgtg

SEQ ID NO: 5901782 - DNA, 18 bp, Homo sapiens
gactgcagaacccccagg

SEQ ID NO: 5901783 - DNA, 17 bp, Homo sapiens
gactgcagacattctca

SEQ ID NO: 5901784 - DNA, 23 bp, Homo sapiens
gactgcagacattctcaaagcct

SEQ ID NO: 5901785 - DNA, 13 bp, Homo sapiens
gactgcagaggag

SEQ ID NO: 5901786 - DNA, 13 bp, Homo sapiens
gactgcagagggc

SEQ ID NO: 5901787 - DNA, 13 bp, Homo sapiens
gactgcagctgct

SEQ ID NO: 5901788 - DNA, 18 bp, Homo sapiens
gactgcaggggccactcc

SEQ ID NO: 5901789 - DNA, 18 bp, Homo sapiens
gactgcaggtgggctggg

SEQ ID NO: 5901790 - DNA, 23 bp, Homo sapiens
gactgcaggttggaccccagaga

SEQ ID NO: 5901791 - DNA, 16 bp, Homo sapiens
gactgcagtcggcatg

SEQ ID NO: 5901792 - DNA, 19 bp, Homo sapiens
gactgcagtcggcatgcca

SEQ ID NO: 5901793 - DNA, 15 bp, Homo sapiens
gactgcagtgtggag

SEQ ID NO: 5901794 - DNA, 21 bp, Homo sapiens
gactgcagtgtggagttcacc

SEQ ID NO: 5901795 - DNA, 16 bp, Homo sapiens
gactgcatcatatatt

SEQ ID NO: 5901796 - DNA, 13 bp, Homo sapiens
gactgcatgcaag

SEQ ID NO: 5901797 - DNA, 14 bp, Homo sapiens
gactgcatgcaagc

SEQ ID NO: 5901798 - DNA, 19 bp, Homo sapiens
gactgcatggggaggcagc

SEQ ID NO: 5901799 - DNA, 22 bp, Homo sapiens
gactgcatggggaggcagcaga

SEQ ID NO: 5901800 - DNA, 17 bp, Homo sapiens
gactgcatggtaattta

SEQ ID NO: 5901801 - DNA, 19 bp, Homo sapiens
gactgcatggtaatttata

SEQ ID NO: 5901802 - DNA, 14 bp, Homo sapiens
gactgcattatatt

SEQ ID NO: 5901803 - DNA, 16 bp, Homo sapiens
gactgcattatattta

SEQ ID NO: 5901804 - DNA, 24 bp, Homo sapiens
gactgcattatatttattactgta

SEQ ID NO: 5901805 - DNA, 17 bp, Homo sapiens
gactgcatttgtgtgtg

SEQ ID NO: 5901806 - DNA, 19 bp, Homo sapiens
gactgccaagactgctgtg

SEQ ID NO: 5901807 - DNA, 18 bp, Homo sapiens
gactgccaagccagattc

SEQ ID NO: 5901808 - DNA, 20 bp, Homo sapiens
gactgccaagccagattctc

SEQ ID NO: 5901809 - DNA, 14 bp, Homo sapiens
gactgccaagccat

SEQ ID NO: 5901810 - DNA, 12 bp, Homo sapiens
gactgccacctc

SEQ ID NO: 5901811 - DNA, 14 bp, Homo sapiens
gactgccacctccc

SEQ ID NO: 5901812 - DNA, 14 bp, Homo sapiens
gactgccagctctt

SEQ ID NO: 5901813 - DNA, 15 bp, Homo sapiens
gactgccagctcttc

SEQ ID NO: 5901814 - DNA, 19 bp, Homo sapiens
gactgccagctcttcctag

SEQ ID NO: 5901815 - DNA, 20 bp, Homo sapiens
gactgccaggaccccaggtc

SEQ ID NO: 5901816 - DNA, 22 bp, Homo sapiens
gactgccaggataaagcttccg

SEQ ID NO: 5901817 - DNA, 17 bp, Homo sapiens
gactgccagtggagacg

SEQ ID NO: 5901818 - DNA, 17 bp, Homo sapiens
gactgcccaccctgggc

SEQ ID NO: 5901819 - DNA, 19 bp, Homo sapiens
gactgcccagaaagtgggg

SEQ ID NO: 5901820 - DNA, 23 bp, Homo sapiens
gactgcccagaaagtgggggtgg

SEQ ID NO: 5901821 - DNA, 13 bp, Homo sapiens
gactgcccagcca

SEQ ID NO: 5901822 - DNA, 18 bp, Homo sapiens
gactgcccagccactcca

SEQ ID NO: 5901823 - DNA, 22 bp, Homo sapiens
gactgccccacggagacagagg

SEQ ID NO: 5901824 - DNA, 19 bp, Homo sapiens
gactgccccagccaacgag

SEQ ID NO: 5901825 - DNA, 17 bp, Homo sapiens
gactgccccgtgcagac

SEQ ID NO: 5901826 - DNA, 15 bp, Homo sapiens
gactgcccctgctgt

SEQ ID NO: 5901827 - DNA, 17 bp, Homo sapiens
gactgccccttgcttct

SEQ ID NO: 5901828 - DNA, 19 bp, Homo sapiens
gactgccccttgcttctca

SEQ ID NO: 5901829 - DNA, 15 bp, Homo sapiens
gactgccctgcccag

SEQ ID NO: 5901830 - DNA, 16 bp, Homo sapiens
gactgccctgcccagg

SEQ ID NO: 5901831 - DNA, 13 bp, Homo sapiens
gactgcccttctc

SEQ ID NO: 5901832 - DNA, 14 bp, Homo sapiens
gactgcccttctca

SEQ ID NO: 5901833 - DNA, 16 bp, Homo sapiens
gactgccgaccgaggc

SEQ ID NO: 5901834 - DNA, 20 bp, Homo sapiens
gactgccgaccgaggctgga

SEQ ID NO: 5901835 - DNA, 23 bp, Homo sapiens
gactgccgaccgaggctggagct

SEQ ID NO: 5901836 - DNA, 10 bp, Homo sapiens
gactgcctcc

SEQ ID NO: 5901837 - DNA, 13 bp, Homo sapiens
gactgcctccctc

SEQ ID NO: 5901838 - DNA, 14 bp, Homo sapiens
gactgcctccctct

SEQ ID NO: 5901839 - DNA, 14 bp, Homo sapiens
gactgcctctgcca

SEQ ID NO: 5901840 - DNA, 15 bp, Homo sapiens
gactgcctgtctgct

SEQ ID NO: 5901841 - DNA, 23 bp, Homo sapiens
gactgcgccacggcactccagcc

SEQ ID NO: 5901842 - DNA, 12 bp, Homo sapiens
gactgcgctgct

SEQ ID NO: 5901843 - DNA, 12 bp, Homo sapiens
gactgcgggagc

SEQ ID NO: 5901844 - DNA, 17 bp, Homo sapiens
gactgcgggagccagac

SEQ ID NO: 5901845 - DNA, 23 bp, Homo sapiens
gactgcgggagccagactgtcca

SEQ ID NO: 5901846 - DNA, 21 bp, Homo sapiens
gactgcgggatggtcctgggg

SEQ ID NO: 5901847 - DNA, 22 bp, Homo sapiens
gactgcgggatggtcctggggc

SEQ ID NO: 5901848 - DNA, 14 bp, Homo sapiens
gactgctaaataaa

SEQ ID NO: 5901849 - DNA, 17 bp, Homo sapiens
gactgctaaataaaatt

SEQ ID NO: 5901850 - DNA, 14 bp, Homo sapiens
gactgctacctctg

SEQ ID NO: 5901851 - DNA, 18 bp, Homo sapiens
gactgctacctctgagaa

SEQ ID NO: 5901852 - DNA, 23 bp, Homo sapiens
gactgctacctctgagaagacac

SEQ ID NO: 5901853 - DNA, 15 bp, Homo sapiens
gactgctagggagtg

SEQ ID NO: 5901854 - DNA, 17 bp, Homo sapiens
gactgctagtgttctgt

SEQ ID NO: 5901855 - DNA, 21 bp, Homo sapiens
gactgctattctagagctttt

SEQ ID NO: 5901856 - DNA, 19 bp, Homo sapiens
gactgctcaggcctcacct

SEQ ID NO: 5901857 - DNA, 17 bp, Homo sapiens
gactgctcaggctcccc

SEQ ID NO: 5901858 - DNA, 20 bp, Homo sapiens
gactgctcaggctccccaag

SEQ ID NO: 5901859 - DNA, 20 bp, Homo sapiens
gactgctccccagccctggc

SEQ ID NO: 5901860 - DNA, 22 bp, Homo sapiens
gactgctcctgggcattagcaa

SEQ ID NO: 5901861 - DNA, 17 bp, Homo sapiens
gactgctgcgctgtgct

SEQ ID NO: 5901862 - DNA, 13 bp, Homo sapiens
gactgctgctccc

SEQ ID NO: 5901863 - DNA, 16 bp, Homo sapiens
gactgctgctccccac

SEQ ID NO: 5901864 - DNA, 14 bp, Homo sapiens
gactgctgctctcc

SEQ ID NO: 5901865 - DNA, 16 bp, Homo sapiens
gactgctgctgcctgg

SEQ ID NO: 5901866 - DNA, 17 bp, Homo sapiens
gactgctgctgcctggc

SEQ ID NO: 5901867 - DNA, 21 bp, Homo sapiens
gactgctgctgcctggccact

SEQ ID NO: 5901868 - DNA, 22 bp, Homo sapiens
gactgctgctgcctggccactg

SEQ ID NO: 5901869 - DNA, 12 bp, Homo sapiens
gactgctggctc

SEQ ID NO: 5901870 - DNA, 12 bp, Homo sapiens
gactgctgggac

SEQ ID NO: 5901871 - DNA, 19 bp, Homo sapiens
gactgctgggactggccag

SEQ ID NO: 5901872 - DNA, 18 bp, Homo sapiens
gactgctggtaaaataat

SEQ ID NO: 5901873 - DNA, 20 bp, Homo sapiens
gactgctgtgaacatgcctc

SEQ ID NO: 5901874 - DNA, 23 bp, Homo sapiens
gactgctgtgaacatgcctcctc

SEQ ID NO: 5901875 - DNA, 15 bp, Homo sapiens
gactgctgtggccag

SEQ ID NO: 5901876 - DNA, 16 bp, Homo sapiens
gactgctgtggccagg

SEQ ID NO: 5901877 - DNA, 23 bp, Homo sapiens
gactgcttcacggactctttgct

SEQ ID NO: 5901878 - DNA, 15 bp, Homo sapiens
gactgcttcccatcc

SEQ ID NO: 5901879 - DNA, 20 bp, Homo sapiens
gactgcttcccatcctaccc

SEQ ID NO: 5901880 - DNA, 13 bp, Homo sapiens
gactgcttgccct

SEQ ID NO: 5901881 - DNA, 18 bp, Homo sapiens
gactgcttgccctaagca

SEQ ID NO: 5901882 - DNA, 22 bp, Homo sapiens
gactgcttgccctaagcagaaa

SEQ ID NO: 5901883 - DNA, 14 bp, Homo sapiens
gactgcttggccag

SEQ ID NO: 5901884 - DNA, 20 bp, Homo sapiens
gactgctttcagtgcctgct

SEQ ID NO: 5901885 - DNA, 21 bp, Homo sapiens
gactgctttcccaaaggccct

SEQ ID NO: 5901886 - DNA, 21 bp, Homo sapiens
gactgctttggacctaaatgg

SEQ ID NO: 5901887 - DNA, 16 bp, Homo sapiens
gactgcttttaaatga

SEQ ID NO: 5901888 - DNA, 16 bp, Homo sapiens
gactggaaagcacaag

SEQ ID NO: 5901889 - DNA, 15 bp, Homo sapiens
gactggaaccaggga

SEQ ID NO: 5901890 - DNA, 19 bp, Homo sapiens
gactggaaggtccttgcct

SEQ ID NO: 5901891 - DNA, 22 bp, Homo sapiens
gactggaagttgtggatatcag

SEQ ID NO: 5901892 - DNA, 15 bp, Homo sapiens
gactggaatttttat

SEQ ID NO: 5901893 - DNA, 13 bp, Homo sapiens
gactggacagcca

SEQ ID NO: 5901894 - DNA, 14 bp, Homo sapiens
gactggacagccag

SEQ ID NO: 5901895 - DNA, 17 bp, Homo sapiens
gactggacagccagggc

SEQ ID NO: 5901896 - DNA, 24 bp, Homo sapiens
gacttcccagctggcagcgcctcc

SEQ ID NO: 5901897 - DNA, 12 bp, Homo sapiens
gacttccccatc

SEQ ID NO: 5901898 - DNA, 14 bp, Homo sapiens
gacttccccatccc

SEQ ID NO: 5901899 - DNA, 17 bp, Homo sapiens
gacttccccatcccgaa

SEQ ID NO: 5901900 - DNA, 23 bp, Homo sapiens
gacttcccccaccccagaagatt

SEQ ID NO: 5901901 - DNA, 23 bp, Homo sapiens
gacttccccggagggctgcggcg

SEQ ID NO: 5901902 - DNA, 15 bp, Homo sapiens
gacttcccctgggca

SEQ ID NO: 5901903 - DNA, 16 bp, Homo sapiens
gacttcccctgggcaa

SEQ ID NO: 5901904 - DNA, 17 bp, Homo sapiens
gacttcccctgggcaag

SEQ ID NO: 5901905 - DNA, 18 bp, Homo sapiens
gacttcctcgcctctccc

SEQ ID NO: 5901906 - DNA, 19 bp, Homo sapiens
gacttcctcgcctctccca

SEQ ID NO: 5901907 - DNA, 21 bp, Homo sapiens
gacttcctgctacagtagctg

SEQ ID NO: 5901908 - DNA, 15 bp, Homo sapiens
gacttcctggggccc

SEQ ID NO: 5901909 - DNA, 19 bp, Homo sapiens
gacttcctgtccagctcca

SEQ ID NO: 5901910 - DNA, 22 bp, Homo sapiens
gacttcctgtccagctccaacc

SEQ ID NO: 5901911 - DNA, 14 bp, Homo sapiens
gacttccttatttc

SEQ ID NO: 5901912 - DNA, 20 bp, Homo sapiens
gacttccttgagacacggag

SEQ ID NO: 5901913 - DNA, 14 bp, Homo sapiens
gacttcgaaaacag

SEQ ID NO: 5901914 - DNA, 17 bp, Homo sapiens
gacttcggaccgcttgt

SEQ ID NO: 5901915 - DNA, 21 bp, Homo sapiens
gacttcgggggcggctctggg

SEQ ID NO: 5901916 - DNA, 17 bp, Homo sapiens
gacttcggggtagaggc

SEQ ID NO: 5901917 - DNA, 15 bp, Homo sapiens
gacttctaaaataaa

SEQ ID NO: 5901918 - DNA, 18 bp, Homo sapiens
gacttctaaaataaatgt

SEQ ID NO: 5901919 - DNA, 16 bp, Homo sapiens
gacttctaagtaaaac

SEQ ID NO: 5901920 - DNA, 17 bp, Homo sapiens
gacttctaagtaaaacc

SEQ ID NO: 5901921 - DNA, 23 bp, Homo sapiens
gacttctaagtaaaaccacagca

SEQ ID NO: 5901922 - DNA, 14 bp, Homo sapiens
gacttctacccaga

SEQ ID NO: 5901923 - DNA, 16 bp, Homo sapiens
gacttctaggaggatg

SEQ ID NO: 5901924 - DNA, 21 bp, Homo sapiens
gacttctaggaggatgctgtg

SEQ ID NO: 5901925 - DNA, 23 bp, Homo sapiens
gacttctaggaggatgctgtgcc

SEQ ID NO: 5901926 - DNA, 15 bp, Homo sapiens
gacttctccaggcag

SEQ ID NO: 5901927 - DNA, 14 bp, Homo sapiens
gacttctccaggtc

SEQ ID NO: 5901928 - DNA, 14 bp, Homo sapiens
gacttctcccccgc

SEQ ID NO: 5901929 - DNA, 16 bp, Homo sapiens
gacttctcccccgccc

SEQ ID NO: 5901930 - DNA, 15 bp, Homo sapiens
gacttctcccctgcc

SEQ ID NO: 5901931 - DNA, 16 bp, Homo sapiens
gacttctcccctgccc

SEQ ID NO: 5901932 - DNA, 20 bp, Homo sapiens
gacttctctaatagaaaagt

SEQ ID NO: 5901933 - DNA, 22 bp, Homo sapiens
gacttctctgaatcagaaaagc

SEQ ID NO: 5901934 - DNA, 21 bp, Homo sapiens
gacttctctgtcctctgcttt

SEQ ID NO: 5901935 - DNA, 17 bp, Homo sapiens
gacttctctttcttatt

SEQ ID NO: 5901936 - DNA, 14 bp, Homo sapiens
gacttctctttgcc

SEQ ID NO: 5901937 - DNA, 16 bp, Homo sapiens
gacttctgaaaaatga

SEQ ID NO: 5901938 - DNA, 23 bp, Homo sapiens
gacttctgaaaaatgaatgtaaa

SEQ ID NO: 5901939 - DNA, 22 bp, Homo sapiens
gacttctgacaaaggtggtaaa

SEQ ID NO: 5901940 - DNA, 13 bp, Homo sapiens
gacttctgcagct

SEQ ID NO: 5901941 - DNA, 11 bp, Homo sapiens
gacttctgcta

SEQ ID NO: 5901942 - DNA, 18 bp, Homo sapiens
gacttctgctaggtagag

SEQ ID NO: 5901943 - DNA, 17 bp, Homo sapiens
gacttctgctttccaca

SEQ ID NO: 5901944 - DNA, 13 bp, Homo sapiens
gacttctggaagg

SEQ ID NO: 5901945 - DNA, 21 bp, Homo sapiens
gacttctggaaggctggctga

SEQ ID NO: 5901946 - DNA, 13 bp, Homo sapiens
gacttctggggta

SEQ ID NO: 5901947 - DNA, 22 bp, Homo sapiens
gacttctgggtctccagggagg

SEQ ID NO: 5901948 - DNA, 20 bp, Homo sapiens
gacttctggttgtatttcta

SEQ ID NO: 5901949 - DNA, 23 bp, Homo sapiens
gacttctgtcttcacaacagatt

SEQ ID NO: 5901950 - DNA, 19 bp, Homo sapiens
gacttcttccctaaaatgt

SEQ ID NO: 5901951 - DNA, 12 bp, Homo sapiens
gacttcttcttc

SEQ ID NO: 5901952 - DNA, 23 bp, Homo sapiens
gacttcttggtttggggagaaat

SEQ ID NO: 5901953 - DNA, 21 bp, Homo sapiens
gacttcttggttttctctctg

SEQ ID NO: 5901954 - DNA, 22 bp, Homo sapiens
gacttcttggttttctctctgg

SEQ ID NO: 5901955 - DNA, 21 bp, Homo sapiens
gacttctttaattttggaatt

SEQ ID NO: 5901956 - DNA, 22 bp, Homo sapiens
gacttctttactaacactggct

SEQ ID NO: 5901957 - DNA, 21 bp, Homo sapiens
gacttctttcaaattgagaga

SEQ ID NO: 5901958 - DNA, 22 bp, Homo sapiens
gacttctttggtgttctggcct

SEQ ID NO: 5901959 - DNA, 15 bp, Homo sapiens
gacttcttttcacat

SEQ ID NO: 5901960 - DNA, 21 bp, Homo sapiens
gacttcttttcacattcttat

SEQ ID NO: 5901961 - DNA, 22 bp, Homo sapiens
gacttcttttcacattcttata

SEQ ID NO: 5901962 - DNA, 12 bp, Homo sapiens
gacttcttttga

SEQ ID NO: 5901963 - DNA, 14 bp, Homo sapiens
gacttgaaaaatat

SEQ ID NO: 5901964 - DNA, 11 bp, Homo sapiens
gacttgaaaag

SEQ ID NO: 5901965 - DNA, 13 bp, Homo sapiens
gacttgaaagcat

SEQ ID NO: 5901966 - DNA, 17 bp, Homo sapiens
gacttgaaagcatccat

SEQ ID NO: 5901967 - DNA, 17 bp, Homo sapiens
gacttgaactttcctgg

SEQ ID NO: 5901968 - DNA, 20 bp, Homo sapiens
gacttgaagcacagagggct

SEQ ID NO: 5901969 - DNA, 13 bp, Homo sapiens
gacttgaaggagt

SEQ ID NO: 5901970 - DNA, 11 bp, Homo sapiens
gacttgaagtt

SEQ ID NO: 5901971 - DNA, 12 bp, Homo sapiens
gacttgaagttg

SEQ ID NO: 5901972 - DNA, 13 bp, Homo sapiens
gacttgaagttgt

SEQ ID NO: 5901973 - DNA, 14 bp, Homo sapiens
gacttgaataaagt

SEQ ID NO: 5901974 - DNA, 22 bp, Homo sapiens
gacttgaatattcctggactta

SEQ ID NO: 5901975 - DNA, 18 bp, Homo sapiens
gacttgaatgtacaaaga

SEQ ID NO: 5901976 - DNA, 20 bp, Homo sapiens
gacttgaattttcccactgc

SEQ ID NO: 5901977 - DNA, 21 bp, Homo sapiens
gacttgaattttcccactgca

SEQ ID NO: 5901978 - DNA, 16 bp, Homo sapiens
gacttgaccctttcct

SEQ ID NO: 5901979 - DNA, 17 bp, Homo sapiens
gacttgaccctttcctc

SEQ ID NO: 5901980 - DNA, 19 bp, Homo sapiens
gacttgagaaacaaataat

SEQ ID NO: 5901981 - DNA, 23 bp, Homo sapiens
gacttgagaaacaaataatttgt

SEQ ID NO: 5901982 - DNA, 13 bp, Homo sapiens
gacttgagccact

SEQ ID NO: 5901983 - DNA, 16 bp, Homo sapiens
gacttgagccactcct

SEQ ID NO: 5901984 - DNA, 18 bp, Homo sapiens
gacttgagccagttacct

SEQ ID NO: 5901985 - DNA, 15 bp, Homo sapiens
gacttgagccatcca

SEQ ID NO: 5901986 - DNA, 16 bp, Homo sapiens
gacttgagccatccaa

SEQ ID NO: 5901987 - DNA, 15 bp, Homo sapiens
gacttgagcctccat

SEQ ID NO: 5901988 - DNA, 21 bp, Homo sapiens
gacttgagcctccatttctgg

SEQ ID NO: 5901989 - DNA, 13 bp, Homo sapiens
gacttgaggggct

SEQ ID NO: 5901990 - DNA, 16 bp, Homo sapiens
gacttgagtctatttt

SEQ ID NO: 5901991 - DNA, 13 bp, Homo sapiens
gacttgataatga

SEQ ID NO: 5901992 - DNA, 20 bp, Homo sapiens
gacttgatatttaagcagct

SEQ ID NO: 5901993 - DNA, 22 bp, Homo sapiens
gacttgatgaataaacactttt

SEQ ID NO: 5901994 - DNA, 16 bp, Homo sapiens
gacttgatgttccttc

SEQ ID NO: 5901995 - DNA, 12 bp, Homo sapiens
gacttgcaaaga

SEQ ID NO: 5901996 - DNA, 20 bp, Homo sapiens
gacttgcaatccaggctgtt

SEQ ID NO: 5901997 - DNA, 18 bp, Homo sapiens
gacttgcacagggattct

SEQ ID NO: 5901998 - DNA, 18 bp, Homo sapiens
gacttgcatgaagagaag

SEQ ID NO: 5901999 - DNA, 13 bp, Homo sapiens
gacttgcattttt

SEQ ID NO: 5902000 - DNA, 20 bp, Homo sapiens
gacttgccacccccagttcc

SEQ ID NO: 5902001 - DNA, 21 bp, Homo sapiens
gacttgccagagccgggcaca

SEQ ID NO: 5902002 - DNA, 17 bp, Homo sapiens
gacttgccatgaaggca

SEQ ID NO: 5902003 - DNA, 21 bp, Homo sapiens
gacttgccatgaaggcacctg

SEQ ID NO: 5902004 - DNA, 15 bp, Homo sapiens
gacttgcctggggcc

SEQ ID NO: 5902005 - DNA, 18 bp, Homo sapiens
gacttgcctggggccaca

SEQ ID NO: 5902006 - DNA, 17 bp, Homo sapiens
gacttgcggccacagca

SEQ ID NO: 5902007 - DNA, 22 bp, Homo sapiens
gacttgcgtggacagtcagggt

SEQ ID NO: 5902008 - DNA, 14 bp, Homo sapiens
gacttgctaaagca

SEQ ID NO: 5902009 - DNA, 17 bp, Homo sapiens
gacttgctcaagttcac

SEQ ID NO: 5902010 - DNA, 20 bp, Homo sapiens
gacttgctcaagttcaccag

SEQ ID NO: 5902011 - DNA, 12 bp, Homo sapiens
gacttgctccct

SEQ ID NO: 5902012 - DNA, 15 bp, Homo sapiens
gacttgctccctctc

SEQ ID NO: 5902013 - DNA, 16 bp, Homo sapiens
gacttgctccctctcc

SEQ ID NO: 5902014 - DNA, 17 bp, Homo sapiens
gacttgctccctctcca

SEQ ID NO: 5902015 - DNA, 17 bp, Homo sapiens
gacttgctgtccaggca

SEQ ID NO: 5902016 - DNA, 14 bp, Homo sapiens
gacttgcttcctgc

SEQ ID NO: 5902017 - DNA, 22 bp, Homo sapiens
gacttgctttaaatagatttca

SEQ ID NO: 5902018 - DNA, 16 bp, Homo sapiens
gacttggaacctcatt

SEQ ID NO: 5902019 - DNA, 19 bp, Homo sapiens
gacttggaagaggaggagg

SEQ ID NO: 5902020 - DNA, 13 bp, Homo sapiens
gacttggaagctc

SEQ ID NO: 5902021 - DNA, 14 bp, Homo sapiens
gacttggaagctcc

SEQ ID NO: 5902022 - DNA, 15 bp, Homo sapiens
gacttggaagctccg

SEQ ID NO: 5902023 - DNA, 16 bp, Homo sapiens
gacttggaagctccgc

SEQ ID NO: 5902024 - DNA, 15 bp, Homo sapiens
gacttggacatctct

SEQ ID NO: 5902025 - DNA, 18 bp, Homo sapiens
gacttggacatctctctg

SEQ ID NO: 5902026 - DNA, 20 bp, Homo sapiens
gacttggacatctctctggc

SEQ ID NO: 5902027 - DNA, 19 bp, Homo sapiens
gacttggagactcctggtc

SEQ ID NO: 5902028 - DNA, 15 bp, Homo sapiens
gacttggagggtctg

SEQ ID NO: 5902029 - DNA, 17 bp, Homo sapiens
gacttggatcccagggg

SEQ ID NO: 5902030 - DNA, 15 bp, Homo sapiens
gacttggcccaggaa

SEQ ID NO: 5902031 - DNA, 16 bp, Homo sapiens
gacttggccccagacg

SEQ ID NO: 5902032 - DNA, 14 bp, Homo sapiens
gacttggcctctct

SEQ ID NO: 5902033 - DNA, 14 bp, Homo sapiens
gacttggctgtcct

SEQ ID NO: 5902034 - DNA, 21 bp, Homo sapiens
gacttgggagagggagcaagc

SEQ ID NO: 5902035 - DNA, 13 bp, Homo sapiens
gacttgggagctg

SEQ ID NO: 5902036 - DNA, 12 bp, Homo sapiens
gacttgggatgg

SEQ ID NO: 5902037 - DNA, 18 bp, Homo sapiens
gacttgggcacccccagc

SEQ ID NO: 5902038 - DNA, 21 bp, Homo sapiens
gacttgggcacccccagcctg

SEQ ID NO: 5902039 - DNA, 23 bp, Homo sapiens
gacttgggcacccccagcctggg

SEQ ID NO: 5902040 - DNA, 18 bp, Homo sapiens
gacttgggctccgctgtg

SEQ ID NO: 5902041 - DNA, 22 bp, Homo sapiens
gacttggggccagcgcttctgg

SEQ ID NO: 5902042 - DNA, 14 bp, Homo sapiens
gacttggggcctct

SEQ ID NO: 5902043 - DNA, 17 bp, Homo sapiens
gacttggggcctctgac

SEQ ID NO: 5902044 - DNA, 17 bp, Homo sapiens
gacttgggggcagagca

SEQ ID NO: 5902045 - DNA, 21 bp, Homo sapiens
gacttggtaagatgactctga

SEQ ID NO: 5902046 - DNA, 18 bp, Homo sapiens
gacttggtacagttgcag

SEQ ID NO: 5902047 - DNA, 17 bp, Homo sapiens
gacttgtaggaatctgc

SEQ ID NO: 5902048 - DNA, 16 bp, Homo sapiens
gacttgtatatttgta

SEQ ID NO: 5902049 - DNA, 18 bp, Homo sapiens
gacttgtatatttgtaca

SEQ ID NO: 5902050 - DNA, 19 bp, Homo sapiens
gacttgtatattttaagaa

SEQ ID NO: 5902051 - DNA, 23 bp, Homo sapiens
gacttgtctcccagtcgaggctg

SEQ ID NO: 5902052 - DNA, 19 bp, Homo sapiens
gacttgtctgcctcctgct

SEQ ID NO: 5902053 - DNA, 18 bp, Homo sapiens
gacttgtgcacaggcaga

SEQ ID NO: 5902054 - DNA, 16 bp, Homo sapiens
gacttgtgcctcttgg

SEQ ID NO: 5902055 - DNA, 13 bp, Homo sapiens
gacttgtgtgttc

SEQ ID NO: 5902056 - DNA, 12 bp, Homo sapiens
gacttgttagat

SEQ ID NO: 5902057 - DNA, 14 bp, Homo sapiens
gacttgttctagag

SEQ ID NO: 5902058 - DNA, 15 bp, Homo sapiens
gacttgttctgagta

SEQ ID NO: 5902059 - DNA, 12 bp, Homo sapiens
gacttgtttccc

SEQ ID NO: 5902060 - DNA, 20 bp, Homo sapiens
gacttgtttcctgtgcccat

SEQ ID NO: 5902061 - DNA, 16 bp, Homo sapiens
gacttgtttctttctg

SEQ ID NO: 5902062 - DNA, 15 bp, Homo sapiens
gacttgtttgtgcat

SEQ ID NO: 5902063 - DNA, 17 bp, Homo sapiens
gactttaaaaaaacaat

SEQ ID NO: 5902064 - DNA, 17 bp, Homo sapiens
gactttaaaaggattaa

SEQ ID NO: 5902065 - DNA, 21 bp, Homo sapiens
gactttaaactttcccttggc

SEQ ID NO: 5902066 - DNA, 22 bp, Homo sapiens
gactttaaactttcccttggct

SEQ ID NO: 5902067 - DNA, 19 bp, Homo sapiens
gactttaacataagctatt

SEQ ID NO: 5902068 - DNA, 20 bp, Homo sapiens
gactttacaaacctttgttt

SEQ ID NO: 5902069 - DNA, 22 bp, Homo sapiens
gactttacaaacctttgtttca

SEQ ID NO: 5902070 - DNA, 21 bp, Homo sapiens
gactttacactcggctttgga

SEQ ID NO: 5902071 - DNA, 23 bp, Homo sapiens
gactttacaggaggttgtggatg

SEQ ID NO: 5902072 - DNA, 13 bp, Homo sapiens
gactttactgggt

SEQ ID NO: 5902073 - DNA, 18 bp, Homo sapiens
gactttagaaataaatgt

SEQ ID NO: 5902074 - DNA, 20 bp, Homo sapiens
gagaaagggatggtggagtg

SEQ ID NO: 5902075 - DNA, 21 bp, Homo sapiens
gagaaagggccctgggcctgc

SEQ ID NO: 5902076 - DNA, 17 bp, Homo sapiens
gagaaaggggagcccac

SEQ ID NO: 5902077 - DNA, 21 bp, Homo sapiens
gagaaaggggtgattgaaaga

SEQ ID NO: 5902078 - DNA, 23 bp, Homo sapiens
gagaaagtaccctcttttaccaa

SEQ ID NO: 5902079 - DNA, 22 bp, Homo sapiens
gagaaagtacttctccaccctg

SEQ ID NO: 5902080 - DNA, 20 bp, Homo sapiens
gagaaagtgatttctagaaa

SEQ ID NO: 5902081 - DNA, 18 bp, Homo sapiens
gagaaagtgtgagcaaac

SEQ ID NO: 5902082 - DNA, 21 bp, Homo sapiens
gagaaagttactgttaagggt

SEQ ID NO: 5902083 - DNA, 23 bp, Homo sapiens
gagaaataaattttgtttcagaa

SEQ ID NO: 5902084 - DNA, 18 bp, Homo sapiens
gagaaataagtgccctct

SEQ ID NO: 5902085 - DNA, 22 bp, Homo sapiens
gagaaataattgttgattaatt

SEQ ID NO: 5902086 - DNA, 16 bp, Homo sapiens
gagaaatacagctggc

SEQ ID NO: 5902087 - DNA, 15 bp, Homo sapiens
gagaaatacagtgct

SEQ ID NO: 5902088 - DNA, 16 bp, Homo sapiens
gagaaatacagtgctt

SEQ ID NO: 5902089 - DNA, 13 bp, Homo sapiens
gagaaatagctga

SEQ ID NO: 5902090 - DNA, 15 bp, Homo sapiens
gagaaatatgcagaa

SEQ ID NO: 5902091 - DNA, 20 bp, Homo sapiens
gagaaatatggacacttaat

SEQ ID NO: 5902092 - DNA, 14 bp, Homo sapiens
gagaaatattttaa

SEQ ID NO: 5902093 - DNA, 17 bp, Homo sapiens
gagaaatattttaattt

SEQ ID NO: 5902094 - DNA, 16 bp, Homo sapiens
gagaaatcaggcctga

SEQ ID NO: 5902095 - DNA, 13 bp, Homo sapiens
gagaaatgaaaac

SEQ ID NO: 5902096 - DNA, 17 bp, Homo sapiens
gagaaatgaagcagagg

SEQ ID NO: 5902097 - DNA, 20 bp, Homo sapiens
gagaaatgaataagctttct

SEQ ID NO: 5902098 - DNA, 18 bp, Homo sapiens
gagaaatgaggaaaagaa

SEQ ID NO: 5902099 - DNA, 20 bp, Homo sapiens
gagaaatgaggaaaagaaaa

SEQ ID NO: 5902100 - DNA, 16 bp, Homo sapiens
gagaaatgatgtgaaa

SEQ ID NO: 5902101 - DNA, 15 bp, Homo sapiens
gagaaatgattgaca

SEQ ID NO: 5902102 - DNA, 11 bp, Homo sapiens
gagaaatgcca

SEQ ID NO: 5902103 - DNA, 17 bp, Homo sapiens
gagaaatgccccagtgt

SEQ ID NO: 5902104 - DNA, 13 bp, Homo sapiens
gagaaatgtaatg

SEQ ID NO: 5902105 - DNA, 18 bp, Homo sapiens
gagaaatgtgaagggtgg

SEQ ID NO: 5902106 - DNA, 23 bp, Homo sapiens
gagaaatgtgtagctgcaaaaat

SEQ ID NO: 5902107 - DNA, 11 bp, Homo sapiens
gagaaattatt

SEQ ID NO: 5902108 - DNA, 17 bp, Homo sapiens
gagaaattcgtgtgttt

SEQ ID NO: 5902109 - DNA, 17 bp, Homo sapiens
gagaaattctgttaaaa

SEQ ID NO: 5902110 - DNA, 22 bp, Homo sapiens
gagaaattctgttaaaatctat

SEQ ID NO: 5902111 - DNA, 14 bp, Homo sapiens
gagaaattcttgtt

SEQ ID NO: 5902112 - DNA, 16 bp, Homo sapiens
gagaaattgtgccaaa

SEQ ID NO: 5902113 - DNA, 23 bp, Homo sapiens
gagaaatttttttccagaattga

SEQ ID NO: 5902114 - DNA, 16 bp, Homo sapiens
gagaacaaaacctctt

SEQ ID NO: 5902115 - DNA, 19 bp, Homo sapiens
gagaacaaagagtgaaata

SEQ ID NO: 5902116 - DNA, 23 bp, Homo sapiens
gagaacaagtcacagctgcagct

SEQ ID NO: 5902117 - DNA, 17 bp, Homo sapiens
gagaacacactgagtga

SEQ ID NO: 5902118 - DNA, 22 bp, Homo sapiens
gagaacacagccgattcacctg

SEQ ID NO: 5902119 - DNA, 20 bp, Homo sapiens
gagaacacgttgccaggggc

SEQ ID NO: 5902120 - DNA, 21 bp, Homo sapiens
gagaacagatctccaaagctt

SEQ ID NO: 5902121 - DNA, 13 bp, Homo sapiens
gagaacagctccc

SEQ ID NO: 5902122 - DNA, 19 bp, Homo sapiens
gagaacagtattgggcagg

SEQ ID NO: 5902123 - DNA, 23 bp, Homo sapiens
gagaacagtattgggcaggagga

SEQ ID NO: 5902124 - DNA, 19 bp, Homo sapiens
gagaacagtttcatcagga

SEQ ID NO: 5902125 - DNA, 12 bp, Homo sapiens
gagaacatccat

SEQ ID NO: 5902126 - DNA, 20 bp, Homo sapiens
gagaacatctgccttgctgc

SEQ ID NO: 5902127 - DNA, 19 bp, Homo sapiens
gagaacatgaatcaaaagt

SEQ ID NO: 5902128 - DNA, 19 bp, Homo sapiens
gagaacattaggccccagc

SEQ ID NO: 5902129 - DNA, 23 bp, Homo sapiens
gagaacattccctggaattgcca

SEQ ID NO: 5902130 - DNA, 23 bp, Homo sapiens
gagaacatttacacattctcaca

SEQ ID NO: 5902131 - DNA, 11 bp, Homo sapiens
gagaacatttt

SEQ ID NO: 5902132 - DNA, 15 bp, Homo sapiens
gagaacattttactg

SEQ ID NO: 5902133 - DNA, 16 bp, Homo sapiens
gagaacattttactgt

SEQ ID NO: 5902134 - DNA, 23 bp, Homo sapiens
gagaacattttactgttgtacaa

SEQ ID NO: 5902135 - DNA, 17 bp, Homo sapiens
gagaaccaaaagatgcc

SEQ ID NO: 5902136 - DNA, 20 bp, Homo sapiens
gagaaccaaaagatgccttg

SEQ ID NO: 5902137 - DNA, 15 bp, Homo sapiens
gagaaccaaaccgca

SEQ ID NO: 5902138 - DNA, 14 bp, Homo sapiens
gagaaccaaagcaa

SEQ ID NO: 5902139 - DNA, 17 bp, Homo sapiens
gagaaccaaatctggaa

SEQ ID NO: 5902140 - DNA, 19 bp, Homo sapiens
gagaaccaaccagggaagc

SEQ ID NO: 5902141 - DNA, 12 bp, Homo sapiens
gagaaccaccta

SEQ ID NO: 5902142 - DNA, 13 bp, Homo sapiens
gagaaccaggagg

SEQ ID NO: 5902143 - DNA, 19 bp, Homo sapiens
gagaaccagtctcctcact

SEQ ID NO: 5902144 - DNA, 22 bp, Homo sapiens
gagaaccagtctcctcactctg

SEQ ID NO: 5902145 - DNA, 16 bp, Homo sapiens
gagaaccattgttctg

SEQ ID NO: 5902146 - DNA, 21 bp, Homo sapiens
gagaacccaaagagacagctc

SEQ ID NO: 5902147 - DNA, 14 bp, Homo sapiens
gagaaccctgagca

SEQ ID NO: 5902148 - DNA, 20 bp, Homo sapiens
gagaaccctgcgtggggaca

SEQ ID NO: 5902149 - DNA, 14 bp, Homo sapiens
gagaacccttcctg

SEQ ID NO: 5902150 - DNA, 20 bp, Homo sapiens
gagaaccgagcaaagatcaa

SEQ ID NO: 5902151 - DNA, 18 bp, Homo sapiens
gagaacctaatgcactct

SEQ ID NO: 5902152 - DNA, 22 bp, Homo sapiens
gagaacctcaggtacggagaag

SEQ ID NO: 5902153 - DNA, 19 bp, Homo sapiens
gagaacctggagttcctga

SEQ ID NO: 5902154 - DNA, 12 bp, Homo sapiens
gagaacctggcc

SEQ ID NO: 5902155 - DNA, 21 bp, Homo sapiens
gagaacctgggttgcagacag

SEQ ID NO: 5902156 - DNA, 14 bp, Homo sapiens
gagaacctgtgggc

SEQ ID NO: 5902157 - DNA, 15 bp, Homo sapiens
gagaacgcagcccta

SEQ ID NO: 5902158 - DNA, 16 bp, Homo sapiens
gagaacgcagccctag

SEQ ID NO: 5902159 - DNA, 15 bp, Homo sapiens
gagaacgccagtctc

SEQ ID NO: 5902160 - DNA, 18 bp, Homo sapiens
gagaacgccagtctccca

SEQ ID NO: 5902161 - DNA, 21 bp, Homo sapiens
gagaacgggcgtcaggggtgc

SEQ ID NO: 5902162 - DNA, 21 bp, Homo sapiens
gagaacggtgaccgcctcctg

SEQ ID NO: 5902163 - DNA, 22 bp, Homo sapiens
gagaactaaactagtttttcct

SEQ ID NO: 5902164 - DNA, 20 bp, Homo sapiens
gagaactaagtaagaaacac

SEQ ID NO: 5902165 - DNA, 21 bp, Homo sapiens
gagaactacgcacagctgccg

SEQ ID NO: 5902166 - DNA, 14 bp, Homo sapiens
gagaactacttgaa

SEQ ID NO: 5902167 - DNA, 18 bp, Homo sapiens
gagaactcagaagagaaa

SEQ ID NO: 5902168 - DNA, 15 bp, Homo sapiens
gagaactcagtgcca

SEQ ID NO: 5902169 - DNA, 23 bp, Homo sapiens
gagaactccagctggtgccccca

SEQ ID NO: 5902170 - DNA, 22 bp, Homo sapiens
gagaactcgcgctcagtaaacg

SEQ ID NO: 5902171 - DNA, 23 bp, Homo sapiens
gagaactgcagacctcactgtca

SEQ ID NO: 5902172 - DNA, 13 bp, Homo sapiens
gagaactgggatt

SEQ ID NO: 5902173 - DNA, 23 bp, Homo sapiens
gagaactggggttcaagcccagg

SEQ ID NO: 5902174 - DNA, 19 bp, Homo sapiens
gagaactggttcttgcctt

SEQ ID NO: 5902175 - DNA, 14 bp, Homo sapiens
gagaactgtctttc

SEQ ID NO: 5902176 - DNA, 18 bp, Homo sapiens
gagaactgtgaatatgtg

SEQ ID NO: 5902177 - DNA, 23 bp, Homo sapiens
gagaacttccagatcctggaaat

SEQ ID NO: 5902178 - DNA, 16 bp, Homo sapiens
gagaactttatttcca

SEQ ID NO: 5902179 - DNA, 15 bp, Homo sapiens
gagaactttcatttt

SEQ ID NO: 5902180 - DNA, 20 bp, Homo sapiens
gagaactttcggagcctgcc

SEQ ID NO: 5902181 - DNA, 14 bp, Homo sapiens
gagaactttttgtt

SEQ ID NO: 5902182 - DNA, 11 bp, Homo sapiens
gagaagaaaat

SEQ ID NO: 5902183 - DNA, 16 bp, Homo sapiens
gagaagaaagaacgga

SEQ ID NO: 5902184 - DNA, 14 bp, Homo sapiens
gagaagaactgaaa

SEQ ID NO: 5902185 - DNA, 9 bp, Homo sapiens
gagaagaag

SEQ ID NO: 5902186 - DNA, 15 bp, Homo sapiens
gagaagaagaaaaaa

SEQ ID NO: 5902187 - DNA, 12 bp, Homo sapiens
gagaagaagctg

SEQ ID NO: 5902188 - DNA, 23 bp, Homo sapiens
gagaagaaggaagatcttgagag

SEQ ID NO: 5902189 - DNA, 23 bp, Homo sapiens
gagaagaatagcctagatatgaa

SEQ ID NO: 5902190 - DNA, 15 bp, Homo sapiens
gagaagaatattgtt

SEQ ID NO: 5902191 - DNA, 19 bp, Homo sapiens
gagaagaatccacaaggac

SEQ ID NO: 5902192 - DNA, 22 bp, Homo sapiens
gagaagaatgaaaatgcagtcc

SEQ ID NO: 5902193 - DNA, 20 bp, Homo sapiens
gagaagaattttcagacccc

SEQ ID NO: 5902194 - DNA, 15 bp, Homo sapiens
gagaagacaaaatta

SEQ ID NO: 5902195 - DNA, 14 bp, Homo sapiens
gagaagacaacaga

SEQ ID NO: 5902196 - DNA, 12 bp, Homo sapiens
gagaagacactg

SEQ ID NO: 5902197 - DNA, 17 bp, Homo sapiens
gagaagacccctgccca

SEQ ID NO: 5902198 - DNA, 12 bp, Homo sapiens
gagaagagagga

SEQ ID NO: 5902199 - DNA, 15 bp, Homo sapiens
gagaagagaggagag

SEQ ID NO: 5902200 - DNA, 16 bp, Homo sapiens
gagaagagaggagagg

SEQ ID NO: 5902201 - DNA, 15 bp, Homo sapiens
gagaagagctgttca

SEQ ID NO: 5902202 - DNA, 22 bp, Homo sapiens
gagaagagctgttcacagccag

SEQ ID NO: 5902203 - DNA, 14 bp, Homo sapiens
gagaagaggaggag

SEQ ID NO: 5902204 - DNA, 16 bp, Homo sapiens
gagaagaggaggaggt

SEQ ID NO: 5902205 - DNA, 21 bp, Homo sapiens
gagaagaggcatcctgcctgg

SEQ ID NO: 5902206 - DNA, 22 bp, Homo sapiens
gagaagaggcatcctgcctggg

SEQ ID NO: 5902207 - DNA, 19 bp, Homo sapiens
gagaagagggcccagccca

SEQ ID NO: 5902208 - DNA, 19 bp, Homo sapiens
gagaagagggcctgtggga

SEQ ID NO: 5902209 - DNA, 17 bp, Homo sapiens
gagaagagtccaggaag

SEQ ID NO: 5902210 - DNA, 21 bp, Homo sapiens
gagaagatcggaacagctcct

SEQ ID NO: 5902211 - DNA, 20 bp, Homo sapiens
gagaagatgcctgttaattt

SEQ ID NO: 5902212 - DNA, 12 bp, Homo sapiens
gagaagatggca

SEQ ID NO: 5902213 - DNA, 16 bp, Homo sapiens
gagaagatggcactgt

SEQ ID NO: 5902214 - DNA, 22 bp, Homo sapiens
gagaagatggcactgtccaggg

SEQ ID NO: 5902215 - DNA, 12 bp, Homo sapiens
gagaagatggcc

SEQ ID NO: 5902216 - DNA, 18 bp, Homo sapiens
gagaagatggccatgccc

SEQ ID NO: 5902217 - DNA, 23 bp, Homo sapiens
gagaagatgggggctggaggggg

SEQ ID NO: 5902218 - DNA, 20 bp, Homo sapiens
gagaagcaaaccgccctgca

SEQ ID NO: 5902219 - DNA, 22 bp, Homo sapiens
gagaagcaagtaaaaaggctaa

SEQ ID NO: 5902220 - DNA, 14 bp, Homo sapiens
gagaagcacttgag

SEQ ID NO: 5902221 - DNA, 16 bp, Homo sapiens
gagaagcagaggaagg

SEQ ID NO: 5902222 - DNA, 14 bp, Homo sapiens
gagaagcagcctcc

SEQ ID NO: 5902223 - DNA, 16 bp, Homo sapiens
gagaagcagcctccta

SEQ ID NO: 5902224 - DNA, 12 bp, Homo sapiens
gagaagcaggca

SEQ ID NO: 5902225 - DNA, 15 bp, Homo sapiens
gagaagcaggcagat

SEQ ID NO: 5902226 - DNA, 19 bp, Homo sapiens
gagaagcatatagaggcaa

SEQ ID NO: 5902227 - DNA, 15 bp, Homo sapiens
gagaagcatcctcca

SEQ ID NO: 5902228 - DNA, 21 bp, Homo sapiens
gagaagcatcggagggaattg

SEQ ID NO: 5902229 - DNA, 13 bp, Homo sapiens
gagaagccaagcc

SEQ ID NO: 5902230 - DNA, 15 bp, Homo sapiens
gagaagccaagcctg

SEQ ID NO: 5902231 - DNA, 13 bp, Homo sapiens
gagaagccaaggg

SEQ ID NO: 5902232 - DNA, 23 bp, Homo sapiens
gagaagccaagggacacaggaga

SEQ ID NO: 5902233 - DNA, 20 bp, Homo sapiens
gagaagccacaggcctgaga

SEQ ID NO: 5902234 - DNA, 14 bp, Homo sapiens
gagaagccaccttc

SEQ ID NO: 5902235 - DNA, 14 bp, Homo sapiens
gagaagccacgctg

SEQ ID NO: 5902236 - DNA, 16 bp, Homo sapiens
gagaagccagccacag

SEQ ID NO: 5902237 - DNA, 23 bp, Homo sapiens
gagaagccaggaatttcccagga

SEQ ID NO: 5902238 - DNA, 20 bp, Homo sapiens
gagaagccagtgcggcaggt

SEQ ID NO: 5902239 - DNA, 24 bp, Homo sapiens
gagaagccagtgtctaggcactga

SEQ ID NO: 5902240 - DNA, 17 bp, Homo sapiens
gagaagccatcacctca

SEQ ID NO: 5902241 - DNA, 15 bp, Homo sapiens
gagaagccatgtact

SEQ ID NO: 5902242 - DNA, 21 bp, Homo sapiens
gagaagccatgtactcaagta

SEQ ID NO: 5902243 - DNA, 11 bp, Homo sapiens
gagaagccatt

SEQ ID NO: 5902244 - DNA, 18 bp, Homo sapiens
gagaagccccgcacgggc

SEQ ID NO: 5902245 - DNA, 24 bp, Homo sapiens
gagaagccccgcacgggctgtctg

SEQ ID NO: 5902246 - DNA, 15 bp, Homo sapiens
gagaagccccttccc

SEQ ID NO: 5902247 - DNA, 14 bp, Homo sapiens
gagaagcccgtgtg

SEQ ID NO: 5902248 - DNA, 15 bp, Homo sapiens
gagaagcccgtgtga

SEQ ID NO: 5902249 - DNA, 16 bp, Homo sapiens
gagaagcccgtgtgag

SEQ ID NO: 5902250 - DNA, 14 bp, Homo sapiens
gagaagcctgtctg

SEQ ID NO: 5902251 - DNA, 23 bp, Homo sapiens
gagaatgaaagggcccagagagg

SEQ ID NO: 5902252 - DNA, 22 bp, Homo sapiens
gagaatgaacaaagaccaattt

SEQ ID NO: 5902253 - DNA, 14 bp, Homo sapiens
gagaatgaactgtg

SEQ ID NO: 5902254 - DNA, 13 bp, Homo sapiens
gagaatgaattca

SEQ ID NO: 5902255 - DNA, 21 bp, Homo sapiens
gagaatgagagacacactgaa

SEQ ID NO: 5902256 - DNA, 19 bp, Homo sapiens
gagaatgagagagtgtgga

SEQ ID NO: 5902257 - DNA, 22 bp, Homo sapiens
gagaatgagagcgacacagacg

SEQ ID NO: 5902258 - DNA, 23 bp, Homo sapiens
gagaatgagggcgtgaaacacaa

SEQ ID NO: 5902259 - DNA, 13 bp, Homo sapiens
gagaatgagggtc

SEQ ID NO: 5902260 - DNA, 22 bp, Homo sapiens
gagaatgcacaaacagaggccg

SEQ ID NO: 5902261 - DNA, 16 bp, Homo sapiens
gagaatgcacagatat

SEQ ID NO: 5902262 - DNA, 14 bp, Homo sapiens
gagaatgccagccc

SEQ ID NO: 5902263 - DNA, 15 bp, Homo sapiens
gagaatgccagccca

SEQ ID NO: 5902264 - DNA, 19 bp, Homo sapiens
gagaatgcccaactcttca

SEQ ID NO: 5902265 - DNA, 14 bp, Homo sapiens
gagaatggagacag

SEQ ID NO: 5902266 - DNA, 21 bp, Homo sapiens
gagaatggcctggagcaggcc

SEQ ID NO: 5902267 - DNA, 22 bp, Homo sapiens
gagaatggcctggagcaggccc

SEQ ID NO: 5902268 - DNA, 22 bp, Homo sapiens
gagaatggctgggtcagggcca

SEQ ID NO: 5902269 - DNA, 20 bp, Homo sapiens
gagaatgggacgaggacatt

SEQ ID NO: 5902270 - DNA, 18 bp, Homo sapiens
gagaatggggttcctgct

SEQ ID NO: 5902271 - DNA, 23 bp, Homo sapiens
gagaatgggtaattcaagaggcc

SEQ ID NO: 5902272 - DNA, 20 bp, Homo sapiens
gagaatgggtttactctcaa

SEQ ID NO: 5902273 - DNA, 23 bp, Homo sapiens
gagaatgtatcagccagccttcc

SEQ ID NO: 5902274 - DNA, 15 bp, Homo sapiens
gagaatgtattctgt

SEQ ID NO: 5902275 - DNA, 17 bp, Homo sapiens
gagaatgtattctgtat

SEQ ID NO: 5902276 - DNA, 14 bp, Homo sapiens
gagaatgtcactgt

SEQ ID NO: 5902277 - DNA, 15 bp, Homo sapiens
gagaatgtcatttgc

SEQ ID NO: 5902278 - DNA, 19 bp, Homo sapiens
gagaatgtcatttgctaat

SEQ ID NO: 5902279 - DNA, 20 bp, Homo sapiens
gagaatgtcatttgctaatg

SEQ ID NO: 5902280 - DNA, 15 bp, Homo sapiens
gagaattaaaacttt

SEQ ID NO: 5902281 - DNA, 19 bp, Homo sapiens
gagaattacagaaaatttg

SEQ ID NO: 5902282 - DNA, 19 bp, Homo sapiens
gagaattagacaaatttgt

SEQ ID NO: 5902283 - DNA, 15 bp, Homo sapiens
gagaattatctcaag

SEQ ID NO: 5902284 - DNA, 16 bp, Homo sapiens
gagaattcttacatgt

SEQ ID NO: 5902285 - DNA, 13 bp, Homo sapiens
gagaattgaaact

SEQ ID NO: 5902286 - DNA, 16 bp, Homo sapiens
gagaattgactgaagc

SEQ ID NO: 5902287 - DNA, 21 bp, Homo sapiens
gagaattgactgaagcacagc

SEQ ID NO: 5902288 - DNA, 21 bp, Homo sapiens
gagaattgctgaagggcattc

SEQ ID NO: 5902289 - DNA, 13 bp, Homo sapiens
gagaattgcttga

SEQ ID NO: 5902290 - DNA, 13 bp, Homo sapiens
gagaattggctca

SEQ ID NO: 5902291 - DNA, 19 bp, Homo sapiens
gagaattgggcggctctga

SEQ ID NO: 5902292 - DNA, 22 bp, Homo sapiens
gagaattgtgcgacttcacaaa

SEQ ID NO: 5902293 - DNA, 20 bp, Homo sapiens
gagaattgtgctttcaccag

SEQ ID NO: 5902294 - DNA, 17 bp, Homo sapiens
gagaatttctaaagtaa

SEQ ID NO: 5902295 - DNA, 18 bp, Homo sapiens
gagaatttgctttatctg

SEQ ID NO: 5902296 - DNA, 15 bp, Homo sapiens
gagaattttaaatta

SEQ ID NO: 5902297 - DNA, 18 bp, Homo sapiens
gagaattttttctttgta

SEQ ID NO: 5902298 - DNA, 15 bp, Homo sapiens
gagacaaaagaaaaa

SEQ ID NO: 5902299 - DNA, 18 bp, Homo sapiens
gagacaaaattgctgagg

SEQ ID NO: 5902300 - DNA, 15 bp, Homo sapiens
gagacaaagtgggtg

SEQ ID NO: 5902301 - DNA, 22 bp, Homo sapiens
gagacaaatcctaggctcctgg

SEQ ID NO: 5902302 - DNA, 15 bp, Homo sapiens
gagacaaatcctttc

SEQ ID NO: 5902303 - DNA, 14 bp, Homo sapiens
gagacaacacacac

SEQ ID NO: 5902304 - DNA, 20 bp, Homo sapiens
gagacaacttgctcctttcc

SEQ ID NO: 5902305 - DNA, 18 bp, Homo sapiens
gagacaagaaaggcagac

SEQ ID NO: 5902306 - DNA, 20 bp, Homo sapiens
gagacaagaaaggcagacac

SEQ ID NO: 5902307 - DNA, 15 bp, Homo sapiens
gagacaagcatggaa

SEQ ID NO: 5902308 - DNA, 13 bp, Homo sapiens
gagacaagccctg

SEQ ID NO: 5902309 - DNA, 16 bp, Homo sapiens
gagacaagccctggca

SEQ ID NO: 5902310 - DNA, 15 bp, Homo sapiens
gagacaaggaaccac

SEQ ID NO: 5902311 - DNA, 18 bp, Homo sapiens
gagacaaggagggcacag

SEQ ID NO: 5902312 - DNA, 16 bp, Homo sapiens
gagacaaggtgctaac

SEQ ID NO: 5902313 - DNA, 22 bp, Homo sapiens
gagacaataaacagctgaacca

SEQ ID NO: 5902314 - DNA, 17 bp, Homo sapiens
gagacaatgcagatgcc

SEQ ID NO: 5902315 - DNA, 18 bp, Homo sapiens
gagacaatgcagatgcca

SEQ ID NO: 5902316 - DNA, 15 bp, Homo sapiens
gagacacaagccttc

SEQ ID NO: 5902317 - DNA, 15 bp, Homo sapiens
gagacacacacacag

SEQ ID NO: 5902318 - DNA, 18 bp, Homo sapiens
gagacacactgaagaagc

SEQ ID NO: 5902319 - DNA, 14 bp, Homo sapiens
gagacaccaccacc

SEQ ID NO: 5902320 - DNA, 17 bp, Homo sapiens
gagacaccatcctgagc

SEQ ID NO: 5902321 - DNA, 19 bp, Homo sapiens
gagacaccatcctgagcca

SEQ ID NO: 5902322 - DNA, 22 bp, Homo sapiens
gagacaccccttcctgctgaca

SEQ ID NO: 5902323 - DNA, 22 bp, Homo sapiens
gagacaccctaactcttgctca

SEQ ID NO: 5902324 - DNA, 23 bp, Homo sapiens
gagacaccctaactcttgctcac

SEQ ID NO: 5902325 - DNA, 14 bp, Homo sapiens
gagacaccctctgg

SEQ ID NO: 5902326 - DNA, 16 bp, Homo sapiens
gagacaccctctgggg

SEQ ID NO: 5902327 - DNA, 20 bp, Homo sapiens
gagacaccggagtatgtgca

SEQ ID NO: 5902328 - DNA, 16 bp, Homo sapiens
gagacacctcagagcc

SEQ ID NO: 5902329 - DNA, 18 bp, Homo sapiens
gagacacctgcacctccc

SEQ ID NO: 5902330 - DNA, 19 bp, Homo sapiens
gagacacctgcacctcccc

SEQ ID NO: 5902331 - DNA, 21 bp, Homo sapiens
gagacacctgcacctcccccc

SEQ ID NO: 5902332 - DNA, 19 bp, Homo sapiens
gagacacggggcaggacct

SEQ ID NO: 5902333 - DNA, 20 bp, Homo sapiens
gagacactaacgacttcagg

SEQ ID NO: 5902334 - DNA, 17 bp, Homo sapiens
gagacactcccagggac

SEQ ID NO: 5902335 - DNA, 18 bp, Homo sapiens
gagacactcccagggaca

SEQ ID NO: 5902336 - DNA, 15 bp, Homo sapiens
gagacactggcccct

SEQ ID NO: 5902337 - DNA, 17 bp, Homo sapiens
gagacactggcccctca

SEQ ID NO: 5902338 - DNA, 13 bp, Homo sapiens
gagacactggtct

SEQ ID NO: 5902339 - DNA, 15 bp, Homo sapiens
gagacactggtctca

SEQ ID NO: 5902340 - DNA, 20 bp, Homo sapiens
gagacactgtgctataaatc

SEQ ID NO: 5902341 - DNA, 20 bp, Homo sapiens
gagacactgttgataaaaac

SEQ ID NO: 5902342 - DNA, 14 bp, Homo sapiens
gagacagaaacaga

SEQ ID NO: 5902343 - DNA, 20 bp, Homo sapiens
gagacagaaacagagagaga

SEQ ID NO: 5902344 - DNA, 21 bp, Homo sapiens
gagacagaaacagagagagac

SEQ ID NO: 5902345 - DNA, 16 bp, Homo sapiens
gagacagaagcaggct

SEQ ID NO: 5902346 - DNA, 18 bp, Homo sapiens
gagacagaatgtatctgt

SEQ ID NO: 5902347 - DNA, 22 bp, Homo sapiens
gagacagaccggggttcaagcc

SEQ ID NO: 5902348 - DNA, 9 bp, Homo sapiens
gagacagag

SEQ ID NO: 5902349 - DNA, 14 bp, Homo sapiens
gagacagagagaga

SEQ ID NO: 5902350 - DNA, 21 bp, Homo sapiens
gagacagagagctcctccctg

SEQ ID NO: 5902351 - DNA, 16 bp, Homo sapiens
gagacagagcccccaa

SEQ ID NO: 5902352 - DNA, 19 bp, Homo sapiens
gagacagagcccccaagcc

SEQ ID NO: 5902353 - DNA, 21 bp, Homo sapiens
gagacagagcccccaagcctc

SEQ ID NO: 5902354 - DNA, 22 bp, Homo sapiens
gagacagagcccccaagcctct

SEQ ID NO: 5902355 - DNA, 14 bp, Homo sapiens
gagacagagctggt

SEQ ID NO: 5902356 - DNA, 19 bp, Homo sapiens
gagacagaggaaagggctg

SEQ ID NO: 5902357 - DNA, 19 bp, Homo sapiens
gagacagagttttcactct

SEQ ID NO: 5902358 - DNA, 16 bp, Homo sapiens
gagacagatacctcca

SEQ ID NO: 5902359 - DNA, 22 bp, Homo sapiens
gagacagatacctccaaccctg

SEQ ID NO: 5902360 - DNA, 23 bp, Homo sapiens
gagacagatacctccaaccctgc

SEQ ID NO: 5902361 - DNA, 14 bp, Homo sapiens
gagacagatgctgg

SEQ ID NO: 5902362 - DNA, 18 bp, Homo sapiens
gagacagatgctggtgga

SEQ ID NO: 5902363 - DNA, 13 bp, Homo sapiens
gagacagcaagtt

SEQ ID NO: 5902364 - DNA, 17 bp, Homo sapiens
gagacagcacaggcagc

SEQ ID NO: 5902365 - DNA, 12 bp, Homo sapiens
gagacagcagca

SEQ ID NO: 5902366 - DNA, 22 bp, Homo sapiens
gagacagcagcacccacccatg

SEQ ID NO: 5902367 - DNA, 12 bp, Homo sapiens
gagacagcagcc

SEQ ID NO: 5902368 - DNA, 19 bp, Homo sapiens
gagacagcagcctgtatgt

SEQ ID NO: 5902369 - DNA, 16 bp, Homo sapiens
gagacagcagtttcca

SEQ ID NO: 5902370 - DNA, 21 bp, Homo sapiens
gagacagcagtttccagagag

SEQ ID NO: 5902371 - DNA, 17 bp, Homo sapiens
gagacagccaggtggca

SEQ ID NO: 5902372 - DNA, 22 bp, Homo sapiens
gagacagccaggtggcacctgc

SEQ ID NO: 5902373 - DNA, 13 bp, Homo sapiens
gagacagccccag

SEQ ID NO: 5902374 - DNA, 14 bp, Homo sapiens
gagacagccccaga

SEQ ID NO: 5902375 - DNA, 19 bp, Homo sapiens
gagacagcccgggctctgc

SEQ ID NO: 5902376 - DNA, 18 bp, Homo sapiens
gagacagccgggaggagc

SEQ ID NO: 5902377 - DNA, 20 bp, Homo sapiens
gagacagctctgcatactca

SEQ ID NO: 5902378 - DNA, 14 bp, Homo sapiens
gagacagcttctct

SEQ ID NO: 5902379 - DNA, 17 bp, Homo sapiens
gagacagcttctctgca

SEQ ID NO: 5902380 - DNA, 21 bp, Homo sapiens
gagacagcttctctgcagtaa

SEQ ID NO: 5902381 - DNA, 19 bp, Homo sapiens
gagacaggaaaatcctctg

SEQ ID NO: 5902382 - DNA, 20 bp, Homo sapiens
gagacaggaaaatcctctgg

SEQ ID NO: 5902383 - DNA, 21 bp, Homo sapiens
gagacaggaaaatcctctggc

SEQ ID NO: 5902384 - DNA, 14 bp, Homo sapiens
gagacaggaacggc

SEQ ID NO: 5902385 - DNA, 20 bp, Homo sapiens
gagacaggagaatcacctga

SEQ ID NO: 5902386 - DNA, 15 bp, Homo sapiens
gagacaggagcagcc

SEQ ID NO: 5902387 - DNA, 15 bp, Homo sapiens
gagacaggagggcaa

SEQ ID NO: 5902388 - DNA, 16 bp, Homo sapiens
gagacaggcagagctg

SEQ ID NO: 5902389 - DNA, 19 bp, Homo sapiens
gagacaggcagcccagcag

SEQ ID NO: 5902390 - DNA, 13 bp, Homo sapiens
gagacaggcagtt

SEQ ID NO: 5902391 - DNA, 14 bp, Homo sapiens
gagacaggctgggt

SEQ ID NO: 5902392 - DNA, 16 bp, Homo sapiens
gagacaggctgggtcc

SEQ ID NO: 5902393 - DNA, 17 bp, Homo sapiens
gagacagggcaatcttg

SEQ ID NO: 5902394 - DNA, 19 bp, Homo sapiens
gagacagggcaatcttgtc

SEQ ID NO: 5902395 - DNA, 22 bp, Homo sapiens
gagacagggcccgggcccaggc

SEQ ID NO: 5902396 - DNA, 18 bp, Homo sapiens
gagacagggtaggaaagg

SEQ ID NO: 5902397 - DNA, 22 bp, Homo sapiens
gagacagggttttgccatgttg

SEQ ID NO: 5902398 - DNA, 18 bp, Homo sapiens
gagacaggtcagtagtca

SEQ ID NO: 5902399 - DNA, 21 bp, Homo sapiens
gagacaggtgcctaacctggg

SEQ ID NO: 5902400 - DNA, 19 bp, Homo sapiens
gagacaggtggcctagcag

SEQ ID NO: 5902401 - DNA, 16 bp, Homo sapiens
gagacagtcaccccag

SEQ ID NO: 5902402 - DNA, 21 bp, Homo sapiens
gagacagtcccagaacacggc

SEQ ID NO: 5902403 - DNA, 20 bp, Homo sapiens
gagacagtgggggtgcctgg

SEQ ID NO: 5902404 - DNA, 23 bp, Homo sapiens
gagacagttgggtgagaacaacc

SEQ ID NO: 5902405 - DNA, 16 bp, Homo sapiens
gagacagtttcttagc

SEQ ID NO: 5902406 - DNA, 15 bp, Homo sapiens
gagacataaatagag

SEQ ID NO: 5902407 - DNA, 18 bp, Homo sapiens
gagacataaatgttcact

SEQ ID NO: 5902408 - DNA, 20 bp, Homo sapiens
gagacatacttgaagggcca

SEQ ID NO: 5902409 - DNA, 21 bp, Homo sapiens
gagacatacttgaagggccag

SEQ ID NO: 5902410 - DNA, 23 bp, Homo sapiens
gagacatcaaaaccaccctaacc

SEQ ID NO: 5902411 - DNA, 16 bp, Homo sapiens
gagacatccctcatct

SEQ ID NO: 5902412 - DNA, 14 bp, Homo sapiens
gagacatgctctcc

SEQ ID NO: 5902413 - DNA, 21 bp, Homo sapiens
gagacatggctttcagaaaac

SEQ ID NO: 5902414 - DNA, 24 bp, Homo sapiens
gagacatgggagtggggagcggag

SEQ ID NO: 5902415 - DNA, 22 bp, Homo sapiens
gagacatgggatccaattttaa

SEQ ID NO: 5902416 - DNA, 13 bp, Homo sapiens
gagacatgtacct

SEQ ID NO: 5902417 - DNA, 22 bp, Homo sapiens
gagacattaactcattagactg

SEQ ID NO: 5902418 - DNA, 22 bp, Homo sapiens
gagacattagaaaaaaatgaaa

SEQ ID NO: 5902419 - DNA, 18 bp, Homo sapiens
gagacattcctgggcaca

SEQ ID NO: 5902420 - DNA, 17 bp, Homo sapiens
gagacattctgtctttc

SEQ ID NO: 5902421 - DNA, 16 bp, Homo sapiens
gagaccaacctgacca

SEQ ID NO: 5902422 - DNA, 13 bp, Homo sapiens
gagaccaactttt

SEQ ID NO: 5902423 - DNA, 18 bp, Homo sapiens
gagaccaactttttcatt

SEQ ID NO: 5902424 - DNA, 17 bp, Homo sapiens
gagaccaagccggtgcc

SEQ ID NO: 5902425 - DNA, 18 bp, Homo sapiens
gagaccaagccggtgccc

SEQ ID NO: 5902426 - DNA, 21 bp, Homo sapiens
gagaccacacaccctttggga

SEQ ID NO: 5902427 - DNA, 21 bp, Homo sapiens
gagagaggccattctttccca

SEQ ID NO: 5902428 - DNA, 15 bp, Homo sapiens
gagagaggctctggg

SEQ ID NO: 5902429 - DNA, 17 bp, Homo sapiens
gagagagggactcaagg

SEQ ID NO: 5902430 - DNA, 18 bp, Homo sapiens
gagagagggcgcccagcc

SEQ ID NO: 5902431 - DNA, 16 bp, Homo sapiens
gagagagggggcactg

SEQ ID NO: 5902432 - DNA, 18 bp, Homo sapiens
gagagagtagctgcagcc

SEQ ID NO: 5902433 - DNA, 22 bp, Homo sapiens
gagagagtcttttaactttaga

SEQ ID NO: 5902434 - DNA, 14 bp, Homo sapiens
gagagagtgctgag

SEQ ID NO: 5902435 - DNA, 14 bp, Homo sapiens
gagagagtgtggaa

SEQ ID NO: 5902436 - DNA, 14 bp, Homo sapiens
gagagagtgtgtgt

SEQ ID NO: 5902437 - DNA, 18 bp, Homo sapiens
gagagatatatctgaaaa

SEQ ID NO: 5902438 - DNA, 15 bp, Homo sapiens
gagagatcatgagaa

SEQ ID NO: 5902439 - DNA, 23 bp, Homo sapiens
gagagatcttcccataataaagc

SEQ ID NO: 5902440 - DNA, 17 bp, Homo sapiens
gagagatgagaagccag

SEQ ID NO: 5902441 - DNA, 18 bp, Homo sapiens
gagagatgggagctcctc

SEQ ID NO: 5902442 - DNA, 19 bp, Homo sapiens
gagagatgtttggaaacca

SEQ ID NO: 5902443 - DNA, 18 bp, Homo sapiens
gagagattgggactgagt

SEQ ID NO: 5902444 - DNA, 17 bp, Homo sapiens
gagagcaaaggcccatg

SEQ ID NO: 5902445 - DNA, 16 bp, Homo sapiens
gagagcaaatgcaaaa

SEQ ID NO: 5902446 - DNA, 15 bp, Homo sapiens
gagagcaagaaggaa

SEQ ID NO: 5902447 - DNA, 13 bp, Homo sapiens
gagagcaaggaag

SEQ ID NO: 5902448 - DNA, 14 bp, Homo sapiens
gagagcaaggaagc

SEQ ID NO: 5902449 - DNA, 22 bp, Homo sapiens
gagagcaagggaagtggttctt

SEQ ID NO: 5902450 - DNA, 13 bp, Homo sapiens
gagagcacagcgt

SEQ ID NO: 5902451 - DNA, 16 bp, Homo sapiens
gagagcacccacagcc

SEQ ID NO: 5902452 - DNA, 14 bp, Homo sapiens
gagagcacctggtg

SEQ ID NO: 5902453 - DNA, 16 bp, Homo sapiens
gagagcacctggtggg

SEQ ID NO: 5902454 - DNA, 16 bp, Homo sapiens
gagagcactgcctcta

SEQ ID NO: 5902455 - DNA, 13 bp, Homo sapiens
gagagcacttgaa

SEQ ID NO: 5902456 - DNA, 16 bp, Homo sapiens
gagagcagaggtctcc

SEQ ID NO: 5902457 - DNA, 12 bp, Homo sapiens
gagagcagcagc

SEQ ID NO: 5902458 - DNA, 17 bp, Homo sapiens
gagagcagcagcaccaa

SEQ ID NO: 5902459 - DNA, 17 bp, Homo sapiens
gagagcagcaggtgctg

SEQ ID NO: 5902460 - DNA, 23 bp, Homo sapiens
gagagcagcattcccagggacct

SEQ ID NO: 5902461 - DNA, 14 bp, Homo sapiens
gagagcagccagga

SEQ ID NO: 5902462 - DNA, 16 bp, Homo sapiens
gagagcagcctggcca

SEQ ID NO: 5902463 - DNA, 21 bp, Homo sapiens
gagagcagcgcccaggcctgc

SEQ ID NO: 5902464 - DNA, 22 bp, Homo sapiens
gagagcagcgcccaggcctgct

SEQ ID NO: 5902465 - DNA, 10 bp, Homo sapiens
gagagcagct

SEQ ID NO: 5902466 - DNA, 15 bp, Homo sapiens
gagagcagctccctt

SEQ ID NO: 5902467 - DNA, 20 bp, Homo sapiens
gagagcagctccctttctca

SEQ ID NO: 5902468 - DNA, 16 bp, Homo sapiens
gagagcagcttctgcc

SEQ ID NO: 5902469 - DNA, 14 bp, Homo sapiens
gagagcaggcaggg

SEQ ID NO: 5902470 - DNA, 21 bp, Homo sapiens
gagagcaggcaggggcatctg

SEQ ID NO: 5902471 - DNA, 13 bp, Homo sapiens
gagagcagggctg

SEQ ID NO: 5902472 - DNA, 20 bp, Homo sapiens
gagagcaggggagcttggga

SEQ ID NO: 5902473 - DNA, 16 bp, Homo sapiens
gagagcagtgggcagg

SEQ ID NO: 5902474 - DNA, 14 bp, Homo sapiens
gagagcatcaggcc

SEQ ID NO: 5902475 - DNA, 13 bp, Homo sapiens
gagagcatctcag

SEQ ID NO: 5902476 - DNA, 15 bp, Homo sapiens
gagagcatctcagga

SEQ ID NO: 5902477 - DNA, 19 bp, Homo sapiens
gagagcatctgcaacaaaa

SEQ ID NO: 5902478 - DNA, 15 bp, Homo sapiens
gagagcatctgctct

SEQ ID NO: 5902479 - DNA, 19 bp, Homo sapiens
gagagcatgtgggggaagg

SEQ ID NO: 5902480 - DNA, 14 bp, Homo sapiens
gagagccaaacaga

SEQ ID NO: 5902481 - DNA, 21 bp, Homo sapiens
gagagccaaacagagcccagg

SEQ ID NO: 5902482 - DNA, 21 bp, Homo sapiens
gagagccaagacggaggaggg

SEQ ID NO: 5902483 - DNA, 23 bp, Homo sapiens
gagagccaagctaatgtggtagt

SEQ ID NO: 5902484 - DNA, 22 bp, Homo sapiens
gagagccaaggcctatgccacc

SEQ ID NO: 5902485 - DNA, 17 bp, Homo sapiens
gagagccacgctggcct

SEQ ID NO: 5902486 - DNA, 18 bp, Homo sapiens
gagagccacgctggcctt

SEQ ID NO: 5902487 - DNA, 16 bp, Homo sapiens
gagagccagaacctgg

SEQ ID NO: 5902488 - DNA, 19 bp, Homo sapiens
gagagccagagaagtgaca

SEQ ID NO: 5902489 - DNA, 21 bp, Homo sapiens
gagagccagatgcctccccaa

SEQ ID NO: 5902490 - DNA, 12 bp, Homo sapiens
gagagccagctc

SEQ ID NO: 5902491 - DNA, 13 bp, Homo sapiens
gagagccagctct

SEQ ID NO: 5902492 - DNA, 14 bp, Homo sapiens
gagagccattttgt

SEQ ID NO: 5902493 - DNA, 18 bp, Homo sapiens
gagagcccaatcactgcc

SEQ ID NO: 5902494 - DNA, 21 bp, Homo sapiens
gagagcccagaggtaacagaa

SEQ ID NO: 5902495 - DNA, 23 bp, Homo sapiens
gagagcccagaggtaacagaaca

SEQ ID NO: 5902496 - DNA, 20 bp, Homo sapiens
gagagcccagagtcccccca

SEQ ID NO: 5902497 - DNA, 13 bp, Homo sapiens
gagagcccagcca

SEQ ID NO: 5902498 - DNA, 16 bp, Homo sapiens
gagagcccaggcctgc

SEQ ID NO: 5902499 - DNA, 17 bp, Homo sapiens
gagagccccaggactgg

SEQ ID NO: 5902500 - DNA, 20 bp, Homo sapiens
gagagcccccaccagcagca

SEQ ID NO: 5902501 - DNA, 23 bp, Homo sapiens
gagagcccccaccagcagcacaa

SEQ ID NO: 5902502 - DNA, 18 bp, Homo sapiens
gagagcccctcacacagc

SEQ ID NO: 5902503 - DNA, 17 bp, Homo sapiens
gagagcccctggggcct

SEQ ID NO: 5902504 - DNA, 20 bp, Homo sapiens
gagagcccctggggcctaga

SEQ ID NO: 5902505 - DNA, 14 bp, Homo sapiens
gagagccctgggac

SEQ ID NO: 5902506 - DNA, 15 bp, Homo sapiens
gagagccctgggacc

SEQ ID NO: 5902507 - DNA, 11 bp, Homo sapiens
gagagccctgt

SEQ ID NO: 5902508 - DNA, 19 bp, Homo sapiens
gagagccggccgtggaagg

SEQ ID NO: 5902509 - DNA, 17 bp, Homo sapiens
gagagccgtggtccctg

SEQ ID NO: 5902510 - DNA, 20 bp, Homo sapiens
gagagccgtggtccctgagg

SEQ ID NO: 5902511 - DNA, 21 bp, Homo sapiens
gagagcctagaacatccctgg

SEQ ID NO: 5902512 - DNA, 16 bp, Homo sapiens
gagagcctcgcttttt

SEQ ID NO: 5902513 - DNA, 20 bp, Homo sapiens
gagagcctctgttttgtaaa

SEQ ID NO: 5902514 - DNA, 14 bp, Homo sapiens
gagagcctcttagt

SEQ ID NO: 5902515 - DNA, 12 bp, Homo sapiens
gagagcctgctg

SEQ ID NO: 5902516 - DNA, 14 bp, Homo sapiens
gagagcctgctgca

SEQ ID NO: 5902517 - DNA, 13 bp, Homo sapiens
gagagcctgctgg

SEQ ID NO: 5902518 - DNA, 15 bp, Homo sapiens
gagagcctgctggca

SEQ ID NO: 5902519 - DNA, 13 bp, Homo sapiens
gagagcctggtgc

SEQ ID NO: 5902520 - DNA, 13 bp, Homo sapiens
gagagccttccag

SEQ ID NO: 5902521 - DNA, 20 bp, Homo sapiens
gagagccttccaggggtggg

SEQ ID NO: 5902522 - DNA, 14 bp, Homo sapiens
gagagccttggcct

SEQ ID NO: 5902523 - DNA, 20 bp, Homo sapiens
gagagccttgggagccactg

SEQ ID NO: 5902524 - DNA, 23 bp, Homo sapiens
gagagccttgggagccactgcca

SEQ ID NO: 5902525 - DNA, 21 bp, Homo sapiens
gagagcctttctccagcccat

SEQ ID NO: 5902526 - DNA, 14 bp, Homo sapiens
gagagcgacacaga

SEQ ID NO: 5902527 - DNA, 16 bp, Homo sapiens
gagagcgacacagacg

SEQ ID NO: 5902528 - DNA, 15 bp, Homo sapiens
gagagcgaggaggcg

SEQ ID NO: 5902529 - DNA, 15 bp, Homo sapiens
gagagcgccacccgc

SEQ ID NO: 5902530 - DNA, 16 bp, Homo sapiens
gagagcgccacccgcc

SEQ ID NO: 5902531 - DNA, 22 bp, Homo sapiens
gagagcgccacccgcccgcccc

SEQ ID NO: 5902532 - DNA, 18 bp, Homo sapiens
gagagcgcctcttcctct

SEQ ID NO: 5902533 - DNA, 22 bp, Homo sapiens
gagagcgcctgcccctcccaga

SEQ ID NO: 5902534 - DNA, 21 bp, Homo sapiens
gagagcggcttccccattgcc

SEQ ID NO: 5902535 - DNA, 14 bp, Homo sapiens
gagagctagaaagt

SEQ ID NO: 5902536 - DNA, 19 bp, Homo sapiens
gagagctagaacctggaga

SEQ ID NO: 5902537 - DNA, 19 bp, Homo sapiens
gagagctaggagcaaagcc

SEQ ID NO: 5902538 - DNA, 22 bp, Homo sapiens
gagagctaggagcaaagcctgt

SEQ ID NO: 5902539 - DNA, 23 bp, Homo sapiens
gagagctatggacagcattgcca

SEQ ID NO: 5902540 - DNA, 16 bp, Homo sapiens
gagagctcagcctgcc

SEQ ID NO: 5902541 - DNA, 15 bp, Homo sapiens
gagagctcaggcagc

SEQ ID NO: 5902542 - DNA, 21 bp, Homo sapiens
gagagctcagtacagggcagg

SEQ ID NO: 5902543 - DNA, 21 bp, Homo sapiens
gagagctctaaccagatggaa

SEQ ID NO: 5902544 - DNA, 14 bp, Homo sapiens
gagagctctggccc

SEQ ID NO: 5902545 - DNA, 16 bp, Homo sapiens
gagagctcttagtttt

SEQ ID NO: 5902546 - DNA, 20 bp, Homo sapiens
gagagctcttagtttttaaa

SEQ ID NO: 5902547 - DNA, 23 bp, Homo sapiens
gagagctcttagtttttaaaaag

SEQ ID NO: 5902548 - DNA, 11 bp, Homo sapiens
gagagctgcct

SEQ ID NO: 5902549 - DNA, 14 bp, Homo sapiens
gagagctgctcctt

SEQ ID NO: 5902550 - DNA, 13 bp, Homo sapiens
gagagctgctgag

SEQ ID NO: 5902551 - DNA, 16 bp, Homo sapiens
gagagctggagcctgg

SEQ ID NO: 5902552 - DNA, 20 bp, Homo sapiens
gagagctggagtctgggctc

SEQ ID NO: 5902553 - DNA, 15 bp, Homo sapiens
gagagctgggcagac

SEQ ID NO: 5902554 - DNA, 20 bp, Homo sapiens
gagagctgggctttcctctg

SEQ ID NO: 5902555 - DNA, 13 bp, Homo sapiens
gagagctgggtgt

SEQ ID NO: 5902556 - DNA, 14 bp, Homo sapiens
gagagctggtgccc

SEQ ID NO: 5902557 - DNA, 16 bp, Homo sapiens
gagagcttaatgataa

SEQ ID NO: 5902558 - DNA, 20 bp, Homo sapiens
gagagctttctgccttagcc

SEQ ID NO: 5902559 - DNA, 21 bp, Homo sapiens
gagaggaaaactattccatgt

SEQ ID NO: 5902560 - DNA, 23 bp, Homo sapiens
gagaggaaaggacatgggtagca

SEQ ID NO: 5902561 - DNA, 18 bp, Homo sapiens
gagaggaaattctccact

SEQ ID NO: 5902562 - DNA, 22 bp, Homo sapiens
gagaggaactccttggcctagc

SEQ ID NO: 5902563 - DNA, 12 bp, Homo sapiens
gagaggaagatg

SEQ ID NO: 5902564 - DNA, 14 bp, Homo sapiens
gagaggaagatgaa

SEQ ID NO: 5902565 - DNA, 13 bp, Homo sapiens
gagaggaagccac

SEQ ID NO: 5902566 - DNA, 11 bp, Homo sapiens
gagaggaagga

SEQ ID NO: 5902567 - DNA, 19 bp, Homo sapiens
gagaggaaggacccctcac

SEQ ID NO: 5902568 - DNA, 14 bp, Homo sapiens
gagaggaaggagat

SEQ ID NO: 5902569 - DNA, 12 bp, Homo sapiens
gagaggaagggt

SEQ ID NO: 5902570 - DNA, 16 bp, Homo sapiens
gagaggacaaaataaa

SEQ ID NO: 5902571 - DNA, 17 bp, Homo sapiens
gagaggacaaaataaag

SEQ ID NO: 5902572 - DNA, 19 bp, Homo sapiens
gagaggacaaaataaagtg

SEQ ID NO: 5902573 - DNA, 15 bp, Homo sapiens
gagaggacagcttga

SEQ ID NO: 5902574 - DNA, 18 bp, Homo sapiens
gagaggaccaacatccag

SEQ ID NO: 5902575 - DNA, 17 bp, Homo sapiens
gagaggacctccatgcc

SEQ ID NO: 5902576 - DNA, 23 bp, Homo sapiens
gagaggacggccctgcctgcctc

SEQ ID NO: 5902577 - DNA, 20 bp, Homo sapiens
gagaggactgatgaatgaca

SEQ ID NO: 5902578 - DNA, 21 bp, Homo sapiens
gagaggactggttctgaggcc

SEQ ID NO: 5902579 - DNA, 14 bp, Homo sapiens
gagaggagaaaaaa

SEQ ID NO: 5902580 - DNA, 15 bp, Homo sapiens
gagaggagaaacaca

SEQ ID NO: 5902581 - DNA, 18 bp, Homo sapiens
gagaggagaacagtagga

SEQ ID NO: 5902582 - DNA, 23 bp, Homo sapiens
gagaggagaacagtaggattgct

SEQ ID NO: 5902583 - DNA, 13 bp, Homo sapiens
gagaggagacaga

SEQ ID NO: 5902584 - DNA, 15 bp, Homo sapiens
gagaggagacagaca

SEQ ID NO: 5902585 - DNA, 15 bp, Homo sapiens
gagaggagagaatga

SEQ ID NO: 5902586 - DNA, 12 bp, Homo sapiens
gagaggagagag

SEQ ID NO: 5902587 - DNA, 19 bp, Homo sapiens
gagaggagagaggcagaga

SEQ ID NO: 5902588 - DNA, 16 bp, Homo sapiens
gagaggagagccagag

SEQ ID NO: 5902589 - DNA, 18 bp, Homo sapiens
gagaggagaggagagagg

SEQ ID NO: 5902590 - DNA, 17 bp, Homo sapiens
gagaggagatcagggcg

SEQ ID NO: 5902591 - DNA, 12 bp, Homo sapiens
gagaggagcacc

SEQ ID NO: 5902592 - DNA, 19 bp, Homo sapiens
gagaggagccagacagacc

SEQ ID NO: 5902593 - DNA, 19 bp, Homo sapiens
gagaggagcgggacctgtg

SEQ ID NO: 5902594 - DNA, 12 bp, Homo sapiens
gagaggagggac

SEQ ID NO: 5902595 - DNA, 18 bp, Homo sapiens
gagaggagggatgcaact

SEQ ID NO: 5902596 - DNA, 18 bp, Homo sapiens
gagaggaggggtaaatat

SEQ ID NO: 5902597 - DNA, 22 bp, Homo sapiens
gagaggaggggtaaatatatgt

SEQ ID NO: 5902598 - DNA, 22 bp, Homo sapiens
gagaggaggtgtggagtggagg

SEQ ID NO: 5902599 - DNA, 18 bp, Homo sapiens
gagaggaggtttgcctgt

SEQ ID NO: 5902600 - DNA, 13 bp, Homo sapiens
gagaggagttcaa

SEQ ID NO: 5902601 - DNA, 16 bp, Homo sapiens
gagaggagttcaatga

SEQ ID NO: 5902602 - DNA, 20 bp, Homo sapiens
gagaggatacatttaataaa

SEQ ID NO: 5902603 - DNA, 16 bp, Homo sapiens
gagaggatgagagccc

SEQ ID NO: 5902604 - DNA, 15 bp, Homo sapiens
gagaggatgcagagg

SEQ ID NO: 5902605 - DNA, 16 bp, Homo sapiens
gagaggatgcagaggg

SEQ ID NO: 5902606 - DNA, 17 bp, Homo sapiens
gagatggagggcttggc

SEQ ID NO: 5902607 - DNA, 21 bp, Homo sapiens
gagatggagtctcgctctgct

SEQ ID NO: 5902608 - DNA, 16 bp, Homo sapiens
gagatggagtttctct

SEQ ID NO: 5902609 - DNA, 18 bp, Homo sapiens
gagatggagtttctctct

SEQ ID NO: 5902610 - DNA, 15 bp, Homo sapiens
gagatggatcacata

SEQ ID NO: 5902611 - DNA, 14 bp, Homo sapiens
gagatggatggaca

SEQ ID NO: 5902612 - DNA, 15 bp, Homo sapiens
gagatggatgtattt

SEQ ID NO: 5902613 - DNA, 14 bp, Homo sapiens
gagatggcagagcc

SEQ ID NO: 5902614 - DNA, 20 bp, Homo sapiens
gagatggcagagccatccac

SEQ ID NO: 5902615 - DNA, 19 bp, Homo sapiens
gagatggcagattcccact

SEQ ID NO: 5902616 - DNA, 18 bp, Homo sapiens
gagatggcagcagtgaag

SEQ ID NO: 5902617 - DNA, 15 bp, Homo sapiens
gagatggccatgctc

SEQ ID NO: 5902618 - DNA, 16 bp, Homo sapiens
gagatggccatgctca

SEQ ID NO: 5902619 - DNA, 22 bp, Homo sapiens
gagatggcgctattgcactcca

SEQ ID NO: 5902620 - DNA, 14 bp, Homo sapiens
gagatggctccttg

SEQ ID NO: 5902621 - DNA, 17 bp, Homo sapiens
gagatggctgctgctca

SEQ ID NO: 5902622 - DNA, 16 bp, Homo sapiens
gagatgggaaggcaca

SEQ ID NO: 5902623 - DNA, 21 bp, Homo sapiens
gagatgggaatgaggtgggag

SEQ ID NO: 5902624 - DNA, 22 bp, Homo sapiens
gagatgggagctcctctcctgg

SEQ ID NO: 5902625 - DNA, 23 bp, Homo sapiens
gagatgggagctcctctcctgga

SEQ ID NO: 5902626 - DNA, 12 bp, Homo sapiens
gagatgggatgc

SEQ ID NO: 5902627 - DNA, 14 bp, Homo sapiens
gagatgggcttccc

SEQ ID NO: 5902628 - DNA, 21 bp, Homo sapiens
gagatggggaataatttcctt

SEQ ID NO: 5902629 - DNA, 18 bp, Homo sapiens
gagatggggagaaaccta

SEQ ID NO: 5902630 - DNA, 18 bp, Homo sapiens
gagatgggggcttcttcc

SEQ ID NO: 5902631 - DNA, 21 bp, Homo sapiens
gagatggggtttcaccatgtt

SEQ ID NO: 5902632 - DNA, 21 bp, Homo sapiens
gagatggtatgcacaattcca

SEQ ID NO: 5902633 - DNA, 15 bp, Homo sapiens
gagatggtctgcatc

SEQ ID NO: 5902634 - DNA, 17 bp, Homo sapiens
gagatggtgccccctgg

SEQ ID NO: 5902635 - DNA, 15 bp, Homo sapiens
gagatgtaagagctt

SEQ ID NO: 5902636 - DNA, 18 bp, Homo sapiens
gagatgtaccatgttaaa

SEQ ID NO: 5902637 - DNA, 15 bp, Homo sapiens
gagatgtagaaagtt

SEQ ID NO: 5902638 - DNA, 15 bp, Homo sapiens
gagatgtagcaaaac

SEQ ID NO: 5902639 - DNA, 15 bp, Homo sapiens
gagatgtagcaaatt

SEQ ID NO: 5902640 - DNA, 20 bp, Homo sapiens
gagatgtatgtttggctctg

SEQ ID NO: 5902641 - DNA, 18 bp, Homo sapiens
gagatgtcagtctgtcca

SEQ ID NO: 5902642 - DNA, 16 bp, Homo sapiens
gagatgtcttggaaca

SEQ ID NO: 5902643 - DNA, 20 bp, Homo sapiens
gagatgtgacccaccagtgc

SEQ ID NO: 5902644 - DNA, 14 bp, Homo sapiens
gagatgtgcaccca

SEQ ID NO: 5902645 - DNA, 15 bp, Homo sapiens
gagatgtgcctgtgg

SEQ ID NO: 5902646 - DNA, 17 bp, Homo sapiens
gagatgtgcctgtggga

SEQ ID NO: 5902647 - DNA, 21 bp, Homo sapiens
gagatgtgcctgtgggagggg

SEQ ID NO: 5902648 - DNA, 15 bp, Homo sapiens
gagatgtggagactg

SEQ ID NO: 5902649 - DNA, 16 bp, Homo sapiens
gagatgtgtggactgt

SEQ ID NO: 5902650 - DNA, 18 bp, Homo sapiens
gagatgtgtgttgatact

SEQ ID NO: 5902651 - DNA, 22 bp, Homo sapiens
gagatgtgtgttgatactgttg

SEQ ID NO: 5902652 - DNA, 17 bp, Homo sapiens
gagatgtgttcctcctg

SEQ ID NO: 5902653 - DNA, 14 bp, Homo sapiens
gagatgttaagcaa

SEQ ID NO: 5902654 - DNA, 21 bp, Homo sapiens
gagatgtttttaaaagtttca

SEQ ID NO: 5902655 - DNA, 16 bp, Homo sapiens
gagattaaaaaaggta

SEQ ID NO: 5902656 - DNA, 16 bp, Homo sapiens
gagattaaaaatctaa

SEQ ID NO: 5902657 - DNA, 18 bp, Homo sapiens
gagattaagaatattgcc

SEQ ID NO: 5902658 - DNA, 23 bp, Homo sapiens
gagattaattttaacttaaattt

SEQ ID NO: 5902659 - DNA, 14 bp, Homo sapiens
gagattacaggtgt

SEQ ID NO: 5902660 - DNA, 17 bp, Homo sapiens
gagattagcatgaaagg

SEQ ID NO: 5902661 - DNA, 23 bp, Homo sapiens
gagattagtaaatatgtgaagaa

SEQ ID NO: 5902662 - DNA, 21 bp, Homo sapiens
gagattatcagtagaaagagt

SEQ ID NO: 5902663 - DNA, 15 bp, Homo sapiens
gagattatgttcttt

SEQ ID NO: 5902664 - DNA, 23 bp, Homo sapiens
gagattcaaaaaaaaaatataag

SEQ ID NO: 5902665 - DNA, 14 bp, Homo sapiens
gagattcagactgt

SEQ ID NO: 5902666 - DNA, 13 bp, Homo sapiens
gagattccacaca

SEQ ID NO: 5902667 - DNA, 13 bp, Homo sapiens
gagattctgcctc

SEQ ID NO: 5902668 - DNA, 15 bp, Homo sapiens
gagattctgcctttg

SEQ ID NO: 5902669 - DNA, 21 bp, Homo sapiens
gagattctggatctcctgctg

SEQ ID NO: 5902670 - DNA, 19 bp, Homo sapiens
gagattctgggtttgccca

SEQ ID NO: 5902671 - DNA, 20 bp, Homo sapiens
gagattctggtccctggaaa

SEQ ID NO: 5902672 - DNA, 15 bp, Homo sapiens
gagattctgtgatct

SEQ ID NO: 5902673 - DNA, 22 bp, Homo sapiens
gagattcttcgtgtatagctgt

SEQ ID NO: 5902674 - DNA, 23 bp, Homo sapiens
gagattcttctaggggtagctgg

SEQ ID NO: 5902675 - DNA, 16 bp, Homo sapiens
gagattgaactccaag

SEQ ID NO: 5902676 - DNA, 13 bp, Homo sapiens
gagattgaacttt

SEQ ID NO: 5902677 - DNA, 14 bp, Homo sapiens
gagattgacctgga

SEQ ID NO: 5902678 - DNA, 13 bp, Homo sapiens
gagattgagaagg

SEQ ID NO: 5902679 - DNA, 21 bp, Homo sapiens
gagattgcgccactgcactcc

SEQ ID NO: 5902680 - DNA, 17 bp, Homo sapiens
gagattggaaaaaatta

SEQ ID NO: 5902681 - DNA, 14 bp, Homo sapiens
gagattggaaggaa

SEQ ID NO: 5902682 - DNA, 17 bp, Homo sapiens
gagattggacggcctga

SEQ ID NO: 5902683 - DNA, 21 bp, Homo sapiens
gagattggatcaagtattact

SEQ ID NO: 5902684 - DNA, 13 bp, Homo sapiens
gagattgggagaa

SEQ ID NO: 5902685 - DNA, 16 bp, Homo sapiens
gagattgggagaaatc

SEQ ID NO: 5902686 - DNA, 18 bp, Homo sapiens
gagattgggagacaatta

SEQ ID NO: 5902687 - DNA, 17 bp, Homo sapiens
gagattggtcattaaat

SEQ ID NO: 5902688 - DNA, 21 bp, Homo sapiens
gagattgtactgttcatacag

SEQ ID NO: 5902689 - DNA, 23 bp, Homo sapiens
gagattgttgtttgccatacttt

SEQ ID NO: 5902690 - DNA, 22 bp, Homo sapiens
gagatttaaatgcaaccagaat

SEQ ID NO: 5902691 - DNA, 13 bp, Homo sapiens
gagatttacaact

SEQ ID NO: 5902692 - DNA, 19 bp, Homo sapiens
gagatttacgtggaaccct

SEQ ID NO: 5902693 - DNA, 22 bp, Homo sapiens
gagatttagggttctatattta

SEQ ID NO: 5902694 - DNA, 15 bp, Homo sapiens
gagatttcaagagat

SEQ ID NO: 5902695 - DNA, 19 bp, Homo sapiens
gagatttcatctgctctcc

SEQ ID NO: 5902696 - DNA, 15 bp, Homo sapiens
gagatttcttaaatc

SEQ ID NO: 5902697 - DNA, 14 bp, Homo sapiens
gagatttcttattt

SEQ ID NO: 5902698 - DNA, 20 bp, Homo sapiens
gagatttcttttttatgtga

SEQ ID NO: 5902699 - DNA, 14 bp, Homo sapiens
gagatttgccagca

SEQ ID NO: 5902700 - DNA, 15 bp, Homo sapiens
gagatttggaataca

SEQ ID NO: 5902701 - DNA, 16 bp, Homo sapiens
gagatttgggagctga

SEQ ID NO: 5902702 - DNA, 16 bp, Homo sapiens
gagatttgtaaatctt

SEQ ID NO: 5902703 - DNA, 13 bp, Homo sapiens
gagatttgtattt

SEQ ID NO: 5902704 - DNA, 15 bp, Homo sapiens
gagatttgtatttat

SEQ ID NO: 5902705 - DNA, 16 bp, Homo sapiens
gagatttgtatttata

SEQ ID NO: 5902706 - DNA, 21 bp, Homo sapiens
gagatttgtatttatattaga

SEQ ID NO: 5902707 - DNA, 16 bp, Homo sapiens
gagattttattttgac

SEQ ID NO: 5902708 - DNA, 13 bp, Homo sapiens
gagattttcacat

SEQ ID NO: 5902709 - DNA, 16 bp, Homo sapiens
gagatttttaagaact

SEQ ID NO: 5902710 - DNA, 18 bp, Homo sapiens
gagatttttaagaacttc

SEQ ID NO: 5902711 - DNA, 14 bp, Homo sapiens
gagatttttcatgt

SEQ ID NO: 5902712 - DNA, 20 bp, Homo sapiens
gagattttttttccgtgtgt

SEQ ID NO: 5902713 - DNA, 16 bp, Homo sapiens
gagatttttttttctc

SEQ ID NO: 5902714 - DNA, 20 bp, Homo sapiens
gagattttttttttaatctc

SEQ ID NO: 5902715 - DNA, 18 bp, Homo sapiens
gagcaaaaatgtaaaaaa

SEQ ID NO: 5902716 - DNA, 22 bp, Homo sapiens
gagcaaaaatgtaaaaaacaaa

SEQ ID NO: 5902717 - DNA, 16 bp, Homo sapiens
gagcaaaacaaagctg

SEQ ID NO: 5902718 - DNA, 13 bp, Homo sapiens
gagcaaaactccg

SEQ ID NO: 5902719 - DNA, 15 bp, Homo sapiens
gagcaaaagaaacac

SEQ ID NO: 5902720 - DNA, 18 bp, Homo sapiens
gagcaaaatgcatgtaat

SEQ ID NO: 5902721 - DNA, 14 bp, Homo sapiens
gagcaaacaccagt

SEQ ID NO: 5902722 - DNA, 17 bp, Homo sapiens
gagcaaacaccagtgag

SEQ ID NO: 5902723 - DNA, 14 bp, Homo sapiens
gagcaaacagaaaa

SEQ ID NO: 5902724 - DNA, 16 bp, Homo sapiens
gagcaaacataggaat

SEQ ID NO: 5902725 - DNA, 13 bp, Homo sapiens
gagcaaacccaga

SEQ ID NO: 5902726 - DNA, 18 bp, Homo sapiens
gagcaaacccagaggtgg

SEQ ID NO: 5902727 - DNA, 15 bp, Homo sapiens
gagcaaactctgctg

SEQ ID NO: 5902728 - DNA, 16 bp, Homo sapiens
gagcaaaggccctggg

SEQ ID NO: 5902729 - DNA, 22 bp, Homo sapiens
gagcaaaggggtcccatagagg

SEQ ID NO: 5902730 - DNA, 14 bp, Homo sapiens
gagcaaagtctaaa

SEQ ID NO: 5902731 - DNA, 14 bp, Homo sapiens
gagcaaagtgaggg

SEQ ID NO: 5902732 - DNA, 16 bp, Homo sapiens
gagcaaatgagggagg

SEQ ID NO: 5902733 - DNA, 14 bp, Homo sapiens
gagcaaatgctgga

SEQ ID NO: 5902734 - DNA, 15 bp, Homo sapiens
gagcaaatgtttctg

SEQ ID NO: 5902735 - DNA, 16 bp, Homo sapiens
gagcaaatgtttctgc

SEQ ID NO: 5902736 - DNA, 18 bp, Homo sapiens
gagcaacaagaatctaaa

SEQ ID NO: 5902737 - DNA, 20 bp, Homo sapiens
gagcaacatatcagtcgtgt

SEQ ID NO: 5902738 - DNA, 13 bp, Homo sapiens
gagcaacccctgt

SEQ ID NO: 5902739 - DNA, 14 bp, Homo sapiens
gagcaacccctgta

SEQ ID NO: 5902740 - DNA, 20 bp, Homo sapiens
gagcaacccctgtacccagc

SEQ ID NO: 5902741 - DNA, 22 bp, Homo sapiens
gagcaacccctgtacccagctc

SEQ ID NO: 5902742 - DNA, 18 bp, Homo sapiens
gagcaaccgtgcagccac

SEQ ID NO: 5902743 - DNA, 15 bp, Homo sapiens
gagcaacctactgtc

SEQ ID NO: 5902744 - DNA, 18 bp, Homo sapiens
gagcaacctactgtctaa

SEQ ID NO: 5902745 - DNA, 15 bp, Homo sapiens
gagcaacctctcact

SEQ ID NO: 5902746 - DNA, 16 bp, Homo sapiens
gagcaacctctcactc

SEQ ID NO: 5902747 - DNA, 14 bp, Homo sapiens
gagcaacctcttca

SEQ ID NO: 5902748 - DNA, 18 bp, Homo sapiens
gagcaactccctctcagc

SEQ ID NO: 5902749 - DNA, 15 bp, Homo sapiens
gagcaactcctgttc

SEQ ID NO: 5902750 - DNA, 16 bp, Homo sapiens
gagcaactctccactc

SEQ ID NO: 5902751 - DNA, 19 bp, Homo sapiens
gagcaactgcgacaaaaca

SEQ ID NO: 5902752 - DNA, 17 bp, Homo sapiens
gagcaactgtgcagcac

SEQ ID NO: 5902753 - DNA, 20 bp, Homo sapiens
gagcaagaccccatctcaaa

SEQ ID NO: 5902754 - DNA, 18 bp, Homo sapiens
gagcaagaccctgtctct

SEQ ID NO: 5902755 - DNA, 17 bp, Homo sapiens
gagcaagacgccctctc

SEQ ID NO: 5902756 - DNA, 13 bp, Homo sapiens
gagcaagactcca

SEQ ID NO: 5902757 - DNA, 15 bp, Homo sapiens
gagcaagagaacatt

SEQ ID NO: 5902758 - DNA, 18 bp, Homo sapiens
gagcaagagagggcaagt

SEQ ID NO: 5902759 - DNA, 14 bp, Homo sapiens
gagcaagagccagg

SEQ ID NO: 5902760 - DNA, 12 bp, Homo sapiens
gagcaagagctg

SEQ ID NO: 5902761 - DNA, 11 bp, Homo sapiens
gagcaagagga

SEQ ID NO: 5902762 - DNA, 23 bp, Homo sapiens
gagcaagcaccaacctccagact

SEQ ID NO: 5902763 - DNA, 13 bp, Homo sapiens
gagcaagccctac

SEQ ID NO: 5902764 - DNA, 13 bp, Homo sapiens
gagcaagccggca

SEQ ID NO: 5902765 - DNA, 19 bp, Homo sapiens
gagcaagcctttgacctgt

SEQ ID NO: 5902766 - DNA, 21 bp, Homo sapiens
gagcaagctctgccctggctg

SEQ ID NO: 5902767 - DNA, 14 bp, Homo sapiens
gagcaagctcttcc

SEQ ID NO: 5902768 - DNA, 16 bp, Homo sapiens
gagcaaggaagcttca

SEQ ID NO: 5902769 - DNA, 17 bp, Homo sapiens
gagcaaggccttctctc

SEQ ID NO: 5902770 - DNA, 19 bp, Homo sapiens
gagcaaggctgctaagtgg

SEQ ID NO: 5902771 - DNA, 22 bp, Homo sapiens
gagcaaggctgctaagtggaag

SEQ ID NO: 5902772 - DNA, 20 bp, Homo sapiens
gagcaaggtttcgtggcagc

SEQ ID NO: 5902773 - DNA, 22 bp, Homo sapiens
gagcaaggtttcgtggcagcac

SEQ ID NO: 5902774 - DNA, 20 bp, Homo sapiens
gagcaagtatgctgtggagt

SEQ ID NO: 5902775 - DNA, 17 bp, Homo sapiens
gagcaagtcccatctca

SEQ ID NO: 5902776 - DNA, 16 bp, Homo sapiens
gagcaagtctgcaggt

SEQ ID NO: 5902777 - DNA, 18 bp, Homo sapiens
gagcaagttccttctggt

SEQ ID NO: 5902778 - DNA, 13 bp, Homo sapiens
gagcaagttgcag

SEQ ID NO: 5902779 - DNA, 16 bp, Homo sapiens
gagcaagttgcagtct

SEQ ID NO: 5902780 - DNA, 18 bp, Homo sapiens
gagcaagtttcatcagcc

SEQ ID NO: 5902781 - DNA, 15 bp, Homo sapiens
gagcaataacttcta

SEQ ID NO: 5902782 - DNA, 14 bp, Homo sapiens
gagcaatcacagga

SEQ ID NO: 5902783 - DNA, 23 bp, Homo sapiens
gagcaatcagaacttcaggtgtg

SEQ ID NO: 5902784 - DNA, 13 bp, Homo sapiens
gagcaatctggaa

SEQ ID NO: 5902785 - DNA, 23 bp, Homo sapiens
gagcagccctggcccccatcagc

SEQ ID NO: 5902786 - DNA, 21 bp, Homo sapiens
gagcagccgccagctgggagc

SEQ ID NO: 5902787 - DNA, 15 bp, Homo sapiens
gagcagcctccaaga

SEQ ID NO: 5902788 - DNA, 22 bp, Homo sapiens
gagcagcctccagtgctggctg

SEQ ID NO: 5902789 - DNA, 15 bp, Homo sapiens
gagcagcctcgaggc

SEQ ID NO: 5902790 - DNA, 18 bp, Homo sapiens
gagcagcctcgaggctgg

SEQ ID NO: 5902791 - DNA, 21 bp, Homo sapiens
gagcagcctcgaggctggtgg

SEQ ID NO: 5902792 - DNA, 18 bp, Homo sapiens
gagcagcctcgtggagct

SEQ ID NO: 5902793 - DNA, 16 bp, Homo sapiens
gagcagcctctgtcct

SEQ ID NO: 5902794 - DNA, 13 bp, Homo sapiens
gagcagcctgatg

SEQ ID NO: 5902795 - DNA, 11 bp, Homo sapiens
gagcagcctgt

SEQ ID NO: 5902796 - DNA, 16 bp, Homo sapiens
gagcagcctgtggcat

SEQ ID NO: 5902797 - DNA, 21 bp, Homo sapiens
gagcagcgcccaggcctgctg

SEQ ID NO: 5902798 - DNA, 22 bp, Homo sapiens
gagcagcgcccaggcctgctgg

SEQ ID NO: 5902799 - DNA, 23 bp, Homo sapiens
gagcagcgcccaggcctgctggc

SEQ ID NO: 5902800 - DNA, 19 bp, Homo sapiens
gagcagcggattgctctgg

SEQ ID NO: 5902801 - DNA, 16 bp, Homo sapiens
gagcagctaaagatga

SEQ ID NO: 5902802 - DNA, 20 bp, Homo sapiens
gagcagctattttaagccat

SEQ ID NO: 5902803 - DNA, 19 bp, Homo sapiens
gagcagctccaccactgtg

SEQ ID NO: 5902804 - DNA, 22 bp, Homo sapiens
gagcagctccaccactgtgcac

SEQ ID NO: 5902805 - DNA, 14 bp, Homo sapiens
gagcagctccccag

SEQ ID NO: 5902806 - DNA, 15 bp, Homo sapiens
gagcagctccccagg

SEQ ID NO: 5902807 - DNA, 17 bp, Homo sapiens
gagcagctccccaggag

SEQ ID NO: 5902808 - DNA, 20 bp, Homo sapiens
gagcagctccccaggagctc

SEQ ID NO: 5902809 - DNA, 13 bp, Homo sapiens
gagcagctgagca

SEQ ID NO: 5902810 - DNA, 15 bp, Homo sapiens
gagcagctgagcagg

SEQ ID NO: 5902811 - DNA, 16 bp, Homo sapiens
gagcagctgagcaggg

SEQ ID NO: 5902812 - DNA, 17 bp, Homo sapiens
gagcagctgagcagggc

SEQ ID NO: 5902813 - DNA, 15 bp, Homo sapiens
gagcagctggcactg

SEQ ID NO: 5902814 - DNA, 18 bp, Homo sapiens
gagcagctggcactgaca

SEQ ID NO: 5902815 - DNA, 15 bp, Homo sapiens
gagcagctggctctc

SEQ ID NO: 5902816 - DNA, 16 bp, Homo sapiens
gagcagctgggcactg

SEQ ID NO: 5902817 - DNA, 23 bp, Homo sapiens
gagcagctggggtaggctgtctg

SEQ ID NO: 5902818 - DNA, 15 bp, Homo sapiens
gagcagcttcagttg

SEQ ID NO: 5902819 - DNA, 18 bp, Homo sapiens
gagcagcttcggtgtgca

SEQ ID NO: 5902820 - DNA, 17 bp, Homo sapiens
gagcagcttcttgggct

SEQ ID NO: 5902821 - DNA, 19 bp, Homo sapiens
gagcagcttcttgggctga

SEQ ID NO: 5902822 - DNA, 20 bp, Homo sapiens
gagcagcttcttgggctgag

SEQ ID NO: 5902823 - DNA, 18 bp, Homo sapiens
gagcagctttaaactcag

SEQ ID NO: 5902824 - DNA, 21 bp, Homo sapiens
gagcagctttaaactcaggga

SEQ ID NO: 5902825 - DNA, 22 bp, Homo sapiens
gagcagctttaaactcagggac

SEQ ID NO: 5902826 - DNA, 13 bp, Homo sapiens
gagcaggaacaga

SEQ ID NO: 5902827 - DNA, 14 bp, Homo sapiens
gagcaggaacagag

SEQ ID NO: 5902828 - DNA, 22 bp, Homo sapiens
gagcaggaacagagactctgga

SEQ ID NO: 5902829 - DNA, 11 bp, Homo sapiens
gagcaggaagc

SEQ ID NO: 5902830 - DNA, 17 bp, Homo sapiens
gagcaggaagcaaggcc

SEQ ID NO: 5902831 - DNA, 22 bp, Homo sapiens
gagcaggaagcaaggccagccc

SEQ ID NO: 5902832 - DNA, 22 bp, Homo sapiens
gagcaggaagcattcagagagc

SEQ ID NO: 5902833 - DNA, 16 bp, Homo sapiens
gagcaggactccaggc

SEQ ID NO: 5902834 - DNA, 11 bp, Homo sapiens
gagcaggagca

SEQ ID NO: 5902835 - DNA, 13 bp, Homo sapiens
gagcaggagcccc

SEQ ID NO: 5902836 - DNA, 16 bp, Homo sapiens
gagcaggagcttgggt

SEQ ID NO: 5902837 - DNA, 14 bp, Homo sapiens
gagcaggaggccaa

SEQ ID NO: 5902838 - DNA, 15 bp, Homo sapiens
gagcaggaggccaat

SEQ ID NO: 5902839 - DNA, 18 bp, Homo sapiens
gagcaggaggccaataaa

SEQ ID NO: 5902840 - DNA, 16 bp, Homo sapiens
gagcaggaggcccctg

SEQ ID NO: 5902841 - DNA, 15 bp, Homo sapiens
gagcaggaggtgcct

SEQ ID NO: 5902842 - DNA, 15 bp, Homo sapiens
gagcaggcacatgga

SEQ ID NO: 5902843 - DNA, 14 bp, Homo sapiens
gagcaggcaccagc

SEQ ID NO: 5902844 - DNA, 16 bp, Homo sapiens
gagcaggcagccagca

SEQ ID NO: 5902845 - DNA, 11 bp, Homo sapiens
gagcaggcagg

SEQ ID NO: 5902846 - DNA, 12 bp, Homo sapiens
gagcaggcaggg

SEQ ID NO: 5902847 - DNA, 15 bp, Homo sapiens
gagcaggcaggggca

SEQ ID NO: 5902848 - DNA, 18 bp, Homo sapiens
gagcaggcaggggcttgg

SEQ ID NO: 5902849 - DNA, 19 bp, Homo sapiens
gagcaggcaggggcttggc

SEQ ID NO: 5902850 - DNA, 16 bp, Homo sapiens
gagcaggcagtggggc

SEQ ID NO: 5902851 - DNA, 19 bp, Homo sapiens
gagcaggccacgctcaggc

SEQ ID NO: 5902852 - DNA, 23 bp, Homo sapiens
gagcaggccacgctcaggcccgg

SEQ ID NO: 5902853 - DNA, 20 bp, Homo sapiens
gagcaggcccaatgctgctt

SEQ ID NO: 5902854 - DNA, 22 bp, Homo sapiens
gagcaggcccaatgctgctttt

SEQ ID NO: 5902855 - DNA, 23 bp, Homo sapiens
gagcaggcccaatgctgcttttg

SEQ ID NO: 5902856 - DNA, 12 bp, Homo sapiens
gagcaggcccga

SEQ ID NO: 5902857 - DNA, 17 bp, Homo sapiens
gagcaggccctgggcct

SEQ ID NO: 5902858 - DNA, 14 bp, Homo sapiens
gagcaggccggaac

SEQ ID NO: 5902859 - DNA, 15 bp, Homo sapiens
gagcaggccggaacc

SEQ ID NO: 5902860 - DNA, 19 bp, Homo sapiens
gagcaggccggaaccacag

SEQ ID NO: 5902861 - DNA, 22 bp, Homo sapiens
gagcaggccggaaccacagggc

SEQ ID NO: 5902862 - DNA, 18 bp, Homo sapiens
gagcaggcggtggggaga

SEQ ID NO: 5902863 - DNA, 18 bp, Homo sapiens
gagcaggctggcagctct

SEQ ID NO: 5902864 - DNA, 20 bp, Homo sapiens
gagcaggctggcagctctcc

SEQ ID NO: 5902865 - DNA, 21 bp, Homo sapiens
gagcaggctggcagctctcca

SEQ ID NO: 5902866 - DNA, 14 bp, Homo sapiens
gagcaggctttgtg

SEQ ID NO: 5902867 - DNA, 13 bp, Homo sapiens
gagcagggaaggc

SEQ ID NO: 5902868 - DNA, 14 bp, Homo sapiens
gagcagggaaggcc

SEQ ID NO: 5902869 - DNA, 16 bp, Homo sapiens
gagcagggaaggcctg

SEQ ID NO: 5902870 - DNA, 18 bp, Homo sapiens
gagcagggacagatcata

SEQ ID NO: 5902871 - DNA, 21 bp, Homo sapiens
gagcagggattaacctctgca

SEQ ID NO: 5902872 - DNA, 16 bp, Homo sapiens
gagcagggcaggcccc

SEQ ID NO: 5902873 - DNA, 15 bp, Homo sapiens
gagcagggccaaagc

SEQ ID NO: 5902874 - DNA, 19 bp, Homo sapiens
gagcagggccaaagcacag

SEQ ID NO: 5902875 - DNA, 21 bp, Homo sapiens
gagcagggctcagcggggaca

SEQ ID NO: 5902876 - DNA, 19 bp, Homo sapiens
gagcagggcttgctcctgc

SEQ ID NO: 5902877 - DNA, 17 bp, Homo sapiens
gagcaggggcaggcgca

SEQ ID NO: 5902878 - DNA, 19 bp, Homo sapiens
gagcaggggcccctgggga

SEQ ID NO: 5902879 - DNA, 15 bp, Homo sapiens
gagcaggggctccag

SEQ ID NO: 5902880 - DNA, 13 bp, Homo sapiens
gagcaggggctgc

SEQ ID NO: 5902881 - DNA, 15 bp, Homo sapiens
gagcaggggctgctg

SEQ ID NO: 5902882 - DNA, 18 bp, Homo sapiens
gagcaggggctgctgggg

SEQ ID NO: 5902883 - DNA, 21 bp, Homo sapiens
gagcagggggacctaggctcc

SEQ ID NO: 5902884 - DNA, 17 bp, Homo sapiens
gagcaggggtctgagcc

SEQ ID NO: 5902885 - DNA, 17 bp, Homo sapiens
gagcagggtccacagct

SEQ ID NO: 5902886 - DNA, 18 bp, Homo sapiens
gagcagggtccacagctg

SEQ ID NO: 5902887 - DNA, 12 bp, Homo sapiens
gagcagggtcct

SEQ ID NO: 5902888 - DNA, 10 bp, Homo sapiens
gagcagggtg

SEQ ID NO: 5902889 - DNA, 15 bp, Homo sapiens
gagcagggtggggtc

SEQ ID NO: 5902890 - DNA, 18 bp, Homo sapiens
gagcagggtggggtctgg

SEQ ID NO: 5902891 - DNA, 16 bp, Homo sapiens
gagcagggtgttggga

SEQ ID NO: 5902892 - DNA, 17 bp, Homo sapiens
gagcaggtctctggcag

SEQ ID NO: 5902893 - DNA, 18 bp, Homo sapiens
gagcaggtctctggcaga

SEQ ID NO: 5902894 - DNA, 16 bp, Homo sapiens
gagcaggtctgcaggc

SEQ ID NO: 5902895 - DNA, 21 bp, Homo sapiens
gagcaggttccccaagggccc

SEQ ID NO: 5902896 - DNA, 23 bp, Homo sapiens
gagcaggttccccaagggccctg

SEQ ID NO: 5902897 - DNA, 20 bp, Homo sapiens
gagcagtaactgtccctgct

SEQ ID NO: 5902898 - DNA, 22 bp, Homo sapiens
gagcagtaactgtccctgcttt

SEQ ID NO: 5902899 - DNA, 16 bp, Homo sapiens
gagcagtcacactgtt

SEQ ID NO: 5902900 - DNA, 19 bp, Homo sapiens
gagcagtcacactgttact

SEQ ID NO: 5902901 - DNA, 18 bp, Homo sapiens
gagcagtcactgggagag

SEQ ID NO: 5902902 - DNA, 16 bp, Homo sapiens
gagcagtcagagtcca

SEQ ID NO: 5902903 - DNA, 14 bp, Homo sapiens
gagcagtcaggaaa

SEQ ID NO: 5902904 - DNA, 17 bp, Homo sapiens
gagcagtcagggtggga

SEQ ID NO: 5902905 - DNA, 15 bp, Homo sapiens
gagcagtccctgctt

SEQ ID NO: 5902906 - DNA, 16 bp, Homo sapiens
gagcagtcctgcctca

SEQ ID NO: 5902907 - DNA, 16 bp, Homo sapiens
gagcagtccttggcct

SEQ ID NO: 5902908 - DNA, 17 bp, Homo sapiens
gagcagtccttggcctg

SEQ ID NO: 5902909 - DNA, 18 bp, Homo sapiens
gagcagtccttggcctgc

SEQ ID NO: 5902910 - DNA, 16 bp, Homo sapiens
gagcagtcgcctgcct

SEQ ID NO: 5902911 - DNA, 18 bp, Homo sapiens
gagcagtgagcactgaaa

SEQ ID NO: 5902912 - DNA, 15 bp, Homo sapiens
gagcagtgcaggcac

SEQ ID NO: 5902913 - DNA, 13 bp, Homo sapiens
gagcagtgctttt

SEQ ID NO: 5902914 - DNA, 15 bp, Homo sapiens
gagcagtgcttttgg

SEQ ID NO: 5902915 - DNA, 17 bp, Homo sapiens
gagcagtggccatcatc

SEQ ID NO: 5902916 - DNA, 14 bp, Homo sapiens
gagcagtggctggt

SEQ ID NO: 5902917 - DNA, 16 bp, Homo sapiens
gagcagtgggccctgg

SEQ ID NO: 5902918 - DNA, 17 bp, Homo sapiens
gagcagtgggccctggc

SEQ ID NO: 5902919 - DNA, 18 bp, Homo sapiens
gagcagtgggccctggct

SEQ ID NO: 5902920 - DNA, 18 bp, Homo sapiens
gagcagtgggcctggcca

SEQ ID NO: 5902921 - DNA, 13 bp, Homo sapiens
gagcagtggggag

SEQ ID NO: 5902922 - DNA, 16 bp, Homo sapiens
gagcagtggggagcgg

SEQ ID NO: 5902923 - DNA, 11 bp, Homo sapiens
gagcagtgtct

SEQ ID NO: 5902924 - DNA, 15 bp, Homo sapiens
gagcagttcccaagg

SEQ ID NO: 5902925 - DNA, 22 bp, Homo sapiens
gagcagttcccctggagcccct

SEQ ID NO: 5902926 - DNA, 15 bp, Homo sapiens
gagcagttggcctgt

SEQ ID NO: 5902927 - DNA, 18 bp, Homo sapiens
gagcagttggcctgtgct

SEQ ID NO: 5902928 - DNA, 20 bp, Homo sapiens
gagcagttgttatattcatt

SEQ ID NO: 5902929 - DNA, 20 bp, Homo sapiens
gagcagtttctgtcctgctg

SEQ ID NO: 5902930 - DNA, 22 bp, Homo sapiens
gagcagtttctgtcctgctggt

SEQ ID NO: 5902931 - DNA, 18 bp, Homo sapiens
gagcagtttggggcaggg

SEQ ID NO: 5902932 - DNA, 19 bp, Homo sapiens
gagcagtttggggcagggg

SEQ ID NO: 5902933 - DNA, 16 bp, Homo sapiens
gagcagttttcccctg

SEQ ID NO: 5902934 - DNA, 15 bp, Homo sapiens
gagcataaaacctaa

SEQ ID NO: 5902935 - DNA, 20 bp, Homo sapiens
gagcataatttaaaaatata

SEQ ID NO: 5902936 - DNA, 16 bp, Homo sapiens
gagcatacaaaataaa

SEQ ID NO: 5902937 - DNA, 21 bp, Homo sapiens
gagcatacatcttaaatcttt

SEQ ID NO: 5902938 - DNA, 20 bp, Homo sapiens
gagcatagaagccacatcgt

SEQ ID NO: 5902939 - DNA, 14 bp, Homo sapiens
gagcatagaaggca

SEQ ID NO: 5902940 - DNA, 16 bp, Homo sapiens
gagcatagaaggcagg

SEQ ID NO: 5902941 - DNA, 21 bp, Homo sapiens
gagcataggtgatccatgtaa

SEQ ID NO: 5902942 - DNA, 22 bp, Homo sapiens
gagcatatctggtatatgtcat

SEQ ID NO: 5902943 - DNA, 24 bp, Homo sapiens
gagcatatctggtatatgtcatta

SEQ ID NO: 5902944 - DNA, 21 bp, Homo sapiens
gagcatatgttccatgcctgg

SEQ ID NO: 5902945 - DNA, 23 bp, Homo sapiens
gagcatatgttccatgcctggcc

SEQ ID NO: 5902946 - DNA, 23 bp, Homo sapiens
gagcatcaaaaacatcactccct

SEQ ID NO: 5902947 - DNA, 16 bp, Homo sapiens
gagcatcaatcttgtt

SEQ ID NO: 5902948 - DNA, 13 bp, Homo sapiens
gagcatcacagaa

SEQ ID NO: 5902949 - DNA, 14 bp, Homo sapiens
gagcatcacagaat

SEQ ID NO: 5902950 - DNA, 18 bp, Homo sapiens
gagcatcaccaccacacc

SEQ ID NO: 5902951 - DNA, 21 bp, Homo sapiens
gagcatcactagtgacaagtc

SEQ ID NO: 5902952 - DNA, 15 bp, Homo sapiens
gagcatcagccagtg

SEQ ID NO: 5902953 - DNA, 22 bp, Homo sapiens
gagcatcagccagtgaatctgt

SEQ ID NO: 5902954 - DNA, 12 bp, Homo sapiens
gagcatcaggcc

SEQ ID NO: 5902955 - DNA, 17 bp, Homo sapiens
gagcatcaggccaggcc

SEQ ID NO: 5902956 - DNA, 22 bp, Homo sapiens
gagcatcaggccaggccctctg

SEQ ID NO: 5902957 - DNA, 14 bp, Homo sapiens
gagcatcatgcctc

SEQ ID NO: 5902958 - DNA, 21 bp, Homo sapiens
gagcatcatgcctctgaggcc

SEQ ID NO: 5902959 - DNA, 18 bp, Homo sapiens
gagcatccacctccttct

SEQ ID NO: 5902960 - DNA, 18 bp, Homo sapiens
gagcatccagacctgagc

SEQ ID NO: 5902961 - DNA, 19 bp, Homo sapiens
gagcatcccccaaagttca

SEQ ID NO: 5902962 - DNA, 13 bp, Homo sapiens
gagcatccccctc

SEQ ID NO: 5902963 - DNA, 20 bp, Homo sapiens
gagccagccgtaatggggac

SEQ ID NO: 5902964 - DNA, 12 bp, Homo sapiens
gagccagcctgc

SEQ ID NO: 5902965 - DNA, 20 bp, Homo sapiens
gagccagcctgcttcccaca

SEQ ID NO: 5902966 - DNA, 14 bp, Homo sapiens
gagccagcctggct

SEQ ID NO: 5902967 - DNA, 22 bp, Homo sapiens
gagccagcctggctctgccccc

SEQ ID NO: 5902968 - DNA, 13 bp, Homo sapiens
gagccagcctggg

SEQ ID NO: 5902969 - DNA, 12 bp, Homo sapiens
gagccagccttg

SEQ ID NO: 5902970 - DNA, 18 bp, Homo sapiens
gagccagcgcctgcccga

SEQ ID NO: 5902971 - DNA, 17 bp, Homo sapiens
gagccagcggctccaac

SEQ ID NO: 5902972 - DNA, 13 bp, Homo sapiens
gagccagctctgg

SEQ ID NO: 5902973 - DNA, 23 bp, Homo sapiens
gagccagctgcttgacctagctc

SEQ ID NO: 5902974 - DNA, 21 bp, Homo sapiens
gagccaggaagatcccccaga

SEQ ID NO: 5902975 - DNA, 14 bp, Homo sapiens
gagccaggactccc

SEQ ID NO: 5902976 - DNA, 18 bp, Homo sapiens
gagccaggactcccagaa

SEQ ID NO: 5902977 - DNA, 22 bp, Homo sapiens
gagccaggactcccagaacctc

SEQ ID NO: 5902978 - DNA, 12 bp, Homo sapiens
gagccaggaggg

SEQ ID NO: 5902979 - DNA, 12 bp, Homo sapiens
gagccaggcccc

SEQ ID NO: 5902980 - DNA, 14 bp, Homo sapiens
gagccaggccccac

SEQ ID NO: 5902981 - DNA, 12 bp, Homo sapiens
gagccaggcctg

SEQ ID NO: 5902982 - DNA, 14 bp, Homo sapiens
gagccaggcttgga

SEQ ID NO: 5902983 - DNA, 19 bp, Homo sapiens
gagccagggcagaggaatg

SEQ ID NO: 5902984 - DNA, 20 bp, Homo sapiens
gagccagggcagaggaatgt

SEQ ID NO: 5902985 - DNA, 16 bp, Homo sapiens
gagccagggcagggcg

SEQ ID NO: 5902986 - DNA, 17 bp, Homo sapiens
gagccagggcagggcga

SEQ ID NO: 5902987 - DNA, 12 bp, Homo sapiens
gagccagggcct

SEQ ID NO: 5902988 - DNA, 15 bp, Homo sapiens
gagccagggctgtcc

SEQ ID NO: 5902989 - DNA, 17 bp, Homo sapiens
gagccagggctgtcctt

SEQ ID NO: 5902990 - DNA, 11 bp, Homo sapiens
gagccagggta

SEQ ID NO: 5902991 - DNA, 15 bp, Homo sapiens
gagccagggtagagc

SEQ ID NO: 5902992 - DNA, 17 bp, Homo sapiens
gagccagggtagagcaa

SEQ ID NO: 5902993 - DNA, 14 bp, Homo sapiens
gagccagggtctca

SEQ ID NO: 5902994 - DNA, 13 bp, Homo sapiens
gagccagggtgag

SEQ ID NO: 5902995 - DNA, 19 bp, Homo sapiens
gagccaggtaatgagggac

SEQ ID NO: 5902996 - DNA, 22 bp, Homo sapiens
gagccaggtaatgagggactgg

SEQ ID NO: 5902997 - DNA, 18 bp, Homo sapiens
gagccagtaaacagagga

SEQ ID NO: 5902998 - DNA, 12 bp, Homo sapiens
gagccagtaact

SEQ ID NO: 5902999 - DNA, 17 bp, Homo sapiens
gagccagtaatctttat

SEQ ID NO: 5903000 - DNA, 23 bp, Homo sapiens
gagccagtcctccactcgaccca

SEQ ID NO: 5903001 - DNA, 23 bp, Homo sapiens
gagccagtgagggcagtcctgca

SEQ ID NO: 5903002 - DNA, 21 bp, Homo sapiens
gagccagttcagtacctggag

SEQ ID NO: 5903003 - DNA, 22 bp, Homo sapiens
gagccagttcagtacctggagg

SEQ ID NO: 5903004 - DNA, 18 bp, Homo sapiens
gagccagttgtcctatgg

SEQ ID NO: 5903005 - DNA, 22 bp, Homo sapiens
gagccagttgtcctatggacaa

SEQ ID NO: 5903006 - DNA, 23 bp, Homo sapiens
gagccatactgcgtccaccctga

SEQ ID NO: 5903007 - DNA, 19 bp, Homo sapiens
gagccatataagtttgaag

SEQ ID NO: 5903008 - DNA, 19 bp, Homo sapiens
gagccatcaccctcaccca

SEQ ID NO: 5903009 - DNA, 23 bp, Homo sapiens
gagccatcacctaggactgactc

SEQ ID NO: 5903010 - DNA, 22 bp, Homo sapiens
gagccatcactagaagaaaagc

SEQ ID NO: 5903011 - DNA, 15 bp, Homo sapiens
gagccatccaccctg

SEQ ID NO: 5903012 - DNA, 20 bp, Homo sapiens
gagccatcccttcggagcca

SEQ ID NO: 5903013 - DNA, 18 bp, Homo sapiens
gagccatcttggcagggt

SEQ ID NO: 5903014 - DNA, 20 bp, Homo sapiens
gagccatgaggagcgtggac

SEQ ID NO: 5903015 - DNA, 19 bp, Homo sapiens
gagccatgatttcccactg

SEQ ID NO: 5903016 - DNA, 17 bp, Homo sapiens
gagccatgcctccctgg

SEQ ID NO: 5903017 - DNA, 17 bp, Homo sapiens
gagccatgcgccccctc

SEQ ID NO: 5903018 - DNA, 20 bp, Homo sapiens
gagccatggcggcccctcag

SEQ ID NO: 5903019 - DNA, 13 bp, Homo sapiens
gagccatgggcct

SEQ ID NO: 5903020 - DNA, 19 bp, Homo sapiens
gagccatgggcctgggcct

SEQ ID NO: 5903021 - DNA, 18 bp, Homo sapiens
gagccatgtcttctccct

SEQ ID NO: 5903022 - DNA, 12 bp, Homo sapiens
gagccatgtttc

SEQ ID NO: 5903023 - DNA, 16 bp, Homo sapiens
gagccattctgtccca

SEQ ID NO: 5903024 - DNA, 18 bp, Homo sapiens
gagccatttaatttttaa

SEQ ID NO: 5903025 - DNA, 13 bp, Homo sapiens
gagccatttgaga

SEQ ID NO: 5903026 - DNA, 15 bp, Homo sapiens
gagccatttgtccca

SEQ ID NO: 5903027 - DNA, 16 bp, Homo sapiens
gagccatttgtcccaa

SEQ ID NO: 5903028 - DNA, 18 bp, Homo sapiens
gagccatttgtcccaagt

SEQ ID NO: 5903029 - DNA, 16 bp, Homo sapiens
gagcccaagcacacat

SEQ ID NO: 5903030 - DNA, 15 bp, Homo sapiens
gagcccaagtgccat

SEQ ID NO: 5903031 - DNA, 17 bp, Homo sapiens
gagcccaagtgccatcc

SEQ ID NO: 5903032 - DNA, 22 bp, Homo sapiens
gagcccaagtgccatcccacat

SEQ ID NO: 5903033 - DNA, 23 bp, Homo sapiens
gagcccaatgcatagagccctgg

SEQ ID NO: 5903034 - DNA, 15 bp, Homo sapiens
gagcccacaccatct

SEQ ID NO: 5903035 - DNA, 16 bp, Homo sapiens
gagcccacaccatctg

SEQ ID NO: 5903036 - DNA, 17 bp, Homo sapiens
gagcccacaccatctgg

SEQ ID NO: 5903037 - DNA, 20 bp, Homo sapiens
gagcccacaccatctggccc

SEQ ID NO: 5903038 - DNA, 21 bp, Homo sapiens
gagcccacaccatctggccca

SEQ ID NO: 5903039 - DNA, 13 bp, Homo sapiens
gagcccacagcga

SEQ ID NO: 5903040 - DNA, 15 bp, Homo sapiens
gagcccacagcgagc

SEQ ID NO: 5903041 - DNA, 21 bp, Homo sapiens
gagcccacagcgagcctgtgc

SEQ ID NO: 5903042 - DNA, 23 bp, Homo sapiens
gagcccacagcgagcctgtgcct

SEQ ID NO: 5903043 - DNA, 16 bp, Homo sapiens
gagcccacagtgcctg

SEQ ID NO: 5903044 - DNA, 15 bp, Homo sapiens
gagcccaccagccag

SEQ ID NO: 5903045 - DNA, 16 bp, Homo sapiens
gagcccaccagccagc

SEQ ID NO: 5903046 - DNA, 17 bp, Homo sapiens
gagcccaccagccagcc

SEQ ID NO: 5903047 - DNA, 20 bp, Homo sapiens
gagcccaccagggacacctc

SEQ ID NO: 5903048 - DNA, 12 bp, Homo sapiens
gagcccacccag

SEQ ID NO: 5903049 - DNA, 14 bp, Homo sapiens
gagcccacccagca

SEQ ID NO: 5903050 - DNA, 13 bp, Homo sapiens
gagcccaccttgg

SEQ ID NO: 5903051 - DNA, 11 bp, Homo sapiens
gagcccacgcc

SEQ ID NO: 5903052 - DNA, 16 bp, Homo sapiens
gagcccacgcccccac

SEQ ID NO: 5903053 - DNA, 18 bp, Homo sapiens
gagcccacgcccccactg

SEQ ID NO: 5903054 - DNA, 12 bp, Homo sapiens
gagcccactcct

SEQ ID NO: 5903055 - DNA, 18 bp, Homo sapiens
gagcccactctactgccc

SEQ ID NO: 5903056 - DNA, 20 bp, Homo sapiens
gagcccactctactgcccca

SEQ ID NO: 5903057 - DNA, 24 bp, Homo sapiens
gagcccactctactgccccagctc

SEQ ID NO: 5903058 - DNA, 21 bp, Homo sapiens
gagcccactgcccaccccctc

SEQ ID NO: 5903059 - DNA, 11 bp, Homo sapiens
gagcccactgt

SEQ ID NO: 5903060 - DNA, 18 bp, Homo sapiens
gagcccactgtacttgct

SEQ ID NO: 5903061 - DNA, 21 bp, Homo sapiens
gagcccactgtacttgctctt

SEQ ID NO: 5903062 - DNA, 23 bp, Homo sapiens
gagcccactgtacttgctcttga

SEQ ID NO: 5903063 - DNA, 19 bp, Homo sapiens
gagcccactgtcctgggcc

SEQ ID NO: 5903064 - DNA, 13 bp, Homo sapiens
gagcccactgtgc

SEQ ID NO: 5903065 - DNA, 20 bp, Homo sapiens
gagcccagaaaacctccagt

SEQ ID NO: 5903066 - DNA, 14 bp, Homo sapiens
gagcccagagaaca

SEQ ID NO: 5903067 - DNA, 14 bp, Homo sapiens
gagcccagaggagg

SEQ ID NO: 5903068 - DNA, 22 bp, Homo sapiens
gagcccagaggagggcagcaga

SEQ ID NO: 5903069 - DNA, 23 bp, Homo sapiens
gagcccagaggtaacagaacagc

SEQ ID NO: 5903070 - DNA, 16 bp, Homo sapiens
gagcccagagtccccc

SEQ ID NO: 5903071 - DNA, 20 bp, Homo sapiens
gagcccagattgtgccactg

SEQ ID NO: 5903072 - DNA, 22 bp, Homo sapiens
gagcccagattgtgccactgct

SEQ ID NO: 5903073 - DNA, 21 bp, Homo sapiens
gagcccagcacactgcttctc

SEQ ID NO: 5903074 - DNA, 15 bp, Homo sapiens
gagcccagccacctc

SEQ ID NO: 5903075 - DNA, 18 bp, Homo sapiens
gagcccagccacctccca

SEQ ID NO: 5903076 - DNA, 20 bp, Homo sapiens
gagcccagccagaaagcact

SEQ ID NO: 5903077 - DNA, 18 bp, Homo sapiens
gagcccagccctccccat

SEQ ID NO: 5903078 - DNA, 17 bp, Homo sapiens
gagcccagcctgggagc

SEQ ID NO: 5903079 - DNA, 17 bp, Homo sapiens
gagcccagcggcccaag

SEQ ID NO: 5903080 - DNA, 21 bp, Homo sapiens
gagcccagcgtcagaagtcta

SEQ ID NO: 5903081 - DNA, 14 bp, Homo sapiens
gagcccagctacat

SEQ ID NO: 5903082 - DNA, 18 bp, Homo sapiens
gagcccagctacattcct

SEQ ID NO: 5903083 - DNA, 20 bp, Homo sapiens
gagcccagctacattcctca

SEQ ID NO: 5903084 - DNA, 11 bp, Homo sapiens
gagcccagctc

SEQ ID NO: 5903085 - DNA, 12 bp, Homo sapiens
gagcccagctct

SEQ ID NO: 5903086 - DNA, 22 bp, Homo sapiens
gagcccagctcttgctctcttg

SEQ ID NO: 5903087 - DNA, 13 bp, Homo sapiens
gagcccagctgcc

SEQ ID NO: 5903088 - DNA, 19 bp, Homo sapiens
gagcccagctgggtcaggc

SEQ ID NO: 5903089 - DNA, 22 bp, Homo sapiens
gagcccagctgggtcaggcagg

SEQ ID NO: 5903090 - DNA, 24 bp, Homo sapiens
gagcccaggagctgagtcacctcc

SEQ ID NO: 5903091 - DNA, 23 bp, Homo sapiens
gagcccaggagttcgaggctgca

SEQ ID NO: 5903092 - DNA, 23 bp, Homo sapiens
gagcccaggccaggactctgcag

SEQ ID NO: 5903093 - DNA, 24 bp, Homo sapiens
gagcccaggccaggactctgcagc

SEQ ID NO: 5903094 - DNA, 14 bp, Homo sapiens
gagcccaggcctcc

SEQ ID NO: 5903095 - DNA, 14 bp, Homo sapiens
gagcccaggcctgc

SEQ ID NO: 5903096 - DNA, 19 bp, Homo sapiens
gagcccaggcctggcctcg

SEQ ID NO: 5903097 - DNA, 11 bp, Homo sapiens
gagcccaggct

SEQ ID NO: 5903098 - DNA, 11 bp, Homo sapiens
gagcccaggga

SEQ ID NO: 5903099 - DNA, 22 bp, Homo sapiens
gagcccagggcatcttgctggc

SEQ ID NO: 5903100 - DNA, 15 bp, Homo sapiens
gagcccaggggagaa

SEQ ID NO: 5903101 - DNA, 13 bp, Homo sapiens
gagcccagggtgc

SEQ ID NO: 5903102 - DNA, 15 bp, Homo sapiens
gagcccagggtgctg

SEQ ID NO: 5903103 - DNA, 16 bp, Homo sapiens
gagcccagggtgctgg

SEQ ID NO: 5903104 - DNA, 17 bp, Homo sapiens
gagcccagtcattgtac

SEQ ID NO: 5903105 - DNA, 19 bp, Homo sapiens
gagcccagtgaagcctctg

SEQ ID NO: 5903106 - DNA, 22 bp, Homo sapiens
gagcccatactcagcctgctgc

SEQ ID NO: 5903107 - DNA, 13 bp, Homo sapiens
gagcccatgctca

SEQ ID NO: 5903108 - DNA, 12 bp, Homo sapiens
gagcccatggtg

SEQ ID NO: 5903109 - DNA, 20 bp, Homo sapiens
gagcccatgttctgccccca

SEQ ID NO: 5903110 - DNA, 18 bp, Homo sapiens
gagcccattaatcttgat

SEQ ID NO: 5903111 - DNA, 14 bp, Homo sapiens
gagcccattctcat

SEQ ID NO: 5903112 - DNA, 16 bp, Homo sapiens
gagcccattcttctgg

SEQ ID NO: 5903113 - DNA, 17 bp, Homo sapiens
gagcccattcttctggg

SEQ ID NO: 5903114 - DNA, 19 bp, Homo sapiens
gagcccattcttctgggtg

SEQ ID NO: 5903115 - DNA, 14 bp, Homo sapiens
gagcccattgtgga

SEQ ID NO: 5903116 - DNA, 20 bp, Homo sapiens
gagccccaagactctgctct

SEQ ID NO: 5903117 - DNA, 22 bp, Homo sapiens
gagccccaagactctgctctcc

SEQ ID NO: 5903118 - DNA, 17 bp, Homo sapiens
gagccccaagtcctgaa

SEQ ID NO: 5903119 - DNA, 16 bp, Homo sapiens
gagccccacacggagg

SEQ ID NO: 5903120 - DNA, 20 bp, Homo sapiens
gagccccacagagcaggaag

SEQ ID NO: 5903121 - DNA, 16 bp, Homo sapiens
gagccccacagccctg

SEQ ID NO: 5903122 - DNA, 19 bp, Homo sapiens
gagccccacgtggagctcg

SEQ ID NO: 5903123 - DNA, 20 bp, Homo sapiens
gagccccactctcagaggcc

SEQ ID NO: 5903124 - DNA, 21 bp, Homo sapiens
gagccccactctcagaggccc

SEQ ID NO: 5903125 - DNA, 23 bp, Homo sapiens
gagccccactctcagaggcccca

SEQ ID NO: 5903126 - DNA, 19 bp, Homo sapiens
gagccccactgcccttctc

SEQ ID NO: 5903127 - DNA, 19 bp, Homo sapiens
gagccccagccccctttgg

SEQ ID NO: 5903128 - DNA, 14 bp, Homo sapiens
gagccccagccccg

SEQ ID NO: 5903129 - DNA, 15 bp, Homo sapiens
gagccccagccccgt

SEQ ID NO: 5903130 - DNA, 17 bp, Homo sapiens
gagccccagcttcctgt

SEQ ID NO: 5903131 - DNA, 14 bp, Homo sapiens
gagccccaggcagg

SEQ ID NO: 5903132 - DNA, 23 bp, Homo sapiens
gagccccagggagagggggctgg

SEQ ID NO: 5903133 - DNA, 21 bp, Homo sapiens
gagccccaggggggcctcctc

SEQ ID NO: 5903134 - DNA, 23 bp, Homo sapiens
gagccccaggggggcctcctcct

SEQ ID NO: 5903135 - DNA, 18 bp, Homo sapiens
gagccccatcagctccag

SEQ ID NO: 5903136 - DNA, 12 bp, Homo sapiens
gagccccatctg

SEQ ID NO: 5903137 - DNA, 12 bp, Homo sapiens
gagccccatctt

SEQ ID NO: 5903138 - DNA, 15 bp, Homo sapiens
gagcccccaagcctc

SEQ ID NO: 5903139 - DNA, 18 bp, Homo sapiens
gagcccccaagcctctgc

SEQ ID NO: 5903140 - DNA, 12 bp, Homo sapiens
gagcccccaagg

SEQ ID NO: 5903141 - DNA, 14 bp, Homo sapiens
gagccttgctctgt

SEQ ID NO: 5903142 - DNA, 15 bp, Homo sapiens
gagccttgctgccaa

SEQ ID NO: 5903143 - DNA, 16 bp, Homo sapiens
gagccttgctgggcca

SEQ ID NO: 5903144 - DNA, 18 bp, Homo sapiens
gagccttgctgggccagg

SEQ ID NO: 5903145 - DNA, 17 bp, Homo sapiens
gagccttggaggacact

SEQ ID NO: 5903146 - DNA, 18 bp, Homo sapiens
gagccttgggagccactg

SEQ ID NO: 5903147 - DNA, 19 bp, Homo sapiens
gagccttgggagccactgc

SEQ ID NO: 5903148 - DNA, 20 bp, Homo sapiens
gagccttgggagccactgcc

SEQ ID NO: 5903149 - DNA, 21 bp, Homo sapiens
gagccttgggagccactgcca

SEQ ID NO: 5903150 - DNA, 20 bp, Homo sapiens
gagccttggtgtccacctgg

SEQ ID NO: 5903151 - DNA, 20 bp, Homo sapiens
gagccttgtgagatccttca

SEQ ID NO: 5903152 - DNA, 13 bp, Homo sapiens
gagcctttccaaa

SEQ ID NO: 5903153 - DNA, 21 bp, Homo sapiens
gagcctttggaagtctgcgcc

SEQ ID NO: 5903154 - DNA, 17 bp, Homo sapiens
gagcctttggatgacca

SEQ ID NO: 5903155 - DNA, 23 bp, Homo sapiens
gagcctttgtgctttttgtcatg

SEQ ID NO: 5903156 - DNA, 20 bp, Homo sapiens
gagccttttatctgcagaac

SEQ ID NO: 5903157 - DNA, 13 bp, Homo sapiens
gagccttttgctc

SEQ ID NO: 5903158 - DNA, 17 bp, Homo sapiens
gagcctttttacctggc

SEQ ID NO: 5903159 - DNA, 20 bp, Homo sapiens
gagcctttttacctggccta

SEQ ID NO: 5903160 - DNA, 16 bp, Homo sapiens
gagcgaaaacaggaga

SEQ ID NO: 5903161 - DNA, 15 bp, Homo sapiens
gagcgaccagcaggc

SEQ ID NO: 5903162 - DNA, 23 bp, Homo sapiens
gagcgaccagcaggctcctcagc

SEQ ID NO: 5903163 - DNA, 12 bp, Homo sapiens
gagcgaccctgg

SEQ ID NO: 5903164 - DNA, 15 bp, Homo sapiens
gagcgaccctggctc

SEQ ID NO: 5903165 - DNA, 16 bp, Homo sapiens
gagcgaccctggctct

SEQ ID NO: 5903166 - DNA, 20 bp, Homo sapiens
gagcgacgtttatttcatct

SEQ ID NO: 5903167 - DNA, 19 bp, Homo sapiens
gagcgagagatcaaagatg

SEQ ID NO: 5903168 - DNA, 17 bp, Homo sapiens
gagcgagcaagccggca

SEQ ID NO: 5903169 - DNA, 18 bp, Homo sapiens
gagcgagcaagccggcaa

SEQ ID NO: 5903170 - DNA, 16 bp, Homo sapiens
gagcgagcatccccca

SEQ ID NO: 5903171 - DNA, 18 bp, Homo sapiens
gagcgaggaaaaacaaca

SEQ ID NO: 5903172 - DNA, 13 bp, Homo sapiens
gagcgaggaaagg

SEQ ID NO: 5903173 - DNA, 21 bp, Homo sapiens
gagcgaggagatgctccttgg

SEQ ID NO: 5903174 - DNA, 12 bp, Homo sapiens
gagcgaggaggc

SEQ ID NO: 5903175 - DNA, 23 bp, Homo sapiens
gagcgagtaaagtctgggccagg

SEQ ID NO: 5903176 - DNA, 20 bp, Homo sapiens
gagcgagtggagtctgccac

SEQ ID NO: 5903177 - DNA, 16 bp, Homo sapiens
gagcgatgtgttcttt

SEQ ID NO: 5903178 - DNA, 12 bp, Homo sapiens
gagcgcaagata

SEQ ID NO: 5903179 - DNA, 15 bp, Homo sapiens
gagcgcaagccacag

SEQ ID NO: 5903180 - DNA, 16 bp, Homo sapiens
gagcgcaagccacagc

SEQ ID NO: 5903181 - DNA, 17 bp, Homo sapiens
gagcgcaagccacagcc

SEQ ID NO: 5903182 - DNA, 20 bp, Homo sapiens
gagcgcaagccacagcctgt

SEQ ID NO: 5903183 - DNA, 13 bp, Homo sapiens
gagcgcacctgct

SEQ ID NO: 5903184 - DNA, 21 bp, Homo sapiens
gagcgcacctgcttcccccac

SEQ ID NO: 5903185 - DNA, 14 bp, Homo sapiens
gagcgcagccgcct

SEQ ID NO: 5903186 - DNA, 22 bp, Homo sapiens
gagcgcagccgccttcacagca

SEQ ID NO: 5903187 - DNA, 20 bp, Homo sapiens
gagcgcaggcagcgcagggc

SEQ ID NO: 5903188 - DNA, 19 bp, Homo sapiens
gagcgcagtgttttgcaag

SEQ ID NO: 5903189 - DNA, 12 bp, Homo sapiens
gagcgccacccg

SEQ ID NO: 5903190 - DNA, 12 bp, Homo sapiens
gagcgccagctc

SEQ ID NO: 5903191 - DNA, 21 bp, Homo sapiens
gagcgccccgcccccacccct

SEQ ID NO: 5903192 - DNA, 12 bp, Homo sapiens
gagcgcccctcc

SEQ ID NO: 5903193 - DNA, 12 bp, Homo sapiens
gagcgccctgca

SEQ ID NO: 5903194 - DNA, 13 bp, Homo sapiens
gagcgccctgcag

SEQ ID NO: 5903195 - DNA, 18 bp, Homo sapiens
gagcgccctgcagggccg

SEQ ID NO: 5903196 - DNA, 19 bp, Homo sapiens
gagcgccctgcagggccgg

SEQ ID NO: 5903197 - DNA, 18 bp, Homo sapiens
gagcgcctcacctgcatc

SEQ ID NO: 5903198 - DNA, 13 bp, Homo sapiens
gagcgcctcttcc

SEQ ID NO: 5903199 - DNA, 17 bp, Homo sapiens
gagcgcctcttcctctg

SEQ ID NO: 5903200 - DNA, 21 bp, Homo sapiens
gagcgcctcttcctctgggca

SEQ ID NO: 5903201 - DNA, 22 bp, Homo sapiens
gagcgcctcttcctctgggcag

SEQ ID NO: 5903202 - DNA, 20 bp, Homo sapiens
gagcgcctgcccctcccaga

SEQ ID NO: 5903203 - DNA, 22 bp, Homo sapiens
gagcgcctgcccctcccagaac

SEQ ID NO: 5903204 - DNA, 14 bp, Homo sapiens
gagcgcggctggct

SEQ ID NO: 5903205 - DNA, 15 bp, Homo sapiens
gagcgcgggagagag

SEQ ID NO: 5903206 - DNA, 16 bp, Homo sapiens
gagcgcgggagagagt

SEQ ID NO: 5903207 - DNA, 21 bp, Homo sapiens
gagcgcgggagagagtgagag

SEQ ID NO: 5903208 - DNA, 15 bp, Homo sapiens
gagcgctagtgcctt

SEQ ID NO: 5903209 - DNA, 23 bp, Homo sapiens
gagcgctagtgccttgcccacag

SEQ ID NO: 5903210 - DNA, 14 bp, Homo sapiens
gagcgctcctctgc

SEQ ID NO: 5903211 - DNA, 21 bp, Homo sapiens
gagcgctcctgccgcagagct

SEQ ID NO: 5903212 - DNA, 12 bp, Homo sapiens
gagcgcttgggc

SEQ ID NO: 5903213 - DNA, 15 bp, Homo sapiens
gagcgcttgggcgcc

SEQ ID NO: 5903214 - DNA, 13 bp, Homo sapiens
gagcggaaagcag

SEQ ID NO: 5903215 - DNA, 16 bp, Homo sapiens
gagcggaaagcagctc

SEQ ID NO: 5903216 - DNA, 19 bp, Homo sapiens
gagcggactcacttgatgt

SEQ ID NO: 5903217 - DNA, 20 bp, Homo sapiens
gagcggagacgggaggcctg

SEQ ID NO: 5903218 - DNA, 19 bp, Homo sapiens
gagcggagcttgcctgcct

SEQ ID NO: 5903219 - DNA, 18 bp, Homo sapiens
gagcggagcttggccctg

SEQ ID NO: 5903220 - DNA, 13 bp, Homo sapiens
gagcggaggttgc

SEQ ID NO: 5903221 - DNA, 18 bp, Homo sapiens
gagcggatgggcacacac

SEQ ID NO: 5903222 - DNA, 17 bp, Homo sapiens
gagcggccgcagagact

SEQ ID NO: 5903223 - DNA, 17 bp, Homo sapiens
gagcggccgcctgtcct

SEQ ID NO: 5903224 - DNA, 14 bp, Homo sapiens
gagcggctgaggac

SEQ ID NO: 5903225 - DNA, 23 bp, Homo sapiens
gagcggctgctcgcccaggaagg

SEQ ID NO: 5903226 - DNA, 12 bp, Homo sapiens
gagcggctggag

SEQ ID NO: 5903227 - DNA, 21 bp, Homo sapiens
gagcggcttccccatcgcctt

SEQ ID NO: 5903228 - DNA, 16 bp, Homo sapiens
gagcgggacctgtggc

SEQ ID NO: 5903229 - DNA, 19 bp, Homo sapiens
gagcgggggctaactggcc

SEQ ID NO: 5903230 - DNA, 16 bp, Homo sapiens
gagcggggtatgaaga

SEQ ID NO: 5903231 - DNA, 14 bp, Homo sapiens
gagcggtctcaggc

SEQ ID NO: 5903232 - DNA, 23 bp, Homo sapiens
gagcggtctcaggctggtgggag

SEQ ID NO: 5903233 - DNA, 17 bp, Homo sapiens
gagcggtggccctgtcc

SEQ ID NO: 5903234 - DNA, 17 bp, Homo sapiens
gagcgtaaatgggtcat

SEQ ID NO: 5903235 - DNA, 16 bp, Homo sapiens
gagcgtagcatacagg

SEQ ID NO: 5903236 - DNA, 15 bp, Homo sapiens
gagcgtcactgccca

SEQ ID NO: 5903237 - DNA, 14 bp, Homo sapiens
gagcgtccaggtga

SEQ ID NO: 5903238 - DNA, 22 bp, Homo sapiens
gagcgtcctccatcttccagga

SEQ ID NO: 5903239 - DNA, 12 bp, Homo sapiens
gagcgtccttgg

SEQ ID NO: 5903240 - DNA, 16 bp, Homo sapiens
gagcgtgagctgagca

SEQ ID NO: 5903241 - DNA, 14 bp, Homo sapiens
gagcgtgcgcactg

SEQ ID NO: 5903242 - DNA, 16 bp, Homo sapiens
gagcgtgcgcactgca

SEQ ID NO: 5903243 - DNA, 22 bp, Homo sapiens
gagcgtgcgtctgtgtgtgcct

SEQ ID NO: 5903244 - DNA, 19 bp, Homo sapiens
gagcgtggactctgctaga

SEQ ID NO: 5903245 - DNA, 14 bp, Homo sapiens
gagcgtggccttgg

SEQ ID NO: 5903246 - DNA, 15 bp, Homo sapiens
gagcgtggccttggg

SEQ ID NO: 5903247 - DNA, 16 bp, Homo sapiens
gagcgtggccttggga

SEQ ID NO: 5903248 - DNA, 17 bp, Homo sapiens
gagcgtggccttgggag

SEQ ID NO: 5903249 - DNA, 23 bp, Homo sapiens
gagcgtgggctcagcagggctgg

SEQ ID NO: 5903250 - DNA, 21 bp, Homo sapiens
gagcgtggggaggggctgagg

SEQ ID NO: 5903251 - DNA, 16 bp, Homo sapiens
gagcgtgtcctatccc

SEQ ID NO: 5903252 - DNA, 15 bp, Homo sapiens
gagcgttactgtaga

SEQ ID NO: 5903253 - DNA, 16 bp, Homo sapiens
gagcgttagaggggcc

SEQ ID NO: 5903254 - DNA, 14 bp, Homo sapiens
gagcgttcccagca

SEQ ID NO: 5903255 - DNA, 16 bp, Homo sapiens
gagcgttctctgtcct

SEQ ID NO: 5903256 - DNA, 22 bp, Homo sapiens
gagctaaactccttcctggcct

SEQ ID NO: 5903257 - DNA, 15 bp, Homo sapiens
gagctaaggccagct

SEQ ID NO: 5903258 - DNA, 18 bp, Homo sapiens
gagctaaggccagctaga

SEQ ID NO: 5903259 - DNA, 15 bp, Homo sapiens
gagctaagggtgggt

SEQ ID NO: 5903260 - DNA, 20 bp, Homo sapiens
gagctaagtcacccagagca

SEQ ID NO: 5903261 - DNA, 21 bp, Homo sapiens
gagctaagtcacccagagcac

SEQ ID NO: 5903262 - DNA, 22 bp, Homo sapiens
gagctaatttactggacaaaga

SEQ ID NO: 5903263 - DNA, 22 bp, Homo sapiens
gagctacaaagcatgggaaaaa

SEQ ID NO: 5903264 - DNA, 12 bp, Homo sapiens
gagctacaaatg

SEQ ID NO: 5903265 - DNA, 13 bp, Homo sapiens
gagctacaaatgc

SEQ ID NO: 5903266 - DNA, 20 bp, Homo sapiens
gagctacaacaaaaggactt

SEQ ID NO: 5903267 - DNA, 23 bp, Homo sapiens
gagctacactcattgaaatgtaa

SEQ ID NO: 5903268 - DNA, 17 bp, Homo sapiens
gagctaccaggaagagg

SEQ ID NO: 5903269 - DNA, 18 bp, Homo sapiens
gagctacccgcagagttc

SEQ ID NO: 5903270 - DNA, 17 bp, Homo sapiens
gagctacgcctgcctcc

SEQ ID NO: 5903271 - DNA, 23 bp, Homo sapiens
gagctacgcctgcctcccctgtg

SEQ ID NO: 5903272 - DNA, 19 bp, Homo sapiens
gagctactctcttgccagc

SEQ ID NO: 5903273 - DNA, 14 bp, Homo sapiens
gagctactgagact

SEQ ID NO: 5903274 - DNA, 11 bp, Homo sapiens
gagctactgcc

SEQ ID NO: 5903275 - DNA, 12 bp, Homo sapiens
gagctagaaaat

SEQ ID NO: 5903276 - DNA, 17 bp, Homo sapiens
gagctagaaccctctgt

SEQ ID NO: 5903277 - DNA, 22 bp, Homo sapiens
gagctagaacctagaagggcta

SEQ ID NO: 5903278 - DNA, 18 bp, Homo sapiens
gagctagaagctggagga

SEQ ID NO: 5903279 - DNA, 17 bp, Homo sapiens
gagctagaccaaggtca

SEQ ID NO: 5903280 - DNA, 13 bp, Homo sapiens
gagctagagaaat

SEQ ID NO: 5903281 - DNA, 20 bp, Homo sapiens
gagctagagaggggcctctg

SEQ ID NO: 5903282 - DNA, 18 bp, Homo sapiens
gagctagcaaatacagga

SEQ ID NO: 5903283 - DNA, 12 bp, Homo sapiens
gagctagccaga

SEQ ID NO: 5903284 - DNA, 14 bp, Homo sapiens
gagctagccagagg

SEQ ID NO: 5903285 - DNA, 19 bp, Homo sapiens
gagctagcctccagctttg

SEQ ID NO: 5903286 - DNA, 17 bp, Homo sapiens
gagctagcgatttcaga

SEQ ID NO: 5903287 - DNA, 20 bp, Homo sapiens
gagctagcgatttcagacct

SEQ ID NO: 5903288 - DNA, 16 bp, Homo sapiens
gagctagctagcgcac

SEQ ID NO: 5903289 - DNA, 16 bp, Homo sapiens
gagctagctgccactt

SEQ ID NO: 5903290 - DNA, 13 bp, Homo sapiens
gagctaggagaag

SEQ ID NO: 5903291 - DNA, 19 bp, Homo sapiens
gagctaggagaagggctga

SEQ ID NO: 5903292 - DNA, 17 bp, Homo sapiens
gagctaggagcaaagcc

SEQ ID NO: 5903293 - DNA, 18 bp, Homo sapiens
gagctaggagcaaagcct

SEQ ID NO: 5903294 - DNA, 13 bp, Homo sapiens
gagctaggcaggg

SEQ ID NO: 5903295 - DNA, 14 bp, Homo sapiens
gagctaggctgtgg

SEQ ID NO: 5903296 - DNA, 14 bp, Homo sapiens
gagctagggctgct

SEQ ID NO: 5903297 - DNA, 17 bp, Homo sapiens
gagctagggctgctgct

SEQ ID NO: 5903298 - DNA, 13 bp, Homo sapiens
gagctaggggggt

SEQ ID NO: 5903299 - DNA, 15 bp, Homo sapiens
gagctagtgtcttat

SEQ ID NO: 5903300 - DNA, 17 bp, Homo sapiens
gagctatcctttcaaac

SEQ ID NO: 5903301 - DNA, 16 bp, Homo sapiens
gagctatgataagatt

SEQ ID NO: 5903302 - DNA, 19 bp, Homo sapiens
gagctatgatatgtgcttg

SEQ ID NO: 5903303 - DNA, 23 bp, Homo sapiens
gagctatgatatgtgcttgtgtg

SEQ ID NO: 5903304 - DNA, 19 bp, Homo sapiens
gagctatggcccagaaaca

SEQ ID NO: 5903305 - DNA, 16 bp, Homo sapiens
gagctattaaaactca

SEQ ID NO: 5903306 - DNA, 21 bp, Homo sapiens
gagctatttccttccagcctt

SEQ ID NO: 5903307 - DNA, 19 bp, Homo sapiens
gagctattttagaaagcta

SEQ ID NO: 5903308 - DNA, 14 bp, Homo sapiens
gagctattttcctc

SEQ ID NO: 5903309 - DNA, 15 bp, Homo sapiens
gagctattttcctct

SEQ ID NO: 5903310 - DNA, 17 bp, Homo sapiens
gagctattttcctctgg

SEQ ID NO: 5903311 - DNA, 16 bp, Homo sapiens
gagctcaaggccacct

SEQ ID NO: 5903312 - DNA, 16 bp, Homo sapiens
gagctcacaaggcagc

SEQ ID NO: 5903313 - DNA, 15 bp, Homo sapiens
gagctcacaccgcac

SEQ ID NO: 5903314 - DNA, 22 bp, Homo sapiens
gagctcaccctgcccgctccca

SEQ ID NO: 5903315 - DNA, 18 bp, Homo sapiens
gagctcacctgtttgaaa

SEQ ID NO: 5903316 - DNA, 20 bp, Homo sapiens
gagctcagaaaatatccctc

SEQ ID NO: 5903317 - DNA, 21 bp, Homo sapiens
gagctcagacattttcttttt

SEQ ID NO: 5903318 - DNA, 18 bp, Homo sapiens
gagctcagacccccactc

SEQ ID NO: 5903319 - DNA, 22 bp, Homo sapiens
gagctcagaggagtctgggaag

SEQ ID NO: 5903320 - DNA, 22 bp, Homo sapiens
gagcttccaaggggcaaatttt

SEQ ID NO: 5903321 - DNA, 20 bp, Homo sapiens
gagcttccaattttccttca

SEQ ID NO: 5903322 - DNA, 17 bp, Homo sapiens
gagcttccactgtcagc

SEQ ID NO: 5903323 - DNA, 20 bp, Homo sapiens
gagcttccactgtcagccct

SEQ ID NO: 5903324 - DNA, 20 bp, Homo sapiens
gagcttccagaaatgccaca

SEQ ID NO: 5903325 - DNA, 15 bp, Homo sapiens
gagcttcccaggatc

SEQ ID NO: 5903326 - DNA, 22 bp, Homo sapiens
gagcttcccctaacctgggttg

SEQ ID NO: 5903327 - DNA, 13 bp, Homo sapiens
gagcttccctgac

SEQ ID NO: 5903328 - DNA, 17 bp, Homo sapiens
gagcttccctgactcat

SEQ ID NO: 5903329 - DNA, 22 bp, Homo sapiens
gagcttcccttcctaaaggtaa

SEQ ID NO: 5903330 - DNA, 21 bp, Homo sapiens
gagcttccgctttgaaagaag

SEQ ID NO: 5903331 - DNA, 23 bp, Homo sapiens
gagcttccgctttgaaagaagca

SEQ ID NO: 5903332 - DNA, 13 bp, Homo sapiens
gagcttcctggct

SEQ ID NO: 5903333 - DNA, 15 bp, Homo sapiens
gagcttcctgtttct

SEQ ID NO: 5903334 - DNA, 13 bp, Homo sapiens
gagcttctcctga

SEQ ID NO: 5903335 - DNA, 18 bp, Homo sapiens
gagcttctcctgaccagg

SEQ ID NO: 5903336 - DNA, 19 bp, Homo sapiens
gagcttctctgggctgaat

SEQ ID NO: 5903337 - DNA, 16 bp, Homo sapiens
gagcttctctgtgaac

SEQ ID NO: 5903338 - DNA, 22 bp, Homo sapiens
gagcttctctttaactcaggac

SEQ ID NO: 5903339 - DNA, 18 bp, Homo sapiens
gagcttctggggtcccca

SEQ ID NO: 5903340 - DNA, 19 bp, Homo sapiens
gagcttctggggtccccag

SEQ ID NO: 5903341 - DNA, 20 bp, Homo sapiens
gagcttctggggtccccagg

SEQ ID NO: 5903342 - DNA, 19 bp, Homo sapiens
gagcttctgtattttcaaa

SEQ ID NO: 5903343 - DNA, 21 bp, Homo sapiens
gagcttctgttgctgcctcat

SEQ ID NO: 5903344 - DNA, 18 bp, Homo sapiens
gagcttcttgtttccttg

SEQ ID NO: 5903345 - DNA, 13 bp, Homo sapiens
gagcttgaagatt

SEQ ID NO: 5903346 - DNA, 19 bp, Homo sapiens
gagcttgcaatgagccaag

SEQ ID NO: 5903347 - DNA, 11 bp, Homo sapiens
gagcttgcctg

SEQ ID NO: 5903348 - DNA, 15 bp, Homo sapiens
gagcttgcctgcctg

SEQ ID NO: 5903349 - DNA, 16 bp, Homo sapiens
gagcttgcctgcctgc

SEQ ID NO: 5903350 - DNA, 21 bp, Homo sapiens
gagcttgctccagattctgat

SEQ ID NO: 5903351 - DNA, 13 bp, Homo sapiens
gagcttgctttga

SEQ ID NO: 5903352 - DNA, 12 bp, Homo sapiens
gagcttggagcc

SEQ ID NO: 5903353 - DNA, 17 bp, Homo sapiens
gagcttggagccccctg

SEQ ID NO: 5903354 - DNA, 21 bp, Homo sapiens
gagcttggagccccctggcgg

SEQ ID NO: 5903355 - DNA, 13 bp, Homo sapiens
gagcttggcagag

SEQ ID NO: 5903356 - DNA, 14 bp, Homo sapiens
gagcttggccagaa

SEQ ID NO: 5903357 - DNA, 15 bp, Homo sapiens
gagcttggccagaag

SEQ ID NO: 5903358 - DNA, 13 bp, Homo sapiens
gagcttggccctg

SEQ ID NO: 5903359 - DNA, 13 bp, Homo sapiens
gagcttggctctc

SEQ ID NO: 5903360 - DNA, 22 bp, Homo sapiens
gagcttggctctcctctggcta

SEQ ID NO: 5903361 - DNA, 20 bp, Homo sapiens
gagcttgggaagtcgaggct

SEQ ID NO: 5903362 - DNA, 21 bp, Homo sapiens
gagcttgggactcaggtctgt

SEQ ID NO: 5903363 - DNA, 20 bp, Homo sapiens
gagcttgggggatgactaga

SEQ ID NO: 5903364 - DNA, 22 bp, Homo sapiens
gagcttgggtctctctcggccc

SEQ ID NO: 5903365 - DNA, 16 bp, Homo sapiens
gagcttgtaataaata

SEQ ID NO: 5903366 - DNA, 16 bp, Homo sapiens
gagcttgtagccctgg

SEQ ID NO: 5903367 - DNA, 19 bp, Homo sapiens
gagcttgtagccctggatg

SEQ ID NO: 5903368 - DNA, 23 bp, Homo sapiens
gagcttgtatatacttcactcac

SEQ ID NO: 5903369 - DNA, 17 bp, Homo sapiens
gagcttgtcttttctgc

SEQ ID NO: 5903370 - DNA, 20 bp, Homo sapiens
gagcttgtcttttctgctga

SEQ ID NO: 5903371 - DNA, 23 bp, Homo sapiens
gagcttgttgtctccacttgtat

SEQ ID NO: 5903372 - DNA, 17 bp, Homo sapiens
gagctttaaaagtatct

SEQ ID NO: 5903373 - DNA, 19 bp, Homo sapiens
gagctttacaaaaagacac

SEQ ID NO: 5903374 - DNA, 19 bp, Homo sapiens
gagctttagacagcagagc

SEQ ID NO: 5903375 - DNA, 16 bp, Homo sapiens
gagctttagcttctct

SEQ ID NO: 5903376 - DNA, 23 bp, Homo sapiens
gagctttatggtcctaaaagcaa

SEQ ID NO: 5903377 - DNA, 15 bp, Homo sapiens
gagctttcaaagaag

SEQ ID NO: 5903378 - DNA, 18 bp, Homo sapiens
gagctttcaaagaaggaa

SEQ ID NO: 5903379 - DNA, 17 bp, Homo sapiens
gagctttccatgttgct

SEQ ID NO: 5903380 - DNA, 14 bp, Homo sapiens
gagctttcccagag

SEQ ID NO: 5903381 - DNA, 14 bp, Homo sapiens
gagctttctagcct

SEQ ID NO: 5903382 - DNA, 20 bp, Homo sapiens
gagctttctcaatgtcttcc

SEQ ID NO: 5903383 - DNA, 22 bp, Homo sapiens
gagctttctcaatgtcttccca

SEQ ID NO: 5903384 - DNA, 19 bp, Homo sapiens
gagctttctgaacagctgg

SEQ ID NO: 5903385 - DNA, 20 bp, Homo sapiens
gagctttctgaacagctggt

SEQ ID NO: 5903386 - DNA, 14 bp, Homo sapiens
gagctttctgtgca

SEQ ID NO: 5903387 - DNA, 12 bp, Homo sapiens
gagctttctttt

SEQ ID NO: 5903388 - DNA, 15 bp, Homo sapiens
gagctttgactcagg

SEQ ID NO: 5903389 - DNA, 18 bp, Homo sapiens
gagctttgactcaggagc

SEQ ID NO: 5903390 - DNA, 21 bp, Homo sapiens
gagctttgactcaggagcctg

SEQ ID NO: 5903391 - DNA, 22 bp, Homo sapiens
gagctttgagacaggtgcctgg

SEQ ID NO: 5903392 - DNA, 21 bp, Homo sapiens
gagctttgcagccaaggtgct

SEQ ID NO: 5903393 - DNA, 12 bp, Homo sapiens
gagctttgctgc

SEQ ID NO: 5903394 - DNA, 14 bp, Homo sapiens
gagctttggaatat

SEQ ID NO: 5903395 - DNA, 19 bp, Homo sapiens
gagctttgggtgaccagcc

SEQ ID NO: 5903396 - DNA, 23 bp, Homo sapiens
gagctttgtctacttcaaaagtt

SEQ ID NO: 5903397 - DNA, 18 bp, Homo sapiens
gagcttttaaaaatgttt

SEQ ID NO: 5903398 - DNA, 22 bp, Homo sapiens
gagcttttatttggtgtgttcg

SEQ ID NO: 5903399 - DNA, 21 bp, Homo sapiens
gagcttttcgaactgtgctcc

SEQ ID NO: 5903400 - DNA, 15 bp, Homo sapiens
gagcttttctaggct

SEQ ID NO: 5903401 - DNA, 14 bp, Homo sapiens
gagcttttgtagaa

SEQ ID NO: 5903402 - DNA, 14 bp, Homo sapiens
gagctttttcactc

SEQ ID NO: 5903403 - DNA, 23 bp, Homo sapiens
gaggaaaaaagaaccaaaacttc

SEQ ID NO: 5903404 - DNA, 15 bp, Homo sapiens
gaggaaaaacaacaa

SEQ ID NO: 5903405 - DNA, 22 bp, Homo sapiens
gaggaaaaacagggaaaaaaag

SEQ ID NO: 5903406 - DNA, 19 bp, Homo sapiens
gaggaaaaatgggagccag

SEQ ID NO: 5903407 - DNA, 22 bp, Homo sapiens
gaggaaaacactatttccaaaa

SEQ ID NO: 5903408 - DNA, 23 bp, Homo sapiens
gaggaaaaccaagccgtggcttc

SEQ ID NO: 5903409 - DNA, 15 bp, Homo sapiens
gaggaaaacgggaaa

SEQ ID NO: 5903410 - DNA, 12 bp, Homo sapiens
gaggaaaactat

SEQ ID NO: 5903411 - DNA, 15 bp, Homo sapiens
gaggaaaagaaacct

SEQ ID NO: 5903412 - DNA, 15 bp, Homo sapiens
gaggaaaaggaaaaa

SEQ ID NO: 5903413 - DNA, 23 bp, Homo sapiens
gaggaaaaggcccctgcaatgtg

SEQ ID NO: 5903414 - DNA, 21 bp, Homo sapiens
gaggaaaaggcttgagtctgg

SEQ ID NO: 5903415 - DNA, 20 bp, Homo sapiens
gaggaaaaggtccttgcctc

SEQ ID NO: 5903416 - DNA, 16 bp, Homo sapiens
gaggaaaagtcttcct

SEQ ID NO: 5903417 - DNA, 20 bp, Homo sapiens
gaggaaaagtgcaatgcgtg

SEQ ID NO: 5903418 - DNA, 18 bp, Homo sapiens
gaggaaaatggaagacct

SEQ ID NO: 5903419 - DNA, 21 bp, Homo sapiens
gaggaaacagttctcactggg

SEQ ID NO: 5903420 - DNA, 18 bp, Homo sapiens
gaggaaactactgccttt

SEQ ID NO: 5903421 - DNA, 14 bp, Homo sapiens
gaggaaactcacct

SEQ ID NO: 5903422 - DNA, 23 bp, Homo sapiens
gaggaaactcacctgctggcccc

SEQ ID NO: 5903423 - DNA, 21 bp, Homo sapiens
gaggaaacttcggttgcagat

SEQ ID NO: 5903424 - DNA, 17 bp, Homo sapiens
gaggaaagacaacacaa

SEQ ID NO: 5903425 - DNA, 13 bp, Homo sapiens
gaggaaagacaca

SEQ ID NO: 5903426 - DNA, 14 bp, Homo sapiens
gaggaaagacacag

SEQ ID NO: 5903427 - DNA, 15 bp, Homo sapiens
gaggaaagacacaga

SEQ ID NO: 5903428 - DNA, 16 bp, Homo sapiens
gaggaaagagagcagg

SEQ ID NO: 5903429 - DNA, 16 bp, Homo sapiens
gaggaaagagtcttca

SEQ ID NO: 5903430 - DNA, 23 bp, Homo sapiens
gaggaaaggccagctggcagcag

SEQ ID NO: 5903431 - DNA, 16 bp, Homo sapiens
gaggaaaggcgccccc

SEQ ID NO: 5903432 - DNA, 17 bp, Homo sapiens
gaggaaagggcctggcc

SEQ ID NO: 5903433 - DNA, 19 bp, Homo sapiens
gaggaaaggtttgagaagc

SEQ ID NO: 5903434 - DNA, 18 bp, Homo sapiens
gaggaaagtcattggctt

SEQ ID NO: 5903435 - DNA, 17 bp, Homo sapiens
gaggaaatcccttcata

SEQ ID NO: 5903436 - DNA, 20 bp, Homo sapiens
gaggaaatcccttcatactt

SEQ ID NO: 5903437 - DNA, 22 bp, Homo sapiens
gaggaaatccggtcagccaagt

SEQ ID NO: 5903438 - DNA, 15 bp, Homo sapiens
gaggaaattaaagtc

SEQ ID NO: 5903439 - DNA, 15 bp, Homo sapiens
gaggaaattaaataa

SEQ ID NO: 5903440 - DNA, 14 bp, Homo sapiens
gaggaacaaggcaa

SEQ ID NO: 5903441 - DNA, 19 bp, Homo sapiens
gaggaacattgggaaggaa

SEQ ID NO: 5903442 - DNA, 14 bp, Homo sapiens
gaggaaccagagcc

SEQ ID NO: 5903443 - DNA, 15 bp, Homo sapiens
gaggaaccagagcca

SEQ ID NO: 5903444 - DNA, 22 bp, Homo sapiens
gaggaaccaggagaagggctgg

SEQ ID NO: 5903445 - DNA, 20 bp, Homo sapiens
gaggaacccccaccagacat

SEQ ID NO: 5903446 - DNA, 22 bp, Homo sapiens
gaggaacccccaccagacatca

SEQ ID NO: 5903447 - DNA, 21 bp, Homo sapiens
gaggaaccgaggtgttgccag

SEQ ID NO: 5903448 - DNA, 14 bp, Homo sapiens
gaggaacgggcagc

SEQ ID NO: 5903449 - DNA, 15 bp, Homo sapiens
gaggaacgggcagcc

SEQ ID NO: 5903450 - DNA, 16 bp, Homo sapiens
gaggaacgggcagcca

SEQ ID NO: 5903451 - DNA, 19 bp, Homo sapiens
gaggaacgggcagccacag

SEQ ID NO: 5903452 - DNA, 21 bp, Homo sapiens
gaggaacgggcagccacagga

SEQ ID NO: 5903453 - DNA, 21 bp, Homo sapiens
gaggaacgtggttcagagact

SEQ ID NO: 5903454 - DNA, 22 bp, Homo sapiens
gaggaacgtggttcagagactg

SEQ ID NO: 5903455 - DNA, 23 bp, Homo sapiens
gaggaacgtggttcagagactgg

SEQ ID NO: 5903456 - DNA, 14 bp, Homo sapiens
gaggaactccagga

SEQ ID NO: 5903457 - DNA, 14 bp, Homo sapiens
gaggaactgggcct

SEQ ID NO: 5903458 - DNA, 13 bp, Homo sapiens
gaggaactggtcc

SEQ ID NO: 5903459 - DNA, 19 bp, Homo sapiens
gaggaactggtccaggcca

SEQ ID NO: 5903460 - DNA, 15 bp, Homo sapiens
gaggaactgtacaga

SEQ ID NO: 5903461 - DNA, 15 bp, Homo sapiens
gaggaactgtccaga

SEQ ID NO: 5903462 - DNA, 20 bp, Homo sapiens
gaggaagaagcttaggcagg

SEQ ID NO: 5903463 - DNA, 13 bp, Homo sapiens
gaggaagaatggt

SEQ ID NO: 5903464 - DNA, 22 bp, Homo sapiens
gaggaagacgagacaggacgag

SEQ ID NO: 5903465 - DNA, 17 bp, Homo sapiens
gaggaagagaaaaaata

SEQ ID NO: 5903466 - DNA, 17 bp, Homo sapiens
gaggaagagagagactg

SEQ ID NO: 5903467 - DNA, 19 bp, Homo sapiens
gaggaagatgaagagaagc

SEQ ID NO: 5903468 - DNA, 22 bp, Homo sapiens
gaggaagatgaagagaagctga

SEQ ID NO: 5903469 - DNA, 20 bp, Homo sapiens
gaggaagatgttcaatagaa

SEQ ID NO: 5903470 - DNA, 19 bp, Homo sapiens
gaggaagcacactgcaggg

SEQ ID NO: 5903471 - DNA, 12 bp, Homo sapiens
gaggaagcacat

SEQ ID NO: 5903472 - DNA, 22 bp, Homo sapiens
gaggaagcacataatgtccaga

SEQ ID NO: 5903473 - DNA, 15 bp, Homo sapiens
gaggaagcacctctc

SEQ ID NO: 5903474 - DNA, 17 bp, Homo sapiens
gaggaagcagaataaag

SEQ ID NO: 5903475 - DNA, 19 bp, Homo sapiens
gaggaagcatccaaagatt

SEQ ID NO: 5903476 - DNA, 20 bp, Homo sapiens
gaggaagcatccaaagattg

SEQ ID NO: 5903477 - DNA, 22 bp, Homo sapiens
gaggaagccaggtccacggtct

SEQ ID NO: 5903478 - DNA, 17 bp, Homo sapiens
gaggaagccagtggagc

SEQ ID NO: 5903479 - DNA, 20 bp, Homo sapiens
gaggaagcccaggctcggag

SEQ ID NO: 5903480 - DNA, 19 bp, Homo sapiens
gaggaagccggtgtccctg

SEQ ID NO: 5903481 - DNA, 19 bp, Homo sapiens
gaggaagcctgattaaaga

SEQ ID NO: 5903482 - DNA, 13 bp, Homo sapiens
gaggaagccttgc

SEQ ID NO: 5903483 - DNA, 20 bp, Homo sapiens
gaggaagcgtgaaggccgag

SEQ ID NO: 5903484 - DNA, 11 bp, Homo sapiens
gaggaaggaaa

SEQ ID NO: 5903485 - DNA, 22 bp, Homo sapiens
gaggaaggaaacaacaaaggaa

SEQ ID NO: 5903486 - DNA, 15 bp, Homo sapiens
gaggaaggacccctc

SEQ ID NO: 5903487 - DNA, 14 bp, Homo sapiens
gaggaaggagagaa

SEQ ID NO: 5903488 - DNA, 15 bp, Homo sapiens
gaggaaggattgtaa

SEQ ID NO: 5903489 - DNA, 16 bp, Homo sapiens
gaggaaggcaggaaga

SEQ ID NO: 5903490 - DNA, 15 bp, Homo sapiens
gaggaaggcccaggg

SEQ ID NO: 5903491 - DNA, 23 bp, Homo sapiens
gaggaaggcccaggggtggggcc

SEQ ID NO: 5903492 - DNA, 12 bp, Homo sapiens
gaggaaggctct

SEQ ID NO: 5903493 - DNA, 12 bp, Homo sapiens
gaggaaggctga

SEQ ID NO: 5903494 - DNA, 14 bp, Homo sapiens
gaggaagggactgg

SEQ ID NO: 5903495 - DNA, 17 bp, Homo sapiens
gaggaagggactggtcc

SEQ ID NO: 5903496 - DNA, 22 bp, Homo sapiens
gaggagaaaagtgacagatcct

SEQ ID NO: 5903497 - DNA, 18 bp, Homo sapiens
gaggagaaaggtgaaaca

SEQ ID NO: 5903498 - DNA, 12 bp, Homo sapiens
gaggagaaataa

SEQ ID NO: 5903499 - DNA, 15 bp, Homo sapiens
gaggagaaatgcaat

SEQ ID NO: 5903500 - DNA, 20 bp, Homo sapiens
gaggagaaatgcaataactc

SEQ ID NO: 5903501 - DNA, 18 bp, Homo sapiens
gaggagaacttgctgcct

SEQ ID NO: 5903502 - DNA, 14 bp, Homo sapiens
gaggagaagaaaat

SEQ ID NO: 5903503 - DNA, 12 bp, Homo sapiens
gaggagaagaat

SEQ ID NO: 5903504 - DNA, 14 bp, Homo sapiens
gaggagaaggagag

SEQ ID NO: 5903505 - DNA, 20 bp, Homo sapiens
gaggagaagtattcctgttg

SEQ ID NO: 5903506 - DNA, 15 bp, Homo sapiens
gaggagaagtgggga

SEQ ID NO: 5903507 - DNA, 14 bp, Homo sapiens
gaggagacagacac

SEQ ID NO: 5903508 - DNA, 15 bp, Homo sapiens
gaggagacaggaagc

SEQ ID NO: 5903509 - DNA, 17 bp, Homo sapiens
gaggagaccctcccctg

SEQ ID NO: 5903510 - DNA, 16 bp, Homo sapiens
gaggagaccctggaat

SEQ ID NO: 5903511 - DNA, 18 bp, Homo sapiens
gaggagactcaggcccac

SEQ ID NO: 5903512 - DNA, 15 bp, Homo sapiens
gaggagagaagaatg

SEQ ID NO: 5903513 - DNA, 21 bp, Homo sapiens
gaggagagaagtggccagggc

SEQ ID NO: 5903514 - DNA, 19 bp, Homo sapiens
gaggagagaatgagagagt

SEQ ID NO: 5903515 - DNA, 17 bp, Homo sapiens
gaggagagagaccccgc

SEQ ID NO: 5903516 - DNA, 16 bp, Homo sapiens
gaggagagagatgctg

SEQ ID NO: 5903517 - DNA, 14 bp, Homo sapiens
gaggagagagcctt

SEQ ID NO: 5903518 - DNA, 11 bp, Homo sapiens
gaggagagagg

SEQ ID NO: 5903519 - DNA, 17 bp, Homo sapiens
gaggagagaggaggaaa

SEQ ID NO: 5903520 - DNA, 16 bp, Homo sapiens
gaggagagagggggag

SEQ ID NO: 5903521 - DNA, 18 bp, Homo sapiens
gaggagagagggggagac

SEQ ID NO: 5903522 - DNA, 20 bp, Homo sapiens
gaggagagatagcctgtggc

SEQ ID NO: 5903523 - DNA, 21 bp, Homo sapiens
gaggagagcatctgctctgag

SEQ ID NO: 5903524 - DNA, 22 bp, Homo sapiens
gaggagagcatctgctctgaga

SEQ ID NO: 5903525 - DNA, 13 bp, Homo sapiens
gaggagagccact

SEQ ID NO: 5903526 - DNA, 15 bp, Homo sapiens
gaggagagccactgg

SEQ ID NO: 5903527 - DNA, 13 bp, Homo sapiens
gaggagagccaga

SEQ ID NO: 5903528 - DNA, 17 bp, Homo sapiens
gaggagagccagagaag

SEQ ID NO: 5903529 - DNA, 23 bp, Homo sapiens
gaggagagccagagaagtgacag

SEQ ID NO: 5903530 - DNA, 21 bp, Homo sapiens
gaggagagtacccccctgaga

SEQ ID NO: 5903531 - DNA, 14 bp, Homo sapiens
gaggagagtcccag

SEQ ID NO: 5903532 - DNA, 15 bp, Homo sapiens
gaggagagtcccaga

SEQ ID NO: 5903533 - DNA, 17 bp, Homo sapiens
gaggagagtcccagagc

SEQ ID NO: 5903534 - DNA, 18 bp, Homo sapiens
gaggagagtggcctgggt

SEQ ID NO: 5903535 - DNA, 17 bp, Homo sapiens
gaggagataaggtggct

SEQ ID NO: 5903536 - DNA, 20 bp, Homo sapiens
gaggagatgtgatcaggccc

SEQ ID NO: 5903537 - DNA, 13 bp, Homo sapiens
gaggagcaaagca

SEQ ID NO: 5903538 - DNA, 20 bp, Homo sapiens
gaggagcaacggccccagcg

SEQ ID NO: 5903539 - DNA, 14 bp, Homo sapiens
gaggagcaccccca

SEQ ID NO: 5903540 - DNA, 15 bp, Homo sapiens
gaggagcacccccag

SEQ ID NO: 5903541 - DNA, 23 bp, Homo sapiens
gaggagcacccccagcctccccc

SEQ ID NO: 5903542 - DNA, 16 bp, Homo sapiens
gaggagcacctgaacc

SEQ ID NO: 5903543 - DNA, 14 bp, Homo sapiens
gaggagcagagggc

SEQ ID NO: 5903544 - DNA, 16 bp, Homo sapiens
gaggagcagcaggagg

SEQ ID NO: 5903545 - DNA, 14 bp, Homo sapiens
gaggagcagccagg

SEQ ID NO: 5903546 - DNA, 20 bp, Homo sapiens
gaggagcagcccacctgctg

SEQ ID NO: 5903547 - DNA, 12 bp, Homo sapiens
gaggagcagcct

SEQ ID NO: 5903548 - DNA, 17 bp, Homo sapiens
gaggagcagcctcgagg

SEQ ID NO: 5903549 - DNA, 21 bp, Homo sapiens
gaggagcagcctcgaggctgg

SEQ ID NO: 5903550 - DNA, 14 bp, Homo sapiens
gaggagcagctctc

SEQ ID NO: 5903551 - DNA, 13 bp, Homo sapiens
gaggagcagggtc

SEQ ID NO: 5903552 - DNA, 17 bp, Homo sapiens
gaggagcagtgcaggca

SEQ ID NO: 5903553 - DNA, 22 bp, Homo sapiens
gaggagcatgcgcagaggccag

SEQ ID NO: 5903554 - DNA, 18 bp, Homo sapiens
gaggagccacctgggctg

SEQ ID NO: 5903555 - DNA, 20 bp, Homo sapiens
gaggagccacctgggctggg

SEQ ID NO: 5903556 - DNA, 16 bp, Homo sapiens
gaggagccaggcccca

SEQ ID NO: 5903557 - DNA, 17 bp, Homo sapiens
gaggagccaggccccac

SEQ ID NO: 5903558 - DNA, 21 bp, Homo sapiens
gaggagcccacggggcaaagc

SEQ ID NO: 5903559 - DNA, 23 bp, Homo sapiens
gaggagcccacggggcaaagctg

SEQ ID NO: 5903560 - DNA, 12 bp, Homo sapiens
gaggagcccagg

SEQ ID NO: 5903561 - DNA, 19 bp, Homo sapiens
gaggagcccagtgggctgc

SEQ ID NO: 5903562 - DNA, 15 bp, Homo sapiens
gaggagccccagtgg

SEQ ID NO: 5903563 - DNA, 18 bp, Homo sapiens
gaggagccccatctgtct

SEQ ID NO: 5903564 - DNA, 18 bp, Homo sapiens
gaggagcccctggacatg

SEQ ID NO: 5903565 - DNA, 13 bp, Homo sapiens
gaggagcctcaga

SEQ ID NO: 5903566 - DNA, 12 bp, Homo sapiens
gaggagcctctg

SEQ ID NO: 5903567 - DNA, 12 bp, Homo sapiens
gaggagcctgtc

SEQ ID NO: 5903568 - DNA, 16 bp, Homo sapiens
gaggagcctgtcctgc

SEQ ID NO: 5903569 - DNA, 18 bp, Homo sapiens
gaggagcctgtcctgcct

SEQ ID NO: 5903570 - DNA, 18 bp, Homo sapiens
gaggagccttgctgggcc

SEQ ID NO: 5903571 - DNA, 11 bp, Homo sapiens
gaggagccttt

SEQ ID NO: 5903572 - DNA, 16 bp, Homo sapiens
gaggagcggactcact

SEQ ID NO: 5903573 - DNA, 17 bp, Homo sapiens
gaggagctcagggctgg

SEQ ID NO: 5903574 - DNA, 19 bp, Homo sapiens
gaggagctcagggctggat

SEQ ID NO: 5903575 - DNA, 15 bp, Homo sapiens
gaggagctggagggg

SEQ ID NO: 5903576 - DNA, 16 bp, Homo sapiens
gaggagctggaggggt

SEQ ID NO: 5903577 - DNA, 16 bp, Homo sapiens
gaggagctggcctgcg

SEQ ID NO: 5903578 - DNA, 18 bp, Homo sapiens
gaggagctggcctgcggt

SEQ ID NO: 5903579 - DNA, 19 bp, Homo sapiens
gaggagctgggagccgggc

SEQ ID NO: 5903580 - DNA, 14 bp, Homo sapiens
gaggagctgggccc

SEQ ID NO: 5903581 - DNA, 13 bp, Homo sapiens
gaggagctggggc

SEQ ID NO: 5903582 - DNA, 20 bp, Homo sapiens
gaggagcttccagtgcatgt

SEQ ID NO: 5903583 - DNA, 23 bp, Homo sapiens
gaggagcttccccggccgggaga

SEQ ID NO: 5903584 - DNA, 13 bp, Homo sapiens
gaggagcttctgg

SEQ ID NO: 5903585 - DNA, 15 bp, Homo sapiens
gaggagcttggggga

SEQ ID NO: 5903586 - DNA, 21 bp, Homo sapiens
gaggagcttgggggatgacta

SEQ ID NO: 5903587 - DNA, 18 bp, Homo sapiens
gaggaggaaaaaggctgg

SEQ ID NO: 5903588 - DNA, 18 bp, Homo sapiens
gaggaggaaaaggaaaaa

SEQ ID NO: 5903589 - DNA, 23 bp, Homo sapiens
gaggaggaacgggcagccacagg

SEQ ID NO: 5903590 - DNA, 12 bp, Homo sapiens
gaggaggaagac

SEQ ID NO: 5903591 - DNA, 14 bp, Homo sapiens
gaggaggaagaggg

SEQ ID NO: 5903592 - DNA, 14 bp, Homo sapiens
gaggaggaagcaga

SEQ ID NO: 5903593 - DNA, 19 bp, Homo sapiens
gaggaggaaggagagaagg

SEQ ID NO: 5903594 - DNA, 14 bp, Homo sapiens
gaggaggacccctg

SEQ ID NO: 5903595 - DNA, 18 bp, Homo sapiens
gaggaggacccctgcctt

SEQ ID NO: 5903596 - DNA, 13 bp, Homo sapiens
gaggaggacttgg

SEQ ID NO: 5903597 - DNA, 22 bp, Homo sapiens
gaggaggacttggttgatgttt

SEQ ID NO: 5903598 - DNA, 12 bp, Homo sapiens
gaggaggagaaa

SEQ ID NO: 5903599 - DNA, 14 bp, Homo sapiens
gaggaggagagagt

SEQ ID NO: 5903600 - DNA, 17 bp, Homo sapiens
gaggaggagctggcctg

SEQ ID NO: 5903601 - DNA, 16 bp, Homo sapiens
gaggaggaggaaggca

SEQ ID NO: 5903602 - DNA, 14 bp, Homo sapiens
gaggaggaggacac

SEQ ID NO: 5903603 - DNA, 14 bp, Homo sapiens
gaggaggaggagaa

SEQ ID NO: 5903604 - DNA, 14 bp, Homo sapiens
gaggaggaggagga

SEQ ID NO: 5903605 - DNA, 16 bp, Homo sapiens
gaggaggaggaggagg

SEQ ID NO: 5903606 - DNA, 14 bp, Homo sapiens
gaggaggaggaggt

SEQ ID NO: 5903607 - DNA, 14 bp, Homo sapiens
gaggaggagggaga

SEQ ID NO: 5903608 - DNA, 21 bp, Homo sapiens
gaggaggattgcttcttgtga

SEQ ID NO: 5903609 - DNA, 17 bp, Homo sapiens
gaggaggcagaaagatt

SEQ ID NO: 5903610 - DNA, 15 bp, Homo sapiens
gaggaggcagagagg

SEQ ID NO: 5903611 - DNA, 14 bp, Homo sapiens
gaggaggcagcagg

SEQ ID NO: 5903612 - DNA, 16 bp, Homo sapiens
gaggaggcaggaggag

SEQ ID NO: 5903613 - DNA, 12 bp, Homo sapiens
gaggaggcatgg

SEQ ID NO: 5903614 - DNA, 14 bp, Homo sapiens
gaggaggccagcct

SEQ ID NO: 5903615 - DNA, 22 bp, Homo sapiens
gaggaggcccttaagggaagct

SEQ ID NO: 5903616 - DNA, 17 bp, Homo sapiens
gaggaggcctgcacagg

SEQ ID NO: 5903617 - DNA, 16 bp, Homo sapiens
gaggaggcctggaccg

SEQ ID NO: 5903618 - DNA, 21 bp, Homo sapiens
gaggaggcctgggggcaggga

SEQ ID NO: 5903619 - DNA, 22 bp, Homo sapiens
gaggaggccttgggctctgctg

SEQ ID NO: 5903620 - DNA, 16 bp, Homo sapiens
gaggaggcgcggcctc

SEQ ID NO: 5903621 - DNA, 18 bp, Homo sapiens
gaggaggctccagagggc

SEQ ID NO: 5903622 - DNA, 17 bp, Homo sapiens
gaggaggctgcttccta

SEQ ID NO: 5903623 - DNA, 13 bp, Homo sapiens
gaggaggctggtg

SEQ ID NO: 5903624 - DNA, 15 bp, Homo sapiens
gaggagggaatgatt

SEQ ID NO: 5903625 - DNA, 11 bp, Homo sapiens
gaggagggaga

SEQ ID NO: 5903626 - DNA, 17 bp, Homo sapiens
gaggagggagaagagaa

SEQ ID NO: 5903627 - DNA, 17 bp, Homo sapiens
gaggagggagagccctg

SEQ ID NO: 5903628 - DNA, 16 bp, Homo sapiens
gaggagggaggccagg

SEQ ID NO: 5903629 - DNA, 18 bp, Homo sapiens
gaggagggaggcggcctc

SEQ ID NO: 5903630 - DNA, 15 bp, Homo sapiens
gaggagggagtgctg

SEQ ID NO: 5903631 - DNA, 22 bp, Homo sapiens
gaggagggatgctgctccgccc

SEQ ID NO: 5903632 - DNA, 15 bp, Homo sapiens
gaggagggcaggcat

SEQ ID NO: 5903633 - DNA, 17 bp, Homo sapiens
gaggagggcagtccaag

SEQ ID NO: 5903634 - DNA, 18 bp, Homo sapiens
gaggagggcatgggttgg

SEQ ID NO: 5903635 - DNA, 22 bp, Homo sapiens
gaggagggcatgggttggcagg

SEQ ID NO: 5903636 - DNA, 14 bp, Homo sapiens
gaggagggccctga

SEQ ID NO: 5903637 - DNA, 17 bp, Homo sapiens
gaggagggccctgagga

SEQ ID NO: 5903638 - DNA, 18 bp, Homo sapiens
gaggagggccctgaggaa

SEQ ID NO: 5903639 - DNA, 19 bp, Homo sapiens
gaggagggccctgaggaat

SEQ ID NO: 5903640 - DNA, 18 bp, Homo sapiens
gaggaggggaagaaggaa

SEQ ID NO: 5903641 - DNA, 19 bp, Homo sapiens
gaggaggggaagctgggcc

SEQ ID NO: 5903642 - DNA, 14 bp, Homo sapiens
gaggaggggaaggg

SEQ ID NO: 5903643 - DNA, 21 bp, Homo sapiens
gaggaggggaaggggctgagg

SEQ ID NO: 5903644 - DNA, 12 bp, Homo sapiens
gaggaggggagc

SEQ ID NO: 5903645 - DNA, 16 bp, Homo sapiens
gaggaggggcacctgc

SEQ ID NO: 5903646 - DNA, 22 bp, Homo sapiens
gaggaggggcccggtggcggca

SEQ ID NO: 5903647 - DNA, 14 bp, Homo sapiens
gaggaggggcggga

SEQ ID NO: 5903648 - DNA, 19 bp, Homo sapiens
gaggagggggcaggctgag

SEQ ID NO: 5903649 - DNA, 15 bp, Homo sapiens
gaggaggggtgtggg

SEQ ID NO: 5903650 - DNA, 21 bp, Homo sapiens
gaggagggtttgggcagagcg

SEQ ID NO: 5903651 - DNA, 17 bp, Homo sapiens
gaggaggtcgaatgggt

SEQ ID NO: 5903652 - DNA, 14 bp, Homo sapiens
gaggaggtgcccgg

SEQ ID NO: 5903653 - DNA, 20 bp, Homo sapiens
gaggaggtgcccgggcaggg

SEQ ID NO: 5903654 - DNA, 20 bp, Homo sapiens
gaggaggtggcagccctgta

SEQ ID NO: 5903655 - DNA, 22 bp, Homo sapiens
gaggaggtgtcccaagctttga

SEQ ID NO: 5903656 - DNA, 19 bp, Homo sapiens
gaggaggtgtctggggtga

SEQ ID NO: 5903657 - DNA, 16 bp, Homo sapiens
gaggaggtgtggagtg

SEQ ID NO: 5903658 - DNA, 14 bp, Homo sapiens
gaggagtaaaattc

SEQ ID NO: 5903659 - DNA, 21 bp, Homo sapiens
gaggagtaaataattggaaaa

SEQ ID NO: 5903660 - DNA, 20 bp, Homo sapiens
gaggagtaacaatacaaatg

SEQ ID NO: 5903661 - DNA, 19 bp, Homo sapiens
gaggagtagctgagaggaa

SEQ ID NO: 5903662 - DNA, 20 bp, Homo sapiens
gaggagtagctgagaggaag

SEQ ID NO: 5903663 - DNA, 15 bp, Homo sapiens
gaggagtcaggggct

SEQ ID NO: 5903664 - DNA, 11 bp, Homo sapiens
gaggagtccaa

SEQ ID NO: 5903665 - DNA, 14 bp, Homo sapiens
gaggagtccaaaat

SEQ ID NO: 5903666 - DNA, 18 bp, Homo sapiens
gaggagtctgaggtcctg

SEQ ID NO: 5903667 - DNA, 23 bp, Homo sapiens
gaggagtctgaggtcctgagcac

SEQ ID NO: 5903668 - DNA, 14 bp, Homo sapiens
gaggagtctgggaa

SEQ ID NO: 5903669 - DNA, 14 bp, Homo sapiens
gaggagtcttgtgt

SEQ ID NO: 5903670 - DNA, 16 bp, Homo sapiens
gaggagtgatgggcaa

SEQ ID NO: 5903671 - DNA, 17 bp, Homo sapiens
gaggagtgatgggcaag

SEQ ID NO: 5903672 - DNA, 14 bp, Homo sapiens
gaggagtgcagcct

SEQ ID NO: 5903673 - DNA, 21 bp, Homo sapiens
gaggagtgcagccttctccat

SEQ ID NO: 5903674 - DNA, 19 bp, Homo sapiens
gaggagtggatctgtagaa

SEQ ID NO: 5903675 - DNA, 21 bp, Homo sapiens
gaggagtggattcctccccac

SEQ ID NO: 5903676 - DNA, 23 bp, Homo sapiens
gaggcccctgggctctcacccag

SEQ ID NO: 5903677 - DNA, 20 bp, Homo sapiens
gaggcccctgtctcagggtg

SEQ ID NO: 5903678 - DNA, 19 bp, Homo sapiens
gaggccccttctaggtggc

SEQ ID NO: 5903679 - DNA, 17 bp, Homo sapiens
gaggccccttctctccc

SEQ ID NO: 5903680 - DNA, 19 bp, Homo sapiens
gaggccccttgctgctggc

SEQ ID NO: 5903681 - DNA, 20 bp, Homo sapiens
gaggcccgcatgcggcccag

SEQ ID NO: 5903682 - DNA, 19 bp, Homo sapiens
gaggccctaggcgggatgg

SEQ ID NO: 5903683 - DNA, 21 bp, Homo sapiens
gaggccctcaatccaccttca

SEQ ID NO: 5903684 - DNA, 12 bp, Homo sapiens
gaggccctccac

SEQ ID NO: 5903685 - DNA, 21 bp, Homo sapiens
gaggccctccacacctgcggc

SEQ ID NO: 5903686 - DNA, 20 bp, Homo sapiens
gaggccctcccaaagaggcc

SEQ ID NO: 5903687 - DNA, 23 bp, Homo sapiens
gaggccctcccaaagaggcccgc

SEQ ID NO: 5903688 - DNA, 14 bp, Homo sapiens
gaggccctcctgtg

SEQ ID NO: 5903689 - DNA, 19 bp, Homo sapiens
gaggccctcgggcccagcc

SEQ ID NO: 5903690 - DNA, 13 bp, Homo sapiens
gaggccctgaagc

SEQ ID NO: 5903691 - DNA, 11 bp, Homo sapiens
gaggccctgca

SEQ ID NO: 5903692 - DNA, 14 bp, Homo sapiens
gaggccctgcacct

SEQ ID NO: 5903693 - DNA, 19 bp, Homo sapiens
gaggccctgcaccttcccc

SEQ ID NO: 5903694 - DNA, 14 bp, Homo sapiens
gaggccctgcatgg

SEQ ID NO: 5903695 - DNA, 14 bp, Homo sapiens
gaggccctgccacg

SEQ ID NO: 5903696 - DNA, 17 bp, Homo sapiens
gaggccctgccacgtcc

SEQ ID NO: 5903697 - DNA, 14 bp, Homo sapiens
gaggccctgcctga

SEQ ID NO: 5903698 - DNA, 14 bp, Homo sapiens
gaggccctggaggt

SEQ ID NO: 5903699 - DNA, 19 bp, Homo sapiens
gaggccctggaggtctcca

SEQ ID NO: 5903700 - DNA, 21 bp, Homo sapiens
gaggccctggaggtctccagg

SEQ ID NO: 5903701 - DNA, 22 bp, Homo sapiens
gaggccctggaggtctccaggg

SEQ ID NO: 5903702 - DNA, 12 bp, Homo sapiens
gaggccctggat

SEQ ID NO: 5903703 - DNA, 22 bp, Homo sapiens
gaggccctggatcagcgtggcc

SEQ ID NO: 5903704 - DNA, 15 bp, Homo sapiens
gaggccctggcagaa

SEQ ID NO: 5903705 - DNA, 13 bp, Homo sapiens
gaggccctggccc

SEQ ID NO: 5903706 - DNA, 13 bp, Homo sapiens
gaggccctgggct

SEQ ID NO: 5903707 - DNA, 14 bp, Homo sapiens
gaggccctgggctg

SEQ ID NO: 5903708 - DNA, 18 bp, Homo sapiens
gaggccctgggctgggtg

SEQ ID NO: 5903709 - DNA, 19 bp, Homo sapiens
gaggccctggtcctggcct

SEQ ID NO: 5903710 - DNA, 22 bp, Homo sapiens
gaggccctgtgccccttgacaa

SEQ ID NO: 5903711 - DNA, 22 bp, Homo sapiens
gaggcccttctctccagcccct

SEQ ID NO: 5903712 - DNA, 23 bp, Homo sapiens
gaggcccttctctccagcccctg

SEQ ID NO: 5903713 - DNA, 18 bp, Homo sapiens
gaggcccttgtcgtggga

SEQ ID NO: 5903714 - DNA, 21 bp, Homo sapiens
gaggcccttgtcgtgggatgg

SEQ ID NO: 5903715 - DNA, 21 bp, Homo sapiens
gaggcccttttctggctcctg

SEQ ID NO: 5903716 - DNA, 20 bp, Homo sapiens
gaggccgaaggtgcctcaga

SEQ ID NO: 5903717 - DNA, 15 bp, Homo sapiens
gaggccgactgggct

SEQ ID NO: 5903718 - DNA, 23 bp, Homo sapiens
gaggccgactgggctgctggggc

SEQ ID NO: 5903719 - DNA, 15 bp, Homo sapiens
gaggccgaggaccac

SEQ ID NO: 5903720 - DNA, 15 bp, Homo sapiens
gaggccgaggcacga

SEQ ID NO: 5903721 - DNA, 16 bp, Homo sapiens
gaggccgaggcagggg

SEQ ID NO: 5903722 - DNA, 14 bp, Homo sapiens
gaggccgaggccat

SEQ ID NO: 5903723 - DNA, 18 bp, Homo sapiens
gaggccgaggtgggcaga

SEQ ID NO: 5903724 - DNA, 17 bp, Homo sapiens
gaggccgagtctgtcct

SEQ ID NO: 5903725 - DNA, 15 bp, Homo sapiens
gaggccgctagaggc

SEQ ID NO: 5903726 - DNA, 17 bp, Homo sapiens
gaggccgctgcccctga

SEQ ID NO: 5903727 - DNA, 18 bp, Homo sapiens
gaggccggagagctggtg

SEQ ID NO: 5903728 - DNA, 14 bp, Homo sapiens
gaggccggccctgc

SEQ ID NO: 5903729 - DNA, 16 bp, Homo sapiens
gaggccggccctgccc

SEQ ID NO: 5903730 - DNA, 13 bp, Homo sapiens
gaggccgggccct

SEQ ID NO: 5903731 - DNA, 18 bp, Homo sapiens
gaggccggggggagcagg

SEQ ID NO: 5903732 - DNA, 19 bp, Homo sapiens
gaggccggggtccaggccc

SEQ ID NO: 5903733 - DNA, 14 bp, Homo sapiens
gaggccgtggctgc

SEQ ID NO: 5903734 - DNA, 19 bp, Homo sapiens
gaggcctacagaggaggcc

SEQ ID NO: 5903735 - DNA, 17 bp, Homo sapiens
gaggcctacctgctccc

SEQ ID NO: 5903736 - DNA, 18 bp, Homo sapiens
gaggcctactcttccatc

SEQ ID NO: 5903737 - DNA, 18 bp, Homo sapiens
gaggcctaggagggtcct

SEQ ID NO: 5903738 - DNA, 21 bp, Homo sapiens
gaggcctagtcagccacatgg

SEQ ID NO: 5903739 - DNA, 20 bp, Homo sapiens
gaggcctattgttgaataaa

SEQ ID NO: 5903740 - DNA, 15 bp, Homo sapiens
gaggcctcaccctgc

SEQ ID NO: 5903741 - DNA, 22 bp, Homo sapiens
gaggcctcactactcgagccca

SEQ ID NO: 5903742 - DNA, 16 bp, Homo sapiens
gaggcctcagtggact

SEQ ID NO: 5903743 - DNA, 15 bp, Homo sapiens
gaggcctcatccctc

SEQ ID NO: 5903744 - DNA, 16 bp, Homo sapiens
gaggcctcatgcctgc

SEQ ID NO: 5903745 - DNA, 20 bp, Homo sapiens
gaggcctcatgcctgctgag

SEQ ID NO: 5903746 - DNA, 19 bp, Homo sapiens
gaggcctccactccttcca

SEQ ID NO: 5903747 - DNA, 17 bp, Homo sapiens
gaggcctcggctgtctc

SEQ ID NO: 5903748 - DNA, 19 bp, Homo sapiens
gaggcctcgtaccagccag

SEQ ID NO: 5903749 - DNA, 15 bp, Homo sapiens
gaggcctctctcagg

SEQ ID NO: 5903750 - DNA, 14 bp, Homo sapiens
gaggcctctggccc

SEQ ID NO: 5903751 - DNA, 18 bp, Homo sapiens
gaggcctgaagccagctg

SEQ ID NO: 5903752 - DNA, 22 bp, Homo sapiens
gaggcctgacacaggccagcct

SEQ ID NO: 5903753 - DNA, 18 bp, Homo sapiens
gaggcctgactgccaagc

SEQ ID NO: 5903754 - DNA, 13 bp, Homo sapiens
gaggcctgaggat

SEQ ID NO: 5903755 - DNA, 14 bp, Homo sapiens
gaggcctgaggcct

SEQ ID NO: 5903756 - DNA, 15 bp, Homo sapiens
gaggcctgaggcctg

SEQ ID NO: 5903757 - DNA, 17 bp, Homo sapiens
gaggcctgaggcctgtg

SEQ ID NO: 5903758 - DNA, 20 bp, Homo sapiens
gaggcctgaggcctgtgcct

SEQ ID NO: 5903759 - DNA, 14 bp, Homo sapiens
gaggcctgaggggc

SEQ ID NO: 5903760 - DNA, 16 bp, Homo sapiens
gaggcctgaggggcag

SEQ ID NO: 5903761 - DNA, 13 bp, Homo sapiens
gaggcctgatgct

SEQ ID NO: 5903762 - DNA, 15 bp, Homo sapiens
gaggcctgatgctgc

SEQ ID NO: 5903763 - DNA, 23 bp, Homo sapiens
gaggcctgcaaaccttcctggga

SEQ ID NO: 5903764 - DNA, 14 bp, Homo sapiens
gaggcctgcagggc

SEQ ID NO: 5903765 - DNA, 12 bp, Homo sapiens
gaggcctgcccg

SEQ ID NO: 5903766 - DNA, 13 bp, Homo sapiens
gaggcctgcccgg

SEQ ID NO: 5903767 - DNA, 19 bp, Homo sapiens
gaggcctgcctccagggct

SEQ ID NO: 5903768 - DNA, 22 bp, Homo sapiens
gaggcctgcctccagggctgga

SEQ ID NO: 5903769 - DNA, 13 bp, Homo sapiens
gaggcctgcttcc

SEQ ID NO: 5903770 - DNA, 16 bp, Homo sapiens
gaggcctggccaatgc

SEQ ID NO: 5903771 - DNA, 15 bp, Homo sapiens
gaggcctggccaggc

SEQ ID NO: 5903772 - DNA, 16 bp, Homo sapiens
gaggcctggccaggca

SEQ ID NO: 5903773 - DNA, 17 bp, Homo sapiens
gaggcctggccaggcac

SEQ ID NO: 5903774 - DNA, 15 bp, Homo sapiens
gaggcctggctctgg

SEQ ID NO: 5903775 - DNA, 17 bp, Homo sapiens
gaggcctgggagatgca

SEQ ID NO: 5903776 - DNA, 13 bp, Homo sapiens
gaggcctgggagg

SEQ ID NO: 5903777 - DNA, 14 bp, Homo sapiens
gaggcctgggccgc

SEQ ID NO: 5903778 - DNA, 17 bp, Homo sapiens
gaggcctgggctgggaa

SEQ ID NO: 5903779 - DNA, 15 bp, Homo sapiens
gaggcctggggccgg

SEQ ID NO: 5903780 - DNA, 22 bp, Homo sapiens
gaggcctggggccggtagaggc

SEQ ID NO: 5903781 - DNA, 13 bp, Homo sapiens
gaggcctgggggt

SEQ ID NO: 5903782 - DNA, 12 bp, Homo sapiens
gaggcctggggt

SEQ ID NO: 5903783 - DNA, 21 bp, Homo sapiens
gaggcctgggtgtgacctgac

SEQ ID NO: 5903784 - DNA, 10 bp, Homo sapiens
gaggcctggt

SEQ ID NO: 5903785 - DNA, 19 bp, Homo sapiens
gaggcctggtctggagccc

SEQ ID NO: 5903786 - DNA, 16 bp, Homo sapiens
gaggcctggtgccctg

SEQ ID NO: 5903787 - DNA, 17 bp, Homo sapiens
gaggcctggtgccctgg

SEQ ID NO: 5903788 - DNA, 20 bp, Homo sapiens
gaggcctggtgccctggccc

SEQ ID NO: 5903789 - DNA, 21 bp, Homo sapiens
gaggccttatgagggtcctct

SEQ ID NO: 5903790 - DNA, 21 bp, Homo sapiens
gaggccttcagaaaagacact

SEQ ID NO: 5903791 - DNA, 15 bp, Homo sapiens
gaggccttccagctg

SEQ ID NO: 5903792 - DNA, 19 bp, Homo sapiens
gaggccttccagctgctgt

SEQ ID NO: 5903793 - DNA, 16 bp, Homo sapiens
gaggccttctctgaag

SEQ ID NO: 5903794 - DNA, 19 bp, Homo sapiens
gaggccttctctgaaggac

SEQ ID NO: 5903795 - DNA, 19 bp, Homo sapiens
gaggccttgggctctgctg

SEQ ID NO: 5903796 - DNA, 17 bp, Homo sapiens
gaggccttgggggtctg

SEQ ID NO: 5903797 - DNA, 17 bp, Homo sapiens
gaggccttggggtgggg

SEQ ID NO: 5903798 - DNA, 19 bp, Homo sapiens
gaggccttggggtgggggc

SEQ ID NO: 5903799 - DNA, 17 bp, Homo sapiens
gaggcctttccccagtg

SEQ ID NO: 5903800 - DNA, 19 bp, Homo sapiens
gaggcctttccctaagcca

SEQ ID NO: 5903801 - DNA, 22 bp, Homo sapiens
gaggcctttccctaagccagct

SEQ ID NO: 5903802 - DNA, 17 bp, Homo sapiens
gaggcgaataaatgttc

SEQ ID NO: 5903803 - DNA, 12 bp, Homo sapiens
gaggcgagcagg

SEQ ID NO: 5903804 - DNA, 15 bp, Homo sapiens
gaggcgagcagggca

SEQ ID NO: 5903805 - DNA, 13 bp, Homo sapiens
gaggcgagccaga

SEQ ID NO: 5903806 - DNA, 21 bp, Homo sapiens
gaggcgagccagattaggcct

SEQ ID NO: 5903807 - DNA, 14 bp, Homo sapiens
gaggcgagccaggc

SEQ ID NO: 5903808 - DNA, 17 bp, Homo sapiens
gaggcgaggctgcctct

SEQ ID NO: 5903809 - DNA, 18 bp, Homo sapiens
gaggcgaggctgcctctg

SEQ ID NO: 5903810 - DNA, 22 bp, Homo sapiens
gaggcgcactttcctcctggca

SEQ ID NO: 5903811 - DNA, 21 bp, Homo sapiens
gaggcgcagcccgaagcccag

SEQ ID NO: 5903812 - DNA, 17 bp, Homo sapiens
gaggcgcagggacatgg

SEQ ID NO: 5903813 - DNA, 15 bp, Homo sapiens
gaggcgcccacctgc

SEQ ID NO: 5903814 - DNA, 16 bp, Homo sapiens
gaggcgcccacctgcc

SEQ ID NO: 5903815 - DNA, 18 bp, Homo sapiens
gaggcgcccacctgccca

SEQ ID NO: 5903816 - DNA, 17 bp, Homo sapiens
gaggcgccccaacccgt

SEQ ID NO: 5903817 - DNA, 17 bp, Homo sapiens
gaggcgccttcctgggt

SEQ ID NO: 5903818 - DNA, 14 bp, Homo sapiens
gaggcgcggagtga

SEQ ID NO: 5903819 - DNA, 14 bp, Homo sapiens
gaggcgcgggggcc

SEQ ID NO: 5903820 - DNA, 14 bp, Homo sapiens
gaggcgcgtctgcc

SEQ ID NO: 5903821 - DNA, 19 bp, Homo sapiens
gaggcggaaaccttgcagc

SEQ ID NO: 5903822 - DNA, 20 bp, Homo sapiens
gaggcggaaaccttgcagca

SEQ ID NO: 5903823 - DNA, 18 bp, Homo sapiens
gaggcggacgttccagcc

SEQ ID NO: 5903824 - DNA, 19 bp, Homo sapiens
gaggcggagagtacagtga

SEQ ID NO: 5903825 - DNA, 14 bp, Homo sapiens
gaggcggagcccag

SEQ ID NO: 5903826 - DNA, 13 bp, Homo sapiens
gaggcggaggctg

SEQ ID NO: 5903827 - DNA, 18 bp, Homo sapiens
gaggcggaggctgtgctc

SEQ ID NO: 5903828 - DNA, 20 bp, Homo sapiens
gaggcggcacattggcagtg

SEQ ID NO: 5903829 - DNA, 13 bp, Homo sapiens
gaggcggcagctc

SEQ ID NO: 5903830 - DNA, 20 bp, Homo sapiens
gaggcggccccggccggggt

SEQ ID NO: 5903831 - DNA, 14 bp, Homo sapiens
gaggcggcccggcc

SEQ ID NO: 5903832 - DNA, 16 bp, Homo sapiens
gaggcggcccggccag

SEQ ID NO: 5903833 - DNA, 23 bp, Homo sapiens
gaggcggcccggccagcgggcac

SEQ ID NO: 5903834 - DNA, 16 bp, Homo sapiens
gaggcggctccaggtc

SEQ ID NO: 5903835 - DNA, 20 bp, Homo sapiens
gaggcggctccaggtccgga

SEQ ID NO: 5903836 - DNA, 15 bp, Homo sapiens
gaggcgggagaatca

SEQ ID NO: 5903837 - DNA, 20 bp, Homo sapiens
gaggcgggagaatcatgtga

SEQ ID NO: 5903838 - DNA, 17 bp, Homo sapiens
gaggcgggccagccagg

SEQ ID NO: 5903839 - DNA, 13 bp, Homo sapiens
gaggcggggagga

SEQ ID NO: 5903840 - DNA, 18 bp, Homo sapiens
gaggcggggaggaggaac

SEQ ID NO: 5903841 - DNA, 16 bp, Homo sapiens
gaggcgggggagcctg

SEQ ID NO: 5903842 - DNA, 19 bp, Homo sapiens
gaggcgggggatcctggag

SEQ ID NO: 5903843 - DNA, 19 bp, Homo sapiens
gaggcgggtggatcacttg

SEQ ID NO: 5903844 - DNA, 19 bp, Homo sapiens
gaggcggtggtagagagag

SEQ ID NO: 5903845 - DNA, 19 bp, Homo sapiens
gaggcggtttgggagaaca

SEQ ID NO: 5903846 - DNA, 18 bp, Homo sapiens
gaggcgtactacccagct

SEQ ID NO: 5903847 - DNA, 20 bp, Homo sapiens
gaggcgtactacccagctct

SEQ ID NO: 5903848 - DNA, 14 bp, Homo sapiens
gaggcgtcctggtg

SEQ ID NO: 5903849 - DNA, 13 bp, Homo sapiens
gaggcgtcttgta

SEQ ID NO: 5903850 - DNA, 16 bp, Homo sapiens
gaggcgtcttgtattt

SEQ ID NO: 5903851 - DNA, 16 bp, Homo sapiens
gaggcgtggaggagag

SEQ ID NO: 5903852 - DNA, 18 bp, Homo sapiens
gaggcgtggaggagagga

SEQ ID NO: 5903853 - DNA, 19 bp, Homo sapiens
gaggcgtggaggagaggag

SEQ ID NO: 5903854 - DNA, 20 bp, Homo sapiens
gaggcgtggaggagaggaga

SEQ ID NO: 5903855 - DNA, 19 bp, Homo sapiens
gaggctttaagctccagct

SEQ ID NO: 5903856 - DNA, 16 bp, Homo sapiens
gaggctttcaaatgta

SEQ ID NO: 5903857 - DNA, 19 bp, Homo sapiens
gaggctttcagtgatatct

SEQ ID NO: 5903858 - DNA, 16 bp, Homo sapiens
gaggctttctgggctc

SEQ ID NO: 5903859 - DNA, 18 bp, Homo sapiens
gaggctttctgggctctg

SEQ ID NO: 5903860 - DNA, 20 bp, Homo sapiens
gaggctttctgggctctgga

SEQ ID NO: 5903861 - DNA, 14 bp, Homo sapiens
gaggctttggattt

SEQ ID NO: 5903862 - DNA, 16 bp, Homo sapiens
gaggctttgggtggct

SEQ ID NO: 5903863 - DNA, 18 bp, Homo sapiens
gaggctttggtaccccca

SEQ ID NO: 5903864 - DNA, 14 bp, Homo sapiens
gaggctttgtgttg

SEQ ID NO: 5903865 - DNA, 16 bp, Homo sapiens
gaggcttttccagtgt

SEQ ID NO: 5903866 - DNA, 18 bp, Homo sapiens
gaggcttttcccaccagc

SEQ ID NO: 5903867 - DNA, 20 bp, Homo sapiens
gaggcttttcccaccagctc

SEQ ID NO: 5903868 - DNA, 13 bp, Homo sapiens
gagggaaaacaga

SEQ ID NO: 5903869 - DNA, 12 bp, Homo sapiens
gagggaaaagct

SEQ ID NO: 5903870 - DNA, 16 bp, Homo sapiens
gagggaaaagctaaga

SEQ ID NO: 5903871 - DNA, 18 bp, Homo sapiens
gagggaaaagctaagagg

SEQ ID NO: 5903872 - DNA, 16 bp, Homo sapiens
gagggaaaaggcaggt

SEQ ID NO: 5903873 - DNA, 12 bp, Homo sapiens
gagggaaacctt

SEQ ID NO: 5903874 - DNA, 13 bp, Homo sapiens
gagggaaaccttt

SEQ ID NO: 5903875 - DNA, 19 bp, Homo sapiens
gagggaaactcagatgtcc

SEQ ID NO: 5903876 - DNA, 17 bp, Homo sapiens
gagggaaactctggaga

SEQ ID NO: 5903877 - DNA, 20 bp, Homo sapiens
gagggaaactctggagagcc

SEQ ID NO: 5903878 - DNA, 22 bp, Homo sapiens
gagggaaactctggagagcctg

SEQ ID NO: 5903879 - DNA, 15 bp, Homo sapiens
gagggaaagtgcata

SEQ ID NO: 5903880 - DNA, 16 bp, Homo sapiens
gagggaaatacaagga

SEQ ID NO: 5903881 - DNA, 20 bp, Homo sapiens
gagggaaatctgtaaagcca

SEQ ID NO: 5903882 - DNA, 14 bp, Homo sapiens
gagggaaatgtaca

SEQ ID NO: 5903883 - DNA, 19 bp, Homo sapiens
gagggaaattgtaaatcct

SEQ ID NO: 5903884 - DNA, 20 bp, Homo sapiens
gagggaaattgtaaatcctg

SEQ ID NO: 5903885 - DNA, 13 bp, Homo sapiens
gagggaacaaaac

SEQ ID NO: 5903886 - DNA, 16 bp, Homo sapiens
gagggaacaaattttc

SEQ ID NO: 5903887 - DNA, 15 bp, Homo sapiens
gagggaacagacagg

SEQ ID NO: 5903888 - DNA, 18 bp, Homo sapiens
gagggaacagacaggaga

SEQ ID NO: 5903889 - DNA, 19 bp, Homo sapiens
gagggaacagacaggagaa

SEQ ID NO: 5903890 - DNA, 22 bp, Homo sapiens
gagggaacatcctaagacagag

SEQ ID NO: 5903891 - DNA, 17 bp, Homo sapiens
gagggaaccaccagcgt

SEQ ID NO: 5903892 - DNA, 21 bp, Homo sapiens
gagggaagacctgaaagagag

SEQ ID NO: 5903893 - DNA, 18 bp, Homo sapiens
gagggaagagggagacca

SEQ ID NO: 5903894 - DNA, 21 bp, Homo sapiens
gagggaagatgacctgcccca

SEQ ID NO: 5903895 - DNA, 14 bp, Homo sapiens
gagggaagctgagg

SEQ ID NO: 5903896 - DNA, 15 bp, Homo sapiens
gagggaaggagccca

SEQ ID NO: 5903897 - DNA, 17 bp, Homo sapiens
gagggaaggatttagga

SEQ ID NO: 5903898 - DNA, 19 bp, Homo sapiens
gagggaagggagccaaggg

SEQ ID NO: 5903899 - DNA, 14 bp, Homo sapiens
gagggaagggccac

SEQ ID NO: 5903900 - DNA, 15 bp, Homo sapiens
gagggaagggccacc

SEQ ID NO: 5903901 - DNA, 16 bp, Homo sapiens
gagggaagggccaccc

SEQ ID NO: 5903902 - DNA, 14 bp, Homo sapiens
gagggaaggggatg

SEQ ID NO: 5903903 - DNA, 19 bp, Homo sapiens
gagggaaggggatggaggc

SEQ ID NO: 5903904 - DNA, 23 bp, Homo sapiens
gagggaaggggatggaggccaga

SEQ ID NO: 5903905 - DNA, 19 bp, Homo sapiens
gagggaagggtttctctat

SEQ ID NO: 5903906 - DNA, 20 bp, Homo sapiens
gagggaagggtttctctatt

SEQ ID NO: 5903907 - DNA, 18 bp, Homo sapiens
gagggaagtcctgggagg

SEQ ID NO: 5903908 - DNA, 16 bp, Homo sapiens
gagggaagtgtgagcg

SEQ ID NO: 5903909 - DNA, 23 bp, Homo sapiens
gagggaagtgtgagcgccttggt

SEQ ID NO: 5903910 - DNA, 14 bp, Homo sapiens
gagggaataaatca

SEQ ID NO: 5903911 - DNA, 22 bp, Homo sapiens
gagggaatccatatcagctctg

SEQ ID NO: 5903912 - DNA, 15 bp, Homo sapiens
gagggaatctagccc

SEQ ID NO: 5903913 - DNA, 16 bp, Homo sapiens
gagggaatctagccca

SEQ ID NO: 5903914 - DNA, 16 bp, Homo sapiens
gagggaatgaacctgg

SEQ ID NO: 5903915 - DNA, 19 bp, Homo sapiens
gagggaatgttccctgcac

SEQ ID NO: 5903916 - DNA, 21 bp, Homo sapiens
gagggaatgttccctgcaccc

SEQ ID NO: 5903917 - DNA, 18 bp, Homo sapiens
gagggacaaaggagcctg

SEQ ID NO: 5903918 - DNA, 22 bp, Homo sapiens
gagggacaaccagaaggccctt

SEQ ID NO: 5903919 - DNA, 18 bp, Homo sapiens
gagggacacatgcccctc

SEQ ID NO: 5903920 - DNA, 20 bp, Homo sapiens
gagggacacatgcccctccc

SEQ ID NO: 5903921 - DNA, 21 bp, Homo sapiens
gagggacacatgcccctcccc

SEQ ID NO: 5903922 - DNA, 23 bp, Homo sapiens
gagggacacatgcccctccccca

SEQ ID NO: 5903923 - DNA, 13 bp, Homo sapiens
gagggacagagcc

SEQ ID NO: 5903924 - DNA, 14 bp, Homo sapiens
gagggacagagccc

SEQ ID NO: 5903925 - DNA, 19 bp, Homo sapiens
gagggacagagcccgggag

SEQ ID NO: 5903926 - DNA, 13 bp, Homo sapiens
gagggacaggctg

SEQ ID NO: 5903927 - DNA, 12 bp, Homo sapiens
gagggacagggc

SEQ ID NO: 5903928 - DNA, 21 bp, Homo sapiens
gagggacagggcttggggagc

SEQ ID NO: 5903929 - DNA, 24 bp, Homo sapiens
gagggacataagataaaatgatgt

SEQ ID NO: 5903930 - DNA, 15 bp, Homo sapiens
gagggacatagaatc

SEQ ID NO: 5903931 - DNA, 19 bp, Homo sapiens
gagggacatatcagtgacc

SEQ ID NO: 5903932 - DNA, 23 bp, Homo sapiens
gagggacatgcttagcagtcccc

SEQ ID NO: 5903933 - DNA, 20 bp, Homo sapiens
gagggaccaaattgcttcta

SEQ ID NO: 5903934 - DNA, 17 bp, Homo sapiens
gagggaccaactgggcc

SEQ ID NO: 5903935 - DNA, 19 bp, Homo sapiens
gagggaccaactgggccca

SEQ ID NO: 5903936 - DNA, 12 bp, Homo sapiens
gagggaccagcc

SEQ ID NO: 5903937 - DNA, 16 bp, Homo sapiens
gagggaccagctgggg

SEQ ID NO: 5903938 - DNA, 16 bp, Homo sapiens
gagggaccatgtgtca

SEQ ID NO: 5903939 - DNA, 13 bp, Homo sapiens
gagggacctctcc

SEQ ID NO: 5903940 - DNA, 15 bp, Homo sapiens
gagggacctctccca

SEQ ID NO: 5903941 - DNA, 17 bp, Homo sapiens
gagggacctctcccagg

SEQ ID NO: 5903942 - DNA, 22 bp, Homo sapiens
gagggaccttggagagctcagg

SEQ ID NO: 5903943 - DNA, 16 bp, Homo sapiens
gagggacgaagaaagg

SEQ ID NO: 5903944 - DNA, 21 bp, Homo sapiens
gagggacgcacagcactgcct

SEQ ID NO: 5903945 - DNA, 15 bp, Homo sapiens
gagggacgcctgggg

SEQ ID NO: 5903946 - DNA, 16 bp, Homo sapiens
gagggacgcctggggg

SEQ ID NO: 5903947 - DNA, 17 bp, Homo sapiens
gagggacgcggaggagg

SEQ ID NO: 5903948 - DNA, 20 bp, Homo sapiens
gagggacgcggaggaggaag

SEQ ID NO: 5903949 - DNA, 22 bp, Homo sapiens
gagggacgcggctcccggggca

SEQ ID NO: 5903950 - DNA, 22 bp, Homo sapiens
gagggacgtcagacttggctca

SEQ ID NO: 5903951 - DNA, 18 bp, Homo sapiens
gagggactccaagccctg

SEQ ID NO: 5903952 - DNA, 24 bp, Homo sapiens
gagggactccaagccctggggcag

SEQ ID NO: 5903953 - DNA, 14 bp, Homo sapiens
gagggactctgaag

SEQ ID NO: 5903954 - DNA, 23 bp, Homo sapiens
gagggactctgaagcctctggga

SEQ ID NO: 5903955 - DNA, 22 bp, Homo sapiens
gagggactctgtctggccaggg

SEQ ID NO: 5903956 - DNA, 23 bp, Homo sapiens
gagggactctgtctggccaggga

SEQ ID NO: 5903957 - DNA, 14 bp, Homo sapiens
gagggactgctgac

SEQ ID NO: 5903958 - DNA, 16 bp, Homo sapiens
gagggactgctgaccc

SEQ ID NO: 5903959 - DNA, 15 bp, Homo sapiens
gagggactggacagc

SEQ ID NO: 5903960 - DNA, 17 bp, Homo sapiens
gagggactgtatttctg

SEQ ID NO: 5903961 - DNA, 20 bp, Homo sapiens
gagggactgtcagctgagct

SEQ ID NO: 5903962 - DNA, 23 bp, Homo sapiens
gagggactgtcgctgcttcgtgg

SEQ ID NO: 5903963 - DNA, 14 bp, Homo sapiens
gagggacttggctg

SEQ ID NO: 5903964 - DNA, 18 bp, Homo sapiens
gagggagaaggagaggct

SEQ ID NO: 5903965 - DNA, 22 bp, Homo sapiens
gagggagaatcctcccttccca

SEQ ID NO: 5903966 - DNA, 16 bp, Homo sapiens
gagggagacagaccac

SEQ ID NO: 5903967 - DNA, 20 bp, Homo sapiens
gagggagacagagacagaaa

SEQ ID NO: 5903968 - DNA, 16 bp, Homo sapiens
gagggagacggccctg

SEQ ID NO: 5903969 - DNA, 16 bp, Homo sapiens
gagggagactcagcct

SEQ ID NO: 5903970 - DNA, 15 bp, Homo sapiens
gagggagactcctgg

SEQ ID NO: 5903971 - DNA, 13 bp, Homo sapiens
gagggagagagag

SEQ ID NO: 5903972 - DNA, 16 bp, Homo sapiens
gagggagagcctctgt

SEQ ID NO: 5903973 - DNA, 16 bp, Homo sapiens
gagggagaggaagcac

SEQ ID NO: 5903974 - DNA, 12 bp, Homo sapiens
gagggagaggtg

SEQ ID NO: 5903975 - DNA, 16 bp, Homo sapiens
gagggagagtctccca

SEQ ID NO: 5903976 - DNA, 15 bp, Homo sapiens
gagggagatctttcc

SEQ ID NO: 5903977 - DNA, 21 bp, Homo sapiens
gagggagatctttcccaggcc

SEQ ID NO: 5903978 - DNA, 12 bp, Homo sapiens
gagggagatgga

SEQ ID NO: 5903979 - DNA, 22 bp, Homo sapiens
gagggagcaagtccttcccttt

SEQ ID NO: 5903980 - DNA, 20 bp, Homo sapiens
gagggagcagacaggaggaa

SEQ ID NO: 5903981 - DNA, 24 bp, Homo sapiens
gagggagcatagaaggcaggtgag

SEQ ID NO: 5903982 - DNA, 18 bp, Homo sapiens
gagggagccctgagcctg

SEQ ID NO: 5903983 - DNA, 19 bp, Homo sapiens
gagggagccctgagcctgg

SEQ ID NO: 5903984 - DNA, 21 bp, Homo sapiens
gagggagccctgagcctggca

SEQ ID NO: 5903985 - DNA, 13 bp, Homo sapiens
gagggagccttgt

SEQ ID NO: 5903986 - DNA, 23 bp, Homo sapiens
gagggagctccaactcagaaggg

SEQ ID NO: 5903987 - DNA, 19 bp, Homo sapiens
gagggagctgaggcctccc

SEQ ID NO: 5903988 - DNA, 20 bp, Homo sapiens
gagggagctgaggcctccct

SEQ ID NO: 5903989 - DNA, 21 bp, Homo sapiens
gagggagctgaggcctccctt

SEQ ID NO: 5903990 - DNA, 12 bp, Homo sapiens
gagggagctgct

SEQ ID NO: 5903991 - DNA, 14 bp, Homo sapiens
gagggagctgctgg

SEQ ID NO: 5903992 - DNA, 14 bp, Homo sapiens
gagggaggacctgg

SEQ ID NO: 5903993 - DNA, 22 bp, Homo sapiens
gagggaggaggcaggagttgga

SEQ ID NO: 5903994 - DNA, 15 bp, Homo sapiens
gagggaggagggagt

SEQ ID NO: 5903995 - DNA, 17 bp, Homo sapiens
gagggaggcaagccctg

SEQ ID NO: 5903996 - DNA, 11 bp, Homo sapiens
gagggaggccc

SEQ ID NO: 5903997 - DNA, 18 bp, Homo sapiens
gagggaggcttcctgact

SEQ ID NO: 5903998 - DNA, 13 bp, Homo sapiens
gagggagggagcc

SEQ ID NO: 5903999 - DNA, 16 bp, Homo sapiens
gagggagggagccatg

SEQ ID NO: 5904000 - DNA, 15 bp, Homo sapiens
gagggagggagggct

SEQ ID NO: 5904001 - DNA, 17 bp, Homo sapiens
gagggagggcagctggc

SEQ ID NO: 5904002 - DNA, 13 bp, Homo sapiens
gagggagggctgg

SEQ ID NO: 5904003 - DNA, 14 bp, Homo sapiens
gagggaggggacag

SEQ ID NO: 5904004 - DNA, 18 bp, Homo sapiens
gagggaggggacagaggc

SEQ ID NO: 5904005 - DNA, 13 bp, Homo sapiens
gagggaggggaga

SEQ ID NO: 5904006 - DNA, 17 bp, Homo sapiens
gagggagggggaagtcg

SEQ ID NO: 5904007 - DNA, 13 bp, Homo sapiens
gagggagggggag

SEQ ID NO: 5904008 - DNA, 17 bp, Homo sapiens
gagggagggtttctctc

SEQ ID NO: 5904009 - DNA, 14 bp, Homo sapiens
gagggaggttcctc

SEQ ID NO: 5904010 - DNA, 22 bp, Homo sapiens
gagggaggttcctcgcaggtct

SEQ ID NO: 5904011 - DNA, 15 bp, Homo sapiens
gagggagtacaaaga

SEQ ID NO: 5904012 - DNA, 19 bp, Homo sapiens
gagggagtcccagagccct

SEQ ID NO: 5904013 - DNA, 17 bp, Homo sapiens
gagggagtctcaggagg

SEQ ID NO: 5904014 - DNA, 13 bp, Homo sapiens
gagggagtgacag

SEQ ID NO: 5904015 - DNA, 18 bp, Homo sapiens
gagggagtgacagaggca

SEQ ID NO: 5904016 - DNA, 21 bp, Homo sapiens
gagggagtgacagaggcagcc

SEQ ID NO: 5904017 - DNA, 20 bp, Homo sapiens
gagggagtggcacttctgcc

SEQ ID NO: 5904018 - DNA, 16 bp, Homo sapiens
gagggagttagggaga

SEQ ID NO: 5904019 - DNA, 20 bp, Homo sapiens
gagggagttagggagagaga

SEQ ID NO: 5904020 - DNA, 16 bp, Homo sapiens
gagggagttttgtctg

SEQ ID NO: 5904021 - DNA, 21 bp, Homo sapiens
gagggataaccccaggcactg

SEQ ID NO: 5904022 - DNA, 16 bp, Homo sapiens
gagggataaggcagtt

SEQ ID NO: 5904023 - DNA, 18 bp, Homo sapiens
gagggataattggttatt

SEQ ID NO: 5904024 - DNA, 15 bp, Homo sapiens
gagggatacaagaga

SEQ ID NO: 5904025 - DNA, 17 bp, Homo sapiens
gagggatagagacgcag

SEQ ID NO: 5904026 - DNA, 15 bp, Homo sapiens
gagggatcacagggc

SEQ ID NO: 5904027 - DNA, 13 bp, Homo sapiens
gagggatcagccc

SEQ ID NO: 5904028 - DNA, 14 bp, Homo sapiens
gagggatcagcccc

SEQ ID NO: 5904029 - DNA, 16 bp, Homo sapiens
gagggatcattttctg

SEQ ID NO: 5904030 - DNA, 23 bp, Homo sapiens
gagggatgaagggcgagtgaatc

SEQ ID NO: 5904031 - DNA, 19 bp, Homo sapiens
gagggatgaccttcccagg

SEQ ID NO: 5904032 - DNA, 15 bp, Homo sapiens
gagggatgagagtgg

SEQ ID NO: 5904033 - DNA, 16 bp, Homo sapiens
gaggggacgcaggccc

SEQ ID NO: 5904034 - DNA, 19 bp, Homo sapiens
gaggggacgcaggcccctc

SEQ ID NO: 5904035 - DNA, 17 bp, Homo sapiens
gaggggacgcctgtgtc

SEQ ID NO: 5904036 - DNA, 16 bp, Homo sapiens
gaggggacgctggcta

SEQ ID NO: 5904037 - DNA, 22 bp, Homo sapiens
gaggggactatttatgaaggca

SEQ ID NO: 5904038 - DNA, 13 bp, Homo sapiens
gaggggacttgga

SEQ ID NO: 5904039 - DNA, 14 bp, Homo sapiens
gaggggagaagcca

SEQ ID NO: 5904040 - DNA, 15 bp, Homo sapiens
gaggggagaagccaa

SEQ ID NO: 5904041 - DNA, 21 bp, Homo sapiens
gaggggagacattagaaaaaa

SEQ ID NO: 5904042 - DNA, 19 bp, Homo sapiens
gaggggagagaccacagcc

SEQ ID NO: 5904043 - DNA, 15 bp, Homo sapiens
gaggggagaggaaat

SEQ ID NO: 5904044 - DNA, 17 bp, Homo sapiens
gaggggagcagcggctc

SEQ ID NO: 5904045 - DNA, 17 bp, Homo sapiens
gaggggagccaggaggg

SEQ ID NO: 5904046 - DNA, 16 bp, Homo sapiens
gaggggagctgctggc

SEQ ID NO: 5904047 - DNA, 19 bp, Homo sapiens
gaggggagctgctggccat

SEQ ID NO: 5904048 - DNA, 21 bp, Homo sapiens
gaggggagctgctggccatgg

SEQ ID NO: 5904049 - DNA, 12 bp, Homo sapiens
gaggggaggagg

SEQ ID NO: 5904050 - DNA, 13 bp, Homo sapiens
gaggggaggcaga

SEQ ID NO: 5904051 - DNA, 12 bp, Homo sapiens
gaggggaggcat

SEQ ID NO: 5904052 - DNA, 13 bp, Homo sapiens
gaggggaggtggc

SEQ ID NO: 5904053 - DNA, 13 bp, Homo sapiens
gaggggatccagc

SEQ ID NO: 5904054 - DNA, 17 bp, Homo sapiens
gaggggatccagccact

SEQ ID NO: 5904055 - DNA, 13 bp, Homo sapiens
gaggggatgataa

SEQ ID NO: 5904056 - DNA, 16 bp, Homo sapiens
gaggggatgataaagg

SEQ ID NO: 5904057 - DNA, 22 bp, Homo sapiens
gaggggcaaccaactgccccag

SEQ ID NO: 5904058 - DNA, 16 bp, Homo sapiens
gaggggcacctgccac

SEQ ID NO: 5904059 - DNA, 18 bp, Homo sapiens
gaggggcacctgccaccg

SEQ ID NO: 5904060 - DNA, 16 bp, Homo sapiens
gaggggcagagaggaa

SEQ ID NO: 5904061 - DNA, 16 bp, Homo sapiens
gaggggcagagccagg

SEQ ID NO: 5904062 - DNA, 12 bp, Homo sapiens
gaggggcagcct

SEQ ID NO: 5904063 - DNA, 13 bp, Homo sapiens
gaggggcagcttt

SEQ ID NO: 5904064 - DNA, 14 bp, Homo sapiens
gaggggcaggccct

SEQ ID NO: 5904065 - DNA, 15 bp, Homo sapiens
gaggggcaggccctg

SEQ ID NO: 5904066 - DNA, 17 bp, Homo sapiens
gaggggcaggccctgca

SEQ ID NO: 5904067 - DNA, 14 bp, Homo sapiens
gaggggcaggcctt

SEQ ID NO: 5904068 - DNA, 22 bp, Homo sapiens
gaggggcaggcctttttgagcc

SEQ ID NO: 5904069 - DNA, 12 bp, Homo sapiens
gaggggcaggga

SEQ ID NO: 5904070 - DNA, 16 bp, Homo sapiens
gaggggcagggagagc

SEQ ID NO: 5904071 - DNA, 17 bp, Homo sapiens
gaggggcaggggagtgc

SEQ ID NO: 5904072 - DNA, 23 bp, Homo sapiens
gaggggcagtttgggaaggtgat

SEQ ID NO: 5904073 - DNA, 17 bp, Homo sapiens
gaggggcatctgcccct

SEQ ID NO: 5904074 - DNA, 22 bp, Homo sapiens
gaggggcatctgcccctccccc

SEQ ID NO: 5904075 - DNA, 18 bp, Homo sapiens
gaggggccagcggccctc

SEQ ID NO: 5904076 - DNA, 19 bp, Homo sapiens
gaggggccagcggccctcc

SEQ ID NO: 5904077 - DNA, 17 bp, Homo sapiens
gaggggccaggggcagg

SEQ ID NO: 5904078 - DNA, 15 bp, Homo sapiens
gaggggcccatgtgg

SEQ ID NO: 5904079 - DNA, 20 bp, Homo sapiens
gaggggccccagcgtctgca

SEQ ID NO: 5904080 - DNA, 21 bp, Homo sapiens
gaggggccccagcgtctgcag

SEQ ID NO: 5904081 - DNA, 23 bp, Homo sapiens
gaggggccccagcgtctgcaggg

SEQ ID NO: 5904082 - DNA, 24 bp, Homo sapiens
gaggggccccagcgtctgcagggt

SEQ ID NO: 5904083 - DNA, 17 bp, Homo sapiens
gaggggcccccctgccc

SEQ ID NO: 5904084 - DNA, 14 bp, Homo sapiens
gaggggcccctgct

SEQ ID NO: 5904085 - DNA, 17 bp, Homo sapiens
gaggggcccgcttgcct

SEQ ID NO: 5904086 - DNA, 20 bp, Homo sapiens
gaggggcccggtggcggcag

SEQ ID NO: 5904087 - DNA, 13 bp, Homo sapiens
gaggggccggagg

SEQ ID NO: 5904088 - DNA, 17 bp, Homo sapiens
gaggggccggccctgtg

SEQ ID NO: 5904089 - DNA, 21 bp, Homo sapiens
gaggggccggccctgtgtgca

SEQ ID NO: 5904090 - DNA, 19 bp, Homo sapiens
gaggggcctaggcctcagc

SEQ ID NO: 5904091 - DNA, 22 bp, Homo sapiens
gaggggcctcatcttccccagc

SEQ ID NO: 5904092 - DNA, 13 bp, Homo sapiens
gaggggcctcccc

SEQ ID NO: 5904093 - DNA, 22 bp, Homo sapiens
gaggggcctcccggggcccagg

SEQ ID NO: 5904094 - DNA, 14 bp, Homo sapiens
gaggggcctctgaa

SEQ ID NO: 5904095 - DNA, 12 bp, Homo sapiens
gaggggcctctt

SEQ ID NO: 5904096 - DNA, 13 bp, Homo sapiens
gaggggcctgcca

SEQ ID NO: 5904097 - DNA, 17 bp, Homo sapiens
gaggggcctgccacctg

SEQ ID NO: 5904098 - DNA, 21 bp, Homo sapiens
gaggggcctgccacctggacc

SEQ ID NO: 5904099 - DNA, 12 bp, Homo sapiens
gaggggcctggc

SEQ ID NO: 5904100 - DNA, 14 bp, Homo sapiens
gaggggcctggcag

SEQ ID NO: 5904101 - DNA, 20 bp, Homo sapiens
gaggggcctggcagccgtgc

SEQ ID NO: 5904102 - DNA, 15 bp, Homo sapiens
gaggggcctggcctg

SEQ ID NO: 5904103 - DNA, 16 bp, Homo sapiens
gaggggcctggcctgg

SEQ ID NO: 5904104 - DNA, 13 bp, Homo sapiens
gaggggcctggga

SEQ ID NO: 5904105 - DNA, 19 bp, Homo sapiens
gaggggcctttgctgccct

SEQ ID NO: 5904106 - DNA, 20 bp, Homo sapiens
gaggggcctttgctgccctt

SEQ ID NO: 5904107 - DNA, 16 bp, Homo sapiens
gaggggcgcccacctc

SEQ ID NO: 5904108 - DNA, 13 bp, Homo sapiens
gaggggcgctggc

SEQ ID NO: 5904109 - DNA, 19 bp, Homo sapiens
gaggggcgctggcccagcc

SEQ ID NO: 5904110 - DNA, 16 bp, Homo sapiens
gaggggcgggctcaga

SEQ ID NO: 5904111 - DNA, 17 bp, Homo sapiens
gaggggcggggccagga

SEQ ID NO: 5904112 - DNA, 19 bp, Homo sapiens
gaggggctaccctgggaag

SEQ ID NO: 5904113 - DNA, 21 bp, Homo sapiens
gaggggctccccgggtctctc

SEQ ID NO: 5904114 - DNA, 11 bp, Homo sapiens
gaggggctctc

SEQ ID NO: 5904115 - DNA, 16 bp, Homo sapiens
gaggggctctcagctc

SEQ ID NO: 5904116 - DNA, 19 bp, Homo sapiens
gaggggctctcagctcagc

SEQ ID NO: 5904117 - DNA, 20 bp, Homo sapiens
gaggggctgcagcagaggcc

SEQ ID NO: 5904118 - DNA, 18 bp, Homo sapiens
gaggggctggacctggcg

SEQ ID NO: 5904119 - DNA, 12 bp, Homo sapiens
gaggggctgggc

SEQ ID NO: 5904120 - DNA, 16 bp, Homo sapiens
gaggggctggggaggg

SEQ ID NO: 5904121 - DNA, 19 bp, Homo sapiens
gaggggctggggagggggt

SEQ ID NO: 5904122 - DNA, 23 bp, Homo sapiens
gaggggctggggagggggtacct

SEQ ID NO: 5904123 - DNA, 14 bp, Homo sapiens
gaggggctggggca

SEQ ID NO: 5904124 - DNA, 15 bp, Homo sapiens
gaggggctgtcctcc

SEQ ID NO: 5904125 - DNA, 17 bp, Homo sapiens
gaggggctgtcctcctt

SEQ ID NO: 5904126 - DNA, 19 bp, Homo sapiens
gaggggctgtcctccttcc

SEQ ID NO: 5904127 - DNA, 17 bp, Homo sapiens
gaggggctgtgggcgtg

SEQ ID NO: 5904128 - DNA, 14 bp, Homo sapiens
gaggggctgttagg

SEQ ID NO: 5904129 - DNA, 15 bp, Homo sapiens
gaggggcttggagca

SEQ ID NO: 5904130 - DNA, 16 bp, Homo sapiens
gaggggcttggagcag

SEQ ID NO: 5904131 - DNA, 21 bp, Homo sapiens
gaggggcttggagcagagacg

SEQ ID NO: 5904132 - DNA, 13 bp, Homo sapiens
gaggggcttggga

SEQ ID NO: 5904133 - DNA, 22 bp, Homo sapiens
gagggggaagagatcccaggag

SEQ ID NO: 5904134 - DNA, 18 bp, Homo sapiens
gagggggaattcctggaa

SEQ ID NO: 5904135 - DNA, 12 bp, Homo sapiens
gagggggacctg

SEQ ID NO: 5904136 - DNA, 18 bp, Homo sapiens
gagggggacctgtccccc

SEQ ID NO: 5904137 - DNA, 21 bp, Homo sapiens
gagggggactgctgctgcctg

SEQ ID NO: 5904138 - DNA, 13 bp, Homo sapiens
gagggggcaaagg

SEQ ID NO: 5904139 - DNA, 13 bp, Homo sapiens
gagggggcaagct

SEQ ID NO: 5904140 - DNA, 17 bp, Homo sapiens
gagggggcaagctttgc

SEQ ID NO: 5904141 - DNA, 16 bp, Homo sapiens
gagggggcagagtggc

SEQ ID NO: 5904142 - DNA, 12 bp, Homo sapiens
gagggggcaggg

SEQ ID NO: 5904143 - DNA, 13 bp, Homo sapiens
gagggggcagggg

SEQ ID NO: 5904144 - DNA, 13 bp, Homo sapiens
gagggggcccggc

SEQ ID NO: 5904145 - DNA, 20 bp, Homo sapiens
gagggggcccggctgggccc

SEQ ID NO: 5904146 - DNA, 15 bp, Homo sapiens
gagggggcctggatg

SEQ ID NO: 5904147 - DNA, 13 bp, Homo sapiens
gagggggcggcag

SEQ ID NO: 5904148 - DNA, 12 bp, Homo sapiens
gagggggctctg

SEQ ID NO: 5904149 - DNA, 22 bp, Homo sapiens
gagggggctctgcccacctggg

SEQ ID NO: 5904150 - DNA, 15 bp, Homo sapiens
gagggggctgctccc

SEQ ID NO: 5904151 - DNA, 13 bp, Homo sapiens
gagggggctggga

SEQ ID NO: 5904152 - DNA, 14 bp, Homo sapiens
gagggggctgtcat

SEQ ID NO: 5904153 - DNA, 17 bp, Homo sapiens
gagggggcttgaagcca

SEQ ID NO: 5904154 - DNA, 12 bp, Homo sapiens
gaggggggaaga

SEQ ID NO: 5904155 - DNA, 15 bp, Homo sapiens
gaggggggagccaga

SEQ ID NO: 5904156 - DNA, 16 bp, Homo sapiens
gaggggggagccagag

SEQ ID NO: 5904157 - DNA, 19 bp, Homo sapiens
gaggggggagccagaggcc

SEQ ID NO: 5904158 - DNA, 22 bp, Homo sapiens
gaggggggagccagaggccagg

SEQ ID NO: 5904159 - DNA, 22 bp, Homo sapiens
gaggggggccaaggtcctgctc

SEQ ID NO: 5904160 - DNA, 15 bp, Homo sapiens
gaggggggcggtgag

SEQ ID NO: 5904161 - DNA, 14 bp, Homo sapiens
gaggggggggtggg

SEQ ID NO: 5904162 - DNA, 15 bp, Homo sapiens
gaggggggggtgggg

SEQ ID NO: 5904163 - DNA, 17 bp, Homo sapiens
gaggggggtgctggccc

SEQ ID NO: 5904164 - DNA, 23 bp, Homo sapiens
gaggggggtgctggcccccagga

SEQ ID NO: 5904165 - DNA, 18 bp, Homo sapiens
gagggggtacctcatgag

SEQ ID NO: 5904166 - DNA, 22 bp, Homo sapiens
gagggggtcatttcagagccct

SEQ ID NO: 5904167 - DNA, 23 bp, Homo sapiens
gagggggtcatttcagagccctc

SEQ ID NO: 5904168 - DNA, 23 bp, Homo sapiens
gagggggtccgtggtagaggcct

SEQ ID NO: 5904169 - DNA, 18 bp, Homo sapiens
gagggggtcgtggagagc

SEQ ID NO: 5904170 - DNA, 19 bp, Homo sapiens
gagggggtcgtggagagct

SEQ ID NO: 5904171 - DNA, 13 bp, Homo sapiens
gagggggtgagag

SEQ ID NO: 5904172 - DNA, 14 bp, Homo sapiens
gagggggtggaggg

SEQ ID NO: 5904173 - DNA, 17 bp, Homo sapiens
gagggggtggcctccca

SEQ ID NO: 5904174 - DNA, 23 bp, Homo sapiens
gagggggtgtctggaagctgagc

SEQ ID NO: 5904175 - DNA, 19 bp, Homo sapiens
gagggggttcttcctcacc

SEQ ID NO: 5904176 - DNA, 16 bp, Homo sapiens
gaggggtaaaagctga

SEQ ID NO: 5904177 - DNA, 17 bp, Homo sapiens
gaggggtaaatatatgt

SEQ ID NO: 5904178 - DNA, 23 bp, Homo sapiens
gaggggtacattggtaaacattt

SEQ ID NO: 5904179 - DNA, 16 bp, Homo sapiens
gaggggtcccctctgg

SEQ ID NO: 5904180 - DNA, 21 bp, Homo sapiens
gaggggtcgacttcgggctgg

SEQ ID NO: 5904181 - DNA, 14 bp, Homo sapiens
gaggggtctcggat

SEQ ID NO: 5904182 - DNA, 16 bp, Homo sapiens
gaggggtctcggatga

SEQ ID NO: 5904183 - DNA, 23 bp, Homo sapiens
gaggggtctcggatgacaccctg

SEQ ID NO: 5904184 - DNA, 18 bp, Homo sapiens
gaggggtctgcctcccac

SEQ ID NO: 5904185 - DNA, 15 bp, Homo sapiens
gaggggtgacagtgg

SEQ ID NO: 5904186 - DNA, 21 bp, Homo sapiens
gaggggtgagtcccctactcc

SEQ ID NO: 5904187 - DNA, 14 bp, Homo sapiens
gaggggtggaggct

SEQ ID NO: 5904188 - DNA, 18 bp, Homo sapiens
gaggggtggcccagagcc

SEQ ID NO: 5904189 - DNA, 21 bp, Homo sapiens
gaggggtggcccagagccata

SEQ ID NO: 5904190 - DNA, 14 bp, Homo sapiens
gaggggtggggagc

SEQ ID NO: 5904191 - DNA, 21 bp, Homo sapiens
gaggggtgggggtgccgctct

SEQ ID NO: 5904192 - DNA, 13 bp, Homo sapiens
gaggggtggtact

SEQ ID NO: 5904193 - DNA, 20 bp, Homo sapiens
gaggggtggtgtccttctcc

SEQ ID NO: 5904194 - DNA, 14 bp, Homo sapiens
gaggggtgtggcag

SEQ ID NO: 5904195 - DNA, 15 bp, Homo sapiens
gaggggttcctcccc

SEQ ID NO: 5904196 - DNA, 17 bp, Homo sapiens
gaggggttgagggaagg

SEQ ID NO: 5904197 - DNA, 17 bp, Homo sapiens
gaggggttgccacaggc

SEQ ID NO: 5904198 - DNA, 22 bp, Homo sapiens
gaggggttgccacaggcctccc

SEQ ID NO: 5904199 - DNA, 19 bp, Homo sapiens
gaggggtttgggagtcagg

SEQ ID NO: 5904200 - DNA, 20 bp, Homo sapiens
gaggggtttgggagtcaggc

SEQ ID NO: 5904201 - DNA, 20 bp, Homo sapiens
gagggtaactggggggccac

SEQ ID NO: 5904202 - DNA, 16 bp, Homo sapiens
gagggtaataaactta

SEQ ID NO: 5904203 - DNA, 17 bp, Homo sapiens
gagggtacagctgggct

SEQ ID NO: 5904204 - DNA, 18 bp, Homo sapiens
gagggtaggcaggattgg

SEQ ID NO: 5904205 - DNA, 22 bp, Homo sapiens
gagggtaggcaggattggggaa

SEQ ID NO: 5904206 - DNA, 13 bp, Homo sapiens
gagggtaggggag

SEQ ID NO: 5904207 - DNA, 18 bp, Homo sapiens
gagggtatgaagagctgt

SEQ ID NO: 5904208 - DNA, 19 bp, Homo sapiens
gagggtatggtgctgctct

SEQ ID NO: 5904209 - DNA, 20 bp, Homo sapiens
gagggtcaagggctggggct

SEQ ID NO: 5904210 - DNA, 23 bp, Homo sapiens
gagggtcacgcttgcctggtcac

SEQ ID NO: 5904211 - DNA, 15 bp, Homo sapiens
gagggtcagagagga

SEQ ID NO: 5904212 - DNA, 23 bp, Homo sapiens
gaggtgaactgtttccacattca

SEQ ID NO: 5904213 - DNA, 15 bp, Homo sapiens
gaggtgaagtccctg

SEQ ID NO: 5904214 - DNA, 19 bp, Homo sapiens
gaggtgaatactcttgaaa

SEQ ID NO: 5904215 - DNA, 20 bp, Homo sapiens
gaggtgacaaaccatttcca

SEQ ID NO: 5904216 - DNA, 16 bp, Homo sapiens
gaggtgaccccagggc

SEQ ID NO: 5904217 - DNA, 16 bp, Homo sapiens
gaggtgacttgcctgg

SEQ ID NO: 5904218 - DNA, 20 bp, Homo sapiens
gaggtgacttgcctggggcc

SEQ ID NO: 5904219 - DNA, 23 bp, Homo sapiens
gaggtgacttgcctggggccaca

SEQ ID NO: 5904220 - DNA, 17 bp, Homo sapiens
gaggtgagaactcagaa

SEQ ID NO: 5904221 - DNA, 17 bp, Homo sapiens
gaggtgagcggatcaca

SEQ ID NO: 5904222 - DNA, 16 bp, Homo sapiens
gaggtgaggagcagag

SEQ ID NO: 5904223 - DNA, 18 bp, Homo sapiens
gaggtgagggaggcctga

SEQ ID NO: 5904224 - DNA, 21 bp, Homo sapiens
gaggtgaggggggctggcggg

SEQ ID NO: 5904225 - DNA, 16 bp, Homo sapiens
gaggtgataggcaagg

SEQ ID NO: 5904226 - DNA, 13 bp, Homo sapiens
gaggtgattccag

SEQ ID NO: 5904227 - DNA, 21 bp, Homo sapiens
gaggtgcaagacctagtcccc

SEQ ID NO: 5904228 - DNA, 19 bp, Homo sapiens
gaggtgcaaggagtgtaaa

SEQ ID NO: 5904229 - DNA, 14 bp, Homo sapiens
gaggtgcactggga

SEQ ID NO: 5904230 - DNA, 19 bp, Homo sapiens
gaggtgcagagtgcccaga

SEQ ID NO: 5904231 - DNA, 15 bp, Homo sapiens
gaggtgcagtggagg

SEQ ID NO: 5904232 - DNA, 23 bp, Homo sapiens
gaggtgccacccagtagcccaga

SEQ ID NO: 5904233 - DNA, 13 bp, Homo sapiens
gaggtgccactgg

SEQ ID NO: 5904234 - DNA, 19 bp, Homo sapiens
gaggtgccagcaaagcccc

SEQ ID NO: 5904235 - DNA, 20 bp, Homo sapiens
gaggtgccagcaaagcccca

SEQ ID NO: 5904236 - DNA, 17 bp, Homo sapiens
gaggtgccagcaactga

SEQ ID NO: 5904237 - DNA, 20 bp, Homo sapiens
gaggtgccagcaactgaata

SEQ ID NO: 5904238 - DNA, 18 bp, Homo sapiens
gaggtgcccactccgcca

SEQ ID NO: 5904239 - DNA, 22 bp, Homo sapiens
gaggtgccggggaggggcagag

SEQ ID NO: 5904240 - DNA, 13 bp, Homo sapiens
gaggtgcctccca

SEQ ID NO: 5904241 - DNA, 14 bp, Homo sapiens
gaggtgcctcccag

SEQ ID NO: 5904242 - DNA, 16 bp, Homo sapiens
gaggtgcctgagctgg

SEQ ID NO: 5904243 - DNA, 14 bp, Homo sapiens
gaggtgcctgctca

SEQ ID NO: 5904244 - DNA, 14 bp, Homo sapiens
gaggtgcctgggag

SEQ ID NO: 5904245 - DNA, 19 bp, Homo sapiens
gaggtgcctgggaggagtg

SEQ ID NO: 5904246 - DNA, 20 bp, Homo sapiens
gaggtgcctgggaggagtgg

SEQ ID NO: 5904247 - DNA, 13 bp, Homo sapiens
gaggtgcctgtcc

SEQ ID NO: 5904248 - DNA, 20 bp, Homo sapiens
gaggtgccttcttcagggcc

SEQ ID NO: 5904249 - DNA, 20 bp, Homo sapiens
gaggtgcggccaccacccta

SEQ ID NO: 5904250 - DNA, 20 bp, Homo sapiens
gaggtgcgtgttcagcagaa

SEQ ID NO: 5904251 - DNA, 24 bp, Homo sapiens
gaggtgcgtgttcagcagaacctg

SEQ ID NO: 5904252 - DNA, 13 bp, Homo sapiens
gaggtgctgatga

SEQ ID NO: 5904253 - DNA, 20 bp, Homo sapiens
gaggtgctgcattgcctgcg

SEQ ID NO: 5904254 - DNA, 20 bp, Homo sapiens
gaggtgcttaagcagaagca

SEQ ID NO: 5904255 - DNA, 18 bp, Homo sapiens
gaggtgcttgaggccccg

SEQ ID NO: 5904256 - DNA, 16 bp, Homo sapiens
gaggtgcttgatctat

SEQ ID NO: 5904257 - DNA, 15 bp, Homo sapiens
gaggtggaagcagag

SEQ ID NO: 5904258 - DNA, 17 bp, Homo sapiens
gaggtggaagcagaggc

SEQ ID NO: 5904259 - DNA, 19 bp, Homo sapiens
gaggtggaagcagaggccc

SEQ ID NO: 5904260 - DNA, 22 bp, Homo sapiens
gaggtggaagcagaggccctgc

SEQ ID NO: 5904261 - DNA, 20 bp, Homo sapiens
gaggtggaagccctccttcc

SEQ ID NO: 5904262 - DNA, 13 bp, Homo sapiens
gaggtggagaaaa

SEQ ID NO: 5904263 - DNA, 19 bp, Homo sapiens
gaggtggagattgcagtga

SEQ ID NO: 5904264 - DNA, 14 bp, Homo sapiens
gaggtggagccaag

SEQ ID NO: 5904265 - DNA, 19 bp, Homo sapiens
gaggtggagcttgcagtga

SEQ ID NO: 5904266 - DNA, 23 bp, Homo sapiens
gaggtggaggaagatagcgcata

SEQ ID NO: 5904267 - DNA, 19 bp, Homo sapiens
gaggtggaggtgggctgat

SEQ ID NO: 5904268 - DNA, 20 bp, Homo sapiens
gaggtggaggttgcagtgag

SEQ ID NO: 5904269 - DNA, 19 bp, Homo sapiens
gaggtggaggttgcattga

SEQ ID NO: 5904270 - DNA, 23 bp, Homo sapiens
gaggtggatactggggggcaggc

SEQ ID NO: 5904271 - DNA, 19 bp, Homo sapiens
gaggtggattcctgggcaa

SEQ ID NO: 5904272 - DNA, 23 bp, Homo sapiens
gaggtggatttactgagagaagg

SEQ ID NO: 5904273 - DNA, 16 bp, Homo sapiens
gaggtggcagccctgt

SEQ ID NO: 5904274 - DNA, 18 bp, Homo sapiens
gaggtggcagccctgtag

SEQ ID NO: 5904275 - DNA, 16 bp, Homo sapiens
gaggtggcagggaagg

SEQ ID NO: 5904276 - DNA, 21 bp, Homo sapiens
gaggtggccaccgggggtggc

SEQ ID NO: 5904277 - DNA, 21 bp, Homo sapiens
gaggtggccagagctgggagg

SEQ ID NO: 5904278 - DNA, 18 bp, Homo sapiens
gaggtggccaggcctgcc

SEQ ID NO: 5904279 - DNA, 16 bp, Homo sapiens
gaggtggcccaggccc

SEQ ID NO: 5904280 - DNA, 22 bp, Homo sapiens
gaggtggccctcccaggctggt

SEQ ID NO: 5904281 - DNA, 13 bp, Homo sapiens
gaggtggcccttg

SEQ ID NO: 5904282 - DNA, 20 bp, Homo sapiens
gaggtggctctggaatgaca

SEQ ID NO: 5904283 - DNA, 11 bp, Homo sapiens
gaggtggctgg

SEQ ID NO: 5904284 - DNA, 14 bp, Homo sapiens
gaggtggcttcatg

SEQ ID NO: 5904285 - DNA, 21 bp, Homo sapiens
gaggtgggagacaaggaacca

SEQ ID NO: 5904286 - DNA, 18 bp, Homo sapiens
gaggtgggagaggcctca

SEQ ID NO: 5904287 - DNA, 15 bp, Homo sapiens
gaggtgggagcagga

SEQ ID NO: 5904288 - DNA, 23 bp, Homo sapiens
gaggtgggagcaggagattgaga

SEQ ID NO: 5904289 - DNA, 20 bp, Homo sapiens
gaggtgggaggatcttttga

SEQ ID NO: 5904290 - DNA, 17 bp, Homo sapiens
gaggtgggaggccaggc

SEQ ID NO: 5904291 - DNA, 21 bp, Homo sapiens
gaggtgggaggcccctggtgg

SEQ ID NO: 5904292 - DNA, 15 bp, Homo sapiens
gaggtgggaggtgga

SEQ ID NO: 5904293 - DNA, 15 bp, Homo sapiens
gaggtgggatcctcc

SEQ ID NO: 5904294 - DNA, 17 bp, Homo sapiens
gaggtgggatcctccct

SEQ ID NO: 5904295 - DNA, 18 bp, Homo sapiens
gaggtgggcagcagctca

SEQ ID NO: 5904296 - DNA, 16 bp, Homo sapiens
gaggtgggcagctggg

SEQ ID NO: 5904297 - DNA, 18 bp, Homo sapiens
gaggtgggcagctgggcc

SEQ ID NO: 5904298 - DNA, 19 bp, Homo sapiens
gaggtgggcagctgggccc

SEQ ID NO: 5904299 - DNA, 12 bp, Homo sapiens
gaggtgggcagg

SEQ ID NO: 5904300 - DNA, 23 bp, Homo sapiens
gaggtgggcaggtggtggcactg

SEQ ID NO: 5904301 - DNA, 11 bp, Homo sapiens
gaggtgggcat

SEQ ID NO: 5904302 - DNA, 15 bp, Homo sapiens
gaggtgggcccagga

SEQ ID NO: 5904303 - DNA, 14 bp, Homo sapiens
gaggtgggccgtgg

SEQ ID NO: 5904304 - DNA, 19 bp, Homo sapiens
gaggtgggccgtggccctt

SEQ ID NO: 5904305 - DNA, 23 bp, Homo sapiens
gaggtgggccttccatgggcatg

SEQ ID NO: 5904306 - DNA, 20 bp, Homo sapiens
gaggtggggaagagagcctg

SEQ ID NO: 5904307 - DNA, 23 bp, Homo sapiens
gaggtggggaagagagcctgccc

SEQ ID NO: 5904308 - DNA, 13 bp, Homo sapiens
gaggtggggaagg

SEQ ID NO: 5904309 - DNA, 14 bp, Homo sapiens
gaggtggggagggc

SEQ ID NO: 5904310 - DNA, 20 bp, Homo sapiens
gaggtggggagggcctctgg

SEQ ID NO: 5904311 - DNA, 22 bp, Homo sapiens
gaggtggggagggcctctggac

SEQ ID NO: 5904312 - DNA, 18 bp, Homo sapiens
gaggtggggcgaggcagg

SEQ ID NO: 5904313 - DNA, 20 bp, Homo sapiens
gaggtgggggcctcctcagc

SEQ ID NO: 5904314 - DNA, 17 bp, Homo sapiens
gaggtgggggctggagg

SEQ ID NO: 5904315 - DNA, 22 bp, Homo sapiens
gaggtgggggctggaggtgctg

SEQ ID NO: 5904316 - DNA, 16 bp, Homo sapiens
gaggtggggtgctggg

SEQ ID NO: 5904317 - DNA, 17 bp, Homo sapiens
gaggtggggtgctgggg

SEQ ID NO: 5904318 - DNA, 21 bp, Homo sapiens
gaggtggggtgctggggctgc

SEQ ID NO: 5904319 - DNA, 20 bp, Homo sapiens
gaggtgggtgggcctgactg

SEQ ID NO: 5904320 - DNA, 21 bp, Homo sapiens
gaggtgggtggtgggcttctg

SEQ ID NO: 5904321 - DNA, 13 bp, Homo sapiens
gaggtggtctgaa

SEQ ID NO: 5904322 - DNA, 17 bp, Homo sapiens
gaggtggtgccttctca

SEQ ID NO: 5904323 - DNA, 21 bp, Homo sapiens
gaggtgtacactaacatttcc

SEQ ID NO: 5904324 - DNA, 20 bp, Homo sapiens
gaggtgtatggagagaaaac

SEQ ID NO: 5904325 - DNA, 23 bp, Homo sapiens
gaggtgtattggtgttgcagccg

SEQ ID NO: 5904326 - DNA, 20 bp, Homo sapiens
gaggtgtcaccctgcagagc

SEQ ID NO: 5904327 - DNA, 21 bp, Homo sapiens
gaggtgtcaccctgcagagct

SEQ ID NO: 5904328 - DNA, 13 bp, Homo sapiens
gaggtgtctcagg

SEQ ID NO: 5904329 - DNA, 13 bp, Homo sapiens
gaggtgtctggcc

SEQ ID NO: 5904330 - DNA, 15 bp, Homo sapiens
gaggtgtctggcctg

SEQ ID NO: 5904331 - DNA, 15 bp, Homo sapiens
gaggtgtctggggtg

SEQ ID NO: 5904332 - DNA, 21 bp, Homo sapiens
gaggtgtgactaactatgcaa

SEQ ID NO: 5904333 - DNA, 18 bp, Homo sapiens
gaggtgtggagtggaggg

SEQ ID NO: 5904334 - DNA, 19 bp, Homo sapiens
gaggtgtggagtggagggg

SEQ ID NO: 5904335 - DNA, 17 bp, Homo sapiens
gaggtgttattttcaat

SEQ ID NO: 5904336 - DNA, 13 bp, Homo sapiens
gaggttaaaatat

SEQ ID NO: 5904337 - DNA, 21 bp, Homo sapiens
gaggttacaggtaccagttct

SEQ ID NO: 5904338 - DNA, 14 bp, Homo sapiens
gaggttactttagt

SEQ ID NO: 5904339 - DNA, 22 bp, Homo sapiens
gaggttagttctgtgtgtctgg

SEQ ID NO: 5904340 - DNA, 19 bp, Homo sapiens
gaggttataggtcactcct

SEQ ID NO: 5904341 - DNA, 15 bp, Homo sapiens
gaggttatctgcctg

SEQ ID NO: 5904342 - DNA, 19 bp, Homo sapiens
gaggttatctgcctggcct

SEQ ID NO: 5904343 - DNA, 23 bp, Homo sapiens
gaggttatctgcctggcctggct

SEQ ID NO: 5904344 - DNA, 18 bp, Homo sapiens
gaggttattttccgccag

SEQ ID NO: 5904345 - DNA, 19 bp, Homo sapiens
gaggttcaaagatattttg

SEQ ID NO: 5904346 - DNA, 19 bp, Homo sapiens
gaggttcaatgagatggtg

SEQ ID NO: 5904347 - DNA, 17 bp, Homo sapiens
gaggttccatgttttgt

SEQ ID NO: 5904348 - DNA, 16 bp, Homo sapiens
gaggttcccactctgg

SEQ ID NO: 5904349 - DNA, 18 bp, Homo sapiens
gaggttcccactctgggc

SEQ ID NO: 5904350 - DNA, 20 bp, Homo sapiens
gaggttcctaggttttgaga

SEQ ID NO: 5904351 - DNA, 16 bp, Homo sapiens
gaggttcctctgcctg

SEQ ID NO: 5904352 - DNA, 19 bp, Homo sapiens
gaggttcctctgcctgccc

SEQ ID NO: 5904353 - DNA, 21 bp, Homo sapiens
gaggttcctgtttgaacccag

SEQ ID NO: 5904354 - DNA, 20 bp, Homo sapiens
gaggttcgggattccctggt

SEQ ID NO: 5904355 - DNA, 20 bp, Homo sapiens
gaggttctcagcaagtgtac

SEQ ID NO: 5904356 - DNA, 18 bp, Homo sapiens
gaggttctggggaggaag

SEQ ID NO: 5904357 - DNA, 19 bp, Homo sapiens
gaggttctggggaggaagg

SEQ ID NO: 5904358 - DNA, 20 bp, Homo sapiens
gaggttctgtattttaagaa

SEQ ID NO: 5904359 - DNA, 22 bp, Homo sapiens
gaggttgaagcagaattgcttg

SEQ ID NO: 5904360 - DNA, 15 bp, Homo sapiens
gaggttgaagccaag

SEQ ID NO: 5904361 - DNA, 23 bp, Homo sapiens
gaggttgagaagactcctgggct

SEQ ID NO: 5904362 - DNA, 12 bp, Homo sapiens
gaggttgaggct

SEQ ID NO: 5904363 - DNA, 19 bp, Homo sapiens
gaggttgataactttgctt

SEQ ID NO: 5904364 - DNA, 20 bp, Homo sapiens
gaggttgatcagatctgaca

SEQ ID NO: 5904365 - DNA, 13 bp, Homo sapiens
gaggttgcagtga

SEQ ID NO: 5904366 - DNA, 20 bp, Homo sapiens
gaggttgcagtgaactgaga

SEQ ID NO: 5904367 - DNA, 19 bp, Homo sapiens
gaggttgcagtgagctgag

SEQ ID NO: 5904368 - DNA, 13 bp, Homo sapiens
gaggttgcagtgt

SEQ ID NO: 5904369 - DNA, 15 bp, Homo sapiens
gaggttgctgtacag

SEQ ID NO: 5904370 - DNA, 12 bp, Homo sapiens
gaggttggattt

SEQ ID NO: 5904371 - DNA, 14 bp, Homo sapiens
gaggttgtggatgc

SEQ ID NO: 5904372 - DNA, 13 bp, Homo sapiens
gaggttgtgggga

SEQ ID NO: 5904373 - DNA, 16 bp, Homo sapiens
gaggttgtggggaggc

SEQ ID NO: 5904374 - DNA, 22 bp, Homo sapiens
gaggttgttaaaacagaaaagg

SEQ ID NO: 5904375 - DNA, 21 bp, Homo sapiens
gaggtttcacccttaacccaa

SEQ ID NO: 5904376 - DNA, 15 bp, Homo sapiens
gaggtttcacctccg

SEQ ID NO: 5904377 - DNA, 20 bp, Homo sapiens
gaggtttcagtagctccttg

SEQ ID NO: 5904378 - DNA, 13 bp, Homo sapiens
gaggtttcagtga

SEQ ID NO: 5904379 - DNA, 19 bp, Homo sapiens
gaggtttcccaatggtgtt

SEQ ID NO: 5904380 - DNA, 22 bp, Homo sapiens
gaggtttgcagtcccaagcggt

SEQ ID NO: 5904381 - DNA, 17 bp, Homo sapiens
gaggtttggaagagtga

SEQ ID NO: 5904382 - DNA, 12 bp, Homo sapiens
gaggtttgtcaa

SEQ ID NO: 5904383 - DNA, 19 bp, Homo sapiens
gaggtttgtcaacacaaag

SEQ ID NO: 5904384 - DNA, 18 bp, Homo sapiens
gaggttttaatgtctgtt

SEQ ID NO: 5904385 - DNA, 18 bp, Homo sapiens
gaggttttattctgactt

SEQ ID NO: 5904386 - DNA, 16 bp, Homo sapiens
gaggttttatttcatt

SEQ ID NO: 5904387 - DNA, 15 bp, Homo sapiens
gaggttttctccccc

SEQ ID NO: 5904388 - DNA, 19 bp, Homo sapiens
gagtcaagtgtgcctgcta

SEQ ID NO: 5904389 - DNA, 16 bp, Homo sapiens
gagtcaatcagccttt

SEQ ID NO: 5904390 - DNA, 15 bp, Homo sapiens
gagtcacaagcctcg

SEQ ID NO: 5904391 - DNA, 17 bp, Homo sapiens
gagtcacagatgaggcc

SEQ ID NO: 5904392 - DNA, 17 bp, Homo sapiens
gagtcacaggtgtggga

SEQ ID NO: 5904393 - DNA, 21 bp, Homo sapiens
gagtcacattctgcttaaagt

SEQ ID NO: 5904394 - DNA, 13 bp, Homo sapiens
gagtcaccaagcc

SEQ ID NO: 5904395 - DNA, 15 bp, Homo sapiens
gagtcaccaagccca

SEQ ID NO: 5904396 - DNA, 17 bp, Homo sapiens
gagtcaccaagcccagt

SEQ ID NO: 5904397 - DNA, 20 bp, Homo sapiens
gagtcacccagttggtgact

SEQ ID NO: 5904398 - DNA, 15 bp, Homo sapiens
gagtcacccccccag

SEQ ID NO: 5904399 - DNA, 16 bp, Homo sapiens
gagtcacccccccagg

SEQ ID NO: 5904400 - DNA, 18 bp, Homo sapiens
gagtcacccccccaggcc

SEQ ID NO: 5904401 - DNA, 12 bp, Homo sapiens
gagtcacctcct

SEQ ID NO: 5904402 - DNA, 15 bp, Homo sapiens
gagtcacctcctcca

SEQ ID NO: 5904403 - DNA, 12 bp, Homo sapiens
gagtcacctgca

SEQ ID NO: 5904404 - DNA, 16 bp, Homo sapiens
gagtcacctgcaagcc

SEQ ID NO: 5904405 - DNA, 14 bp, Homo sapiens
gagtcacctgctcc

SEQ ID NO: 5904406 - DNA, 21 bp, Homo sapiens
gagtcacgctggggctctctg

SEQ ID NO: 5904407 - DNA, 15 bp, Homo sapiens
gagtcactacaactg

SEQ ID NO: 5904408 - DNA, 17 bp, Homo sapiens
gagtcactcacattgag

SEQ ID NO: 5904409 - DNA, 12 bp, Homo sapiens
gagtcactgcct

SEQ ID NO: 5904410 - DNA, 17 bp, Homo sapiens
gagtcacttctaataaa

SEQ ID NO: 5904411 - DNA, 15 bp, Homo sapiens
gagtcagagccatgt

SEQ ID NO: 5904412 - DNA, 17 bp, Homo sapiens
gagtcagagccctggct

SEQ ID NO: 5904413 - DNA, 13 bp, Homo sapiens
gagtcagaggaga

SEQ ID NO: 5904414 - DNA, 14 bp, Homo sapiens
gagtcagaggagaa

SEQ ID NO: 5904415 - DNA, 16 bp, Homo sapiens
gagtcagatgaggccc

SEQ ID NO: 5904416 - DNA, 19 bp, Homo sapiens
gagtcagatgaggccctgc

SEQ ID NO: 5904417 - DNA, 20 bp, Homo sapiens
gagtcagatgaggccctgca

SEQ ID NO: 5904418 - DNA, 16 bp, Homo sapiens
gagtcagatggcaatg

SEQ ID NO: 5904419 - DNA, 13 bp, Homo sapiens
gagtcagcacagg

SEQ ID NO: 5904420 - DNA, 14 bp, Homo sapiens
gagtcagccaggag

SEQ ID NO: 5904421 - DNA, 12 bp, Homo sapiens
gagtcagccctt

SEQ ID NO: 5904422 - DNA, 11 bp, Homo sapiens
gagtcagcctt

SEQ ID NO: 5904423 - DNA, 14 bp, Homo sapiens
gagtcagctctctg

SEQ ID NO: 5904424 - DNA, 15 bp, Homo sapiens
gagtcaggaaagaca

SEQ ID NO: 5904425 - DNA, 13 bp, Homo sapiens
gagtcaggaagag

SEQ ID NO: 5904426 - DNA, 21 bp, Homo sapiens
gagtcaggacctccggggaga

SEQ ID NO: 5904427 - DNA, 12 bp, Homo sapiens
gagtcaggagaa

SEQ ID NO: 5904428 - DNA, 14 bp, Homo sapiens
gagtcaggcccggc

SEQ ID NO: 5904429 - DNA, 17 bp, Homo sapiens
gagtcaggcctgggcag

SEQ ID NO: 5904430 - DNA, 17 bp, Homo sapiens
gagtcagggcccagagg

SEQ ID NO: 5904431 - DNA, 16 bp, Homo sapiens
gagtcagggctgtgct

SEQ ID NO: 5904432 - DNA, 15 bp, Homo sapiens
gagtcagtagccaga

SEQ ID NO: 5904433 - DNA, 17 bp, Homo sapiens
gagtcagtagccagagt

SEQ ID NO: 5904434 - DNA, 13 bp, Homo sapiens
gagtcagtctctt

SEQ ID NO: 5904435 - DNA, 15 bp, Homo sapiens
gagtcagtctctttc

SEQ ID NO: 5904436 - DNA, 14 bp, Homo sapiens
gagtcatattttga

SEQ ID NO: 5904437 - DNA, 13 bp, Homo sapiens
gagtcatcttgtg

SEQ ID NO: 5904438 - DNA, 19 bp, Homo sapiens
gagtcatgatctccctgcc

SEQ ID NO: 5904439 - DNA, 21 bp, Homo sapiens
gagtcattgccttgggcctgg

SEQ ID NO: 5904440 - DNA, 15 bp, Homo sapiens
gagtcatttaaatgt

SEQ ID NO: 5904441 - DNA, 13 bp, Homo sapiens
gagtcatttctga

SEQ ID NO: 5904442 - DNA, 21 bp, Homo sapiens
gagtcattttgtgttgaagag

SEQ ID NO: 5904443 - DNA, 15 bp, Homo sapiens
gagtccaaaatcatt

SEQ ID NO: 5904444 - DNA, 20 bp, Homo sapiens
gagtccaacgtggggcagca

SEQ ID NO: 5904445 - DNA, 15 bp, Homo sapiens
gagtccaagaatcca

SEQ ID NO: 5904446 - DNA, 13 bp, Homo sapiens
gagtccaaggcca

SEQ ID NO: 5904447 - DNA, 14 bp, Homo sapiens
gagtccaaggccag

SEQ ID NO: 5904448 - DNA, 17 bp, Homo sapiens
gagtccaaggccagtcc

SEQ ID NO: 5904449 - DNA, 16 bp, Homo sapiens
gagtccaatttaagga

SEQ ID NO: 5904450 - DNA, 16 bp, Homo sapiens
gagtccacgcccacca

SEQ ID NO: 5904451 - DNA, 20 bp, Homo sapiens
gagtccacgcccaccagcct

SEQ ID NO: 5904452 - DNA, 11 bp, Homo sapiens
gagtccactcc

SEQ ID NO: 5904453 - DNA, 15 bp, Homo sapiens
gagtccactgctcca

SEQ ID NO: 5904454 - DNA, 17 bp, Homo sapiens
gagtccactgtggcact

SEQ ID NO: 5904455 - DNA, 22 bp, Homo sapiens
gagtccactttgtttcgtgggg

SEQ ID NO: 5904456 - DNA, 23 bp, Homo sapiens
gagtccagacaccatcaccacgc

SEQ ID NO: 5904457 - DNA, 17 bp, Homo sapiens
gagtccagaccccccag

SEQ ID NO: 5904458 - DNA, 17 bp, Homo sapiens
gagtccagatggcaggc

SEQ ID NO: 5904459 - DNA, 14 bp, Homo sapiens
gagtccagcccctc

SEQ ID NO: 5904460 - DNA, 19 bp, Homo sapiens
gagtccagcccctcctccc

SEQ ID NO: 5904461 - DNA, 22 bp, Homo sapiens
gagtccagcccctcctccctca

SEQ ID NO: 5904462 - DNA, 23 bp, Homo sapiens
gagtccagcccctcctccctcag

SEQ ID NO: 5904463 - DNA, 16 bp, Homo sapiens
gagtccagctcccccc

SEQ ID NO: 5904464 - DNA, 20 bp, Homo sapiens
gagtccaggagccccagcca

SEQ ID NO: 5904465 - DNA, 23 bp, Homo sapiens
gagtccaggagccccagccagcc

SEQ ID NO: 5904466 - DNA, 14 bp, Homo sapiens
gagtccaggcacag

SEQ ID NO: 5904467 - DNA, 16 bp, Homo sapiens
gagtccaggcacagga

SEQ ID NO: 5904468 - DNA, 14 bp, Homo sapiens
gagtccaggcccca

SEQ ID NO: 5904469 - DNA, 12 bp, Homo sapiens
gagtccagggaa

SEQ ID NO: 5904470 - DNA, 20 bp, Homo sapiens
gagtccagggtttctctgca

SEQ ID NO: 5904471 - DNA, 16 bp, Homo sapiens
gagtccagtgctctgc

SEQ ID NO: 5904472 - DNA, 19 bp, Homo sapiens
gagtccagtgctctgcctc

SEQ ID NO: 5904473 - DNA, 14 bp, Homo sapiens
gagtccatcagcct

SEQ ID NO: 5904474 - DNA, 17 bp, Homo sapiens
gagtccatcagcctcca

SEQ ID NO: 5904475 - DNA, 13 bp, Homo sapiens
gagtccatgaaaa

SEQ ID NO: 5904476 - DNA, 18 bp, Homo sapiens
gagtccatgtcctatgcc

SEQ ID NO: 5904477 - DNA, 15 bp, Homo sapiens
gagtccattctccca

SEQ ID NO: 5904478 - DNA, 16 bp, Homo sapiens
gagtccattctcccag

SEQ ID NO: 5904479 - DNA, 17 bp, Homo sapiens
gagtccattctcccagg

SEQ ID NO: 5904480 - DNA, 15 bp, Homo sapiens
gagtcccaaggaaag

SEQ ID NO: 5904481 - DNA, 12 bp, Homo sapiens
gagtcccacccg

SEQ ID NO: 5904482 - DNA, 16 bp, Homo sapiens
gagtcccaccttggct

SEQ ID NO: 5904483 - DNA, 23 bp, Homo sapiens
gagtcccactgcctcaggttcct

SEQ ID NO: 5904484 - DNA, 12 bp, Homo sapiens
gagtcccagagc

SEQ ID NO: 5904485 - DNA, 14 bp, Homo sapiens
gagtcccagagctg

SEQ ID NO: 5904486 - DNA, 22 bp, Homo sapiens
gagtcccagagctgcacagggt

SEQ ID NO: 5904487 - DNA, 20 bp, Homo sapiens
gagtcccaggagctgcccag

SEQ ID NO: 5904488 - DNA, 18 bp, Homo sapiens
gagtcccaggctgagcct

SEQ ID NO: 5904489 - DNA, 19 bp, Homo sapiens
gagtcccaggctgagcctc

SEQ ID NO: 5904490 - DNA, 16 bp, Homo sapiens
gagtcccagtgggagg

SEQ ID NO: 5904491 - DNA, 20 bp, Homo sapiens
gagtccccagactctgccta

SEQ ID NO: 5904492 - DNA, 16 bp, Homo sapiens
gagtccccccacccct

SEQ ID NO: 5904493 - DNA, 21 bp, Homo sapiens
gagtccccccacccctcccca

SEQ ID NO: 5904494 - DNA, 20 bp, Homo sapiens
gagtcccccctcccacctcc

SEQ ID NO: 5904495 - DNA, 22 bp, Homo sapiens
gagtcccccctcccacctccag

SEQ ID NO: 5904496 - DNA, 11 bp, Homo sapiens
gagtcccctca

SEQ ID NO: 5904497 - DNA, 16 bp, Homo sapiens
gagtcccctcacctcc

SEQ ID NO: 5904498 - DNA, 19 bp, Homo sapiens
gagtcccctcacctcctct

SEQ ID NO: 5904499 - DNA, 16 bp, Homo sapiens
gagtcccctccaggaa

SEQ ID NO: 5904500 - DNA, 14 bp, Homo sapiens
gagtcccctgtttg

SEQ ID NO: 5904501 - DNA, 23 bp, Homo sapiens
gagtcccctgtttgtttctgaaa

SEQ ID NO: 5904502 - DNA, 14 bp, Homo sapiens
gagtcccgtcagga

SEQ ID NO: 5904503 - DNA, 20 bp, Homo sapiens
gagtccctatagtttcacca

SEQ ID NO: 5904504 - DNA, 22 bp, Homo sapiens
gagtccctcacgtttcttcccc

SEQ ID NO: 5904505 - DNA, 22 bp, Homo sapiens
gagtccctcctcccccacgcct

SEQ ID NO: 5904506 - DNA, 16 bp, Homo sapiens
gagtccctgcctggac

SEQ ID NO: 5904507 - DNA, 15 bp, Homo sapiens
gagtccctggcaaga

SEQ ID NO: 5904508 - DNA, 23 bp, Homo sapiens
gagtcccttagtactcttctagc

SEQ ID NO: 5904509 - DNA, 22 bp, Homo sapiens
gagtcccttccaggccatcaga

SEQ ID NO: 5904510 - DNA, 14 bp, Homo sapiens
gagtccctttgaag

SEQ ID NO: 5904511 - DNA, 19 bp, Homo sapiens
gagtcccttttcattctcc

SEQ ID NO: 5904512 - DNA, 14 bp, Homo sapiens
gagtccgcccatcc

SEQ ID NO: 5904513 - DNA, 22 bp, Homo sapiens
gagtccgcctgcgcctccatcc

SEQ ID NO: 5904514 - DNA, 16 bp, Homo sapiens
gagtccggatttctaa

SEQ ID NO: 5904515 - DNA, 17 bp, Homo sapiens
gagtcctaggacttaaa

SEQ ID NO: 5904516 - DNA, 16 bp, Homo sapiens
gagtcctcactcccag

SEQ ID NO: 5904517 - DNA, 20 bp, Homo sapiens
gagtcctcattgaatcctca

SEQ ID NO: 5904518 - DNA, 21 bp, Homo sapiens
gagtcctcattgttcagaaaa

SEQ ID NO: 5904519 - DNA, 14 bp, Homo sapiens
gagtcctccagaac

SEQ ID NO: 5904520 - DNA, 15 bp, Homo sapiens
gagtcctccagaact

SEQ ID NO: 5904521 - DNA, 21 bp, Homo sapiens
gagtcctccagaactcttcct

SEQ ID NO: 5904522 - DNA, 20 bp, Homo sapiens
gagtcctccttcccagctct

SEQ ID NO: 5904523 - DNA, 19 bp, Homo sapiens
gagtcctctagcaggccta

SEQ ID NO: 5904524 - DNA, 22 bp, Homo sapiens
gagtcctgaagatcaagccagt

SEQ ID NO: 5904525 - DNA, 22 bp, Homo sapiens
gagtcctgatcctaaccctggg

SEQ ID NO: 5904526 - DNA, 21 bp, Homo sapiens
gagtcctgccgacggagccac

SEQ ID NO: 5904527 - DNA, 13 bp, Homo sapiens
gagtcctgccttc

SEQ ID NO: 5904528 - DNA, 19 bp, Homo sapiens
gagtcctggatgatactaa

SEQ ID NO: 5904529 - DNA, 14 bp, Homo sapiens
gagtcctggtccct

SEQ ID NO: 5904530 - DNA, 19 bp, Homo sapiens
gagtcctggtccctctgag

SEQ ID NO: 5904531 - DNA, 19 bp, Homo sapiens
gagtcctggtttcctggca

SEQ ID NO: 5904532 - DNA, 15 bp, Homo sapiens
gagtcctgtctctgc

SEQ ID NO: 5904533 - DNA, 13 bp, Homo sapiens
gagtcctgttctc

SEQ ID NO: 5904534 - DNA, 16 bp, Homo sapiens
gagtcctgttctcaga

SEQ ID NO: 5904535 - DNA, 17 bp, Homo sapiens
gagtcctgttctcagag

SEQ ID NO: 5904536 - DNA, 18 bp, Homo sapiens
gagtcctgttctcagagc

SEQ ID NO: 5904537 - DNA, 22 bp, Homo sapiens
gagtccttagcctgggcctcct

SEQ ID NO: 5904538 - DNA, 15 bp, Homo sapiens
gagtcgaggacaggg

SEQ ID NO: 5904539 - DNA, 13 bp, Homo sapiens
gagtcgctgtgcc

SEQ ID NO: 5904540 - DNA, 22 bp, Homo sapiens
gagtcggagtggacaccgctca

SEQ ID NO: 5904541 - DNA, 19 bp, Homo sapiens
gagtcggatctagccatgg

SEQ ID NO: 5904542 - DNA, 18 bp, Homo sapiens
gagtcggccccacatggg

SEQ ID NO: 5904543 - DNA, 15 bp, Homo sapiens
gagtcggctgggcag

SEQ ID NO: 5904544 - DNA, 16 bp, Homo sapiens
gagtcggctgggcagg

SEQ ID NO: 5904545 - DNA, 18 bp, Homo sapiens
gagtcggctgggcagggc

SEQ ID NO: 5904546 - DNA, 20 bp, Homo sapiens
gagtcggttagtcattgata

SEQ ID NO: 5904547 - DNA, 18 bp, Homo sapiens
gagtcgtggggtgtgctg

SEQ ID NO: 5904548 - DNA, 17 bp, Homo sapiens
gagtcgttggagactga

SEQ ID NO: 5904549 - DNA, 20 bp, Homo sapiens
gagtcgttggagactgaaga

SEQ ID NO: 5904550 - DNA, 13 bp, Homo sapiens
gagtctagaaccc

SEQ ID NO: 5904551 - DNA, 17 bp, Homo sapiens
gagtctagattcaaagg

SEQ ID NO: 5904552 - DNA, 22 bp, Homo sapiens
gagtctagattcaaaggttcta

SEQ ID NO: 5904553 - DNA, 19 bp, Homo sapiens
gagtctagcgtagtgcagc

SEQ ID NO: 5904554 - DNA, 15 bp, Homo sapiens
gagtctagtcagtgt

SEQ ID NO: 5904555 - DNA, 15 bp, Homo sapiens
gagtctatcaatcaa

SEQ ID NO: 5904556 - DNA, 16 bp, Homo sapiens
gagtctatgttcaaag

SEQ ID NO: 5904557 - DNA, 22 bp, Homo sapiens
gagtctcaacatgtgtttctga

SEQ ID NO: 5904558 - DNA, 18 bp, Homo sapiens
gagtctcaataaactgaa

SEQ ID NO: 5904559 - DNA, 21 bp, Homo sapiens
gagtctcactctcgtcgccca

SEQ ID NO: 5904560 - DNA, 22 bp, Homo sapiens
gagtctcagaaactcccctggg

SEQ ID NO: 5904561 - DNA, 16 bp, Homo sapiens
gagtctcagagcacag

SEQ ID NO: 5904562 - DNA, 16 bp, Homo sapiens
gagtctcattcctctg

SEQ ID NO: 5904563 - DNA, 17 bp, Homo sapiens
gagtctcattcctctgt

SEQ ID NO: 5904564 - DNA, 17 bp, Homo sapiens
gagtctcatttgggcta

SEQ ID NO: 5904565 - DNA, 14 bp, Homo sapiens
gagtctcccaaggc

SEQ ID NO: 5904566 - DNA, 14 bp, Homo sapiens
gagtctcccaggga

SEQ ID NO: 5904567 - DNA, 22 bp, Homo sapiens
gagtctccctccgactccagat

SEQ ID NO: 5904568 - DNA, 16 bp, Homo sapiens
gagtgtcctgtctgct

SEQ ID NO: 5904569 - DNA, 20 bp, Homo sapiens
gagtgtcctgtctgctgggc

SEQ ID NO: 5904570 - DNA, 20 bp, Homo sapiens
gagtgtctatggagcagccg

SEQ ID NO: 5904571 - DNA, 18 bp, Homo sapiens
gagtgtctgcgccccgcc

SEQ ID NO: 5904572 - DNA, 16 bp, Homo sapiens
gagtgtctgtgagagg

SEQ ID NO: 5904573 - DNA, 19 bp, Homo sapiens
gagtgtctttccacggagc

SEQ ID NO: 5904574 - DNA, 20 bp, Homo sapiens
gagtgtgaatataaatgtgt

SEQ ID NO: 5904575 - DNA, 12 bp, Homo sapiens
gagtgtgacagg

SEQ ID NO: 5904576 - DNA, 14 bp, Homo sapiens
gagtgtgacagggc

SEQ ID NO: 5904577 - DNA, 15 bp, Homo sapiens
gagtgtgacagggcc

SEQ ID NO: 5904578 - DNA, 17 bp, Homo sapiens
gagtgtgacagggccag

SEQ ID NO: 5904579 - DNA, 20 bp, Homo sapiens
gagtgtgaccaaaagttaca

SEQ ID NO: 5904580 - DNA, 22 bp, Homo sapiens
gagtgtgacgggggttggggtg

SEQ ID NO: 5904581 - DNA, 18 bp, Homo sapiens
gagtgtgagggcagcact

SEQ ID NO: 5904582 - DNA, 19 bp, Homo sapiens
gagtgtgagtgtgtgtgca

SEQ ID NO: 5904583 - DNA, 16 bp, Homo sapiens
gagtgtgatgcaggaa

SEQ ID NO: 5904584 - DNA, 10 bp, Homo sapiens
gagtgtgcaa

SEQ ID NO: 5904585 - DNA, 21 bp, Homo sapiens
gagtgtgcaactggccagcca

SEQ ID NO: 5904586 - DNA, 14 bp, Homo sapiens
gagtgtgcagacag

SEQ ID NO: 5904587 - DNA, 18 bp, Homo sapiens
gagtgtgcagacagccat

SEQ ID NO: 5904588 - DNA, 13 bp, Homo sapiens
gagtgtgcatgga

SEQ ID NO: 5904589 - DNA, 15 bp, Homo sapiens
gagtgtgcatggagg

SEQ ID NO: 5904590 - DNA, 18 bp, Homo sapiens
gagtgtgcggctgtgtgt

SEQ ID NO: 5904591 - DNA, 19 bp, Homo sapiens
gagtgtgctcaggccgggc

SEQ ID NO: 5904592 - DNA, 16 bp, Homo sapiens
gagtgtgctgaacaca

SEQ ID NO: 5904593 - DNA, 15 bp, Homo sapiens
gagtgtgctggagga

SEQ ID NO: 5904594 - DNA, 14 bp, Homo sapiens
gagtgtggcctgga

SEQ ID NO: 5904595 - DNA, 16 bp, Homo sapiens
gagtgtggcctggatc

SEQ ID NO: 5904596 - DNA, 12 bp, Homo sapiens
gagtgtgggaag

SEQ ID NO: 5904597 - DNA, 18 bp, Homo sapiens
gagtgtgggaagggagag

SEQ ID NO: 5904598 - DNA, 15 bp, Homo sapiens
gagtgtgggctgccc

SEQ ID NO: 5904599 - DNA, 18 bp, Homo sapiens
gagtgtgggggaggcgca

SEQ ID NO: 5904600 - DNA, 16 bp, Homo sapiens
gagtgtgtaaggtata

SEQ ID NO: 5904601 - DNA, 13 bp, Homo sapiens
gagtgtgtaattt

SEQ ID NO: 5904602 - DNA, 12 bp, Homo sapiens
gagtgtgtctgc

SEQ ID NO: 5904603 - DNA, 13 bp, Homo sapiens
gagtgtgtctgct

SEQ ID NO: 5904604 - DNA, 21 bp, Homo sapiens
gagtgtgtgggggtctgggag

SEQ ID NO: 5904605 - DNA, 15 bp, Homo sapiens
gagtgtgtgtgtgca

SEQ ID NO: 5904606 - DNA, 14 bp, Homo sapiens
gagtgtgtgtgtgt

SEQ ID NO: 5904607 - DNA, 17 bp, Homo sapiens
gagtgtgtgtgtgtgtc

SEQ ID NO: 5904608 - DNA, 18 bp, Homo sapiens
gagtgtgttttataaact

SEQ ID NO: 5904609 - DNA, 21 bp, Homo sapiens
gagtgtgtttttgcactgtct

SEQ ID NO: 5904610 - DNA, 21 bp, Homo sapiens
gagtgttatcatattggtgct

SEQ ID NO: 5904611 - DNA, 15 bp, Homo sapiens
gagtgttatgtattt

SEQ ID NO: 5904612 - DNA, 21 bp, Homo sapiens
gagtgttcaaactactgtaca

SEQ ID NO: 5904613 - DNA, 19 bp, Homo sapiens
gagtgttccccttccactg

SEQ ID NO: 5904614 - DNA, 23 bp, Homo sapiens
gagtgttctgggatttctctaga

SEQ ID NO: 5904615 - DNA, 22 bp, Homo sapiens
gagtgttctgtgggcttggcct

SEQ ID NO: 5904616 - DNA, 22 bp, Homo sapiens
gagtgttgggcatgtgatcacg

SEQ ID NO: 5904617 - DNA, 14 bp, Homo sapiens
gagtgttggggctg

SEQ ID NO: 5904618 - DNA, 15 bp, Homo sapiens
gagtgttggggctgg

SEQ ID NO: 5904619 - DNA, 19 bp, Homo sapiens
gagtgttgttgctgaccag

SEQ ID NO: 5904620 - DNA, 15 bp, Homo sapiens
gagtgtttgaaaact

SEQ ID NO: 5904621 - DNA, 18 bp, Homo sapiens
gagtgtttgtgagctttt

SEQ ID NO: 5904622 - DNA, 22 bp, Homo sapiens
gagtgtttgtgtctgactcagg

SEQ ID NO: 5904623 - DNA, 17 bp, Homo sapiens
gagttaaaaagggcagg

SEQ ID NO: 5904624 - DNA, 12 bp, Homo sapiens
gagttaaaatgt

SEQ ID NO: 5904625 - DNA, 13 bp, Homo sapiens
gagttaaaatgtt

SEQ ID NO: 5904626 - DNA, 18 bp, Homo sapiens
gagttaaatcagtaatct

SEQ ID NO: 5904627 - DNA, 16 bp, Homo sapiens
gagttaacaggacagt

SEQ ID NO: 5904628 - DNA, 18 bp, Homo sapiens
gagttaacgggtgaataa

SEQ ID NO: 5904629 - DNA, 19 bp, Homo sapiens
gagttaactttttgtagga

SEQ ID NO: 5904630 - DNA, 12 bp, Homo sapiens
gagttaagacct

SEQ ID NO: 5904631 - DNA, 13 bp, Homo sapiens
gagttaagtctat

SEQ ID NO: 5904632 - DNA, 17 bp, Homo sapiens
gagttacattaatgtta

SEQ ID NO: 5904633 - DNA, 18 bp, Homo sapiens
gagttacttagaatgcca

SEQ ID NO: 5904634 - DNA, 21 bp, Homo sapiens
gagttagaaccacagcagaca

SEQ ID NO: 5904635 - DNA, 20 bp, Homo sapiens
gagttagaggccagcctggc

SEQ ID NO: 5904636 - DNA, 18 bp, Homo sapiens
gagttaggctattcacaa

SEQ ID NO: 5904637 - DNA, 15 bp, Homo sapiens
gagttagggagagag

SEQ ID NO: 5904638 - DNA, 22 bp, Homo sapiens
gagttagggagagagaagcagg

SEQ ID NO: 5904639 - DNA, 18 bp, Homo sapiens
gagttaggggccttaggg

SEQ ID NO: 5904640 - DNA, 16 bp, Homo sapiens
gagttaggtgggggtg

SEQ ID NO: 5904641 - DNA, 22 bp, Homo sapiens
gagttagtcgccctacagaaaa

SEQ ID NO: 5904642 - DNA, 16 bp, Homo sapiens
gagttataaaaataca

SEQ ID NO: 5904643 - DNA, 15 bp, Homo sapiens
gagttatattaaaga

SEQ ID NO: 5904644 - DNA, 18 bp, Homo sapiens
gagttatcaagagacact

SEQ ID NO: 5904645 - DNA, 20 bp, Homo sapiens
gagttatcatgaattttaaa

SEQ ID NO: 5904646 - DNA, 15 bp, Homo sapiens
gagttatcttcttta

SEQ ID NO: 5904647 - DNA, 20 bp, Homo sapiens
gagttatgataacaccagtg

SEQ ID NO: 5904648 - DNA, 22 bp, Homo sapiens
gagttatgataacaccagtggg

SEQ ID NO: 5904649 - DNA, 22 bp, Homo sapiens
gagttatgatgtaatctctctg

SEQ ID NO: 5904650 - DNA, 22 bp, Homo sapiens
gagttattcataaagagaaaat

SEQ ID NO: 5904651 - DNA, 14 bp, Homo sapiens
gagttattgagatt

SEQ ID NO: 5904652 - DNA, 21 bp, Homo sapiens
gagttatttaactggtaagcg

SEQ ID NO: 5904653 - DNA, 15 bp, Homo sapiens
gagttcaaatacttt

SEQ ID NO: 5904654 - DNA, 15 bp, Homo sapiens
gagttcaactacatg

SEQ ID NO: 5904655 - DNA, 14 bp, Homo sapiens
gagttcaagaccag

SEQ ID NO: 5904656 - DNA, 11 bp, Homo sapiens
gagttcaatga

SEQ ID NO: 5904657 - DNA, 12 bp, Homo sapiens
gagttcaatgat

SEQ ID NO: 5904658 - DNA, 16 bp, Homo sapiens
gagttcaatgatctag

SEQ ID NO: 5904659 - DNA, 21 bp, Homo sapiens
gagttcaatgatctaggttta

SEQ ID NO: 5904660 - DNA, 13 bp, Homo sapiens
gagttcacaggag

SEQ ID NO: 5904661 - DNA, 22 bp, Homo sapiens
gagttcacaggaggccagtggg

SEQ ID NO: 5904662 - DNA, 14 bp, Homo sapiens
gagttcaccttgga

SEQ ID NO: 5904663 - DNA, 17 bp, Homo sapiens
gagttcaccttggaagg

SEQ ID NO: 5904664 - DNA, 22 bp, Homo sapiens
gagttcacttcatcttctcagc

SEQ ID NO: 5904665 - DNA, 16 bp, Homo sapiens
gagttcagctgcttct

SEQ ID NO: 5904666 - DNA, 19 bp, Homo sapiens
gagttcaggaacccttctc

SEQ ID NO: 5904667 - DNA, 19 bp, Homo sapiens
gagttcagggaggggctga

SEQ ID NO: 5904668 - DNA, 19 bp, Homo sapiens
gagttcaggtagctgcccc

SEQ ID NO: 5904669 - DNA, 22 bp, Homo sapiens
gagttcaggttaccagaaccag

SEQ ID NO: 5904670 - DNA, 21 bp, Homo sapiens
gagttcatagaaatacatcaa

SEQ ID NO: 5904671 - DNA, 20 bp, Homo sapiens
gagttcatcttgaattgtaa

SEQ ID NO: 5904672 - DNA, 19 bp, Homo sapiens
gagttccaagttgaaggga

SEQ ID NO: 5904673 - DNA, 15 bp, Homo sapiens
gagttccagaaagta

SEQ ID NO: 5904674 - DNA, 20 bp, Homo sapiens
gagttcccaaagggagggtg

SEQ ID NO: 5904675 - DNA, 22 bp, Homo sapiens
gagttcccaaagggagggtggc

SEQ ID NO: 5904676 - DNA, 18 bp, Homo sapiens
gagttcccgggagctggg

SEQ ID NO: 5904677 - DNA, 20 bp, Homo sapiens
gagttcccgggagctgggcc

SEQ ID NO: 5904678 - DNA, 23 bp, Homo sapiens
gagttcccgggagctgggccctg

SEQ ID NO: 5904679 - DNA, 21 bp, Homo sapiens
gagttcccttgattcaaataa

SEQ ID NO: 5904680 - DNA, 22 bp, Homo sapiens
gagttccggggagaaacccaga

SEQ ID NO: 5904681 - DNA, 13 bp, Homo sapiens
gagttcctagcca

SEQ ID NO: 5904682 - DNA, 19 bp, Homo sapiens
gagttcctctttgccctga

SEQ ID NO: 5904683 - DNA, 15 bp, Homo sapiens
gagttcctgctccgt

SEQ ID NO: 5904684 - DNA, 17 bp, Homo sapiens
gagttccttatccctct

SEQ ID NO: 5904685 - DNA, 23 bp, Homo sapiens
gagttccttatccctctcttccc

SEQ ID NO: 5904686 - DNA, 14 bp, Homo sapiens
gagttcctttctgg

SEQ ID NO: 5904687 - DNA, 17 bp, Homo sapiens
gagttcgagaccagcct

SEQ ID NO: 5904688 - DNA, 18 bp, Homo sapiens
gagttcgagaccagcctc

SEQ ID NO: 5904689 - DNA, 21 bp, Homo sapiens
gagttcgagaccagcctggcc

SEQ ID NO: 5904690 - DNA, 18 bp, Homo sapiens
gagttcgagagcagcctg

SEQ ID NO: 5904691 - DNA, 19 bp, Homo sapiens
gagttcgagagcagcctgg

SEQ ID NO: 5904692 - DNA, 17 bp, Homo sapiens
gagttcgaggcgagcct

SEQ ID NO: 5904693 - DNA, 18 bp, Homo sapiens
gagttcgaggcgagcctg

SEQ ID NO: 5904694 - DNA, 19 bp, Homo sapiens
gagttcgaggctgcagtca

SEQ ID NO: 5904695 - DNA, 18 bp, Homo sapiens
gagttctaacacatttcg

SEQ ID NO: 5904696 - DNA, 20 bp, Homo sapiens
gagttctatccccaagctgg

SEQ ID NO: 5904697 - DNA, 23 bp, Homo sapiens
gagttctatggagactttgctgt

SEQ ID NO: 5904698 - DNA, 20 bp, Homo sapiens
gagttctcactatgtttctc

SEQ ID NO: 5904699 - DNA, 21 bp, Homo sapiens
gagttctcactatgtttctca

SEQ ID NO: 5904700 - DNA, 18 bp, Homo sapiens
gagttctcagggctcctg

SEQ ID NO: 5904701 - DNA, 21 bp, Homo sapiens
gagttctcagggctcctgcct

SEQ ID NO: 5904702 - DNA, 16 bp, Homo sapiens
gagttctccctgtaca

SEQ ID NO: 5904703 - DNA, 15 bp, Homo sapiens
gagttctcctggagc

SEQ ID NO: 5904704 - DNA, 20 bp, Homo sapiens
gagttctcctggaggcaggg

SEQ ID NO: 5904705 - DNA, 22 bp, Homo sapiens
gagttctctcatcggaggccca

SEQ ID NO: 5904706 - DNA, 12 bp, Homo sapiens
gagttctctgat

SEQ ID NO: 5904707 - DNA, 19 bp, Homo sapiens
gagttctctgatgcagaaa

SEQ ID NO: 5904708 - DNA, 13 bp, Homo sapiens
gagttctcttccg

SEQ ID NO: 5904709 - DNA, 16 bp, Homo sapiens
gagttctgctcattct

SEQ ID NO: 5904710 - DNA, 21 bp, Homo sapiens
gagttctgctcattctaatga

SEQ ID NO: 5904711 - DNA, 16 bp, Homo sapiens
gagttctggatgtaaa

SEQ ID NO: 5904712 - DNA, 17 bp, Homo sapiens
gagttctgggtttctag

SEQ ID NO: 5904713 - DNA, 22 bp, Homo sapiens
gagttctgttgtgtttgtcaaa

SEQ ID NO: 5904714 - DNA, 15 bp, Homo sapiens
gagttcttaaagttt

SEQ ID NO: 5904715 - DNA, 15 bp, Homo sapiens
gagttcttcctgtaa

SEQ ID NO: 5904716 - DNA, 21 bp, Homo sapiens
gagttcttcctgtaatcttgt

SEQ ID NO: 5904717 - DNA, 12 bp, Homo sapiens
gagttcttgccc

SEQ ID NO: 5904718 - DNA, 21 bp, Homo sapiens
gagttctttaggtgcctcctg

SEQ ID NO: 5904719 - DNA, 22 bp, Homo sapiens
gagttctttgcaagcttattta

SEQ ID NO: 5904720 - DNA, 12 bp, Homo sapiens
gagttctttgct

SEQ ID NO: 5904721 - DNA, 22 bp, Homo sapiens
gagttctttgctgcccctgtct

SEQ ID NO: 5904722 - DNA, 23 bp, Homo sapiens
gagttctttgctgcccctgtctg

SEQ ID NO: 5904723 - DNA, 16 bp, Homo sapiens
gagttctttggctcta

SEQ ID NO: 5904724 - DNA, 21 bp, Homo sapiens
gagttctttttgaagtattta

SEQ ID NO: 5904725 - DNA, 16 bp, Homo sapiens
gagttgaggaactgta

SEQ ID NO: 5904726 - DNA, 12 bp, Homo sapiens
gagttgaggcca

SEQ ID NO: 5904727 - DNA, 18 bp, Homo sapiens
gagttgaggggcttccct

SEQ ID NO: 5904728 - DNA, 22 bp, Homo sapiens
gagttgaggggcttccctctgc

SEQ ID NO: 5904729 - DNA, 20 bp, Homo sapiens
gagttgagtattacacatta

SEQ ID NO: 5904730 - DNA, 22 bp, Homo sapiens
gagttgatactacagtttgtta

SEQ ID NO: 5904731 - DNA, 20 bp, Homo sapiens
gagttgatctggaacccaga

SEQ ID NO: 5904732 - DNA, 20 bp, Homo sapiens
gagttgatgactttctgttt

SEQ ID NO: 5904733 - DNA, 14 bp, Homo sapiens
gagttgatgtctcc

SEQ ID NO: 5904734 - DNA, 15 bp, Homo sapiens
gagttgattcagctc

SEQ ID NO: 5904735 - DNA, 17 bp, Homo sapiens
gagttgattcagctctg

SEQ ID NO: 5904736 - DNA, 19 bp, Homo sapiens
gagttgcaccattctttct

SEQ ID NO: 5904737 - DNA, 20 bp, Homo sapiens
gagttgcaccattctttctt

SEQ ID NO: 5904738 - DNA, 16 bp, Homo sapiens
gagttgcattgattca

SEQ ID NO: 5904739 - DNA, 18 bp, Homo sapiens
gagttgctcactcaggac

SEQ ID NO: 5904740 - DNA, 14 bp, Homo sapiens
gagttgctggaaaa

SEQ ID NO: 5904741 - DNA, 15 bp, Homo sapiens
gagttgctttgccag

SEQ ID NO: 5904742 - DNA, 14 bp, Homo sapiens
gagttgcttttcta

SEQ ID NO: 5904743 - DNA, 15 bp, Homo sapiens
gagttggacacactg

SEQ ID NO: 5904744 - DNA, 16 bp, Homo sapiens
gagttggacacactgt

SEQ ID NO: 5904745 - DNA, 20 bp, Homo sapiens
gatacaggactggttccttc

SEQ ID NO: 5904746 - DNA, 19 bp, Homo sapiens
gatacaggagagaagctgg

SEQ ID NO: 5904747 - DNA, 22 bp, Homo sapiens
gatacagggtgctccttgtcaa

SEQ ID NO: 5904748 - DNA, 21 bp, Homo sapiens
gatacagtattatagatataa

SEQ ID NO: 5904749 - DNA, 18 bp, Homo sapiens
gatacagtcaacaagcct

SEQ ID NO: 5904750 - DNA, 19 bp, Homo sapiens
gatacagtcaacaagcctg

SEQ ID NO: 5904751 - DNA, 14 bp, Homo sapiens
gatacagtcattat

SEQ ID NO: 5904752 - DNA, 14 bp, Homo sapiens
gatacagtgcccac

SEQ ID NO: 5904753 - DNA, 21 bp, Homo sapiens
gatacagtgcccaccgccctc

SEQ ID NO: 5904754 - DNA, 14 bp, Homo sapiens
gatacagtgttttt

SEQ ID NO: 5904755 - DNA, 16 bp, Homo sapiens
gatacagttactcaga

SEQ ID NO: 5904756 - DNA, 12 bp, Homo sapiens
gatacataaaaa

SEQ ID NO: 5904757 - DNA, 20 bp, Homo sapiens
gatacataactaaatttgat

SEQ ID NO: 5904758 - DNA, 23 bp, Homo sapiens
gatacataactaaatttgatact

SEQ ID NO: 5904759 - DNA, 15 bp, Homo sapiens
gatacatagatggac

SEQ ID NO: 5904760 - DNA, 13 bp, Homo sapiens
gatacatcactgc

SEQ ID NO: 5904761 - DNA, 14 bp, Homo sapiens
gatacatcactgct

SEQ ID NO: 5904762 - DNA, 16 bp, Homo sapiens
gatacatcactgcttg

SEQ ID NO: 5904763 - DNA, 20 bp, Homo sapiens
gatacatccaaagcagacag

SEQ ID NO: 5904764 - DNA, 21 bp, Homo sapiens
gatacatccaaagcagacagc

SEQ ID NO: 5904765 - DNA, 21 bp, Homo sapiens
gatacatcttataaactgact

SEQ ID NO: 5904766 - DNA, 12 bp, Homo sapiens
gatacatgtgcc

SEQ ID NO: 5904767 - DNA, 23 bp, Homo sapiens
gatacattccctatcaaaacata

SEQ ID NO: 5904768 - DNA, 20 bp, Homo sapiens
gatacatttatcttctgttt

SEQ ID NO: 5904769 - DNA, 21 bp, Homo sapiens
gatacatttatcttctgtttt

SEQ ID NO: 5904770 - DNA, 13 bp, Homo sapiens
gatacatttctga

SEQ ID NO: 5904771 - DNA, 13 bp, Homo sapiens
gatacatttttat

SEQ ID NO: 5904772 - DNA, 16 bp, Homo sapiens
gataccacttttcatt

SEQ ID NO: 5904773 - DNA, 17 bp, Homo sapiens
gataccagacctcttct

SEQ ID NO: 5904774 - DNA, 16 bp, Homo sapiens
gataccagcagcaact

SEQ ID NO: 5904775 - DNA, 20 bp, Homo sapiens
gataccagcagcaactgaaa

SEQ ID NO: 5904776 - DNA, 12 bp, Homo sapiens
gataccagcccc

SEQ ID NO: 5904777 - DNA, 15 bp, Homo sapiens
gataccagcgaggag

SEQ ID NO: 5904778 - DNA, 20 bp, Homo sapiens
gataccaggttgaaagacct

SEQ ID NO: 5904779 - DNA, 22 bp, Homo sapiens
gataccataaaaagaggatgat

SEQ ID NO: 5904780 - DNA, 16 bp, Homo sapiens
gataccatatgaatga

SEQ ID NO: 5904781 - DNA, 21 bp, Homo sapiens
gataccatcagcaaagaattt

SEQ ID NO: 5904782 - DNA, 18 bp, Homo sapiens
gatacccaggaccaagcc

SEQ ID NO: 5904783 - DNA, 14 bp, Homo sapiens
gatacccatcccat

SEQ ID NO: 5904784 - DNA, 14 bp, Homo sapiens
gataccccaaagtc

SEQ ID NO: 5904785 - DNA, 21 bp, Homo sapiens
gatacccccctctgtcttgtg

SEQ ID NO: 5904786 - DNA, 13 bp, Homo sapiens
gataccctctgag

SEQ ID NO: 5904787 - DNA, 21 bp, Homo sapiens
gataccctctgagacagagag

SEQ ID NO: 5904788 - DNA, 22 bp, Homo sapiens
gataccctctgagacagagagc

SEQ ID NO: 5904789 - DNA, 18 bp, Homo sapiens
gatacctattaaaggaaa

SEQ ID NO: 5904790 - DNA, 22 bp, Homo sapiens
gatacctattaaaggaaaacca

SEQ ID NO: 5904791 - DNA, 18 bp, Homo sapiens
gatacctcagccctggcc

SEQ ID NO: 5904792 - DNA, 12 bp, Homo sapiens
gatacctggagc

SEQ ID NO: 5904793 - DNA, 14 bp, Homo sapiens
gatacctgtgagga

SEQ ID NO: 5904794 - DNA, 15 bp, Homo sapiens
gatacctgtgaggac

SEQ ID NO: 5904795 - DNA, 19 bp, Homo sapiens
gataccttaaaatttgaaa

SEQ ID NO: 5904796 - DNA, 20 bp, Homo sapiens
gataccttcatttaatatat

SEQ ID NO: 5904797 - DNA, 18 bp, Homo sapiens
gataccttcttatttaat

SEQ ID NO: 5904798 - DNA, 17 bp, Homo sapiens
gatacgacaacttgcac

SEQ ID NO: 5904799 - DNA, 21 bp, Homo sapiens
gatacgagttttggccgggtg

SEQ ID NO: 5904800 - DNA, 13 bp, Homo sapiens
gatacgcactttg

SEQ ID NO: 5904801 - DNA, 22 bp, Homo sapiens
gatacgcttaaggtggaaagtg

SEQ ID NO: 5904802 - DNA, 13 bp, Homo sapiens
gatacgtgtgtga

SEQ ID NO: 5904803 - DNA, 20 bp, Homo sapiens
gatactaaaagttcttctcc

SEQ ID NO: 5904804 - DNA, 22 bp, Homo sapiens
gatactaatagagtacttaata

SEQ ID NO: 5904805 - DNA, 16 bp, Homo sapiens
gatactacagtttgtt

SEQ ID NO: 5904806 - DNA, 22 bp, Homo sapiens
gatactaccagggtctctcagg

SEQ ID NO: 5904807 - DNA, 12 bp, Homo sapiens
gatactattcaa

SEQ ID NO: 5904808 - DNA, 13 bp, Homo sapiens
gatactattttca

SEQ ID NO: 5904809 - DNA, 23 bp, Homo sapiens
gatactccgctgtcggcacattc

SEQ ID NO: 5904810 - DNA, 14 bp, Homo sapiens
gatactctgggaac

SEQ ID NO: 5904811 - DNA, 17 bp, Homo sapiens
gatactctgtcagatgg

SEQ ID NO: 5904812 - DNA, 17 bp, Homo sapiens
gatactgaatattgaca

SEQ ID NO: 5904813 - DNA, 18 bp, Homo sapiens
gatactgaatgcataaat

SEQ ID NO: 5904814 - DNA, 19 bp, Homo sapiens
gatactgattatgaaatgt

SEQ ID NO: 5904815 - DNA, 13 bp, Homo sapiens
gatactgcctccc

SEQ ID NO: 5904816 - DNA, 17 bp, Homo sapiens
gatactgcgactttctg

SEQ ID NO: 5904817 - DNA, 19 bp, Homo sapiens
gatactgcgactttctgcc

SEQ ID NO: 5904818 - DNA, 21 bp, Homo sapiens
gatactgcgactttctgcctg

SEQ ID NO: 5904819 - DNA, 22 bp, Homo sapiens
gatactgctgatgctgaaataa

SEQ ID NO: 5904820 - DNA, 13 bp, Homo sapiens
gatactgctgctt

SEQ ID NO: 5904821 - DNA, 19 bp, Homo sapiens
gatactggaagttttgcat

SEQ ID NO: 5904822 - DNA, 20 bp, Homo sapiens
gatactggaagttttgcatt

SEQ ID NO: 5904823 - DNA, 20 bp, Homo sapiens
gatactggattgtactttgt

SEQ ID NO: 5904824 - DNA, 16 bp, Homo sapiens
gatactggcacagagg

SEQ ID NO: 5904825 - DNA, 19 bp, Homo sapiens
gatactgtatatgtcaaaa

SEQ ID NO: 5904826 - DNA, 17 bp, Homo sapiens
gatactgtctaagaata

SEQ ID NO: 5904827 - DNA, 21 bp, Homo sapiens
gatactgtctctccagtgaaa

SEQ ID NO: 5904828 - DNA, 15 bp, Homo sapiens
gatactgttgcacgt

SEQ ID NO: 5904829 - DNA, 18 bp, Homo sapiens
gatactgttgcacgtgtg

SEQ ID NO: 5904830 - DNA, 19 bp, Homo sapiens
gatactgttgcacgtgtgt

SEQ ID NO: 5904831 - DNA, 16 bp, Homo sapiens
gatacttaacaaatac

SEQ ID NO: 5904832 - DNA, 17 bp, Homo sapiens
gatacttaacaaataca

SEQ ID NO: 5904833 - DNA, 13 bp, Homo sapiens
gatacttatttaa

SEQ ID NO: 5904834 - DNA, 13 bp, Homo sapiens
gatacttcaggtg

SEQ ID NO: 5904835 - DNA, 15 bp, Homo sapiens
gatacttcaggtgct

SEQ ID NO: 5904836 - DNA, 20 bp, Homo sapiens
gatacttcaggtgcttttga

SEQ ID NO: 5904837 - DNA, 21 bp, Homo sapiens
gatacttcaggtgcttttgat

SEQ ID NO: 5904838 - DNA, 21 bp, Homo sapiens
gatacttcctgccctaactct

SEQ ID NO: 5904839 - DNA, 15 bp, Homo sapiens
gatacttcctgggtc

SEQ ID NO: 5904840 - DNA, 20 bp, Homo sapiens
gatacttcgacactgttctt

SEQ ID NO: 5904841 - DNA, 23 bp, Homo sapiens
gatacttggatttagtttcagta

SEQ ID NO: 5904842 - DNA, 22 bp, Homo sapiens
gatacttggtcacagccaggcg

SEQ ID NO: 5904843 - DNA, 13 bp, Homo sapiens
gatactttacatg

SEQ ID NO: 5904844 - DNA, 22 bp, Homo sapiens
gatactttagtacaatttcaac

SEQ ID NO: 5904845 - DNA, 13 bp, Homo sapiens
gatactttgaagt

SEQ ID NO: 5904846 - DNA, 20 bp, Homo sapiens
gatactttgaagtgcagctc

SEQ ID NO: 5904847 - DNA, 22 bp, Homo sapiens
gatactttgaagtgcagctcat

SEQ ID NO: 5904848 - DNA, 23 bp, Homo sapiens
gatactttgtattgtcctattag

SEQ ID NO: 5904849 - DNA, 20 bp, Homo sapiens
gatactttttcttttgtaag

SEQ ID NO: 5904850 - DNA, 16 bp, Homo sapiens
gatagaaaaaaactaa

SEQ ID NO: 5904851 - DNA, 17 bp, Homo sapiens
gatagaaaaaaactaaa

SEQ ID NO: 5904852 - DNA, 18 bp, Homo sapiens
gatagaaaatccttcagc

SEQ ID NO: 5904853 - DNA, 16 bp, Homo sapiens
gatagaaagaataaaa

SEQ ID NO: 5904854 - DNA, 18 bp, Homo sapiens
gatagaaagctggactga

SEQ ID NO: 5904855 - DNA, 19 bp, Homo sapiens
gatagaaagctggactgac

SEQ ID NO: 5904856 - DNA, 14 bp, Homo sapiens
gatagaaataaata

SEQ ID NO: 5904857 - DNA, 20 bp, Homo sapiens
gatagaaataaatagctata

SEQ ID NO: 5904858 - DNA, 14 bp, Homo sapiens
gatagaaatgccaa

SEQ ID NO: 5904859 - DNA, 15 bp, Homo sapiens
gatagaacaggctgg

SEQ ID NO: 5904860 - DNA, 14 bp, Homo sapiens
gatagaactgtact

SEQ ID NO: 5904861 - DNA, 21 bp, Homo sapiens
gatagaactttgccagtcttt

SEQ ID NO: 5904862 - DNA, 22 bp, Homo sapiens
gatagaactttgccagtcttta

SEQ ID NO: 5904863 - DNA, 16 bp, Homo sapiens
gatagaagaactgcaa

SEQ ID NO: 5904864 - DNA, 14 bp, Homo sapiens
gatagaatgacagt

SEQ ID NO: 5904865 - DNA, 17 bp, Homo sapiens
gatagaatttggcccag

SEQ ID NO: 5904866 - DNA, 19 bp, Homo sapiens
gatagaatttggcccagag

SEQ ID NO: 5904867 - DNA, 22 bp, Homo sapiens
gatagaatttggcccagagagg

SEQ ID NO: 5904868 - DNA, 11 bp, Homo sapiens
gatagacaaaa

SEQ ID NO: 5904869 - DNA, 22 bp, Homo sapiens
gatagacagtgctgccctgcga

SEQ ID NO: 5904870 - DNA, 21 bp, Homo sapiens
gatagacgagttgatttcctc

SEQ ID NO: 5904871 - DNA, 23 bp, Homo sapiens
gatagacgggttgaaagacatca

SEQ ID NO: 5904872 - DNA, 14 bp, Homo sapiens
gatagactgctaca

SEQ ID NO: 5904873 - DNA, 23 bp, Homo sapiens
gatagacttactaataaaatgtg

SEQ ID NO: 5904874 - DNA, 21 bp, Homo sapiens
gatagacttgggatggggagg

SEQ ID NO: 5904875 - DNA, 14 bp, Homo sapiens
gatagactttgtga

SEQ ID NO: 5904876 - DNA, 11 bp, Homo sapiens
gatagagaaat

SEQ ID NO: 5904877 - DNA, 19 bp, Homo sapiens
gatagagaatgccctcagc

SEQ ID NO: 5904878 - DNA, 23 bp, Homo sapiens
gatagagactggaacactagaca

SEQ ID NO: 5904879 - DNA, 21 bp, Homo sapiens
gatagagacttgcagttagac

SEQ ID NO: 5904880 - DNA, 17 bp, Homo sapiens
gatagagattcccctgg

SEQ ID NO: 5904881 - DNA, 19 bp, Homo sapiens
gatagagcagaactgaact

SEQ ID NO: 5904882 - DNA, 15 bp, Homo sapiens
gatagagcagcctgc

SEQ ID NO: 5904883 - DNA, 16 bp, Homo sapiens
gatagagcagcctgct

SEQ ID NO: 5904884 - DNA, 13 bp, Homo sapiens
gatagagcctttg

SEQ ID NO: 5904885 - DNA, 15 bp, Homo sapiens
gatagagcctttgat

SEQ ID NO: 5904886 - DNA, 22 bp, Homo sapiens
gatagaggacacggaccctgtg

SEQ ID NO: 5904887 - DNA, 12 bp, Homo sapiens
gatagagggggg

SEQ ID NO: 5904888 - DNA, 14 bp, Homo sapiens
gatagagtgatttt

SEQ ID NO: 5904889 - DNA, 16 bp, Homo sapiens
gatagagtttaacaga

SEQ ID NO: 5904890 - DNA, 16 bp, Homo sapiens
gatagatattgtccta

SEQ ID NO: 5904891 - DNA, 18 bp, Homo sapiens
gatagatgactttgcaga

SEQ ID NO: 5904892 - DNA, 14 bp, Homo sapiens
gatagatgccctgc

SEQ ID NO: 5904893 - DNA, 20 bp, Homo sapiens
gatagatgctggcccagggc

SEQ ID NO: 5904894 - DNA, 21 bp, Homo sapiens
gatagatgctggcccagggcc

SEQ ID NO: 5904895 - DNA, 23 bp, Homo sapiens
gatagatggtactctccaaaggc

SEQ ID NO: 5904896 - DNA, 12 bp, Homo sapiens
gatagatgtttg

SEQ ID NO: 5904897 - DNA, 13 bp, Homo sapiens
gatagatgtttga

SEQ ID NO: 5904898 - DNA, 20 bp, Homo sapiens
gatagatgtttgactttaaa

SEQ ID NO: 5904899 - DNA, 16 bp, Homo sapiens
gatagatttggaatag

SEQ ID NO: 5904900 - DNA, 18 bp, Homo sapiens
gatagcaatgttccagga

SEQ ID NO: 5904901 - DNA, 23 bp, Homo sapiens
gatagcaatgttccaggaatgaa

SEQ ID NO: 5904902 - DNA, 16 bp, Homo sapiens
gatagcacagaccctg

SEQ ID NO: 5904903 - DNA, 17 bp, Homo sapiens
gatagcacagaccctgc

SEQ ID NO: 5904904 - DNA, 21 bp, Homo sapiens
gatagcacagaccctgccctg

SEQ ID NO: 5904905 - DNA, 22 bp, Homo sapiens
gatagcacagaccctgccctgt

SEQ ID NO: 5904906 - DNA, 22 bp, Homo sapiens
gatagcactggtttgtttctca

SEQ ID NO: 5904907 - DNA, 14 bp, Homo sapiens
gatagcactttcta

SEQ ID NO: 5904908 - DNA, 22 bp, Homo sapiens
gatagcagcctggctcccctgg

SEQ ID NO: 5904909 - DNA, 16 bp, Homo sapiens
gatagcaggaggaact

SEQ ID NO: 5904910 - DNA, 15 bp, Homo sapiens
gatagcattgtaagc

SEQ ID NO: 5904911 - DNA, 15 bp, Homo sapiens
gatagcattgtgaac

SEQ ID NO: 5904912 - DNA, 12 bp, Homo sapiens
gatagccaaggc

SEQ ID NO: 5904913 - DNA, 13 bp, Homo sapiens
gatagccaaggcc

SEQ ID NO: 5904914 - DNA, 14 bp, Homo sapiens
gatagccagacaca

SEQ ID NO: 5904915 - DNA, 21 bp, Homo sapiens
gatagccatttccatggctct

SEQ ID NO: 5904916 - DNA, 23 bp, Homo sapiens
gatagcccagaacaaaaagaaat

SEQ ID NO: 5904917 - DNA, 13 bp, Homo sapiens
gatagcccaggag

SEQ ID NO: 5904918 - DNA, 22 bp, Homo sapiens
gatagcccatagctattttcct

SEQ ID NO: 5904919 - DNA, 23 bp, Homo sapiens
gatagcccatagctattttcctt

SEQ ID NO: 5904920 - DNA, 17 bp, Homo sapiens
gatagccctgtcctggt

SEQ ID NO: 5904921 - DNA, 21 bp, Homo sapiens
gatagccctgtcctggtggta

SEQ ID NO: 5904922 - DNA, 14 bp, Homo sapiens
gatcaaatgtttaa

SEQ ID NO: 5904923 - DNA, 16 bp, Homo sapiens
gatcaaatgtttaatc

SEQ ID NO: 5904924 - DNA, 18 bp, Homo sapiens
gatcaacaacatccactg

SEQ ID NO: 5904925 - DNA, 14 bp, Homo sapiens
gatcaacaatgatt

SEQ ID NO: 5904926 - DNA, 20 bp, Homo sapiens
gatcaacatcttttcttgcc

SEQ ID NO: 5904927 - DNA, 12 bp, Homo sapiens
gatcaacattta

SEQ ID NO: 5904928 - DNA, 16 bp, Homo sapiens
gatcaaccaagttaca

SEQ ID NO: 5904929 - DNA, 14 bp, Homo sapiens
gatcaaccaggcag

SEQ ID NO: 5904930 - DNA, 21 bp, Homo sapiens
gatcaaccccttcgctcctgt

SEQ ID NO: 5904931 - DNA, 18 bp, Homo sapiens
gatcaacgcctcactgaa

SEQ ID NO: 5904932 - DNA, 17 bp, Homo sapiens
gatcaagaaatgtctct

SEQ ID NO: 5904933 - DNA, 15 bp, Homo sapiens
gatcaagagaatcaa

SEQ ID NO: 5904934 - DNA, 21 bp, Homo sapiens
gatcaagcatggaacaaagca

SEQ ID NO: 5904935 - DNA, 14 bp, Homo sapiens
gatcaagctgtgag

SEQ ID NO: 5904936 - DNA, 16 bp, Homo sapiens
gatcaaggagaggagg

SEQ ID NO: 5904937 - DNA, 18 bp, Homo sapiens
gatcaaggagaggaggca

SEQ ID NO: 5904938 - DNA, 19 bp, Homo sapiens
gatcaaggcaaaaatatca

SEQ ID NO: 5904939 - DNA, 13 bp, Homo sapiens
gatcaaggcctta

SEQ ID NO: 5904940 - DNA, 14 bp, Homo sapiens
gatcaaggtgctct

SEQ ID NO: 5904941 - DNA, 20 bp, Homo sapiens
gatcaaggtgctcttctcat

SEQ ID NO: 5904942 - DNA, 21 bp, Homo sapiens
gatcaagttatttttaatttg

SEQ ID NO: 5904943 - DNA, 13 bp, Homo sapiens
gatcaagttcagc

SEQ ID NO: 5904944 - DNA, 13 bp, Homo sapiens
gatcaagttgttg

SEQ ID NO: 5904945 - DNA, 21 bp, Homo sapiens
gatcaataaaatgtgattttt

SEQ ID NO: 5904946 - DNA, 13 bp, Homo sapiens
gatcaataaatgt

SEQ ID NO: 5904947 - DNA, 14 bp, Homo sapiens
gatcaatgacagag

SEQ ID NO: 5904948 - DNA, 15 bp, Homo sapiens
gatcaattaaatgta

SEQ ID NO: 5904949 - DNA, 19 bp, Homo sapiens
gatcaattccctctctcag

SEQ ID NO: 5904950 - DNA, 21 bp, Homo sapiens
gatcaattccctctctcagca

SEQ ID NO: 5904951 - DNA, 23 bp, Homo sapiens
gatcaattccctctctcagcaca

SEQ ID NO: 5904952 - DNA, 16 bp, Homo sapiens
gatcacaaatgacttt

SEQ ID NO: 5904953 - DNA, 20 bp, Homo sapiens
gatcacaaatgactttatta

SEQ ID NO: 5904954 - DNA, 15 bp, Homo sapiens
gatcacaacgtgcat

SEQ ID NO: 5904955 - DNA, 20 bp, Homo sapiens
gatcacaacgtgcattgtgc

SEQ ID NO: 5904956 - DNA, 22 bp, Homo sapiens
gatcacaacgtgcattgtgctt

SEQ ID NO: 5904957 - DNA, 14 bp, Homo sapiens
gatcacaacttttc

SEQ ID NO: 5904958 - DNA, 13 bp, Homo sapiens
gatcacaagatgg

SEQ ID NO: 5904959 - DNA, 14 bp, Homo sapiens
gatcacacagtgtt

SEQ ID NO: 5904960 - DNA, 15 bp, Homo sapiens
gatcacaccactaca

SEQ ID NO: 5904961 - DNA, 14 bp, Homo sapiens
gatcacaccactgc

SEQ ID NO: 5904962 - DNA, 20 bp, Homo sapiens
gatcacacctcagtgggaag

SEQ ID NO: 5904963 - DNA, 16 bp, Homo sapiens
gatcacagaccacagg

SEQ ID NO: 5904964 - DNA, 17 bp, Homo sapiens
gatcacagagacattcc

SEQ ID NO: 5904965 - DNA, 17 bp, Homo sapiens
gatcacagatgtgccca

SEQ ID NO: 5904966 - DNA, 13 bp, Homo sapiens
gatcacagatttt

SEQ ID NO: 5904967 - DNA, 14 bp, Homo sapiens
gatcacagcagggc

SEQ ID NO: 5904968 - DNA, 21 bp, Homo sapiens
gatcacagcagggccttctgc

SEQ ID NO: 5904969 - DNA, 11 bp, Homo sapiens
gatcacagcct

SEQ ID NO: 5904970 - DNA, 15 bp, Homo sapiens
gatcacagcctcacc

SEQ ID NO: 5904971 - DNA, 17 bp, Homo sapiens
gatcacagcctccaggg

SEQ ID NO: 5904972 - DNA, 14 bp, Homo sapiens
gatcacagcctctg

SEQ ID NO: 5904973 - DNA, 17 bp, Homo sapiens
gatcacagctcacggca

SEQ ID NO: 5904974 - DNA, 19 bp, Homo sapiens
gatcacagcttcagccagg

SEQ ID NO: 5904975 - DNA, 20 bp, Homo sapiens
gatcacagggccccagaagg

SEQ ID NO: 5904976 - DNA, 22 bp, Homo sapiens
gatcacagtgactttacaggag

SEQ ID NO: 5904977 - DNA, 19 bp, Homo sapiens
gatcacataacagaatgca

SEQ ID NO: 5904978 - DNA, 19 bp, Homo sapiens
gatcacatcttaaattcat

SEQ ID NO: 5904979 - DNA, 23 bp, Homo sapiens
gatcacatcttaaattcatttct

SEQ ID NO: 5904980 - DNA, 21 bp, Homo sapiens
gatcaccaaacaacttcagaa

SEQ ID NO: 5904981 - DNA, 14 bp, Homo sapiens
gatcaccagaataa

SEQ ID NO: 5904982 - DNA, 20 bp, Homo sapiens
gatcaccagtgcatccttca

SEQ ID NO: 5904983 - DNA, 15 bp, Homo sapiens
gatcaccatgttagc

SEQ ID NO: 5904984 - DNA, 17 bp, Homo sapiens
gatcaccccagccccca

SEQ ID NO: 5904985 - DNA, 22 bp, Homo sapiens
gatcaccccagcccccacagcc

SEQ ID NO: 5904986 - DNA, 23 bp, Homo sapiens
gatcaccctgaattcattgtctc

SEQ ID NO: 5904987 - DNA, 23 bp, Homo sapiens
gatcaccgactgaaaatattgtt

SEQ ID NO: 5904988 - DNA, 19 bp, Homo sapiens
gatcacctgaggtcaggag

SEQ ID NO: 5904989 - DNA, 14 bp, Homo sapiens
gatcacctgaggtt

SEQ ID NO: 5904990 - DNA, 12 bp, Homo sapiens
gatcacctgcat

SEQ ID NO: 5904991 - DNA, 15 bp, Homo sapiens
gatcacgcctggcta

SEQ ID NO: 5904992 - DNA, 20 bp, Homo sapiens
gatcacggctcactgcagcc

SEQ ID NO: 5904993 - DNA, 16 bp, Homo sapiens
gatcactcccagcact

SEQ ID NO: 5904994 - DNA, 14 bp, Homo sapiens
gatcactgaaataa

SEQ ID NO: 5904995 - DNA, 20 bp, Homo sapiens
gatcactgaaataaaagcta

SEQ ID NO: 5904996 - DNA, 19 bp, Homo sapiens
gatcactgaacttttcaaa

SEQ ID NO: 5904997 - DNA, 13 bp, Homo sapiens
gatcactgaattg

SEQ ID NO: 5904998 - DNA, 20 bp, Homo sapiens
gatcactgagccatcatttc

SEQ ID NO: 5904999 - DNA, 13 bp, Homo sapiens
gatcactgccaca

SEQ ID NO: 5905000 - DNA, 13 bp, Homo sapiens
gatcactgccaga

SEQ ID NO: 5905001 - DNA, 13 bp, Homo sapiens
gatcactggagcc

SEQ ID NO: 5905002 - DNA, 18 bp, Homo sapiens
gatcactggctggcctga

SEQ ID NO: 5905003 - DNA, 13 bp, Homo sapiens
gatcactgtgctt

SEQ ID NO: 5905004 - DNA, 16 bp, Homo sapiens
gatcacttaagcccag

SEQ ID NO: 5905005 - DNA, 23 bp, Homo sapiens
gatcacttagcgaaccctttatt

SEQ ID NO: 5905006 - DNA, 18 bp, Homo sapiens
gatcacttgagcccagga

SEQ ID NO: 5905007 - DNA, 19 bp, Homo sapiens
gatcacttgagcccaggaa

SEQ ID NO: 5905008 - DNA, 20 bp, Homo sapiens
gatcacttgaggtcaggagt

SEQ ID NO: 5905009 - DNA, 19 bp, Homo sapiens
gatcacttgagttcaggag

SEQ ID NO: 5905010 - DNA, 16 bp, Homo sapiens
gatcacttgggcccag

SEQ ID NO: 5905011 - DNA, 22 bp, Homo sapiens
gatcagaaaaatggagcaaagt

SEQ ID NO: 5905012 - DNA, 11 bp, Homo sapiens
gatcagaacag

SEQ ID NO: 5905013 - DNA, 20 bp, Homo sapiens
gatcagaactgggaaaacag

SEQ ID NO: 5905014 - DNA, 17 bp, Homo sapiens
gatcagaaggctggggc

SEQ ID NO: 5905015 - DNA, 14 bp, Homo sapiens
gatcagaattttac

SEQ ID NO: 5905016 - DNA, 11 bp, Homo sapiens
gatcagacagc

SEQ ID NO: 5905017 - DNA, 19 bp, Homo sapiens
gatcagacatacagctgcc

SEQ ID NO: 5905018 - DNA, 20 bp, Homo sapiens
gatcagacatacagctgcct

SEQ ID NO: 5905019 - DNA, 12 bp, Homo sapiens
gatcagagcagg

SEQ ID NO: 5905020 - DNA, 15 bp, Homo sapiens
gatcagagctgcagc

SEQ ID NO: 5905021 - DNA, 17 bp, Homo sapiens
gatcagagctgcagcca

SEQ ID NO: 5905022 - DNA, 18 bp, Homo sapiens
gatcagaggtgtacacta

SEQ ID NO: 5905023 - DNA, 14 bp, Homo sapiens
gatcagatctgaca

SEQ ID NO: 5905024 - DNA, 17 bp, Homo sapiens
gatcagatgctccaaga

SEQ ID NO: 5905025 - DNA, 16 bp, Homo sapiens
gatcagatgctgaatt

SEQ ID NO: 5905026 - DNA, 17 bp, Homo sapiens
gatcagattcttgctgt

SEQ ID NO: 5905027 - DNA, 15 bp, Homo sapiens
gatcagattgcatgt

SEQ ID NO: 5905028 - DNA, 23 bp, Homo sapiens
gatcagatttggtgatggaaaaa

SEQ ID NO: 5905029 - DNA, 18 bp, Homo sapiens
gatcagcaaaaagactgg

SEQ ID NO: 5905030 - DNA, 19 bp, Homo sapiens
gatcagcaaaaagactgga

SEQ ID NO: 5905031 - DNA, 14 bp, Homo sapiens
gatcagcaaattta

SEQ ID NO: 5905032 - DNA, 13 bp, Homo sapiens
gatcagcaatgaa

SEQ ID NO: 5905033 - DNA, 16 bp, Homo sapiens
gatcagcagtggcagg

SEQ ID NO: 5905034 - DNA, 17 bp, Homo sapiens
gatcagcagtggcagga

SEQ ID NO: 5905035 - DNA, 17 bp, Homo sapiens
gatcagcatccaaaagc

SEQ ID NO: 5905036 - DNA, 14 bp, Homo sapiens
gatcagcatctgtg

SEQ ID NO: 5905037 - DNA, 15 bp, Homo sapiens
gatcagcattcaaaa

SEQ ID NO: 5905038 - DNA, 17 bp, Homo sapiens
gatcagcattcaaaata

SEQ ID NO: 5905039 - DNA, 24 bp, Homo sapiens
gatcagcattcaaaatagttctat

SEQ ID NO: 5905040 - DNA, 21 bp, Homo sapiens
gatcagcattgtgacttggag

SEQ ID NO: 5905041 - DNA, 13 bp, Homo sapiens
gatcagccatggc

SEQ ID NO: 5905042 - DNA, 14 bp, Homo sapiens
gatcagccattaaa

SEQ ID NO: 5905043 - DNA, 15 bp, Homo sapiens
gatcagccattaaaa

SEQ ID NO: 5905044 - DNA, 15 bp, Homo sapiens
gatcagccccgcctg

SEQ ID NO: 5905045 - DNA, 21 bp, Homo sapiens
gatcagccccgcctgtcacaa

SEQ ID NO: 5905046 - DNA, 17 bp, Homo sapiens
gatcagccccgctcctc

SEQ ID NO: 5905047 - DNA, 21 bp, Homo sapiens
gatcagcctccgccattccaa

SEQ ID NO: 5905048 - DNA, 12 bp, Homo sapiens
gatcagcctggg

SEQ ID NO: 5905049 - DNA, 16 bp, Homo sapiens
gatcagcgtggccttg

SEQ ID NO: 5905050 - DNA, 16 bp, Homo sapiens
gatcaggaaccagggc

SEQ ID NO: 5905051 - DNA, 17 bp, Homo sapiens
gatcaggaaccagggcc

SEQ ID NO: 5905052 - DNA, 18 bp, Homo sapiens
gatcaggaaccagggcct

SEQ ID NO: 5905053 - DNA, 12 bp, Homo sapiens
gatcaggaagag

SEQ ID NO: 5905054 - DNA, 17 bp, Homo sapiens
gatcaggaagagaagga

SEQ ID NO: 5905055 - DNA, 19 bp, Homo sapiens
gatcaggaggggtgttaaa

SEQ ID NO: 5905056 - DNA, 18 bp, Homo sapiens
gatcaggatcagctttga

SEQ ID NO: 5905057 - DNA, 21 bp, Homo sapiens
gatcaggcacccggggccaga

SEQ ID NO: 5905058 - DNA, 17 bp, Homo sapiens
gatcaggcagtgtttaa

SEQ ID NO: 5905059 - DNA, 13 bp, Homo sapiens
gatcaggccccac

SEQ ID NO: 5905060 - DNA, 23 bp, Homo sapiens
gatcaggctgctggaaacacagt

SEQ ID NO: 5905061 - DNA, 15 bp, Homo sapiens
gatcaggcttcctgg

SEQ ID NO: 5905062 - DNA, 16 bp, Homo sapiens
gatcagggcctgcccc

SEQ ID NO: 5905063 - DNA, 20 bp, Homo sapiens
gatcaggtcagagcccagga

SEQ ID NO: 5905064 - DNA, 23 bp, Homo sapiens
gatcaggtgacttctagcagaga

SEQ ID NO: 5905065 - DNA, 20 bp, Homo sapiens
gatcaggttatactttaggt

SEQ ID NO: 5905066 - DNA, 23 bp, Homo sapiens
gatcagtaaaattatactgtgtg

SEQ ID NO: 5905067 - DNA, 14 bp, Homo sapiens
gatcagtatttcac

SEQ ID NO: 5905068 - DNA, 22 bp, Homo sapiens
gatcagtctgattcccaagctc

SEQ ID NO: 5905069 - DNA, 18 bp, Homo sapiens
gatcagtgaaaaacatta

SEQ ID NO: 5905070 - DNA, 22 bp, Homo sapiens
gatcagtgtgctaacctcactg

SEQ ID NO: 5905071 - DNA, 11 bp, Homo sapiens
gatcagtgttg

SEQ ID NO: 5905072 - DNA, 22 bp, Homo sapiens
gatcagtttcacaaagtttgtt

SEQ ID NO: 5905073 - DNA, 22 bp, Homo sapiens
gatcataaaagtgattcttttt

SEQ ID NO: 5905074 - DNA, 19 bp, Homo sapiens
gatcatacagttatgtggg

SEQ ID NO: 5905075 - DNA, 16 bp, Homo sapiens
gatcatagatttctga

SEQ ID NO: 5905076 - DNA, 19 bp, Homo sapiens
gatcatagatttctgattt

SEQ ID NO: 5905077 - DNA, 23 bp, Homo sapiens
gatcataggaagtggctggtctg

SEQ ID NO: 5905078 - DNA, 17 bp, Homo sapiens
gatcataggtatttcaa

SEQ ID NO: 5905079 - DNA, 18 bp, Homo sapiens
gatcatagttttatttat

SEQ ID NO: 5905080 - DNA, 20 bp, Homo sapiens
gatcatatgaattagccaaa

SEQ ID NO: 5905081 - DNA, 21 bp, Homo sapiens
gatcatatgaattgctgtcta

SEQ ID NO: 5905082 - DNA, 15 bp, Homo sapiens
gatcatcaacaagat

SEQ ID NO: 5905083 - DNA, 15 bp, Homo sapiens
gatcatcatttaaaa

SEQ ID NO: 5905084 - DNA, 19 bp, Homo sapiens
gatcatccactgtgccatg

SEQ ID NO: 5905085 - DNA, 14 bp, Homo sapiens
gatcatccaggcct

SEQ ID NO: 5905086 - DNA, 22 bp, Homo sapiens
gatcatcccatctaagctgcag

SEQ ID NO: 5905087 - DNA, 12 bp, Homo sapiens
gatcatccccga

SEQ ID NO: 5905088 - DNA, 21 bp, Homo sapiens
gatcatcctttccagcatgag

SEQ ID NO: 5905089 - DNA, 16 bp, Homo sapiens
gatcatcgccagaggt

SEQ ID NO: 5905090 - DNA, 19 bp, Homo sapiens
gatcatcgccagaggtgct

SEQ ID NO: 5905091 - DNA, 23 bp, Homo sapiens
gatcatcgccagaggtgcttcac

SEQ ID NO: 5905092 - DNA, 17 bp, Homo sapiens
gatcatctccaaatctt

SEQ ID NO: 5905093 - DNA, 18 bp, Homo sapiens
gatcatctctgcaggttt

SEQ ID NO: 5905094 - DNA, 13 bp, Homo sapiens
gatcatctttgct

SEQ ID NO: 5905095 - DNA, 14 bp, Homo sapiens
gatcatgaaaagtg

SEQ ID NO: 5905096 - DNA, 19 bp, Homo sapiens
gatcatgaaagtagacagt

SEQ ID NO: 5905097 - DNA, 12 bp, Homo sapiens
gatcatgaataa

SEQ ID NO: 5905098 - DNA, 17 bp, Homo sapiens
gatcatgaattatataa

SEQ ID NO: 5905099 - DNA, 10 bp, Homo sapiens
gatcatgaga

SEQ ID NO: 5905100 - DNA, 16 bp, Homo sapiens
gatcatgaggtcagga

SEQ ID NO: 5905101 - DNA, 23 bp, Homo sapiens
gatgtttaaaacaccttctatag

SEQ ID NO: 5905102 - DNA, 14 bp, Homo sapiens
gatgtttaacaaat

SEQ ID NO: 5905103 - DNA, 23 bp, Homo sapiens
gatgtttacaggtggacacacaa

SEQ ID NO: 5905104 - DNA, 22 bp, Homo sapiens
gatgtttacatttttaaaggta

SEQ ID NO: 5905105 - DNA, 16 bp, Homo sapiens
gatgtttaccgtgtgt

SEQ ID NO: 5905106 - DNA, 15 bp, Homo sapiens
gatgtttacctggtg

SEQ ID NO: 5905107 - DNA, 20 bp, Homo sapiens
gatgtttagtagctgataaa

SEQ ID NO: 5905108 - DNA, 18 bp, Homo sapiens
gatgtttattcttctaga

SEQ ID NO: 5905109 - DNA, 21 bp, Homo sapiens
gatgtttattcttctagagtt

SEQ ID NO: 5905110 - DNA, 23 bp, Homo sapiens
gatgtttattcttctagagttca

SEQ ID NO: 5905111 - DNA, 17 bp, Homo sapiens
gatgtttccagctgcca

SEQ ID NO: 5905112 - DNA, 16 bp, Homo sapiens
gatgtttcctggaagc

SEQ ID NO: 5905113 - DNA, 19 bp, Homo sapiens
gatgtttctatatgtaact

SEQ ID NO: 5905114 - DNA, 21 bp, Homo sapiens
gatgtttctcattttaaacaa

SEQ ID NO: 5905115 - DNA, 13 bp, Homo sapiens
gatgtttctgtga

SEQ ID NO: 5905116 - DNA, 18 bp, Homo sapiens
gatgtttcttttgtatgt

SEQ ID NO: 5905117 - DNA, 23 bp, Homo sapiens
gatgtttcttttgtatgtaaatg

SEQ ID NO: 5905118 - DNA, 14 bp, Homo sapiens
gatgtttgaaaatg

SEQ ID NO: 5905119 - DNA, 19 bp, Homo sapiens
gatgtttgaaaatgctctt

SEQ ID NO: 5905120 - DNA, 16 bp, Homo sapiens
gatgtttgagcagtgg

SEQ ID NO: 5905121 - DNA, 22 bp, Homo sapiens
gatgtttgctcttgtttttatt

SEQ ID NO: 5905122 - DNA, 23 bp, Homo sapiens
gatgtttggaaaaaactctgaag

SEQ ID NO: 5905123 - DNA, 14 bp, Homo sapiens
gatgtttgggtggg

SEQ ID NO: 5905124 - DNA, 21 bp, Homo sapiens
gatgtttgtacttttgtgtta

SEQ ID NO: 5905125 - DNA, 14 bp, Homo sapiens
gatgtttgtggcct

SEQ ID NO: 5905126 - DNA, 17 bp, Homo sapiens
gatgtttgttgctagga

SEQ ID NO: 5905127 - DNA, 22 bp, Homo sapiens
gatgtttgttttcaaaatactt

SEQ ID NO: 5905128 - DNA, 14 bp, Homo sapiens
gatgtttgttttcg

SEQ ID NO: 5905129 - DNA, 21 bp, Homo sapiens
gatgttttaaggatgcttgta

SEQ ID NO: 5905130 - DNA, 20 bp, Homo sapiens
gatgttttacgcaaggaagg

SEQ ID NO: 5905131 - DNA, 21 bp, Homo sapiens
gatgttttacgcaaggaagga

SEQ ID NO: 5905132 - DNA, 23 bp, Homo sapiens
gatgttttacgcaaggaaggact

SEQ ID NO: 5905133 - DNA, 15 bp, Homo sapiens
gatgttttacgtgca

SEQ ID NO: 5905134 - DNA, 14 bp, Homo sapiens
gatgttttattatt

SEQ ID NO: 5905135 - DNA, 13 bp, Homo sapiens
gatgttttatttg

SEQ ID NO: 5905136 - DNA, 17 bp, Homo sapiens
gatgttttcaggtgtca

SEQ ID NO: 5905137 - DNA, 23 bp, Homo sapiens
gatgttttcaggtgtcatggact

SEQ ID NO: 5905138 - DNA, 15 bp, Homo sapiens
gatgttttccactga

SEQ ID NO: 5905139 - DNA, 21 bp, Homo sapiens
gatgttttgacatttacagga

SEQ ID NO: 5905140 - DNA, 13 bp, Homo sapiens
gatgttttgatat

SEQ ID NO: 5905141 - DNA, 13 bp, Homo sapiens
gatgttttgcaaa

SEQ ID NO: 5905142 - DNA, 23 bp, Homo sapiens
gatgttttgccgtggcttgggga

SEQ ID NO: 5905143 - DNA, 23 bp, Homo sapiens
gatgttttgtcccatttccttgg

SEQ ID NO: 5905144 - DNA, 18 bp, Homo sapiens
gatgtttttaaaagtttc

SEQ ID NO: 5905145 - DNA, 16 bp, Homo sapiens
gatgtttttaaaatct

SEQ ID NO: 5905146 - DNA, 17 bp, Homo sapiens
gatgtttttagttctga

SEQ ID NO: 5905147 - DNA, 19 bp, Homo sapiens
gatgtttttagttctgact

SEQ ID NO: 5905148 - DNA, 16 bp, Homo sapiens
gatgtttttcatgaaa

SEQ ID NO: 5905149 - DNA, 14 bp, Homo sapiens
gatgtttttctgtg

SEQ ID NO: 5905150 - DNA, 16 bp, Homo sapiens
gattaaaaatgctttt

SEQ ID NO: 5905151 - DNA, 14 bp, Homo sapiens
gattaaaacaattt

SEQ ID NO: 5905152 - DNA, 14 bp, Homo sapiens
gattaaaatatttg

SEQ ID NO: 5905153 - DNA, 18 bp, Homo sapiens
gattaaacacctgacaca

SEQ ID NO: 5905154 - DNA, 15 bp, Homo sapiens
gattaaaccttttta

SEQ ID NO: 5905155 - DNA, 16 bp, Homo sapiens
gattaaacgtgcagac

SEQ ID NO: 5905156 - DNA, 16 bp, Homo sapiens
gattaaactgggaaat

SEQ ID NO: 5905157 - DNA, 20 bp, Homo sapiens
gattaaactgggaaatgaga

SEQ ID NO: 5905158 - DNA, 13 bp, Homo sapiens
gattaaactgtat

SEQ ID NO: 5905159 - DNA, 13 bp, Homo sapiens
gattaaagactgt

SEQ ID NO: 5905160 - DNA, 12 bp, Homo sapiens
gattaaaggaag

SEQ ID NO: 5905161 - DNA, 15 bp, Homo sapiens
gattaaaggaaggaa

SEQ ID NO: 5905162 - DNA, 15 bp, Homo sapiens
gattaaagtgccttc

SEQ ID NO: 5905163 - DNA, 18 bp, Homo sapiens
gattaaataagattctaa

SEQ ID NO: 5905164 - DNA, 20 bp, Homo sapiens
gattaaatatagattagaaa

SEQ ID NO: 5905165 - DNA, 14 bp, Homo sapiens
gattaaatatttaa

SEQ ID NO: 5905166 - DNA, 19 bp, Homo sapiens
gattaaatatttaatgatg

SEQ ID NO: 5905167 - DNA, 17 bp, Homo sapiens
gattaaatatttgaaga

SEQ ID NO: 5905168 - DNA, 11 bp, Homo sapiens
gattaaatggc

SEQ ID NO: 5905169 - DNA, 21 bp, Homo sapiens
gattaaatggcacctgtatac

SEQ ID NO: 5905170 - DNA, 19 bp, Homo sapiens
gattaaattcttgcaaagt

SEQ ID NO: 5905171 - DNA, 20 bp, Homo sapiens
gattaaattttagtacattt

SEQ ID NO: 5905172 - DNA, 14 bp, Homo sapiens
gattaacaaatatg

SEQ ID NO: 5905173 - DNA, 17 bp, Homo sapiens
gattaacataaagaaaa

SEQ ID NO: 5905174 - DNA, 12 bp, Homo sapiens
gattaacatttg

SEQ ID NO: 5905175 - DNA, 18 bp, Homo sapiens
gattaaccacttcagctg

SEQ ID NO: 5905176 - DNA, 16 bp, Homo sapiens
gattaaccttttcaaa

SEQ ID NO: 5905177 - DNA, 22 bp, Homo sapiens
gattaaccttttcaaattaatg

SEQ ID NO: 5905178 - DNA, 19 bp, Homo sapiens
gattaactcttagaagtgt

SEQ ID NO: 5905179 - DNA, 20 bp, Homo sapiens
gattaactggtagttcattg

SEQ ID NO: 5905180 - DNA, 21 bp, Homo sapiens
gattaactttcaaaagcaaac

SEQ ID NO: 5905181 - DNA, 15 bp, Homo sapiens
gattaagaaaggaag

SEQ ID NO: 5905182 - DNA, 22 bp, Homo sapiens
gattaagatctcagtggttaag

SEQ ID NO: 5905183 - DNA, 18 bp, Homo sapiens
gattaaggactacagaat

SEQ ID NO: 5905184 - DNA, 21 bp, Homo sapiens
gattaaggcgtggcttctgca

SEQ ID NO: 5905185 - DNA, 12 bp, Homo sapiens
gattaagggcaa

SEQ ID NO: 5905186 - DNA, 18 bp, Homo sapiens
gattaaggtctctctttg

SEQ ID NO: 5905187 - DNA, 14 bp, Homo sapiens
gattaagtaatgat

SEQ ID NO: 5905188 - DNA, 18 bp, Homo sapiens
gattaagttataccagca

SEQ ID NO: 5905189 - DNA, 22 bp, Homo sapiens
gattaagttataccagcaaaag

SEQ ID NO: 5905190 - DNA, 17 bp, Homo sapiens
gattaagttcgaggtgg

SEQ ID NO: 5905191 - DNA, 17 bp, Homo sapiens
gattaataacagaaata

SEQ ID NO: 5905192 - DNA, 19 bp, Homo sapiens
gattaataacagaaataca

SEQ ID NO: 5905193 - DNA, 15 bp, Homo sapiens
gattaataacctgcc

SEQ ID NO: 5905194 - DNA, 23 bp, Homo sapiens
gattaataacctgccagtcccag

SEQ ID NO: 5905195 - DNA, 13 bp, Homo sapiens
gattaatcaaagg

SEQ ID NO: 5905196 - DNA, 21 bp, Homo sapiens
gattaatctctaaaattctag

SEQ ID NO: 5905197 - DNA, 20 bp, Homo sapiens
gattaatctgggcagacatt

SEQ ID NO: 5905198 - DNA, 18 bp, Homo sapiens
gattaatgacctgaattg

SEQ ID NO: 5905199 - DNA, 14 bp, Homo sapiens
gattaatggcactg

SEQ ID NO: 5905200 - DNA, 22 bp, Homo sapiens
gattaatgtactttttattgca

SEQ ID NO: 5905201 - DNA, 23 bp, Homo sapiens
gattaatgtactttttattgcat

SEQ ID NO: 5905202 - DNA, 21 bp, Homo sapiens
gattaatgtcaatgttaatca

SEQ ID NO: 5905203 - DNA, 14 bp, Homo sapiens
gattaatgttttca

SEQ ID NO: 5905204 - DNA, 16 bp, Homo sapiens
gattaatgttttgtac

SEQ ID NO: 5905205 - DNA, 19 bp, Homo sapiens
gattaatgttttgtacaat

SEQ ID NO: 5905206 - DNA, 15 bp, Homo sapiens
gattaattcctttcc

SEQ ID NO: 5905207 - DNA, 19 bp, Homo sapiens
gattaatttaattcatgta

SEQ ID NO: 5905208 - DNA, 13 bp, Homo sapiens
gattaatttatgg

SEQ ID NO: 5905209 - DNA, 20 bp, Homo sapiens
gattaatttgcatctgaaat

SEQ ID NO: 5905210 - DNA, 17 bp, Homo sapiens
gattacaaataaacagt

SEQ ID NO: 5905211 - DNA, 23 bp, Homo sapiens
gattacaaatcagaagtcatctt

SEQ ID NO: 5905212 - DNA, 23 bp, Homo sapiens
gattacaagcgtgagccactgca

SEQ ID NO: 5905213 - DNA, 22 bp, Homo sapiens
gattacaataaatcctttactt

SEQ ID NO: 5905214 - DNA, 23 bp, Homo sapiens
gattacaattgagggaagtttga

SEQ ID NO: 5905215 - DNA, 22 bp, Homo sapiens
gattacaggaatgaagaactgt

SEQ ID NO: 5905216 - DNA, 10 bp, Homo sapiens
gattacaggc

SEQ ID NO: 5905217 - DNA, 14 bp, Homo sapiens
gattacaggcgtga

SEQ ID NO: 5905218 - DNA, 20 bp, Homo sapiens
gattacaggcgtgagccacc

SEQ ID NO: 5905219 - DNA, 21 bp, Homo sapiens
gattacaggctcctgccacca

SEQ ID NO: 5905220 - DNA, 18 bp, Homo sapiens
gattacagggatgagcca

SEQ ID NO: 5905221 - DNA, 20 bp, Homo sapiens
gattacagggatgagccacc

SEQ ID NO: 5905222 - DNA, 18 bp, Homo sapiens
gattacaggtgcccacca

SEQ ID NO: 5905223 - DNA, 21 bp, Homo sapiens
gattacaggtgtgacccactg

SEQ ID NO: 5905224 - DNA, 22 bp, Homo sapiens
gattacaggtgtgagccacagc

SEQ ID NO: 5905225 - DNA, 21 bp, Homo sapiens
gattacagtatggcaatatct

SEQ ID NO: 5905226 - DNA, 20 bp, Homo sapiens
gattacataatcaaagctac

SEQ ID NO: 5905227 - DNA, 22 bp, Homo sapiens
gattacataatcaaagctacct

SEQ ID NO: 5905228 - DNA, 15 bp, Homo sapiens
gattacataatctgt

SEQ ID NO: 5905229 - DNA, 17 bp, Homo sapiens
gattacatagatcagcc

SEQ ID NO: 5905230 - DNA, 22 bp, Homo sapiens
gattacatccgtaggacaagtt

SEQ ID NO: 5905231 - DNA, 14 bp, Homo sapiens
gattacatgcatgt

SEQ ID NO: 5905232 - DNA, 15 bp, Homo sapiens
gattacatgtatgtt

SEQ ID NO: 5905233 - DNA, 15 bp, Homo sapiens
gattacattcagttg

SEQ ID NO: 5905234 - DNA, 19 bp, Homo sapiens
gattacgatgtaaattttt

SEQ ID NO: 5905235 - DNA, 17 bp, Homo sapiens
gattacgtgaataaaat

SEQ ID NO: 5905236 - DNA, 19 bp, Homo sapiens
gattacgtgtatgtttctt

SEQ ID NO: 5905237 - DNA, 21 bp, Homo sapiens
gattactaattattcctcttt

SEQ ID NO: 5905238 - DNA, 17 bp, Homo sapiens
gattactgaattgtatc

SEQ ID NO: 5905239 - DNA, 16 bp, Homo sapiens
gattactgatgtgata

SEQ ID NO: 5905240 - DNA, 22 bp, Homo sapiens
gattactggcctttttcattta

SEQ ID NO: 5905241 - DNA, 18 bp, Homo sapiens
gattactgtcaataaaca

SEQ ID NO: 5905242 - DNA, 20 bp, Homo sapiens
gattacttctctataaaaaa

SEQ ID NO: 5905243 - DNA, 16 bp, Homo sapiens
gattacttgtaattat

SEQ ID NO: 5905244 - DNA, 19 bp, Homo sapiens
gattagaaaaattcctaag

SEQ ID NO: 5905245 - DNA, 15 bp, Homo sapiens
gattagaaagaatta

SEQ ID NO: 5905246 - DNA, 15 bp, Homo sapiens
gattagaaattacct

SEQ ID NO: 5905247 - DNA, 15 bp, Homo sapiens
gattagaaatttaac

SEQ ID NO: 5905248 - DNA, 14 bp, Homo sapiens
gattagaacattta

SEQ ID NO: 5905249 - DNA, 18 bp, Homo sapiens
gattagaagccaagacag

SEQ ID NO: 5905250 - DNA, 22 bp, Homo sapiens
gattagaagccaagacagtggc

SEQ ID NO: 5905251 - DNA, 14 bp, Homo sapiens
gattagaattctgt

SEQ ID NO: 5905252 - DNA, 14 bp, Homo sapiens
gattagacaatgtg

SEQ ID NO: 5905253 - DNA, 16 bp, Homo sapiens
gattagacaatgtgga

SEQ ID NO: 5905254 - DNA, 14 bp, Homo sapiens
gattagacagaaca

SEQ ID NO: 5905255 - DNA, 18 bp, Homo sapiens
gattagactggacagctt

SEQ ID NO: 5905256 - DNA, 14 bp, Homo sapiens
gattagagagtgtt

SEQ ID NO: 5905257 - DNA, 13 bp, Homo sapiens
gattagagggagg

SEQ ID NO: 5905258 - DNA, 17 bp, Homo sapiens
gattagagggaggtgtt

SEQ ID NO: 5905259 - DNA, 15 bp, Homo sapiens
gattagatcttttaa

SEQ ID NO: 5905260 - DNA, 23 bp, Homo sapiens
gattagcaggccaaggtctgagc

SEQ ID NO: 5905261 - DNA, 12 bp, Homo sapiens
gattagctctgg

SEQ ID NO: 5905262 - DNA, 13 bp, Homo sapiens
gattagctctgga

SEQ ID NO: 5905263 - DNA, 16 bp, Homo sapiens
gattagctctggacca

SEQ ID NO: 5905264 - DNA, 14 bp, Homo sapiens
gattagctttatta

SEQ ID NO: 5905265 - DNA, 20 bp, Homo sapiens
gattagctttattatggctt

SEQ ID NO: 5905266 - DNA, 13 bp, Homo sapiens
gattagctttgtg

SEQ ID NO: 5905267 - DNA, 16 bp, Homo sapiens
gattagctttgtgttt

SEQ ID NO: 5905268 - DNA, 20 bp, Homo sapiens
gattaggagaaacacattct

SEQ ID NO: 5905269 - DNA, 12 bp, Homo sapiens
gattaggcctgg

SEQ ID NO: 5905270 - DNA, 23 bp, Homo sapiens
gattagggcatttgagaaatgca

SEQ ID NO: 5905271 - DNA, 17 bp, Homo sapiens
gattaggggatggggag

SEQ ID NO: 5905272 - DNA, 17 bp, Homo sapiens
gattagggtagtaatta

SEQ ID NO: 5905273 - DNA, 13 bp, Homo sapiens
gattaggtatgtt

SEQ ID NO: 5905274 - DNA, 15 bp, Homo sapiens
gattagtaaagaaat

SEQ ID NO: 5905275 - DNA, 18 bp, Homo sapiens
gattagtagaaaatacat

SEQ ID NO: 5905276 - DNA, 21 bp, Homo sapiens
gattagtaggaaaggactgag

SEQ ID NO: 5905277 - DNA, 15 bp, Homo sapiens
gattagttatgtctt

SEQ ID NO: 5905278 - DNA, 22 bp, Homo sapiens
gattagttgaaaggcctcaaga

SEQ ID NO: 5905279 - DNA, 13 bp, Homo sapiens
gattagtttagaa

SEQ ID NO: 5905280 - DNA, 23 bp, Homo sapiens
gattagttttcttgttgctttgt

SEQ ID NO: 5905281 - DNA, 16 bp, Homo sapiens
gattataaaaaatgta

SEQ ID NO: 5905282 - DNA, 21 bp, Homo sapiens
gattataaaaaatgtaacatc

SEQ ID NO: 5905283 - DNA, 22 bp, Homo sapiens
gattataaaaaatgtaacatca

SEQ ID NO: 5905284 - DNA, 14 bp, Homo sapiens
gattataaaaatga

SEQ ID NO: 5905285 - DNA, 23 bp, Homo sapiens
gattataaaattatttttattaa

SEQ ID NO: 5905286 - DNA, 22 bp, Homo sapiens
gattataaacaacagaaacttc

SEQ ID NO: 5905287 - DNA, 22 bp, Homo sapiens
gattataaatgaaatttgcaaa

SEQ ID NO: 5905288 - DNA, 13 bp, Homo sapiens
gattataaatgtt

SEQ ID NO: 5905289 - DNA, 17 bp, Homo sapiens
gattataacttgtctaa

SEQ ID NO: 5905290 - DNA, 23 bp, Homo sapiens
gattataagccctgcataatgtt

SEQ ID NO: 5905291 - DNA, 14 bp, Homo sapiens
gattataatatgtg

SEQ ID NO: 5905292 - DNA, 15 bp, Homo sapiens
gattataatatgtgc

SEQ ID NO: 5905293 - DNA, 22 bp, Homo sapiens
gattataatatgtgccttaagt

SEQ ID NO: 5905294 - DNA, 13 bp, Homo sapiens
gattatacagaat

SEQ ID NO: 5905295 - DNA, 14 bp, Homo sapiens
gattatagattcta

SEQ ID NO: 5905296 - DNA, 17 bp, Homo sapiens
gattatagattctaaag

SEQ ID NO: 5905297 - DNA, 20 bp, Homo sapiens
gattatagctcccaaaagaa

SEQ ID NO: 5905298 - DNA, 18 bp, Homo sapiens
gattatatacaaagctgt

SEQ ID NO: 5905299 - DNA, 13 bp, Homo sapiens
gattatatatcat

SEQ ID NO: 5905300 - DNA, 20 bp, Homo sapiens
gattatatcaaagtatttgt

SEQ ID NO: 5905301 - DNA, 13 bp, Homo sapiens
gattatatgacaa

SEQ ID NO: 5905302 - DNA, 16 bp, Homo sapiens
gattatattataataa

SEQ ID NO: 5905303 - DNA, 13 bp, Homo sapiens
gattatattcaca

SEQ ID NO: 5905304 - DNA, 15 bp, Homo sapiens
gattatattcacaga

SEQ ID NO: 5905305 - DNA, 18 bp, Homo sapiens
gattatattgagacaaaa

SEQ ID NO: 5905306 - DNA, 16 bp, Homo sapiens
gattatcagtagaaag

SEQ ID NO: 5905307 - DNA, 12 bp, Homo sapiens
gattatcctgag

SEQ ID NO: 5905308 - DNA, 20 bp, Homo sapiens
gattatcctgttactgaatt

SEQ ID NO: 5905309 - DNA, 18 bp, Homo sapiens
gattatcgtcttctaaga

SEQ ID NO: 5905310 - DNA, 16 bp, Homo sapiens
gattatctatttgtgt

SEQ ID NO: 5905311 - DNA, 22 bp, Homo sapiens
gattatctctttgatctacttg

SEQ ID NO: 5905312 - DNA, 21 bp, Homo sapiens
gattatctgattcctttaaaa

SEQ ID NO: 5905313 - DNA, 12 bp, Homo sapiens
gattatcttcag

SEQ ID NO: 5905314 - DNA, 20 bp, Homo sapiens
gattatcttcagcccaggct

SEQ ID NO: 5905315 - DNA, 21 bp, Homo sapiens
gattatcttcagcccaggctt

SEQ ID NO: 5905316 - DNA, 15 bp, Homo sapiens
gattatgaaatgcca

SEQ ID NO: 5905317 - DNA, 14 bp, Homo sapiens
gattatgatgcata

SEQ ID NO: 5905318 - DNA, 18 bp, Homo sapiens
gattatgggtcacaggaa

SEQ ID NO: 5905319 - DNA, 14 bp, Homo sapiens
gattatgtagctaa

SEQ ID NO: 5905320 - DNA, 13 bp, Homo sapiens
gattatgtctttc

SEQ ID NO: 5905321 - DNA, 18 bp, Homo sapiens
gattatgtcttttatatt

SEQ ID NO: 5905322 - DNA, 17 bp, Homo sapiens
gattatgttcctgctgt

SEQ ID NO: 5905323 - DNA, 18 bp, Homo sapiens
gattatgttcctgctgta

SEQ ID NO: 5905324 - DNA, 13 bp, Homo sapiens
gattattacaaca

SEQ ID NO: 5905325 - DNA, 18 bp, Homo sapiens
gattattactaattctat

SEQ ID NO: 5905326 - DNA, 17 bp, Homo sapiens
gattattacttctgttt

SEQ ID NO: 5905327 - DNA, 20 bp, Homo sapiens
gattattagccaggtaatgt

SEQ ID NO: 5905328 - DNA, 15 bp, Homo sapiens
gattattataaacta

SEQ ID NO: 5905329 - DNA, 14 bp, Homo sapiens
gattattatctaaa

SEQ ID NO: 5905330 - DNA, 15 bp, Homo sapiens
gattattatttaaaa

SEQ ID NO: 5905331 - DNA, 13 bp, Homo sapiens
gattattcaagaa

SEQ ID NO: 5905332 - DNA, 15 bp, Homo sapiens
gattattcactgatt

SEQ ID NO: 5905333 - DNA, 21 bp, Homo sapiens
gattattcactgatttgacat

SEQ ID NO: 5905334 - DNA, 14 bp, Homo sapiens
gattattcttccag

SEQ ID NO: 5905335 - DNA, 20 bp, Homo sapiens
gattattgatcaaaatcaaa

SEQ ID NO: 5905336 - DNA, 17 bp, Homo sapiens
gattattgtatttattc

SEQ ID NO: 5905337 - DNA, 22 bp, Homo sapiens
gattattgtctgattgaaacat

SEQ ID NO: 5905338 - DNA, 23 bp, Homo sapiens
gattattgtgacttcactgtata

SEQ ID NO: 5905339 - DNA, 19 bp, Homo sapiens
gattatttaaacctgccct

SEQ ID NO: 5905340 - DNA, 15 bp, Homo sapiens
gattatttaataaca

SEQ ID NO: 5905341 - DNA, 17 bp, Homo sapiens
gattatttaataacatt

SEQ ID NO: 5905342 - DNA, 21 bp, Homo sapiens
gattatttaataacattacct

SEQ ID NO: 5905343 - DNA, 22 bp, Homo sapiens
gattatttaataacattacctt

SEQ ID NO: 5905344 - DNA, 12 bp, Homo sapiens
gattatttatcc

SEQ ID NO: 5905345 - DNA, 18 bp, Homo sapiens
gattatttatttctgtaa

SEQ ID NO: 5905346 - DNA, 14 bp, Homo sapiens
gattatttgcatgt

SEQ ID NO: 5905347 - DNA, 18 bp, Homo sapiens
gattatttgcatgttatg

SEQ ID NO: 5905348 - DNA, 19 bp, Homo sapiens
gattatttgcatgttatgt

SEQ ID NO: 5905349 - DNA, 20 bp, Homo sapiens
gattatttgtatttacagtt

SEQ ID NO: 5905350 - DNA, 15 bp, Homo sapiens
gattatttgttttac

SEQ ID NO: 5905351 - DNA, 21 bp, Homo sapiens
gattattttagtctgtcatcc

SEQ ID NO: 5905352 - DNA, 20 bp, Homo sapiens
gattattttatcactacaag

SEQ ID NO: 5905353 - DNA, 14 bp, Homo sapiens
gattattttcatta

SEQ ID NO: 5905354 - DNA, 11 bp, Homo sapiens
gattattttgg

SEQ ID NO: 5905355 - DNA, 22 bp, Homo sapiens
gattattttgtgcaacataaca

SEQ ID NO: 5905356 - DNA, 14 bp, Homo sapiens
gattatttttccag

SEQ ID NO: 5905357 - DNA, 20 bp, Homo sapiens
gattatttttcttttaaaga

SEQ ID NO: 5905358 - DNA, 22 bp, Homo sapiens
gattatttttcttttaaagatt

SEQ ID NO: 5905359 - DNA, 18 bp, Homo sapiens
gattattttttatactgt

SEQ ID NO: 5905360 - DNA, 15 bp, Homo sapiens
gattattttttcaga

SEQ ID NO: 5905361 - DNA, 12 bp, Homo sapiens
gattcaaaagtg

SEQ ID NO: 5905362 - DNA, 13 bp, Homo sapiens
gattcaaaatatt

SEQ ID NO: 5905363 - DNA, 22 bp, Homo sapiens
gattcaaaatatttaaaaatgt

SEQ ID NO: 5905364 - DNA, 16 bp, Homo sapiens
gattcaaaatggcttg

SEQ ID NO: 5905365 - DNA, 21 bp, Homo sapiens
gattcaaaattgacattgctt

SEQ ID NO: 5905366 - DNA, 16 bp, Homo sapiens
gattcaaaccaaagct

SEQ ID NO: 5905367 - DNA, 20 bp, Homo sapiens
gattcaaaccaaagctgcct

SEQ ID NO: 5905368 - DNA, 18 bp, Homo sapiens
gattcaaaggttctaggt

SEQ ID NO: 5905369 - DNA, 19 bp, Homo sapiens
gattcaaaggttctaggtt

SEQ ID NO: 5905370 - DNA, 17 bp, Homo sapiens
gattcaaagtagtttta

SEQ ID NO: 5905371 - DNA, 23 bp, Homo sapiens
gattcaaagtgttgtgttcctgg

SEQ ID NO: 5905372 - DNA, 18 bp, Homo sapiens
gattcaaataaccctgaa

SEQ ID NO: 5905373 - DNA, 23 bp, Homo sapiens
gattcaaatatcaaaaggaagat

SEQ ID NO: 5905374 - DNA, 20 bp, Homo sapiens
gattcaaatgttacaaaaaa

SEQ ID NO: 5905375 - DNA, 17 bp, Homo sapiens
gattcaaattgctgctt

SEQ ID NO: 5905376 - DNA, 13 bp, Homo sapiens
gattcaacacctt

SEQ ID NO: 5905377 - DNA, 15 bp, Homo sapiens
gattcaaccctggct

SEQ ID NO: 5905378 - DNA, 12 bp, Homo sapiens
gattcaacctga

SEQ ID NO: 5905379 - DNA, 23 bp, Homo sapiens
gattcaactaaaaaaaaaaaagt

SEQ ID NO: 5905380 - DNA, 17 bp, Homo sapiens
gattcaagccattccaa

SEQ ID NO: 5905381 - DNA, 17 bp, Homo sapiens
gattcaaggctcagaag

SEQ ID NO: 5905382 - DNA, 14 bp, Homo sapiens
gattcaatctgtaa

SEQ ID NO: 5905383 - DNA, 19 bp, Homo sapiens
gattcaatctgtaaactgt

SEQ ID NO: 5905384 - DNA, 20 bp, Homo sapiens
gattcaatgcccctgaattt

SEQ ID NO: 5905385 - DNA, 22 bp, Homo sapiens
gattcaattacggactctggat

SEQ ID NO: 5905386 - DNA, 18 bp, Homo sapiens
gattcaattataattgta

SEQ ID NO: 5905387 - DNA, 18 bp, Homo sapiens
gattcaattttttaatgt

SEQ ID NO: 5905388 - DNA, 19 bp, Homo sapiens
gattcacaccccacctgcg

SEQ ID NO: 5905389 - DNA, 14 bp, Homo sapiens
gattcacagcctcc

SEQ ID NO: 5905390 - DNA, 18 bp, Homo sapiens
gattcacatgttttcaaa

SEQ ID NO: 5905391 - DNA, 13 bp, Homo sapiens
gattcacctgtaa

SEQ ID NO: 5905392 - DNA, 14 bp, Homo sapiens
gattcacctgtaaa

SEQ ID NO: 5905393 - DNA, 14 bp, Homo sapiens
gattcactgtgctt

SEQ ID NO: 5905394 - DNA, 15 bp, Homo sapiens
gattcactgtgcttc

SEQ ID NO: 5905395 - DNA, 19 bp, Homo sapiens
gattcagaatgagaatgga

SEQ ID NO: 5905396 - DNA, 17 bp, Homo sapiens
gattcagacagctgcct

SEQ ID NO: 5905397 - DNA, 19 bp, Homo sapiens
gattcagacagctgcctgg

SEQ ID NO: 5905398 - DNA, 14 bp, Homo sapiens
gattcagagaaatt

SEQ ID NO: 5905399 - DNA, 12 bp, Homo sapiens
gattcagagact

SEQ ID NO: 5905400 - DNA, 15 bp, Homo sapiens
gattcagccctcaga

SEQ ID NO: 5905401 - DNA, 21 bp, Homo sapiens
gattcagccttctttttctgg

SEQ ID NO: 5905402 - DNA, 21 bp, Homo sapiens
gattcagctcattatgaaaaa

SEQ ID NO: 5905403 - DNA, 16 bp, Homo sapiens
gattcaggagctcagt

SEQ ID NO: 5905404 - DNA, 19 bp, Homo sapiens
gattcaggccagcccagcc

SEQ ID NO: 5905405 - DNA, 21 bp, Homo sapiens
gattcaggccagcccagccag

SEQ ID NO: 5905406 - DNA, 17 bp, Homo sapiens
gattcaggcctctgagg

SEQ ID NO: 5905407 - DNA, 18 bp, Homo sapiens
gattcaggcctctgagga

SEQ ID NO: 5905408 - DNA, 19 bp, Homo sapiens
gattcagggagaatgttgt

SEQ ID NO: 5905409 - DNA, 19 bp, Homo sapiens
gattcagggcccctgaagt

SEQ ID NO: 5905410 - DNA, 16 bp, Homo sapiens
gattcaggggaagggc

SEQ ID NO: 5905411 - DNA, 18 bp, Homo sapiens
gattcaggggaagggcag

SEQ ID NO: 5905412 - DNA, 20 bp, Homo sapiens
gattcaggggctttgggccc

SEQ ID NO: 5905413 - DNA, 14 bp, Homo sapiens
gattcagtcttctg

SEQ ID NO: 5905414 - DNA, 13 bp, Homo sapiens
gattcagtcttgc

SEQ ID NO: 5905415 - DNA, 20 bp, Homo sapiens
gattcagtgttaaatgtgat

SEQ ID NO: 5905416 - DNA, 15 bp, Homo sapiens
gattcagttttcatt

SEQ ID NO: 5905417 - DNA, 20 bp, Homo sapiens
gattcagttttcccactttt

SEQ ID NO: 5905418 - DNA, 21 bp, Homo sapiens
gattcataaagtaatgatgaa

SEQ ID NO: 5905419 - DNA, 19 bp, Homo sapiens
gattcataagacacttaga

SEQ ID NO: 5905420 - DNA, 14 bp, Homo sapiens
gattcatataacca

SEQ ID NO: 5905421 - DNA, 22 bp, Homo sapiens
gattcatatatccgaactactg

SEQ ID NO: 5905422 - DNA, 18 bp, Homo sapiens
gattcatattgcatcata

SEQ ID NO: 5905423 - DNA, 12 bp, Homo sapiens
gattcatattta

SEQ ID NO: 5905424 - DNA, 22 bp, Homo sapiens
gattcatatttaatttgaagat

SEQ ID NO: 5905425 - DNA, 14 bp, Homo sapiens
gattcatctctggt

SEQ ID NO: 5905426 - DNA, 12 bp, Homo sapiens
gattcatctttc

SEQ ID NO: 5905427 - DNA, 15 bp, Homo sapiens
gattcatctttcaga

SEQ ID NO: 5905428 - DNA, 17 bp, Homo sapiens
gattcatgatttataaa

SEQ ID NO: 5905429 - DNA, 21 bp, Homo sapiens
gattcatgccaattagcaatt

SEQ ID NO: 5905430 - DNA, 19 bp, Homo sapiens
gattcatggagtagcctgg

SEQ ID NO: 5905431 - DNA, 24 bp, Homo sapiens
gattcatggagtagcctggactgt

SEQ ID NO: 5905432 - DNA, 19 bp, Homo sapiens
gattcatgtgcttgtgcct

SEQ ID NO: 5905433 - DNA, 15 bp, Homo sapiens
gattcattctcataa

SEQ ID NO: 5905434 - DNA, 18 bp, Homo sapiens
gattcattcttaacaaga

SEQ ID NO: 5905435 - DNA, 17 bp, Homo sapiens
gattcatttataagaag

SEQ ID NO: 5905436 - DNA, 21 bp, Homo sapiens
gattcatttcctgcccttcct

SEQ ID NO: 5905437 - DNA, 15 bp, Homo sapiens
gattcattttcctgt

SEQ ID NO: 5905438 - DNA, 19 bp, Homo sapiens
gattcatttttaatcatga

SEQ ID NO: 5905439 - DNA, 18 bp, Homo sapiens
gattccaaagcattttca

SEQ ID NO: 5905440 - DNA, 22 bp, Homo sapiens
gattccaacaggcgtgggatca

SEQ ID NO: 5905441 - DNA, 14 bp, Homo sapiens
gattccaaccttcc

SEQ ID NO: 5905442 - DNA, 17 bp, Homo sapiens
gattccaagggcccaga

SEQ ID NO: 5905443 - DNA, 15 bp, Homo sapiens
gattccacacaaaat

SEQ ID NO: 5905444 - DNA, 23 bp, Homo sapiens
gattccactgaaacctctgttct

SEQ ID NO: 5905445 - DNA, 18 bp, Homo sapiens
gattccagaacgccctgt

SEQ ID NO: 5905446 - DNA, 20 bp, Homo sapiens
gattccagaacgccctgtgt

SEQ ID NO: 5905447 - DNA, 19 bp, Homo sapiens
gattccagagagtggctcc

SEQ ID NO: 5905448 - DNA, 20 bp, Homo sapiens
gattccagagagtggctcct

SEQ ID NO: 5905449 - DNA, 22 bp, Homo sapiens
gattccagagagtggctcctcc

SEQ ID NO: 5905450 - DNA, 19 bp, Homo sapiens
gattccagagcactgctcc

SEQ ID NO: 5905451 - DNA, 15 bp, Homo sapiens
gattccagcacaacc

SEQ ID NO: 5905452 - DNA, 16 bp, Homo sapiens
gattccagcatttgcc

SEQ ID NO: 5905453 - DNA, 14 bp, Homo sapiens
gattccagccatca

SEQ ID NO: 5905454 - DNA, 12 bp, Homo sapiens
gattccagtgca

SEQ ID NO: 5905455 - DNA, 22 bp, Homo sapiens
gattgtaacgttgctgtgggaa

SEQ ID NO: 5905456 - DNA, 21 bp, Homo sapiens
gattgtacagaatcattgctt

SEQ ID NO: 5905457 - DNA, 23 bp, Homo sapiens
gattgtacatttatttattactg

SEQ ID NO: 5905458 - DNA, 19 bp, Homo sapiens
gattgtacgtgggagaggc

SEQ ID NO: 5905459 - DNA, 23 bp, Homo sapiens
gattgtacgtgggagaggcagaa

SEQ ID NO: 5905460 - DNA, 14 bp, Homo sapiens
gattgtactgttca

SEQ ID NO: 5905461 - DNA, 15 bp, Homo sapiens
gattgtactgttcat

SEQ ID NO: 5905462 - DNA, 16 bp, Homo sapiens
gattgtactgttcata

SEQ ID NO: 5905463 - DNA, 14 bp, Homo sapiens
gattgtagaacttg

SEQ ID NO: 5905464 - DNA, 16 bp, Homo sapiens
gattgtagaacttgtt

SEQ ID NO: 5905465 - DNA, 20 bp, Homo sapiens
gattgtagaacttgttgctg

SEQ ID NO: 5905466 - DNA, 20 bp, Homo sapiens
gattgtaggtgcaagatgga

SEQ ID NO: 5905467 - DNA, 16 bp, Homo sapiens
gattgtatctgaactc

SEQ ID NO: 5905468 - DNA, 15 bp, Homo sapiens
gattgtattgctgtc

SEQ ID NO: 5905469 - DNA, 19 bp, Homo sapiens
gattgtattgtgagatcct

SEQ ID NO: 5905470 - DNA, 14 bp, Homo sapiens
gattgtatttaaga

SEQ ID NO: 5905471 - DNA, 18 bp, Homo sapiens
gattgtatttaagacata

SEQ ID NO: 5905472 - DNA, 15 bp, Homo sapiens
gattgtatttgtgac

SEQ ID NO: 5905473 - DNA, 17 bp, Homo sapiens
gattgtcagccacctcc

SEQ ID NO: 5905474 - DNA, 19 bp, Homo sapiens
gattgtccacaaatgtcct

SEQ ID NO: 5905475 - DNA, 15 bp, Homo sapiens
gattgtccccgaccc

SEQ ID NO: 5905476 - DNA, 19 bp, Homo sapiens
gattgtcctcatttctcca

SEQ ID NO: 5905477 - DNA, 17 bp, Homo sapiens
gattgtccttttgcaaa

SEQ ID NO: 5905478 - DNA, 13 bp, Homo sapiens
gattgtctgctgc

SEQ ID NO: 5905479 - DNA, 22 bp, Homo sapiens
gattgtctgctgcctccaagtc

SEQ ID NO: 5905480 - DNA, 16 bp, Homo sapiens
gattgtcttgcaactt

SEQ ID NO: 5905481 - DNA, 22 bp, Homo sapiens
gattgtgaattccttaaagttt

SEQ ID NO: 5905482 - DNA, 22 bp, Homo sapiens
gattgtgaggcttctaataaag

SEQ ID NO: 5905483 - DNA, 22 bp, Homo sapiens
gattgtgcaatagtcagagtgt

SEQ ID NO: 5905484 - DNA, 20 bp, Homo sapiens
gattgtgcccacccagggaa

SEQ ID NO: 5905485 - DNA, 18 bp, Homo sapiens
gattgtggaaaaccagga

SEQ ID NO: 5905486 - DNA, 16 bp, Homo sapiens
gattgtggaatgttgg

SEQ ID NO: 5905487 - DNA, 21 bp, Homo sapiens
gattgtggaatgttggataag

SEQ ID NO: 5905488 - DNA, 16 bp, Homo sapiens
gattgtggggagagaa

SEQ ID NO: 5905489 - DNA, 20 bp, Homo sapiens
gattgtggggagagaaatct

SEQ ID NO: 5905490 - DNA, 20 bp, Homo sapiens
gattgtggggtgcagctggg

SEQ ID NO: 5905491 - DNA, 12 bp, Homo sapiens
gattgtgtacat

SEQ ID NO: 5905492 - DNA, 13 bp, Homo sapiens
gattgtgtacata

SEQ ID NO: 5905493 - DNA, 22 bp, Homo sapiens
gattgtgtacatagagcaatgt

SEQ ID NO: 5905494 - DNA, 17 bp, Homo sapiens
gattgtgtcccattccc

SEQ ID NO: 5905495 - DNA, 18 bp, Homo sapiens
gattgtgtcccattcccc

SEQ ID NO: 5905496 - DNA, 23 bp, Homo sapiens
gattgtgtgactattcatggcta

SEQ ID NO: 5905497 - DNA, 20 bp, Homo sapiens
gattgtgttcctgaagaaaa

SEQ ID NO: 5905498 - DNA, 13 bp, Homo sapiens
gattgttagttaa

SEQ ID NO: 5905499 - DNA, 19 bp, Homo sapiens
gattgttccataataaact

SEQ ID NO: 5905500 - DNA, 15 bp, Homo sapiens
gattgttcctgcttt

SEQ ID NO: 5905501 - DNA, 18 bp, Homo sapiens
gattgttcgggtgtgcaa

SEQ ID NO: 5905502 - DNA, 21 bp, Homo sapiens
gattgttctgtccagtttcca

SEQ ID NO: 5905503 - DNA, 18 bp, Homo sapiens
gattgttcttttgtttca

SEQ ID NO: 5905504 - DNA, 13 bp, Homo sapiens
gattgttgtttgc

SEQ ID NO: 5905505 - DNA, 22 bp, Homo sapiens
gattgtttaaagaagctctcca

SEQ ID NO: 5905506 - DNA, 13 bp, Homo sapiens
gattgtttacagg

SEQ ID NO: 5905507 - DNA, 11 bp, Homo sapiens
gattgtttcta

SEQ ID NO: 5905508 - DNA, 18 bp, Homo sapiens
gattgtttctatacaaat

SEQ ID NO: 5905509 - DNA, 12 bp, Homo sapiens
gattgttttatc

SEQ ID NO: 5905510 - DNA, 13 bp, Homo sapiens
gatttaaaaagtg

SEQ ID NO: 5905511 - DNA, 12 bp, Homo sapiens
gatttaaaacaa

SEQ ID NO: 5905512 - DNA, 17 bp, Homo sapiens
gatttaaactctgaatt

SEQ ID NO: 5905513 - DNA, 18 bp, Homo sapiens
gatttaaagtattttaat

SEQ ID NO: 5905514 - DNA, 23 bp, Homo sapiens
gatttaaagtgccttatcaaata

SEQ ID NO: 5905515 - DNA, 18 bp, Homo sapiens
gatttaaatagaacttga

SEQ ID NO: 5905516 - DNA, 15 bp, Homo sapiens
gatttaaattttcac

SEQ ID NO: 5905517 - DNA, 13 bp, Homo sapiens
gatttaacaaata

SEQ ID NO: 5905518 - DNA, 17 bp, Homo sapiens
gatttaacaaatacatt

SEQ ID NO: 5905519 - DNA, 14 bp, Homo sapiens
gatttaacactttt

SEQ ID NO: 5905520 - DNA, 15 bp, Homo sapiens
gatttaacagaaatg

SEQ ID NO: 5905521 - DNA, 17 bp, Homo sapiens
gatttaacagaaatgta

SEQ ID NO: 5905522 - DNA, 20 bp, Homo sapiens
gatttaacagaaatgtacag

SEQ ID NO: 5905523 - DNA, 17 bp, Homo sapiens
gatttaacagtcattta

SEQ ID NO: 5905524 - DNA, 18 bp, Homo sapiens
gatttaacattatctagt

SEQ ID NO: 5905525 - DNA, 16 bp, Homo sapiens
gatttaacttgtattt

SEQ ID NO: 5905526 - DNA, 21 bp, Homo sapiens
gatttaagcaaaggctccctc

SEQ ID NO: 5905527 - DNA, 18 bp, Homo sapiens
gatttaagccttgacaca

SEQ ID NO: 5905528 - DNA, 23 bp, Homo sapiens
gatttaagccttgacacactgtg

SEQ ID NO: 5905529 - DNA, 20 bp, Homo sapiens
gatttaagggcccaggtcag

SEQ ID NO: 5905530 - DNA, 13 bp, Homo sapiens
gatttaaggtatt

SEQ ID NO: 5905531 - DNA, 19 bp, Homo sapiens
gatttaagtgaatacatta

SEQ ID NO: 5905532 - DNA, 23 bp, Homo sapiens
gatttaataaaataattctaaag

SEQ ID NO: 5905533 - DNA, 19 bp, Homo sapiens
gatttaataacataacaaa

SEQ ID NO: 5905534 - DNA, 17 bp, Homo sapiens
gatttaatagtgttaat

SEQ ID NO: 5905535 - DNA, 21 bp, Homo sapiens
gatttaatagtgttaatcaat

SEQ ID NO: 5905536 - DNA, 21 bp, Homo sapiens
gatttaatataaagttttata

SEQ ID NO: 5905537 - DNA, 23 bp, Homo sapiens
gatttaatataaagttttatata

SEQ ID NO: 5905538 - DNA, 13 bp, Homo sapiens
gatttaatccaga

SEQ ID NO: 5905539 - DNA, 15 bp, Homo sapiens
gatttaatccatttt

SEQ ID NO: 5905540 - DNA, 13 bp, Homo sapiens
gatttaatgtttt

SEQ ID NO: 5905541 - DNA, 22 bp, Homo sapiens
gatttaatgttttctgctgttt

SEQ ID NO: 5905542 - DNA, 21 bp, Homo sapiens
gatttaattaatcatgaatgt

SEQ ID NO: 5905543 - DNA, 12 bp, Homo sapiens
gatttaattctt

SEQ ID NO: 5905544 - DNA, 19 bp, Homo sapiens
gatttaatttgatatcaca

SEQ ID NO: 5905545 - DNA, 16 bp, Homo sapiens
gatttaatttgccaaa

SEQ ID NO: 5905546 - DNA, 20 bp, Homo sapiens
gatttaatttgttgttaata

SEQ ID NO: 5905547 - DNA, 18 bp, Homo sapiens
gatttacaggacttctct

SEQ ID NO: 5905548 - DNA, 13 bp, Homo sapiens
gatttacataggc

SEQ ID NO: 5905549 - DNA, 15 bp, Homo sapiens
gatttacatgtatgg

SEQ ID NO: 5905550 - DNA, 20 bp, Homo sapiens
gatttacatgtatggttact

SEQ ID NO: 5905551 - DNA, 12 bp, Homo sapiens
gatttacattca

SEQ ID NO: 5905552 - DNA, 22 bp, Homo sapiens
gatttacccagaatgtcagatt

SEQ ID NO: 5905553 - DNA, 15 bp, Homo sapiens
gatttaccctttata

SEQ ID NO: 5905554 - DNA, 14 bp, Homo sapiens
gatttacgactgaa

SEQ ID NO: 5905555 - DNA, 12 bp, Homo sapiens
gatttagaaaaa

SEQ ID NO: 5905556 - DNA, 20 bp, Homo sapiens
gatttagaaaaaagtttaca

SEQ ID NO: 5905557 - DNA, 21 bp, Homo sapiens
gatttagaaaaaagtttacaa

SEQ ID NO: 5905558 - DNA, 17 bp, Homo sapiens
gatttagagactgtaaa

SEQ ID NO: 5905559 - DNA, 19 bp, Homo sapiens
gatttagcaatgctgtgaa

SEQ ID NO: 5905560 - DNA, 16 bp, Homo sapiens
gatttagggaagcagg

SEQ ID NO: 5905561 - DNA, 18 bp, Homo sapiens
gatttagggaagcaggga

SEQ ID NO: 5905562 - DNA, 19 bp, Homo sapiens
gatttagtctgttatattt

SEQ ID NO: 5905563 - DNA, 20 bp, Homo sapiens
gatttagtctgttatatttc

SEQ ID NO: 5905564 - DNA, 22 bp, Homo sapiens
gatttagtgtttttacctctgt

SEQ ID NO: 5905565 - DNA, 20 bp, Homo sapiens
gatttagttgtggaaagata

SEQ ID NO: 5905566 - DNA, 13 bp, Homo sapiens
gatttagtttcag

SEQ ID NO: 5905567 - DNA, 14 bp, Homo sapiens
gatttagtttcagt

SEQ ID NO: 5905568 - DNA, 14 bp, Homo sapiens
gatttataaacaga

SEQ ID NO: 5905569 - DNA, 14 bp, Homo sapiens
gatttataaagcaa

SEQ ID NO: 5905570 - DNA, 13 bp, Homo sapiens
gatttataaatgc

SEQ ID NO: 5905571 - DNA, 18 bp, Homo sapiens
gatttataaatgctattt

SEQ ID NO: 5905572 - DNA, 15 bp, Homo sapiens
gatttatactcattt

SEQ ID NO: 5905573 - DNA, 20 bp, Homo sapiens
gatttatagtttgtacatgc

SEQ ID NO: 5905574 - DNA, 14 bp, Homo sapiens
gatttatatctata

SEQ ID NO: 5905575 - DNA, 14 bp, Homo sapiens
gatttatcaaatca

SEQ ID NO: 5905576 - DNA, 15 bp, Homo sapiens
gatttatcacacaaa

SEQ ID NO: 5905577 - DNA, 21 bp, Homo sapiens
gatttatctaaggtccccagc

SEQ ID NO: 5905578 - DNA, 11 bp, Homo sapiens
gatttatcttt

SEQ ID NO: 5905579 - DNA, 18 bp, Homo sapiens
gatttatctttatacaga

SEQ ID NO: 5905580 - DNA, 13 bp, Homo sapiens
gatttatgcttta

SEQ ID NO: 5905581 - DNA, 12 bp, Homo sapiens
gatttatggttt

SEQ ID NO: 5905582 - DNA, 21 bp, Homo sapiens
gatttatggtttttttaagta

SEQ ID NO: 5905583 - DNA, 19 bp, Homo sapiens
gatttatgtgcactgcctg

SEQ ID NO: 5905584 - DNA, 19 bp, Homo sapiens
gatttattaaagaaaaaaa

SEQ ID NO: 5905585 - DNA, 13 bp, Homo sapiens
gatttattctcag

SEQ ID NO: 5905586 - DNA, 18 bp, Homo sapiens
gatttatttcatcatatt

SEQ ID NO: 5905587 - DNA, 14 bp, Homo sapiens
gatttattttacat

SEQ ID NO: 5905588 - DNA, 15 bp, Homo sapiens
gatttattttacatt

SEQ ID NO: 5905589 - DNA, 21 bp, Homo sapiens
gatttattttgtatgaaatat

SEQ ID NO: 5905590 - DNA, 23 bp, Homo sapiens
gatttattttttaatcatttaaa

SEQ ID NO: 5905591 - DNA, 15 bp, Homo sapiens
gatttattttttgta

SEQ ID NO: 5905592 - DNA, 19 bp, Homo sapiens
gatttattttttgtaactc

SEQ ID NO: 5905593 - DNA, 13 bp, Homo sapiens
gatttcaaatgca

SEQ ID NO: 5905594 - DNA, 20 bp, Homo sapiens
gatttcaatgattgtttaat

SEQ ID NO: 5905595 - DNA, 13 bp, Homo sapiens
gatttcacaaata

SEQ ID NO: 5905596 - DNA, 14 bp, Homo sapiens
gatttcacaaatat

SEQ ID NO: 5905597 - DNA, 19 bp, Homo sapiens
gatttcacagttggcactt

SEQ ID NO: 5905598 - DNA, 19 bp, Homo sapiens
gatttcactaggactcaga

SEQ ID NO: 5905599 - DNA, 11 bp, Homo sapiens
gatttcactct

SEQ ID NO: 5905600 - DNA, 17 bp, Homo sapiens
gatttcactctccttgg

SEQ ID NO: 5905601 - DNA, 15 bp, Homo sapiens
gatttcactgacact

SEQ ID NO: 5905602 - DNA, 15 bp, Homo sapiens
gatttcagaagccta

SEQ ID NO: 5905603 - DNA, 18 bp, Homo sapiens
gatttcagcacatgcact

SEQ ID NO: 5905604 - DNA, 12 bp, Homo sapiens
gatttcagccat

SEQ ID NO: 5905605 - DNA, 20 bp, Homo sapiens
gatttcaggatactctgtca

SEQ ID NO: 5905606 - DNA, 22 bp, Homo sapiens
gatttcaggatactctgtcaga

SEQ ID NO: 5905607 - DNA, 17 bp, Homo sapiens
gatttcagtaatgtctt

SEQ ID NO: 5905608 - DNA, 13 bp, Homo sapiens
gatttcagtagaa

SEQ ID NO: 5905609 - DNA, 18 bp, Homo sapiens
gatttcagttcaatcaaa

SEQ ID NO: 5905610 - DNA, 23 bp, Homo sapiens
gatttcagttttaacaaatgcta

SEQ ID NO: 5905611 - DNA, 11 bp, Homo sapiens
gatttcataat

SEQ ID NO: 5905612 - DNA, 23 bp, Homo sapiens
gatttcatacctcagaatgtaaa

SEQ ID NO: 5905613 - DNA, 23 bp, Homo sapiens
gatttcatattgatctttttatc

SEQ ID NO: 5905614 - DNA, 17 bp, Homo sapiens
gatttcatctgctctcc

SEQ ID NO: 5905615 - DNA, 20 bp, Homo sapiens
gatttcatctgctctccttc

SEQ ID NO: 5905616 - DNA, 21 bp, Homo sapiens
gatttcatctgctctccttcc

SEQ ID NO: 5905617 - DNA, 16 bp, Homo sapiens
gatttcatcttctgga

SEQ ID NO: 5905618 - DNA, 23 bp, Homo sapiens
gatttcatgcattctagtgcaga

SEQ ID NO: 5905619 - DNA, 16 bp, Homo sapiens
gatttcatgctatctc

SEQ ID NO: 5905620 - DNA, 18 bp, Homo sapiens
gatttcatgctatctctg

SEQ ID NO: 5905621 - DNA, 12 bp, Homo sapiens
gatttcatgtac

SEQ ID NO: 5905622 - DNA, 16 bp, Homo sapiens
gatttcattatcacat

SEQ ID NO: 5905623 - DNA, 12 bp, Homo sapiens
gatttcattgac

SEQ ID NO: 5905624 - DNA, 16 bp, Homo sapiens
gatttcattgactgaa

SEQ ID NO: 5905625 - DNA, 20 bp, Homo sapiens
gatttcatttcaactgtttg

SEQ ID NO: 5905626 - DNA, 20 bp, Homo sapiens
gatttccacctttatgtttt

SEQ ID NO: 5905627 - DNA, 21 bp, Homo sapiens
gatttccacctttatgtttta

SEQ ID NO: 5905628 - DNA, 15 bp, Homo sapiens
gatttccagccaggg

SEQ ID NO: 5905629 - DNA, 18 bp, Homo sapiens
gatttccagccagggctg

SEQ ID NO: 5905630 - DNA, 15 bp, Homo sapiens
gatttccagccttct

SEQ ID NO: 5905631 - DNA, 12 bp, Homo sapiens
gatttccaggcc

SEQ ID NO: 5905632 - DNA, 22 bp, Homo sapiens
gatttccagtctccaccaggaa

SEQ ID NO: 5905633 - DNA, 23 bp, Homo sapiens
gcaaaactaaatacttgctccat

SEQ ID NO: 5905634 - DNA, 19 bp, Homo sapiens
gcaaaactcactaagttta

SEQ ID NO: 5905635 - DNA, 20 bp, Homo sapiens
gcaaaactcagtctcaaata

SEQ ID NO: 5905636 - DNA, 11 bp, Homo sapiens
gcaaaactgtg

SEQ ID NO: 5905637 - DNA, 16 bp, Homo sapiens
gcaaaacttttaaact

SEQ ID NO: 5905638 - DNA, 13 bp, Homo sapiens
gcaaaagaatgtt

SEQ ID NO: 5905639 - DNA, 13 bp, Homo sapiens
gcaaaagagaaat

SEQ ID NO: 5905640 - DNA, 22 bp, Homo sapiens
gcaaaagagctactcagaaatg

SEQ ID NO: 5905641 - DNA, 16 bp, Homo sapiens
gcaaaagatgcttctc

SEQ ID NO: 5905642 - DNA, 20 bp, Homo sapiens
gcaaaagcaagggaccttca

SEQ ID NO: 5905643 - DNA, 16 bp, Homo sapiens
gcaaaagcctcagaaa

SEQ ID NO: 5905644 - DNA, 15 bp, Homo sapiens
gcaaaaggcagctca

SEQ ID NO: 5905645 - DNA, 13 bp, Homo sapiens
gcaaaaggcctct

SEQ ID NO: 5905646 - DNA, 22 bp, Homo sapiens
gcaaaaggcctgtgatccagga

SEQ ID NO: 5905647 - DNA, 21 bp, Homo sapiens
gcaaaaggcggtgagagagga

SEQ ID NO: 5905648 - DNA, 19 bp, Homo sapiens
gcaaaagtaatcacttaaa

SEQ ID NO: 5905649 - DNA, 21 bp, Homo sapiens
gcaaaagtacaagggctgaga

SEQ ID NO: 5905650 - DNA, 23 bp, Homo sapiens
gcaaaagtcagcgtgacaatata

SEQ ID NO: 5905651 - DNA, 23 bp, Homo sapiens
gcaaaagtcattgctgacagagc

SEQ ID NO: 5905652 - DNA, 13 bp, Homo sapiens
gcaaaagtggggc

SEQ ID NO: 5905653 - DNA, 15 bp, Homo sapiens
gcaaaataaaaacta

SEQ ID NO: 5905654 - DNA, 13 bp, Homo sapiens
gcaaaataaaaca

SEQ ID NO: 5905655 - DNA, 17 bp, Homo sapiens
gcaaaataaaatgagtt

SEQ ID NO: 5905656 - DNA, 18 bp, Homo sapiens
gcaaaataaatgttttta

SEQ ID NO: 5905657 - DNA, 20 bp, Homo sapiens
gcaaaataattttaaacaaa

SEQ ID NO: 5905658 - DNA, 12 bp, Homo sapiens
gcaaaatacatc

SEQ ID NO: 5905659 - DNA, 14 bp, Homo sapiens
gcaaaatacatgaa

SEQ ID NO: 5905660 - DNA, 16 bp, Homo sapiens
gcaaaatagaagaaga

SEQ ID NO: 5905661 - DNA, 21 bp, Homo sapiens
gcaaaatatatgtttggctga

SEQ ID NO: 5905662 - DNA, 13 bp, Homo sapiens
gcaaaatatgttt

SEQ ID NO: 5905663 - DNA, 15 bp, Homo sapiens
gcaaaatattatgtt

SEQ ID NO: 5905664 - DNA, 20 bp, Homo sapiens
gcaaaatattcactgggcca

SEQ ID NO: 5905665 - DNA, 16 bp, Homo sapiens
gcaaaatatttgtgaa

SEQ ID NO: 5905666 - DNA, 17 bp, Homo sapiens
gcaaaatatttgtgaaa

SEQ ID NO: 5905667 - DNA, 16 bp, Homo sapiens
gcaaaatcaacatgac

SEQ ID NO: 5905668 - DNA, 16 bp, Homo sapiens
gcaaaatcacttagca

SEQ ID NO: 5905669 - DNA, 20 bp, Homo sapiens
gcaaaatcacttagcagcaa

SEQ ID NO: 5905670 - DNA, 20 bp, Homo sapiens
gcaaaatcaggaaaggctgt

SEQ ID NO: 5905671 - DNA, 13 bp, Homo sapiens
gcaaaatcagttt

SEQ ID NO: 5905672 - DNA, 13 bp, Homo sapiens
gcaaaatcatgga

SEQ ID NO: 5905673 - DNA, 23 bp, Homo sapiens
gcaaaatcattttatatgtcaaa

SEQ ID NO: 5905674 - DNA, 15 bp, Homo sapiens
gcaaaatccaaactg

SEQ ID NO: 5905675 - DNA, 19 bp, Homo sapiens
gcaaaatccaaactgctgt

SEQ ID NO: 5905676 - DNA, 21 bp, Homo sapiens
gcaaaatccttacttccagca

SEQ ID NO: 5905677 - DNA, 18 bp, Homo sapiens
gcaaaatctaaaatgttt

SEQ ID NO: 5905678 - DNA, 21 bp, Homo sapiens
gcaaaatgaaaagagaaactt

SEQ ID NO: 5905679 - DNA, 20 bp, Homo sapiens
gcaaaatgatagttttctag

SEQ ID NO: 5905680 - DNA, 13 bp, Homo sapiens
gcaaaatgctttt

SEQ ID NO: 5905681 - DNA, 13 bp, Homo sapiens
gcaaaatggaaat

SEQ ID NO: 5905682 - DNA, 16 bp, Homo sapiens
gcaaaatggaaatgta

SEQ ID NO: 5905683 - DNA, 17 bp, Homo sapiens
gcaaaatggaagcaaag

SEQ ID NO: 5905684 - DNA, 13 bp, Homo sapiens
gcaaaatgtgaat

SEQ ID NO: 5905685 - DNA, 14 bp, Homo sapiens
gcaaaattaaatct

SEQ ID NO: 5905686 - DNA, 17 bp, Homo sapiens
gcaaaattacagttcac

SEQ ID NO: 5905687 - DNA, 23 bp, Homo sapiens
gcaaaattatagaagtttagatt

SEQ ID NO: 5905688 - DNA, 14 bp, Homo sapiens
gcaaaattcctgtg

SEQ ID NO: 5905689 - DNA, 17 bp, Homo sapiens
gcaaaattgatgtgttt

SEQ ID NO: 5905690 - DNA, 12 bp, Homo sapiens
gcaaaattgttt

SEQ ID NO: 5905691 - DNA, 13 bp, Homo sapiens
gcaaaattgtttt

SEQ ID NO: 5905692 - DNA, 21 bp, Homo sapiens
gcaaaattgttttcacttgta

SEQ ID NO: 5905693 - DNA, 22 bp, Homo sapiens
gcaaaattgttttcacttgtat

SEQ ID NO: 5905694 - DNA, 17 bp, Homo sapiens
gcaaaatttagaagaaa

SEQ ID NO: 5905695 - DNA, 14 bp, Homo sapiens
gcaaaatttctgta

SEQ ID NO: 5905696 - DNA, 15 bp, Homo sapiens
gcaaaatttgatgcc

SEQ ID NO: 5905697 - DNA, 16 bp, Homo sapiens
gcaaaattttatagct

SEQ ID NO: 5905698 - DNA, 18 bp, Homo sapiens
gcaaaatttttaaaactg

SEQ ID NO: 5905699 - DNA, 23 bp, Homo sapiens
gcaaacaaaaatagaatatataa

SEQ ID NO: 5905700 - DNA, 13 bp, Homo sapiens
gcaaacaacatta

SEQ ID NO: 5905701 - DNA, 17 bp, Homo sapiens
gcaaacaacctgaatct

SEQ ID NO: 5905702 - DNA, 17 bp, Homo sapiens
gcaaacaactttctgga

SEQ ID NO: 5905703 - DNA, 13 bp, Homo sapiens
gcaaacaataaac

SEQ ID NO: 5905704 - DNA, 15 bp, Homo sapiens
gcaaacaatcccaat

SEQ ID NO: 5905705 - DNA, 12 bp, Homo sapiens
gcaaacaatttt

SEQ ID NO: 5905706 - DNA, 17 bp, Homo sapiens
gcaaacacaagaaatca

SEQ ID NO: 5905707 - DNA, 13 bp, Homo sapiens
gcaaacacaataa

SEQ ID NO: 5905708 - DNA, 18 bp, Homo sapiens
gcaaacacaccttggaga

SEQ ID NO: 5905709 - DNA, 11 bp, Homo sapiens
gcaaacacagt

SEQ ID NO: 5905710 - DNA, 13 bp, Homo sapiens
gcaaacacctgct

SEQ ID NO: 5905711 - DNA, 16 bp, Homo sapiens
gcaaacactgtgtatt

SEQ ID NO: 5905712 - DNA, 19 bp, Homo sapiens
gcaaacactgtgtatttat

SEQ ID NO: 5905713 - DNA, 13 bp, Homo sapiens
gcaaacagaaaaa

SEQ ID NO: 5905714 - DNA, 15 bp, Homo sapiens
gcaaacagaacaggg

SEQ ID NO: 5905715 - DNA, 14 bp, Homo sapiens
gcaaacagaagtgc

SEQ ID NO: 5905716 - DNA, 13 bp, Homo sapiens
gcaaacagagcta

SEQ ID NO: 5905717 - DNA, 20 bp, Homo sapiens
gcaaacagaggaggccagcc

SEQ ID NO: 5905718 - DNA, 18 bp, Homo sapiens
gcaaacagctgaaagagg

SEQ ID NO: 5905719 - DNA, 21 bp, Homo sapiens
gcaaacaggatcagttaacta

SEQ ID NO: 5905720 - DNA, 16 bp, Homo sapiens
gcaaacagggcctctg

SEQ ID NO: 5905721 - DNA, 17 bp, Homo sapiens
gcaaacagggcctctgc

SEQ ID NO: 5905722 - DNA, 20 bp, Homo sapiens
gcaaacagggtggcccaggt

SEQ ID NO: 5905723 - DNA, 22 bp, Homo sapiens
gcaaacaggttgttttctactt

SEQ ID NO: 5905724 - DNA, 18 bp, Homo sapiens
gcaaacatggagaaatct

SEQ ID NO: 5905725 - DNA, 21 bp, Homo sapiens
gcaaacatggggttggctggg

SEQ ID NO: 5905726 - DNA, 20 bp, Homo sapiens
gcaaacatttcttaaaatgt

SEQ ID NO: 5905727 - DNA, 15 bp, Homo sapiens
gcaaacattttctct

SEQ ID NO: 5905728 - DNA, 20 bp, Homo sapiens
gcaaacattttctcttagaa

SEQ ID NO: 5905729 - DNA, 20 bp, Homo sapiens
gcaaaccaacaagaataaag

SEQ ID NO: 5905730 - DNA, 18 bp, Homo sapiens
gcaaaccaatacagaatt

SEQ ID NO: 5905731 - DNA, 17 bp, Homo sapiens
gcaaaccacactggact

SEQ ID NO: 5905732 - DNA, 18 bp, Homo sapiens
gcaaaccacactggactc

SEQ ID NO: 5905733 - DNA, 20 bp, Homo sapiens
gcaaaccacactggactccg

SEQ ID NO: 5905734 - DNA, 22 bp, Homo sapiens
gcaaaccagcttgttctgggct

SEQ ID NO: 5905735 - DNA, 23 bp, Homo sapiens
gcaaaccagcttgttctgggctc

SEQ ID NO: 5905736 - DNA, 14 bp, Homo sapiens
gcaaaccaggctgc

SEQ ID NO: 5905737 - DNA, 16 bp, Homo sapiens
gcaaaccaggctgcag

SEQ ID NO: 5905738 - DNA, 12 bp, Homo sapiens
gcaaaccatcat

SEQ ID NO: 5905739 - DNA, 15 bp, Homo sapiens
gcaaaccatcattga

SEQ ID NO: 5905740 - DNA, 20 bp, Homo sapiens
gcaaaccatcattgaaatct

SEQ ID NO: 5905741 - DNA, 16 bp, Homo sapiens
gcaaaccatttttaaa

SEQ ID NO: 5905742 - DNA, 15 bp, Homo sapiens
gcaaacccaaagatg

SEQ ID NO: 5905743 - DNA, 17 bp, Homo sapiens
gcaaacccaaagatgtt

SEQ ID NO: 5905744 - DNA, 20 bp, Homo sapiens
gcaaacccaaagatgttaac

SEQ ID NO: 5905745 - DNA, 17 bp, Homo sapiens
gcaaacccagaggtgga

SEQ ID NO: 5905746 - DNA, 23 bp, Homo sapiens
gcaaacccatgaagctggccctc

SEQ ID NO: 5905747 - DNA, 20 bp, Homo sapiens
gcaaaccctcccagaaacat

SEQ ID NO: 5905748 - DNA, 23 bp, Homo sapiens
gcaaaccctcccagaaacatctc

SEQ ID NO: 5905749 - DNA, 19 bp, Homo sapiens
gcaaaccctggtggtattt

SEQ ID NO: 5905750 - DNA, 23 bp, Homo sapiens
gcaaacccttctcttctcccccc

SEQ ID NO: 5905751 - DNA, 18 bp, Homo sapiens
gcaaaccgttaggaaaac

SEQ ID NO: 5905752 - DNA, 19 bp, Homo sapiens
gcaaacctagcccccaagc

SEQ ID NO: 5905753 - DNA, 13 bp, Homo sapiens
gcaaacctctcct

SEQ ID NO: 5905754 - DNA, 19 bp, Homo sapiens
gcaaacctgcagtttttaa

SEQ ID NO: 5905755 - DNA, 20 bp, Homo sapiens
gcaaacctgcagtttttaat

SEQ ID NO: 5905756 - DNA, 17 bp, Homo sapiens
gcaaacctgccccatcc

SEQ ID NO: 5905757 - DNA, 20 bp, Homo sapiens
gcaaacctgctggtggggca

SEQ ID NO: 5905758 - DNA, 21 bp, Homo sapiens
gcaaacctgctggtggggcag

SEQ ID NO: 5905759 - DNA, 18 bp, Homo sapiens
gcaaacgaataaagatag

SEQ ID NO: 5905760 - DNA, 19 bp, Homo sapiens
gcaaacgagactttctcct

SEQ ID NO: 5905761 - DNA, 14 bp, Homo sapiens
gcaaacgctgcctg

SEQ ID NO: 5905762 - DNA, 17 bp, Homo sapiens
gcaaacgctgcctgccg

SEQ ID NO: 5905763 - DNA, 18 bp, Homo sapiens
gcaaacgtacgggaatgt

SEQ ID NO: 5905764 - DNA, 21 bp, Homo sapiens
gcaaacgtctattttgtatat

SEQ ID NO: 5905765 - DNA, 14 bp, Homo sapiens
gcaaacgtgaaatt

SEQ ID NO: 5905766 - DNA, 22 bp, Homo sapiens
gcaaactaaccagcattcccta

SEQ ID NO: 5905767 - DNA, 16 bp, Homo sapiens
gcaaactatgagttca

SEQ ID NO: 5905768 - DNA, 12 bp, Homo sapiens
gcaaactccagg

SEQ ID NO: 5905769 - DNA, 18 bp, Homo sapiens
gcaaactccaggttcctg

SEQ ID NO: 5905770 - DNA, 19 bp, Homo sapiens
gcaaactctataaagaaac

SEQ ID NO: 5905771 - DNA, 22 bp, Homo sapiens
gcaaactctttggtcgtttttt

SEQ ID NO: 5905772 - DNA, 23 bp, Homo sapiens
gcaaactctttggtcgttttttt

SEQ ID NO: 5905773 - DNA, 14 bp, Homo sapiens
gcaaactgcatgcc

SEQ ID NO: 5905774 - DNA, 15 bp, Homo sapiens
gcaaactgcatgccc

SEQ ID NO: 5905775 - DNA, 16 bp, Homo sapiens
gcaaactgcatgccca

SEQ ID NO: 5905776 - DNA, 19 bp, Homo sapiens
gcaaactgcatgcccagag

SEQ ID NO: 5905777 - DNA, 14 bp, Homo sapiens
gcaaactgctttat

SEQ ID NO: 5905778 - DNA, 21 bp, Homo sapiens
gcaaactgctttattttccct

SEQ ID NO: 5905779 - DNA, 23 bp, Homo sapiens
gcaaactggccgcgggggcaggg

SEQ ID NO: 5905780 - DNA, 20 bp, Homo sapiens
gcaaactgggaacccctttc

SEQ ID NO: 5905781 - DNA, 23 bp, Homo sapiens
gcaaactgggaacccctttccca

SEQ ID NO: 5905782 - DNA, 20 bp, Homo sapiens
gcaaacttaagaaacactga

SEQ ID NO: 5905783 - DNA, 18 bp, Homo sapiens
gcaaacttaatgttctta

SEQ ID NO: 5905784 - DNA, 22 bp, Homo sapiens
gcaaactttaacaggttttctt

SEQ ID NO: 5905785 - DNA, 23 bp, Homo sapiens
gcaaagaaaaaaaaaaaagccag

SEQ ID NO: 5905786 - DNA, 14 bp, Homo sapiens
gcaaagaaaacaca

SEQ ID NO: 5905787 - DNA, 17 bp, Homo sapiens
gcaaagaaaattctcaa

SEQ ID NO: 5905788 - DNA, 21 bp, Homo sapiens
gcaaagaaaattctcaagtga

SEQ ID NO: 5905789 - DNA, 16 bp, Homo sapiens
gcaaagaaaggagata

SEQ ID NO: 5905790 - DNA, 22 bp, Homo sapiens
gcaaagaaagtgggaggtcagg

SEQ ID NO: 5905791 - DNA, 14 bp, Homo sapiens
gcaaagaactctta

SEQ ID NO: 5905792 - DNA, 22 bp, Homo sapiens
gcaaagaactcttaccctggca

SEQ ID NO: 5905793 - DNA, 17 bp, Homo sapiens
gcaaagaactgccccat

SEQ ID NO: 5905794 - DNA, 18 bp, Homo sapiens
gcaaagacagtatttatt

SEQ ID NO: 5905795 - DNA, 18 bp, Homo sapiens
gcaaagacagtttcttgc

SEQ ID NO: 5905796 - DNA, 16 bp, Homo sapiens
gcaaagacctacctcc

SEQ ID NO: 5905797 - DNA, 17 bp, Homo sapiens
gcaaagacgtaataaaa

SEQ ID NO: 5905798 - DNA, 14 bp, Homo sapiens
gcaaagagacattt

SEQ ID NO: 5905799 - DNA, 16 bp, Homo sapiens
gcaaagagctcccgag

SEQ ID NO: 5905800 - DNA, 21 bp, Homo sapiens
gcaaagaggactcgcttgtaa

SEQ ID NO: 5905801 - DNA, 14 bp, Homo sapiens
gcaaagaggcaaga

SEQ ID NO: 5905802 - DNA, 14 bp, Homo sapiens
gcaaagaggggcgc

SEQ ID NO: 5905803 - DNA, 15 bp, Homo sapiens
gcaaagaggggcgct

SEQ ID NO: 5905804 - DNA, 21 bp, Homo sapiens
gcaaagaggggcgctgtcctg

SEQ ID NO: 5905805 - DNA, 13 bp, Homo sapiens
gcaaagaggtgct

SEQ ID NO: 5905806 - DNA, 20 bp, Homo sapiens
gcaaagaggtgctgctttgc

SEQ ID NO: 5905807 - DNA, 18 bp, Homo sapiens
gcaaagataatttatttc

SEQ ID NO: 5905808 - DNA, 17 bp, Homo sapiens
gcaaagatatatattca

SEQ ID NO: 5905809 - DNA, 16 bp, Homo sapiens
gcaaagatatctcatc

SEQ ID NO: 5905810 - DNA, 18 bp, Homo sapiens
gcaaattgattcaaatgt

SEQ ID NO: 5905811 - DNA, 14 bp, Homo sapiens
gcaaattgattgtc

SEQ ID NO: 5905812 - DNA, 19 bp, Homo sapiens
gcaaattgtagcccagttg

SEQ ID NO: 5905813 - DNA, 14 bp, Homo sapiens
gcaaattgtatctt

SEQ ID NO: 5905814 - DNA, 17 bp, Homo sapiens
gcaaattgtatcttatt

SEQ ID NO: 5905815 - DNA, 16 bp, Homo sapiens
gcaaattgtcacagga

SEQ ID NO: 5905816 - DNA, 14 bp, Homo sapiens
gcaaatttaagaga

SEQ ID NO: 5905817 - DNA, 18 bp, Homo sapiens
gcaaatttagtttgttaa

SEQ ID NO: 5905818 - DNA, 16 bp, Homo sapiens
gcaaatttcaaaagac

SEQ ID NO: 5905819 - DNA, 20 bp, Homo sapiens
gcaaatttcaaaagacatgt

SEQ ID NO: 5905820 - DNA, 22 bp, Homo sapiens
gcaaatttcaaaagacatgttg

SEQ ID NO: 5905821 - DNA, 20 bp, Homo sapiens
gcaaatttcatctttccaaa

SEQ ID NO: 5905822 - DNA, 18 bp, Homo sapiens
gcaaatttcattatctaa

SEQ ID NO: 5905823 - DNA, 22 bp, Homo sapiens
gcaaatttctataaatttaaga

SEQ ID NO: 5905824 - DNA, 17 bp, Homo sapiens
gcaaatttgtgaactgt

SEQ ID NO: 5905825 - DNA, 13 bp, Homo sapiens
gcaaattttaaaa

SEQ ID NO: 5905826 - DNA, 15 bp, Homo sapiens
gcaaattttgcattt

SEQ ID NO: 5905827 - DNA, 16 bp, Homo sapiens
gcaacaaacctcactg

SEQ ID NO: 5905828 - DNA, 23 bp, Homo sapiens
gcaacaaactgcacatgatttca

SEQ ID NO: 5905829 - DNA, 23 bp, Homo sapiens
gcaacaaatacctccattaaatg

SEQ ID NO: 5905830 - DNA, 19 bp, Homo sapiens
gcaacaaatgaattttcca

SEQ ID NO: 5905831 - DNA, 18 bp, Homo sapiens
gcaacaacaacagaacaa

SEQ ID NO: 5905832 - DNA, 15 bp, Homo sapiens
gcaacaacaattggt

SEQ ID NO: 5905833 - DNA, 21 bp, Homo sapiens
gcaacaacaattggtaaaact

SEQ ID NO: 5905834 - DNA, 12 bp, Homo sapiens
gcaacaacagaa

SEQ ID NO: 5905835 - DNA, 20 bp, Homo sapiens
gcaacaactttgtttctcat

SEQ ID NO: 5905836 - DNA, 18 bp, Homo sapiens
gcaacaagactgccaggt

SEQ ID NO: 5905837 - DNA, 13 bp, Homo sapiens
gcaacaagtagag

SEQ ID NO: 5905838 - DNA, 17 bp, Homo sapiens
gcaacaataataaatgt

SEQ ID NO: 5905839 - DNA, 22 bp, Homo sapiens
gcaacaatcagacatgagtcca

SEQ ID NO: 5905840 - DNA, 16 bp, Homo sapiens
gcaacaattttcagat

SEQ ID NO: 5905841 - DNA, 18 bp, Homo sapiens
gcaacacaacatttgtgt

SEQ ID NO: 5905842 - DNA, 17 bp, Homo sapiens
gcaacacaagctggaag

SEQ ID NO: 5905843 - DNA, 14 bp, Homo sapiens
gcaacacacatgct

SEQ ID NO: 5905844 - DNA, 16 bp, Homo sapiens
gcaacacagaggaatt

SEQ ID NO: 5905845 - DNA, 18 bp, Homo sapiens
gcaacacccaagtccacc

SEQ ID NO: 5905846 - DNA, 21 bp, Homo sapiens
gcaacacctgtggataaaaca

SEQ ID NO: 5905847 - DNA, 23 bp, Homo sapiens
gcaacactcactgcctgcagctg

SEQ ID NO: 5905848 - DNA, 17 bp, Homo sapiens
gcaacactccggtcagc

SEQ ID NO: 5905849 - DNA, 16 bp, Homo sapiens
gcaacactgcaggaca

SEQ ID NO: 5905850 - DNA, 22 bp, Homo sapiens
gcaacactggaacatggctagc

SEQ ID NO: 5905851 - DNA, 14 bp, Homo sapiens
gcaacacttggaac

SEQ ID NO: 5905852 - DNA, 15 bp, Homo sapiens
gcaacagaaaaatgg

SEQ ID NO: 5905853 - DNA, 17 bp, Homo sapiens
gcaacagaaaaatggag

SEQ ID NO: 5905854 - DNA, 20 bp, Homo sapiens
gcaacagaaaccaagagaca

SEQ ID NO: 5905855 - DNA, 16 bp, Homo sapiens
gcaacagaagcaaaaa

SEQ ID NO: 5905856 - DNA, 23 bp, Homo sapiens
gcaacagatagatgttgctcttt

SEQ ID NO: 5905857 - DNA, 14 bp, Homo sapiens
gcaacagcaaatta

SEQ ID NO: 5905858 - DNA, 14 bp, Homo sapiens
gcaacagcaagaaa

SEQ ID NO: 5905859 - DNA, 18 bp, Homo sapiens
gcaacagcactttctgta

SEQ ID NO: 5905860 - DNA, 23 bp, Homo sapiens
gcaacagcctacaaagagatgct

SEQ ID NO: 5905861 - DNA, 15 bp, Homo sapiens
gcaacagcctttgaa

SEQ ID NO: 5905862 - DNA, 19 bp, Homo sapiens
gcaacagcctttgaatgta

SEQ ID NO: 5905863 - DNA, 15 bp, Homo sapiens
gcaacagctggacac

SEQ ID NO: 5905864 - DNA, 18 bp, Homo sapiens
gcaacaggaatctcagag

SEQ ID NO: 5905865 - DNA, 21 bp, Homo sapiens
gcaacaggaccaggagccagg

SEQ ID NO: 5905866 - DNA, 13 bp, Homo sapiens
gcaacaggctggg

SEQ ID NO: 5905867 - DNA, 19 bp, Homo sapiens
gcaacaggctgggcttcag

SEQ ID NO: 5905868 - DNA, 15 bp, Homo sapiens
gcaacagggagcacc

SEQ ID NO: 5905869 - DNA, 21 bp, Homo sapiens
gcaacagggagcacctgtctg

SEQ ID NO: 5905870 - DNA, 16 bp, Homo sapiens
gcaacagggcttctct

SEQ ID NO: 5905871 - DNA, 18 bp, Homo sapiens
gcaacaggggaggaaaaa

SEQ ID NO: 5905872 - DNA, 20 bp, Homo sapiens
gcaacaggggaggaaaaaag

SEQ ID NO: 5905873 - DNA, 17 bp, Homo sapiens
gcaacagtagcatagga

SEQ ID NO: 5905874 - DNA, 21 bp, Homo sapiens
gcaacagtgccccctccgtcc

SEQ ID NO: 5905875 - DNA, 19 bp, Homo sapiens
gcaacatagtgagaccctg

SEQ ID NO: 5905876 - DNA, 16 bp, Homo sapiens
gcaacatatctctgcc

SEQ ID NO: 5905877 - DNA, 14 bp, Homo sapiens
gcaacatcccatct

SEQ ID NO: 5905878 - DNA, 16 bp, Homo sapiens
gcaacatctctgaatc

SEQ ID NO: 5905879 - DNA, 15 bp, Homo sapiens
gcaacatggattcca

SEQ ID NO: 5905880 - DNA, 21 bp, Homo sapiens
gcaacatggattccaaagcat

SEQ ID NO: 5905881 - DNA, 15 bp, Homo sapiens
gcaacatggtccagt

SEQ ID NO: 5905882 - DNA, 22 bp, Homo sapiens
gcaacatttctgtatactgtaa

SEQ ID NO: 5905883 - DNA, 15 bp, Homo sapiens
gcaacatttgacaaa

SEQ ID NO: 5905884 - DNA, 16 bp, Homo sapiens
gcaacatttggggaga

SEQ ID NO: 5905885 - DNA, 23 bp, Homo sapiens
gcaacattttatttaagaataaa

SEQ ID NO: 5905886 - DNA, 22 bp, Homo sapiens
gcaacattttcttgaatttttt

SEQ ID NO: 5905887 - DNA, 18 bp, Homo sapiens
gcaaccaaaagggaaaaa

SEQ ID NO: 5905888 - DNA, 13 bp, Homo sapiens
gcaaccaataaaa

SEQ ID NO: 5905889 - DNA, 18 bp, Homo sapiens
gcaaccaataaaagccag

SEQ ID NO: 5905890 - DNA, 19 bp, Homo sapiens
gcaaccaataaaagccaga

SEQ ID NO: 5905891 - DNA, 21 bp, Homo sapiens
gcaaccaataaaagtgtcact

SEQ ID NO: 5905892 - DNA, 20 bp, Homo sapiens
gcaaccacaggcagcattta

SEQ ID NO: 5905893 - DNA, 15 bp, Homo sapiens
gcaaccacatgtccc

SEQ ID NO: 5905894 - DNA, 13 bp, Homo sapiens
gcaaccaccacca

SEQ ID NO: 5905895 - DNA, 14 bp, Homo sapiens
gcaaccactaagaa

SEQ ID NO: 5905896 - DNA, 23 bp, Homo sapiens
gcaaccactctgtggccagcctg

SEQ ID NO: 5905897 - DNA, 15 bp, Homo sapiens
gcaaccagagcactg

SEQ ID NO: 5905898 - DNA, 16 bp, Homo sapiens
gcaaccagagcactgt

SEQ ID NO: 5905899 - DNA, 13 bp, Homo sapiens
gcaaccagaggaa

SEQ ID NO: 5905900 - DNA, 14 bp, Homo sapiens
gcaaccagaggaag

SEQ ID NO: 5905901 - DNA, 13 bp, Homo sapiens
gcaaccagccagc

SEQ ID NO: 5905902 - DNA, 16 bp, Homo sapiens
gcaaccagccagcgtc

SEQ ID NO: 5905903 - DNA, 11 bp, Homo sapiens
gcaaccaggaa

SEQ ID NO: 5905904 - DNA, 17 bp, Homo sapiens
gcaaccaggaacagcaa

SEQ ID NO: 5905905 - DNA, 21 bp, Homo sapiens
gcaaccaggcagctgagacca

SEQ ID NO: 5905906 - DNA, 17 bp, Homo sapiens
gcaaccagggagctgca

SEQ ID NO: 5905907 - DNA, 23 bp, Homo sapiens
gcaaccagggagctgcaggggca

SEQ ID NO: 5905908 - DNA, 14 bp, Homo sapiens
gcaaccagttggct

SEQ ID NO: 5905909 - DNA, 18 bp, Homo sapiens
gcaaccagttggctaggg

SEQ ID NO: 5905910 - DNA, 18 bp, Homo sapiens
gcaaccataagacaaact

SEQ ID NO: 5905911 - DNA, 14 bp, Homo sapiens
gcaaccatttgaaa

SEQ ID NO: 5905912 - DNA, 23 bp, Homo sapiens
gcaaccatttttagaaggaaaaa

SEQ ID NO: 5905913 - DNA, 13 bp, Homo sapiens
gcaacccaaactg

SEQ ID NO: 5905914 - DNA, 15 bp, Homo sapiens
gcaacccaaggaacc

SEQ ID NO: 5905915 - DNA, 19 bp, Homo sapiens
gcaacccacagctcagctg

SEQ ID NO: 5905916 - DNA, 19 bp, Homo sapiens
gcaacccatgccctggacc

SEQ ID NO: 5905917 - DNA, 22 bp, Homo sapiens
gcaacccatgccctggaccagc

SEQ ID NO: 5905918 - DNA, 17 bp, Homo sapiens
gcaacccccagcctgct

SEQ ID NO: 5905919 - DNA, 18 bp, Homo sapiens
gcaaccccccagctcgct

SEQ ID NO: 5905920 - DNA, 14 bp, Homo sapiens
gcaacccctggacc

SEQ ID NO: 5905921 - DNA, 13 bp, Homo sapiens
gcaacccctgtac

SEQ ID NO: 5905922 - DNA, 19 bp, Homo sapiens
gcaacccctgtacccagct

SEQ ID NO: 5905923 - DNA, 20 bp, Homo sapiens
gcaacccgctggagcccaca

SEQ ID NO: 5905924 - DNA, 18 bp, Homo sapiens
gcaacccgtgccaagtcc

SEQ ID NO: 5905925 - DNA, 17 bp, Homo sapiens
gcaaccctacagtatat

SEQ ID NO: 5905926 - DNA, 22 bp, Homo sapiens
gcaaccctggtgaccagcacca

SEQ ID NO: 5905927 - DNA, 22 bp, Homo sapiens
gcaacccttagagattgcccca

SEQ ID NO: 5905928 - DNA, 20 bp, Homo sapiens
gcaacccttcctgctgctgc

SEQ ID NO: 5905929 - DNA, 16 bp, Homo sapiens
gcaaccgggccctctc

SEQ ID NO: 5905930 - DNA, 23 bp, Homo sapiens
gcaaccgtggcccttcctggaca

SEQ ID NO: 5905931 - DNA, 14 bp, Homo sapiens
gcaaccgtggggag

SEQ ID NO: 5905932 - DNA, 12 bp, Homo sapiens
gcaacctcacct

SEQ ID NO: 5905933 - DNA, 12 bp, Homo sapiens
gcaacctcccaa

SEQ ID NO: 5905934 - DNA, 22 bp, Homo sapiens
gcaacctccgcctcctgggttc

SEQ ID NO: 5905935 - DNA, 20 bp, Homo sapiens
gcaacctctgcctcccgggt

SEQ ID NO: 5905936 - DNA, 17 bp, Homo sapiens
gcaacctctgcctcctg

SEQ ID NO: 5905937 - DNA, 15 bp, Homo sapiens
gcaacctcttcctcc

SEQ ID NO: 5905938 - DNA, 18 bp, Homo sapiens
gcaacctcttcctcctgg

SEQ ID NO: 5905939 - DNA, 21 bp, Homo sapiens
gcaacctgacagcaaacacag

SEQ ID NO: 5905940 - DNA, 14 bp, Homo sapiens
gcaacctgcttcca

SEQ ID NO: 5905941 - DNA, 14 bp, Homo sapiens
gcaacctgggtcca

SEQ ID NO: 5905942 - DNA, 17 bp, Homo sapiens
gcaacctgtaagactga

SEQ ID NO: 5905943 - DNA, 17 bp, Homo sapiens
gcaacctgtggctcagg

SEQ ID NO: 5905944 - DNA, 22 bp, Homo sapiens
gcaacctgtggctcaggggagc

SEQ ID NO: 5905945 - DNA, 18 bp, Homo sapiens
gcaaccttcattttacat

SEQ ID NO: 5905946 - DNA, 22 bp, Homo sapiens
gcaaccttgcatccatctgggc

SEQ ID NO: 5905947 - DNA, 16 bp, Homo sapiens
gcaaccttgtacttta

SEQ ID NO: 5905948 - DNA, 13 bp, Homo sapiens
gcaacctttgtgt

SEQ ID NO: 5905949 - DNA, 22 bp, Homo sapiens
gcaacgaccagggccgaggagg

SEQ ID NO: 5905950 - DNA, 20 bp, Homo sapiens
gcaacgatcacaaatgactt

SEQ ID NO: 5905951 - DNA, 13 bp, Homo sapiens
gcaacgcccctcc

SEQ ID NO: 5905952 - DNA, 19 bp, Homo sapiens
gcaacgcccctccaaacct

SEQ ID NO: 5905953 - DNA, 21 bp, Homo sapiens
gcaacgctgattcctaaggcc

SEQ ID NO: 5905954 - DNA, 12 bp, Homo sapiens
gcaacggcccat

SEQ ID NO: 5905955 - DNA, 15 bp, Homo sapiens
gcaacgtagcctggg

SEQ ID NO: 5905956 - DNA, 18 bp, Homo sapiens
gcaactaactaaccacat

SEQ ID NO: 5905957 - DNA, 19 bp, Homo sapiens
gcaactaatgtttgaacaa

SEQ ID NO: 5905958 - DNA, 20 bp, Homo sapiens
gcaactaatgtttgaacaaa

SEQ ID NO: 5905959 - DNA, 16 bp, Homo sapiens
gcaactacaacttctc

SEQ ID NO: 5905960 - DNA, 22 bp, Homo sapiens
gcaactatcagactaagccagc

SEQ ID NO: 5905961 - DNA, 12 bp, Homo sapiens
gcaactcagaat

SEQ ID NO: 5905962 - DNA, 21 bp, Homo sapiens
gcaactcatgaacaaaatgaa

SEQ ID NO: 5905963 - DNA, 22 bp, Homo sapiens
gcaactcatgaacaaaatgaag

SEQ ID NO: 5905964 - DNA, 12 bp, Homo sapiens
gcaactccagcg

SEQ ID NO: 5905965 - DNA, 20 bp, Homo sapiens
gcaactccagcgtcctcagc

SEQ ID NO: 5905966 - DNA, 16 bp, Homo sapiens
gcaactccatcctcct

SEQ ID NO: 5905967 - DNA, 19 bp, Homo sapiens
gcaactccgtgtgcctggg

SEQ ID NO: 5905968 - DNA, 16 bp, Homo sapiens
gcaactcgtgacagcc

SEQ ID NO: 5905969 - DNA, 16 bp, Homo sapiens
gcaactctgactcttt

SEQ ID NO: 5905970 - DNA, 18 bp, Homo sapiens
gcaactctggctccaggc

SEQ ID NO: 5905971 - DNA, 14 bp, Homo sapiens
gcaactcttggaag

SEQ ID NO: 5905972 - DNA, 12 bp, Homo sapiens
gcaactgaaaat

SEQ ID NO: 5905973 - DNA, 15 bp, Homo sapiens
gcaactgaagatcca

SEQ ID NO: 5905974 - DNA, 19 bp, Homo sapiens
gcaactgacactcccaccc

SEQ ID NO: 5905975 - DNA, 19 bp, Homo sapiens
gcaactgagagctgagcgc

SEQ ID NO: 5905976 - DNA, 17 bp, Homo sapiens
gcaactgagatgtcaga

SEQ ID NO: 5905977 - DNA, 13 bp, Homo sapiens
gcaactgaggcag

SEQ ID NO: 5905978 - DNA, 18 bp, Homo sapiens
gcaactgagtctgcggga

SEQ ID NO: 5905979 - DNA, 18 bp, Homo sapiens
gcaactgcattggctttg

SEQ ID NO: 5905980 - DNA, 20 bp, Homo sapiens
gcaactgctcagctctggtc

SEQ ID NO: 5905981 - DNA, 20 bp, Homo sapiens
gcaactgctgatgctcatgg

SEQ ID NO: 5905982 - DNA, 16 bp, Homo sapiens
gcaactgctggtgatt

SEQ ID NO: 5905983 - DNA, 11 bp, Homo sapiens
gcaactggaaa

SEQ ID NO: 5905984 - DNA, 22 bp, Homo sapiens
gcaactggactatagcagggct

SEQ ID NO: 5905985 - DNA, 14 bp, Homo sapiens
gcaactggccagcc

SEQ ID NO: 5905986 - DNA, 20 bp, Homo sapiens
gcaactgtattaaagaaaaa

SEQ ID NO: 5905987 - DNA, 21 bp, Homo sapiens
gcaactgtattaaagaaaaat

SEQ ID NO: 5905988 - DNA, 18 bp, Homo sapiens
gcaagcgaaagagcaaag

SEQ ID NO: 5905989 - DNA, 19 bp, Homo sapiens
gcaagcgacacaggctgcc

SEQ ID NO: 5905990 - DNA, 17 bp, Homo sapiens
gcaagcgagcacagtat

SEQ ID NO: 5905991 - DNA, 14 bp, Homo sapiens
gcaagcgcacttga

SEQ ID NO: 5905992 - DNA, 15 bp, Homo sapiens
gcaagcgcagggagg

SEQ ID NO: 5905993 - DNA, 20 bp, Homo sapiens
gcaagcggccacaagggact

SEQ ID NO: 5905994 - DNA, 13 bp, Homo sapiens
gcaagcgggagcc

SEQ ID NO: 5905995 - DNA, 18 bp, Homo sapiens
gcaagcgtgttctcagca

SEQ ID NO: 5905996 - DNA, 23 bp, Homo sapiens
gcaagctaaccttatcctgcatt

SEQ ID NO: 5905997 - DNA, 18 bp, Homo sapiens
gcaagctaggccccagag

SEQ ID NO: 5905998 - DNA, 22 bp, Homo sapiens
gcaagctcatagcacatgtttt

SEQ ID NO: 5905999 - DNA, 16 bp, Homo sapiens
gcaagctccagtagct

SEQ ID NO: 5906000 - DNA, 18 bp, Homo sapiens
gcaagctccgcaggactt

SEQ ID NO: 5906001 - DNA, 21 bp, Homo sapiens
gcaagctccgcctcctgggtt

SEQ ID NO: 5906002 - DNA, 14 bp, Homo sapiens
gcaagctctgccct

SEQ ID NO: 5906003 - DNA, 16 bp, Homo sapiens
gcaagctctgcctccc

SEQ ID NO: 5906004 - DNA, 14 bp, Homo sapiens
gcaagctcttccct

SEQ ID NO: 5906005 - DNA, 20 bp, Homo sapiens
gcaagctcttcccttgctca

SEQ ID NO: 5906006 - DNA, 19 bp, Homo sapiens
gcaagctcttttatatgct

SEQ ID NO: 5906007 - DNA, 14 bp, Homo sapiens
gcaagctgaaattt

SEQ ID NO: 5906008 - DNA, 17 bp, Homo sapiens
gcaagctgaaattttag

SEQ ID NO: 5906009 - DNA, 22 bp, Homo sapiens
gcaagctgccgaaccaaaagaa

SEQ ID NO: 5906010 - DNA, 12 bp, Homo sapiens
gcaagctgcttg

SEQ ID NO: 5906011 - DNA, 17 bp, Homo sapiens
gcaagctggcaggaggg

SEQ ID NO: 5906012 - DNA, 14 bp, Homo sapiens
gcaagctggcctct

SEQ ID NO: 5906013 - DNA, 16 bp, Homo sapiens
gcaagcttcttgctga

SEQ ID NO: 5906014 - DNA, 14 bp, Homo sapiens
gcaagctttaacag

SEQ ID NO: 5906015 - DNA, 12 bp, Homo sapiens
gcaagctttgct

SEQ ID NO: 5906016 - DNA, 19 bp, Homo sapiens
gcaagctttgctccttcag

SEQ ID NO: 5906017 - DNA, 20 bp, Homo sapiens
gcaagctttgctccttcagt

SEQ ID NO: 5906018 - DNA, 16 bp, Homo sapiens
gcaaggaaaaacaggt

SEQ ID NO: 5906019 - DNA, 22 bp, Homo sapiens
gcaaggaaattaagaactgaat

SEQ ID NO: 5906020 - DNA, 18 bp, Homo sapiens
gcaaggaagctttggaag

SEQ ID NO: 5906021 - DNA, 21 bp, Homo sapiens
gcaaggaagctttggaagcag

SEQ ID NO: 5906022 - DNA, 14 bp, Homo sapiens
gcaaggaaggacac

SEQ ID NO: 5906023 - DNA, 20 bp, Homo sapiens
gcaaggaaggtaaaaagtta

SEQ ID NO: 5906024 - DNA, 16 bp, Homo sapiens
gcaaggaagtaaggga

SEQ ID NO: 5906025 - DNA, 18 bp, Homo sapiens
gcaaggaagtaagggagt

SEQ ID NO: 5906026 - DNA, 17 bp, Homo sapiens
gcaaggaatcctctggg

SEQ ID NO: 5906027 - DNA, 18 bp, Homo sapiens
gcaaggaatcctctggga

SEQ ID NO: 5906028 - DNA, 16 bp, Homo sapiens
gcaaggacaagcaatt

SEQ ID NO: 5906029 - DNA, 22 bp, Homo sapiens
gcaaggactacgttaagggaag

SEQ ID NO: 5906030 - DNA, 16 bp, Homo sapiens
gcaaggactcccggag

SEQ ID NO: 5906031 - DNA, 18 bp, Homo sapiens
gcaaggactcccggagcc

SEQ ID NO: 5906032 - DNA, 14 bp, Homo sapiens
gcaaggactttgta

SEQ ID NO: 5906033 - DNA, 16 bp, Homo sapiens
gcaaggactttgtaca

SEQ ID NO: 5906034 - DNA, 19 bp, Homo sapiens
gcaaggactttgtacattt

SEQ ID NO: 5906035 - DNA, 16 bp, Homo sapiens
gcaaggagaaaatata

SEQ ID NO: 5906036 - DNA, 16 bp, Homo sapiens
gcaaggagcacaagcc

SEQ ID NO: 5906037 - DNA, 14 bp, Homo sapiens
gcaaggaggctggc

SEQ ID NO: 5906038 - DNA, 16 bp, Homo sapiens
gcaaggaggctggctg

SEQ ID NO: 5906039 - DNA, 16 bp, Homo sapiens
gcaaggagtggggagg

SEQ ID NO: 5906040 - DNA, 22 bp, Homo sapiens
gcaaggagttcgtggctgcaaa

SEQ ID NO: 5906041 - DNA, 19 bp, Homo sapiens
gcaaggatatcagagctgg

SEQ ID NO: 5906042 - DNA, 20 bp, Homo sapiens
gcaaggatatcagagctggg

SEQ ID NO: 5906043 - DNA, 18 bp, Homo sapiens
gcaaggatccttccctgt

SEQ ID NO: 5906044 - DNA, 14 bp, Homo sapiens
gcaaggatggtggg

SEQ ID NO: 5906045 - DNA, 16 bp, Homo sapiens
gcaaggattacagaaa

SEQ ID NO: 5906046 - DNA, 19 bp, Homo sapiens
gcaaggattacagaaactg

SEQ ID NO: 5906047 - DNA, 21 bp, Homo sapiens
gcaaggattacagaaactgat

SEQ ID NO: 5906048 - DNA, 22 bp, Homo sapiens
gcaaggattacagaaactgatg

SEQ ID NO: 5906049 - DNA, 23 bp, Homo sapiens
gcaaggatttttccatgtgtggt

SEQ ID NO: 5906050 - DNA, 22 bp, Homo sapiens
gcaaggcaaatgtttatttaaa

SEQ ID NO: 5906051 - DNA, 18 bp, Homo sapiens
gcaaggcacaggctcctg

SEQ ID NO: 5906052 - DNA, 13 bp, Homo sapiens
gcaaggcagagcc

SEQ ID NO: 5906053 - DNA, 17 bp, Homo sapiens
gcaaggcagctcccagg

SEQ ID NO: 5906054 - DNA, 13 bp, Homo sapiens
gcaaggcaggtgc

SEQ ID NO: 5906055 - DNA, 20 bp, Homo sapiens
gcaaggcaggtgcctccagg

SEQ ID NO: 5906056 - DNA, 15 bp, Homo sapiens
gcaaggcaggttgga

SEQ ID NO: 5906057 - DNA, 13 bp, Homo sapiens
gcaaggccacctc

SEQ ID NO: 5906058 - DNA, 14 bp, Homo sapiens
gcaaggccacctct

SEQ ID NO: 5906059 - DNA, 20 bp, Homo sapiens
gcaaggccacctcttcctgg

SEQ ID NO: 5906060 - DNA, 12 bp, Homo sapiens
gcaaggccaggg

SEQ ID NO: 5906061 - DNA, 16 bp, Homo sapiens
gcaaggcccagacctg

SEQ ID NO: 5906062 - DNA, 20 bp, Homo sapiens
gcaaggcccagacctggcct

SEQ ID NO: 5906063 - DNA, 14 bp, Homo sapiens
gcaaggccccttcc

SEQ ID NO: 5906064 - DNA, 20 bp, Homo sapiens
gcaaggcccgagcagctgag

SEQ ID NO: 5906065 - DNA, 16 bp, Homo sapiens
gcaaggccctgctgcc

SEQ ID NO: 5906066 - DNA, 15 bp, Homo sapiens
gcaaggccctgtccc

SEQ ID NO: 5906067 - DNA, 22 bp, Homo sapiens
gcaaggcctcgctcttgacaga

SEQ ID NO: 5906068 - DNA, 19 bp, Homo sapiens
gcaaggcctctcagaccca

SEQ ID NO: 5906069 - DNA, 20 bp, Homo sapiens
gcaaggcctggtgtttcttg

SEQ ID NO: 5906070 - DNA, 22 bp, Homo sapiens
gcaaggccttggtggagcagcc

SEQ ID NO: 5906071 - DNA, 18 bp, Homo sapiens
gcaaggcgctaacttgct

SEQ ID NO: 5906072 - DNA, 20 bp, Homo sapiens
gcaaggcgctaacttgctta

SEQ ID NO: 5906073 - DNA, 14 bp, Homo sapiens
gcaaggcgctcagg

SEQ ID NO: 5906074 - DNA, 17 bp, Homo sapiens
gcaaggctgccctgtcc

SEQ ID NO: 5906075 - DNA, 18 bp, Homo sapiens
gcaaggctgccggctgca

SEQ ID NO: 5906076 - DNA, 16 bp, Homo sapiens
gcaaggctgctgccgg

SEQ ID NO: 5906077 - DNA, 17 bp, Homo sapiens
gcaaggctgctgccgga

SEQ ID NO: 5906078 - DNA, 20 bp, Homo sapiens
gcaaggctggggtcttgggt

SEQ ID NO: 5906079 - DNA, 12 bp, Homo sapiens
gcaaggctgggt

SEQ ID NO: 5906080 - DNA, 11 bp, Homo sapiens
gcaaggctgtc

SEQ ID NO: 5906081 - DNA, 13 bp, Homo sapiens
gcaaggctgtcaa

SEQ ID NO: 5906082 - DNA, 14 bp, Homo sapiens
gcaaggctgtcaat

SEQ ID NO: 5906083 - DNA, 18 bp, Homo sapiens
gcaaggctgtcaattaca

SEQ ID NO: 5906084 - DNA, 11 bp, Homo sapiens
gcaagggaaga

SEQ ID NO: 5906085 - DNA, 15 bp, Homo sapiens
gcaagggacaggaag

SEQ ID NO: 5906086 - DNA, 15 bp, Homo sapiens
gcaagggacctgctc

SEQ ID NO: 5906087 - DNA, 17 bp, Homo sapiens
gcaagggaggcccagcg

SEQ ID NO: 5906088 - DNA, 19 bp, Homo sapiens
gcaagggcatcaggcactg

SEQ ID NO: 5906089 - DNA, 15 bp, Homo sapiens
gcaagggccatgctg

SEQ ID NO: 5906090 - DNA, 13 bp, Homo sapiens
gcaagggcctgga

SEQ ID NO: 5906091 - DNA, 14 bp, Homo sapiens
gcaagggcctggac

SEQ ID NO: 5906092 - DNA, 19 bp, Homo sapiens
gcaagggcggcctttccca

SEQ ID NO: 5906093 - DNA, 11 bp, Homo sapiens
gcaagggctcc

SEQ ID NO: 5906094 - DNA, 16 bp, Homo sapiens
gcaagggctccagcat

SEQ ID NO: 5906095 - DNA, 17 bp, Homo sapiens
gcaagggctccagcatc

SEQ ID NO: 5906096 - DNA, 19 bp, Homo sapiens
gcaagggctccagcatcca

SEQ ID NO: 5906097 - DNA, 14 bp, Homo sapiens
gcaagggctcccca

SEQ ID NO: 5906098 - DNA, 13 bp, Homo sapiens
gcaagggctccta

SEQ ID NO: 5906099 - DNA, 10 bp, Homo sapiens
gcaagggctt

SEQ ID NO: 5906100 - DNA, 15 bp, Homo sapiens
gcaaggggaaaatct

SEQ ID NO: 5906101 - DNA, 19 bp, Homo sapiens
gcaaggggccaggaagggg

SEQ ID NO: 5906102 - DNA, 23 bp, Homo sapiens
gcaaggggcgcgcgcccccagga

SEQ ID NO: 5906103 - DNA, 20 bp, Homo sapiens
gcaaggggctcagcaaggtg

SEQ ID NO: 5906104 - DNA, 22 bp, Homo sapiens
gcaaggggctcagcaaggtgtg

SEQ ID NO: 5906105 - DNA, 14 bp, Homo sapiens
gcaaggggctctgc

SEQ ID NO: 5906106 - DNA, 12 bp, Homo sapiens
gcaaggggctgc

SEQ ID NO: 5906107 - DNA, 19 bp, Homo sapiens
gcaaggggctgcttctggg

SEQ ID NO: 5906108 - DNA, 20 bp, Homo sapiens
gcaagggggaaggctgcaaa

SEQ ID NO: 5906109 - DNA, 15 bp, Homo sapiens
gcaagggggcggggc

SEQ ID NO: 5906110 - DNA, 15 bp, Homo sapiens
gcaaggggtgaggat

SEQ ID NO: 5906111 - DNA, 22 bp, Homo sapiens
gcaaggggtgaggataggacag

SEQ ID NO: 5906112 - DNA, 16 bp, Homo sapiens
gcaaggggtgcctggg

SEQ ID NO: 5906113 - DNA, 14 bp, Homo sapiens
gcaagggtgacatc

SEQ ID NO: 5906114 - DNA, 14 bp, Homo sapiens
gcaagggtgatggg

SEQ ID NO: 5906115 - DNA, 15 bp, Homo sapiens
gcaagggtgcctcag

SEQ ID NO: 5906116 - DNA, 17 bp, Homo sapiens
gcaagggtgcctcagga

SEQ ID NO: 5906117 - DNA, 18 bp, Homo sapiens
gcaagggttaaggcctga

SEQ ID NO: 5906118 - DNA, 22 bp, Homo sapiens
gcaagggttggaggcaatgtgg

SEQ ID NO: 5906119 - DNA, 15 bp, Homo sapiens
gcaaggtactctggt

SEQ ID NO: 5906120 - DNA, 18 bp, Homo sapiens
gcaaggtatttctccagt

SEQ ID NO: 5906121 - DNA, 21 bp, Homo sapiens
gcaaggtatttctccagttgg

SEQ ID NO: 5906122 - DNA, 23 bp, Homo sapiens
gcaaggtcatgaaggaggggacc

SEQ ID NO: 5906123 - DNA, 16 bp, Homo sapiens
gcaaggtcatggtctg

SEQ ID NO: 5906124 - DNA, 18 bp, Homo sapiens
gcaaggtccggcccatcc

SEQ ID NO: 5906125 - DNA, 22 bp, Homo sapiens
gcaaggtctccttactctgagc

SEQ ID NO: 5906126 - DNA, 16 bp, Homo sapiens
gcaaggtgaaacgact

SEQ ID NO: 5906127 - DNA, 17 bp, Homo sapiens
gcaaggtgagggatgcc

SEQ ID NO: 5906128 - DNA, 16 bp, Homo sapiens
gcaaggtgataggaaa

SEQ ID NO: 5906129 - DNA, 14 bp, Homo sapiens
gcaaggtgctcaca

SEQ ID NO: 5906130 - DNA, 22 bp, Homo sapiens
gcaaggtgctcttgaacctgtg

SEQ ID NO: 5906131 - DNA, 15 bp, Homo sapiens
gcaaggtggccacag

SEQ ID NO: 5906132 - DNA, 18 bp, Homo sapiens
gcaaggtggcctctgcct

SEQ ID NO: 5906133 - DNA, 21 bp, Homo sapiens
gcaaggtggcctctgcctggg

SEQ ID NO: 5906134 - DNA, 22 bp, Homo sapiens
gcaaggtggcctttgtgctgcg

SEQ ID NO: 5906135 - DNA, 23 bp, Homo sapiens
gcaaggtgggtgattcctcccag

SEQ ID NO: 5906136 - DNA, 17 bp, Homo sapiens
gcaaggtgggttccagg

SEQ ID NO: 5906137 - DNA, 17 bp, Homo sapiens
gcaaggtgtgatggtct

SEQ ID NO: 5906138 - DNA, 14 bp, Homo sapiens
gcaaggtgtggagg

SEQ ID NO: 5906139 - DNA, 21 bp, Homo sapiens
gcaaggtgtggaggctcctgt

SEQ ID NO: 5906140 - DNA, 14 bp, Homo sapiens
gcaaggttccacag

SEQ ID NO: 5906141 - DNA, 21 bp, Homo sapiens
gcaaggttgtagtcaagaggt

SEQ ID NO: 5906142 - DNA, 19 bp, Homo sapiens
gcaaggtttaagttattaa

SEQ ID NO: 5906143 - DNA, 14 bp, Homo sapiens
gcaagtaacttctg

SEQ ID NO: 5906144 - DNA, 20 bp, Homo sapiens
gcaagtacagcggctcccct

SEQ ID NO: 5906145 - DNA, 19 bp, Homo sapiens
gcaagtagataaatatttg

SEQ ID NO: 5906146 - DNA, 20 bp, Homo sapiens
gcaagtattagaataccaca

SEQ ID NO: 5906147 - DNA, 18 bp, Homo sapiens
gcaagtcacactgcattg

SEQ ID NO: 5906148 - DNA, 18 bp, Homo sapiens
gcaagtcagaatagaaat

SEQ ID NO: 5906149 - DNA, 15 bp, Homo sapiens
gcaagtcagaggatg

SEQ ID NO: 5906150 - DNA, 21 bp, Homo sapiens
gcaagtcagattgctgggagg

SEQ ID NO: 5906151 - DNA, 13 bp, Homo sapiens
gcaagtcagggtt

SEQ ID NO: 5906152 - DNA, 14 bp, Homo sapiens
gcaagtcatactta

SEQ ID NO: 5906153 - DNA, 15 bp, Homo sapiens
gcaagtcatacttag

SEQ ID NO: 5906154 - DNA, 15 bp, Homo sapiens
gcaagtcatgtaaat

SEQ ID NO: 5906155 - DNA, 17 bp, Homo sapiens
gcaagtcattagaatgt

SEQ ID NO: 5906156 - DNA, 20 bp, Homo sapiens
gcaagtccatagctgagctg

SEQ ID NO: 5906157 - DNA, 18 bp, Homo sapiens
gcaagtcccagacaagga

SEQ ID NO: 5906158 - DNA, 22 bp, Homo sapiens
gcaagtcccagacaaggagagc

SEQ ID NO: 5906159 - DNA, 15 bp, Homo sapiens
gcaagtccccagccc

SEQ ID NO: 5906160 - DNA, 20 bp, Homo sapiens
gcaagtccctgactctctgt

SEQ ID NO: 5906161 - DNA, 21 bp, Homo sapiens
gcaagtcctaagcctgttagc

SEQ ID NO: 5906162 - DNA, 17 bp, Homo sapiens
gcaagtccttttgtaaa

SEQ ID NO: 5906163 - DNA, 17 bp, Homo sapiens
gcaagtcgagagggctg

SEQ ID NO: 5906164 - DNA, 21 bp, Homo sapiens
gcaagtctgtggccccacaac

SEQ ID NO: 5906165 - DNA, 21 bp, Homo sapiens
gcaagtctttaggtctttgta

SEQ ID NO: 5906166 - DNA, 18 bp, Homo sapiens
gcacaagtaacacatttg

SEQ ID NO: 5906167 - DNA, 17 bp, Homo sapiens
gcacaagtgtaatgaat

SEQ ID NO: 5906168 - DNA, 17 bp, Homo sapiens
gcacaagttatttaaat

SEQ ID NO: 5906169 - DNA, 21 bp, Homo sapiens
gcacaataaaaccaagcctct

SEQ ID NO: 5906170 - DNA, 23 bp, Homo sapiens
gcacaataaaaccaagcctctgg

SEQ ID NO: 5906171 - DNA, 19 bp, Homo sapiens
gcacaataaatggctgtaa

SEQ ID NO: 5906172 - DNA, 13 bp, Homo sapiens
gcacaataatttg

SEQ ID NO: 5906173 - DNA, 15 bp, Homo sapiens
gcacaatagtaacct

SEQ ID NO: 5906174 - DNA, 20 bp, Homo sapiens
gcacaatagtaacctgggta

SEQ ID NO: 5906175 - DNA, 17 bp, Homo sapiens
gcacaatatatttttac

SEQ ID NO: 5906176 - DNA, 20 bp, Homo sapiens
gcacaatattgaactttttt

SEQ ID NO: 5906177 - DNA, 17 bp, Homo sapiens
gcacaatcaacttttct

SEQ ID NO: 5906178 - DNA, 20 bp, Homo sapiens
gcacaatcactaaactttat

SEQ ID NO: 5906179 - DNA, 16 bp, Homo sapiens
gcacaatcagtttatc

SEQ ID NO: 5906180 - DNA, 24 bp, Homo sapiens
gcacaatcatggctgattgcagcc

SEQ ID NO: 5906181 - DNA, 18 bp, Homo sapiens
gcacaatctacactgcct

SEQ ID NO: 5906182 - DNA, 13 bp, Homo sapiens
gcacaatctgttc

SEQ ID NO: 5906183 - DNA, 14 bp, Homo sapiens
gcacaatctgttct

SEQ ID NO: 5906184 - DNA, 16 bp, Homo sapiens
gcacaatctgttctac

SEQ ID NO: 5906185 - DNA, 10 bp, Homo sapiens
gcacaatgaa

SEQ ID NO: 5906186 - DNA, 17 bp, Homo sapiens
gcacaatgaatgtatat

SEQ ID NO: 5906187 - DNA, 14 bp, Homo sapiens
gcacaatgcatgtg

SEQ ID NO: 5906188 - DNA, 14 bp, Homo sapiens
gcacaatgtcttgg

SEQ ID NO: 5906189 - DNA, 16 bp, Homo sapiens
gcacaatgttggagca

SEQ ID NO: 5906190 - DNA, 21 bp, Homo sapiens
gcacaatgttggagcagcagg

SEQ ID NO: 5906191 - DNA, 13 bp, Homo sapiens
gcacaattcattg

SEQ ID NO: 5906192 - DNA, 19 bp, Homo sapiens
gcacaattcctgtgctcaa

SEQ ID NO: 5906193 - DNA, 15 bp, Homo sapiens
gcacaattctgtccc

SEQ ID NO: 5906194 - DNA, 18 bp, Homo sapiens
gcacaatttatattttcc

SEQ ID NO: 5906195 - DNA, 11 bp, Homo sapiens
gcacaatttga

SEQ ID NO: 5906196 - DNA, 18 bp, Homo sapiens
gcacaatttttttttgtt

SEQ ID NO: 5906197 - DNA, 17 bp, Homo sapiens
gcacacaacaggctgtg

SEQ ID NO: 5906198 - DNA, 18 bp, Homo sapiens
gcacacacaaacctactg

SEQ ID NO: 5906199 - DNA, 21 bp, Homo sapiens
gcacacacaaacctactgccc

SEQ ID NO: 5906200 - DNA, 23 bp, Homo sapiens
gcacacacaaacctactgcccac

SEQ ID NO: 5906201 - DNA, 12 bp, Homo sapiens
gcacacacacaa

SEQ ID NO: 5906202 - DNA, 12 bp, Homo sapiens
gcacacacacac

SEQ ID NO: 5906203 - DNA, 23 bp, Homo sapiens
gcacacacacacacacacacacg

SEQ ID NO: 5906204 - DNA, 15 bp, Homo sapiens
gcacacacacacata

SEQ ID NO: 5906205 - DNA, 16 bp, Homo sapiens
gcacacacacatacag

SEQ ID NO: 5906206 - DNA, 18 bp, Homo sapiens
gcacacacacatacagag

SEQ ID NO: 5906207 - DNA, 20 bp, Homo sapiens
gcacacacaccggtcaccga

SEQ ID NO: 5906208 - DNA, 22 bp, Homo sapiens
gcacacacaccggtcaccgaga

SEQ ID NO: 5906209 - DNA, 23 bp, Homo sapiens
gcacacacacgcgtccacataca

SEQ ID NO: 5906210 - DNA, 17 bp, Homo sapiens
gcacacacacggatgca

SEQ ID NO: 5906211 - DNA, 13 bp, Homo sapiens
gcacacacactct

SEQ ID NO: 5906212 - DNA, 17 bp, Homo sapiens
gcacacacactcttcaa

SEQ ID NO: 5906213 - DNA, 20 bp, Homo sapiens
gcacacacagatatgcacac

SEQ ID NO: 5906214 - DNA, 15 bp, Homo sapiens
gcacacacagatgca

SEQ ID NO: 5906215 - DNA, 15 bp, Homo sapiens
gcacacacagcccct

SEQ ID NO: 5906216 - DNA, 11 bp, Homo sapiens
gcacacacagt

SEQ ID NO: 5906217 - DNA, 14 bp, Homo sapiens
gcacacacatctgg

SEQ ID NO: 5906218 - DNA, 17 bp, Homo sapiens
gcacacaccagagccca

SEQ ID NO: 5906219 - DNA, 19 bp, Homo sapiens
gcacacaccagagcccacc

SEQ ID NO: 5906220 - DNA, 11 bp, Homo sapiens
gcacacaccca

SEQ ID NO: 5906221 - DNA, 12 bp, Homo sapiens
gcacacacctgc

SEQ ID NO: 5906222 - DNA, 17 bp, Homo sapiens
gcacacacctgcacacc

SEQ ID NO: 5906223 - DNA, 21 bp, Homo sapiens
gcacacacctgtagtcccagc

SEQ ID NO: 5906224 - DNA, 15 bp, Homo sapiens
gcacacactgaccac

SEQ ID NO: 5906225 - DNA, 12 bp, Homo sapiens
gcacacactgtg

SEQ ID NO: 5906226 - DNA, 19 bp, Homo sapiens
gcacacactgtgctttcta

SEQ ID NO: 5906227 - DNA, 13 bp, Homo sapiens
gcacacagaaata

SEQ ID NO: 5906228 - DNA, 14 bp, Homo sapiens
gcacacagaaatat

SEQ ID NO: 5906229 - DNA, 17 bp, Homo sapiens
gcacacagaaatatata

SEQ ID NO: 5906230 - DNA, 20 bp, Homo sapiens
gcacacagaaatatatatac

SEQ ID NO: 5906231 - DNA, 22 bp, Homo sapiens
gcacacagaaatatatatacat

SEQ ID NO: 5906232 - DNA, 23 bp, Homo sapiens
gcacacagaaatatatatacata

SEQ ID NO: 5906233 - DNA, 18 bp, Homo sapiens
gcacacagacggcctagg

SEQ ID NO: 5906234 - DNA, 19 bp, Homo sapiens
gcacacagacggcctaggg

SEQ ID NO: 5906235 - DNA, 13 bp, Homo sapiens
gcacacagagatt

SEQ ID NO: 5906236 - DNA, 11 bp, Homo sapiens
gcacacagcac

SEQ ID NO: 5906237 - DNA, 15 bp, Homo sapiens
gcacacagcggctgc

SEQ ID NO: 5906238 - DNA, 18 bp, Homo sapiens
gcacacagcggctgcctc

SEQ ID NO: 5906239 - DNA, 21 bp, Homo sapiens
gcacacagcggctgcctcctg

SEQ ID NO: 5906240 - DNA, 21 bp, Homo sapiens
gcacacagcttttagtaccca

SEQ ID NO: 5906241 - DNA, 13 bp, Homo sapiens
gcacacaggacag

SEQ ID NO: 5906242 - DNA, 11 bp, Homo sapiens
gcacacaggca

SEQ ID NO: 5906243 - DNA, 17 bp, Homo sapiens
gcacacaggcagccagc

SEQ ID NO: 5906244 - DNA, 20 bp, Homo sapiens
gcacacagggcccggccaca

SEQ ID NO: 5906245 - DNA, 12 bp, Homo sapiens
gcacacagggct

SEQ ID NO: 5906246 - DNA, 13 bp, Homo sapiens
gcacacagggctc

SEQ ID NO: 5906247 - DNA, 14 bp, Homo sapiens
gcacacagggctca

SEQ ID NO: 5906248 - DNA, 18 bp, Homo sapiens
gcacacagggctcacagg

SEQ ID NO: 5906249 - DNA, 19 bp, Homo sapiens
gcacacagggctcacaggg

SEQ ID NO: 5906250 - DNA, 23 bp, Homo sapiens
gcacacagggctcacagggcagg

SEQ ID NO: 5906251 - DNA, 15 bp, Homo sapiens
gcacacatcaccagg

SEQ ID NO: 5906252 - DNA, 16 bp, Homo sapiens
gcacacatcaccaggt

SEQ ID NO: 5906253 - DNA, 16 bp, Homo sapiens
gcacacatcatctgta

SEQ ID NO: 5906254 - DNA, 17 bp, Homo sapiens
gcacacatcatctgtaa

SEQ ID NO: 5906255 - DNA, 18 bp, Homo sapiens
gcacacattggccgcttc

SEQ ID NO: 5906256 - DNA, 14 bp, Homo sapiens
gcacacattgtgtt

SEQ ID NO: 5906257 - DNA, 15 bp, Homo sapiens
gcacacattgtgtta

SEQ ID NO: 5906258 - DNA, 14 bp, Homo sapiens
gcacacatttttta

SEQ ID NO: 5906259 - DNA, 13 bp, Homo sapiens
gcacaccaaagct

SEQ ID NO: 5906260 - DNA, 16 bp, Homo sapiens
gcacaccaaggccctg

SEQ ID NO: 5906261 - DNA, 22 bp, Homo sapiens
gcacaccaaggccctgcatctg

SEQ ID NO: 5906262 - DNA, 16 bp, Homo sapiens
gcacaccaatcttact

SEQ ID NO: 5906263 - DNA, 20 bp, Homo sapiens
gcacaccacaattctcccta

SEQ ID NO: 5906264 - DNA, 17 bp, Homo sapiens
gcacaccacgcccagct

SEQ ID NO: 5906265 - DNA, 15 bp, Homo sapiens
gcacaccactgccct

SEQ ID NO: 5906266 - DNA, 17 bp, Homo sapiens
gcacaccactgccctgc

SEQ ID NO: 5906267 - DNA, 18 bp, Homo sapiens
gcacaccagaagtgccat

SEQ ID NO: 5906268 - DNA, 12 bp, Homo sapiens
gcacaccagaga

SEQ ID NO: 5906269 - DNA, 16 bp, Homo sapiens
gcacaccagagacaag

SEQ ID NO: 5906270 - DNA, 17 bp, Homo sapiens
gcacaccagttactgtt

SEQ ID NO: 5906271 - DNA, 17 bp, Homo sapiens
gcacacccactcagctc

SEQ ID NO: 5906272 - DNA, 18 bp, Homo sapiens
gcacacccactcagctcc

SEQ ID NO: 5906273 - DNA, 14 bp, Homo sapiens
gcacaccccaaggg

SEQ ID NO: 5906274 - DNA, 16 bp, Homo sapiens
gcacacccctgcacac

SEQ ID NO: 5906275 - DNA, 16 bp, Homo sapiens
gcacacccctggggct

SEQ ID NO: 5906276 - DNA, 21 bp, Homo sapiens
gcacaccctcactctgccagg

SEQ ID NO: 5906277 - DNA, 16 bp, Homo sapiens
gcacaccctctctgtc

SEQ ID NO: 5906278 - DNA, 14 bp, Homo sapiens
gcacaccctgcccc

SEQ ID NO: 5906279 - DNA, 13 bp, Homo sapiens
gcacaccctgggc

SEQ ID NO: 5906280 - DNA, 18 bp, Homo sapiens
gcacaccgtccctctccc

SEQ ID NO: 5906281 - DNA, 18 bp, Homo sapiens
gcacacctcagccccact

SEQ ID NO: 5906282 - DNA, 19 bp, Homo sapiens
gcacacctcctcccactgc

SEQ ID NO: 5906283 - DNA, 20 bp, Homo sapiens
gcacacctcctcccactgcc

SEQ ID NO: 5906284 - DNA, 14 bp, Homo sapiens
gcacacctctggct

SEQ ID NO: 5906285 - DNA, 13 bp, Homo sapiens
gcacacctctggg

SEQ ID NO: 5906286 - DNA, 22 bp, Homo sapiens
gcacacctgaatcagctggaca

SEQ ID NO: 5906287 - DNA, 15 bp, Homo sapiens
gcacacctgtaatcc

SEQ ID NO: 5906288 - DNA, 12 bp, Homo sapiens
gcacacctgtgg

SEQ ID NO: 5906289 - DNA, 13 bp, Homo sapiens
gcacacctgtggt

SEQ ID NO: 5906290 - DNA, 17 bp, Homo sapiens
gcacacctgtggtgcct

SEQ ID NO: 5906291 - DNA, 13 bp, Homo sapiens
gcacaccttgcag

SEQ ID NO: 5906292 - DNA, 14 bp, Homo sapiens
gcacaccttgcaga

SEQ ID NO: 5906293 - DNA, 21 bp, Homo sapiens
gcacacctttattcagaactt

SEQ ID NO: 5906294 - DNA, 13 bp, Homo sapiens
gcacaccttttcc

SEQ ID NO: 5906295 - DNA, 19 bp, Homo sapiens
gcacaccttttccccagga

SEQ ID NO: 5906296 - DNA, 20 bp, Homo sapiens
gcacaccttttccccaggag

SEQ ID NO: 5906297 - DNA, 21 bp, Homo sapiens
gcacaccttttccccaggagc

SEQ ID NO: 5906298 - DNA, 22 bp, Homo sapiens
gcacaccttttccccaggagca

SEQ ID NO: 5906299 - DNA, 15 bp, Homo sapiens
gcacacgaagggtga

SEQ ID NO: 5906300 - DNA, 23 bp, Homo sapiens
gcacacgcacacatcttacctct

SEQ ID NO: 5906301 - DNA, 20 bp, Homo sapiens
gcacacgcacgcacacacac

SEQ ID NO: 5906302 - DNA, 21 bp, Homo sapiens
gcacacgcctgtaatcccagc

SEQ ID NO: 5906303 - DNA, 15 bp, Homo sapiens
gcacacgctgctctg

SEQ ID NO: 5906304 - DNA, 17 bp, Homo sapiens
gcacacggctggtcact

SEQ ID NO: 5906305 - DNA, 20 bp, Homo sapiens
gcacacggctggtcactctg

SEQ ID NO: 5906306 - DNA, 17 bp, Homo sapiens
gcacacgggcctctgct

SEQ ID NO: 5906307 - DNA, 13 bp, Homo sapiens
gcacacgtgtgta

SEQ ID NO: 5906308 - DNA, 15 bp, Homo sapiens
gcacacgtgtgtatg

SEQ ID NO: 5906309 - DNA, 23 bp, Homo sapiens
gcacactacagagcagctcccca

SEQ ID NO: 5906310 - DNA, 11 bp, Homo sapiens
gcacactattt

SEQ ID NO: 5906311 - DNA, 23 bp, Homo sapiens
gcacactcagtgggctgtttctg

SEQ ID NO: 5906312 - DNA, 17 bp, Homo sapiens
gcacactcatacacatg

SEQ ID NO: 5906313 - DNA, 23 bp, Homo sapiens
gcacactctcccattatatttat

SEQ ID NO: 5906314 - DNA, 19 bp, Homo sapiens
gcacactctcttctccatt

SEQ ID NO: 5906315 - DNA, 23 bp, Homo sapiens
gcacactctcttctccattccct

SEQ ID NO: 5906316 - DNA, 13 bp, Homo sapiens
gcacactctgcca

SEQ ID NO: 5906317 - DNA, 20 bp, Homo sapiens
gcacactctgccagcaaaga

SEQ ID NO: 5906318 - DNA, 19 bp, Homo sapiens
gcacactgacataatgtag

SEQ ID NO: 5906319 - DNA, 11 bp, Homo sapiens
gcacactgcca

SEQ ID NO: 5906320 - DNA, 16 bp, Homo sapiens
gcacactgctaaattt

SEQ ID NO: 5906321 - DNA, 18 bp, Homo sapiens
gcacactgctcttaagaa

SEQ ID NO: 5906322 - DNA, 14 bp, Homo sapiens
gcacactggaatat

SEQ ID NO: 5906323 - DNA, 14 bp, Homo sapiens
gcacactggggccc

SEQ ID NO: 5906324 - DNA, 12 bp, Homo sapiens
gcacactgtagc

SEQ ID NO: 5906325 - DNA, 23 bp, Homo sapiens
gcacactgtgattttgccctcct

SEQ ID NO: 5906326 - DNA, 24 bp, Homo sapiens
gcacactgttggaatgtatgctaa

SEQ ID NO: 5906327 - DNA, 16 bp, Homo sapiens
gcacacttatttatga

SEQ ID NO: 5906328 - DNA, 20 bp, Homo sapiens
gcacacttatttatgaattg

SEQ ID NO: 5906329 - DNA, 14 bp, Homo sapiens
gcacacttccagac

SEQ ID NO: 5906330 - DNA, 13 bp, Homo sapiens
gcacacttcccca

SEQ ID NO: 5906331 - DNA, 14 bp, Homo sapiens
gcacacttcccctt

SEQ ID NO: 5906332 - DNA, 19 bp, Homo sapiens
gcacacttccccttgggat

SEQ ID NO: 5906333 - DNA, 23 bp, Homo sapiens
gcacacttctgaccttgctgcca

SEQ ID NO: 5906334 - DNA, 20 bp, Homo sapiens
gcacacttggcccaagtggc

SEQ ID NO: 5906335 - DNA, 19 bp, Homo sapiens
gcacacttgtacccacagg

SEQ ID NO: 5906336 - DNA, 22 bp, Homo sapiens
gcacactttgccatattttcac

SEQ ID NO: 5906337 - DNA, 11 bp, Homo sapiens
gcacagaaaac

SEQ ID NO: 5906338 - DNA, 21 bp, Homo sapiens
gcacagaaaaccgagaatatt

SEQ ID NO: 5906339 - DNA, 20 bp, Homo sapiens
gcacagaaaatggaagacag

SEQ ID NO: 5906340 - DNA, 21 bp, Homo sapiens
gcacagaaacctctactaaaa

SEQ ID NO: 5906341 - DNA, 17 bp, Homo sapiens
gcacagaaacttgaact

SEQ ID NO: 5906342 - DNA, 18 bp, Homo sapiens
gcacagaaagggcagctt

SEQ ID NO: 5906343 - DNA, 18 bp, Homo sapiens
gcacagaacaggaggtgt

SEQ ID NO: 5906344 - DNA, 17 bp, Homo sapiens
gcacagaagcacatgca

SEQ ID NO: 5906345 - DNA, 23 bp, Homo sapiens
gcacagtcaggggctgggcatcc

SEQ ID NO: 5906346 - DNA, 14 bp, Homo sapiens
gcacagtcaggttg

SEQ ID NO: 5906347 - DNA, 16 bp, Homo sapiens
gcacagtccctcctgt

SEQ ID NO: 5906348 - DNA, 17 bp, Homo sapiens
gcacagtgacttctgag

SEQ ID NO: 5906349 - DNA, 19 bp, Homo sapiens
gcacagtgatatatttcta

SEQ ID NO: 5906350 - DNA, 21 bp, Homo sapiens
gcacagtgatgccgggcgcca

SEQ ID NO: 5906351 - DNA, 20 bp, Homo sapiens
gcacagtgcagcaagcctgg

SEQ ID NO: 5906352 - DNA, 12 bp, Homo sapiens
gcacagtgcctg

SEQ ID NO: 5906353 - DNA, 16 bp, Homo sapiens
gcacagtgctgcccct

SEQ ID NO: 5906354 - DNA, 18 bp, Homo sapiens
gcacagtgctgccccttg

SEQ ID NO: 5906355 - DNA, 20 bp, Homo sapiens
gcacagtggctcacacctgt

SEQ ID NO: 5906356 - DNA, 17 bp, Homo sapiens
gcacagtggctcacgcc

SEQ ID NO: 5906357 - DNA, 12 bp, Homo sapiens
gcacagtggctt

SEQ ID NO: 5906358 - DNA, 14 bp, Homo sapiens
gcacagtgggagct

SEQ ID NO: 5906359 - DNA, 16 bp, Homo sapiens
gcacagtgggagctga

SEQ ID NO: 5906360 - DNA, 18 bp, Homo sapiens
gcacagtgggagctgagc

SEQ ID NO: 5906361 - DNA, 19 bp, Homo sapiens
gcacagtgggagctgagct

SEQ ID NO: 5906362 - DNA, 20 bp, Homo sapiens
gcacagtgggagctgagctg

SEQ ID NO: 5906363 - DNA, 15 bp, Homo sapiens
gcacagtggtctgga

SEQ ID NO: 5906364 - DNA, 16 bp, Homo sapiens
gcacagtggtggcagg

SEQ ID NO: 5906365 - DNA, 19 bp, Homo sapiens
gcacagtgtctgggctgac

SEQ ID NO: 5906366 - DNA, 14 bp, Homo sapiens
gcacagtgtgagcc

SEQ ID NO: 5906367 - DNA, 13 bp, Homo sapiens
gcacagtgtgtga

SEQ ID NO: 5906368 - DNA, 17 bp, Homo sapiens
gcacagtgtgtgactta

SEQ ID NO: 5906369 - DNA, 20 bp, Homo sapiens
gcacagtgttaaatgaaatt

SEQ ID NO: 5906370 - DNA, 14 bp, Homo sapiens
gcacagttctattt

SEQ ID NO: 5906371 - DNA, 16 bp, Homo sapiens
gcacagttctatttgc

SEQ ID NO: 5906372 - DNA, 13 bp, Homo sapiens
gcacagtttgaac

SEQ ID NO: 5906373 - DNA, 15 bp, Homo sapiens
gcacagtttgaacaa

SEQ ID NO: 5906374 - DNA, 15 bp, Homo sapiens
gcacagtttgcaatc

SEQ ID NO: 5906375 - DNA, 15 bp, Homo sapiens
gcacagttttaagag

SEQ ID NO: 5906376 - DNA, 23 bp, Homo sapiens
gcacagttttctgagaaagacta

SEQ ID NO: 5906377 - DNA, 23 bp, Homo sapiens
gcacagttttctggctggagcct

SEQ ID NO: 5906378 - DNA, 23 bp, Homo sapiens
gcacagtttttgtaaagcccttg

SEQ ID NO: 5906379 - DNA, 20 bp, Homo sapiens
gcacataactggattttgaa

SEQ ID NO: 5906380 - DNA, 22 bp, Homo sapiens
gcacataactggattttgaacg

SEQ ID NO: 5906381 - DNA, 23 bp, Homo sapiens
gcacatacacctcgtcaagagca

SEQ ID NO: 5906382 - DNA, 11 bp, Homo sapiens
gcacatacatt

SEQ ID NO: 5906383 - DNA, 15 bp, Homo sapiens
gcacatacattaaaa

SEQ ID NO: 5906384 - DNA, 17 bp, Homo sapiens
gcacatacattaaaact

SEQ ID NO: 5906385 - DNA, 23 bp, Homo sapiens
gcacatacgggctttaatagtca

SEQ ID NO: 5906386 - DNA, 17 bp, Homo sapiens
gcacatactacctagaa

SEQ ID NO: 5906387 - DNA, 18 bp, Homo sapiens
gcacatactacctagaag

SEQ ID NO: 5906388 - DNA, 23 bp, Homo sapiens
gcacatagaaagtaaataaaagg

SEQ ID NO: 5906389 - DNA, 14 bp, Homo sapiens
gcacatagagaggg

SEQ ID NO: 5906390 - DNA, 13 bp, Homo sapiens
gcacatagccctg

SEQ ID NO: 5906391 - DNA, 17 bp, Homo sapiens
gcacatagccctgttga

SEQ ID NO: 5906392 - DNA, 21 bp, Homo sapiens
gcacataggcagtagcctcct

SEQ ID NO: 5906393 - DNA, 16 bp, Homo sapiens
gcacatatacatctag

SEQ ID NO: 5906394 - DNA, 12 bp, Homo sapiens
gcacatatattt

SEQ ID NO: 5906395 - DNA, 13 bp, Homo sapiens
gcacatatatttt

SEQ ID NO: 5906396 - DNA, 13 bp, Homo sapiens
gcacatatggact

SEQ ID NO: 5906397 - DNA, 18 bp, Homo sapiens
gcacatatggactctgca

SEQ ID NO: 5906398 - DNA, 18 bp, Homo sapiens
gcacatatgggtgctggc

SEQ ID NO: 5906399 - DNA, 22 bp, Homo sapiens
gcacatattagtgcagccaagt

SEQ ID NO: 5906400 - DNA, 21 bp, Homo sapiens
gcacatattggagggaaatct

SEQ ID NO: 5906401 - DNA, 20 bp, Homo sapiens
gcacatcagcacgatttctg

SEQ ID NO: 5906402 - DNA, 20 bp, Homo sapiens
gcacatcattcattcactgt

SEQ ID NO: 5906403 - DNA, 13 bp, Homo sapiens
gcacatcatttca

SEQ ID NO: 5906404 - DNA, 14 bp, Homo sapiens
gcacatccaactac

SEQ ID NO: 5906405 - DNA, 15 bp, Homo sapiens
gcacatccctgccct

SEQ ID NO: 5906406 - DNA, 20 bp, Homo sapiens
gcacatccctgccctcctac

SEQ ID NO: 5906407 - DNA, 19 bp, Homo sapiens
gcacatctcaacaggcctc

SEQ ID NO: 5906408 - DNA, 21 bp, Homo sapiens
gcacatctcaacaggcctcag

SEQ ID NO: 5906409 - DNA, 20 bp, Homo sapiens
gcacatctggatgccttccc

SEQ ID NO: 5906410 - DNA, 15 bp, Homo sapiens
gcacatctgttttgt

SEQ ID NO: 5906411 - DNA, 16 bp, Homo sapiens
gcacatgaaaaatttt

SEQ ID NO: 5906412 - DNA, 14 bp, Homo sapiens
gcacatgaaagttt

SEQ ID NO: 5906413 - DNA, 16 bp, Homo sapiens
gcacatgaacttagat

SEQ ID NO: 5906414 - DNA, 13 bp, Homo sapiens
gcacatgaagaaa

SEQ ID NO: 5906415 - DNA, 20 bp, Homo sapiens
gcacatgaataatttcactt

SEQ ID NO: 5906416 - DNA, 19 bp, Homo sapiens
gcacatgacaactttgcca

SEQ ID NO: 5906417 - DNA, 23 bp, Homo sapiens
gcacatgacatttgtcctgcaga

SEQ ID NO: 5906418 - DNA, 21 bp, Homo sapiens
gcacatgagctggcgggattg

SEQ ID NO: 5906419 - DNA, 19 bp, Homo sapiens
gcacatgaggagggtgccc

SEQ ID NO: 5906420 - DNA, 22 bp, Homo sapiens
gcacatgattgtataagcatgc

SEQ ID NO: 5906421 - DNA, 12 bp, Homo sapiens
gcacatgatttc

SEQ ID NO: 5906422 - DNA, 18 bp, Homo sapiens
gcacatgattttcttttg

SEQ ID NO: 5906423 - DNA, 21 bp, Homo sapiens
gcacatgcaccacgcccggct

SEQ ID NO: 5906424 - DNA, 22 bp, Homo sapiens
gcacatgccgcgggcggccagg

SEQ ID NO: 5906425 - DNA, 19 bp, Homo sapiens
gcacatgcctctctcaggc

SEQ ID NO: 5906426 - DNA, 18 bp, Homo sapiens
gcacatgccttaagccag

SEQ ID NO: 5906427 - DNA, 14 bp, Homo sapiens
gcacatgcgggctc

SEQ ID NO: 5906428 - DNA, 19 bp, Homo sapiens
gcacatgctgagtctccca

SEQ ID NO: 5906429 - DNA, 15 bp, Homo sapiens
gcacatgctggccag

SEQ ID NO: 5906430 - DNA, 18 bp, Homo sapiens
gcacatgctggccagcct

SEQ ID NO: 5906431 - DNA, 22 bp, Homo sapiens
gcacatgctggccagcctgggg

SEQ ID NO: 5906432 - DNA, 20 bp, Homo sapiens
gcacatggacagacttcaca

SEQ ID NO: 5906433 - DNA, 23 bp, Homo sapiens
gcacatggccatagaggcccagg

SEQ ID NO: 5906434 - DNA, 16 bp, Homo sapiens
gcacatggcctgagca

SEQ ID NO: 5906435 - DNA, 13 bp, Homo sapiens
gcacatggctggg

SEQ ID NO: 5906436 - DNA, 21 bp, Homo sapiens
gcacatggctgggggagggac

SEQ ID NO: 5906437 - DNA, 17 bp, Homo sapiens
gcacatggtgttgtata

SEQ ID NO: 5906438 - DNA, 20 bp, Homo sapiens
gcacatggtttaaatatgaa

SEQ ID NO: 5906439 - DNA, 20 bp, Homo sapiens
gcacatgtacatatggaaat

SEQ ID NO: 5906440 - DNA, 22 bp, Homo sapiens
gcacatgtattctgttggccag

SEQ ID NO: 5906441 - DNA, 20 bp, Homo sapiens
gcacatgtctgtcctcagag

SEQ ID NO: 5906442 - DNA, 15 bp, Homo sapiens
gcacatgtcttaatg

SEQ ID NO: 5906443 - DNA, 21 bp, Homo sapiens
gcacatgtcttaatgaagttt

SEQ ID NO: 5906444 - DNA, 22 bp, Homo sapiens
gcacatgtcttaatgaagtttg

SEQ ID NO: 5906445 - DNA, 15 bp, Homo sapiens
gcacatgtgttcaga

SEQ ID NO: 5906446 - DNA, 12 bp, Homo sapiens
gcacatgttcat

SEQ ID NO: 5906447 - DNA, 20 bp, Homo sapiens
gcacatgttggaggagagag

SEQ ID NO: 5906448 - DNA, 23 bp, Homo sapiens
gcacatgttggaggagagagcct

SEQ ID NO: 5906449 - DNA, 15 bp, Homo sapiens
gcacatgttttacaa

SEQ ID NO: 5906450 - DNA, 20 bp, Homo sapiens
gcacattagagggacagcca

SEQ ID NO: 5906451 - DNA, 19 bp, Homo sapiens
gcacattcatcctcacatg

SEQ ID NO: 5906452 - DNA, 13 bp, Homo sapiens
gcacattccaaaa

SEQ ID NO: 5906453 - DNA, 22 bp, Homo sapiens
gcacattccaaaattcatttca

SEQ ID NO: 5906454 - DNA, 16 bp, Homo sapiens
gcacattcctggcccc

SEQ ID NO: 5906455 - DNA, 12 bp, Homo sapiens
gcacattccttt

SEQ ID NO: 5906456 - DNA, 14 bp, Homo sapiens
gcacattcctttgg

SEQ ID NO: 5906457 - DNA, 19 bp, Homo sapiens
gcacattcctttgggtatg

SEQ ID NO: 5906458 - DNA, 18 bp, Homo sapiens
gcacattcgggaccaata

SEQ ID NO: 5906459 - DNA, 21 bp, Homo sapiens
gcacattcgggaccaatatat

SEQ ID NO: 5906460 - DNA, 14 bp, Homo sapiens
gcacattgagctgt

SEQ ID NO: 5906461 - DNA, 22 bp, Homo sapiens
gcacattgcccatggctgggaa

SEQ ID NO: 5906462 - DNA, 16 bp, Homo sapiens
gcacattgcccctctg

SEQ ID NO: 5906463 - DNA, 18 bp, Homo sapiens
gcacattgcccctctgcc

SEQ ID NO: 5906464 - DNA, 16 bp, Homo sapiens
gcacattgccctgagg

SEQ ID NO: 5906465 - DNA, 20 bp, Homo sapiens
gcacattgccctgaggggcc

SEQ ID NO: 5906466 - DNA, 21 bp, Homo sapiens
gcacattgccctgaggggcct

SEQ ID NO: 5906467 - DNA, 19 bp, Homo sapiens
gcacattggaagctcccac

SEQ ID NO: 5906468 - DNA, 20 bp, Homo sapiens
gcacattgggtggggctcct

SEQ ID NO: 5906469 - DNA, 22 bp, Homo sapiens
gcacattgggtggggctcctgg

SEQ ID NO: 5906470 - DNA, 17 bp, Homo sapiens
gcacatttaagagacag

SEQ ID NO: 5906471 - DNA, 23 bp, Homo sapiens
gcacatttaagagacagtcaccc

SEQ ID NO: 5906472 - DNA, 14 bp, Homo sapiens
gcacatttatatat

SEQ ID NO: 5906473 - DNA, 20 bp, Homo sapiens
gcacatttatatatatatgt

SEQ ID NO: 5906474 - DNA, 19 bp, Homo sapiens
gcacatttcagggagaaac

SEQ ID NO: 5906475 - DNA, 19 bp, Homo sapiens
gcacatttgttaatgattc

SEQ ID NO: 5906476 - DNA, 14 bp, Homo sapiens
gcacattttgtaca

SEQ ID NO: 5906477 - DNA, 23 bp, Homo sapiens
gcacatttttttctatgcataaa

SEQ ID NO: 5906478 - DNA, 22 bp, Homo sapiens
gcacatttttttttttaatttt

SEQ ID NO: 5906479 - DNA, 16 bp, Homo sapiens
gcaccaaaagaagtaa

SEQ ID NO: 5906480 - DNA, 18 bp, Homo sapiens
gcaccaaaagaagtaaaa

SEQ ID NO: 5906481 - DNA, 18 bp, Homo sapiens
gcaccaaaataagaaaag

SEQ ID NO: 5906482 - DNA, 18 bp, Homo sapiens
gcaccaaaccctgtcctc

SEQ ID NO: 5906483 - DNA, 20 bp, Homo sapiens
gcaccaaaccctgtcctccc

SEQ ID NO: 5906484 - DNA, 23 bp, Homo sapiens
gcaccaaaccctgtcctcccacc

SEQ ID NO: 5906485 - DNA, 12 bp, Homo sapiens
gcaccaaagaca

SEQ ID NO: 5906486 - DNA, 13 bp, Homo sapiens
gcaccaaagacat

SEQ ID NO: 5906487 - DNA, 22 bp, Homo sapiens
gcaccaaagacatcagtctcca

SEQ ID NO: 5906488 - DNA, 22 bp, Homo sapiens
gcaccaaatgtcagaagcttgg

SEQ ID NO: 5906489 - DNA, 15 bp, Homo sapiens
gcaccaaccacagca

SEQ ID NO: 5906490 - DNA, 18 bp, Homo sapiens
gcaccaacccactgccca

SEQ ID NO: 5906491 - DNA, 14 bp, Homo sapiens
gcaccaacccagcc

SEQ ID NO: 5906492 - DNA, 20 bp, Homo sapiens
gcaccaacccagccgctgcc

SEQ ID NO: 5906493 - DNA, 22 bp, Homo sapiens
gcaccaacctcactgccctccc

SEQ ID NO: 5906494 - DNA, 14 bp, Homo sapiens
gcaccaacctccag

SEQ ID NO: 5906495 - DNA, 21 bp, Homo sapiens
gcaccaacctccagactcagc

SEQ ID NO: 5906496 - DNA, 15 bp, Homo sapiens
gcaccaagcaggaaa

SEQ ID NO: 5906497 - DNA, 13 bp, Homo sapiens
gcaccaagcccac

SEQ ID NO: 5906498 - DNA, 22 bp, Homo sapiens
gcaccaagtgcgggtccggcag

SEQ ID NO: 5906499 - DNA, 14 bp, Homo sapiens
gcaccaataaagga

SEQ ID NO: 5906500 - DNA, 21 bp, Homo sapiens
gcaccaataaaggaggaatca

SEQ ID NO: 5906501 - DNA, 20 bp, Homo sapiens
gcaccaattgtacattccct

SEQ ID NO: 5906502 - DNA, 21 bp, Homo sapiens
gcaccaattgtacattccctg

SEQ ID NO: 5906503 - DNA, 15 bp, Homo sapiens
gcaccacactcagcc

SEQ ID NO: 5906504 - DNA, 17 bp, Homo sapiens
gcaccacaggctgcctc

SEQ ID NO: 5906505 - DNA, 17 bp, Homo sapiens
gcaccacattgcctcat

SEQ ID NO: 5906506 - DNA, 13 bp, Homo sapiens
gcaccaccaagcc

SEQ ID NO: 5906507 - DNA, 14 bp, Homo sapiens
gcaccaccaagcca

SEQ ID NO: 5906508 - DNA, 23 bp, Homo sapiens
gcaccaccacacagtcacccctc

SEQ ID NO: 5906509 - DNA, 18 bp, Homo sapiens
gcaccaccaggagcagca

SEQ ID NO: 5906510 - DNA, 22 bp, Homo sapiens
gcaccaccaggagcagcagcca

SEQ ID NO: 5906511 - DNA, 23 bp, Homo sapiens
gcaccaccaggagcagcagccag

SEQ ID NO: 5906512 - DNA, 20 bp, Homo sapiens
gcaccaccagggctccagga

SEQ ID NO: 5906513 - DNA, 13 bp, Homo sapiens
gcaccaccagggt

SEQ ID NO: 5906514 - DNA, 14 bp, Homo sapiens
gcaccaccagggtg

SEQ ID NO: 5906515 - DNA, 22 bp, Homo sapiens
gcaccaccagggtggaccaggc

SEQ ID NO: 5906516 - DNA, 16 bp, Homo sapiens
gcaccaccaggtctcc

SEQ ID NO: 5906517 - DNA, 20 bp, Homo sapiens
gcaccaccaggtctcccggg

SEQ ID NO: 5906518 - DNA, 13 bp, Homo sapiens
gcaccaccatgcc

SEQ ID NO: 5906519 - DNA, 14 bp, Homo sapiens
gcaccaccatgccc

SEQ ID NO: 5906520 - DNA, 18 bp, Homo sapiens
gcaccacccatggagagg

SEQ ID NO: 5906521 - DNA, 17 bp, Homo sapiens
gcaccctcccctcccgt

SEQ ID NO: 5906522 - DNA, 16 bp, Homo sapiens
gcaccctccctagctc

SEQ ID NO: 5906523 - DNA, 17 bp, Homo sapiens
gcaccctctcctggggg

SEQ ID NO: 5906524 - DNA, 22 bp, Homo sapiens
gcaccctctcctgggggtggca

SEQ ID NO: 5906525 - DNA, 22 bp, Homo sapiens
gcaccctctgctatgtctgtga

SEQ ID NO: 5906526 - DNA, 16 bp, Homo sapiens
gcaccctcttctcctc

SEQ ID NO: 5906527 - DNA, 19 bp, Homo sapiens
gcaccctcttctcctctgg

SEQ ID NO: 5906528 - DNA, 12 bp, Homo sapiens
gcaccctgaggg

SEQ ID NO: 5906529 - DNA, 16 bp, Homo sapiens
gcaccctgcacctgct

SEQ ID NO: 5906530 - DNA, 15 bp, Homo sapiens
gcaccctgcaggcag

SEQ ID NO: 5906531 - DNA, 18 bp, Homo sapiens
gcaccctgcaggcaggca

SEQ ID NO: 5906532 - DNA, 21 bp, Homo sapiens
gcaccctgcctacgccaggag

SEQ ID NO: 5906533 - DNA, 18 bp, Homo sapiens
gcaccctggaaaggggag

SEQ ID NO: 5906534 - DNA, 22 bp, Homo sapiens
gcaccctggaaaggggagttga

SEQ ID NO: 5906535 - DNA, 23 bp, Homo sapiens
gcaccctggaaaggggagttgag

SEQ ID NO: 5906536 - DNA, 15 bp, Homo sapiens
gcaccctggcctggt

SEQ ID NO: 5906537 - DNA, 21 bp, Homo sapiens
gcaccctggggcctggacctg

SEQ ID NO: 5906538 - DNA, 19 bp, Homo sapiens
gcaccctgtagatgttcta

SEQ ID NO: 5906539 - DNA, 17 bp, Homo sapiens
gcaccctgtatggagct

SEQ ID NO: 5906540 - DNA, 20 bp, Homo sapiens
gcaccctgtatggagctaga

SEQ ID NO: 5906541 - DNA, 18 bp, Homo sapiens
gcaccctgtggccctggc

SEQ ID NO: 5906542 - DNA, 17 bp, Homo sapiens
gcacccttatcatggga

SEQ ID NO: 5906543 - DNA, 12 bp, Homo sapiens
gcacccttccct

SEQ ID NO: 5906544 - DNA, 23 bp, Homo sapiens
gcacccttccctcttccctctcc

SEQ ID NO: 5906545 - DNA, 20 bp, Homo sapiens
gcacccttcctcctcctttg

SEQ ID NO: 5906546 - DNA, 19 bp, Homo sapiens
gcacccttctcggagaccc

SEQ ID NO: 5906547 - DNA, 15 bp, Homo sapiens
gcacccttctgctgt

SEQ ID NO: 5906548 - DNA, 12 bp, Homo sapiens
gcacccttcttt

SEQ ID NO: 5906549 - DNA, 17 bp, Homo sapiens
gcaccctttcaccccca

SEQ ID NO: 5906550 - DNA, 15 bp, Homo sapiens
gcaccgaagcccaga

SEQ ID NO: 5906551 - DNA, 16 bp, Homo sapiens
gcaccgacccgaggcc

SEQ ID NO: 5906552 - DNA, 19 bp, Homo sapiens
gcaccgacccgaggcccag

SEQ ID NO: 5906553 - DNA, 20 bp, Homo sapiens
gcaccgacccgaggcccaga

SEQ ID NO: 5906554 - DNA, 18 bp, Homo sapiens
gcaccgagtgatttccat

SEQ ID NO: 5906555 - DNA, 14 bp, Homo sapiens
gcaccgcagcatgt

SEQ ID NO: 5906556 - DNA, 20 bp, Homo sapiens
gcaccgccacgtcccagcat

SEQ ID NO: 5906557 - DNA, 14 bp, Homo sapiens
gcaccgccagagtg

SEQ ID NO: 5906558 - DNA, 13 bp, Homo sapiens
gcaccgccatgca

SEQ ID NO: 5906559 - DNA, 21 bp, Homo sapiens
gcaccgcccaacccccacctc

SEQ ID NO: 5906560 - DNA, 22 bp, Homo sapiens
gcaccgcccaacccccacctcc

SEQ ID NO: 5906561 - DNA, 16 bp, Homo sapiens
gcaccgcccacccaca

SEQ ID NO: 5906562 - DNA, 17 bp, Homo sapiens
gcaccgccgccaccagc

SEQ ID NO: 5906563 - DNA, 18 bp, Homo sapiens
gcaccgccgccaccagcc

SEQ ID NO: 5906564 - DNA, 16 bp, Homo sapiens
gcaccgccgccaccct

SEQ ID NO: 5906565 - DNA, 17 bp, Homo sapiens
gcaccgccgccaccctg

SEQ ID NO: 5906566 - DNA, 20 bp, Homo sapiens
gcaccgccggccagctggga

SEQ ID NO: 5906567 - DNA, 20 bp, Homo sapiens
gcaccgccggctttcagggc

SEQ ID NO: 5906568 - DNA, 21 bp, Homo sapiens
gcaccgcctgaaggcacagct

SEQ ID NO: 5906569 - DNA, 14 bp, Homo sapiens
gcaccgcctgccct

SEQ ID NO: 5906570 - DNA, 23 bp, Homo sapiens
gcaccgcctgccctcccgcacct

SEQ ID NO: 5906571 - DNA, 15 bp, Homo sapiens
gcaccggaccagcct

SEQ ID NO: 5906572 - DNA, 21 bp, Homo sapiens
gcaccggaccagcctggccca

SEQ ID NO: 5906573 - DNA, 16 bp, Homo sapiens
gcaccggacgctggag

SEQ ID NO: 5906574 - DNA, 19 bp, Homo sapiens
gcaccggcctggctgcagc

SEQ ID NO: 5906575 - DNA, 21 bp, Homo sapiens
gcaccggcctggctgcagctg

SEQ ID NO: 5906576 - DNA, 14 bp, Homo sapiens
gcaccggctcagga

SEQ ID NO: 5906577 - DNA, 16 bp, Homo sapiens
gcaccggctggcctgg

SEQ ID NO: 5906578 - DNA, 19 bp, Homo sapiens
gcaccggctggcctggccc

SEQ ID NO: 5906579 - DNA, 22 bp, Homo sapiens
gcaccgggctccatgcctctgg

SEQ ID NO: 5906580 - DNA, 13 bp, Homo sapiens
gcaccgggctggc

SEQ ID NO: 5906581 - DNA, 20 bp, Homo sapiens
gcaccggggcctgggcagga

SEQ ID NO: 5906582 - DNA, 15 bp, Homo sapiens
gcaccgggggagagg

SEQ ID NO: 5906583 - DNA, 21 bp, Homo sapiens
gcaccgtcatggcttaatgtt

SEQ ID NO: 5906584 - DNA, 16 bp, Homo sapiens
gcaccgtccaggcccc

SEQ ID NO: 5906585 - DNA, 14 bp, Homo sapiens
gcaccgtctcactg

SEQ ID NO: 5906586 - DNA, 15 bp, Homo sapiens
gcaccgtctcactgt

SEQ ID NO: 5906587 - DNA, 12 bp, Homo sapiens
gcaccgtgctgg

SEQ ID NO: 5906588 - DNA, 15 bp, Homo sapiens
gcaccgtgctgggct

SEQ ID NO: 5906589 - DNA, 18 bp, Homo sapiens
gcaccgtggtgtgaggcc

SEQ ID NO: 5906590 - DNA, 13 bp, Homo sapiens
gcaccgtgtcctc

SEQ ID NO: 5906591 - DNA, 16 bp, Homo sapiens
gcaccgtgtcctcctc

SEQ ID NO: 5906592 - DNA, 18 bp, Homo sapiens
gcaccgtgtcctcctctg

SEQ ID NO: 5906593 - DNA, 22 bp, Homo sapiens
gcaccgtgtcctcctctgagga

SEQ ID NO: 5906594 - DNA, 18 bp, Homo sapiens
gcacctaaaacccaaagg

SEQ ID NO: 5906595 - DNA, 23 bp, Homo sapiens
gcacctaaaccaccagtgcccaa

SEQ ID NO: 5906596 - DNA, 14 bp, Homo sapiens
gcacctaaagaaaa

SEQ ID NO: 5906597 - DNA, 16 bp, Homo sapiens
gcacctaaagcagcca

SEQ ID NO: 5906598 - DNA, 21 bp, Homo sapiens
gcacctacatccccaggtctc

SEQ ID NO: 5906599 - DNA, 18 bp, Homo sapiens
gcacctaccaccagggcc

SEQ ID NO: 5906600 - DNA, 15 bp, Homo sapiens
gcacctaccatcagg

SEQ ID NO: 5906601 - DNA, 20 bp, Homo sapiens
gcacctaccatcagggacag

SEQ ID NO: 5906602 - DNA, 20 bp, Homo sapiens
gcacctaccccttggaaatg

SEQ ID NO: 5906603 - DNA, 19 bp, Homo sapiens
gcacctactatgtgctggg

SEQ ID NO: 5906604 - DNA, 17 bp, Homo sapiens
gcacctatagtcccagc

SEQ ID NO: 5906605 - DNA, 16 bp, Homo sapiens
gcacctatctcagcca

SEQ ID NO: 5906606 - DNA, 16 bp, Homo sapiens
gcacctatgaaagcaa

SEQ ID NO: 5906607 - DNA, 21 bp, Homo sapiens
gcacctatgagatggccatgc

SEQ ID NO: 5906608 - DNA, 24 bp, Homo sapiens
gcacctatgagatggccatgctca

SEQ ID NO: 5906609 - DNA, 21 bp, Homo sapiens
gcacctatggcccagccactg

SEQ ID NO: 5906610 - DNA, 22 bp, Homo sapiens
gcacctatggcccagccactgc

SEQ ID NO: 5906611 - DNA, 23 bp, Homo sapiens
gcacctatggcccagccactgca

SEQ ID NO: 5906612 - DNA, 14 bp, Homo sapiens
gcacctattctgta

SEQ ID NO: 5906613 - DNA, 14 bp, Homo sapiens
gcacctattgaatt

SEQ ID NO: 5906614 - DNA, 21 bp, Homo sapiens
gcacctcagaaagtcaccagg

SEQ ID NO: 5906615 - DNA, 14 bp, Homo sapiens
gcacctcagggcca

SEQ ID NO: 5906616 - DNA, 19 bp, Homo sapiens
gcacctcatggactccagg

SEQ ID NO: 5906617 - DNA, 13 bp, Homo sapiens
gcacctcattcca

SEQ ID NO: 5906618 - DNA, 14 bp, Homo sapiens
gcacctcattccaa

SEQ ID NO: 5906619 - DNA, 22 bp, Homo sapiens
gcacctccacgccactgcctcc

SEQ ID NO: 5906620 - DNA, 15 bp, Homo sapiens
gcacctccagcctga

SEQ ID NO: 5906621 - DNA, 15 bp, Homo sapiens
gcacctccaggcagg

SEQ ID NO: 5906622 - DNA, 15 bp, Homo sapiens
gcacctccaggcctg

SEQ ID NO: 5906623 - DNA, 16 bp, Homo sapiens
gcacctccaggcctgt

SEQ ID NO: 5906624 - DNA, 15 bp, Homo sapiens
gcacctccccagaca

SEQ ID NO: 5906625 - DNA, 17 bp, Homo sapiens
gcacctccccagacagg

SEQ ID NO: 5906626 - DNA, 19 bp, Homo sapiens
gcacctccccagacagggc

SEQ ID NO: 5906627 - DNA, 21 bp, Homo sapiens
gcacctccccagacagggctc

SEQ ID NO: 5906628 - DNA, 19 bp, Homo sapiens
gcacctccccccactgcag

SEQ ID NO: 5906629 - DNA, 21 bp, Homo sapiens
gcacctccccccactgcaggc

SEQ ID NO: 5906630 - DNA, 22 bp, Homo sapiens
gcacctccccgctctccctgtc

SEQ ID NO: 5906631 - DNA, 23 bp, Homo sapiens
gcacctccccgctctccctgtca

SEQ ID NO: 5906632 - DNA, 14 bp, Homo sapiens
gcacctccccgctg

SEQ ID NO: 5906633 - DNA, 21 bp, Homo sapiens
gcacctccctccccagctccg

SEQ ID NO: 5906634 - DNA, 15 bp, Homo sapiens
gcacctcccttccct

SEQ ID NO: 5906635 - DNA, 15 bp, Homo sapiens
gcacctcccttgggc

SEQ ID NO: 5906636 - DNA, 17 bp, Homo sapiens
gcacctcccttgggcac

SEQ ID NO: 5906637 - DNA, 22 bp, Homo sapiens
gcacctccgcgggctgactggg

SEQ ID NO: 5906638 - DNA, 17 bp, Homo sapiens
gcacctccgggactgac

SEQ ID NO: 5906639 - DNA, 19 bp, Homo sapiens
gcacctccgggactgacct

SEQ ID NO: 5906640 - DNA, 14 bp, Homo sapiens
gcacctcctaccct

SEQ ID NO: 5906641 - DNA, 12 bp, Homo sapiens
gcacctcctcag

SEQ ID NO: 5906642 - DNA, 15 bp, Homo sapiens
gcacctcctcagcct

SEQ ID NO: 5906643 - DNA, 17 bp, Homo sapiens
gcacctcctcagcctga

SEQ ID NO: 5906644 - DNA, 20 bp, Homo sapiens
gcacctcctcggctggctgt

SEQ ID NO: 5906645 - DNA, 21 bp, Homo sapiens
gcacctcctcggctggctgtc

SEQ ID NO: 5906646 - DNA, 15 bp, Homo sapiens
gcacctcctctctgc

SEQ ID NO: 5906647 - DNA, 16 bp, Homo sapiens
gcacctcctctctgct

SEQ ID NO: 5906648 - DNA, 16 bp, Homo sapiens
gcacctcctgagaagg

SEQ ID NO: 5906649 - DNA, 22 bp, Homo sapiens
gcacctcggggacaccagagct

SEQ ID NO: 5906650 - DNA, 20 bp, Homo sapiens
gcacctctcagagcaagcct

SEQ ID NO: 5906651 - DNA, 21 bp, Homo sapiens
gcacctctcagagcaagcctt

SEQ ID NO: 5906652 - DNA, 22 bp, Homo sapiens
gcacctctcagagcaagccttt

SEQ ID NO: 5906653 - DNA, 21 bp, Homo sapiens
gcacctctcatcagcccaggt

SEQ ID NO: 5906654 - DNA, 19 bp, Homo sapiens
gcacctctccagctcctcc

SEQ ID NO: 5906655 - DNA, 24 bp, Homo sapiens
gcacctctcttgaaccccaaatgc

SEQ ID NO: 5906656 - DNA, 19 bp, Homo sapiens
gcacctctgacctatcact

SEQ ID NO: 5906657 - DNA, 16 bp, Homo sapiens
gcacctgaaccactgt

SEQ ID NO: 5906658 - DNA, 19 bp, Homo sapiens
gcacctgaaccactgtggc

SEQ ID NO: 5906659 - DNA, 18 bp, Homo sapiens
gcacctgaaccccatggg

SEQ ID NO: 5906660 - DNA, 19 bp, Homo sapiens
gcacctgaaccccatgggc

SEQ ID NO: 5906661 - DNA, 24 bp, Homo sapiens
gcacctgaaccccatgggcttgga

SEQ ID NO: 5906662 - DNA, 17 bp, Homo sapiens
gcacctgaccagaatgc

SEQ ID NO: 5906663 - DNA, 18 bp, Homo sapiens
gcacctgaccgctgccca

SEQ ID NO: 5906664 - DNA, 19 bp, Homo sapiens
gcacctgaccgctgcccag

SEQ ID NO: 5906665 - DNA, 13 bp, Homo sapiens
gcacctgagaccc

SEQ ID NO: 5906666 - DNA, 18 bp, Homo sapiens
gcacctgagaccctactg

SEQ ID NO: 5906667 - DNA, 12 bp, Homo sapiens
gcacctgagcct

SEQ ID NO: 5906668 - DNA, 19 bp, Homo sapiens
gcacctgaggcccagcaga

SEQ ID NO: 5906669 - DNA, 18 bp, Homo sapiens
gcacctgagggggaaaaa

SEQ ID NO: 5906670 - DNA, 21 bp, Homo sapiens
gcacctgatggaaaagatata

SEQ ID NO: 5906671 - DNA, 11 bp, Homo sapiens
gcacctgcaca

SEQ ID NO: 5906672 - DNA, 12 bp, Homo sapiens
gcacctgcacac

SEQ ID NO: 5906673 - DNA, 17 bp, Homo sapiens
gcacctgcagattctga

SEQ ID NO: 5906674 - DNA, 14 bp, Homo sapiens
gcacctgcagggag

SEQ ID NO: 5906675 - DNA, 16 bp, Homo sapiens
gcacctgcagggagca

SEQ ID NO: 5906676 - DNA, 15 bp, Homo sapiens
gcacctgcaggttgg

SEQ ID NO: 5906677 - DNA, 22 bp, Homo sapiens
gcacctgcatccgtagttccct

SEQ ID NO: 5906678 - DNA, 14 bp, Homo sapiens
gcacctgccagcct

SEQ ID NO: 5906679 - DNA, 15 bp, Homo sapiens
gcacctgccagcctg

SEQ ID NO: 5906680 - DNA, 13 bp, Homo sapiens
gcacctgccccca

SEQ ID NO: 5906681 - DNA, 15 bp, Homo sapiens
gcacctgcccccaca

SEQ ID NO: 5906682 - DNA, 18 bp, Homo sapiens
gcacctgcccccacagct

SEQ ID NO: 5906683 - DNA, 19 bp, Homo sapiens
gcacctgcccccacagctc

SEQ ID NO: 5906684 - DNA, 22 bp, Homo sapiens
gcacctgccccctggtggacag

SEQ ID NO: 5906685 - DNA, 15 bp, Homo sapiens
gcacctgccctctgt

SEQ ID NO: 5906686 - DNA, 16 bp, Homo sapiens
gcacctgcctagctct

SEQ ID NO: 5906687 - DNA, 14 bp, Homo sapiens
gcacctgcctcagg

SEQ ID NO: 5906688 - DNA, 16 bp, Homo sapiens
gcacctgcctcaggac

SEQ ID NO: 5906689 - DNA, 13 bp, Homo sapiens
gcacctgcctcca

SEQ ID NO: 5906690 - DNA, 16 bp, Homo sapiens
gcacctgcctccagcc

SEQ ID NO: 5906691 - DNA, 23 bp, Homo sapiens
gcacctgcgagaggtccctgctt

SEQ ID NO: 5906692 - DNA, 16 bp, Homo sapiens
gcacctgcgcacaggt

SEQ ID NO: 5906693 - DNA, 18 bp, Homo sapiens
gcacctgcgcacaggtgg

SEQ ID NO: 5906694 - DNA, 12 bp, Homo sapiens
gcacctgctccc

SEQ ID NO: 5906695 - DNA, 15 bp, Homo sapiens
gcacctgctctcttg

SEQ ID NO: 5906696 - DNA, 14 bp, Homo sapiens
gcacctgctgcgtc

SEQ ID NO: 5906697 - DNA, 17 bp, Homo sapiens
gcacctgctgcgtcccc

SEQ ID NO: 5906698 - DNA, 16 bp, Homo sapiens
gcactaagggtggaga

SEQ ID NO: 5906699 - DNA, 15 bp, Homo sapiens
gcactaagtctcttt

SEQ ID NO: 5906700 - DNA, 19 bp, Homo sapiens
gcactaagtctctttttta

SEQ ID NO: 5906701 - DNA, 14 bp, Homo sapiens
gcactaatcaatac

SEQ ID NO: 5906702 - DNA, 14 bp, Homo sapiens
gcactacaatcatg

SEQ ID NO: 5906703 - DNA, 16 bp, Homo sapiens
gcactacaatcatggt

SEQ ID NO: 5906704 - DNA, 16 bp, Homo sapiens
gcactacaggaggaat

SEQ ID NO: 5906705 - DNA, 14 bp, Homo sapiens
gcactacataaact

SEQ ID NO: 5906706 - DNA, 22 bp, Homo sapiens
gcactacatctgatatcaggaa

SEQ ID NO: 5906707 - DNA, 12 bp, Homo sapiens
gcactacattca

SEQ ID NO: 5906708 - DNA, 20 bp, Homo sapiens
gcactaccactcctgccaag

SEQ ID NO: 5906709 - DNA, 20 bp, Homo sapiens
gcactacctgaacattgtaa

SEQ ID NO: 5906710 - DNA, 21 bp, Homo sapiens
gcactactccctcaaagcaca

SEQ ID NO: 5906711 - DNA, 13 bp, Homo sapiens
gcactactcctct

SEQ ID NO: 5906712 - DNA, 16 bp, Homo sapiens
gcactactcctctgca

SEQ ID NO: 5906713 - DNA, 17 bp, Homo sapiens
gcactactcctctgcag

SEQ ID NO: 5906714 - DNA, 17 bp, Homo sapiens
gcactactctaccatgg

SEQ ID NO: 5906715 - DNA, 17 bp, Homo sapiens
gcactactgacatgtgg

SEQ ID NO: 5906716 - DNA, 14 bp, Homo sapiens
gcactactgggtgt

SEQ ID NO: 5906717 - DNA, 21 bp, Homo sapiens
gcactactgggtgtcatttca

SEQ ID NO: 5906718 - DNA, 20 bp, Homo sapiens
gcactagaactttgtgccag

SEQ ID NO: 5906719 - DNA, 15 bp, Homo sapiens
gcactagaatgagaa

SEQ ID NO: 5906720 - DNA, 19 bp, Homo sapiens
gcactagaatgagaaatca

SEQ ID NO: 5906721 - DNA, 20 bp, Homo sapiens
gcactagaatgagaaatcat

SEQ ID NO: 5906722 - DNA, 17 bp, Homo sapiens
gcactagaccatataac

SEQ ID NO: 5906723 - DNA, 16 bp, Homo sapiens
gcactagagaatgcac

SEQ ID NO: 5906724 - DNA, 18 bp, Homo sapiens
gcactagagaatgcacag

SEQ ID NO: 5906725 - DNA, 13 bp, Homo sapiens
gcactagagtcac

SEQ ID NO: 5906726 - DNA, 21 bp, Homo sapiens
gcactagccaaacctcaccaa

SEQ ID NO: 5906727 - DNA, 14 bp, Homo sapiens
gcactagcctgtga

SEQ ID NO: 5906728 - DNA, 12 bp, Homo sapiens
gcactagccttc

SEQ ID NO: 5906729 - DNA, 15 bp, Homo sapiens
gcactagccttccca

SEQ ID NO: 5906730 - DNA, 16 bp, Homo sapiens
gcactagctagatgct

SEQ ID NO: 5906731 - DNA, 17 bp, Homo sapiens
gcactaggcacccagct

SEQ ID NO: 5906732 - DNA, 16 bp, Homo sapiens
gcactaggtaggcttc

SEQ ID NO: 5906733 - DNA, 18 bp, Homo sapiens
gcactaggtaggcttcta

SEQ ID NO: 5906734 - DNA, 23 bp, Homo sapiens
gcactagtcaccgacagcggcct

SEQ ID NO: 5906735 - DNA, 22 bp, Homo sapiens
gcactagtttgattattatgtt

SEQ ID NO: 5906736 - DNA, 14 bp, Homo sapiens
gcactataatgtaa

SEQ ID NO: 5906737 - DNA, 15 bp, Homo sapiens
gcactatagccattt

SEQ ID NO: 5906738 - DNA, 19 bp, Homo sapiens
gcactatatgtttacacaa

SEQ ID NO: 5906739 - DNA, 14 bp, Homo sapiens
gcactatctttcag

SEQ ID NO: 5906740 - DNA, 18 bp, Homo sapiens
gcactatctttcagctcc

SEQ ID NO: 5906741 - DNA, 19 bp, Homo sapiens
gcactatctttcagctcca

SEQ ID NO: 5906742 - DNA, 21 bp, Homo sapiens
gcactatggacattttgggct

SEQ ID NO: 5906743 - DNA, 22 bp, Homo sapiens
gcactattctttgtattaccaa

SEQ ID NO: 5906744 - DNA, 18 bp, Homo sapiens
gcactatttatttacaaa

SEQ ID NO: 5906745 - DNA, 21 bp, Homo sapiens
gcactatttatttacaaatgt

SEQ ID NO: 5906746 - DNA, 12 bp, Homo sapiens
gcactattttat

SEQ ID NO: 5906747 - DNA, 13 bp, Homo sapiens
gcactatttttat

SEQ ID NO: 5906748 - DNA, 22 bp, Homo sapiens
gcactcaaccaacctccccgca

SEQ ID NO: 5906749 - DNA, 16 bp, Homo sapiens
gcactcaagttgttta

SEQ ID NO: 5906750 - DNA, 22 bp, Homo sapiens
gcactcaagttgtttaactgtg

SEQ ID NO: 5906751 - DNA, 16 bp, Homo sapiens
gcactcacacaggacc

SEQ ID NO: 5906752 - DNA, 19 bp, Homo sapiens
gcactcacagacctggagc

SEQ ID NO: 5906753 - DNA, 14 bp, Homo sapiens
gcactcacatgccg

SEQ ID NO: 5906754 - DNA, 17 bp, Homo sapiens
gcactcacccatgtgcc

SEQ ID NO: 5906755 - DNA, 23 bp, Homo sapiens
gcactcacccatgtgccaaggtg

SEQ ID NO: 5906756 - DNA, 22 bp, Homo sapiens
gcactcagaaaagaaaaccatt

SEQ ID NO: 5906757 - DNA, 21 bp, Homo sapiens
gcactcagaagttgtgctaaa

SEQ ID NO: 5906758 - DNA, 11 bp, Homo sapiens
gcactcagatt

SEQ ID NO: 5906759 - DNA, 19 bp, Homo sapiens
gcactcagccacgaccagc

SEQ ID NO: 5906760 - DNA, 23 bp, Homo sapiens
gcactcagcctcattcagcatgg

SEQ ID NO: 5906761 - DNA, 18 bp, Homo sapiens
gcactcaggagcacagcc

SEQ ID NO: 5906762 - DNA, 21 bp, Homo sapiens
gcactcaggagcacagccata

SEQ ID NO: 5906763 - DNA, 17 bp, Homo sapiens
gcactcaggctctccat

SEQ ID NO: 5906764 - DNA, 22 bp, Homo sapiens
gcactcagtgagcctcctgtgc

SEQ ID NO: 5906765 - DNA, 21 bp, Homo sapiens
gcactcagtgtggactgggaa

SEQ ID NO: 5906766 - DNA, 21 bp, Homo sapiens
gcactcatgacggcctgcctg

SEQ ID NO: 5906767 - DNA, 23 bp, Homo sapiens
gcactcatgacggcctgcctgca

SEQ ID NO: 5906768 - DNA, 14 bp, Homo sapiens
gcactccaaacctg

SEQ ID NO: 5906769 - DNA, 23 bp, Homo sapiens
gcactccaacctaacctgtgtct

SEQ ID NO: 5906770 - DNA, 15 bp, Homo sapiens
gcactccacacatct

SEQ ID NO: 5906771 - DNA, 21 bp, Homo sapiens
gcactccacacatctttcttg

SEQ ID NO: 5906772 - DNA, 22 bp, Homo sapiens
gcactccacacatctttcttga

SEQ ID NO: 5906773 - DNA, 11 bp, Homo sapiens
gcactccagaa

SEQ ID NO: 5906774 - DNA, 11 bp, Homo sapiens
gcactccagac

SEQ ID NO: 5906775 - DNA, 18 bp, Homo sapiens
gcactccagactctgggg

SEQ ID NO: 5906776 - DNA, 12 bp, Homo sapiens
gcactccagcct

SEQ ID NO: 5906777 - DNA, 15 bp, Homo sapiens
gcactccagcctggg

SEQ ID NO: 5906778 - DNA, 19 bp, Homo sapiens
gcactccagcctgggggac

SEQ ID NO: 5906779 - DNA, 18 bp, Homo sapiens
gcactccagcctgggtca

SEQ ID NO: 5906780 - DNA, 20 bp, Homo sapiens
gcactccagggaagatttta

SEQ ID NO: 5906781 - DNA, 19 bp, Homo sapiens
gcactccatcactgagagc

SEQ ID NO: 5906782 - DNA, 16 bp, Homo sapiens
gcactccatgagcacc

SEQ ID NO: 5906783 - DNA, 23 bp, Homo sapiens
gcactccatgcttagtcactgcc

SEQ ID NO: 5906784 - DNA, 14 bp, Homo sapiens
gcactccatggcca

SEQ ID NO: 5906785 - DNA, 15 bp, Homo sapiens
gcactccatggccac

SEQ ID NO: 5906786 - DNA, 17 bp, Homo sapiens
gcactccatggccaccc

SEQ ID NO: 5906787 - DNA, 13 bp, Homo sapiens
gcactcccagggc

SEQ ID NO: 5906788 - DNA, 21 bp, Homo sapiens
gcactcccagggcccgagcgc

SEQ ID NO: 5906789 - DNA, 14 bp, Homo sapiens
gcactccccagagc

SEQ ID NO: 5906790 - DNA, 18 bp, Homo sapiens
gcactccccagagctgtg

SEQ ID NO: 5906791 - DNA, 12 bp, Homo sapiens
gcactcccccag

SEQ ID NO: 5906792 - DNA, 14 bp, Homo sapiens
gcactcccccagga

SEQ ID NO: 5906793 - DNA, 11 bp, Homo sapiens
gcactcccctt

SEQ ID NO: 5906794 - DNA, 15 bp, Homo sapiens
gcactccccttgcct

SEQ ID NO: 5906795 - DNA, 21 bp, Homo sapiens
gcactccccttgccttcccct

SEQ ID NO: 5906796 - DNA, 16 bp, Homo sapiens
gcactcccgctgcaca

SEQ ID NO: 5906797 - DNA, 18 bp, Homo sapiens
gcactcccgggatgggtg

SEQ ID NO: 5906798 - DNA, 18 bp, Homo sapiens
gcactccctggccttgcc

SEQ ID NO: 5906799 - DNA, 21 bp, Homo sapiens
gcactccgcgccgatgccacc

SEQ ID NO: 5906800 - DNA, 16 bp, Homo sapiens
gcactcctcaagactt

SEQ ID NO: 5906801 - DNA, 23 bp, Homo sapiens
gcactcctcacacagaattgcta

SEQ ID NO: 5906802 - DNA, 16 bp, Homo sapiens
gcactcctgattttta

SEQ ID NO: 5906803 - DNA, 20 bp, Homo sapiens
gcactcctgccccggcccaa

SEQ ID NO: 5906804 - DNA, 22 bp, Homo sapiens
gcactcctgccccggcccaacc

SEQ ID NO: 5906805 - DNA, 19 bp, Homo sapiens
gcactcctttatctgtaat

SEQ ID NO: 5906806 - DNA, 17 bp, Homo sapiens
gcactcgagaccatcct

SEQ ID NO: 5906807 - DNA, 20 bp, Homo sapiens
gcactcgagaccatcctggc

SEQ ID NO: 5906808 - DNA, 21 bp, Homo sapiens
gcactcgagaccatcctggcc

SEQ ID NO: 5906809 - DNA, 17 bp, Homo sapiens
gcactcgctagcagtgg

SEQ ID NO: 5906810 - DNA, 21 bp, Homo sapiens
gcactcgggaaacctggggct

SEQ ID NO: 5906811 - DNA, 22 bp, Homo sapiens
gcactcggggtccctggagggc

SEQ ID NO: 5906812 - DNA, 21 bp, Homo sapiens
gcactcgtgtgcaacagacaa

SEQ ID NO: 5906813 - DNA, 23 bp, Homo sapiens
gcactctaattagagaactggag

SEQ ID NO: 5906814 - DNA, 23 bp, Homo sapiens
gcactctactctgcgacgatccc

SEQ ID NO: 5906815 - DNA, 11 bp, Homo sapiens
gcactctagat

SEQ ID NO: 5906816 - DNA, 12 bp, Homo sapiens
gcactctagatt

SEQ ID NO: 5906817 - DNA, 13 bp, Homo sapiens
gcactctcagagt

SEQ ID NO: 5906818 - DNA, 17 bp, Homo sapiens
gcactctccccgctcag

SEQ ID NO: 5906819 - DNA, 21 bp, Homo sapiens
gcactctcgcacacacagtga

SEQ ID NO: 5906820 - DNA, 18 bp, Homo sapiens
gcactctctgcagtcctc

SEQ ID NO: 5906821 - DNA, 18 bp, Homo sapiens
gcactctctgccagctcc

SEQ ID NO: 5906822 - DNA, 18 bp, Homo sapiens
gcactctctgccattctg

SEQ ID NO: 5906823 - DNA, 23 bp, Homo sapiens
gcactctctgccattctgtgcag

SEQ ID NO: 5906824 - DNA, 14 bp, Homo sapiens
gcactctgcagtga

SEQ ID NO: 5906825 - DNA, 22 bp, Homo sapiens
gcactctggatgatggattcca

SEQ ID NO: 5906826 - DNA, 20 bp, Homo sapiens
gcactctggggctggcacca

SEQ ID NO: 5906827 - DNA, 19 bp, Homo sapiens
gcactctgggtctggccag

SEQ ID NO: 5906828 - DNA, 13 bp, Homo sapiens
gcactctgtgccc

SEQ ID NO: 5906829 - DNA, 14 bp, Homo sapiens
gcactctgtgccca

SEQ ID NO: 5906830 - DNA, 16 bp, Homo sapiens
gcactcttaagcttcc

SEQ ID NO: 5906831 - DNA, 13 bp, Homo sapiens
gcactcttcatgg

SEQ ID NO: 5906832 - DNA, 15 bp, Homo sapiens
gcactcttcatggtg

SEQ ID NO: 5906833 - DNA, 12 bp, Homo sapiens
gcactcttgtac

SEQ ID NO: 5906834 - DNA, 22 bp, Homo sapiens
gcactcttgtacaaaagaaaaa

SEQ ID NO: 5906835 - DNA, 20 bp, Homo sapiens
gcactctttaacacattctt

SEQ ID NO: 5906836 - DNA, 21 bp, Homo sapiens
gcactgaaaacttagccagag

SEQ ID NO: 5906837 - DNA, 20 bp, Homo sapiens
gcactgaaaataccatcagg

SEQ ID NO: 5906838 - DNA, 16 bp, Homo sapiens
gcactgaaacattatt

SEQ ID NO: 5906839 - DNA, 15 bp, Homo sapiens
gcactgaacagaatt

SEQ ID NO: 5906840 - DNA, 20 bp, Homo sapiens
gcactgaacaggctggggcc

SEQ ID NO: 5906841 - DNA, 22 bp, Homo sapiens
gcactgaaccacattcagggaa

SEQ ID NO: 5906842 - DNA, 15 bp, Homo sapiens
gcactgaactgcttt

SEQ ID NO: 5906843 - DNA, 19 bp, Homo sapiens
gcactgaagagctcttggc

SEQ ID NO: 5906844 - DNA, 19 bp, Homo sapiens
gcactgaagccggacagct

SEQ ID NO: 5906845 - DNA, 23 bp, Homo sapiens
gcactgaagccggacagctgccc

SEQ ID NO: 5906846 - DNA, 21 bp, Homo sapiens
gcactgaaggctttcagggcc

SEQ ID NO: 5906847 - DNA, 22 bp, Homo sapiens
gcactgaagggatatgtgaaac

SEQ ID NO: 5906848 - DNA, 18 bp, Homo sapiens
gcactgaagtggccctcc

SEQ ID NO: 5906849 - DNA, 16 bp, Homo sapiens
gcactgaagtttttga

SEQ ID NO: 5906850 - DNA, 17 bp, Homo sapiens
gcactgaagtttttgaa

SEQ ID NO: 5906851 - DNA, 22 bp, Homo sapiens
gcactgaataaattgtacagcc

SEQ ID NO: 5906852 - DNA, 21 bp, Homo sapiens
gcactgaatatataaacactc

SEQ ID NO: 5906853 - DNA, 12 bp, Homo sapiens
gcactgacagat

SEQ ID NO: 5906854 - DNA, 13 bp, Homo sapiens
gcactgacagcct

SEQ ID NO: 5906855 - DNA, 15 bp, Homo sapiens
gcactgacagcctgg

SEQ ID NO: 5906856 - DNA, 19 bp, Homo sapiens
gcactgacagcctgggggg

SEQ ID NO: 5906857 - DNA, 23 bp, Homo sapiens
gcactgacctgctccgccaggaa

SEQ ID NO: 5906858 - DNA, 17 bp, Homo sapiens
gcactgactgggcatag

SEQ ID NO: 5906859 - DNA, 11 bp, Homo sapiens
gcactgactgt

SEQ ID NO: 5906860 - DNA, 19 bp, Homo sapiens
gcactgagagagcgcagcc

SEQ ID NO: 5906861 - DNA, 14 bp, Homo sapiens
gcactgagagggca

SEQ ID NO: 5906862 - DNA, 15 bp, Homo sapiens
gcactgagcagggat

SEQ ID NO: 5906863 - DNA, 17 bp, Homo sapiens
gcactgagcagggatct

SEQ ID NO: 5906864 - DNA, 21 bp, Homo sapiens
gcactgagcagggatctgccc

SEQ ID NO: 5906865 - DNA, 13 bp, Homo sapiens
gcactgagccccc

SEQ ID NO: 5906866 - DNA, 14 bp, Homo sapiens
gcactgagcccccc

SEQ ID NO: 5906867 - DNA, 17 bp, Homo sapiens
gcactgagcctgcttgt

SEQ ID NO: 5906868 - DNA, 18 bp, Homo sapiens
gcactgagcgcctgcaga

SEQ ID NO: 5906869 - DNA, 16 bp, Homo sapiens
gcactgagctcacatg

SEQ ID NO: 5906870 - DNA, 20 bp, Homo sapiens
gcactgagctcacatgggac

SEQ ID NO: 5906871 - DNA, 17 bp, Homo sapiens
gcactgaggaccagcca

SEQ ID NO: 5906872 - DNA, 16 bp, Homo sapiens
gcactgaggatttctt

SEQ ID NO: 5906873 - DNA, 14 bp, Homo sapiens
gcactgagggccac

SEQ ID NO: 5906874 - DNA, 18 bp, Homo sapiens
gcactgagggtctggtgc

SEQ ID NO: 5906875 - DNA, 14 bp, Homo sapiens
gcagaagccagaag

SEQ ID NO: 5906876 - DNA, 16 bp, Homo sapiens
gcagaagccccaactg

SEQ ID NO: 5906877 - DNA, 21 bp, Homo sapiens
gcagaagccccaactgtgatc

SEQ ID NO: 5906878 - DNA, 18 bp, Homo sapiens
gcagaagccccacagcct

SEQ ID NO: 5906879 - DNA, 15 bp, Homo sapiens
gcagaagcgtctccc

SEQ ID NO: 5906880 - DNA, 15 bp, Homo sapiens
gcagaagctatgttt

SEQ ID NO: 5906881 - DNA, 18 bp, Homo sapiens
gcagaagctatgttttta

SEQ ID NO: 5906882 - DNA, 13 bp, Homo sapiens
gcagaagctctcg

SEQ ID NO: 5906883 - DNA, 17 bp, Homo sapiens
gcagaagcttggaggag

SEQ ID NO: 5906884 - DNA, 11 bp, Homo sapiens
gcagaaggaaa

SEQ ID NO: 5906885 - DNA, 15 bp, Homo sapiens
gcagaaggaaaaatg

SEQ ID NO: 5906886 - DNA, 21 bp, Homo sapiens
gcagaaggaaaaatgtgtaat

SEQ ID NO: 5906887 - DNA, 21 bp, Homo sapiens
gcagaaggaaggatgccactt

SEQ ID NO: 5906888 - DNA, 15 bp, Homo sapiens
gcagaaggccaagaa

SEQ ID NO: 5906889 - DNA, 14 bp, Homo sapiens
gcagaaggccttgc

SEQ ID NO: 5906890 - DNA, 15 bp, Homo sapiens
gcagaagggagaagg

SEQ ID NO: 5906891 - DNA, 20 bp, Homo sapiens
gcagaagggagctggctcca

SEQ ID NO: 5906892 - DNA, 23 bp, Homo sapiens
gcagaagggggtctcttcttcca

SEQ ID NO: 5906893 - DNA, 14 bp, Homo sapiens
gcagaagggggtgg

SEQ ID NO: 5906894 - DNA, 15 bp, Homo sapiens
gcagaagggggtggt

SEQ ID NO: 5906895 - DNA, 21 bp, Homo sapiens
gcagaaggtatttttgaagtc

SEQ ID NO: 5906896 - DNA, 15 bp, Homo sapiens
gcagaagtaagcctc

SEQ ID NO: 5906897 - DNA, 15 bp, Homo sapiens
gcagaagtctggctt

SEQ ID NO: 5906898 - DNA, 19 bp, Homo sapiens
gcagaagtctggctttgct

SEQ ID NO: 5906899 - DNA, 21 bp, Homo sapiens
gcagaagtctggctttgctct

SEQ ID NO: 5906900 - DNA, 16 bp, Homo sapiens
gcagaagtgctctttg

SEQ ID NO: 5906901 - DNA, 21 bp, Homo sapiens
gcagaagtgctctttgtggca

SEQ ID NO: 5906902 - DNA, 16 bp, Homo sapiens
gcagaagtgtttttta

SEQ ID NO: 5906903 - DNA, 22 bp, Homo sapiens
gcagaataaaccggatcctgtt

SEQ ID NO: 5906904 - DNA, 14 bp, Homo sapiens
gcagaataaagcaa

SEQ ID NO: 5906905 - DNA, 17 bp, Homo sapiens
gcagaataaagcaattt

SEQ ID NO: 5906906 - DNA, 19 bp, Homo sapiens
gcagaataaagcaattttc

SEQ ID NO: 5906907 - DNA, 21 bp, Homo sapiens
gcagaataaagcaattttcct

SEQ ID NO: 5906908 - DNA, 16 bp, Homo sapiens
gcagaataatcctgtt

SEQ ID NO: 5906909 - DNA, 15 bp, Homo sapiens
gcagaatactggtct

SEQ ID NO: 5906910 - DNA, 17 bp, Homo sapiens
gcagaatagcttatgcc

SEQ ID NO: 5906911 - DNA, 20 bp, Homo sapiens
gcagaatatgacaatctacc

SEQ ID NO: 5906912 - DNA, 13 bp, Homo sapiens
gcagaatcctggg

SEQ ID NO: 5906913 - DNA, 15 bp, Homo sapiens
gcagaatgaacccat

SEQ ID NO: 5906914 - DNA, 22 bp, Homo sapiens
gcagaatgaacccatagggagc

SEQ ID NO: 5906915 - DNA, 14 bp, Homo sapiens
gcagaatgaagcca

SEQ ID NO: 5906916 - DNA, 19 bp, Homo sapiens
gcagaatgaagggccaggc

SEQ ID NO: 5906917 - DNA, 16 bp, Homo sapiens
gcagaatgaatctatg

SEQ ID NO: 5906918 - DNA, 16 bp, Homo sapiens
gcagaatgactccacc

SEQ ID NO: 5906919 - DNA, 23 bp, Homo sapiens
gcagaatgagatgatttaattct

SEQ ID NO: 5906920 - DNA, 14 bp, Homo sapiens
gcagaatggaggca

SEQ ID NO: 5906921 - DNA, 17 bp, Homo sapiens
gcagaatggaggcaggg

SEQ ID NO: 5906922 - DNA, 19 bp, Homo sapiens
gcagaatgtaagtgggccc

SEQ ID NO: 5906923 - DNA, 22 bp, Homo sapiens
gcagaatgtaagtgggcccacc

SEQ ID NO: 5906924 - DNA, 19 bp, Homo sapiens
gcagaatgttgtacttgaa

SEQ ID NO: 5906925 - DNA, 13 bp, Homo sapiens
gcagaatgttttt

SEQ ID NO: 5906926 - DNA, 13 bp, Homo sapiens
gcagaattcattc

SEQ ID NO: 5906927 - DNA, 14 bp, Homo sapiens
gcagaattcattca

SEQ ID NO: 5906928 - DNA, 20 bp, Homo sapiens
gcagaattttaatgtgaaga

SEQ ID NO: 5906929 - DNA, 17 bp, Homo sapiens
gcagacaaagccctgtc

SEQ ID NO: 5906930 - DNA, 21 bp, Homo sapiens
gcagacaacaccttcctcctg

SEQ ID NO: 5906931 - DNA, 14 bp, Homo sapiens
gcagacaagagctg

SEQ ID NO: 5906932 - DNA, 13 bp, Homo sapiens
gcagacaagaggg

SEQ ID NO: 5906933 - DNA, 16 bp, Homo sapiens
gcagacaagtcttgct

SEQ ID NO: 5906934 - DNA, 17 bp, Homo sapiens
gcagacaagtcttgctg

SEQ ID NO: 5906935 - DNA, 22 bp, Homo sapiens
gcagacaagtcttgctgtgctt

SEQ ID NO: 5906936 - DNA, 21 bp, Homo sapiens
gcagacaataaaccctcagag

SEQ ID NO: 5906937 - DNA, 22 bp, Homo sapiens
gcagacacacacacacacacaa

SEQ ID NO: 5906938 - DNA, 21 bp, Homo sapiens
gcagacacacatgggcagccc

SEQ ID NO: 5906939 - DNA, 22 bp, Homo sapiens
gcagacacacatgggcagccca

SEQ ID NO: 5906940 - DNA, 23 bp, Homo sapiens
gcagacacacatgggcagcccaa

SEQ ID NO: 5906941 - DNA, 18 bp, Homo sapiens
gcagacacagggacttga

SEQ ID NO: 5906942 - DNA, 19 bp, Homo sapiens
gcagacacagggacttgaa

SEQ ID NO: 5906943 - DNA, 19 bp, Homo sapiens
gcagacacccttggagctc

SEQ ID NO: 5906944 - DNA, 16 bp, Homo sapiens
gcagacacggatctga

SEQ ID NO: 5906945 - DNA, 23 bp, Homo sapiens
gcagacacggatctgagaatctt

SEQ ID NO: 5906946 - DNA, 14 bp, Homo sapiens
gcagacactcaaga

SEQ ID NO: 5906947 - DNA, 18 bp, Homo sapiens
gcagacagaaactggatt

SEQ ID NO: 5906948 - DNA, 17 bp, Homo sapiens
gcagacagaagtctcct

SEQ ID NO: 5906949 - DNA, 20 bp, Homo sapiens
gcagacagaagtctcctcaa

SEQ ID NO: 5906950 - DNA, 14 bp, Homo sapiens
gcagacagagccag

SEQ ID NO: 5906951 - DNA, 21 bp, Homo sapiens
gcagacagagccaggagaagc

SEQ ID NO: 5906952 - DNA, 14 bp, Homo sapiens
gcagacagagggga

SEQ ID NO: 5906953 - DNA, 15 bp, Homo sapiens
gcagacagcaagggc

SEQ ID NO: 5906954 - DNA, 18 bp, Homo sapiens
gcagacagcaagggcttg

SEQ ID NO: 5906955 - DNA, 13 bp, Homo sapiens
gcagacagcagct

SEQ ID NO: 5906956 - DNA, 16 bp, Homo sapiens
gcagacagcagctcag

SEQ ID NO: 5906957 - DNA, 17 bp, Homo sapiens
gcagacagcagctcagg

SEQ ID NO: 5906958 - DNA, 19 bp, Homo sapiens
gcagacagcagctcaggca

SEQ ID NO: 5906959 - DNA, 15 bp, Homo sapiens
gcagacagcaggcag

SEQ ID NO: 5906960 - DNA, 14 bp, Homo sapiens
gcagacaggaagga

SEQ ID NO: 5906961 - DNA, 15 bp, Homo sapiens
gcagacaggaaggaa

SEQ ID NO: 5906962 - DNA, 18 bp, Homo sapiens
gcagacaggaaggaagca

SEQ ID NO: 5906963 - DNA, 12 bp, Homo sapiens
gcagacaggcaa

SEQ ID NO: 5906964 - DNA, 13 bp, Homo sapiens
gcagacaggcaag

SEQ ID NO: 5906965 - DNA, 23 bp, Homo sapiens
gcagacaggcaagcacctcctgc

SEQ ID NO: 5906966 - DNA, 20 bp, Homo sapiens
gcagacaggccatgtgagcc

SEQ ID NO: 5906967 - DNA, 21 bp, Homo sapiens
gcagacaggccatgtgagcca

SEQ ID NO: 5906968 - DNA, 22 bp, Homo sapiens
gcagacaggccatgtgagccac

SEQ ID NO: 5906969 - DNA, 18 bp, Homo sapiens
gcagacaggctacaaagc

SEQ ID NO: 5906970 - DNA, 20 bp, Homo sapiens
gcagacaggctggcattcta

SEQ ID NO: 5906971 - DNA, 20 bp, Homo sapiens
gcagacagggggccagaaca

SEQ ID NO: 5906972 - DNA, 21 bp, Homo sapiens
gcagacaggtgggagatggag

SEQ ID NO: 5906973 - DNA, 22 bp, Homo sapiens
gcagacaggtgggagatggagg

SEQ ID NO: 5906974 - DNA, 22 bp, Homo sapiens
gcagacagtctgttatgcactg

SEQ ID NO: 5906975 - DNA, 19 bp, Homo sapiens
gcagacatcaagctcaagg

SEQ ID NO: 5906976 - DNA, 19 bp, Homo sapiens
gcagacatctctggagcca

SEQ ID NO: 5906977 - DNA, 23 bp, Homo sapiens
gcagacatctctggagccagaga

SEQ ID NO: 5906978 - DNA, 20 bp, Homo sapiens
gcagacatgccttggtgccg

SEQ ID NO: 5906979 - DNA, 13 bp, Homo sapiens
gcagacattctca

SEQ ID NO: 5906980 - DNA, 20 bp, Homo sapiens
gcagacattctcaaagcctc

SEQ ID NO: 5906981 - DNA, 12 bp, Homo sapiens
gcagacattgtc

SEQ ID NO: 5906982 - DNA, 17 bp, Homo sapiens
gcagacattttaaaaaa

SEQ ID NO: 5906983 - DNA, 21 bp, Homo sapiens
gcagacattttcctcacaccc

SEQ ID NO: 5906984 - DNA, 22 bp, Homo sapiens
gcagacattttcctcacaccca

SEQ ID NO: 5906985 - DNA, 23 bp, Homo sapiens
gcagaccacgcccgtcctgcctg

SEQ ID NO: 5906986 - DNA, 14 bp, Homo sapiens
gcagaccagagagc

SEQ ID NO: 5906987 - DNA, 14 bp, Homo sapiens
gcagaccaggaagg

SEQ ID NO: 5906988 - DNA, 20 bp, Homo sapiens
gcagaccaggaaggaagagc

SEQ ID NO: 5906989 - DNA, 22 bp, Homo sapiens
gcagaccattggggctcccagc

SEQ ID NO: 5906990 - DNA, 22 bp, Homo sapiens
gcagaccccaccctgtctgcag

SEQ ID NO: 5906991 - DNA, 23 bp, Homo sapiens
gcagaccccaccctgtctgcagg

SEQ ID NO: 5906992 - DNA, 17 bp, Homo sapiens
gcagaccgggggccaga

SEQ ID NO: 5906993 - DNA, 21 bp, Homo sapiens
gcagaccgggggccagacaca

SEQ ID NO: 5906994 - DNA, 17 bp, Homo sapiens
gcagaccgtgatttgga

SEQ ID NO: 5906995 - DNA, 19 bp, Homo sapiens
gcagacctacctgcagtgg

SEQ ID NO: 5906996 - DNA, 17 bp, Homo sapiens
gcagacctcaagccatc

SEQ ID NO: 5906997 - DNA, 14 bp, Homo sapiens
gcagacctcatgcc

SEQ ID NO: 5906998 - DNA, 16 bp, Homo sapiens
gcagacctccccagcc

SEQ ID NO: 5906999 - DNA, 19 bp, Homo sapiens
gcagacctccccagcccct

SEQ ID NO: 5907000 - DNA, 13 bp, Homo sapiens
gcagacctggagc

SEQ ID NO: 5907001 - DNA, 15 bp, Homo sapiens
gcagacctggagctt

SEQ ID NO: 5907002 - DNA, 23 bp, Homo sapiens
gcagacctggagcttcagccagg

SEQ ID NO: 5907003 - DNA, 11 bp, Homo sapiens
gcagacctggc

SEQ ID NO: 5907004 - DNA, 15 bp, Homo sapiens
gcagacctggctggg

SEQ ID NO: 5907005 - DNA, 17 bp, Homo sapiens
gcagacctggctgggcc

SEQ ID NO: 5907006 - DNA, 14 bp, Homo sapiens
gcagacctgggact

SEQ ID NO: 5907007 - DNA, 14 bp, Homo sapiens
gcagaccttactca

SEQ ID NO: 5907008 - DNA, 21 bp, Homo sapiens
gcagaccttactcaggggatg

SEQ ID NO: 5907009 - DNA, 17 bp, Homo sapiens
gcagaccttttttagga

SEQ ID NO: 5907010 - DNA, 13 bp, Homo sapiens
gcagacgcccaga

SEQ ID NO: 5907011 - DNA, 19 bp, Homo sapiens
gcagacgggaatgcctagg

SEQ ID NO: 5907012 - DNA, 20 bp, Homo sapiens
gcagacgggaatgcctaggt

SEQ ID NO: 5907013 - DNA, 22 bp, Homo sapiens
gcagacgggaggggaaaggctg

SEQ ID NO: 5907014 - DNA, 14 bp, Homo sapiens
gcagacgggcaaga

SEQ ID NO: 5907015 - DNA, 17 bp, Homo sapiens
gcagacgggcacagaca

SEQ ID NO: 5907016 - DNA, 18 bp, Homo sapiens
gcagacgggcacagacac

SEQ ID NO: 5907017 - DNA, 20 bp, Homo sapiens
gcagacggggggctgcgggc

SEQ ID NO: 5907018 - DNA, 19 bp, Homo sapiens
gcagacgtctgccttggca

SEQ ID NO: 5907019 - DNA, 19 bp, Homo sapiens
gcagacgtctgtcaggggc

SEQ ID NO: 5907020 - DNA, 22 bp, Homo sapiens
gcagacgtctgtcaggggcttg

SEQ ID NO: 5907021 - DNA, 19 bp, Homo sapiens
gcagactagaattctggga

SEQ ID NO: 5907022 - DNA, 13 bp, Homo sapiens
gcagactcactgt

SEQ ID NO: 5907023 - DNA, 15 bp, Homo sapiens
gcagactcagctctg

SEQ ID NO: 5907024 - DNA, 19 bp, Homo sapiens
gcagactccagcccctgga

SEQ ID NO: 5907025 - DNA, 17 bp, Homo sapiens
gcagactctacagaggc

SEQ ID NO: 5907026 - DNA, 18 bp, Homo sapiens
gcagactctacagaggcc

SEQ ID NO: 5907027 - DNA, 18 bp, Homo sapiens
gcagactgatcaggacct

SEQ ID NO: 5907028 - DNA, 20 bp, Homo sapiens
gcagactgatgggacatcaa

SEQ ID NO: 5907029 - DNA, 17 bp, Homo sapiens
gcagactgcttggccag

SEQ ID NO: 5907030 - DNA, 18 bp, Homo sapiens
gcagactgcttggccaga

SEQ ID NO: 5907031 - DNA, 19 bp, Homo sapiens
gcagactgcttggccagat

SEQ ID NO: 5907032 - DNA, 20 bp, Homo sapiens
gcagactgcttggccagatg

SEQ ID NO: 5907033 - DNA, 22 bp, Homo sapiens
gcagactggcggagaaggagag

SEQ ID NO: 5907034 - DNA, 23 bp, Homo sapiens
gcagactggcggagaaggagagg

SEQ ID NO: 5907035 - DNA, 20 bp, Homo sapiens
gcagactggggcatcctgtg

SEQ ID NO: 5907036 - DNA, 17 bp, Homo sapiens
gcagactggtgagcaga

SEQ ID NO: 5907037 - DNA, 16 bp, Homo sapiens
gcagactggtgttaat

SEQ ID NO: 5907038 - DNA, 20 bp, Homo sapiens
gcagactggtgttaatgagt

SEQ ID NO: 5907039 - DNA, 12 bp, Homo sapiens
gcagactgtggc

SEQ ID NO: 5907040 - DNA, 23 bp, Homo sapiens
gcagactgttctaaaatataata

SEQ ID NO: 5907041 - DNA, 15 bp, Homo sapiens
gcagacttcccagct

SEQ ID NO: 5907042 - DNA, 23 bp, Homo sapiens
gcagacttcttaaaaggagctcg

SEQ ID NO: 5907043 - DNA, 13 bp, Homo sapiens
gcagactttctac

SEQ ID NO: 5907044 - DNA, 17 bp, Homo sapiens
gcagactttctctgtgt

SEQ ID NO: 5907045 - DNA, 19 bp, Homo sapiens
gcagacttttaaagacttg

SEQ ID NO: 5907046 - DNA, 20 bp, Homo sapiens
gcagacttttaaagacttgc

SEQ ID NO: 5907047 - DNA, 20 bp, Homo sapiens
gcagagaaacgcgctccttg

SEQ ID NO: 5907048 - DNA, 13 bp, Homo sapiens
gcagagaaagaaa

SEQ ID NO: 5907049 - DNA, 10 bp, Homo sapiens
gcagagaaat

SEQ ID NO: 5907050 - DNA, 14 bp, Homo sapiens
gcagagaaatacag

SEQ ID NO: 5907051 - DNA, 13 bp, Homo sapiens
gcagcacagccca

SEQ ID NO: 5907052 - DNA, 18 bp, Homo sapiens
gcagcacaggaggctccg

SEQ ID NO: 5907053 - DNA, 16 bp, Homo sapiens
gcagcacagtgtgtga

SEQ ID NO: 5907054 - DNA, 18 bp, Homo sapiens
gcagcacatggtgttgta

SEQ ID NO: 5907055 - DNA, 21 bp, Homo sapiens
gcagcacattgccctgagggg

SEQ ID NO: 5907056 - DNA, 22 bp, Homo sapiens
gcagcacattgccctgaggggc

SEQ ID NO: 5907057 - DNA, 21 bp, Homo sapiens
gcagcaccaaccacagcatcg

SEQ ID NO: 5907058 - DNA, 17 bp, Homo sapiens
gcagcaccaccacacag

SEQ ID NO: 5907059 - DNA, 20 bp, Homo sapiens
gcagcaccaccacacagtca

SEQ ID NO: 5907060 - DNA, 17 bp, Homo sapiens
gcagcaccagcctgagc

SEQ ID NO: 5907061 - DNA, 19 bp, Homo sapiens
gcagcacccactcagccat

SEQ ID NO: 5907062 - DNA, 13 bp, Homo sapiens
gcagcaccctccc

SEQ ID NO: 5907063 - DNA, 15 bp, Homo sapiens
gcagcaccctccccc

SEQ ID NO: 5907064 - DNA, 19 bp, Homo sapiens
gcagcaccctcccccgcag

SEQ ID NO: 5907065 - DNA, 20 bp, Homo sapiens
gcagcaccctcccccgcagc

SEQ ID NO: 5907066 - DNA, 15 bp, Homo sapiens
gcagcaccctgcaga

SEQ ID NO: 5907067 - DNA, 11 bp, Homo sapiens
gcagcaccctt

SEQ ID NO: 5907068 - DNA, 21 bp, Homo sapiens
gcagcaccctttcacccccaa

SEQ ID NO: 5907069 - DNA, 18 bp, Homo sapiens
gcagcaccgttctgtgca

SEQ ID NO: 5907070 - DNA, 16 bp, Homo sapiens
gcagcacctccaggcc

SEQ ID NO: 5907071 - DNA, 18 bp, Homo sapiens
gcagcacctccaggcctg

SEQ ID NO: 5907072 - DNA, 15 bp, Homo sapiens
gcagcacctcctcag

SEQ ID NO: 5907073 - DNA, 16 bp, Homo sapiens
gcagcacctcctcagc

SEQ ID NO: 5907074 - DNA, 18 bp, Homo sapiens
gcagcacctcctcagcct

SEQ ID NO: 5907075 - DNA, 20 bp, Homo sapiens
gcagcacctcctcagcctga

SEQ ID NO: 5907076 - DNA, 12 bp, Homo sapiens
gcagcacctgcc

SEQ ID NO: 5907077 - DNA, 17 bp, Homo sapiens
gcagcacctgccctacc

SEQ ID NO: 5907078 - DNA, 14 bp, Homo sapiens
gcagcacctggagc

SEQ ID NO: 5907079 - DNA, 14 bp, Homo sapiens
gcagcacctttcta

SEQ ID NO: 5907080 - DNA, 16 bp, Homo sapiens
gcagcacgcggccttg

SEQ ID NO: 5907081 - DNA, 19 bp, Homo sapiens
gcagcacgtcgccatccgt

SEQ ID NO: 5907082 - DNA, 16 bp, Homo sapiens
gcagcacgtctcagag

SEQ ID NO: 5907083 - DNA, 17 bp, Homo sapiens
gcagcacgtctcagaga

SEQ ID NO: 5907084 - DNA, 23 bp, Homo sapiens
gcagcactcaaacctggagctga

SEQ ID NO: 5907085 - DNA, 19 bp, Homo sapiens
gcagcactcacacaggacc

SEQ ID NO: 5907086 - DNA, 12 bp, Homo sapiens
gcagcactcccc

SEQ ID NO: 5907087 - DNA, 22 bp, Homo sapiens
gcagcactccccagagctgtgc

SEQ ID NO: 5907088 - DNA, 21 bp, Homo sapiens
gcagcactccgcatcacctca

SEQ ID NO: 5907089 - DNA, 17 bp, Homo sapiens
gcagcactgctgcctca

SEQ ID NO: 5907090 - DNA, 16 bp, Homo sapiens
gcagcacttagacctg

SEQ ID NO: 5907091 - DNA, 11 bp, Homo sapiens
gcagcacttta

SEQ ID NO: 5907092 - DNA, 13 bp, Homo sapiens
gcagcagaaaact

SEQ ID NO: 5907093 - DNA, 11 bp, Homo sapiens
gcagcagaagc

SEQ ID NO: 5907094 - DNA, 13 bp, Homo sapiens
gcagcagaagggg

SEQ ID NO: 5907095 - DNA, 12 bp, Homo sapiens
gcagcagagaga

SEQ ID NO: 5907096 - DNA, 13 bp, Homo sapiens
gcagcagagagag

SEQ ID NO: 5907097 - DNA, 14 bp, Homo sapiens
gcagcagagagaga

SEQ ID NO: 5907098 - DNA, 21 bp, Homo sapiens
gcagcagagagagaggacaga

SEQ ID NO: 5907099 - DNA, 14 bp, Homo sapiens
gcagcagagagccc

SEQ ID NO: 5907100 - DNA, 19 bp, Homo sapiens
gcagcagagatggagaaat

SEQ ID NO: 5907101 - DNA, 10 bp, Homo sapiens
gcagcagagg

SEQ ID NO: 5907102 - DNA, 23 bp, Homo sapiens
gcagcagaggacagtctggagaa

SEQ ID NO: 5907103 - DNA, 14 bp, Homo sapiens
gcagcagaggcagg

SEQ ID NO: 5907104 - DNA, 15 bp, Homo sapiens
gcagcagaggcagga

SEQ ID NO: 5907105 - DNA, 19 bp, Homo sapiens
gcagcagattggaaggaga

SEQ ID NO: 5907106 - DNA, 20 bp, Homo sapiens
gcagcagattggaaggagac

SEQ ID NO: 5907107 - DNA, 21 bp, Homo sapiens
gcagcagattggaaggagaca

SEQ ID NO: 5907108 - DNA, 23 bp, Homo sapiens
gcagcagattggaaggagacaca

SEQ ID NO: 5907109 - DNA, 13 bp, Homo sapiens
gcagcagatttta

SEQ ID NO: 5907110 - DNA, 22 bp, Homo sapiens
gcagcagcacaaacattgctgc

SEQ ID NO: 5907111 - DNA, 13 bp, Homo sapiens
gcagcagcagccc

SEQ ID NO: 5907112 - DNA, 16 bp, Homo sapiens
gcagcagcagccctgc

SEQ ID NO: 5907113 - DNA, 21 bp, Homo sapiens
gcagcagcatcccagccttga

SEQ ID NO: 5907114 - DNA, 11 bp, Homo sapiens
gcagcagccac

SEQ ID NO: 5907115 - DNA, 14 bp, Homo sapiens
gcagcagccagcac

SEQ ID NO: 5907116 - DNA, 16 bp, Homo sapiens
gcagcagccagccctg

SEQ ID NO: 5907117 - DNA, 22 bp, Homo sapiens
gcagcagccagccctgcctgga

SEQ ID NO: 5907118 - DNA, 13 bp, Homo sapiens
gcagcagcccaag

SEQ ID NO: 5907119 - DNA, 12 bp, Homo sapiens
gcagcagcccag

SEQ ID NO: 5907120 - DNA, 13 bp, Homo sapiens
gcagcagccccca

SEQ ID NO: 5907121 - DNA, 20 bp, Homo sapiens
gcagcagcctcgcccctggc

SEQ ID NO: 5907122 - DNA, 23 bp, Homo sapiens
gcagcagcctcgcccctggcaga

SEQ ID NO: 5907123 - DNA, 18 bp, Homo sapiens
gcagcagcctgcacctgc

SEQ ID NO: 5907124 - DNA, 20 bp, Homo sapiens
gcagcagcctgcacctgccc

SEQ ID NO: 5907125 - DNA, 15 bp, Homo sapiens
gcagcagcgggagct

SEQ ID NO: 5907126 - DNA, 20 bp, Homo sapiens
gcagcagctagaaagagaaa

SEQ ID NO: 5907127 - DNA, 16 bp, Homo sapiens
gcagcagctaggactg

SEQ ID NO: 5907128 - DNA, 17 bp, Homo sapiens
gcagcagctaggactga

SEQ ID NO: 5907129 - DNA, 23 bp, Homo sapiens
gcagcagctaggactgaggagtg

SEQ ID NO: 5907130 - DNA, 16 bp, Homo sapiens
gcagcagctcagcctc

SEQ ID NO: 5907131 - DNA, 21 bp, Homo sapiens
gcagcagctcagcctcccccc

SEQ ID NO: 5907132 - DNA, 15 bp, Homo sapiens
gcagcagctctgagc

SEQ ID NO: 5907133 - DNA, 16 bp, Homo sapiens
gcagcagctgaggccc

SEQ ID NO: 5907134 - DNA, 21 bp, Homo sapiens
gcagcagctgggacccctccc

SEQ ID NO: 5907135 - DNA, 23 bp, Homo sapiens
gcagcagctgggacccctcccaa

SEQ ID NO: 5907136 - DNA, 14 bp, Homo sapiens
gcagcagcttctcc

SEQ ID NO: 5907137 - DNA, 16 bp, Homo sapiens
gcagcagcttggggag

SEQ ID NO: 5907138 - DNA, 12 bp, Homo sapiens
gcagcaggaagg

SEQ ID NO: 5907139 - DNA, 16 bp, Homo sapiens
gcagcaggactgtggg

SEQ ID NO: 5907140 - DNA, 17 bp, Homo sapiens
gcagcaggagcggtaga

SEQ ID NO: 5907141 - DNA, 23 bp, Homo sapiens
gcagcaggaggctttctgggctc

SEQ ID NO: 5907142 - DNA, 14 bp, Homo sapiens
gcagcaggagggac

SEQ ID NO: 5907143 - DNA, 14 bp, Homo sapiens
gcagcaggaggggg

SEQ ID NO: 5907144 - DNA, 15 bp, Homo sapiens
gcagcaggagggggg

SEQ ID NO: 5907145 - DNA, 21 bp, Homo sapiens
gcagcaggaggggggagggaa

SEQ ID NO: 5907146 - DNA, 18 bp, Homo sapiens
gcagcaggatagagtggg

SEQ ID NO: 5907147 - DNA, 12 bp, Homo sapiens
gcagcaggatgg

SEQ ID NO: 5907148 - DNA, 16 bp, Homo sapiens
gcagcaggatgggctg

SEQ ID NO: 5907149 - DNA, 15 bp, Homo sapiens
gcagcaggcagagga

SEQ ID NO: 5907150 - DNA, 17 bp, Homo sapiens
gcagcaggcagaggaga

SEQ ID NO: 5907151 - DNA, 19 bp, Homo sapiens
gcagcaggccagagaaagc

SEQ ID NO: 5907152 - DNA, 15 bp, Homo sapiens
gcagcaggcctctgg

SEQ ID NO: 5907153 - DNA, 14 bp, Homo sapiens
gcagcaggctcagg

SEQ ID NO: 5907154 - DNA, 16 bp, Homo sapiens
gcagcaggctcaggca

SEQ ID NO: 5907155 - DNA, 19 bp, Homo sapiens
gcagcagggagggcttctg

SEQ ID NO: 5907156 - DNA, 20 bp, Homo sapiens
gcagcagggatgccctggag

SEQ ID NO: 5907157 - DNA, 12 bp, Homo sapiens
gcagcagggcta

SEQ ID NO: 5907158 - DNA, 20 bp, Homo sapiens
gcagcagggctaccctgagc

SEQ ID NO: 5907159 - DNA, 15 bp, Homo sapiens
gcagcagggctgggc

SEQ ID NO: 5907160 - DNA, 20 bp, Homo sapiens
gcagcaggggccaagcaggc

SEQ ID NO: 5907161 - DNA, 21 bp, Homo sapiens
gcagcaggggccaagcaggca

SEQ ID NO: 5907162 - DNA, 16 bp, Homo sapiens
gcagcaggggctgctg

SEQ ID NO: 5907163 - DNA, 19 bp, Homo sapiens
gcagcaggtagcctgctgg

SEQ ID NO: 5907164 - DNA, 17 bp, Homo sapiens
gcagcaggtgcaagaga

SEQ ID NO: 5907165 - DNA, 18 bp, Homo sapiens
gcagcaggtgcaagagac

SEQ ID NO: 5907166 - DNA, 14 bp, Homo sapiens
gcagcaggtgctgc

SEQ ID NO: 5907167 - DNA, 16 bp, Homo sapiens
gcagcaggtgctgcta

SEQ ID NO: 5907168 - DNA, 17 bp, Homo sapiens
gcagcaggtgctgctac

SEQ ID NO: 5907169 - DNA, 18 bp, Homo sapiens
gcagcaggtgctgggctg

SEQ ID NO: 5907170 - DNA, 15 bp, Homo sapiens
gcagcagtgaaaaca

SEQ ID NO: 5907171 - DNA, 13 bp, Homo sapiens
gcagcagtgagct

SEQ ID NO: 5907172 - DNA, 14 bp, Homo sapiens
gcagcagtgtctgt

SEQ ID NO: 5907173 - DNA, 20 bp, Homo sapiens
gcagcagtgtgaggccaggg

SEQ ID NO: 5907174 - DNA, 20 bp, Homo sapiens
gcagcagttccatgaagaca

SEQ ID NO: 5907175 - DNA, 17 bp, Homo sapiens
gcagcagttgaggtggg

SEQ ID NO: 5907176 - DNA, 18 bp, Homo sapiens
gcagcatattcaggaagc

SEQ ID NO: 5907177 - DNA, 24 bp, Homo sapiens
gcagcatcaacctaggagcagtgg

SEQ ID NO: 5907178 - DNA, 19 bp, Homo sapiens
gcagcatcccagccttgag

SEQ ID NO: 5907179 - DNA, 15 bp, Homo sapiens
gcagcatcctccaaa

SEQ ID NO: 5907180 - DNA, 22 bp, Homo sapiens
gcagcatctctaccttctcccc

SEQ ID NO: 5907181 - DNA, 15 bp, Homo sapiens
gcagcatcttcaaac

SEQ ID NO: 5907182 - DNA, 19 bp, Homo sapiens
gcagcatcttcacttctaa

SEQ ID NO: 5907183 - DNA, 12 bp, Homo sapiens
gcagcatcttct

SEQ ID NO: 5907184 - DNA, 14 bp, Homo sapiens
gcagcatcttctgg

SEQ ID NO: 5907185 - DNA, 17 bp, Homo sapiens
gcagcatgacctgtgac

SEQ ID NO: 5907186 - DNA, 15 bp, Homo sapiens
gcagcatgagacttt

SEQ ID NO: 5907187 - DNA, 14 bp, Homo sapiens
gcagcatgcccagt

SEQ ID NO: 5907188 - DNA, 20 bp, Homo sapiens
gcagcatgcttgggctgacc

SEQ ID NO: 5907189 - DNA, 14 bp, Homo sapiens
gcagcatggaaaaa

SEQ ID NO: 5907190 - DNA, 23 bp, Homo sapiens
gcagcatggaaaaatggttgatg

SEQ ID NO: 5907191 - DNA, 14 bp, Homo sapiens
gcagcatggaggaa

SEQ ID NO: 5907192 - DNA, 18 bp, Homo sapiens
gcagcatggggtttttat

SEQ ID NO: 5907193 - DNA, 15 bp, Homo sapiens
gcagcatggtccctg

SEQ ID NO: 5907194 - DNA, 10 bp, Homo sapiens
gcagcatgtg

SEQ ID NO: 5907195 - DNA, 20 bp, Homo sapiens
gcagcatgttgctgaggagt

SEQ ID NO: 5907196 - DNA, 14 bp, Homo sapiens
gcagcattcagcac

SEQ ID NO: 5907197 - DNA, 21 bp, Homo sapiens
gcagcattcagcacaccccaa

SEQ ID NO: 5907198 - DNA, 14 bp, Homo sapiens
gcagcattcccacc

SEQ ID NO: 5907199 - DNA, 18 bp, Homo sapiens
gcagcattcccaccaaca

SEQ ID NO: 5907200 - DNA, 18 bp, Homo sapiens
gcagcattcccagggacc

SEQ ID NO: 5907201 - DNA, 17 bp, Homo sapiens
gcagcattttgctgctt

SEQ ID NO: 5907202 - DNA, 13 bp, Homo sapiens
gcagcatttttaa

SEQ ID NO: 5907203 - DNA, 18 bp, Homo sapiens
gcagccaaacagagcctt

SEQ ID NO: 5907204 - DNA, 15 bp, Homo sapiens
gcagccaaaggggag

SEQ ID NO: 5907205 - DNA, 15 bp, Homo sapiens
gcagccaagagccat

SEQ ID NO: 5907206 - DNA, 17 bp, Homo sapiens
gcagccaagctccttgg

SEQ ID NO: 5907207 - DNA, 20 bp, Homo sapiens
gcagccaagctccttgggag

SEQ ID NO: 5907208 - DNA, 12 bp, Homo sapiens
gcagccaaggaa

SEQ ID NO: 5907209 - DNA, 17 bp, Homo sapiens
gcagccaaggaatgtgt

SEQ ID NO: 5907210 - DNA, 22 bp, Homo sapiens
gcagccaaggccgaagctctgg

SEQ ID NO: 5907211 - DNA, 22 bp, Homo sapiens
gcagccaaggccgccagcgtgt

SEQ ID NO: 5907212 - DNA, 12 bp, Homo sapiens
gcagccaaggga

SEQ ID NO: 5907213 - DNA, 17 bp, Homo sapiens
gcagccacacagtggcc

SEQ ID NO: 5907214 - DNA, 19 bp, Homo sapiens
gcagccacacagtggccgg

SEQ ID NO: 5907215 - DNA, 20 bp, Homo sapiens
gcagccacacagtggccggg

SEQ ID NO: 5907216 - DNA, 23 bp, Homo sapiens
gcagccacacagtggccggggct

SEQ ID NO: 5907217 - DNA, 22 bp, Homo sapiens
gcagccacacgcaggcggccag

SEQ ID NO: 5907218 - DNA, 17 bp, Homo sapiens
gcagccacacttccttt

SEQ ID NO: 5907219 - DNA, 18 bp, Homo sapiens
gcagccacacttccttta

SEQ ID NO: 5907220 - DNA, 11 bp, Homo sapiens
gcagccacagg

SEQ ID NO: 5907221 - DNA, 12 bp, Homo sapiens
gcagccacagga

SEQ ID NO: 5907222 - DNA, 15 bp, Homo sapiens
gcagccacattcctg

SEQ ID NO: 5907223 - DNA, 15 bp, Homo sapiens
gcagccaccagtgga

SEQ ID NO: 5907224 - DNA, 23 bp, Homo sapiens
gcagccacccaagcctgctggct

SEQ ID NO: 5907225 - DNA, 14 bp, Homo sapiens
gcagccaccctgag

SEQ ID NO: 5907226 - DNA, 17 bp, Homo sapiens
gcagccaccctgccatg

SEQ ID NO: 5907227 - DNA, 22 bp, Homo sapiens
gcagccaccctgccatggaggc

SEQ ID NO: 5907228 - DNA, 17 bp, Homo sapiens
gcagccacggccccggg

SEQ ID NO: 5907229 - DNA, 23 bp, Homo sapiens
gcagccacggccccgggtccagg

SEQ ID NO: 5907230 - DNA, 22 bp, Homo sapiens
gcagctcacaccctaccttccc

SEQ ID NO: 5907231 - DNA, 13 bp, Homo sapiens
gcagctcacccct

SEQ ID NO: 5907232 - DNA, 14 bp, Homo sapiens
gcagctcacccctg

SEQ ID NO: 5907233 - DNA, 15 bp, Homo sapiens
gcagctcacccctgg

SEQ ID NO: 5907234 - DNA, 18 bp, Homo sapiens
gcagctcacccctgggca

SEQ ID NO: 5907235 - DNA, 21 bp, Homo sapiens
gcagctcacccctgggcaggc

SEQ ID NO: 5907236 - DNA, 20 bp, Homo sapiens
gcagctcacctctcccttgg

SEQ ID NO: 5907237 - DNA, 21 bp, Homo sapiens
gcagctcactgctgctgcctc

SEQ ID NO: 5907238 - DNA, 19 bp, Homo sapiens
gcagctcagagagggtggg

SEQ ID NO: 5907239 - DNA, 23 bp, Homo sapiens
gcagctcagccaccactcagtgc

SEQ ID NO: 5907240 - DNA, 17 bp, Homo sapiens
gcagctcagcctccccc

SEQ ID NO: 5907241 - DNA, 20 bp, Homo sapiens
gcagctcaggcgcagcccta

SEQ ID NO: 5907242 - DNA, 19 bp, Homo sapiens
gcagctcaggttgtagtgg

SEQ ID NO: 5907243 - DNA, 20 bp, Homo sapiens
gcagctcataagagccacag

SEQ ID NO: 5907244 - DNA, 23 bp, Homo sapiens
gcagctcatagagtcccccctcc

SEQ ID NO: 5907245 - DNA, 18 bp, Homo sapiens
gcagctccaacctggagg

SEQ ID NO: 5907246 - DNA, 18 bp, Homo sapiens
gcagctccaccactgtgc

SEQ ID NO: 5907247 - DNA, 16 bp, Homo sapiens
gcagctccatcctctt

SEQ ID NO: 5907248 - DNA, 20 bp, Homo sapiens
gcagctcccaggtttagaga

SEQ ID NO: 5907249 - DNA, 15 bp, Homo sapiens
gcagctccccaggag

SEQ ID NO: 5907250 - DNA, 18 bp, Homo sapiens
gcagctccccaggagctc

SEQ ID NO: 5907251 - DNA, 22 bp, Homo sapiens
gcagctcccctgggggctagca

SEQ ID NO: 5907252 - DNA, 14 bp, Homo sapiens
gcagctcccgcagg

SEQ ID NO: 5907253 - DNA, 17 bp, Homo sapiens
gcagctcccgcagggct

SEQ ID NO: 5907254 - DNA, 15 bp, Homo sapiens
gcagctccctcctca

SEQ ID NO: 5907255 - DNA, 17 bp, Homo sapiens
gcagctccctcctcagg

SEQ ID NO: 5907256 - DNA, 15 bp, Homo sapiens
gcagctccctcctgc

SEQ ID NO: 5907257 - DNA, 13 bp, Homo sapiens
gcagctccctggc

SEQ ID NO: 5907258 - DNA, 17 bp, Homo sapiens
gcagctccctggcttct

SEQ ID NO: 5907259 - DNA, 19 bp, Homo sapiens
gcagctccctttctcagga

SEQ ID NO: 5907260 - DNA, 22 bp, Homo sapiens
gcagctccctttctcaggagct

SEQ ID NO: 5907261 - DNA, 17 bp, Homo sapiens
gcagctccgcctggcac

SEQ ID NO: 5907262 - DNA, 19 bp, Homo sapiens
gcagctccgcctggcaccc

SEQ ID NO: 5907263 - DNA, 19 bp, Homo sapiens
gcagctcctctccttgggc

SEQ ID NO: 5907264 - DNA, 11 bp, Homo sapiens
gcagctcctga

SEQ ID NO: 5907265 - DNA, 18 bp, Homo sapiens
gcagctcctgaccaaaga

SEQ ID NO: 5907266 - DNA, 14 bp, Homo sapiens
gcagctcctgacct

SEQ ID NO: 5907267 - DNA, 18 bp, Homo sapiens
gcagctcctgaccttggg

SEQ ID NO: 5907268 - DNA, 23 bp, Homo sapiens
gcagctcctgaccttgggtcctg

SEQ ID NO: 5907269 - DNA, 20 bp, Homo sapiens
gcagctcgagcatgccctga

SEQ ID NO: 5907270 - DNA, 23 bp, Homo sapiens
gcagctctaaaacatagactgaa

SEQ ID NO: 5907271 - DNA, 12 bp, Homo sapiens
gcagctctcccc

SEQ ID NO: 5907272 - DNA, 22 bp, Homo sapiens
gcagctctccgccaatttctct

SEQ ID NO: 5907273 - DNA, 13 bp, Homo sapiens
gcagctctctttc

SEQ ID NO: 5907274 - DNA, 14 bp, Homo sapiens
gcagctctgagaca

SEQ ID NO: 5907275 - DNA, 13 bp, Homo sapiens
gcagctctgcctt

SEQ ID NO: 5907276 - DNA, 16 bp, Homo sapiens
gcagctctggctctgc

SEQ ID NO: 5907277 - DNA, 19 bp, Homo sapiens
gcagctcttcccctttcct

SEQ ID NO: 5907278 - DNA, 16 bp, Homo sapiens
gcagctcttctggagt

SEQ ID NO: 5907279 - DNA, 23 bp, Homo sapiens
gcagctcttctggagtttctcta

SEQ ID NO: 5907280 - DNA, 20 bp, Homo sapiens
gcagctcttctgggcagagc

SEQ ID NO: 5907281 - DNA, 14 bp, Homo sapiens
gcagctcttgccct

SEQ ID NO: 5907282 - DNA, 15 bp, Homo sapiens
gcagctcttgccctt

SEQ ID NO: 5907283 - DNA, 23 bp, Homo sapiens
gcagctcttgctaatcagtgtct

SEQ ID NO: 5907284 - DNA, 15 bp, Homo sapiens
gcagctctttcttct

SEQ ID NO: 5907285 - DNA, 17 bp, Homo sapiens
gcagctctttcttcttt

SEQ ID NO: 5907286 - DNA, 22 bp, Homo sapiens
gcagctgaaatatgctggctgg

SEQ ID NO: 5907287 - DNA, 22 bp, Homo sapiens
gcagctgaagccagctccctga

SEQ ID NO: 5907288 - DNA, 13 bp, Homo sapiens
gcagctgaagcct

SEQ ID NO: 5907289 - DNA, 15 bp, Homo sapiens
gcagctgaagcctgg

SEQ ID NO: 5907290 - DNA, 17 bp, Homo sapiens
gcagctgaagcctggac

SEQ ID NO: 5907291 - DNA, 22 bp, Homo sapiens
gcagctgaagcctggacgcagc

SEQ ID NO: 5907292 - DNA, 23 bp, Homo sapiens
gcagctgacttggttctgaagcc

SEQ ID NO: 5907293 - DNA, 14 bp, Homo sapiens
gcagctgagaccag

SEQ ID NO: 5907294 - DNA, 17 bp, Homo sapiens
gcagctgagaccagggt

SEQ ID NO: 5907295 - DNA, 18 bp, Homo sapiens
gcagctgagaccagggtc

SEQ ID NO: 5907296 - DNA, 16 bp, Homo sapiens
gcagctgagagccctg

SEQ ID NO: 5907297 - DNA, 17 bp, Homo sapiens
gcagctgagagccctgc

SEQ ID NO: 5907298 - DNA, 21 bp, Homo sapiens
gcagctgagagccctgctgtg

SEQ ID NO: 5907299 - DNA, 12 bp, Homo sapiens
gcagctgagcag

SEQ ID NO: 5907300 - DNA, 17 bp, Homo sapiens
gcagctgagcagggccg

SEQ ID NO: 5907301 - DNA, 21 bp, Homo sapiens
gcagctgaggacacaccccac

SEQ ID NO: 5907302 - DNA, 12 bp, Homo sapiens
gcagctgaggcc

SEQ ID NO: 5907303 - DNA, 15 bp, Homo sapiens
gcagctgaggcccca

SEQ ID NO: 5907304 - DNA, 19 bp, Homo sapiens
gcagctgatgcctccttgg

SEQ ID NO: 5907305 - DNA, 14 bp, Homo sapiens
gcagctgattttaa

SEQ ID NO: 5907306 - DNA, 17 bp, Homo sapiens
gcagctgattttaacaa

SEQ ID NO: 5907307 - DNA, 15 bp, Homo sapiens
gcagctgattttgtc

SEQ ID NO: 5907308 - DNA, 20 bp, Homo sapiens
gcagctgcaccccagcgtca

SEQ ID NO: 5907309 - DNA, 15 bp, Homo sapiens
gcagctgccagagaa

SEQ ID NO: 5907310 - DNA, 17 bp, Homo sapiens
gcagctgccaggagcac

SEQ ID NO: 5907311 - DNA, 21 bp, Homo sapiens
gcagctgccaggagcacggct

SEQ ID NO: 5907312 - DNA, 18 bp, Homo sapiens
gcagctgcccctcctgga

SEQ ID NO: 5907313 - DNA, 24 bp, Homo sapiens
gcagctgcccctcctggagcagaa

SEQ ID NO: 5907314 - DNA, 11 bp, Homo sapiens
gcagctgccta

SEQ ID NO: 5907315 - DNA, 11 bp, Homo sapiens
gcagctgcctc

SEQ ID NO: 5907316 - DNA, 12 bp, Homo sapiens
gcagctgcctcc

SEQ ID NO: 5907317 - DNA, 13 bp, Homo sapiens
gcagctgcctctg

SEQ ID NO: 5907318 - DNA, 17 bp, Homo sapiens
gcagctgcctctgctcc

SEQ ID NO: 5907319 - DNA, 13 bp, Homo sapiens
gcagctgcctggc

SEQ ID NO: 5907320 - DNA, 14 bp, Homo sapiens
gcagctgcctggcc

SEQ ID NO: 5907321 - DNA, 15 bp, Homo sapiens
gcagctgcctggcca

SEQ ID NO: 5907322 - DNA, 14 bp, Homo sapiens
gcagctgcctgggg

SEQ ID NO: 5907323 - DNA, 14 bp, Homo sapiens
gcagctgcgggtct

SEQ ID NO: 5907324 - DNA, 20 bp, Homo sapiens
gcagctgcgggtctgaagga

SEQ ID NO: 5907325 - DNA, 9 bp, Homo sapiens
gcagctgct

SEQ ID NO: 5907326 - DNA, 13 bp, Homo sapiens
gcagctgctcccc

SEQ ID NO: 5907327 - DNA, 11 bp, Homo sapiens
gcagctgctct

SEQ ID NO: 5907328 - DNA, 13 bp, Homo sapiens
gcagctgctctta

SEQ ID NO: 5907329 - DNA, 13 bp, Homo sapiens
gcagctgctgcca

SEQ ID NO: 5907330 - DNA, 14 bp, Homo sapiens
gcagctgctgccac

SEQ ID NO: 5907331 - DNA, 17 bp, Homo sapiens
gcagctgctgccactct

SEQ ID NO: 5907332 - DNA, 19 bp, Homo sapiens
gcagctgctgtctgagtag

SEQ ID NO: 5907333 - DNA, 13 bp, Homo sapiens
gcagctgctgtgg

SEQ ID NO: 5907334 - DNA, 13 bp, Homo sapiens
gcagctgcttttg

SEQ ID NO: 5907335 - DNA, 23 bp, Homo sapiens
gcagctggaaaagggtcttggga

SEQ ID NO: 5907336 - DNA, 20 bp, Homo sapiens
gcagctggaatgtgccacag

SEQ ID NO: 5907337 - DNA, 21 bp, Homo sapiens
gcagctggaatgtgccacaga

SEQ ID NO: 5907338 - DNA, 24 bp, Homo sapiens
gcagctggaatgtgccacagaggc

SEQ ID NO: 5907339 - DNA, 23 bp, Homo sapiens
gcagctggacagaggggactctg

SEQ ID NO: 5907340 - DNA, 18 bp, Homo sapiens
gcagctggaccatctctg

SEQ ID NO: 5907341 - DNA, 15 bp, Homo sapiens
gcagctggactaccc

SEQ ID NO: 5907342 - DNA, 16 bp, Homo sapiens
gcagctggactgggtg

SEQ ID NO: 5907343 - DNA, 19 bp, Homo sapiens
gcagctggcactgacagcc

SEQ ID NO: 5907344 - DNA, 12 bp, Homo sapiens
gcagctggcagg

SEQ ID NO: 5907345 - DNA, 18 bp, Homo sapiens
gcagctggcaggagtggg

SEQ ID NO: 5907346 - DNA, 19 bp, Homo sapiens
gcagctggcccactgctgg

SEQ ID NO: 5907347 - DNA, 18 bp, Homo sapiens
gcagctggcccccagccc

SEQ ID NO: 5907348 - DNA, 21 bp, Homo sapiens
gcagctggcgcgtgtgtggcc

SEQ ID NO: 5907349 - DNA, 12 bp, Homo sapiens
gcagctggctct

SEQ ID NO: 5907350 - DNA, 19 bp, Homo sapiens
gcagctgggacccctccca

SEQ ID NO: 5907351 - DNA, 17 bp, Homo sapiens
gcagctgggagaagggg

SEQ ID NO: 5907352 - DNA, 13 bp, Homo sapiens
gcagctgggcact

SEQ ID NO: 5907353 - DNA, 11 bp, Homo sapiens
gcagctgggcc

SEQ ID NO: 5907354 - DNA, 14 bp, Homo sapiens
gcagctgggcccaa

SEQ ID NO: 5907355 - DNA, 15 bp, Homo sapiens
gcagctgggcccaac

SEQ ID NO: 5907356 - DNA, 22 bp, Homo sapiens
gcagctgggcccaaccctgtct

SEQ ID NO: 5907357 - DNA, 14 bp, Homo sapiens
gcagctgggcccac

SEQ ID NO: 5907358 - DNA, 17 bp, Homo sapiens
gcagctgggcccacagc

SEQ ID NO: 5907359 - DNA, 23 bp, Homo sapiens
gcagctgggcccacagcccccac

SEQ ID NO: 5907360 - DNA, 14 bp, Homo sapiens
gcagctgggcccca

SEQ ID NO: 5907361 - DNA, 16 bp, Homo sapiens
gcagctgggccccatg

SEQ ID NO: 5907362 - DNA, 17 bp, Homo sapiens
gcagctgggccccatgc

SEQ ID NO: 5907363 - DNA, 20 bp, Homo sapiens
gcagctgggccccatgctct

SEQ ID NO: 5907364 - DNA, 12 bp, Homo sapiens
gcagctgggccg

SEQ ID NO: 5907365 - DNA, 16 bp, Homo sapiens
gcagctgggccggcca

SEQ ID NO: 5907366 - DNA, 22 bp, Homo sapiens
gcagctgggcttggcctggaga

SEQ ID NO: 5907367 - DNA, 20 bp, Homo sapiens
gcagctggggagcagctgag

SEQ ID NO: 5907368 - DNA, 18 bp, Homo sapiens
gcagctggggggcaccgg

SEQ ID NO: 5907369 - DNA, 19 bp, Homo sapiens
gcagctggggggctgtcct

SEQ ID NO: 5907370 - DNA, 20 bp, Homo sapiens
gcagctggggggctgtcctg

SEQ ID NO: 5907371 - DNA, 15 bp, Homo sapiens
gcagctggggtaggc

SEQ ID NO: 5907372 - DNA, 14 bp, Homo sapiens
gcagctgggtgcag

SEQ ID NO: 5907373 - DNA, 12 bp, Homo sapiens
gcagctgggtgg

SEQ ID NO: 5907374 - DNA, 12 bp, Homo sapiens
gcagctggtgtg

SEQ ID NO: 5907375 - DNA, 18 bp, Homo sapiens
gcagctggtgtgggaact

SEQ ID NO: 5907376 - DNA, 12 bp, Homo sapiens
gcagctgtcacc

SEQ ID NO: 5907377 - DNA, 17 bp, Homo sapiens
gcagctgtcattcagga

SEQ ID NO: 5907378 - DNA, 17 bp, Homo sapiens
gcagctgtcccctctcc

SEQ ID NO: 5907379 - DNA, 18 bp, Homo sapiens
gcagctgtcctgtgatgt

SEQ ID NO: 5907380 - DNA, 20 bp, Homo sapiens
gcagctgtcctgtgatgtca

SEQ ID NO: 5907381 - DNA, 21 bp, Homo sapiens
gcagctgtcctgtgatgtcag

SEQ ID NO: 5907382 - DNA, 22 bp, Homo sapiens
gcagctgtctaaaatgcagtgg

SEQ ID NO: 5907383 - DNA, 13 bp, Homo sapiens
gcagctgtgtctg

SEQ ID NO: 5907384 - DNA, 14 bp, Homo sapiens
gcagctgtgtctga

SEQ ID NO: 5907385 - DNA, 17 bp, Homo sapiens
gcagctgtgtctgagcc

SEQ ID NO: 5907386 - DNA, 22 bp, Homo sapiens
gcagctgtgtctgagcccaacc

SEQ ID NO: 5907387 - DNA, 17 bp, Homo sapiens
gcagctgttagagtcca

SEQ ID NO: 5907388 - DNA, 21 bp, Homo sapiens
gcagctgttgagaaaacgaag

SEQ ID NO: 5907389 - DNA, 14 bp, Homo sapiens
gcagctgtttctca

SEQ ID NO: 5907390 - DNA, 16 bp, Homo sapiens
gcagctgtttctcatg

SEQ ID NO: 5907391 - DNA, 18 bp, Homo sapiens
gcagctgtttctcatgaa

SEQ ID NO: 5907392 - DNA, 17 bp, Homo sapiens
gcagctgtttctggaaa

SEQ ID NO: 5907393 - DNA, 16 bp, Homo sapiens
gcagcttaagtccagc

SEQ ID NO: 5907394 - DNA, 20 bp, Homo sapiens
gcagcttaagtccagctcat

SEQ ID NO: 5907395 - DNA, 18 bp, Homo sapiens
gcagcttagggccctgga

SEQ ID NO: 5907396 - DNA, 21 bp, Homo sapiens
gcagcttcaacttttctcttt

SEQ ID NO: 5907397 - DNA, 16 bp, Homo sapiens
gcagcttcaagtgcct

SEQ ID NO: 5907398 - DNA, 14 bp, Homo sapiens
gcagcttcaccaga

SEQ ID NO: 5907399 - DNA, 21 bp, Homo sapiens
gcagcttcacccaccaggcca

SEQ ID NO: 5907400 - DNA, 15 bp, Homo sapiens
gcagcttcaggtgag

SEQ ID NO: 5907401 - DNA, 23 bp, Homo sapiens
gcagcttccttccaagtcttcct

SEQ ID NO: 5907402 - DNA, 15 bp, Homo sapiens
gcagcttcgaggaca

SEQ ID NO: 5907403 - DNA, 18 bp, Homo sapiens
gcagcttcggtgtgcaga

SEQ ID NO: 5907404 - DNA, 21 bp, Homo sapiens
gcagcttctactcctgcctca

SEQ ID NO: 5907405 - DNA, 15 bp, Homo sapiens
gcagcttctagacag

SEQ ID NO: 5907406 - DNA, 15 bp, Homo sapiens
gcagcttctgccact

SEQ ID NO: 5907407 - DNA, 17 bp, Homo sapiens
gcagcttcttgggctga

SEQ ID NO: 5907408 - DNA, 21 bp, Homo sapiens
gcagcttcttgggctgagtgc

SEQ ID NO: 5907409 - DNA, 14 bp, Homo sapiens
gcaggcggtgggca

SEQ ID NO: 5907410 - DNA, 16 bp, Homo sapiens
gcaggcggtgggcacc

SEQ ID NO: 5907411 - DNA, 17 bp, Homo sapiens
gcaggcgtgactcagca

SEQ ID NO: 5907412 - DNA, 21 bp, Homo sapiens
gcaggcgtgactcagcagcct

SEQ ID NO: 5907413 - DNA, 14 bp, Homo sapiens
gcaggcgtgcctcg

SEQ ID NO: 5907414 - DNA, 20 bp, Homo sapiens
gcaggcgtgtggcagccaca

SEQ ID NO: 5907415 - DNA, 22 bp, Homo sapiens
gcaggcgtgtggcagccacacg

SEQ ID NO: 5907416 - DNA, 19 bp, Homo sapiens
gcaggcgttcagctcactg

SEQ ID NO: 5907417 - DNA, 17 bp, Homo sapiens
gcaggctactctgccca

SEQ ID NO: 5907418 - DNA, 14 bp, Homo sapiens
gcaggctcactgcc

SEQ ID NO: 5907419 - DNA, 23 bp, Homo sapiens
gcaggctccatgcacctcccttc

SEQ ID NO: 5907420 - DNA, 16 bp, Homo sapiens
gcaggctcccctgagg

SEQ ID NO: 5907421 - DNA, 19 bp, Homo sapiens
gcaggctcccgagtggggc

SEQ ID NO: 5907422 - DNA, 18 bp, Homo sapiens
gcaggctcctcagccctc

SEQ ID NO: 5907423 - DNA, 20 bp, Homo sapiens
gcaggctcctcagccctctc

SEQ ID NO: 5907424 - DNA, 21 bp, Homo sapiens
gcaggctcctcagccctctct

SEQ ID NO: 5907425 - DNA, 24 bp, Homo sapiens
gcaggctcctcctctctggacttt

SEQ ID NO: 5907426 - DNA, 20 bp, Homo sapiens
gcaggctcctggctgtgccc

SEQ ID NO: 5907427 - DNA, 22 bp, Homo sapiens
gcaggctcgggctccccagccc

SEQ ID NO: 5907428 - DNA, 14 bp, Homo sapiens
gcaggctctcaggc

SEQ ID NO: 5907429 - DNA, 17 bp, Homo sapiens
gcaggctctcaggccag

SEQ ID NO: 5907430 - DNA, 22 bp, Homo sapiens
gcaggctctcaggccagctgct

SEQ ID NO: 5907431 - DNA, 23 bp, Homo sapiens
gcaggctctcaggccagctgctt

SEQ ID NO: 5907432 - DNA, 13 bp, Homo sapiens
gcaggctctgggc

SEQ ID NO: 5907433 - DNA, 14 bp, Homo sapiens
gcaggctctgggct

SEQ ID NO: 5907434 - DNA, 20 bp, Homo sapiens
gcaggctctgggctcagggc

SEQ ID NO: 5907435 - DNA, 23 bp, Homo sapiens
gcaggctctgggctcagggctgg

SEQ ID NO: 5907436 - DNA, 19 bp, Homo sapiens
gcaggctgaggtggggaag

SEQ ID NO: 5907437 - DNA, 19 bp, Homo sapiens
gcaggctgcaaccctggtg

SEQ ID NO: 5907438 - DNA, 19 bp, Homo sapiens
gcaggctgcacctctggct

SEQ ID NO: 5907439 - DNA, 21 bp, Homo sapiens
gcaggctgcacctctggctag

SEQ ID NO: 5907440 - DNA, 20 bp, Homo sapiens
gcaggctgcagcaggcagag

SEQ ID NO: 5907441 - DNA, 17 bp, Homo sapiens
gcaggctgcaggagggc

SEQ ID NO: 5907442 - DNA, 16 bp, Homo sapiens
gcaggctgcagtggct

SEQ ID NO: 5907443 - DNA, 18 bp, Homo sapiens
gcaggctgccagtgcctg

SEQ ID NO: 5907444 - DNA, 17 bp, Homo sapiens
gcaggctggcctatgtg

SEQ ID NO: 5907445 - DNA, 15 bp, Homo sapiens
gcaggctggctggcc

SEQ ID NO: 5907446 - DNA, 20 bp, Homo sapiens
gcaggctgtggggcagctga

SEQ ID NO: 5907447 - DNA, 22 bp, Homo sapiens
gcaggcttaataaaaatgacag

SEQ ID NO: 5907448 - DNA, 13 bp, Homo sapiens
gcaggcttccccc

SEQ ID NO: 5907449 - DNA, 15 bp, Homo sapiens
gcaggcttccccctt

SEQ ID NO: 5907450 - DNA, 20 bp, Homo sapiens
gcaggcttcgtttgcctcca

SEQ ID NO: 5907451 - DNA, 22 bp, Homo sapiens
gcaggcttcgtttgcctccaga

SEQ ID NO: 5907452 - DNA, 13 bp, Homo sapiens
gcaggcttgggga

SEQ ID NO: 5907453 - DNA, 16 bp, Homo sapiens
gcaggcttgtggcagc

SEQ ID NO: 5907454 - DNA, 21 bp, Homo sapiens
gcaggctttgggaacactggc

SEQ ID NO: 5907455 - DNA, 23 bp, Homo sapiens
gcaggctttgggaacactggcct

SEQ ID NO: 5907456 - DNA, 15 bp, Homo sapiens
gcaggctttgtgaga

SEQ ID NO: 5907457 - DNA, 23 bp, Homo sapiens
gcaggctttgtgagagaggacct

SEQ ID NO: 5907458 - DNA, 16 bp, Homo sapiens
gcaggcttttgtgttc

SEQ ID NO: 5907459 - DNA, 13 bp, Homo sapiens
gcagggaaacagc

SEQ ID NO: 5907460 - DNA, 15 bp, Homo sapiens
gcagggaaagctcca

SEQ ID NO: 5907461 - DNA, 17 bp, Homo sapiens
gcagggaacatggggag

SEQ ID NO: 5907462 - DNA, 16 bp, Homo sapiens
gcagggaagagggcag

SEQ ID NO: 5907463 - DNA, 17 bp, Homo sapiens
gcagggaagagggcagt

SEQ ID NO: 5907464 - DNA, 18 bp, Homo sapiens
gcagggaaggaatcctgg

SEQ ID NO: 5907465 - DNA, 17 bp, Homo sapiens
gcagggaaggagacacc

SEQ ID NO: 5907466 - DNA, 14 bp, Homo sapiens
gcagggaaggcctg

SEQ ID NO: 5907467 - DNA, 20 bp, Homo sapiens
gcagggaaggggaggcagcc

SEQ ID NO: 5907468 - DNA, 17 bp, Homo sapiens
gcagggaagggtgcctg

SEQ ID NO: 5907469 - DNA, 18 bp, Homo sapiens
gcagggaagggtgcctgg

SEQ ID NO: 5907470 - DNA, 19 bp, Homo sapiens
gcagggaagggtgcctggc

SEQ ID NO: 5907471 - DNA, 22 bp, Homo sapiens
gcagggaagggtgcctggctgg

SEQ ID NO: 5907472 - DNA, 21 bp, Homo sapiens
gcagggaagtcttacttaaaa

SEQ ID NO: 5907473 - DNA, 15 bp, Homo sapiens
gcagggaatgcagca

SEQ ID NO: 5907474 - DNA, 16 bp, Homo sapiens
gcagggaatgcagcag

SEQ ID NO: 5907475 - DNA, 17 bp, Homo sapiens
gcagggaatgcctggag

SEQ ID NO: 5907476 - DNA, 18 bp, Homo sapiens
gcagggaatgcctggagg

SEQ ID NO: 5907477 - DNA, 18 bp, Homo sapiens
gcagggaattaatgacag

SEQ ID NO: 5907478 - DNA, 16 bp, Homo sapiens
gcagggacaagccctg

SEQ ID NO: 5907479 - DNA, 14 bp, Homo sapiens
gcagggacaccccc

SEQ ID NO: 5907480 - DNA, 15 bp, Homo sapiens
gcagggacacccccc

SEQ ID NO: 5907481 - DNA, 14 bp, Homo sapiens
gcagggacatgggg

SEQ ID NO: 5907482 - DNA, 16 bp, Homo sapiens
gcagggacatggggca

SEQ ID NO: 5907483 - DNA, 18 bp, Homo sapiens
gcagggacatggggcaag

SEQ ID NO: 5907484 - DNA, 21 bp, Homo sapiens
gcagggacccggggtctcctg

SEQ ID NO: 5907485 - DNA, 23 bp, Homo sapiens
gcagggacccggggtctcctgga

SEQ ID NO: 5907486 - DNA, 18 bp, Homo sapiens
gcagggaccggcagagct

SEQ ID NO: 5907487 - DNA, 19 bp, Homo sapiens
gcagggaccggcagagctc

SEQ ID NO: 5907488 - DNA, 15 bp, Homo sapiens
gcagggacctgagag

SEQ ID NO: 5907489 - DNA, 20 bp, Homo sapiens
gcagggagacatctgcaccc

SEQ ID NO: 5907490 - DNA, 13 bp, Homo sapiens
gcagggagaccag

SEQ ID NO: 5907491 - DNA, 14 bp, Homo sapiens
gcagggagaccctg

SEQ ID NO: 5907492 - DNA, 23 bp, Homo sapiens
gcagggagagagtagctgcagcc

SEQ ID NO: 5907493 - DNA, 19 bp, Homo sapiens
gcagggagagcgcctcttc

SEQ ID NO: 5907494 - DNA, 22 bp, Homo sapiens
gcagggagaggagtgactgagc

SEQ ID NO: 5907495 - DNA, 15 bp, Homo sapiens
gcagggagagttggg

SEQ ID NO: 5907496 - DNA, 19 bp, Homo sapiens
gcagggagcaactctccac

SEQ ID NO: 5907497 - DNA, 22 bp, Homo sapiens
gcagggagccgagatcacgcca

SEQ ID NO: 5907498 - DNA, 17 bp, Homo sapiens
gcagggagctgggcttc

SEQ ID NO: 5907499 - DNA, 16 bp, Homo sapiens
gcagggaggaagaagc

SEQ ID NO: 5907500 - DNA, 13 bp, Homo sapiens
gcagggaggagtg

SEQ ID NO: 5907501 - DNA, 14 bp, Homo sapiens
gcagggaggagtgg

SEQ ID NO: 5907502 - DNA, 20 bp, Homo sapiens
gcagggaggatgccacagcc

SEQ ID NO: 5907503 - DNA, 13 bp, Homo sapiens
gcagggaggcagc

SEQ ID NO: 5907504 - DNA, 10 bp, Homo sapiens
gcagggaggg

SEQ ID NO: 5907505 - DNA, 21 bp, Homo sapiens
gcagggagggaaacccgggga

SEQ ID NO: 5907506 - DNA, 13 bp, Homo sapiens
gcagggagggcct

SEQ ID NO: 5907507 - DNA, 22 bp, Homo sapiens
gcagggagggcctgggccccag

SEQ ID NO: 5907508 - DNA, 20 bp, Homo sapiens
gcagggaggggaggcagatg

SEQ ID NO: 5907509 - DNA, 19 bp, Homo sapiens
gcagggaggggctggggca

SEQ ID NO: 5907510 - DNA, 20 bp, Homo sapiens
gcagggaggggctggggcag

SEQ ID NO: 5907511 - DNA, 21 bp, Homo sapiens
gcagggagggggctgggaaag

SEQ ID NO: 5907512 - DNA, 15 bp, Homo sapiens
gcagggaggtcaggc

SEQ ID NO: 5907513 - DNA, 17 bp, Homo sapiens
gcagggagtgtctgcag

SEQ ID NO: 5907514 - DNA, 19 bp, Homo sapiens
gcagggatgataggccctg

SEQ ID NO: 5907515 - DNA, 21 bp, Homo sapiens
gcagggatgatggcagagcca

SEQ ID NO: 5907516 - DNA, 23 bp, Homo sapiens
gcagggatgtgggttccacagac

SEQ ID NO: 5907517 - DNA, 19 bp, Homo sapiens
gcagggattaacctctgca

SEQ ID NO: 5907518 - DNA, 19 bp, Homo sapiens
gcagggattgctgccactt

SEQ ID NO: 5907519 - DNA, 22 bp, Homo sapiens
gcagggcaaatgacatgcactg

SEQ ID NO: 5907520 - DNA, 12 bp, Homo sapiens
gcagggcacagg

SEQ ID NO: 5907521 - DNA, 16 bp, Homo sapiens
gcagggcacagggcct

SEQ ID NO: 5907522 - DNA, 22 bp, Homo sapiens
gcagggcacagggcctggccca

SEQ ID NO: 5907523 - DNA, 15 bp, Homo sapiens
gcagggcagagggaa

SEQ ID NO: 5907524 - DNA, 15 bp, Homo sapiens
gcagggcagccccac

SEQ ID NO: 5907525 - DNA, 12 bp, Homo sapiens
gcagggcagccg

SEQ ID NO: 5907526 - DNA, 21 bp, Homo sapiens
gcagggcagcctgtgggagaa

SEQ ID NO: 5907527 - DNA, 17 bp, Homo sapiens
gcagggcataggaagaa

SEQ ID NO: 5907528 - DNA, 14 bp, Homo sapiens
gcagggcatctcct

SEQ ID NO: 5907529 - DNA, 19 bp, Homo sapiens
gcagggccaccccactcta

SEQ ID NO: 5907530 - DNA, 22 bp, Homo sapiens
gcagggccaccccactctacct

SEQ ID NO: 5907531 - DNA, 17 bp, Homo sapiens
gcagggccacctgcagg

SEQ ID NO: 5907532 - DNA, 23 bp, Homo sapiens
gcagggccactcaacagagagga

SEQ ID NO: 5907533 - DNA, 19 bp, Homo sapiens
gcagggccaggcctctgct

SEQ ID NO: 5907534 - DNA, 16 bp, Homo sapiens
gcagggccaggctggt

SEQ ID NO: 5907535 - DNA, 22 bp, Homo sapiens
gcagggccagggcaatgccatc

SEQ ID NO: 5907536 - DNA, 17 bp, Homo sapiens
gcagggccatccactgt

SEQ ID NO: 5907537 - DNA, 21 bp, Homo sapiens
gcagggccatccactgtgacg

SEQ ID NO: 5907538 - DNA, 16 bp, Homo sapiens
gcagggccatgcagac

SEQ ID NO: 5907539 - DNA, 21 bp, Homo sapiens
gcagggccatgcagacctcat

SEQ ID NO: 5907540 - DNA, 14 bp, Homo sapiens
gcagggcccacgtg

SEQ ID NO: 5907541 - DNA, 12 bp, Homo sapiens
gcagggcccagc

SEQ ID NO: 5907542 - DNA, 21 bp, Homo sapiens
gcagggcccagggaggtggca

SEQ ID NO: 5907543 - DNA, 21 bp, Homo sapiens
gcagggccccaggcattgcca

SEQ ID NO: 5907544 - DNA, 18 bp, Homo sapiens
gcagggcccccaataaac

SEQ ID NO: 5907545 - DNA, 21 bp, Homo sapiens
gcagggccctgaaatggcctg

SEQ ID NO: 5907546 - DNA, 17 bp, Homo sapiens
gcagggccctggggtct

SEQ ID NO: 5907547 - DNA, 20 bp, Homo sapiens
gcagggccctggggtctctg

SEQ ID NO: 5907548 - DNA, 21 bp, Homo sapiens
gcagggccctggggtctctga

SEQ ID NO: 5907549 - DNA, 14 bp, Homo sapiens
gcagggccctgtgg

SEQ ID NO: 5907550 - DNA, 19 bp, Homo sapiens
gcagggcccttggggctgg

SEQ ID NO: 5907551 - DNA, 20 bp, Homo sapiens
gcagggccgcgagaggccga

SEQ ID NO: 5907552 - DNA, 22 bp, Homo sapiens
gcagggccggggaactggccaa

SEQ ID NO: 5907553 - DNA, 18 bp, Homo sapiens
gcagggcctcatctcacc

SEQ ID NO: 5907554 - DNA, 17 bp, Homo sapiens
gcagggcctggcctggt

SEQ ID NO: 5907555 - DNA, 16 bp, Homo sapiens
gcagggcctggctcca

SEQ ID NO: 5907556 - DNA, 14 bp, Homo sapiens
gcagggcctgggcc

SEQ ID NO: 5907557 - DNA, 17 bp, Homo sapiens
gcagggccttctgcctg

SEQ ID NO: 5907558 - DNA, 18 bp, Homo sapiens
gcagggccttctgcctgc

SEQ ID NO: 5907559 - DNA, 21 bp, Homo sapiens
gcagggccttgcccagagatg

SEQ ID NO: 5907560 - DNA, 22 bp, Homo sapiens
gcagggcgccaagtctggcacc

SEQ ID NO: 5907561 - DNA, 23 bp, Homo sapiens
gcagggcgccaagtctggcacca

SEQ ID NO: 5907562 - DNA, 18 bp, Homo sapiens
gcagggcgcccctgggag

SEQ ID NO: 5907563 - DNA, 19 bp, Homo sapiens
gcagggcgcccctgggaga

SEQ ID NO: 5907564 - DNA, 17 bp, Homo sapiens
gcagggcgctccggcag

SEQ ID NO: 5907565 - DNA, 19 bp, Homo sapiens
gcagggcgctccggcagag

SEQ ID NO: 5907566 - DNA, 16 bp, Homo sapiens
gcagggcgggccagga

SEQ ID NO: 5907567 - DNA, 21 bp, Homo sapiens
gcagggctaccctgagctgag

SEQ ID NO: 5907568 - DNA, 23 bp, Homo sapiens
gcagggctaccctgagctgaggc

SEQ ID NO: 5907569 - DNA, 17 bp, Homo sapiens
gcagggctcacactcct

SEQ ID NO: 5907570 - DNA, 19 bp, Homo sapiens
gcagggctcagcggggaca

SEQ ID NO: 5907571 - DNA, 22 bp, Homo sapiens
gcagggctcagcggggacagct

SEQ ID NO: 5907572 - DNA, 13 bp, Homo sapiens
gcagggctcagga

SEQ ID NO: 5907573 - DNA, 12 bp, Homo sapiens
gcagggctcctc

SEQ ID NO: 5907574 - DNA, 15 bp, Homo sapiens
gcagggctcctccct

SEQ ID NO: 5907575 - DNA, 19 bp, Homo sapiens
gcagggctcctccctggag

SEQ ID NO: 5907576 - DNA, 20 bp, Homo sapiens
gcagggctcctccctggagc

SEQ ID NO: 5907577 - DNA, 14 bp, Homo sapiens
gcagggctctcctg

SEQ ID NO: 5907578 - DNA, 21 bp, Homo sapiens
gcagggctctgccccagaggc

SEQ ID NO: 5907579 - DNA, 19 bp, Homo sapiens
gcagggctctggggccaga

SEQ ID NO: 5907580 - DNA, 18 bp, Homo sapiens
gcagggctgaagtctggc

SEQ ID NO: 5907581 - DNA, 14 bp, Homo sapiens
gcagggctgaggat

SEQ ID NO: 5907582 - DNA, 20 bp, Homo sapiens
gcagggctgcagagggagac

SEQ ID NO: 5907583 - DNA, 15 bp, Homo sapiens
gcagggctgctgtgg

SEQ ID NO: 5907584 - DNA, 20 bp, Homo sapiens
gcagggctgctgtggcccag

SEQ ID NO: 5907585 - DNA, 22 bp, Homo sapiens
gcagggctggcacgtgacaggc

SEQ ID NO: 5907586 - DNA, 11 bp, Homo sapiens
gcagggctggg

SEQ ID NO: 5907587 - DNA, 12 bp, Homo sapiens
gcagggctgggc

SEQ ID NO: 5907588 - DNA, 15 bp, Homo sapiens
gcagggctgggccag

SEQ ID NO: 5907589 - DNA, 14 bp, Homo sapiens
gcagggctgggcct

SEQ ID NO: 5907590 - DNA, 14 bp, Homo sapiens
gcagggctgggcgc

SEQ ID NO: 5907591 - DNA, 16 bp, Homo sapiens
gcagggctgggcgcct

SEQ ID NO: 5907592 - DNA, 14 bp, Homo sapiens
gcagggctggtctt

SEQ ID NO: 5907593 - DNA, 15 bp, Homo sapiens
gcagggctgtgcttg

SEQ ID NO: 5907594 - DNA, 23 bp, Homo sapiens
gcagggctgtgcttgaaggccct

SEQ ID NO: 5907595 - DNA, 12 bp, Homo sapiens
gcagggctgtgt

SEQ ID NO: 5907596 - DNA, 22 bp, Homo sapiens
gcagggctgttccctccaggca

SEQ ID NO: 5907597 - DNA, 13 bp, Homo sapiens
gcagggcttctcc

SEQ ID NO: 5907598 - DNA, 14 bp, Homo sapiens
gcagggctttaaaa

SEQ ID NO: 5907599 - DNA, 22 bp, Homo sapiens
gcagggctttggggggcactag

SEQ ID NO: 5907600 - DNA, 17 bp, Homo sapiens
gcaggggaaactctggt

SEQ ID NO: 5907601 - DNA, 22 bp, Homo sapiens
gcaggggaaactctggtgccgg

SEQ ID NO: 5907602 - DNA, 14 bp, Homo sapiens
gcaggggaaagatt

SEQ ID NO: 5907603 - DNA, 22 bp, Homo sapiens
gcaggggacaagggaggcagtg

SEQ ID NO: 5907604 - DNA, 21 bp, Homo sapiens
gcaggggacctggagctgcca

SEQ ID NO: 5907605 - DNA, 12 bp, Homo sapiens
gcaggggactgg

SEQ ID NO: 5907606 - DNA, 15 bp, Homo sapiens
gcaggggactgggcc

SEQ ID NO: 5907607 - DNA, 17 bp, Homo sapiens
gcaggggactgggccat

SEQ ID NO: 5907608 - DNA, 18 bp, Homo sapiens
gcaggggactgggccatg

SEQ ID NO: 5907609 - DNA, 14 bp, Homo sapiens
gcaggggactgtct

SEQ ID NO: 5907610 - DNA, 14 bp, Homo sapiens
gcaggggagccagg

SEQ ID NO: 5907611 - DNA, 21 bp, Homo sapiens
gcaggggagccagggtagagc

SEQ ID NO: 5907612 - DNA, 17 bp, Homo sapiens
gcaggggagcttgggac

SEQ ID NO: 5907613 - DNA, 17 bp, Homo sapiens
gcaggggaggccatctg

SEQ ID NO: 5907614 - DNA, 12 bp, Homo sapiens
gcaggggagggg

SEQ ID NO: 5907615 - DNA, 22 bp, Homo sapiens
gcaggggagggtagagcggaga

SEQ ID NO: 5907616 - DNA, 19 bp, Homo sapiens
gcaggggagggtcagccag

SEQ ID NO: 5907617 - DNA, 20 bp, Homo sapiens
gcaggggagggtcagccagg

SEQ ID NO: 5907618 - DNA, 17 bp, Homo sapiens
gcaggggagtagtggag

SEQ ID NO: 5907619 - DNA, 20 bp, Homo sapiens
gcaggggcaaacacctgctg

SEQ ID NO: 5907620 - DNA, 15 bp, Homo sapiens
gcaggggcaggaggg

SEQ ID NO: 5907621 - DNA, 12 bp, Homo sapiens
gcaggggcagtg

SEQ ID NO: 5907622 - DNA, 13 bp, Homo sapiens
gcaggggcagtgg

SEQ ID NO: 5907623 - DNA, 15 bp, Homo sapiens
gcaggggcagtggcc

SEQ ID NO: 5907624 - DNA, 12 bp, Homo sapiens
gcaggggcccac

SEQ ID NO: 5907625 - DNA, 21 bp, Homo sapiens
gcaggggcccacttggggcct

SEQ ID NO: 5907626 - DNA, 16 bp, Homo sapiens
gcaggggcccctcctc

SEQ ID NO: 5907627 - DNA, 20 bp, Homo sapiens
gcaggggcccctcctccaga

SEQ ID NO: 5907628 - DNA, 16 bp, Homo sapiens
gcaggggcccctgggg

SEQ ID NO: 5907629 - DNA, 17 bp, Homo sapiens
gcaggggccctgagcca

SEQ ID NO: 5907630 - DNA, 19 bp, Homo sapiens
gcaggggccgggggcagtc

SEQ ID NO: 5907631 - DNA, 18 bp, Homo sapiens
gcaggggccgtgcagggc

SEQ ID NO: 5907632 - DNA, 15 bp, Homo sapiens
gcaggggcctccatg

SEQ ID NO: 5907633 - DNA, 14 bp, Homo sapiens
gcaggggcctctgt

SEQ ID NO: 5907634 - DNA, 14 bp, Homo sapiens
gcaggggcctgggc

SEQ ID NO: 5907635 - DNA, 19 bp, Homo sapiens
gcaggggcgtggagggcgt

SEQ ID NO: 5907636 - DNA, 10 bp, Homo sapiens
gcaggggcta

SEQ ID NO: 5907637 - DNA, 17 bp, Homo sapiens
gcaggggctacaagagg

SEQ ID NO: 5907638 - DNA, 12 bp, Homo sapiens
gcaggggctctg

SEQ ID NO: 5907639 - DNA, 17 bp, Homo sapiens
gcaggggctctgagccc

SEQ ID NO: 5907640 - DNA, 13 bp, Homo sapiens
gcaggggctctgg

SEQ ID NO: 5907641 - DNA, 14 bp, Homo sapiens
gcaggggctctgga

SEQ ID NO: 5907642 - DNA, 18 bp, Homo sapiens
gcaggggctctggagaga

SEQ ID NO: 5907643 - DNA, 19 bp, Homo sapiens
gcaggggctctggagagaa

SEQ ID NO: 5907644 - DNA, 22 bp, Homo sapiens
gcaggggctctggagagaaaca

SEQ ID NO: 5907645 - DNA, 15 bp, Homo sapiens
gcaggggctgcagta

SEQ ID NO: 5907646 - DNA, 14 bp, Homo sapiens
gcaggggctgctgg

SEQ ID NO: 5907647 - DNA, 15 bp, Homo sapiens
gcaggggctgggcag

SEQ ID NO: 5907648 - DNA, 18 bp, Homo sapiens
gcagggggacagcaggga

SEQ ID NO: 5907649 - DNA, 16 bp, Homo sapiens
gcagggggactgcttg

SEQ ID NO: 5907650 - DNA, 17 bp, Homo sapiens
gcagggggaggaggact

SEQ ID NO: 5907651 - DNA, 18 bp, Homo sapiens
gcagggggccccgccagg

SEQ ID NO: 5907652 - DNA, 21 bp, Homo sapiens
gcagggggccccgccagggct

SEQ ID NO: 5907653 - DNA, 15 bp, Homo sapiens
gcagggggctgctgc

SEQ ID NO: 5907654 - DNA, 16 bp, Homo sapiens
gcagggggctgctgct

SEQ ID NO: 5907655 - DNA, 13 bp, Homo sapiens
gcaggggggagag

SEQ ID NO: 5907656 - DNA, 22 bp, Homo sapiens
gcaggggggctgtgccaacctg

SEQ ID NO: 5907657 - DNA, 21 bp, Homo sapiens
gcagggggggaaatgcattta

SEQ ID NO: 5907658 - DNA, 21 bp, Homo sapiens
gcaggggggttgggttccaga

SEQ ID NO: 5907659 - DNA, 20 bp, Homo sapiens
gcagggggtgaaggcaggag

SEQ ID NO: 5907660 - DNA, 21 bp, Homo sapiens
gcagggggtgaaggcaggagt

SEQ ID NO: 5907661 - DNA, 16 bp, Homo sapiens
gcagggggttctggga

SEQ ID NO: 5907662 - DNA, 22 bp, Homo sapiens
gcaggggtaggggtagggagcc

SEQ ID NO: 5907663 - DNA, 15 bp, Homo sapiens
gcaggggtccctgct

SEQ ID NO: 5907664 - DNA, 16 bp, Homo sapiens
gcaggggtccctgcta

SEQ ID NO: 5907665 - DNA, 14 bp, Homo sapiens
gcaggggtcctgca

SEQ ID NO: 5907666 - DNA, 15 bp, Homo sapiens
gcaggggtctgagcc

SEQ ID NO: 5907667 - DNA, 17 bp, Homo sapiens
gcaggggtctgagccac

SEQ ID NO: 5907668 - DNA, 22 bp, Homo sapiens
gcaggggtctgggagtcaggcc

SEQ ID NO: 5907669 - DNA, 20 bp, Homo sapiens
gcaggggtgacggccctcat

SEQ ID NO: 5907670 - DNA, 22 bp, Homo sapiens
gcaggggtggctgcctcattta

SEQ ID NO: 5907671 - DNA, 17 bp, Homo sapiens
gcaggggtgggagagcc

SEQ ID NO: 5907672 - DNA, 14 bp, Homo sapiens
gcaggggtgggagg

SEQ ID NO: 5907673 - DNA, 22 bp, Homo sapiens
gcaggggtgggaggctcccaga

SEQ ID NO: 5907674 - DNA, 16 bp, Homo sapiens
gcagggtaccctttgg

SEQ ID NO: 5907675 - DNA, 16 bp, Homo sapiens
gcagggtcaagcctct

SEQ ID NO: 5907676 - DNA, 18 bp, Homo sapiens
gcagggtcagtggaagcc

SEQ ID NO: 5907677 - DNA, 20 bp, Homo sapiens
gcagggtccaaaggccagcg

SEQ ID NO: 5907678 - DNA, 20 bp, Homo sapiens
gcagggtccacagctggaaa

SEQ ID NO: 5907679 - DNA, 13 bp, Homo sapiens
gcagggtccacgc

SEQ ID NO: 5907680 - DNA, 19 bp, Homo sapiens
gcagggtctctgctccagc

SEQ ID NO: 5907681 - DNA, 14 bp, Homo sapiens
gcagggtctgggca

SEQ ID NO: 5907682 - DNA, 20 bp, Homo sapiens
gcagggtctgggctgggcac

SEQ ID NO: 5907683 - DNA, 18 bp, Homo sapiens
gcagggtctttgtgtgct

SEQ ID NO: 5907684 - DNA, 19 bp, Homo sapiens
gcagggtctttgtgtgctg

SEQ ID NO: 5907685 - DNA, 16 bp, Homo sapiens
gcagggtcttttcatc

SEQ ID NO: 5907686 - DNA, 18 bp, Homo sapiens
gcagggtgacgcctgaga

SEQ ID NO: 5907687 - DNA, 20 bp, Homo sapiens
gcagggtgacgcctgagaca

SEQ ID NO: 5907688 - DNA, 22 bp, Homo sapiens
gcagggtgcagtatcatgccct

SEQ ID NO: 5907689 - DNA, 15 bp, Homo sapiens
gcagggtgggatgga

SEQ ID NO: 5907690 - DNA, 19 bp, Homo sapiens
gcagggtgggcagcctatg

SEQ ID NO: 5907691 - DNA, 20 bp, Homo sapiens
gcagggtgggggagggaggt

SEQ ID NO: 5907692 - DNA, 23 bp, Homo sapiens
gcagggtggggtaaggaggagaa

SEQ ID NO: 5907693 - DNA, 19 bp, Homo sapiens
gcagggtggggtctgggag

SEQ ID NO: 5907694 - DNA, 20 bp, Homo sapiens
gcagggtggggtctgggagg

SEQ ID NO: 5907695 - DNA, 23 bp, Homo sapiens
gcagggtggggtctgggaggggg

SEQ ID NO: 5907696 - DNA, 23 bp, Homo sapiens
gcagggtgggtgagctctcaggc

SEQ ID NO: 5907697 - DNA, 15 bp, Homo sapiens
gcagggtggtgctgg

SEQ ID NO: 5907698 - DNA, 17 bp, Homo sapiens
gcagggtggtgctggga

SEQ ID NO: 5907699 - DNA, 18 bp, Homo sapiens
gcagggtggtgctgggac

SEQ ID NO: 5907700 - DNA, 19 bp, Homo sapiens
gcagggtgtctgccccctc

SEQ ID NO: 5907701 - DNA, 23 bp, Homo sapiens
gcagggttctagaaggggcgagg

SEQ ID NO: 5907702 - DNA, 21 bp, Homo sapiens
gcaggtaattttttgtctgct

SEQ ID NO: 5907703 - DNA, 21 bp, Homo sapiens
gcaggtacaggtagtgggctc

SEQ ID NO: 5907704 - DNA, 18 bp, Homo sapiens
gcaggtacatttctgatt

SEQ ID NO: 5907705 - DNA, 20 bp, Homo sapiens
gcaggtacatttctgattct

SEQ ID NO: 5907706 - DNA, 23 bp, Homo sapiens
gcaggtacatttctgattctgat

SEQ ID NO: 5907707 - DNA, 14 bp, Homo sapiens
gcaggtaccactga

SEQ ID NO: 5907708 - DNA, 17 bp, Homo sapiens
gcaggtagacctgtctc

SEQ ID NO: 5907709 - DNA, 22 bp, Homo sapiens
gcaggtatgatcggcaggacac

SEQ ID NO: 5907710 - DNA, 23 bp, Homo sapiens
gcaggtatttcagaaggagaagg

SEQ ID NO: 5907711 - DNA, 21 bp, Homo sapiens
gcaggtattttaactgtgtga

SEQ ID NO: 5907712 - DNA, 14 bp, Homo sapiens
gcaggtcacagaaa

SEQ ID NO: 5907713 - DNA, 17 bp, Homo sapiens
gcaggtcaggaccagga

SEQ ID NO: 5907714 - DNA, 22 bp, Homo sapiens
gcaggtcatattgtcagtccta

SEQ ID NO: 5907715 - DNA, 20 bp, Homo sapiens
gcaggtccagctctgtgggc

SEQ ID NO: 5907716 - DNA, 22 bp, Homo sapiens
gcaggtccagctctgtgggccc

SEQ ID NO: 5907717 - DNA, 13 bp, Homo sapiens
gcaggtccccaga

SEQ ID NO: 5907718 - DNA, 23 bp, Homo sapiens
gcaggtcccgagccccctgtcct

SEQ ID NO: 5907719 - DNA, 14 bp, Homo sapiens
gcaggtccctaata

SEQ ID NO: 5907720 - DNA, 16 bp, Homo sapiens
gcaggtccctaataaa

SEQ ID NO: 5907721 - DNA, 18 bp, Homo sapiens
gcaggtccctaataaagc

SEQ ID NO: 5907722 - DNA, 19 bp, Homo sapiens
gcaggtccggggaggaggt

SEQ ID NO: 5907723 - DNA, 12 bp, Homo sapiens
gcaggtcctggg

SEQ ID NO: 5907724 - DNA, 13 bp, Homo sapiens
gcaggtcctgggg

SEQ ID NO: 5907725 - DNA, 15 bp, Homo sapiens
gcaggtcctggggag

SEQ ID NO: 5907726 - DNA, 16 bp, Homo sapiens
gcaggtcctggggagg

SEQ ID NO: 5907727 - DNA, 19 bp, Homo sapiens
gcaggtcctggggaggctg

SEQ ID NO: 5907728 - DNA, 19 bp, Homo sapiens
gcaggtcctggtgggtcag

SEQ ID NO: 5907729 - DNA, 19 bp, Homo sapiens
gcaggtcgggctgccagcc

SEQ ID NO: 5907730 - DNA, 20 bp, Homo sapiens
gcaggtcgggctgccagccc

SEQ ID NO: 5907731 - DNA, 21 bp, Homo sapiens
gcaggtcgggctgccagccca

SEQ ID NO: 5907732 - DNA, 15 bp, Homo sapiens
gcaggtctcagcccg

SEQ ID NO: 5907733 - DNA, 17 bp, Homo sapiens
gcaggtctccacctgca

SEQ ID NO: 5907734 - DNA, 14 bp, Homo sapiens
gcaggtctgcaggc

SEQ ID NO: 5907735 - DNA, 17 bp, Homo sapiens
gcaggtctgcaggccac

SEQ ID NO: 5907736 - DNA, 20 bp, Homo sapiens
gcaggtctgcaggccaccag

SEQ ID NO: 5907737 - DNA, 19 bp, Homo sapiens
gcaggtcttgaactcctgg

SEQ ID NO: 5907738 - DNA, 21 bp, Homo sapiens
gcaggtctttaaatcatttta

SEQ ID NO: 5907739 - DNA, 20 bp, Homo sapiens
gcaggtgaaacccagtcact

SEQ ID NO: 5907740 - DNA, 20 bp, Homo sapiens
gcaggtgaccagaatgaggc

SEQ ID NO: 5907741 - DNA, 17 bp, Homo sapiens
gcaggtgaccttctggg

SEQ ID NO: 5907742 - DNA, 14 bp, Homo sapiens
gcaggtgagaaccc

SEQ ID NO: 5907743 - DNA, 15 bp, Homo sapiens
gcaggtgcaagagac

SEQ ID NO: 5907744 - DNA, 20 bp, Homo sapiens
gcaggtgcaagagacagagc

SEQ ID NO: 5907745 - DNA, 21 bp, Homo sapiens
gcaggtgcaagagacagagcc

SEQ ID NO: 5907746 - DNA, 23 bp, Homo sapiens
gcaggtgcaagagacagagcccc

SEQ ID NO: 5907747 - DNA, 15 bp, Homo sapiens
gcaggtgcagatggg

SEQ ID NO: 5907748 - DNA, 18 bp, Homo sapiens
gcaggtgcagatgggctg

SEQ ID NO: 5907749 - DNA, 16 bp, Homo sapiens
gcaggtgccaatgact

SEQ ID NO: 5907750 - DNA, 21 bp, Homo sapiens
gcaggtgccatgcctgctccc

SEQ ID NO: 5907751 - DNA, 18 bp, Homo sapiens
gcaggtgcccccaggtga

SEQ ID NO: 5907752 - DNA, 23 bp, Homo sapiens
gcaggtgcccccaggtgagacag

SEQ ID NO: 5907753 - DNA, 21 bp, Homo sapiens
gcaggtgcccctctctccatc

SEQ ID NO: 5907754 - DNA, 14 bp, Homo sapiens
gcaggtgcctccag

SEQ ID NO: 5907755 - DNA, 15 bp, Homo sapiens
gcaggtgcctccagg

SEQ ID NO: 5907756 - DNA, 12 bp, Homo sapiens
gcaggtgcctgg

SEQ ID NO: 5907757 - DNA, 17 bp, Homo sapiens
gcaggtgctcatgctgc

SEQ ID NO: 5907758 - DNA, 13 bp, Homo sapiens
gcaggtgctgcct

SEQ ID NO: 5907759 - DNA, 20 bp, Homo sapiens
gcaggtgctgctaccctccc

SEQ ID NO: 5907760 - DNA, 23 bp, Homo sapiens
gcaggtgctgctaccctccctgc

SEQ ID NO: 5907761 - DNA, 11 bp, Homo sapiens
gcagtgtgcag

SEQ ID NO: 5907762 - DNA, 12 bp, Homo sapiens
gcagtgtgcagg

SEQ ID NO: 5907763 - DNA, 22 bp, Homo sapiens
gcagtgtgctttgcattttctg

SEQ ID NO: 5907764 - DNA, 12 bp, Homo sapiens
gcagtgtggaga

SEQ ID NO: 5907765 - DNA, 22 bp, Homo sapiens
gcagtgtggagaccctgccaca

SEQ ID NO: 5907766 - DNA, 23 bp, Homo sapiens
gcagtgtggagaccctgccacag

SEQ ID NO: 5907767 - DNA, 17 bp, Homo sapiens
gcagtgtggggagggca

SEQ ID NO: 5907768 - DNA, 20 bp, Homo sapiens
gcagtgtggggagggcaggt

SEQ ID NO: 5907769 - DNA, 14 bp, Homo sapiens
gcagtgtgtaaagt

SEQ ID NO: 5907770 - DNA, 13 bp, Homo sapiens
gcagtgtgtcctt

SEQ ID NO: 5907771 - DNA, 23 bp, Homo sapiens
gcagtgtgtccttggggcacagt

SEQ ID NO: 5907772 - DNA, 13 bp, Homo sapiens
gcagtgttagctt

SEQ ID NO: 5907773 - DNA, 17 bp, Homo sapiens
gcagtgttatttatttc

SEQ ID NO: 5907774 - DNA, 19 bp, Homo sapiens
gcagtgttccttgtgcccg

SEQ ID NO: 5907775 - DNA, 16 bp, Homo sapiens
gcagtgttcgcttggc

SEQ ID NO: 5907776 - DNA, 22 bp, Homo sapiens
gcagtgttcgcttggctccatg

SEQ ID NO: 5907777 - DNA, 12 bp, Homo sapiens
gcagtgttctca

SEQ ID NO: 5907778 - DNA, 18 bp, Homo sapiens
gcagtgttctcacagtgt

SEQ ID NO: 5907779 - DNA, 18 bp, Homo sapiens
gcagtgttggagtgagga

SEQ ID NO: 5907780 - DNA, 17 bp, Homo sapiens
gcagtgttttggttcag

SEQ ID NO: 5907781 - DNA, 16 bp, Homo sapiens
gcagttaagctaaagc

SEQ ID NO: 5907782 - DNA, 13 bp, Homo sapiens
gcagttacatgca

SEQ ID NO: 5907783 - DNA, 14 bp, Homo sapiens
gcagttaccattaa

SEQ ID NO: 5907784 - DNA, 18 bp, Homo sapiens
gcagttaccattaaacca

SEQ ID NO: 5907785 - DNA, 22 bp, Homo sapiens
gcagttacccaacagaaacatt

SEQ ID NO: 5907786 - DNA, 22 bp, Homo sapiens
gcagttaccttaaagctgaatt

SEQ ID NO: 5907787 - DNA, 17 bp, Homo sapiens
gcagttactgaaatctt

SEQ ID NO: 5907788 - DNA, 16 bp, Homo sapiens
gcagttagcacagagg

SEQ ID NO: 5907789 - DNA, 22 bp, Homo sapiens
gcagttaggcaccttaactgga

SEQ ID NO: 5907790 - DNA, 21 bp, Homo sapiens
gcagttataacagatgtgaaa

SEQ ID NO: 5907791 - DNA, 16 bp, Homo sapiens
gcagttatattttgca

SEQ ID NO: 5907792 - DNA, 12 bp, Homo sapiens
gcagttatttgc

SEQ ID NO: 5907793 - DNA, 19 bp, Homo sapiens
gcagttcaaatcctcacca

SEQ ID NO: 5907794 - DNA, 17 bp, Homo sapiens
gcagttcagagctgccc

SEQ ID NO: 5907795 - DNA, 19 bp, Homo sapiens
gcagttcagagctgccctc

SEQ ID NO: 5907796 - DNA, 20 bp, Homo sapiens
gcagttcagagctgccctct

SEQ ID NO: 5907797 - DNA, 18 bp, Homo sapiens
gcagttcatccgcactgt

SEQ ID NO: 5907798 - DNA, 13 bp, Homo sapiens
gcagttcattcta

SEQ ID NO: 5907799 - DNA, 22 bp, Homo sapiens
gcagttcattctaccaagctgt

SEQ ID NO: 5907800 - DNA, 21 bp, Homo sapiens
gcagttcccacattaaagaag

SEQ ID NO: 5907801 - DNA, 20 bp, Homo sapiens
gcagttcccccaacctcaga

SEQ ID NO: 5907802 - DNA, 17 bp, Homo sapiens
gcagttcccctggaagc

SEQ ID NO: 5907803 - DNA, 23 bp, Homo sapiens
gcagttcccctggaagcagtgcc

SEQ ID NO: 5907804 - DNA, 16 bp, Homo sapiens
gcagttccctgttgaa

SEQ ID NO: 5907805 - DNA, 23 bp, Homo sapiens
gcagttccggattggcttgtgtg

SEQ ID NO: 5907806 - DNA, 13 bp, Homo sapiens
gcagttcctggca

SEQ ID NO: 5907807 - DNA, 15 bp, Homo sapiens
gcagttcctgtccca

SEQ ID NO: 5907808 - DNA, 14 bp, Homo sapiens
gcagttcctgtgcc

SEQ ID NO: 5907809 - DNA, 15 bp, Homo sapiens
gcagttcgcagccac

SEQ ID NO: 5907810 - DNA, 17 bp, Homo sapiens
gcagttcgcagccaccc

SEQ ID NO: 5907811 - DNA, 18 bp, Homo sapiens
gcagttcgcagccaccct

SEQ ID NO: 5907812 - DNA, 20 bp, Homo sapiens
gcagttctactcaggctggt

SEQ ID NO: 5907813 - DNA, 12 bp, Homo sapiens
gcagttctagaa

SEQ ID NO: 5907814 - DNA, 23 bp, Homo sapiens
gcagttctagaagccacagtgcc

SEQ ID NO: 5907815 - DNA, 15 bp, Homo sapiens
gcagttctcactcct

SEQ ID NO: 5907816 - DNA, 21 bp, Homo sapiens
gcagttctcccagggagtgag

SEQ ID NO: 5907817 - DNA, 22 bp, Homo sapiens
gcagttctcccagggagtgagc

SEQ ID NO: 5907818 - DNA, 14 bp, Homo sapiens
gcagttctctgcca

SEQ ID NO: 5907819 - DNA, 15 bp, Homo sapiens
gcagttctgaagaag

SEQ ID NO: 5907820 - DNA, 11 bp, Homo sapiens
gcagttctgca

SEQ ID NO: 5907821 - DNA, 18 bp, Homo sapiens
gcagttctgcaaatagaa

SEQ ID NO: 5907822 - DNA, 11 bp, Homo sapiens
gcagttctgtt

SEQ ID NO: 5907823 - DNA, 12 bp, Homo sapiens
gcagttctgtta

SEQ ID NO: 5907824 - DNA, 15 bp, Homo sapiens
gcagttctgttgcat

SEQ ID NO: 5907825 - DNA, 16 bp, Homo sapiens
gcagttgaaaagactc

SEQ ID NO: 5907826 - DNA, 21 bp, Homo sapiens
gcagttgaaaagactccaaag

SEQ ID NO: 5907827 - DNA, 18 bp, Homo sapiens
gcagttgaatttttatat

SEQ ID NO: 5907828 - DNA, 20 bp, Homo sapiens
gcagttgacatccaaatcta

SEQ ID NO: 5907829 - DNA, 14 bp, Homo sapiens
gcagttgacttttt

SEQ ID NO: 5907830 - DNA, 13 bp, Homo sapiens
gcagttgaggtgg

SEQ ID NO: 5907831 - DNA, 19 bp, Homo sapiens
gcagttgattccttgagtt

SEQ ID NO: 5907832 - DNA, 20 bp, Homo sapiens
gcagttgattccttgagttt

SEQ ID NO: 5907833 - DNA, 18 bp, Homo sapiens
gcagttgcagtgctgctg

SEQ ID NO: 5907834 - DNA, 23 bp, Homo sapiens
gcagttgccagtcaccccggcca

SEQ ID NO: 5907835 - DNA, 15 bp, Homo sapiens
gcagttgcccagcct

SEQ ID NO: 5907836 - DNA, 18 bp, Homo sapiens
gcagttgctggtaaaatg

SEQ ID NO: 5907837 - DNA, 18 bp, Homo sapiens
gcagttggccaagcagaa

SEQ ID NO: 5907838 - DNA, 22 bp, Homo sapiens
gcagttggccagagagcctggt

SEQ ID NO: 5907839 - DNA, 22 bp, Homo sapiens
gcagttggcctcagcagaaggc

SEQ ID NO: 5907840 - DNA, 12 bp, Homo sapiens
gcagttggcctg

SEQ ID NO: 5907841 - DNA, 13 bp, Homo sapiens
gcagttggggccc

SEQ ID NO: 5907842 - DNA, 17 bp, Homo sapiens
gcagttggggccctctt

SEQ ID NO: 5907843 - DNA, 22 bp, Homo sapiens
gcagttggggccctcttgccag

SEQ ID NO: 5907844 - DNA, 16 bp, Homo sapiens
gcagttgtagcagaaa

SEQ ID NO: 5907845 - DNA, 13 bp, Homo sapiens
gcagttgtctctg

SEQ ID NO: 5907846 - DNA, 17 bp, Homo sapiens
gcagttgtggtgtgcca

SEQ ID NO: 5907847 - DNA, 13 bp, Homo sapiens
gcagttgtgtcag

SEQ ID NO: 5907848 - DNA, 21 bp, Homo sapiens
gcagttgttatattcattctt

SEQ ID NO: 5907849 - DNA, 22 bp, Homo sapiens
gcagttgttgcccacagctgta

SEQ ID NO: 5907850 - DNA, 17 bp, Homo sapiens
gcagtttacagtatttc

SEQ ID NO: 5907851 - DNA, 18 bp, Homo sapiens
gcagtttacagtatttct

SEQ ID NO: 5907852 - DNA, 14 bp, Homo sapiens
gcagtttatcattc

SEQ ID NO: 5907853 - DNA, 16 bp, Homo sapiens
gcagtttatcattcaa

SEQ ID NO: 5907854 - DNA, 20 bp, Homo sapiens
gcagtttcagagatggacag

SEQ ID NO: 5907855 - DNA, 22 bp, Homo sapiens
gcagtttcagataaatcatggg

SEQ ID NO: 5907856 - DNA, 22 bp, Homo sapiens
gcagtttccagtcctaacaaat

SEQ ID NO: 5907857 - DNA, 16 bp, Homo sapiens
gcagtttcccagaata

SEQ ID NO: 5907858 - DNA, 18 bp, Homo sapiens
gcagtttcctcagtgatg

SEQ ID NO: 5907859 - DNA, 21 bp, Homo sapiens
gcagtttcctcagtgatggaa

SEQ ID NO: 5907860 - DNA, 22 bp, Homo sapiens
gcagtttcctcagtgatggaat

SEQ ID NO: 5907861 - DNA, 13 bp, Homo sapiens
gcagtttcctgga

SEQ ID NO: 5907862 - DNA, 17 bp, Homo sapiens
gcagtttcttttcacat

SEQ ID NO: 5907863 - DNA, 13 bp, Homo sapiens
gcagtttgaaatt

SEQ ID NO: 5907864 - DNA, 14 bp, Homo sapiens
gcagtttgaaattc

SEQ ID NO: 5907865 - DNA, 19 bp, Homo sapiens
gcagtttgaaattctgaat

SEQ ID NO: 5907866 - DNA, 12 bp, Homo sapiens
gcagtttgcaaa

SEQ ID NO: 5907867 - DNA, 13 bp, Homo sapiens
gcagtttgcaaaa

SEQ ID NO: 5907868 - DNA, 13 bp, Homo sapiens
gcagtttgcctct

SEQ ID NO: 5907869 - DNA, 18 bp, Homo sapiens
gcagtttgcctctgcacg

SEQ ID NO: 5907870 - DNA, 14 bp, Homo sapiens
gcagtttggccctg

SEQ ID NO: 5907871 - DNA, 17 bp, Homo sapiens
gcagtttggtatttgcg

SEQ ID NO: 5907872 - DNA, 21 bp, Homo sapiens
gcagtttggtttatattctta

SEQ ID NO: 5907873 - DNA, 12 bp, Homo sapiens
gcagtttgtgaa

SEQ ID NO: 5907874 - DNA, 13 bp, Homo sapiens
gcagttttaagaa

SEQ ID NO: 5907875 - DNA, 17 bp, Homo sapiens
gcagttttcaagtcaaa

SEQ ID NO: 5907876 - DNA, 15 bp, Homo sapiens
gcagttttccaggaa

SEQ ID NO: 5907877 - DNA, 22 bp, Homo sapiens
gcagttttgacatcagccagct

SEQ ID NO: 5907878 - DNA, 14 bp, Homo sapiens
gcagtttttcagga

SEQ ID NO: 5907879 - DNA, 18 bp, Homo sapiens
gcagtttttctgccttta

SEQ ID NO: 5907880 - DNA, 19 bp, Homo sapiens
gcagtttttgaaagacaaa

SEQ ID NO: 5907881 - DNA, 11 bp, Homo sapiens
gcagttttttt

SEQ ID NO: 5907882 - DNA, 23 bp, Homo sapiens
gcagttttttttttcttgtctat

SEQ ID NO: 5907883 - DNA, 14 bp, Homo sapiens
gcataaaaaaatga

SEQ ID NO: 5907884 - DNA, 18 bp, Homo sapiens
gcataaaaattaaatgga

SEQ ID NO: 5907885 - DNA, 15 bp, Homo sapiens
gcataaaaattagcc

SEQ ID NO: 5907886 - DNA, 12 bp, Homo sapiens
gcataaaacagc

SEQ ID NO: 5907887 - DNA, 15 bp, Homo sapiens
gcataaaagatgaaa

SEQ ID NO: 5907888 - DNA, 19 bp, Homo sapiens
gcataaaatggaataacat

SEQ ID NO: 5907889 - DNA, 13 bp, Homo sapiens
gcataaaattcta

SEQ ID NO: 5907890 - DNA, 13 bp, Homo sapiens
gcataaactaaaa

SEQ ID NO: 5907891 - DNA, 15 bp, Homo sapiens
gcataaagaagaaga

SEQ ID NO: 5907892 - DNA, 16 bp, Homo sapiens
gcataaagaagaagaa

SEQ ID NO: 5907893 - DNA, 20 bp, Homo sapiens
gcataaagaattaatgactt

SEQ ID NO: 5907894 - DNA, 22 bp, Homo sapiens
gcataaagcaaggcaaaaatgt

SEQ ID NO: 5907895 - DNA, 21 bp, Homo sapiens
gcataaagctcaaatgaaatg

SEQ ID NO: 5907896 - DNA, 13 bp, Homo sapiens
gcataaagtaaat

SEQ ID NO: 5907897 - DNA, 16 bp, Homo sapiens
gcataaagtaaataca

SEQ ID NO: 5907898 - DNA, 17 bp, Homo sapiens
gcataaataaaactgaa

SEQ ID NO: 5907899 - DNA, 13 bp, Homo sapiens
gcataaatatgca

SEQ ID NO: 5907900 - DNA, 14 bp, Homo sapiens
gcataaatatgcag

SEQ ID NO: 5907901 - DNA, 14 bp, Homo sapiens
gcataaatcacttc

SEQ ID NO: 5907902 - DNA, 16 bp, Homo sapiens
gcataaattagagaaa

SEQ ID NO: 5907903 - DNA, 13 bp, Homo sapiens
gcataaattattg

SEQ ID NO: 5907904 - DNA, 13 bp, Homo sapiens
gcataaatttaat

SEQ ID NO: 5907905 - DNA, 13 bp, Homo sapiens
gcataacataaat

SEQ ID NO: 5907906 - DNA, 19 bp, Homo sapiens
gcataacctgtctcacctg

SEQ ID NO: 5907907 - DNA, 22 bp, Homo sapiens
gcataacgtataaaagcctgtt

SEQ ID NO: 5907908 - DNA, 17 bp, Homo sapiens
gcataactgacaaatca

SEQ ID NO: 5907909 - DNA, 18 bp, Homo sapiens
gcataactgacaaatcaa

SEQ ID NO: 5907910 - DNA, 21 bp, Homo sapiens
gcataactgacaaatcaagtt

SEQ ID NO: 5907911 - DNA, 12 bp, Homo sapiens
gcataagaaaaa

SEQ ID NO: 5907912 - DNA, 16 bp, Homo sapiens
gcataagattatatac

SEQ ID NO: 5907913 - DNA, 22 bp, Homo sapiens
gcataaggagttagaaccacag

SEQ ID NO: 5907914 - DNA, 15 bp, Homo sapiens
gcataagtcctctag

SEQ ID NO: 5907915 - DNA, 19 bp, Homo sapiens
gcataagtggacccagctg

SEQ ID NO: 5907916 - DNA, 18 bp, Homo sapiens
gcataatatgaagccttt

SEQ ID NO: 5907917 - DNA, 15 bp, Homo sapiens
gcataatatgcatat

SEQ ID NO: 5907918 - DNA, 19 bp, Homo sapiens
gcataatatgcatatatat

SEQ ID NO: 5907919 - DNA, 21 bp, Homo sapiens
gcataatattttctttctttt

SEQ ID NO: 5907920 - DNA, 19 bp, Homo sapiens
gcataatcagcgccctgga

SEQ ID NO: 5907921 - DNA, 17 bp, Homo sapiens
gcataatgataaaataa

SEQ ID NO: 5907922 - DNA, 13 bp, Homo sapiens
gcataatgcaatc

SEQ ID NO: 5907923 - DNA, 22 bp, Homo sapiens
gcataatgctcccatctcctga

SEQ ID NO: 5907924 - DNA, 16 bp, Homo sapiens
gcataatgctttggaa

SEQ ID NO: 5907925 - DNA, 23 bp, Homo sapiens
gcataattctgaagttatatttc

SEQ ID NO: 5907926 - DNA, 19 bp, Homo sapiens
gcataatttaaaaatatat

SEQ ID NO: 5907927 - DNA, 22 bp, Homo sapiens
gcataatttgtttaaaattctc

SEQ ID NO: 5907928 - DNA, 19 bp, Homo sapiens
gcataattttgtgttgtac

SEQ ID NO: 5907929 - DNA, 21 bp, Homo sapiens
gcataattttgtgttgtacaa

SEQ ID NO: 5907930 - DNA, 12 bp, Homo sapiens
gcatacaaaata

SEQ ID NO: 5907931 - DNA, 15 bp, Homo sapiens
gcatacaaaatattt

SEQ ID NO: 5907932 - DNA, 21 bp, Homo sapiens
gcatacaaaatatttaagtga

SEQ ID NO: 5907933 - DNA, 16 bp, Homo sapiens
gcatacaacagagggg

SEQ ID NO: 5907934 - DNA, 16 bp, Homo sapiens
gcatacaataaaagag

SEQ ID NO: 5907935 - DNA, 18 bp, Homo sapiens
gcatacaataaaagagct

SEQ ID NO: 5907936 - DNA, 20 bp, Homo sapiens
gcatacaataaaagagcttt

SEQ ID NO: 5907937 - DNA, 21 bp, Homo sapiens
gcatacaataaaagagcttta

SEQ ID NO: 5907938 - DNA, 21 bp, Homo sapiens
gcatacacacacacacacagc

SEQ ID NO: 5907939 - DNA, 16 bp, Homo sapiens
gcatacacacagcagt

SEQ ID NO: 5907940 - DNA, 19 bp, Homo sapiens
gcatcacgtaccccactgg

SEQ ID NO: 5907941 - DNA, 15 bp, Homo sapiens
gcatcactaaaccga

SEQ ID NO: 5907942 - DNA, 22 bp, Homo sapiens
gcatcactaaaccgataatgca

SEQ ID NO: 5907943 - DNA, 16 bp, Homo sapiens
gcatcacttaaaacac

SEQ ID NO: 5907944 - DNA, 14 bp, Homo sapiens
gcatcacttggggt

SEQ ID NO: 5907945 - DNA, 15 bp, Homo sapiens
gcatcacttggggtc

SEQ ID NO: 5907946 - DNA, 17 bp, Homo sapiens
gcatcactttcctggat

SEQ ID NO: 5907947 - DNA, 17 bp, Homo sapiens
gcatcagaaagaggcag

SEQ ID NO: 5907948 - DNA, 22 bp, Homo sapiens
gcatcagaaatcctctgttaat

SEQ ID NO: 5907949 - DNA, 21 bp, Homo sapiens
gcatcagagcccttttgctat

SEQ ID NO: 5907950 - DNA, 13 bp, Homo sapiens
gcatcagcaagac

SEQ ID NO: 5907951 - DNA, 22 bp, Homo sapiens
gcatcagctgctgaaacaacaa

SEQ ID NO: 5907952 - DNA, 21 bp, Homo sapiens
gcatcagctggcgtcatgcaa

SEQ ID NO: 5907953 - DNA, 16 bp, Homo sapiens
gcatcagctttccctg

SEQ ID NO: 5907954 - DNA, 23 bp, Homo sapiens
gcatcagctttccctggctcagg

SEQ ID NO: 5907955 - DNA, 17 bp, Homo sapiens
gcatcaggagctgctca

SEQ ID NO: 5907956 - DNA, 12 bp, Homo sapiens
gcatcaggcact

SEQ ID NO: 5907957 - DNA, 14 bp, Homo sapiens
gcatcaggcactgg

SEQ ID NO: 5907958 - DNA, 17 bp, Homo sapiens
gcatcaggcactggtgg

SEQ ID NO: 5907959 - DNA, 18 bp, Homo sapiens
gcatcaggcactggtggc

SEQ ID NO: 5907960 - DNA, 19 bp, Homo sapiens
gcatcaggcactggtggca

SEQ ID NO: 5907961 - DNA, 18 bp, Homo sapiens
gcatcaggctaagaccct

SEQ ID NO: 5907962 - DNA, 24 bp, Homo sapiens
gcatcagggggaagaagcagagag

SEQ ID NO: 5907963 - DNA, 16 bp, Homo sapiens
gcatcaggtctgggca

SEQ ID NO: 5907964 - DNA, 18 bp, Homo sapiens
gcatcaggtctgggcaag

SEQ ID NO: 5907965 - DNA, 21 bp, Homo sapiens
gcatcagtgactgaattctgc

SEQ ID NO: 5907966 - DNA, 23 bp, Homo sapiens
gcatcagtgccctccaggataga

SEQ ID NO: 5907967 - DNA, 12 bp, Homo sapiens
gcatcagttcat

SEQ ID NO: 5907968 - DNA, 19 bp, Homo sapiens
gcatcagtttaggccttgg

SEQ ID NO: 5907969 - DNA, 17 bp, Homo sapiens
gcatcatagtagttttt

SEQ ID NO: 5907970 - DNA, 23 bp, Homo sapiens
gcatcatcaataaaacagttggc

SEQ ID NO: 5907971 - DNA, 19 bp, Homo sapiens
gcatcatccattctctctg

SEQ ID NO: 5907972 - DNA, 15 bp, Homo sapiens
gcatcatctcttcct

SEQ ID NO: 5907973 - DNA, 14 bp, Homo sapiens
gcatcatctgtaga

SEQ ID NO: 5907974 - DNA, 20 bp, Homo sapiens
gcatcatctgtagatactag

SEQ ID NO: 5907975 - DNA, 16 bp, Homo sapiens
gcatcatctgtttgta

SEQ ID NO: 5907976 - DNA, 19 bp, Homo sapiens
gcatcatcttgaacattaa

SEQ ID NO: 5907977 - DNA, 21 bp, Homo sapiens
gcatcatcttgaacattaatc

SEQ ID NO: 5907978 - DNA, 13 bp, Homo sapiens
gcatcatgcatgt

SEQ ID NO: 5907979 - DNA, 19 bp, Homo sapiens
gcatcatgccaacttgtga

SEQ ID NO: 5907980 - DNA, 13 bp, Homo sapiens
gcatcatgcctct

SEQ ID NO: 5907981 - DNA, 14 bp, Homo sapiens
gcatcatgcctctg

SEQ ID NO: 5907982 - DNA, 17 bp, Homo sapiens
gcatcatgcctctgagg

SEQ ID NO: 5907983 - DNA, 20 bp, Homo sapiens
gcatcatgtttctgagacca

SEQ ID NO: 5907984 - DNA, 21 bp, Homo sapiens
gcatcattactgttccagatt

SEQ ID NO: 5907985 - DNA, 20 bp, Homo sapiens
gcatcattatttatgtattg

SEQ ID NO: 5907986 - DNA, 22 bp, Homo sapiens
gcatcattatttgcagagacag

SEQ ID NO: 5907987 - DNA, 23 bp, Homo sapiens
gcatcattcagcaaatgcctttt

SEQ ID NO: 5907988 - DNA, 18 bp, Homo sapiens
gcatcattctttctgcta

SEQ ID NO: 5907989 - DNA, 15 bp, Homo sapiens
gcatcattgtaaatt

SEQ ID NO: 5907990 - DNA, 15 bp, Homo sapiens
gcatcatttcccctc

SEQ ID NO: 5907991 - DNA, 16 bp, Homo sapiens
gcatcatttcccctcc

SEQ ID NO: 5907992 - DNA, 17 bp, Homo sapiens
gcatcatttcccctccc

SEQ ID NO: 5907993 - DNA, 23 bp, Homo sapiens
gcatcatttcccctcccgcttcc

SEQ ID NO: 5907994 - DNA, 18 bp, Homo sapiens
gcatcattttcacctcca

SEQ ID NO: 5907995 - DNA, 15 bp, Homo sapiens
gcatccaaaggtgct

SEQ ID NO: 5907996 - DNA, 12 bp, Homo sapiens
gcatccaaataa

SEQ ID NO: 5907997 - DNA, 16 bp, Homo sapiens
gcatccaaataggagt

SEQ ID NO: 5907998 - DNA, 19 bp, Homo sapiens
gcatccaagcttaaccaag

SEQ ID NO: 5907999 - DNA, 21 bp, Homo sapiens
gcatccaagcttaaccaaggc

SEQ ID NO: 5908000 - DNA, 21 bp, Homo sapiens
gcatccaaggaacttcatgct

SEQ ID NO: 5908001 - DNA, 17 bp, Homo sapiens
gcatccaaggcaaacaa

SEQ ID NO: 5908002 - DNA, 14 bp, Homo sapiens
gcatccaaggcctt

SEQ ID NO: 5908003 - DNA, 16 bp, Homo sapiens
gcatccacccagtgct

SEQ ID NO: 5908004 - DNA, 19 bp, Homo sapiens
gcatccacccagtgctgcc

SEQ ID NO: 5908005 - DNA, 21 bp, Homo sapiens
gcatccacccagtgctgccat

SEQ ID NO: 5908006 - DNA, 23 bp, Homo sapiens
gcatccacccagtgctgccatgc

SEQ ID NO: 5908007 - DNA, 17 bp, Homo sapiens
gcatccaccgccacccc

SEQ ID NO: 5908008 - DNA, 19 bp, Homo sapiens
gcatccaccgccaccccac

SEQ ID NO: 5908009 - DNA, 17 bp, Homo sapiens
gcatccacctccttctc

SEQ ID NO: 5908010 - DNA, 21 bp, Homo sapiens
gcatccaccttcctgcccagg

SEQ ID NO: 5908011 - DNA, 14 bp, Homo sapiens
gcatccacgcacac

SEQ ID NO: 5908012 - DNA, 21 bp, Homo sapiens
gcatccacgtagggggcaggg

SEQ ID NO: 5908013 - DNA, 22 bp, Homo sapiens
gcatccacgtagggggcagggg

SEQ ID NO: 5908014 - DNA, 23 bp, Homo sapiens
gcatccagagtccctgcctggac

SEQ ID NO: 5908015 - DNA, 18 bp, Homo sapiens
gcatccagcagcagcact

SEQ ID NO: 5908016 - DNA, 14 bp, Homo sapiens
gcatccagcctgtg

SEQ ID NO: 5908017 - DNA, 17 bp, Homo sapiens
gcatccaggccagggct

SEQ ID NO: 5908018 - DNA, 14 bp, Homo sapiens
gcatccaggcctga

SEQ ID NO: 5908019 - DNA, 22 bp, Homo sapiens
gcatccaggcctgaggctgctg

SEQ ID NO: 5908020 - DNA, 17 bp, Homo sapiens
gcatccagggctgccag

SEQ ID NO: 5908021 - DNA, 15 bp, Homo sapiens
gcatccagttaacca

SEQ ID NO: 5908022 - DNA, 17 bp, Homo sapiens
gcatccataccagctcg

SEQ ID NO: 5908023 - DNA, 16 bp, Homo sapiens
gcatccatcttggaag

SEQ ID NO: 5908024 - DNA, 11 bp, Homo sapiens
gcatccatggg

SEQ ID NO: 5908025 - DNA, 18 bp, Homo sapiens
gcatccattcctcaggga

SEQ ID NO: 5908026 - DNA, 19 bp, Homo sapiens
gcatccatttgaacacatt

SEQ ID NO: 5908027 - DNA, 13 bp, Homo sapiens
gcatcccacagcc

SEQ ID NO: 5908028 - DNA, 23 bp, Homo sapiens
gcatcccacgttctgttaattta

SEQ ID NO: 5908029 - DNA, 20 bp, Homo sapiens
gcatcccagcacctgcctcc

SEQ ID NO: 5908030 - DNA, 21 bp, Homo sapiens
gcatcccagcacctgcctcct

SEQ ID NO: 5908031 - DNA, 16 bp, Homo sapiens
gcatcccagcctcaga

SEQ ID NO: 5908032 - DNA, 18 bp, Homo sapiens
gcatcccagcctgggggc

SEQ ID NO: 5908033 - DNA, 17 bp, Homo sapiens
gcatcccagcttgcccc

SEQ ID NO: 5908034 - DNA, 19 bp, Homo sapiens
gcatcccagcttgcccccg

SEQ ID NO: 5908035 - DNA, 13 bp, Homo sapiens
gcatcccagggga

SEQ ID NO: 5908036 - DNA, 15 bp, Homo sapiens
gcatcccaggggacc

SEQ ID NO: 5908037 - DNA, 16 bp, Homo sapiens
gcatcccaggggacca

SEQ ID NO: 5908038 - DNA, 19 bp, Homo sapiens
gcatcccaggggaccacac

SEQ ID NO: 5908039 - DNA, 17 bp, Homo sapiens
gcatcccagtggcctca

SEQ ID NO: 5908040 - DNA, 20 bp, Homo sapiens
gcatcccagtggcctcaacc

SEQ ID NO: 5908041 - DNA, 12 bp, Homo sapiens
gcatcccatccc

SEQ ID NO: 5908042 - DNA, 14 bp, Homo sapiens
gcatcccatccctt

SEQ ID NO: 5908043 - DNA, 15 bp, Homo sapiens
gcatcccatctctcc

SEQ ID NO: 5908044 - DNA, 13 bp, Homo sapiens
gcatcccatgggg

SEQ ID NO: 5908045 - DNA, 20 bp, Homo sapiens
gcatccccacgacccctgcc

SEQ ID NO: 5908046 - DNA, 22 bp, Homo sapiens
gcatccccacgacccctgcctc

SEQ ID NO: 5908047 - DNA, 15 bp, Homo sapiens
gcatccccagccccc

SEQ ID NO: 5908048 - DNA, 12 bp, Homo sapiens
gcatccccagtg

SEQ ID NO: 5908049 - DNA, 15 bp, Homo sapiens
gcatccccagtgcca

SEQ ID NO: 5908050 - DNA, 22 bp, Homo sapiens
gcatcccccacctactctcagg

SEQ ID NO: 5908051 - DNA, 15 bp, Homo sapiens
gcatcccccttagaa

SEQ ID NO: 5908052 - DNA, 14 bp, Homo sapiens
gcatcccctgtgaa

SEQ ID NO: 5908053 - DNA, 13 bp, Homo sapiens
gcatccccttcca

SEQ ID NO: 5908054 - DNA, 14 bp, Homo sapiens
gcatccccttccag

SEQ ID NO: 5908055 - DNA, 21 bp, Homo sapiens
gcatccccttggctgtgaggc

SEQ ID NO: 5908056 - DNA, 22 bp, Homo sapiens
gcatcccgatacctcagccctg

SEQ ID NO: 5908057 - DNA, 23 bp, Homo sapiens
gcatcccgatacctcagccctgg

SEQ ID NO: 5908058 - DNA, 13 bp, Homo sapiens
gcatcccggagga

SEQ ID NO: 5908059 - DNA, 18 bp, Homo sapiens
gcatcccggaggaaatct

SEQ ID NO: 5908060 - DNA, 12 bp, Homo sapiens
gcatccctgaga

SEQ ID NO: 5908061 - DNA, 17 bp, Homo sapiens
gcatccctgaggctgga

SEQ ID NO: 5908062 - DNA, 20 bp, Homo sapiens
gcatccctgaggctggactc

SEQ ID NO: 5908063 - DNA, 16 bp, Homo sapiens
gcatccctggagcagg

SEQ ID NO: 5908064 - DNA, 19 bp, Homo sapiens
gcatccctggagcaggagc

SEQ ID NO: 5908065 - DNA, 17 bp, Homo sapiens
gcatccctgggccttgg

SEQ ID NO: 5908066 - DNA, 18 bp, Homo sapiens
gcatccctgggccttggg

SEQ ID NO: 5908067 - DNA, 19 bp, Homo sapiens
gcatccctgggccttgggc

SEQ ID NO: 5908068 - DNA, 12 bp, Homo sapiens
gcatccctgtgt

SEQ ID NO: 5908069 - DNA, 15 bp, Homo sapiens
gcatccctgtgtcca

SEQ ID NO: 5908070 - DNA, 13 bp, Homo sapiens
gcatcccttccca

SEQ ID NO: 5908071 - DNA, 17 bp, Homo sapiens
gcatcccttcccacatg

SEQ ID NO: 5908072 - DNA, 19 bp, Homo sapiens
gcatcccttcgcctgcagc

SEQ ID NO: 5908073 - DNA, 20 bp, Homo sapiens
gcatcccttgaccaggcctg

SEQ ID NO: 5908074 - DNA, 13 bp, Homo sapiens
gcatcccttggcc

SEQ ID NO: 5908075 - DNA, 22 bp, Homo sapiens
gcatccgagcccctgtttctcc

SEQ ID NO: 5908076 - DNA, 17 bp, Homo sapiens
gcatccgcaggtgctgg

SEQ ID NO: 5908077 - DNA, 13 bp, Homo sapiens
gcatccggagaat

SEQ ID NO: 5908078 - DNA, 19 bp, Homo sapiens
gcatccgtagttccctgaa

SEQ ID NO: 5908079 - DNA, 14 bp, Homo sapiens
gcatccgtcctggg

SEQ ID NO: 5908080 - DNA, 17 bp, Homo sapiens
gcatccgtctcccctcg

SEQ ID NO: 5908081 - DNA, 16 bp, Homo sapiens
gcatccgtgaggcagg

SEQ ID NO: 5908082 - DNA, 14 bp, Homo sapiens
gcatccgtgtattt

SEQ ID NO: 5908083 - DNA, 24 bp, Homo sapiens
gcatcctaagaaatatgtgagatt

SEQ ID NO: 5908084 - DNA, 15 bp, Homo sapiens
gcatcctatgcttaa

SEQ ID NO: 5908085 - DNA, 16 bp, Homo sapiens
gcatcctatgcttaat

SEQ ID NO: 5908086 - DNA, 14 bp, Homo sapiens
gcatcctatttggt

SEQ ID NO: 5908087 - DNA, 15 bp, Homo sapiens
gcatcctcactgggc

SEQ ID NO: 5908088 - DNA, 22 bp, Homo sapiens
gcatcctcactgggctcactgc

SEQ ID NO: 5908089 - DNA, 16 bp, Homo sapiens
gcatcctcagccccag

SEQ ID NO: 5908090 - DNA, 21 bp, Homo sapiens
gcatcctcagttcctgcagca

SEQ ID NO: 5908091 - DNA, 14 bp, Homo sapiens
gcatcctccaagaa

SEQ ID NO: 5908092 - DNA, 22 bp, Homo sapiens
gcatcctccacatcctgtgtca

SEQ ID NO: 5908093 - DNA, 14 bp, Homo sapiens
gcatcctccagccc

SEQ ID NO: 5908094 - DNA, 15 bp, Homo sapiens
gcatcctccagcccc

SEQ ID NO: 5908095 - DNA, 22 bp, Homo sapiens
gcatcctccagggggcctgcag

SEQ ID NO: 5908096 - DNA, 14 bp, Homo sapiens
gcatcctccccacc

SEQ ID NO: 5908097 - DNA, 17 bp, Homo sapiens
gcatcctccccaccaga

SEQ ID NO: 5908098 - DNA, 18 bp, Homo sapiens
gcatcctccccaccagag

SEQ ID NO: 5908099 - DNA, 17 bp, Homo sapiens
gcatcctccgcctcccg

SEQ ID NO: 5908100 - DNA, 21 bp, Homo sapiens
gcatcctctcccccacaagag

SEQ ID NO: 5908101 - DNA, 12 bp, Homo sapiens
gcatcctctgac

SEQ ID NO: 5908102 - DNA, 16 bp, Homo sapiens
gcatcctctgactcca

SEQ ID NO: 5908103 - DNA, 20 bp, Homo sapiens
gcatcctctgactccactca

SEQ ID NO: 5908104 - DNA, 11 bp, Homo sapiens
gcatcctgaaa

SEQ ID NO: 5908105 - DNA, 17 bp, Homo sapiens
gcatcctgaaagccagc

SEQ ID NO: 5908106 - DNA, 21 bp, Homo sapiens
gcatcctgagccccgccctct

SEQ ID NO: 5908107 - DNA, 15 bp, Homo sapiens
gcatcctgaggccag

SEQ ID NO: 5908108 - DNA, 18 bp, Homo sapiens
gcatcctgcaaggtgaaa

SEQ ID NO: 5908109 - DNA, 20 bp, Homo sapiens
gcatcctgcagggcttctcc

SEQ ID NO: 5908110 - DNA, 20 bp, Homo sapiens
gcatcctgcccgagggcagc

SEQ ID NO: 5908111 - DNA, 13 bp, Homo sapiens
gcatcctgcctgg

SEQ ID NO: 5908112 - DNA, 21 bp, Homo sapiens
gcatcctgcctgggtgggaca

SEQ ID NO: 5908113 - DNA, 23 bp, Homo sapiens
gcatcctgccttagagccaggca

SEQ ID NO: 5908114 - DNA, 13 bp, Homo sapiens
gcatcctgctggg

SEQ ID NO: 5908115 - DNA, 13 bp, Homo sapiens
gcatcctgcttcc

SEQ ID NO: 5908116 - DNA, 17 bp, Homo sapiens
gcatcctgcttcctgaa

SEQ ID NO: 5908117 - DNA, 23 bp, Homo sapiens
gcatcctgcttcctgaaagctgt

SEQ ID NO: 5908118 - DNA, 21 bp, Homo sapiens
gcatgacagaaaatatgtatt

SEQ ID NO: 5908119 - DNA, 15 bp, Homo sapiens
gcatgacagcctgca

SEQ ID NO: 5908120 - DNA, 21 bp, Homo sapiens
gcatgacatcctttcttttaa

SEQ ID NO: 5908121 - DNA, 16 bp, Homo sapiens
gcatgaccatcctgtc

SEQ ID NO: 5908122 - DNA, 11 bp, Homo sapiens
gcatgaccctg

SEQ ID NO: 5908123 - DNA, 16 bp, Homo sapiens
gcatgaccctggagcc

SEQ ID NO: 5908124 - DNA, 16 bp, Homo sapiens
gcatgacctgtgacca

SEQ ID NO: 5908125 - DNA, 22 bp, Homo sapiens
gcatgaccttttggcctttgta

SEQ ID NO: 5908126 - DNA, 21 bp, Homo sapiens
gcatgacttgtagcatattct

SEQ ID NO: 5908127 - DNA, 23 bp, Homo sapiens
gcatgactttagatgggaagcct

SEQ ID NO: 5908128 - DNA, 17 bp, Homo sapiens
gcatgactttccttagg

SEQ ID NO: 5908129 - DNA, 17 bp, Homo sapiens
gcatgagaactaaatag

SEQ ID NO: 5908130 - DNA, 18 bp, Homo sapiens
gcatgagaactaaataga

SEQ ID NO: 5908131 - DNA, 12 bp, Homo sapiens
gcatgagacttt

SEQ ID NO: 5908132 - DNA, 13 bp, Homo sapiens
gcatgagactttc

SEQ ID NO: 5908133 - DNA, 16 bp, Homo sapiens
gcatgagattgtacat

SEQ ID NO: 5908134 - DNA, 19 bp, Homo sapiens
gcatgagattgtacatttt

SEQ ID NO: 5908135 - DNA, 22 bp, Homo sapiens
gcatgagcattggatacagcag

SEQ ID NO: 5908136 - DNA, 13 bp, Homo sapiens
gcatgagccactg

SEQ ID NO: 5908137 - DNA, 22 bp, Homo sapiens
gcatgagccactgagcctggcc

SEQ ID NO: 5908138 - DNA, 13 bp, Homo sapiens
gcatgagccagct

SEQ ID NO: 5908139 - DNA, 15 bp, Homo sapiens
gcatgagctattgct

SEQ ID NO: 5908140 - DNA, 22 bp, Homo sapiens
gcatgagctccctcgctgtatg

SEQ ID NO: 5908141 - DNA, 15 bp, Homo sapiens
gcatgagctggcaac

SEQ ID NO: 5908142 - DNA, 21 bp, Homo sapiens
gcatgaggaactagccaccaa

SEQ ID NO: 5908143 - DNA, 12 bp, Homo sapiens
gcatgaggaggt

SEQ ID NO: 5908144 - DNA, 12 bp, Homo sapiens
gcatgaggcccc

SEQ ID NO: 5908145 - DNA, 19 bp, Homo sapiens
gcatgagggatcacagggc

SEQ ID NO: 5908146 - DNA, 22 bp, Homo sapiens
gcatgaggggttcctcccctcc

SEQ ID NO: 5908147 - DNA, 23 bp, Homo sapiens
gcatgagtgctggatattttact

SEQ ID NO: 5908148 - DNA, 22 bp, Homo sapiens
gcatgagtggccttaataaata

SEQ ID NO: 5908149 - DNA, 16 bp, Homo sapiens
gcatgatattgtatgt

SEQ ID NO: 5908150 - DNA, 22 bp, Homo sapiens
gcatgatattgttctccaagga

SEQ ID NO: 5908151 - DNA, 16 bp, Homo sapiens
gcatgatattttcaga

SEQ ID NO: 5908152 - DNA, 14 bp, Homo sapiens
gcatgatctgtcaa

SEQ ID NO: 5908153 - DNA, 20 bp, Homo sapiens
gcatgatcttgttactgtga

SEQ ID NO: 5908154 - DNA, 16 bp, Homo sapiens
gcatgatgactcttct

SEQ ID NO: 5908155 - DNA, 21 bp, Homo sapiens
gcatgatgactcttcttatca

SEQ ID NO: 5908156 - DNA, 14 bp, Homo sapiens
gcatgatggagctg

SEQ ID NO: 5908157 - DNA, 15 bp, Homo sapiens
gcatgatggagctga

SEQ ID NO: 5908158 - DNA, 16 bp, Homo sapiens
gcatgatggagctgat

SEQ ID NO: 5908159 - DNA, 13 bp, Homo sapiens
gcatgatgggaaa

SEQ ID NO: 5908160 - DNA, 18 bp, Homo sapiens
gcatgatgggaaaatatt

SEQ ID NO: 5908161 - DNA, 20 bp, Homo sapiens
gcatgatgggaggtgtgcca

SEQ ID NO: 5908162 - DNA, 13 bp, Homo sapiens
gcatgatggtgag

SEQ ID NO: 5908163 - DNA, 17 bp, Homo sapiens
gcatgatggtgagagcc

SEQ ID NO: 5908164 - DNA, 20 bp, Homo sapiens
gcatgatgttaaccagaata

SEQ ID NO: 5908165 - DNA, 22 bp, Homo sapiens
gcatgatgtttccctctccttc

SEQ ID NO: 5908166 - DNA, 23 bp, Homo sapiens
gcatgatttactcttagagatga

SEQ ID NO: 5908167 - DNA, 11 bp, Homo sapiens
gcatgatttat

SEQ ID NO: 5908168 - DNA, 15 bp, Homo sapiens
gcatgatttatatat

SEQ ID NO: 5908169 - DNA, 21 bp, Homo sapiens
gcatgatttatatatggcata

SEQ ID NO: 5908170 - DNA, 22 bp, Homo sapiens
gcatgatttatatatggcatat

SEQ ID NO: 5908171 - DNA, 16 bp, Homo sapiens
gcatgatttgaaaaaa

SEQ ID NO: 5908172 - DNA, 14 bp, Homo sapiens
gcatgattttatac

SEQ ID NO: 5908173 - DNA, 21 bp, Homo sapiens
gcatgattttggctcactgca

SEQ ID NO: 5908174 - DNA, 15 bp, Homo sapiens
gcatgattttgtaac

SEQ ID NO: 5908175 - DNA, 14 bp, Homo sapiens
gcatgcaaaaatga

SEQ ID NO: 5908176 - DNA, 17 bp, Homo sapiens
gcatgcaaacaagaaac

SEQ ID NO: 5908177 - DNA, 18 bp, Homo sapiens
gcatgcaaaccaggagca

SEQ ID NO: 5908178 - DNA, 20 bp, Homo sapiens
gcatgcaaacttggatcaga

SEQ ID NO: 5908179 - DNA, 16 bp, Homo sapiens
gcatgcaaatgagctc

SEQ ID NO: 5908180 - DNA, 18 bp, Homo sapiens
gcatgcaaatgagctctg

SEQ ID NO: 5908181 - DNA, 14 bp, Homo sapiens
gcatgcaataatgt

SEQ ID NO: 5908182 - DNA, 15 bp, Homo sapiens
gcatgcaatttgaag

SEQ ID NO: 5908183 - DNA, 15 bp, Homo sapiens
gcatgcacacggctg

SEQ ID NO: 5908184 - DNA, 17 bp, Homo sapiens
gcatgcacacggctggt

SEQ ID NO: 5908185 - DNA, 24 bp, Homo sapiens
gcatgcacacggctggtcactctg

SEQ ID NO: 5908186 - DNA, 16 bp, Homo sapiens
gcatgcacagctgctt

SEQ ID NO: 5908187 - DNA, 17 bp, Homo sapiens
gcatgcacagctgcttg

SEQ ID NO: 5908188 - DNA, 22 bp, Homo sapiens
gcatgcacagctgcttgtcctg

SEQ ID NO: 5908189 - DNA, 13 bp, Homo sapiens
gcatgcacatctg

SEQ ID NO: 5908190 - DNA, 19 bp, Homo sapiens
gcatgcacatgctgtctgg

SEQ ID NO: 5908191 - DNA, 21 bp, Homo sapiens
gcatgcaccagtgccgcctgt

SEQ ID NO: 5908192 - DNA, 15 bp, Homo sapiens
gcatgcacgggcatg

SEQ ID NO: 5908193 - DNA, 16 bp, Homo sapiens
gcatgcactgttcccc

SEQ ID NO: 5908194 - DNA, 17 bp, Homo sapiens
gcatgcactgttccccc

SEQ ID NO: 5908195 - DNA, 14 bp, Homo sapiens
gcatgcagaaaggg

SEQ ID NO: 5908196 - DNA, 12 bp, Homo sapiens
gcatgcagcagc

SEQ ID NO: 5908197 - DNA, 19 bp, Homo sapiens
gcatgcagcgaattcagaa

SEQ ID NO: 5908198 - DNA, 14 bp, Homo sapiens
gcatgcagctgcct

SEQ ID NO: 5908199 - DNA, 15 bp, Homo sapiens
gcatgcagctgcctg

SEQ ID NO: 5908200 - DNA, 14 bp, Homo sapiens
gcatgcagctttgc

SEQ ID NO: 5908201 - DNA, 19 bp, Homo sapiens
gcatgcagtcttgtactgt

SEQ ID NO: 5908202 - DNA, 20 bp, Homo sapiens
gcatgcagtcttgtactgtg

SEQ ID NO: 5908203 - DNA, 21 bp, Homo sapiens
gcatgcatcccactgctgact

SEQ ID NO: 5908204 - DNA, 19 bp, Homo sapiens
gcatgcatgccctctctga

SEQ ID NO: 5908205 - DNA, 17 bp, Homo sapiens
gcatgcatggaggactc

SEQ ID NO: 5908206 - DNA, 22 bp, Homo sapiens
gcatgcatggaggactctcctc

SEQ ID NO: 5908207 - DNA, 22 bp, Homo sapiens
gcatgcattgaaaaatttctaa

SEQ ID NO: 5908208 - DNA, 17 bp, Homo sapiens
gcatgcattgagctgcc

SEQ ID NO: 5908209 - DNA, 20 bp, Homo sapiens
gcatgcattgagctgcctcc

SEQ ID NO: 5908210 - DNA, 14 bp, Homo sapiens
gcatgcattttgca

SEQ ID NO: 5908211 - DNA, 21 bp, Homo sapiens
gcatgcattttgcagcagtga

SEQ ID NO: 5908212 - DNA, 21 bp, Homo sapiens
gcatgccaacaagaatgcatt

SEQ ID NO: 5908213 - DNA, 21 bp, Homo sapiens
gcatgccaagtactaaagcac

SEQ ID NO: 5908214 - DNA, 12 bp, Homo sapiens
gcatgccaccct

SEQ ID NO: 5908215 - DNA, 19 bp, Homo sapiens
gcatgccacgccccgtgtc

SEQ ID NO: 5908216 - DNA, 22 bp, Homo sapiens
gcatgccaggacccgccagccc

SEQ ID NO: 5908217 - DNA, 17 bp, Homo sapiens
gcatgccaggctgggca

SEQ ID NO: 5908218 - DNA, 18 bp, Homo sapiens
gcatgccaggctgggcac

SEQ ID NO: 5908219 - DNA, 16 bp, Homo sapiens
gcatgccatgtctgag

SEQ ID NO: 5908220 - DNA, 17 bp, Homo sapiens
gcatgccccacccaccc

SEQ ID NO: 5908221 - DNA, 18 bp, Homo sapiens
gcatgccccacccacccc

SEQ ID NO: 5908222 - DNA, 21 bp, Homo sapiens
gcatgccccacccacccctcc

SEQ ID NO: 5908223 - DNA, 20 bp, Homo sapiens
gcatgccccggccacctctg

SEQ ID NO: 5908224 - DNA, 12 bp, Homo sapiens
gcatgccctctc

SEQ ID NO: 5908225 - DNA, 17 bp, Homo sapiens
gcatgcccttcctttct

SEQ ID NO: 5908226 - DNA, 23 bp, Homo sapiens
gcatgccgggcccctccatccac

SEQ ID NO: 5908227 - DNA, 13 bp, Homo sapiens
gcatgcctcagcc

SEQ ID NO: 5908228 - DNA, 18 bp, Homo sapiens
gcatgcctcagccagccc

SEQ ID NO: 5908229 - DNA, 20 bp, Homo sapiens
gcatgcctcagccagccctg

SEQ ID NO: 5908230 - DNA, 16 bp, Homo sapiens
gcatgcctcccaggcc

SEQ ID NO: 5908231 - DNA, 11 bp, Homo sapiens
gcatgcctctg

SEQ ID NO: 5908232 - DNA, 14 bp, Homo sapiens
gcatgcctggacaa

SEQ ID NO: 5908233 - DNA, 13 bp, Homo sapiens
gcatgcctggcct

SEQ ID NO: 5908234 - DNA, 16 bp, Homo sapiens
gcatgcctgggaatcc

SEQ ID NO: 5908235 - DNA, 21 bp, Homo sapiens
gcatgcctgggaatcctgctg

SEQ ID NO: 5908236 - DNA, 23 bp, Homo sapiens
gcatgcctgggcccaggcccagc

SEQ ID NO: 5908237 - DNA, 18 bp, Homo sapiens
gcatgcctgtaatcccag

SEQ ID NO: 5908238 - DNA, 18 bp, Homo sapiens
gcatgcctgtagtctcag

SEQ ID NO: 5908239 - DNA, 19 bp, Homo sapiens
gcatgcctgtagtctcagc

SEQ ID NO: 5908240 - DNA, 16 bp, Homo sapiens
gcatgcctgtcctttc

SEQ ID NO: 5908241 - DNA, 13 bp, Homo sapiens
gcatgcctgtgtg

SEQ ID NO: 5908242 - DNA, 16 bp, Homo sapiens
gcatgccttccagcac

SEQ ID NO: 5908243 - DNA, 15 bp, Homo sapiens
gcatgcgaaatgttc

SEQ ID NO: 5908244 - DNA, 19 bp, Homo sapiens
gcatgcgaaatgttctcat

SEQ ID NO: 5908245 - DNA, 16 bp, Homo sapiens
gcatgcgatgtcatat

SEQ ID NO: 5908246 - DNA, 21 bp, Homo sapiens
gcatgcgcacaaggctgacca

SEQ ID NO: 5908247 - DNA, 14 bp, Homo sapiens
gcatgcgcagaggc

SEQ ID NO: 5908248 - DNA, 21 bp, Homo sapiens
gcatgcgccaccatgccctat

SEQ ID NO: 5908249 - DNA, 15 bp, Homo sapiens
gcatgcggcccagcc

SEQ ID NO: 5908250 - DNA, 19 bp, Homo sapiens
gcatgcggcccagcccggc

SEQ ID NO: 5908251 - DNA, 20 bp, Homo sapiens
gcatgcggcccagcccggct

SEQ ID NO: 5908252 - DNA, 11 bp, Homo sapiens
gcatgctcagt

SEQ ID NO: 5908253 - DNA, 16 bp, Homo sapiens
gcatgctcagtattga

SEQ ID NO: 5908254 - DNA, 16 bp, Homo sapiens
gcatgctcagtgcctt

SEQ ID NO: 5908255 - DNA, 15 bp, Homo sapiens
gcatgctccctcatg

SEQ ID NO: 5908256 - DNA, 18 bp, Homo sapiens
gcatgctctctgcagcca

SEQ ID NO: 5908257 - DNA, 12 bp, Homo sapiens
gcatgctctgga

SEQ ID NO: 5908258 - DNA, 18 bp, Homo sapiens
gcatgctctggaagcctg

SEQ ID NO: 5908259 - DNA, 13 bp, Homo sapiens
gcatgctgcctgc

SEQ ID NO: 5908260 - DNA, 14 bp, Homo sapiens
gcatgctgctttgc

SEQ ID NO: 5908261 - DNA, 12 bp, Homo sapiens
gcatgctggagt

SEQ ID NO: 5908262 - DNA, 21 bp, Homo sapiens
gcatgctggagtacccagcct

SEQ ID NO: 5908263 - DNA, 13 bp, Homo sapiens
gcatgctggcctg

SEQ ID NO: 5908264 - DNA, 17 bp, Homo sapiens
gcatgctggcctgtggc

SEQ ID NO: 5908265 - DNA, 18 bp, Homo sapiens
gcatgctggcctgtggca

SEQ ID NO: 5908266 - DNA, 21 bp, Homo sapiens
gcatgctgtattatgaaatcg

SEQ ID NO: 5908267 - DNA, 14 bp, Homo sapiens
gcatgcttaaattt

SEQ ID NO: 5908268 - DNA, 18 bp, Homo sapiens
gcatgcttaaattttaac

SEQ ID NO: 5908269 - DNA, 15 bp, Homo sapiens
gcatgcttagagcat

SEQ ID NO: 5908270 - DNA, 16 bp, Homo sapiens
gcatgcttcccagagg

SEQ ID NO: 5908271 - DNA, 18 bp, Homo sapiens
gcatgcttcccagaggga

SEQ ID NO: 5908272 - DNA, 17 bp, Homo sapiens
gcatgcttccctgcagc

SEQ ID NO: 5908273 - DNA, 19 bp, Homo sapiens
gcatgcttccctgcagctg

SEQ ID NO: 5908274 - DNA, 12 bp, Homo sapiens
gcatgcttcctt

SEQ ID NO: 5908275 - DNA, 17 bp, Homo sapiens
gcatgcttcctttctct

SEQ ID NO: 5908276 - DNA, 19 bp, Homo sapiens
gcatgcttcctttctctcc

SEQ ID NO: 5908277 - DNA, 21 bp, Homo sapiens
gcatgcttctattagtcacct

SEQ ID NO: 5908278 - DNA, 15 bp, Homo sapiens
gcatgctttctttga

SEQ ID NO: 5908279 - DNA, 22 bp, Homo sapiens
gcatgctttgagaccagaagaa

SEQ ID NO: 5908280 - DNA, 22 bp, Homo sapiens
gcatgctttggaaatttggaag

SEQ ID NO: 5908281 - DNA, 14 bp, Homo sapiens
gcatggaaaaatgg

SEQ ID NO: 5908282 - DNA, 23 bp, Homo sapiens
gcatggaaaaatggttgatggaa

SEQ ID NO: 5908283 - DNA, 15 bp, Homo sapiens
gcatggaaagatggg

SEQ ID NO: 5908284 - DNA, 18 bp, Homo sapiens
gcatggaaagatggggag

SEQ ID NO: 5908285 - DNA, 21 bp, Homo sapiens
gcatggaaggggcttctggac

SEQ ID NO: 5908286 - DNA, 23 bp, Homo sapiens
gcatggaagtaattaaggtacat

SEQ ID NO: 5908287 - DNA, 19 bp, Homo sapiens
gcatggacaccttgtgttt

SEQ ID NO: 5908288 - DNA, 15 bp, Homo sapiens
gcatggacagggcca

SEQ ID NO: 5908289 - DNA, 17 bp, Homo sapiens
gcatggacagggccagg

SEQ ID NO: 5908290 - DNA, 19 bp, Homo sapiens
gcatggacagtgtgggcgc

SEQ ID NO: 5908291 - DNA, 22 bp, Homo sapiens
gcatggacagtgtgggcgctct

SEQ ID NO: 5908292 - DNA, 22 bp, Homo sapiens
gcatggacatttagaagaaaga

SEQ ID NO: 5908293 - DNA, 17 bp, Homo sapiens
gcatggacctaacattc

SEQ ID NO: 5908294 - DNA, 18 bp, Homo sapiens
gcatggacctaacattcg

SEQ ID NO: 5908295 - DNA, 14 bp, Homo sapiens
gcatggacgcctgg

SEQ ID NO: 5908296 - DNA, 16 bp, Homo sapiens
gcattctacacctgga

SEQ ID NO: 5908297 - DNA, 14 bp, Homo sapiens
gcattctagtgcag

SEQ ID NO: 5908298 - DNA, 16 bp, Homo sapiens
gcattctattgccttc

SEQ ID NO: 5908299 - DNA, 20 bp, Homo sapiens
gcattctattgccttctttg

SEQ ID NO: 5908300 - DNA, 13 bp, Homo sapiens
gcattctcactcc

SEQ ID NO: 5908301 - DNA, 15 bp, Homo sapiens
gcattctcactccta

SEQ ID NO: 5908302 - DNA, 20 bp, Homo sapiens
gcattctcattggaaattta

SEQ ID NO: 5908303 - DNA, 18 bp, Homo sapiens
gcattctcggtacttctg

SEQ ID NO: 5908304 - DNA, 16 bp, Homo sapiens
gcattctctcccatcc

SEQ ID NO: 5908305 - DNA, 20 bp, Homo sapiens
gcattctctcccatcctggg

SEQ ID NO: 5908306 - DNA, 14 bp, Homo sapiens
gcattctctctcca

SEQ ID NO: 5908307 - DNA, 14 bp, Homo sapiens
gcattctctgaaga

SEQ ID NO: 5908308 - DNA, 13 bp, Homo sapiens
gcattctctgccc

SEQ ID NO: 5908309 - DNA, 20 bp, Homo sapiens
gcattctctgcccactttgc

SEQ ID NO: 5908310 - DNA, 19 bp, Homo sapiens
gcattctgaatgaataaag

SEQ ID NO: 5908311 - DNA, 17 bp, Homo sapiens
gcattctgataggaggg

SEQ ID NO: 5908312 - DNA, 20 bp, Homo sapiens
gcattctgcctctctaggac

SEQ ID NO: 5908313 - DNA, 20 bp, Homo sapiens
gcattctgcctgcctgggaa

SEQ ID NO: 5908314 - DNA, 16 bp, Homo sapiens
gcattctggacctctg

SEQ ID NO: 5908315 - DNA, 16 bp, Homo sapiens
gcattctggagacaga

SEQ ID NO: 5908316 - DNA, 22 bp, Homo sapiens
gcattctggaggggagagcttt

SEQ ID NO: 5908317 - DNA, 15 bp, Homo sapiens
gcattctggcagttt

SEQ ID NO: 5908318 - DNA, 17 bp, Homo sapiens
gcattctggcataattt

SEQ ID NO: 5908319 - DNA, 18 bp, Homo sapiens
gcattctgtttcctcttg

SEQ ID NO: 5908320 - DNA, 22 bp, Homo sapiens
gcattctttcttctctttactt

SEQ ID NO: 5908321 - DNA, 13 bp, Homo sapiens
gcattctttgcaa

SEQ ID NO: 5908322 - DNA, 17 bp, Homo sapiens
gcattctttggtaattt

SEQ ID NO: 5908323 - DNA, 21 bp, Homo sapiens
gcattcttttaaaagacaaga

SEQ ID NO: 5908324 - DNA, 16 bp, Homo sapiens
gcattcttttaaagtt

SEQ ID NO: 5908325 - DNA, 20 bp, Homo sapiens
gcattcttttaaagttttat

SEQ ID NO: 5908326 - DNA, 17 bp, Homo sapiens
gcattcttttgctgttt

SEQ ID NO: 5908327 - DNA, 18 bp, Homo sapiens
gcattgaaataataatat

SEQ ID NO: 5908328 - DNA, 12 bp, Homo sapiens
gcattgaacaca

SEQ ID NO: 5908329 - DNA, 19 bp, Homo sapiens
gcattgaacacaaactgta

SEQ ID NO: 5908330 - DNA, 21 bp, Homo sapiens
gcattgaacacaaactgtaaa

SEQ ID NO: 5908331 - DNA, 14 bp, Homo sapiens
gcattgaacttctt

SEQ ID NO: 5908332 - DNA, 23 bp, Homo sapiens
gcattgaattcctaaagctgctt

SEQ ID NO: 5908333 - DNA, 15 bp, Homo sapiens
gcattgacaaatctg

SEQ ID NO: 5908334 - DNA, 14 bp, Homo sapiens
gcattgacataggt

SEQ ID NO: 5908335 - DNA, 21 bp, Homo sapiens
gcattgacataggtcataaag

SEQ ID NO: 5908336 - DNA, 22 bp, Homo sapiens
gcattgacataggtcataaagc

SEQ ID NO: 5908337 - DNA, 23 bp, Homo sapiens
gcattgacataggtcataaagca

SEQ ID NO: 5908338 - DNA, 23 bp, Homo sapiens
gcattgaccgcgactaatttcaa

SEQ ID NO: 5908339 - DNA, 15 bp, Homo sapiens
gcattgacctggagg

SEQ ID NO: 5908340 - DNA, 15 bp, Homo sapiens
gcattgaccttcatg

SEQ ID NO: 5908341 - DNA, 21 bp, Homo sapiens
gcattgactttcagtaaacat

SEQ ID NO: 5908342 - DNA, 12 bp, Homo sapiens
gcattgagaact

SEQ ID NO: 5908343 - DNA, 22 bp, Homo sapiens
gcattgagaactgcatatgttt

SEQ ID NO: 5908344 - DNA, 15 bp, Homo sapiens
gcattgagcatattt

SEQ ID NO: 5908345 - DNA, 15 bp, Homo sapiens
gcattgagctgagat

SEQ ID NO: 5908346 - DNA, 19 bp, Homo sapiens
gcattgagctgcctccagc

SEQ ID NO: 5908347 - DNA, 20 bp, Homo sapiens
gcattgagctgcctccagcc

SEQ ID NO: 5908348 - DNA, 21 bp, Homo sapiens
gcattgagctgcctccagcct

SEQ ID NO: 5908349 - DNA, 23 bp, Homo sapiens
gcattgagctgcctccagcctgg

SEQ ID NO: 5908350 - DNA, 23 bp, Homo sapiens
gcattgagggctctaaacaggat

SEQ ID NO: 5908351 - DNA, 15 bp, Homo sapiens
gcattgagtccagct

SEQ ID NO: 5908352 - DNA, 22 bp, Homo sapiens
gcattgagtccagctttccttc

SEQ ID NO: 5908353 - DNA, 15 bp, Homo sapiens
gcattgataatcttc

SEQ ID NO: 5908354 - DNA, 17 bp, Homo sapiens
gcattgataatcttcag

SEQ ID NO: 5908355 - DNA, 18 bp, Homo sapiens
gcattgatattgtgaaca

SEQ ID NO: 5908356 - DNA, 16 bp, Homo sapiens
gcattgatggggaagg

SEQ ID NO: 5908357 - DNA, 18 bp, Homo sapiens
gcattgatggggaaggag

SEQ ID NO: 5908358 - DNA, 21 bp, Homo sapiens
gcattgcactaaaagtgatgt

SEQ ID NO: 5908359 - DNA, 13 bp, Homo sapiens
gcattgcagccta

SEQ ID NO: 5908360 - DNA, 20 bp, Homo sapiens
gcattgcagtcactttgaca

SEQ ID NO: 5908361 - DNA, 14 bp, Homo sapiens
gcattgccaagggc

SEQ ID NO: 5908362 - DNA, 20 bp, Homo sapiens
gcattgccaatatcctgtat

SEQ ID NO: 5908363 - DNA, 20 bp, Homo sapiens
gcattgccgctgtataaagc

SEQ ID NO: 5908364 - DNA, 17 bp, Homo sapiens
gcattgcctggactgac

SEQ ID NO: 5908365 - DNA, 20 bp, Homo sapiens
gcattgcctggactgaccac

SEQ ID NO: 5908366 - DNA, 12 bp, Homo sapiens
gcattgcctggc

SEQ ID NO: 5908367 - DNA, 14 bp, Homo sapiens
gcattgctagataa

SEQ ID NO: 5908368 - DNA, 17 bp, Homo sapiens
gcattgctcagcccgct

SEQ ID NO: 5908369 - DNA, 17 bp, Homo sapiens
gcattgctggactgatg

SEQ ID NO: 5908370 - DNA, 18 bp, Homo sapiens
gcattgctggactgatgg

SEQ ID NO: 5908371 - DNA, 12 bp, Homo sapiens
gcattgctgtgt

SEQ ID NO: 5908372 - DNA, 12 bp, Homo sapiens
gcattgctgtta

SEQ ID NO: 5908373 - DNA, 12 bp, Homo sapiens
gcattgctttcc

SEQ ID NO: 5908374 - DNA, 20 bp, Homo sapiens
gcattgcttttattttgaaa

SEQ ID NO: 5908375 - DNA, 21 bp, Homo sapiens
gcattggaaaccctatttccc

SEQ ID NO: 5908376 - DNA, 13 bp, Homo sapiens
gcattggaattct

SEQ ID NO: 5908377 - DNA, 18 bp, Homo sapiens
gcattggatacagcagta

SEQ ID NO: 5908378 - DNA, 18 bp, Homo sapiens
gcattggcatctgctttt

SEQ ID NO: 5908379 - DNA, 20 bp, Homo sapiens
gcattggccagaccacagca

SEQ ID NO: 5908380 - DNA, 19 bp, Homo sapiens
gcattggcccctgagccca

SEQ ID NO: 5908381 - DNA, 17 bp, Homo sapiens
gcattggcctggcctcc

SEQ ID NO: 5908382 - DNA, 16 bp, Homo sapiens
gcattgggctgacacc

SEQ ID NO: 5908383 - DNA, 16 bp, Homo sapiens
gcattggggggccggg

SEQ ID NO: 5908384 - DNA, 18 bp, Homo sapiens
gcattggggggccgggca

SEQ ID NO: 5908385 - DNA, 20 bp, Homo sapiens
gcattggggttcctctgtac

SEQ ID NO: 5908386 - DNA, 23 bp, Homo sapiens
gcattgggtagctatactcatgg

SEQ ID NO: 5908387 - DNA, 21 bp, Homo sapiens
gcattggtggcatcacagacc

SEQ ID NO: 5908388 - DNA, 22 bp, Homo sapiens
gcattggtggcatcacagaccc

SEQ ID NO: 5908389 - DNA, 17 bp, Homo sapiens
gcattggttccctttgc

SEQ ID NO: 5908390 - DNA, 11 bp, Homo sapiens
gcattgtaaat

SEQ ID NO: 5908391 - DNA, 12 bp, Homo sapiens
gcattgtaaata

SEQ ID NO: 5908392 - DNA, 16 bp, Homo sapiens
gcattgtaaatgtgct

SEQ ID NO: 5908393 - DNA, 20 bp, Homo sapiens
gcattgtatagatataatga

SEQ ID NO: 5908394 - DNA, 19 bp, Homo sapiens
gcattgtatcgatgttatg

SEQ ID NO: 5908395 - DNA, 12 bp, Homo sapiens
gcattgtctctc

SEQ ID NO: 5908396 - DNA, 11 bp, Homo sapiens
gcattgtctgt

SEQ ID NO: 5908397 - DNA, 13 bp, Homo sapiens
gcattgtcttgtt

SEQ ID NO: 5908398 - DNA, 22 bp, Homo sapiens
gcattgtctttaatataataaa

SEQ ID NO: 5908399 - DNA, 13 bp, Homo sapiens
gcattgtctttgc

SEQ ID NO: 5908400 - DNA, 16 bp, Homo sapiens
gcattgtctttgctgt

SEQ ID NO: 5908401 - DNA, 18 bp, Homo sapiens
gcattgtgaactgacagg

SEQ ID NO: 5908402 - DNA, 15 bp, Homo sapiens
gcattgtgatgttta

SEQ ID NO: 5908403 - DNA, 17 bp, Homo sapiens
gcattgtgattggcctg

SEQ ID NO: 5908404 - DNA, 15 bp, Homo sapiens
gcattgtggctgtca

SEQ ID NO: 5908405 - DNA, 23 bp, Homo sapiens
gcattgtggctgtcaaatccatg

SEQ ID NO: 5908406 - DNA, 16 bp, Homo sapiens
gcattgtggctgtcag

SEQ ID NO: 5908407 - DNA, 15 bp, Homo sapiens
gcattgtgggaaggg

SEQ ID NO: 5908408 - DNA, 18 bp, Homo sapiens
gcattgtgggaaggggag

SEQ ID NO: 5908409 - DNA, 19 bp, Homo sapiens
gcattgttattgtggaaga

SEQ ID NO: 5908410 - DNA, 15 bp, Homo sapiens
gcattgttatttaat

SEQ ID NO: 5908411 - DNA, 22 bp, Homo sapiens
gcattgttccacacatttaaaa

SEQ ID NO: 5908412 - DNA, 12 bp, Homo sapiens
gcattgttcttc

SEQ ID NO: 5908413 - DNA, 14 bp, Homo sapiens
gcattgttggctat

SEQ ID NO: 5908414 - DNA, 21 bp, Homo sapiens
gcattgttggctatttgaaat

SEQ ID NO: 5908415 - DNA, 17 bp, Homo sapiens
gcattgttgtaaagtat

SEQ ID NO: 5908416 - DNA, 16 bp, Homo sapiens
gcattgtttcaagact

SEQ ID NO: 5908417 - DNA, 17 bp, Homo sapiens
gcattgtttgcttattg

SEQ ID NO: 5908418 - DNA, 23 bp, Homo sapiens
gcattgtttgcttattgttccaa

SEQ ID NO: 5908419 - DNA, 12 bp, Homo sapiens
gcatttaaaatg

SEQ ID NO: 5908420 - DNA, 18 bp, Homo sapiens
gcatttaaaatggaaaat

SEQ ID NO: 5908421 - DNA, 19 bp, Homo sapiens
gcatttaaagttgtataaa

SEQ ID NO: 5908422 - DNA, 21 bp, Homo sapiens
gcatttaacccccctgtacac

SEQ ID NO: 5908423 - DNA, 17 bp, Homo sapiens
gcatttaacttacattt

SEQ ID NO: 5908424 - DNA, 14 bp, Homo sapiens
gcatttaagaattg

SEQ ID NO: 5908425 - DNA, 22 bp, Homo sapiens
gcatttaagttgtaaacgtctt

SEQ ID NO: 5908426 - DNA, 19 bp, Homo sapiens
gcatttaataaagatgagt

SEQ ID NO: 5908427 - DNA, 14 bp, Homo sapiens
gcatttaataaatg

SEQ ID NO: 5908428 - DNA, 20 bp, Homo sapiens
gcatttaccaacatgtatct

SEQ ID NO: 5908429 - DNA, 22 bp, Homo sapiens
gcatttaccaacatgtatctgt

SEQ ID NO: 5908430 - DNA, 14 bp, Homo sapiens
gcatttaccatgtg

SEQ ID NO: 5908431 - DNA, 17 bp, Homo sapiens
gcatttactttgaattt

SEQ ID NO: 5908432 - DNA, 15 bp, Homo sapiens
gcatttactttgtgt

SEQ ID NO: 5908433 - DNA, 18 bp, Homo sapiens
gcatttagaacgagcctg

SEQ ID NO: 5908434 - DNA, 23 bp, Homo sapiens
gcatttagaacgagcctggaagc

SEQ ID NO: 5908435 - DNA, 16 bp, Homo sapiens
gcatttagcacaaaaa

SEQ ID NO: 5908436 - DNA, 16 bp, Homo sapiens
gcatttagcatgagtt

SEQ ID NO: 5908437 - DNA, 20 bp, Homo sapiens
gcatttagctgtattcatat

SEQ ID NO: 5908438 - DNA, 15 bp, Homo sapiens
gcatttaggagaata

SEQ ID NO: 5908439 - DNA, 22 bp, Homo sapiens
gcatttagggagtattctaata

SEQ ID NO: 5908440 - DNA, 23 bp, Homo sapiens
gcatttagggagtattctaataa

SEQ ID NO: 5908441 - DNA, 16 bp, Homo sapiens
gcatttagtaccttca

SEQ ID NO: 5908442 - DNA, 20 bp, Homo sapiens
gcatttagtaccttcaaata

SEQ ID NO: 5908443 - DNA, 16 bp, Homo sapiens
gcatttatagatcatt

SEQ ID NO: 5908444 - DNA, 10 bp, Homo sapiens
gcatttatgc

SEQ ID NO: 5908445 - DNA, 22 bp, Homo sapiens
gcatttatgcatgagaactaaa

SEQ ID NO: 5908446 - DNA, 18 bp, Homo sapiens
gcatttatggtaatcata

SEQ ID NO: 5908447 - DNA, 23 bp, Homo sapiens
gcatttatggtaatcatattaga

SEQ ID NO: 5908448 - DNA, 14 bp, Homo sapiens
gcatttattgcagt

SEQ ID NO: 5908449 - DNA, 21 bp, Homo sapiens
gcatttatttatacagtgcct

SEQ ID NO: 5908450 - DNA, 22 bp, Homo sapiens
gcatttatttatacagtgcctt

SEQ ID NO: 5908451 - DNA, 15 bp, Homo sapiens
gcatttattttataa

SEQ ID NO: 5908452 - DNA, 21 bp, Homo sapiens
gcatttcaaagccctgcctct

SEQ ID NO: 5908453 - DNA, 14 bp, Homo sapiens
gcatttcaaatgtt

SEQ ID NO: 5908454 - DNA, 20 bp, Homo sapiens
gcatttcacaaaacagcctt

SEQ ID NO: 5908455 - DNA, 14 bp, Homo sapiens
gcatttcagctgtg

SEQ ID NO: 5908456 - DNA, 18 bp, Homo sapiens
gcatttcaggccagtgtg

SEQ ID NO: 5908457 - DNA, 18 bp, Homo sapiens
gcatttcatattatttta

SEQ ID NO: 5908458 - DNA, 11 bp, Homo sapiens
gcatttcattc

SEQ ID NO: 5908459 - DNA, 22 bp, Homo sapiens
gcatttcattcaaatcagtgat

SEQ ID NO: 5908460 - DNA, 22 bp, Homo sapiens
gcatttccaacaccacagacac

SEQ ID NO: 5908461 - DNA, 13 bp, Homo sapiens
gcatttccacact

SEQ ID NO: 5908462 - DNA, 19 bp, Homo sapiens
gcatttccacactgtcaga

SEQ ID NO: 5908463 - DNA, 22 bp, Homo sapiens
gcatttccacactgtcagagct

SEQ ID NO: 5908464 - DNA, 19 bp, Homo sapiens
gcatttccagaaatctgcc

SEQ ID NO: 5908465 - DNA, 19 bp, Homo sapiens
gcatttccagagcagagcc

SEQ ID NO: 5908466 - DNA, 17 bp, Homo sapiens
gcatttccagctgtgca

SEQ ID NO: 5908467 - DNA, 16 bp, Homo sapiens
gcatttcccccaggga

SEQ ID NO: 5908468 - DNA, 12 bp, Homo sapiens
gcatttcctaag

SEQ ID NO: 5908469 - DNA, 12 bp, Homo sapiens
gcatttcctgct

SEQ ID NO: 5908470 - DNA, 13 bp, Homo sapiens
gcatttcctgctg

SEQ ID NO: 5908471 - DNA, 12 bp, Homo sapiens
gcatttcctggg

SEQ ID NO: 5908472 - DNA, 14 bp, Homo sapiens
gcatttcctgggtg

SEQ ID NO: 5908473 - DNA, 13 bp, Homo sapiens
gcatttccttcca

SEQ ID NO: 5908474 - DNA, 16 bp, Homo sapiens
gccaaagaagcagacc

SEQ ID NO: 5908475 - DNA, 16 bp, Homo sapiens
gccaaagaaggcaggg

SEQ ID NO: 5908476 - DNA, 15 bp, Homo sapiens
gccaaagacaaatag

SEQ ID NO: 5908477 - DNA, 22 bp, Homo sapiens
gccaaagacctcccaagctgta

SEQ ID NO: 5908478 - DNA, 15 bp, Homo sapiens
gccaaagagctcttt

SEQ ID NO: 5908479 - DNA, 15 bp, Homo sapiens
gccaaagatagcaga

SEQ ID NO: 5908480 - DNA, 13 bp, Homo sapiens
gccaaagcagaca

SEQ ID NO: 5908481 - DNA, 22 bp, Homo sapiens
gccaaagcagacattttcctca

SEQ ID NO: 5908482 - DNA, 22 bp, Homo sapiens
gccaaagcagattttcctaagg

SEQ ID NO: 5908483 - DNA, 20 bp, Homo sapiens
gccaaagccaaagctaggcc

SEQ ID NO: 5908484 - DNA, 16 bp, Homo sapiens
gccaaagccaggcctg

SEQ ID NO: 5908485 - DNA, 14 bp, Homo sapiens
gccaaagccccatg

SEQ ID NO: 5908486 - DNA, 19 bp, Homo sapiens
gccaaagcctcctccagcc

SEQ ID NO: 5908487 - DNA, 22 bp, Homo sapiens
gccaaagctaggcctggccaga

SEQ ID NO: 5908488 - DNA, 16 bp, Homo sapiens
gccaaagctagggtgg

SEQ ID NO: 5908489 - DNA, 20 bp, Homo sapiens
gccaaagctagggtggccct

SEQ ID NO: 5908490 - DNA, 14 bp, Homo sapiens
gccaaagctgcttt

SEQ ID NO: 5908491 - DNA, 14 bp, Homo sapiens
gccaaaggaagcac

SEQ ID NO: 5908492 - DNA, 16 bp, Homo sapiens
gccaaaggaagtttta

SEQ ID NO: 5908493 - DNA, 16 bp, Homo sapiens
gccaaaggatgtgata

SEQ ID NO: 5908494 - DNA, 16 bp, Homo sapiens
gccaaaggggagccag

SEQ ID NO: 5908495 - DNA, 20 bp, Homo sapiens
gccaaaggtcaaacaggctg

SEQ ID NO: 5908496 - DNA, 23 bp, Homo sapiens
gccaaaggttcagaaaattaaac

SEQ ID NO: 5908497 - DNA, 15 bp, Homo sapiens
gccaaagtgcagccc

SEQ ID NO: 5908498 - DNA, 18 bp, Homo sapiens
gccaaagtgcagcccttc

SEQ ID NO: 5908499 - DNA, 12 bp, Homo sapiens
gccaaagtgtta

SEQ ID NO: 5908500 - DNA, 18 bp, Homo sapiens
gccaaagttttcaaactg

SEQ ID NO: 5908501 - DNA, 22 bp, Homo sapiens
gccaaataaaacctcagggaca

SEQ ID NO: 5908502 - DNA, 16 bp, Homo sapiens
gccaaataaaatgttt

SEQ ID NO: 5908503 - DNA, 14 bp, Homo sapiens
gccaaataaacagc

SEQ ID NO: 5908504 - DNA, 15 bp, Homo sapiens
gccaaataaacagct

SEQ ID NO: 5908505 - DNA, 15 bp, Homo sapiens
gccaaatagcaaaga

SEQ ID NO: 5908506 - DNA, 15 bp, Homo sapiens
gccaaataggaggga

SEQ ID NO: 5908507 - DNA, 15 bp, Homo sapiens
gccaaatatgtcctg

SEQ ID NO: 5908508 - DNA, 18 bp, Homo sapiens
gccaaatccgctctcttc

SEQ ID NO: 5908509 - DNA, 19 bp, Homo sapiens
gccaaatccgctctcttcc

SEQ ID NO: 5908510 - DNA, 16 bp, Homo sapiens
gccaaatcctgggcat

SEQ ID NO: 5908511 - DNA, 20 bp, Homo sapiens
gccaaatcctgggcatcccc

SEQ ID NO: 5908512 - DNA, 22 bp, Homo sapiens
gccaaatccttggagtcccagg

SEQ ID NO: 5908513 - DNA, 11 bp, Homo sapiens
gccaaatgagt

SEQ ID NO: 5908514 - DNA, 14 bp, Homo sapiens
gccaaatgcacaag

SEQ ID NO: 5908515 - DNA, 21 bp, Homo sapiens
gccaaatgcagggaggggagg

SEQ ID NO: 5908516 - DNA, 22 bp, Homo sapiens
gccaaatgctctctcaaattgt

SEQ ID NO: 5908517 - DNA, 22 bp, Homo sapiens
gccaaatggtttaacttctgcc

SEQ ID NO: 5908518 - DNA, 16 bp, Homo sapiens
gccaaatgtaattgaa

SEQ ID NO: 5908519 - DNA, 18 bp, Homo sapiens
gccaaatgtaattgaata

SEQ ID NO: 5908520 - DNA, 18 bp, Homo sapiens
gccaaattaaaaaagata

SEQ ID NO: 5908521 - DNA, 18 bp, Homo sapiens
gccaaattatttgtgtaa

SEQ ID NO: 5908522 - DNA, 19 bp, Homo sapiens
gccaaattatttgtgtaat

SEQ ID NO: 5908523 - DNA, 18 bp, Homo sapiens
gccaaattgctgcatatt

SEQ ID NO: 5908524 - DNA, 20 bp, Homo sapiens
gccaaatttatatgccaccg

SEQ ID NO: 5908525 - DNA, 18 bp, Homo sapiens
gccaacaaagctgttgat

SEQ ID NO: 5908526 - DNA, 16 bp, Homo sapiens
gccaacaactctgcct

SEQ ID NO: 5908527 - DNA, 18 bp, Homo sapiens
gccaacaactctgccttt

SEQ ID NO: 5908528 - DNA, 22 bp, Homo sapiens
gccaacaagaccgccccagggc

SEQ ID NO: 5908529 - DNA, 21 bp, Homo sapiens
gccaacacacgtccactccca

SEQ ID NO: 5908530 - DNA, 23 bp, Homo sapiens
gccaacacgcacctgcctcagga

SEQ ID NO: 5908531 - DNA, 13 bp, Homo sapiens
gccaacagaacac

SEQ ID NO: 5908532 - DNA, 17 bp, Homo sapiens
gccaacagaagcttcca

SEQ ID NO: 5908533 - DNA, 13 bp, Homo sapiens
gccaacagacact

SEQ ID NO: 5908534 - DNA, 12 bp, Homo sapiens
gccaacagcagc

SEQ ID NO: 5908535 - DNA, 11 bp, Homo sapiens
gccaacagcta

SEQ ID NO: 5908536 - DNA, 17 bp, Homo sapiens
gccaacagctacaacag

SEQ ID NO: 5908537 - DNA, 21 bp, Homo sapiens
gccaacagggtagatttctct

SEQ ID NO: 5908538 - DNA, 19 bp, Homo sapiens
gccaacaggtggcaggacc

SEQ ID NO: 5908539 - DNA, 23 bp, Homo sapiens
gccaacaggtggcaggaccagga

SEQ ID NO: 5908540 - DNA, 22 bp, Homo sapiens
gccaacagtgttaggcctggca

SEQ ID NO: 5908541 - DNA, 19 bp, Homo sapiens
gccaacatgaggacagaag

SEQ ID NO: 5908542 - DNA, 20 bp, Homo sapiens
gccaacatgctgaaaccctg

SEQ ID NO: 5908543 - DNA, 14 bp, Homo sapiens
gccaacatggtgaa

SEQ ID NO: 5908544 - DNA, 22 bp, Homo sapiens
gccaaccactttcacctgggat

SEQ ID NO: 5908545 - DNA, 17 bp, Homo sapiens
gccaaccagcccgacag

SEQ ID NO: 5908546 - DNA, 22 bp, Homo sapiens
gccaaccagcccgacagtgcca

SEQ ID NO: 5908547 - DNA, 12 bp, Homo sapiens
gccaaccagcct

SEQ ID NO: 5908548 - DNA, 15 bp, Homo sapiens
gccaaccagcctttg

SEQ ID NO: 5908549 - DNA, 15 bp, Homo sapiens
gccaaccaggaccca

SEQ ID NO: 5908550 - DNA, 13 bp, Homo sapiens
gccaaccccaccc

SEQ ID NO: 5908551 - DNA, 15 bp, Homo sapiens
gccaaccccacccag

SEQ ID NO: 5908552 - DNA, 17 bp, Homo sapiens
gccaaccccacccagct

SEQ ID NO: 5908553 - DNA, 18 bp, Homo sapiens
gccaaccccacccagctc

SEQ ID NO: 5908554 - DNA, 12 bp, Homo sapiens
gccaaccccagc

SEQ ID NO: 5908555 - DNA, 15 bp, Homo sapiens
gccaacccctgtgga

SEQ ID NO: 5908556 - DNA, 13 bp, Homo sapiens
gccaaccctcccg

SEQ ID NO: 5908557 - DNA, 21 bp, Homo sapiens
gccaaccctcctccaatggaa

SEQ ID NO: 5908558 - DNA, 13 bp, Homo sapiens
gccaacccttctc

SEQ ID NO: 5908559 - DNA, 15 bp, Homo sapiens
gccaacctaaaactc

SEQ ID NO: 5908560 - DNA, 15 bp, Homo sapiens
gccaacctggacttc

SEQ ID NO: 5908561 - DNA, 18 bp, Homo sapiens
gccaacctgtaataaata

SEQ ID NO: 5908562 - DNA, 20 bp, Homo sapiens
gccaacctgtaataaatatg

SEQ ID NO: 5908563 - DNA, 23 bp, Homo sapiens
gccaaccttgctcttggggaagg

SEQ ID NO: 5908564 - DNA, 14 bp, Homo sapiens
gccaacgaagccgg

SEQ ID NO: 5908565 - DNA, 18 bp, Homo sapiens
gccaacgagattgctgga

SEQ ID NO: 5908566 - DNA, 18 bp, Homo sapiens
gccaacggcaacagcatg

SEQ ID NO: 5908567 - DNA, 22 bp, Homo sapiens
gccaacgtgtgtgtcagctggt

SEQ ID NO: 5908568 - DNA, 23 bp, Homo sapiens
gccaactaagccctcgaaccaag

SEQ ID NO: 5908569 - DNA, 15 bp, Homo sapiens
gccaactcacccttg

SEQ ID NO: 5908570 - DNA, 20 bp, Homo sapiens
gccaactcactcttatgaaa

SEQ ID NO: 5908571 - DNA, 15 bp, Homo sapiens
gccaactccatgacc

SEQ ID NO: 5908572 - DNA, 19 bp, Homo sapiens
gccaactccatgaccaggc

SEQ ID NO: 5908573 - DNA, 14 bp, Homo sapiens
gccaactcctcaca

SEQ ID NO: 5908574 - DNA, 15 bp, Homo sapiens
gccaactcgggagca

SEQ ID NO: 5908575 - DNA, 16 bp, Homo sapiens
gccaactcgggagcat

SEQ ID NO: 5908576 - DNA, 23 bp, Homo sapiens
gccaactctaacaggcactttga

SEQ ID NO: 5908577 - DNA, 22 bp, Homo sapiens
gccaactctcccaaagggcaca

SEQ ID NO: 5908578 - DNA, 14 bp, Homo sapiens
gccaactgaagcct

SEQ ID NO: 5908579 - DNA, 20 bp, Homo sapiens
gccaactgaagccttcttct

SEQ ID NO: 5908580 - DNA, 13 bp, Homo sapiens
gccaactgacaaa

SEQ ID NO: 5908581 - DNA, 17 bp, Homo sapiens
gccaactgatctgttat

SEQ ID NO: 5908582 - DNA, 17 bp, Homo sapiens
gccaactgccaggctgc

SEQ ID NO: 5908583 - DNA, 22 bp, Homo sapiens
gccaactgccaggctgcctcct

SEQ ID NO: 5908584 - DNA, 17 bp, Homo sapiens
gccaactggtgtttgaa

SEQ ID NO: 5908585 - DNA, 19 bp, Homo sapiens
gccaactgtttccctgctg

SEQ ID NO: 5908586 - DNA, 22 bp, Homo sapiens
gccaactgtttccctgctgaat

SEQ ID NO: 5908587 - DNA, 22 bp, Homo sapiens
gccaacttaaacctgtgctttc

SEQ ID NO: 5908588 - DNA, 16 bp, Homo sapiens
gccaacttcccctcta

SEQ ID NO: 5908589 - DNA, 16 bp, Homo sapiens
gccaacttctcccacc

SEQ ID NO: 5908590 - DNA, 19 bp, Homo sapiens
gccaacttcttcagagctg

SEQ ID NO: 5908591 - DNA, 21 bp, Homo sapiens
gccaacttgagggcccagagc

SEQ ID NO: 5908592 - DNA, 13 bp, Homo sapiens
gccaacttgccat

SEQ ID NO: 5908593 - DNA, 14 bp, Homo sapiens
gccaacttggcttt

SEQ ID NO: 5908594 - DNA, 14 bp, Homo sapiens
gccaacttgtaaat

SEQ ID NO: 5908595 - DNA, 15 bp, Homo sapiens
gccaacttgtaaata

SEQ ID NO: 5908596 - DNA, 17 bp, Homo sapiens
gccaactttccagactt

SEQ ID NO: 5908597 - DNA, 19 bp, Homo sapiens
gccaacttttagtgggtga

SEQ ID NO: 5908598 - DNA, 15 bp, Homo sapiens
gccaagaactctggg

SEQ ID NO: 5908599 - DNA, 17 bp, Homo sapiens
gccaagaactctgggca

SEQ ID NO: 5908600 - DNA, 15 bp, Homo sapiens
gccaagaagcagtgg

SEQ ID NO: 5908601 - DNA, 16 bp, Homo sapiens
gccaagaagcagtggc

SEQ ID NO: 5908602 - DNA, 20 bp, Homo sapiens
gccaagaagcagtggcctta

SEQ ID NO: 5908603 - DNA, 13 bp, Homo sapiens
gccaagaataaaa

SEQ ID NO: 5908604 - DNA, 16 bp, Homo sapiens
gccaagaatacttgaa

SEQ ID NO: 5908605 - DNA, 16 bp, Homo sapiens
gccaagaatattgcaa

SEQ ID NO: 5908606 - DNA, 18 bp, Homo sapiens
gccaagaatattgcaaaa

SEQ ID NO: 5908607 - DNA, 17 bp, Homo sapiens
gccaagacaaatcaaca

SEQ ID NO: 5908608 - DNA, 19 bp, Homo sapiens
gccaagacaaatcaacaga

SEQ ID NO: 5908609 - DNA, 15 bp, Homo sapiens
gccaagacagatgga

SEQ ID NO: 5908610 - DNA, 19 bp, Homo sapiens
gccaagacgggatgattgc

SEQ ID NO: 5908611 - DNA, 15 bp, Homo sapiens
gccaagactcagggg

SEQ ID NO: 5908612 - DNA, 16 bp, Homo sapiens
gccaagactcagggga

SEQ ID NO: 5908613 - DNA, 12 bp, Homo sapiens
gccaagactcct

SEQ ID NO: 5908614 - DNA, 17 bp, Homo sapiens
gccaagactcctcaggc

SEQ ID NO: 5908615 - DNA, 21 bp, Homo sapiens
gccaagactgctgtggccagg

SEQ ID NO: 5908616 - DNA, 18 bp, Homo sapiens
gccaagacttggcaacag

SEQ ID NO: 5908617 - DNA, 23 bp, Homo sapiens
gccaagacttggcaacagaagca

SEQ ID NO: 5908618 - DNA, 22 bp, Homo sapiens
gccaagagaaaggcctgcacac

SEQ ID NO: 5908619 - DNA, 13 bp, Homo sapiens
gccaagagaaggg

SEQ ID NO: 5908620 - DNA, 17 bp, Homo sapiens
gccaagagagcctcttg

SEQ ID NO: 5908621 - DNA, 20 bp, Homo sapiens
gccaagagcagaggcagcga

SEQ ID NO: 5908622 - DNA, 22 bp, Homo sapiens
gccaagagccatctgaagccac

SEQ ID NO: 5908623 - DNA, 17 bp, Homo sapiens
gccaagagccgccgtgg

SEQ ID NO: 5908624 - DNA, 19 bp, Homo sapiens
gccaagagccgccgtggct

SEQ ID NO: 5908625 - DNA, 11 bp, Homo sapiens
gccaagaggaa

SEQ ID NO: 5908626 - DNA, 20 bp, Homo sapiens
gccaagatcacgccactgca

SEQ ID NO: 5908627 - DNA, 16 bp, Homo sapiens
gccaagatgcttttca

SEQ ID NO: 5908628 - DNA, 19 bp, Homo sapiens
gccaagatggctgctgcct

SEQ ID NO: 5908629 - DNA, 20 bp, Homo sapiens
gccaagatggctgctgcctg

SEQ ID NO: 5908630 - DNA, 22 bp, Homo sapiens
gccaagatggctgctgcctgct

SEQ ID NO: 5908631 - DNA, 20 bp, Homo sapiens
gccaagatttaaaattaaat

SEQ ID NO: 5908632 - DNA, 22 bp, Homo sapiens
gccaagcaaaccaatggtgatc

SEQ ID NO: 5908633 - DNA, 12 bp, Homo sapiens
gccaagcacagt

SEQ ID NO: 5908634 - DNA, 20 bp, Homo sapiens
gccaagcacagtgcctgcat

SEQ ID NO: 5908635 - DNA, 14 bp, Homo sapiens
gccaagcagccaag

SEQ ID NO: 5908636 - DNA, 11 bp, Homo sapiens
gccaagccaga

SEQ ID NO: 5908637 - DNA, 22 bp, Homo sapiens
gccaagccagattctcttgaat

SEQ ID NO: 5908638 - DNA, 13 bp, Homo sapiens
gccaagccaggga

SEQ ID NO: 5908639 - DNA, 20 bp, Homo sapiens
gccaagccagggttccagac

SEQ ID NO: 5908640 - DNA, 21 bp, Homo sapiens
gccaagccagggttccagaca

SEQ ID NO: 5908641 - DNA, 19 bp, Homo sapiens
gccaagccctaagcctgtc

SEQ ID NO: 5908642 - DNA, 12 bp, Homo sapiens
gccaagccctgg

SEQ ID NO: 5908643 - DNA, 14 bp, Homo sapiens
gccaagccggccca

SEQ ID NO: 5908644 - DNA, 20 bp, Homo sapiens
gccaagccggcccaacccaa

SEQ ID NO: 5908645 - DNA, 14 bp, Homo sapiens
gccaagcctaggcc

SEQ ID NO: 5908646 - DNA, 16 bp, Homo sapiens
gccaagcctgcagctt

SEQ ID NO: 5908647 - DNA, 15 bp, Homo sapiens
gccaagcctgccccg

SEQ ID NO: 5908648 - DNA, 11 bp, Homo sapiens
gccaagcctgg

SEQ ID NO: 5908649 - DNA, 13 bp, Homo sapiens
gccaagcctggag

SEQ ID NO: 5908650 - DNA, 13 bp, Homo sapiens
gccaagcctggcc

SEQ ID NO: 5908651 - DNA, 12 bp, Homo sapiens
gccaagccttct

SEQ ID NO: 5908652 - DNA, 16 bp, Homo sapiens
gccacatcattctgtg

SEQ ID NO: 5908653 - DNA, 14 bp, Homo sapiens
gccacatccagctt

SEQ ID NO: 5908654 - DNA, 14 bp, Homo sapiens
gccacatccccaag

SEQ ID NO: 5908655 - DNA, 16 bp, Homo sapiens
gccacatccccaagcc

SEQ ID NO: 5908656 - DNA, 16 bp, Homo sapiens
gccacatcctcatggc

SEQ ID NO: 5908657 - DNA, 17 bp, Homo sapiens
gccacatcgcagcccct

SEQ ID NO: 5908658 - DNA, 12 bp, Homo sapiens
gccacatcttga

SEQ ID NO: 5908659 - DNA, 18 bp, Homo sapiens
gccacatcttgctctgca

SEQ ID NO: 5908660 - DNA, 14 bp, Homo sapiens
gccacatgagtccc

SEQ ID NO: 5908661 - DNA, 16 bp, Homo sapiens
gccacatggagccccc

SEQ ID NO: 5908662 - DNA, 20 bp, Homo sapiens
gccacatggccccatcccag

SEQ ID NO: 5908663 - DNA, 22 bp, Homo sapiens
gccacatgggaggaaggcccag

SEQ ID NO: 5908664 - DNA, 23 bp, Homo sapiens
gccacatgggaggaaggcccagg

SEQ ID NO: 5908665 - DNA, 15 bp, Homo sapiens
gccacatgggaggct

SEQ ID NO: 5908666 - DNA, 17 bp, Homo sapiens
gccacatggggctgggc

SEQ ID NO: 5908667 - DNA, 17 bp, Homo sapiens
gccacatggtgtggcca

SEQ ID NO: 5908668 - DNA, 15 bp, Homo sapiens
gccacattagaactt

SEQ ID NO: 5908669 - DNA, 21 bp, Homo sapiens
gccacattgaaaaatgtccac

SEQ ID NO: 5908670 - DNA, 15 bp, Homo sapiens
gccacattgctggct

SEQ ID NO: 5908671 - DNA, 16 bp, Homo sapiens
gccacattgggcagcg

SEQ ID NO: 5908672 - DNA, 22 bp, Homo sapiens
gccacatttctgatcagaggtg

SEQ ID NO: 5908673 - DNA, 14 bp, Homo sapiens
gccacatttggaat

SEQ ID NO: 5908674 - DNA, 16 bp, Homo sapiens
gccacatttggttcta

SEQ ID NO: 5908675 - DNA, 11 bp, Homo sapiens
gccacattttg

SEQ ID NO: 5908676 - DNA, 23 bp, Homo sapiens
gccacattttgctttataatttc

SEQ ID NO: 5908677 - DNA, 19 bp, Homo sapiens
gccacattttttgaggtat

SEQ ID NO: 5908678 - DNA, 14 bp, Homo sapiens
gccaccaaagctgc

SEQ ID NO: 5908679 - DNA, 16 bp, Homo sapiens
gccaccaaagctgccc

SEQ ID NO: 5908680 - DNA, 20 bp, Homo sapiens
gccaccaaagctgcccactg

SEQ ID NO: 5908681 - DNA, 17 bp, Homo sapiens
gccaccaaaggccaggg

SEQ ID NO: 5908682 - DNA, 17 bp, Homo sapiens
gccaccaaatctgtcta

SEQ ID NO: 5908683 - DNA, 16 bp, Homo sapiens
gccaccaactggccct

SEQ ID NO: 5908684 - DNA, 18 bp, Homo sapiens
gccaccaacttacaaaaa

SEQ ID NO: 5908685 - DNA, 22 bp, Homo sapiens
gccaccaagagggacgcctggg

SEQ ID NO: 5908686 - DNA, 12 bp, Homo sapiens
gccaccaagctc

SEQ ID NO: 5908687 - DNA, 13 bp, Homo sapiens
gccaccaagctca

SEQ ID NO: 5908688 - DNA, 16 bp, Homo sapiens
gccaccaagctcacac

SEQ ID NO: 5908689 - DNA, 20 bp, Homo sapiens
gccaccaagctcacacctgt

SEQ ID NO: 5908690 - DNA, 18 bp, Homo sapiens
gccaccaaggctgcctgc

SEQ ID NO: 5908691 - DNA, 23 bp, Homo sapiens
gccaccaagtgaaaaatgttagg

SEQ ID NO: 5908692 - DNA, 13 bp, Homo sapiens
gccaccacacaca

SEQ ID NO: 5908693 - DNA, 15 bp, Homo sapiens
gccaccacacccagc

SEQ ID NO: 5908694 - DNA, 21 bp, Homo sapiens
gccaccacacccagcctctgt

SEQ ID NO: 5908695 - DNA, 17 bp, Homo sapiens
gccaccacacctggctt

SEQ ID NO: 5908696 - DNA, 15 bp, Homo sapiens
gccaccacactcagc

SEQ ID NO: 5908697 - DNA, 13 bp, Homo sapiens
gccaccacagagg

SEQ ID NO: 5908698 - DNA, 14 bp, Homo sapiens
gccaccaccacctg

SEQ ID NO: 5908699 - DNA, 16 bp, Homo sapiens
gccaccaccacctgac

SEQ ID NO: 5908700 - DNA, 23 bp, Homo sapiens
gccaccaccacgcagccgccgcc

SEQ ID NO: 5908701 - DNA, 22 bp, Homo sapiens
gccaccaccactctcactccac

SEQ ID NO: 5908702 - DNA, 15 bp, Homo sapiens
gccaccaccactgtc

SEQ ID NO: 5908703 - DNA, 16 bp, Homo sapiens
gccaccacccaacctg

SEQ ID NO: 5908704 - DNA, 19 bp, Homo sapiens
gccaccacccaacctgtcc

SEQ ID NO: 5908705 - DNA, 16 bp, Homo sapiens
gccaccacccacccca

SEQ ID NO: 5908706 - DNA, 22 bp, Homo sapiens
gccaccaccccataatctcatt

SEQ ID NO: 5908707 - DNA, 16 bp, Homo sapiens
gccaccaccccccact

SEQ ID NO: 5908708 - DNA, 14 bp, Homo sapiens
gccaccacccctcc

SEQ ID NO: 5908709 - DNA, 22 bp, Homo sapiens
gccaccaccggggcactggctg

SEQ ID NO: 5908710 - DNA, 14 bp, Homo sapiens
gccaccacctctgt

SEQ ID NO: 5908711 - DNA, 23 bp, Homo sapiens
gccaccacctttggctggtagca

SEQ ID NO: 5908712 - DNA, 14 bp, Homo sapiens
gccaccacgcccgg

SEQ ID NO: 5908713 - DNA, 17 bp, Homo sapiens
gccaccacgccctgcct

SEQ ID NO: 5908714 - DNA, 24 bp, Homo sapiens
gccaccacgcctagcctcacgctc

SEQ ID NO: 5908715 - DNA, 16 bp, Homo sapiens
gccaccacgctggcca

SEQ ID NO: 5908716 - DNA, 16 bp, Homo sapiens
gccaccacgtctgcca

SEQ ID NO: 5908717 - DNA, 17 bp, Homo sapiens
gccaccacgtctgccag

SEQ ID NO: 5908718 - DNA, 19 bp, Homo sapiens
gccaccacgtctgccaggc

SEQ ID NO: 5908719 - DNA, 15 bp, Homo sapiens
gccaccactcagtgc

SEQ ID NO: 5908720 - DNA, 17 bp, Homo sapiens
gccaccactcctgcctg

SEQ ID NO: 5908721 - DNA, 23 bp, Homo sapiens
gccaccactcctgcctgccccca

SEQ ID NO: 5908722 - DNA, 23 bp, Homo sapiens
gccaccactgactataccaactg

SEQ ID NO: 5908723 - DNA, 17 bp, Homo sapiens
gccaccacttccagagc

SEQ ID NO: 5908724 - DNA, 21 bp, Homo sapiens
gccaccacttccagagccaga

SEQ ID NO: 5908725 - DNA, 19 bp, Homo sapiens
gccaccagagaccgtcctc

SEQ ID NO: 5908726 - DNA, 23 bp, Homo sapiens
gccaccagagaccgtcctcaccc

SEQ ID NO: 5908727 - DNA, 16 bp, Homo sapiens
gccaccagatgctgaa

SEQ ID NO: 5908728 - DNA, 23 bp, Homo sapiens
gccaccagatgctgaatccccta

SEQ ID NO: 5908729 - DNA, 19 bp, Homo sapiens
gccaccagcaatgccctgc

SEQ ID NO: 5908730 - DNA, 23 bp, Homo sapiens
gccaccagcaatgccctgccttg

SEQ ID NO: 5908731 - DNA, 20 bp, Homo sapiens
gccaccagccatcctccctc

SEQ ID NO: 5908732 - DNA, 13 bp, Homo sapiens
gccaccagcgccc

SEQ ID NO: 5908733 - DNA, 21 bp, Homo sapiens
gccaccagctccactggcctg

SEQ ID NO: 5908734 - DNA, 15 bp, Homo sapiens
gccaccagctctgcc

SEQ ID NO: 5908735 - DNA, 17 bp, Homo sapiens
gccaccagctctgccgt

SEQ ID NO: 5908736 - DNA, 19 bp, Homo sapiens
gccaccagctctgccgtct

SEQ ID NO: 5908737 - DNA, 20 bp, Homo sapiens
gccaccagcttccctctgcc

SEQ ID NO: 5908738 - DNA, 22 bp, Homo sapiens
gccaccaggatcagccaggagg

SEQ ID NO: 5908739 - DNA, 12 bp, Homo sapiens
gccaccaggctg

SEQ ID NO: 5908740 - DNA, 12 bp, Homo sapiens
gccaccagggag

SEQ ID NO: 5908741 - DNA, 12 bp, Homo sapiens
gccaccagggat

SEQ ID NO: 5908742 - DNA, 13 bp, Homo sapiens
gccaccagggatc

SEQ ID NO: 5908743 - DNA, 16 bp, Homo sapiens
gccaccaggtactctt

SEQ ID NO: 5908744 - DNA, 20 bp, Homo sapiens
gccaccaggtgcctttcaaa

SEQ ID NO: 5908745 - DNA, 16 bp, Homo sapiens
gccaccagtcactgtc

SEQ ID NO: 5908746 - DNA, 17 bp, Homo sapiens
gccaccagtgtcctcca

SEQ ID NO: 5908747 - DNA, 17 bp, Homo sapiens
gccaccatccaataaaa

SEQ ID NO: 5908748 - DNA, 19 bp, Homo sapiens
gccaccatccaataaaaat

SEQ ID NO: 5908749 - DNA, 16 bp, Homo sapiens
gccaccatccccaccc

SEQ ID NO: 5908750 - DNA, 13 bp, Homo sapiens
gccaccatccctg

SEQ ID NO: 5908751 - DNA, 21 bp, Homo sapiens
gccaccatccctgatggcaga

SEQ ID NO: 5908752 - DNA, 12 bp, Homo sapiens
gccaccatcctg

SEQ ID NO: 5908753 - DNA, 20 bp, Homo sapiens
gccaccatctgtaccctgct

SEQ ID NO: 5908754 - DNA, 17 bp, Homo sapiens
gccaccatgaccccttc

SEQ ID NO: 5908755 - DNA, 13 bp, Homo sapiens
gccaccatgcccg

SEQ ID NO: 5908756 - DNA, 17 bp, Homo sapiens
gccaccatgcctggccc

SEQ ID NO: 5908757 - DNA, 20 bp, Homo sapiens
gccaccatgcttgcctgaag

SEQ ID NO: 5908758 - DNA, 18 bp, Homo sapiens
gccaccatggccagccaa

SEQ ID NO: 5908759 - DNA, 23 bp, Homo sapiens
gccaccatgtatgtggaagcagg

SEQ ID NO: 5908760 - DNA, 14 bp, Homo sapiens
gccacccaaagcag

SEQ ID NO: 5908761 - DNA, 17 bp, Homo sapiens
gccacccaacagcacca

SEQ ID NO: 5908762 - DNA, 20 bp, Homo sapiens
gccacccaagcctgctggct

SEQ ID NO: 5908763 - DNA, 12 bp, Homo sapiens
gccacccacccc

SEQ ID NO: 5908764 - DNA, 13 bp, Homo sapiens
gccacccacccca

SEQ ID NO: 5908765 - DNA, 13 bp, Homo sapiens
gccacccaccctt

SEQ ID NO: 5908766 - DNA, 22 bp, Homo sapiens
gccacccacccttctcccctgc

SEQ ID NO: 5908767 - DNA, 13 bp, Homo sapiens
gccacccactcag

SEQ ID NO: 5908768 - DNA, 14 bp, Homo sapiens
gccacccagccagg

SEQ ID NO: 5908769 - DNA, 15 bp, Homo sapiens
gccacccagccagga

SEQ ID NO: 5908770 - DNA, 23 bp, Homo sapiens
gccacccagccccagccagggct

SEQ ID NO: 5908771 - DNA, 15 bp, Homo sapiens
gccacccagggacca

SEQ ID NO: 5908772 - DNA, 13 bp, Homo sapiens
gccacccaggtga

SEQ ID NO: 5908773 - DNA, 22 bp, Homo sapiens
gccacccatgcagctgctcccc

SEQ ID NO: 5908774 - DNA, 21 bp, Homo sapiens
gccaccccaaaccccagcccc

SEQ ID NO: 5908775 - DNA, 14 bp, Homo sapiens
gccaccccaacctc

SEQ ID NO: 5908776 - DNA, 15 bp, Homo sapiens
gccaccccaccctcc

SEQ ID NO: 5908777 - DNA, 13 bp, Homo sapiens
gccaccccactga

SEQ ID NO: 5908778 - DNA, 12 bp, Homo sapiens
gccaccccactt

SEQ ID NO: 5908779 - DNA, 23 bp, Homo sapiens
gccacccccacctccctgcagct

SEQ ID NO: 5908780 - DNA, 14 bp, Homo sapiens
gccacccccaggtc

SEQ ID NO: 5908781 - DNA, 17 bp, Homo sapiens
gccacccccaggtcttc

SEQ ID NO: 5908782 - DNA, 21 bp, Homo sapiens
gccacccccaggtcttcctgc

SEQ ID NO: 5908783 - DNA, 18 bp, Homo sapiens
gccacccccccaccccag

SEQ ID NO: 5908784 - DNA, 13 bp, Homo sapiens
gccacccccgccc

SEQ ID NO: 5908785 - DNA, 16 bp, Homo sapiens
gccacccccgccccca

SEQ ID NO: 5908786 - DNA, 19 bp, Homo sapiens
gccacccccgcccccaccg

SEQ ID NO: 5908787 - DNA, 19 bp, Homo sapiens
gccacccccgctggaggat

SEQ ID NO: 5908788 - DNA, 18 bp, Homo sapiens
gccacccccttccctggg

SEQ ID NO: 5908789 - DNA, 19 bp, Homo sapiens
gccacccccttccctggga

SEQ ID NO: 5908790 - DNA, 20 bp, Homo sapiens
gccacccccttccctgggag

SEQ ID NO: 5908791 - DNA, 23 bp, Homo sapiens
gccacccctcctctagctctggt

SEQ ID NO: 5908792 - DNA, 14 bp, Homo sapiens
gccaccccttcctc

SEQ ID NO: 5908793 - DNA, 17 bp, Homo sapiens
gccaccccttcctcagc

SEQ ID NO: 5908794 - DNA, 19 bp, Homo sapiens
gccaccccttcctcagcct

SEQ ID NO: 5908795 - DNA, 23 bp, Homo sapiens
gccaccccttcctcagcctgggg

SEQ ID NO: 5908796 - DNA, 17 bp, Homo sapiens
gccaccccttgctctct

SEQ ID NO: 5908797 - DNA, 12 bp, Homo sapiens
gccacccgcccg

SEQ ID NO: 5908798 - DNA, 15 bp, Homo sapiens
gccacccgcccgccc

SEQ ID NO: 5908799 - DNA, 18 bp, Homo sapiens
gccacccggatctccagg

SEQ ID NO: 5908800 - DNA, 21 bp, Homo sapiens
gccacccggatctccaggccc

SEQ ID NO: 5908801 - DNA, 24 bp, Homo sapiens
gccacccggatctccaggcccagc

SEQ ID NO: 5908802 - DNA, 20 bp, Homo sapiens
gccacccgtaggcagcctct

SEQ ID NO: 5908803 - DNA, 21 bp, Homo sapiens
gccacccgtaggcagcctctc

SEQ ID NO: 5908804 - DNA, 22 bp, Homo sapiens
gccacccgtaggcagcctctct

SEQ ID NO: 5908805 - DNA, 20 bp, Homo sapiens
gccacccgtggggtgctgcc

SEQ ID NO: 5908806 - DNA, 23 bp, Homo sapiens
gccacccgttctgctggcctgga

SEQ ID NO: 5908807 - DNA, 22 bp, Homo sapiens
gccaccctagccaatgtctcct

SEQ ID NO: 5908808 - DNA, 15 bp, Homo sapiens
gccaccctcacacac

SEQ ID NO: 5908809 - DNA, 19 bp, Homo sapiens
gccaccctcacacacacag

SEQ ID NO: 5908810 - DNA, 22 bp, Homo sapiens
gccaccctccacgaggtgtgac

SEQ ID NO: 5908811 - DNA, 22 bp, Homo sapiens
gccaccctcccctatgctggta

SEQ ID NO: 5908812 - DNA, 13 bp, Homo sapiens
gccaccctcctgc

SEQ ID NO: 5908813 - DNA, 13 bp, Homo sapiens
gccaccctctcca

SEQ ID NO: 5908814 - DNA, 19 bp, Homo sapiens
gccaccctctgcagggcag

SEQ ID NO: 5908815 - DNA, 19 bp, Homo sapiens
gccaccctctgctgcacag

SEQ ID NO: 5908816 - DNA, 13 bp, Homo sapiens
gccaccctctggg

SEQ ID NO: 5908817 - DNA, 14 bp, Homo sapiens
gccaccctgagcag

SEQ ID NO: 5908818 - DNA, 12 bp, Homo sapiens
gccaccctgagg

SEQ ID NO: 5908819 - DNA, 19 bp, Homo sapiens
gccaccctgaggagtctga

SEQ ID NO: 5908820 - DNA, 23 bp, Homo sapiens
gccaccctgaggagtctgaggtc

SEQ ID NO: 5908821 - DNA, 12 bp, Homo sapiens
gccaccctgcca

SEQ ID NO: 5908822 - DNA, 13 bp, Homo sapiens
gccaccctgccat

SEQ ID NO: 5908823 - DNA, 15 bp, Homo sapiens
gccaccctgccccta

SEQ ID NO: 5908824 - DNA, 18 bp, Homo sapiens
gccaccctgctgcactag

SEQ ID NO: 5908825 - DNA, 23 bp, Homo sapiens
gccaccctggcatgctgtctcta

SEQ ID NO: 5908826 - DNA, 14 bp, Homo sapiens
gccaccctggcccg

SEQ ID NO: 5908827 - DNA, 12 bp, Homo sapiens
gccaccctgggc

SEQ ID NO: 5908828 - DNA, 13 bp, Homo sapiens
gccaccctgggga

SEQ ID NO: 5908829 - DNA, 12 bp, Homo sapiens
gccaccctgtct

SEQ ID NO: 5908830 - DNA, 16 bp, Homo sapiens
gccacgttcagggagg

SEQ ID NO: 5908831 - DNA, 17 bp, Homo sapiens
gccacgttcagggaggg

SEQ ID NO: 5908832 - DNA, 22 bp, Homo sapiens
gccacgttggagaagcccgtgt

SEQ ID NO: 5908833 - DNA, 18 bp, Homo sapiens
gccactaaaatccaccca

SEQ ID NO: 5908834 - DNA, 23 bp, Homo sapiens
gccactaaaatccacccagccca

SEQ ID NO: 5908835 - DNA, 18 bp, Homo sapiens
gccactaaagcttcagac

SEQ ID NO: 5908836 - DNA, 19 bp, Homo sapiens
gccactaaccttgcctggt

SEQ ID NO: 5908837 - DNA, 23 bp, Homo sapiens
gccactaactagagcagccctgg

SEQ ID NO: 5908838 - DNA, 14 bp, Homo sapiens
gccactaacttcta

SEQ ID NO: 5908839 - DNA, 13 bp, Homo sapiens
gccactaagcaga

SEQ ID NO: 5908840 - DNA, 16 bp, Homo sapiens
gccactaagcagagga

SEQ ID NO: 5908841 - DNA, 19 bp, Homo sapiens
gccactaagcagaggaggg

SEQ ID NO: 5908842 - DNA, 20 bp, Homo sapiens
gccactaagcagaggagggg

SEQ ID NO: 5908843 - DNA, 23 bp, Homo sapiens
gccactaagcagaggaggggccg

SEQ ID NO: 5908844 - DNA, 22 bp, Homo sapiens
gccactacactccagcctgagc

SEQ ID NO: 5908845 - DNA, 21 bp, Homo sapiens
gccactagactcttcactgtt

SEQ ID NO: 5908846 - DNA, 19 bp, Homo sapiens
gccactaggccctggtctg

SEQ ID NO: 5908847 - DNA, 13 bp, Homo sapiens
gccactaggctgg

SEQ ID NO: 5908848 - DNA, 17 bp, Homo sapiens
gccactaggctgggtgc

SEQ ID NO: 5908849 - DNA, 21 bp, Homo sapiens
gccactaggctgggtgcccac

SEQ ID NO: 5908850 - DNA, 16 bp, Homo sapiens
gccactagtaagtaat

SEQ ID NO: 5908851 - DNA, 22 bp, Homo sapiens
gccactagtgacagtttctttt

SEQ ID NO: 5908852 - DNA, 20 bp, Homo sapiens
gccactattgttagtctctt

SEQ ID NO: 5908853 - DNA, 16 bp, Homo sapiens
gccactcaacagagag

SEQ ID NO: 5908854 - DNA, 18 bp, Homo sapiens
gccactcacacagccagg

SEQ ID NO: 5908855 - DNA, 12 bp, Homo sapiens
gccactcaccct

SEQ ID NO: 5908856 - DNA, 13 bp, Homo sapiens
gccactcaccctt

SEQ ID NO: 5908857 - DNA, 16 bp, Homo sapiens
gccactcaccgaagcc

SEQ ID NO: 5908858 - DNA, 15 bp, Homo sapiens
gccactcactaggcc

SEQ ID NO: 5908859 - DNA, 15 bp, Homo sapiens
gccactcagaggccc

SEQ ID NO: 5908860 - DNA, 18 bp, Homo sapiens
gccactcagaggccccca

SEQ ID NO: 5908861 - DNA, 21 bp, Homo sapiens
gccactcagaggcccccagtg

SEQ ID NO: 5908862 - DNA, 23 bp, Homo sapiens
gccactcagaggcccccagtggg

SEQ ID NO: 5908863 - DNA, 20 bp, Homo sapiens
gccactcaggaggctgaggc

SEQ ID NO: 5908864 - DNA, 17 bp, Homo sapiens
gccactcaggcagcctg

SEQ ID NO: 5908865 - DNA, 22 bp, Homo sapiens
gccactcaggcccaaagcctcg

SEQ ID NO: 5908866 - DNA, 20 bp, Homo sapiens
gccactcatattctgggctc

SEQ ID NO: 5908867 - DNA, 12 bp, Homo sapiens
gccactcatttc

SEQ ID NO: 5908868 - DNA, 13 bp, Homo sapiens
gccactcatttca

SEQ ID NO: 5908869 - DNA, 15 bp, Homo sapiens
gccactcatttcatc

SEQ ID NO: 5908870 - DNA, 14 bp, Homo sapiens
gccactccaaactc

SEQ ID NO: 5908871 - DNA, 20 bp, Homo sapiens
gccactccaagccccctggc

SEQ ID NO: 5908872 - DNA, 21 bp, Homo sapiens
gccactccagtcctgccacca

SEQ ID NO: 5908873 - DNA, 21 bp, Homo sapiens
gccactccagttttctcctct

SEQ ID NO: 5908874 - DNA, 13 bp, Homo sapiens
gccactccccagc

SEQ ID NO: 5908875 - DNA, 23 bp, Homo sapiens
gccactccccagtgctcctgtgc

SEQ ID NO: 5908876 - DNA, 20 bp, Homo sapiens
gccactccctgagctttggg

SEQ ID NO: 5908877 - DNA, 21 bp, Homo sapiens
gccactccgagaggtgggcca

SEQ ID NO: 5908878 - DNA, 16 bp, Homo sapiens
gccactcctccctccg

SEQ ID NO: 5908879 - DNA, 21 bp, Homo sapiens
gccactcctctgactcagggc

SEQ ID NO: 5908880 - DNA, 19 bp, Homo sapiens
gccactccttccttcagga

SEQ ID NO: 5908881 - DNA, 20 bp, Homo sapiens
gccactccttccttcaggac

SEQ ID NO: 5908882 - DNA, 15 bp, Homo sapiens
gccactcgccttctt

SEQ ID NO: 5908883 - DNA, 15 bp, Homo sapiens
gccactctatgagtt

SEQ ID NO: 5908884 - DNA, 15 bp, Homo sapiens
gccactctcccctcc

SEQ ID NO: 5908885 - DNA, 15 bp, Homo sapiens
gccactctctgggac

SEQ ID NO: 5908886 - DNA, 15 bp, Homo sapiens
gccactctgcctctg

SEQ ID NO: 5908887 - DNA, 17 bp, Homo sapiens
gccactctgcctctgcc

SEQ ID NO: 5908888 - DNA, 19 bp, Homo sapiens
gccactctgcctctgcctg

SEQ ID NO: 5908889 - DNA, 14 bp, Homo sapiens
gccactctgtttgc

SEQ ID NO: 5908890 - DNA, 18 bp, Homo sapiens
gccactctgtttgctcac

SEQ ID NO: 5908891 - DNA, 20 bp, Homo sapiens
gccactctgtttgctcaccc

SEQ ID NO: 5908892 - DNA, 21 bp, Homo sapiens
gccactgaaaagctttcctga

SEQ ID NO: 5908893 - DNA, 13 bp, Homo sapiens
gccactgaagagg

SEQ ID NO: 5908894 - DNA, 18 bp, Homo sapiens
gccactgaagaggaggag

SEQ ID NO: 5908895 - DNA, 19 bp, Homo sapiens
gccactgaagctgggattc

SEQ ID NO: 5908896 - DNA, 15 bp, Homo sapiens
gccactgacccacct

SEQ ID NO: 5908897 - DNA, 17 bp, Homo sapiens
gccactgacccacctgc

SEQ ID NO: 5908898 - DNA, 12 bp, Homo sapiens
gccactgacctc

SEQ ID NO: 5908899 - DNA, 18 bp, Homo sapiens
gccactgactgcagggac

SEQ ID NO: 5908900 - DNA, 13 bp, Homo sapiens
gccactgagctgg

SEQ ID NO: 5908901 - DNA, 17 bp, Homo sapiens
gccactgagctggctga

SEQ ID NO: 5908902 - DNA, 18 bp, Homo sapiens
gccactgaggagacagaa

SEQ ID NO: 5908903 - DNA, 21 bp, Homo sapiens
gccactgaggagacagaaagc

SEQ ID NO: 5908904 - DNA, 20 bp, Homo sapiens
gccactgaggggggatccag

SEQ ID NO: 5908905 - DNA, 12 bp, Homo sapiens
gccactgcaaac

SEQ ID NO: 5908906 - DNA, 17 bp, Homo sapiens
gccactgcacagagctc

SEQ ID NO: 5908907 - DNA, 17 bp, Homo sapiens
gccactgcactccagcc

SEQ ID NO: 5908908 - DNA, 20 bp, Homo sapiens
gccactgcactccagcctgg

SEQ ID NO: 5908909 - DNA, 19 bp, Homo sapiens
gccactgcactccagtctg

SEQ ID NO: 5908910 - DNA, 18 bp, Homo sapiens
gccactgcagcacctgcc

SEQ ID NO: 5908911 - DNA, 12 bp, Homo sapiens
gccactgcagtc

SEQ ID NO: 5908912 - DNA, 18 bp, Homo sapiens
gccactgccaagcttcct

SEQ ID NO: 5908913 - DNA, 19 bp, Homo sapiens
gccactgccaagcttcctg

SEQ ID NO: 5908914 - DNA, 20 bp, Homo sapiens
gccactgccaagcttcctgt

SEQ ID NO: 5908915 - DNA, 17 bp, Homo sapiens
gccactgccagcagctg

SEQ ID NO: 5908916 - DNA, 12 bp, Homo sapiens
gccactgccagg

SEQ ID NO: 5908917 - DNA, 15 bp, Homo sapiens
gccactgccaggcac

SEQ ID NO: 5908918 - DNA, 16 bp, Homo sapiens
gccactgccaggcacc

SEQ ID NO: 5908919 - DNA, 18 bp, Homo sapiens
gccactgccaggcacctg

SEQ ID NO: 5908920 - DNA, 19 bp, Homo sapiens
gccactgccaggcacctgg

SEQ ID NO: 5908921 - DNA, 24 bp, Homo sapiens
gccactgccaggcacctggcctgc

SEQ ID NO: 5908922 - DNA, 18 bp, Homo sapiens
gccactgccccccgaggc

SEQ ID NO: 5908923 - DNA, 18 bp, Homo sapiens
gccactgcccgagctggt

SEQ ID NO: 5908924 - DNA, 14 bp, Homo sapiens
gccactgccctctc

SEQ ID NO: 5908925 - DNA, 17 bp, Homo sapiens
gccactgccctctccac

SEQ ID NO: 5908926 - DNA, 18 bp, Homo sapiens
gccactgccgtcacctct

SEQ ID NO: 5908927 - DNA, 13 bp, Homo sapiens
gccactgcctctc

SEQ ID NO: 5908928 - DNA, 16 bp, Homo sapiens
gccactgcctcttcct

SEQ ID NO: 5908929 - DNA, 22 bp, Homo sapiens
gccactgccttcgcttcttgcc

SEQ ID NO: 5908930 - DNA, 23 bp, Homo sapiens
gccactgcctttcagaagtgatt

SEQ ID NO: 5908931 - DNA, 19 bp, Homo sapiens
gccactgcgccactgccat

SEQ ID NO: 5908932 - DNA, 18 bp, Homo sapiens
gccactgcgcccagcctg

SEQ ID NO: 5908933 - DNA, 12 bp, Homo sapiens
gccactgctccc

SEQ ID NO: 5908934 - DNA, 15 bp, Homo sapiens
gccactgctccgtgg

SEQ ID NO: 5908935 - DNA, 16 bp, Homo sapiens
gccactgctccgtgga

SEQ ID NO: 5908936 - DNA, 19 bp, Homo sapiens
gccactgctccgtggagga

SEQ ID NO: 5908937 - DNA, 24 bp, Homo sapiens
gccactgctggaggcagcgctggt

SEQ ID NO: 5908938 - DNA, 14 bp, Homo sapiens
gccactgctggtgt

SEQ ID NO: 5908939 - DNA, 14 bp, Homo sapiens
gccactgctgtatt

SEQ ID NO: 5908940 - DNA, 18 bp, Homo sapiens
gccactgctttccagcct

SEQ ID NO: 5908941 - DNA, 12 bp, Homo sapiens
gccactggaaat

SEQ ID NO: 5908942 - DNA, 15 bp, Homo sapiens
gccactggaaggaac

SEQ ID NO: 5908943 - DNA, 16 bp, Homo sapiens
gccactggaaggaaca

SEQ ID NO: 5908944 - DNA, 16 bp, Homo sapiens
gccactggaaggagca

SEQ ID NO: 5908945 - DNA, 18 bp, Homo sapiens
gccactggaggaagctgt

SEQ ID NO: 5908946 - DNA, 22 bp, Homo sapiens
gccactggaggaagctgttttg

SEQ ID NO: 5908947 - DNA, 22 bp, Homo sapiens
gccactggcacttgcctgctgc

SEQ ID NO: 5908948 - DNA, 19 bp, Homo sapiens
gccactgggcacctgcgca

SEQ ID NO: 5908949 - DNA, 12 bp, Homo sapiens
gccactgggccc

SEQ ID NO: 5908950 - DNA, 24 bp, Homo sapiens
gccactgggcccctgtccccagtc

SEQ ID NO: 5908951 - DNA, 12 bp, Homo sapiens
gccactgggctc

SEQ ID NO: 5908952 - DNA, 13 bp, Homo sapiens
gccactgggctct

SEQ ID NO: 5908953 - DNA, 17 bp, Homo sapiens
gccactgggctctggac

SEQ ID NO: 5908954 - DNA, 16 bp, Homo sapiens
gccactggggctcaga

SEQ ID NO: 5908955 - DNA, 15 bp, Homo sapiens
gccactggggtgcct

SEQ ID NO: 5908956 - DNA, 23 bp, Homo sapiens
gccactggggtgggagggggcag

SEQ ID NO: 5908957 - DNA, 18 bp, Homo sapiens
gccactgggtctcactcc

SEQ ID NO: 5908958 - DNA, 19 bp, Homo sapiens
gccactgtactccagcctg

SEQ ID NO: 5908959 - DNA, 19 bp, Homo sapiens
gccactgtatttgttaatt

SEQ ID NO: 5908960 - DNA, 16 bp, Homo sapiens
gccactgtcacaggca

SEQ ID NO: 5908961 - DNA, 18 bp, Homo sapiens
gccactgtccctgtcctt

SEQ ID NO: 5908962 - DNA, 21 bp, Homo sapiens
gccactgtccgctgtctccct

SEQ ID NO: 5908963 - DNA, 19 bp, Homo sapiens
gccactgtgaagagaacca

SEQ ID NO: 5908964 - DNA, 19 bp, Homo sapiens
gccactgtgctccagcctg

SEQ ID NO: 5908965 - DNA, 18 bp, Homo sapiens
gccactgtggccagagct

SEQ ID NO: 5908966 - DNA, 12 bp, Homo sapiens
gccactgtgtct

SEQ ID NO: 5908967 - DNA, 15 bp, Homo sapiens
gccactgtgtctctg

SEQ ID NO: 5908968 - DNA, 16 bp, Homo sapiens
gccactgtgtctctgt

SEQ ID NO: 5908969 - DNA, 19 bp, Homo sapiens
gccactgtgtgccttctgc

SEQ ID NO: 5908970 - DNA, 16 bp, Homo sapiens
gccactgtgttccttc

SEQ ID NO: 5908971 - DNA, 21 bp, Homo sapiens
gccactgtgtttctgtgctcc

SEQ ID NO: 5908972 - DNA, 19 bp, Homo sapiens
gccactgttcagcggagct

SEQ ID NO: 5908973 - DNA, 13 bp, Homo sapiens
gccacttaatgta

SEQ ID NO: 5908974 - DNA, 19 bp, Homo sapiens
gccacttaccttcaataaa

SEQ ID NO: 5908975 - DNA, 22 bp, Homo sapiens
gccacttaccttcaataaagta

SEQ ID NO: 5908976 - DNA, 20 bp, Homo sapiens
gccacttagggagtgtgcct

SEQ ID NO: 5908977 - DNA, 16 bp, Homo sapiens
gccacttatttccatg

SEQ ID NO: 5908978 - DNA, 19 bp, Homo sapiens
gccacttcaacccccagct

SEQ ID NO: 5908979 - DNA, 17 bp, Homo sapiens
gccacttcattccagca

SEQ ID NO: 5908980 - DNA, 23 bp, Homo sapiens
gccacttcattccagcagctgca

SEQ ID NO: 5908981 - DNA, 15 bp, Homo sapiens
gccacttcccaggta

SEQ ID NO: 5908982 - DNA, 14 bp, Homo sapiens
gccacttcctttgt

SEQ ID NO: 5908983 - DNA, 15 bp, Homo sapiens
gccacttcctttgtg

SEQ ID NO: 5908984 - DNA, 18 bp, Homo sapiens
gccacttccttttaactg

SEQ ID NO: 5908985 - DNA, 18 bp, Homo sapiens
gccacttctcactcacca

SEQ ID NO: 5908986 - DNA, 23 bp, Homo sapiens
gccacttctcactcaccactacc

SEQ ID NO: 5908987 - DNA, 16 bp, Homo sapiens
gccacttctgtccata

SEQ ID NO: 5908988 - DNA, 15 bp, Homo sapiens
gccacttgaaatgtt

SEQ ID NO: 5908989 - DNA, 16 bp, Homo sapiens
gccacttgacattcct

SEQ ID NO: 5908990 - DNA, 23 bp, Homo sapiens
gccacttgatggggcctgggttt

SEQ ID NO: 5908991 - DNA, 16 bp, Homo sapiens
gccacttgcactgtgc

SEQ ID NO: 5908992 - DNA, 18 bp, Homo sapiens
gccacttgcactgtgctt

SEQ ID NO: 5908993 - DNA, 14 bp, Homo sapiens
gccacttgctcaga

SEQ ID NO: 5908994 - DNA, 19 bp, Homo sapiens
gccacttggcccagaaagc

SEQ ID NO: 5908995 - DNA, 20 bp, Homo sapiens
gccacttggtttttggctct

SEQ ID NO: 5908996 - DNA, 15 bp, Homo sapiens
gccactttaagagag

SEQ ID NO: 5908997 - DNA, 18 bp, Homo sapiens
gccactttacccacctag

SEQ ID NO: 5908998 - DNA, 22 bp, Homo sapiens
gccactttacccacctagaaca

SEQ ID NO: 5908999 - DNA, 16 bp, Homo sapiens
gccactttcaagctgc

SEQ ID NO: 5909000 - DNA, 13 bp, Homo sapiens
gccactttccacc

SEQ ID NO: 5909001 - DNA, 15 bp, Homo sapiens
gccactttgactcag

SEQ ID NO: 5909002 - DNA, 14 bp, Homo sapiens
gccactttgcacga

SEQ ID NO: 5909003 - DNA, 21 bp, Homo sapiens
gccactttgcacgacgccctc

SEQ ID NO: 5909004 - DNA, 23 bp, Homo sapiens
gccactttgcacgacgccctctc

SEQ ID NO: 5909005 - DNA, 21 bp, Homo sapiens
gccactttggtacatggccag

SEQ ID NO: 5909006 - DNA, 22 bp, Homo sapiens
gccactttggtacatggccagt

SEQ ID NO: 5909007 - DNA, 16 bp, Homo sapiens
gccagattctcttgaa

SEQ ID NO: 5909008 - DNA, 15 bp, Homo sapiens
gccagattctgcctc

SEQ ID NO: 5909009 - DNA, 17 bp, Homo sapiens
gccagattctgcctctc

SEQ ID NO: 5909010 - DNA, 21 bp, Homo sapiens
gccagattggccaattaaaaa

SEQ ID NO: 5909011 - DNA, 13 bp, Homo sapiens
gccagatttttta

SEQ ID NO: 5909012 - DNA, 20 bp, Homo sapiens
gccagcaaaacttagatgtg

SEQ ID NO: 5909013 - DNA, 17 bp, Homo sapiens
gccagcaaaccaggact

SEQ ID NO: 5909014 - DNA, 23 bp, Homo sapiens
gccagcaaagaggactcgcttgt

SEQ ID NO: 5909015 - DNA, 14 bp, Homo sapiens
gccagcaaagcctc

SEQ ID NO: 5909016 - DNA, 19 bp, Homo sapiens
gccagcaacattggcacat

SEQ ID NO: 5909017 - DNA, 14 bp, Homo sapiens
gccagcaacgcttg

SEQ ID NO: 5909018 - DNA, 18 bp, Homo sapiens
gccagcaacgcttgtaga

SEQ ID NO: 5909019 - DNA, 22 bp, Homo sapiens
gccagcaacgcttgtagaactc

SEQ ID NO: 5909020 - DNA, 14 bp, Homo sapiens
gccagcaactgaat

SEQ ID NO: 5909021 - DNA, 18 bp, Homo sapiens
gccagcaaggtggagtgg

SEQ ID NO: 5909022 - DNA, 20 bp, Homo sapiens
gccagcaatgacatctcagg

SEQ ID NO: 5909023 - DNA, 23 bp, Homo sapiens
gccagcaatgacatctcaggggc

SEQ ID NO: 5909024 - DNA, 21 bp, Homo sapiens
gccagcaatgatgtccagaag

SEQ ID NO: 5909025 - DNA, 16 bp, Homo sapiens
gccagcacacagggca

SEQ ID NO: 5909026 - DNA, 17 bp, Homo sapiens
gccagcacacagggcag

SEQ ID NO: 5909027 - DNA, 22 bp, Homo sapiens
gccagcacagaaacagaggaga

SEQ ID NO: 5909028 - DNA, 13 bp, Homo sapiens
gccagcacagagc

SEQ ID NO: 5909029 - DNA, 18 bp, Homo sapiens
gccagcacagtaggtccc

SEQ ID NO: 5909030 - DNA, 13 bp, Homo sapiens
gccagcaccacag

SEQ ID NO: 5909031 - DNA, 17 bp, Homo sapiens
gccagcaccacagccgg

SEQ ID NO: 5909032 - DNA, 16 bp, Homo sapiens
gccagcaccacctaca

SEQ ID NO: 5909033 - DNA, 21 bp, Homo sapiens
gccagcaccacctacacagga

SEQ ID NO: 5909034 - DNA, 18 bp, Homo sapiens
gccagcaccacttccttt

SEQ ID NO: 5909035 - DNA, 21 bp, Homo sapiens
gccagcacccccacgccctca

SEQ ID NO: 5909036 - DNA, 14 bp, Homo sapiens
gccagcaccctctc

SEQ ID NO: 5909037 - DNA, 18 bp, Homo sapiens
gccagcaccgccggcttt

SEQ ID NO: 5909038 - DNA, 15 bp, Homo sapiens
gccagcaccggacca

SEQ ID NO: 5909039 - DNA, 18 bp, Homo sapiens
gccagcaccggaccagcc

SEQ ID NO: 5909040 - DNA, 19 bp, Homo sapiens
gccagcaccggaccagcct

SEQ ID NO: 5909041 - DNA, 14 bp, Homo sapiens
gccagcacctggca

SEQ ID NO: 5909042 - DNA, 16 bp, Homo sapiens
gccagcacgcctggct

SEQ ID NO: 5909043 - DNA, 18 bp, Homo sapiens
gccagcactcgctagcag

SEQ ID NO: 5909044 - DNA, 22 bp, Homo sapiens
gccagcactggaggggcccacc

SEQ ID NO: 5909045 - DNA, 15 bp, Homo sapiens
gccagcacttgtata

SEQ ID NO: 5909046 - DNA, 20 bp, Homo sapiens
gccagcacttgtccagctga

SEQ ID NO: 5909047 - DNA, 15 bp, Homo sapiens
gccagcagagcatgt

SEQ ID NO: 5909048 - DNA, 12 bp, Homo sapiens
gccagcagagcc

SEQ ID NO: 5909049 - DNA, 13 bp, Homo sapiens
gccagcagagcca

SEQ ID NO: 5909050 - DNA, 16 bp, Homo sapiens
gccagcagagccaggg

SEQ ID NO: 5909051 - DNA, 18 bp, Homo sapiens
gccagcagagccagggca

SEQ ID NO: 5909052 - DNA, 19 bp, Homo sapiens
gccagcagagccagggcag

SEQ ID NO: 5909053 - DNA, 23 bp, Homo sapiens
gccagcagagccagggcagggcg

SEQ ID NO: 5909054 - DNA, 13 bp, Homo sapiens
gccagcagcacct

SEQ ID NO: 5909055 - DNA, 14 bp, Homo sapiens
gccagcagcacctg

SEQ ID NO: 5909056 - DNA, 18 bp, Homo sapiens
gccagcagcagcaacctg

SEQ ID NO: 5909057 - DNA, 15 bp, Homo sapiens
gccagcagcagcagg

SEQ ID NO: 5909058 - DNA, 16 bp, Homo sapiens
gccagcagcagcaggt

SEQ ID NO: 5909059 - DNA, 20 bp, Homo sapiens
gccagcagccagctctcagc

SEQ ID NO: 5909060 - DNA, 17 bp, Homo sapiens
gccagcagcccttgttt

SEQ ID NO: 5909061 - DNA, 12 bp, Homo sapiens
gccagcagcctc

SEQ ID NO: 5909062 - DNA, 18 bp, Homo sapiens
gccagcagcctctgatct

SEQ ID NO: 5909063 - DNA, 15 bp, Homo sapiens
gccagcagccttcca

SEQ ID NO: 5909064 - DNA, 16 bp, Homo sapiens
gccagcagccttccag

SEQ ID NO: 5909065 - DNA, 18 bp, Homo sapiens
gccagcagcgcgcaggcc

SEQ ID NO: 5909066 - DNA, 21 bp, Homo sapiens
gccagcagctgaagtctcttt

SEQ ID NO: 5909067 - DNA, 13 bp, Homo sapiens
gccagcagctgat

SEQ ID NO: 5909068 - DNA, 22 bp, Homo sapiens
gccagcagcttaagtccagctc

SEQ ID NO: 5909069 - DNA, 23 bp, Homo sapiens
gccagcagcttaagtccagctca

SEQ ID NO: 5909070 - DNA, 13 bp, Homo sapiens
gccagcaggaata

SEQ ID NO: 5909071 - DNA, 18 bp, Homo sapiens
gccagcaggcagcgcctg

SEQ ID NO: 5909072 - DNA, 20 bp, Homo sapiens
gccagcaggcgggctccttt

SEQ ID NO: 5909073 - DNA, 15 bp, Homo sapiens
gccagcaggctcctg

SEQ ID NO: 5909074 - DNA, 18 bp, Homo sapiens
gccagcaggctctcaggc

SEQ ID NO: 5909075 - DNA, 23 bp, Homo sapiens
gccagcagggcatcttggaaaag

SEQ ID NO: 5909076 - DNA, 16 bp, Homo sapiens
gccagcagttgtaaaa

SEQ ID NO: 5909077 - DNA, 17 bp, Homo sapiens
gccagcataggggggag

SEQ ID NO: 5909078 - DNA, 18 bp, Homo sapiens
gccagcataggggggagg

SEQ ID NO: 5909079 - DNA, 13 bp, Homo sapiens
gccagcatctggg

SEQ ID NO: 5909080 - DNA, 20 bp, Homo sapiens
gccagccaagctctgcagtc

SEQ ID NO: 5909081 - DNA, 19 bp, Homo sapiens
gccagccaatccctggcca

SEQ ID NO: 5909082 - DNA, 17 bp, Homo sapiens
gccagccaatttcccgg

SEQ ID NO: 5909083 - DNA, 18 bp, Homo sapiens
gccagccaatttcccgga

SEQ ID NO: 5909084 - DNA, 9 bp, Homo sapiens
gccagccac

SEQ ID NO: 5909085 - DNA, 10 bp, Homo sapiens
gccagccaca

SEQ ID NO: 5909086 - DNA, 22 bp, Homo sapiens
gccagccacagacccctgggag

SEQ ID NO: 5909087 - DNA, 13 bp, Homo sapiens
gccagccacagga

SEQ ID NO: 5909088 - DNA, 12 bp, Homo sapiens
gccagccactgt

SEQ ID NO: 5909089 - DNA, 18 bp, Homo sapiens
gccagccagaagcctctg

SEQ ID NO: 5909090 - DNA, 19 bp, Homo sapiens
gccagccagcagccagctc

SEQ ID NO: 5909091 - DNA, 19 bp, Homo sapiens
gccagccaggaagatgaat

SEQ ID NO: 5909092 - DNA, 14 bp, Homo sapiens
gccagccaggagtg

SEQ ID NO: 5909093 - DNA, 18 bp, Homo sapiens
gccagccaggcgggctca

SEQ ID NO: 5909094 - DNA, 21 bp, Homo sapiens
gccagccaggcgggctcaagg

SEQ ID NO: 5909095 - DNA, 19 bp, Homo sapiens
gccagccagtcttgcctag

SEQ ID NO: 5909096 - DNA, 19 bp, Homo sapiens
gccagccagtgacctgagg

SEQ ID NO: 5909097 - DNA, 12 bp, Homo sapiens
gccagccagtgg

SEQ ID NO: 5909098 - DNA, 21 bp, Homo sapiens
gccagccatcacaaggggaac

SEQ ID NO: 5909099 - DNA, 19 bp, Homo sapiens
gccagccatcggaagagag

SEQ ID NO: 5909100 - DNA, 21 bp, Homo sapiens
gccagccatcggaagagaggg

SEQ ID NO: 5909101 - DNA, 20 bp, Homo sapiens
gccagccatttttcagtagc

SEQ ID NO: 5909102 - DNA, 11 bp, Homo sapiens
gccagcccaaa

SEQ ID NO: 5909103 - DNA, 18 bp, Homo sapiens
gccagcccaaaccttggg

SEQ ID NO: 5909104 - DNA, 21 bp, Homo sapiens
gccagcccaaaccttgggccc

SEQ ID NO: 5909105 - DNA, 14 bp, Homo sapiens
gccagcccactggg

SEQ ID NO: 5909106 - DNA, 16 bp, Homo sapiens
gccagcccactgggcc

SEQ ID NO: 5909107 - DNA, 10 bp, Homo sapiens
gccagcccag

SEQ ID NO: 5909108 - DNA, 12 bp, Homo sapiens
gccagcccagaa

SEQ ID NO: 5909109 - DNA, 19 bp, Homo sapiens
gccagcccagatggctccc

SEQ ID NO: 5909110 - DNA, 12 bp, Homo sapiens
gccagcccagcc

SEQ ID NO: 5909111 - DNA, 13 bp, Homo sapiens
gccagcccagcca

SEQ ID NO: 5909112 - DNA, 14 bp, Homo sapiens
gccagcccagccca

SEQ ID NO: 5909113 - DNA, 15 bp, Homo sapiens
gccagcccagctcca

SEQ ID NO: 5909114 - DNA, 14 bp, Homo sapiens
gccagcccagctgg

SEQ ID NO: 5909115 - DNA, 20 bp, Homo sapiens
gccagcccatggcccccaat

SEQ ID NO: 5909116 - DNA, 20 bp, Homo sapiens
gccagccccaagctgggccg

SEQ ID NO: 5909117 - DNA, 15 bp, Homo sapiens
gccagccccacagcc

SEQ ID NO: 5909118 - DNA, 14 bp, Homo sapiens
gccagccccaccca

SEQ ID NO: 5909119 - DNA, 17 bp, Homo sapiens
gccagccccacccagga

SEQ ID NO: 5909120 - DNA, 19 bp, Homo sapiens
gccagccccacccaggagg

SEQ ID NO: 5909121 - DNA, 20 bp, Homo sapiens
gccagccccacccccagcca

SEQ ID NO: 5909122 - DNA, 15 bp, Homo sapiens
gccagccccatcttg

SEQ ID NO: 5909123 - DNA, 20 bp, Homo sapiens
gccagccccatcttggtcct

SEQ ID NO: 5909124 - DNA, 17 bp, Homo sapiens
gccagcccccccaccca

SEQ ID NO: 5909125 - DNA, 23 bp, Homo sapiens
gccagcccccccacccaccccca

SEQ ID NO: 5909126 - DNA, 16 bp, Homo sapiens
gccagccccgctccca

SEQ ID NO: 5909127 - DNA, 17 bp, Homo sapiens
gccagccccgctcccac

SEQ ID NO: 5909128 - DNA, 20 bp, Homo sapiens
gccagccccgctcccaccta

SEQ ID NO: 5909129 - DNA, 18 bp, Homo sapiens
gccagccccggccctggg

SEQ ID NO: 5909130 - DNA, 19 bp, Homo sapiens
gccagccccggccctgggc

SEQ ID NO: 5909131 - DNA, 21 bp, Homo sapiens
gccagccccggccctgggctc

SEQ ID NO: 5909132 - DNA, 17 bp, Homo sapiens
gccagccccgtgccagg

SEQ ID NO: 5909133 - DNA, 22 bp, Homo sapiens
gccagcccctagatgaagaaag

SEQ ID NO: 5909134 - DNA, 13 bp, Homo sapiens
gccagcccctccc

SEQ ID NO: 5909135 - DNA, 21 bp, Homo sapiens
gccagcccctcccaccacagc

SEQ ID NO: 5909136 - DNA, 20 bp, Homo sapiens
gccagcccctccccgcctcc

SEQ ID NO: 5909137 - DNA, 22 bp, Homo sapiens
gccagcccctccccgcctcctc

SEQ ID NO: 5909138 - DNA, 21 bp, Homo sapiens
gccagcccctcggctctgccg

SEQ ID NO: 5909139 - DNA, 15 bp, Homo sapiens
gccagcccctcttcc

SEQ ID NO: 5909140 - DNA, 14 bp, Homo sapiens
gccagcccctgcct

SEQ ID NO: 5909141 - DNA, 18 bp, Homo sapiens
gccagcccctgcctgggt

SEQ ID NO: 5909142 - DNA, 19 bp, Homo sapiens
gccagcccctgcctgggtt

SEQ ID NO: 5909143 - DNA, 19 bp, Homo sapiens
gccagcccctgctggctgg

SEQ ID NO: 5909144 - DNA, 16 bp, Homo sapiens
gccagcccctggggcc

SEQ ID NO: 5909145 - DNA, 17 bp, Homo sapiens
gccagcccctggggccc

SEQ ID NO: 5909146 - DNA, 23 bp, Homo sapiens
gccagcccgccgcccgcccctca

SEQ ID NO: 5909147 - DNA, 21 bp, Homo sapiens
gccagcccggaggggactggt

SEQ ID NO: 5909148 - DNA, 23 bp, Homo sapiens
gccagcccggctcggcccagcac

SEQ ID NO: 5909149 - DNA, 16 bp, Homo sapiens
gccagcccgtcctcct

SEQ ID NO: 5909150 - DNA, 15 bp, Homo sapiens
gccagccctaggcta

SEQ ID NO: 5909151 - DNA, 16 bp, Homo sapiens
gccagccctaggctac

SEQ ID NO: 5909152 - DNA, 18 bp, Homo sapiens
gccagccctaggctaccc

SEQ ID NO: 5909153 - DNA, 19 bp, Homo sapiens
gccagccctaggctaccct

SEQ ID NO: 5909154 - DNA, 15 bp, Homo sapiens
gccagccctcccagc

SEQ ID NO: 5909155 - DNA, 18 bp, Homo sapiens
gccagccctcccagcagt

SEQ ID NO: 5909156 - DNA, 13 bp, Homo sapiens
gccagccctccct

SEQ ID NO: 5909157 - DNA, 17 bp, Homo sapiens
gccagccctccctggct

SEQ ID NO: 5909158 - DNA, 24 bp, Homo sapiens
gccagccctccctggctgtgagca

SEQ ID NO: 5909159 - DNA, 23 bp, Homo sapiens
gccagccctccctgtcctcctcg

SEQ ID NO: 5909160 - DNA, 10 bp, Homo sapiens
gccagccctg

SEQ ID NO: 5909161 - DNA, 15 bp, Homo sapiens
gccagccctgcagcc

SEQ ID NO: 5909162 - DNA, 14 bp, Homo sapiens
gccagccctgcctg

SEQ ID NO: 5909163 - DNA, 15 bp, Homo sapiens
gccagccctgcctgg

SEQ ID NO: 5909164 - DNA, 17 bp, Homo sapiens
gccagccctgcctggag

SEQ ID NO: 5909165 - DNA, 20 bp, Homo sapiens
gccagccctgcctggaggac

SEQ ID NO: 5909166 - DNA, 11 bp, Homo sapiens
gccagccctgg

SEQ ID NO: 5909167 - DNA, 20 bp, Homo sapiens
gccagccctggaggctggat

SEQ ID NO: 5909168 - DNA, 15 bp, Homo sapiens
gccagccctggccca

SEQ ID NO: 5909169 - DNA, 19 bp, Homo sapiens
gccagccctggcttccaag

SEQ ID NO: 5909170 - DNA, 22 bp, Homo sapiens
gccagccctgttccgcctcact

SEQ ID NO: 5909171 - DNA, 23 bp, Homo sapiens
gccagccctgttccgcctcactg

SEQ ID NO: 5909172 - DNA, 14 bp, Homo sapiens
gccagcccttccca

SEQ ID NO: 5909173 - DNA, 20 bp, Homo sapiens
gccagcccttcccaggccag

SEQ ID NO: 5909174 - DNA, 22 bp, Homo sapiens
gccagcccttcccaggccagcg

SEQ ID NO: 5909175 - DNA, 16 bp, Homo sapiens
gccagccgaccctcct

SEQ ID NO: 5909176 - DNA, 18 bp, Homo sapiens
gccagccgaccctcctgg

SEQ ID NO: 5909177 - DNA, 21 bp, Homo sapiens
gccagccgagatagccaaggc

SEQ ID NO: 5909178 - DNA, 22 bp, Homo sapiens
gccagccgagatagccaaggcc

SEQ ID NO: 5909179 - DNA, 17 bp, Homo sapiens
gccagccgattcctcca

SEQ ID NO: 5909180 - DNA, 15 bp, Homo sapiens
gccagccgccctggg

SEQ ID NO: 5909181 - DNA, 16 bp, Homo sapiens
gccagccgccctgggc

SEQ ID NO: 5909182 - DNA, 17 bp, Homo sapiens
gccagccgccctgggct

SEQ ID NO: 5909183 - DNA, 20 bp, Homo sapiens
gccagccgccctgggctgtc

SEQ ID NO: 5909184 - DNA, 20 bp, Homo sapiens
gccagccgcgcatcagactg

SEQ ID NO: 5909185 - DNA, 16 bp, Homo sapiens
gccaggctgaccacag

SEQ ID NO: 5909186 - DNA, 19 bp, Homo sapiens
gccaggctgaccacagcac

SEQ ID NO: 5909187 - DNA, 22 bp, Homo sapiens
gccaggctgaccacagcacagc

SEQ ID NO: 5909188 - DNA, 14 bp, Homo sapiens
gccaggctgagccg

SEQ ID NO: 5909189 - DNA, 15 bp, Homo sapiens
gccaggctgagccga

SEQ ID NO: 5909190 - DNA, 16 bp, Homo sapiens
gccaggctgcagggac

SEQ ID NO: 5909191 - DNA, 19 bp, Homo sapiens
gccaggctgcctcctgccc

SEQ ID NO: 5909192 - DNA, 14 bp, Homo sapiens
gccaggctgctaac

SEQ ID NO: 5909193 - DNA, 15 bp, Homo sapiens
gccaggctgggaggc

SEQ ID NO: 5909194 - DNA, 14 bp, Homo sapiens
gccaggctgggccg

SEQ ID NO: 5909195 - DNA, 21 bp, Homo sapiens
gccaggctgggccgcaagggc

SEQ ID NO: 5909196 - DNA, 15 bp, Homo sapiens
gccaggctggtctca

SEQ ID NO: 5909197 - DNA, 15 bp, Homo sapiens
gccaggcttgcctgg

SEQ ID NO: 5909198 - DNA, 17 bp, Homo sapiens
gccaggcttgcctgggc

SEQ ID NO: 5909199 - DNA, 17 bp, Homo sapiens
gccaggcttggatggaa

SEQ ID NO: 5909200 - DNA, 19 bp, Homo sapiens
gccagggaaagactggcaa

SEQ ID NO: 5909201 - DNA, 17 bp, Homo sapiens
gccagggaactggcctg

SEQ ID NO: 5909202 - DNA, 18 bp, Homo sapiens
gccagggaactggcctgc

SEQ ID NO: 5909203 - DNA, 20 bp, Homo sapiens
gccagggaactggcctgctg

SEQ ID NO: 5909204 - DNA, 17 bp, Homo sapiens
gccagggaagacagagc

SEQ ID NO: 5909205 - DNA, 12 bp, Homo sapiens
gccagggaaggc

SEQ ID NO: 5909206 - DNA, 23 bp, Homo sapiens
gccagggacagagggggtggcct

SEQ ID NO: 5909207 - DNA, 18 bp, Homo sapiens
gccagggacattttcaag

SEQ ID NO: 5909208 - DNA, 12 bp, Homo sapiens
gccagggaccca

SEQ ID NO: 5909209 - DNA, 16 bp, Homo sapiens
gccagggacccaggtg

SEQ ID NO: 5909210 - DNA, 23 bp, Homo sapiens
gccagggacccaggtgtgcctgt

SEQ ID NO: 5909211 - DNA, 12 bp, Homo sapiens
gccagggacccc

SEQ ID NO: 5909212 - DNA, 13 bp, Homo sapiens
gccagggaccccc

SEQ ID NO: 5909213 - DNA, 15 bp, Homo sapiens
gccagggacccccag

SEQ ID NO: 5909214 - DNA, 14 bp, Homo sapiens
gccagggagaagct

SEQ ID NO: 5909215 - DNA, 19 bp, Homo sapiens
gccagggagacctggacac

SEQ ID NO: 5909216 - DNA, 21 bp, Homo sapiens
gccagggagacctggacacag

SEQ ID NO: 5909217 - DNA, 21 bp, Homo sapiens
gccagggagagcccaggagct

SEQ ID NO: 5909218 - DNA, 13 bp, Homo sapiens
gccagggagcccg

SEQ ID NO: 5909219 - DNA, 14 bp, Homo sapiens
gccagggagcgagt

SEQ ID NO: 5909220 - DNA, 21 bp, Homo sapiens
gccagggagcttgccacactc

SEQ ID NO: 5909221 - DNA, 23 bp, Homo sapiens
gccagggaggaaggaggccacgg

SEQ ID NO: 5909222 - DNA, 16 bp, Homo sapiens
gccagggaggagcccc

SEQ ID NO: 5909223 - DNA, 18 bp, Homo sapiens
gccagggaggagccccag

SEQ ID NO: 5909224 - DNA, 15 bp, Homo sapiens
gccagggaggcgcag

SEQ ID NO: 5909225 - DNA, 13 bp, Homo sapiens
gccagggatggca

SEQ ID NO: 5909226 - DNA, 14 bp, Homo sapiens
gccagggatggcag

SEQ ID NO: 5909227 - DNA, 19 bp, Homo sapiens
gccagggatggggccacag

SEQ ID NO: 5909228 - DNA, 17 bp, Homo sapiens
gccagggcaagagagcg

SEQ ID NO: 5909229 - DNA, 20 bp, Homo sapiens
gccagggcaatgatgaatga

SEQ ID NO: 5909230 - DNA, 13 bp, Homo sapiens
gccagggcaatgc

SEQ ID NO: 5909231 - DNA, 14 bp, Homo sapiens
gccagggcaatgcc

SEQ ID NO: 5909232 - DNA, 15 bp, Homo sapiens
gccagggcaatgcca

SEQ ID NO: 5909233 - DNA, 17 bp, Homo sapiens
gccagggcacagctgga

SEQ ID NO: 5909234 - DNA, 10 bp, Homo sapiens
gccagggcag

SEQ ID NO: 5909235 - DNA, 11 bp, Homo sapiens
gccagggcaga

SEQ ID NO: 5909236 - DNA, 15 bp, Homo sapiens
gccagggcagaggaa

SEQ ID NO: 5909237 - DNA, 16 bp, Homo sapiens
gccagggcagaggaat

SEQ ID NO: 5909238 - DNA, 21 bp, Homo sapiens
gccagggcagagtgagaccca

SEQ ID NO: 5909239 - DNA, 12 bp, Homo sapiens
gccagggcagca

SEQ ID NO: 5909240 - DNA, 21 bp, Homo sapiens
gccagggcagcaagggacctg

SEQ ID NO: 5909241 - DNA, 17 bp, Homo sapiens
gccagggcagggccacc

SEQ ID NO: 5909242 - DNA, 21 bp, Homo sapiens
gccagggcagggcgagctgca

SEQ ID NO: 5909243 - DNA, 14 bp, Homo sapiens
gccagggcagggct

SEQ ID NO: 5909244 - DNA, 16 bp, Homo sapiens
gccagggcagggtctg

SEQ ID NO: 5909245 - DNA, 20 bp, Homo sapiens
gccagggcagggtctgggct

SEQ ID NO: 5909246 - DNA, 21 bp, Homo sapiens
gccagggcagggtctgggctg

SEQ ID NO: 5909247 - DNA, 20 bp, Homo sapiens
gccagggccacgctccagct

SEQ ID NO: 5909248 - DNA, 13 bp, Homo sapiens
gccagggccaggg

SEQ ID NO: 5909249 - DNA, 15 bp, Homo sapiens
gccagggcccacccc

SEQ ID NO: 5909250 - DNA, 14 bp, Homo sapiens
gccagggcccagag

SEQ ID NO: 5909251 - DNA, 15 bp, Homo sapiens
gccagggcccagagc

SEQ ID NO: 5909252 - DNA, 16 bp, Homo sapiens
gccagggcccagagcc

SEQ ID NO: 5909253 - DNA, 23 bp, Homo sapiens
gccagggcccagagcccttgact

SEQ ID NO: 5909254 - DNA, 22 bp, Homo sapiens
gccagggcccctcaccctgcct

SEQ ID NO: 5909255 - DNA, 15 bp, Homo sapiens
gccagggcccctctc

SEQ ID NO: 5909256 - DNA, 18 bp, Homo sapiens
gccagggcccctctcccc

SEQ ID NO: 5909257 - DNA, 19 bp, Homo sapiens
gccagggcccctctcccca

SEQ ID NO: 5909258 - DNA, 20 bp, Homo sapiens
gccagggcccctctccccag

SEQ ID NO: 5909259 - DNA, 23 bp, Homo sapiens
gccagggcccctctccccaggga

SEQ ID NO: 5909260 - DNA, 15 bp, Homo sapiens
gccagggccctgcag

SEQ ID NO: 5909261 - DNA, 17 bp, Homo sapiens
gccagggccctgcagag

SEQ ID NO: 5909262 - DNA, 20 bp, Homo sapiens
gccagggccgcggccgcccg

SEQ ID NO: 5909263 - DNA, 17 bp, Homo sapiens
gccagggcctctccaac

SEQ ID NO: 5909264 - DNA, 21 bp, Homo sapiens
gccagggcctgctgagttgct

SEQ ID NO: 5909265 - DNA, 16 bp, Homo sapiens
gccagggcctggaaga

SEQ ID NO: 5909266 - DNA, 22 bp, Homo sapiens
gccagggctatagctcaggacc

SEQ ID NO: 5909267 - DNA, 19 bp, Homo sapiens
gccagggctcaccagctgg

SEQ ID NO: 5909268 - DNA, 17 bp, Homo sapiens
gccagggctcagatggg

SEQ ID NO: 5909269 - DNA, 13 bp, Homo sapiens
gccagggctcctg

SEQ ID NO: 5909270 - DNA, 14 bp, Homo sapiens
gccagggctcctgt

SEQ ID NO: 5909271 - DNA, 17 bp, Homo sapiens
gccagggctcctgtggc

SEQ ID NO: 5909272 - DNA, 22 bp, Homo sapiens
gccagggctcctgtggcagctg

SEQ ID NO: 5909273 - DNA, 14 bp, Homo sapiens
gccagggctctggc

SEQ ID NO: 5909274 - DNA, 16 bp, Homo sapiens
gccagggctctggggg

SEQ ID NO: 5909275 - DNA, 11 bp, Homo sapiens
gccagggctgg

SEQ ID NO: 5909276 - DNA, 15 bp, Homo sapiens
gccagggctggagaa

SEQ ID NO: 5909277 - DNA, 16 bp, Homo sapiens
gccagggctggatgga

SEQ ID NO: 5909278 - DNA, 19 bp, Homo sapiens
gccagggctggatggacag

SEQ ID NO: 5909279 - DNA, 20 bp, Homo sapiens
gccagggctggatggacaga

SEQ ID NO: 5909280 - DNA, 18 bp, Homo sapiens
gccagggctgggtcacag

SEQ ID NO: 5909281 - DNA, 23 bp, Homo sapiens
gccagggctgggtcacaggaagg

SEQ ID NO: 5909282 - DNA, 14 bp, Homo sapiens
gccagggctgtcct

SEQ ID NO: 5909283 - DNA, 10 bp, Homo sapiens
gccagggctt

SEQ ID NO: 5909284 - DNA, 16 bp, Homo sapiens
gccagggcttcctctt

SEQ ID NO: 5909285 - DNA, 17 bp, Homo sapiens
gccagggcttgtggact

SEQ ID NO: 5909286 - DNA, 21 bp, Homo sapiens
gccaggggagcagaggggcag

SEQ ID NO: 5909287 - DNA, 13 bp, Homo sapiens
gccaggggatctg

SEQ ID NO: 5909288 - DNA, 14 bp, Homo sapiens
gccaggggcaggca

SEQ ID NO: 5909289 - DNA, 15 bp, Homo sapiens
gccaggggcaggcag

SEQ ID NO: 5909290 - DNA, 16 bp, Homo sapiens
gccaggggcaggcagc

SEQ ID NO: 5909291 - DNA, 17 bp, Homo sapiens
gccaggggcaggcagct

SEQ ID NO: 5909292 - DNA, 14 bp, Homo sapiens
gccaggggccagga

SEQ ID NO: 5909293 - DNA, 17 bp, Homo sapiens
gccaggggctctgtggc

SEQ ID NO: 5909294 - DNA, 15 bp, Homo sapiens
gccaggggctgctca

SEQ ID NO: 5909295 - DNA, 20 bp, Homo sapiens
gccaggggcttcccactttg

SEQ ID NO: 5909296 - DNA, 23 bp, Homo sapiens
gccaggggcttctccccctcagc

SEQ ID NO: 5909297 - DNA, 20 bp, Homo sapiens
gccagggggactagcccctg

SEQ ID NO: 5909298 - DNA, 22 bp, Homo sapiens
gccagggggagctgggcctggt

SEQ ID NO: 5909299 - DNA, 19 bp, Homo sapiens
gccaggggggtgaggagct

SEQ ID NO: 5909300 - DNA, 20 bp, Homo sapiens
gccaggggggtgaggagctg

SEQ ID NO: 5909301 - DNA, 21 bp, Homo sapiens
gccaggggtctccctggagtg

SEQ ID NO: 5909302 - DNA, 17 bp, Homo sapiens
gccaggggtgctcctgt

SEQ ID NO: 5909303 - DNA, 21 bp, Homo sapiens
gccaggggtgctcctgtgctc

SEQ ID NO: 5909304 - DNA, 20 bp, Homo sapiens
gccaggggtgtcccagtccc

SEQ ID NO: 5909305 - DNA, 21 bp, Homo sapiens
gccaggggtgtcccagtccca

SEQ ID NO: 5909306 - DNA, 23 bp, Homo sapiens
gccagggtagacttggagctgtc

SEQ ID NO: 5909307 - DNA, 22 bp, Homo sapiens
gccagggtagagcaaaggagac

SEQ ID NO: 5909308 - DNA, 23 bp, Homo sapiens
gccagggtctctccctcaggtgt

SEQ ID NO: 5909309 - DNA, 19 bp, Homo sapiens
gccagggtctgtgtgaatg

SEQ ID NO: 5909310 - DNA, 21 bp, Homo sapiens
gccagggtctgtgtgaatgtg

SEQ ID NO: 5909311 - DNA, 15 bp, Homo sapiens
gccagggtgagagct

SEQ ID NO: 5909312 - DNA, 19 bp, Homo sapiens
gccagggtgagagtctggg

SEQ ID NO: 5909313 - DNA, 17 bp, Homo sapiens
gccagggtgggaagaga

SEQ ID NO: 5909314 - DNA, 18 bp, Homo sapiens
gccagggtgggaagagaa

SEQ ID NO: 5909315 - DNA, 15 bp, Homo sapiens
gccagggtgggctgg

SEQ ID NO: 5909316 - DNA, 19 bp, Homo sapiens
gccagggtgggctggggac

SEQ ID NO: 5909317 - DNA, 18 bp, Homo sapiens
gccagggtgggtgtccat

SEQ ID NO: 5909318 - DNA, 23 bp, Homo sapiens
gccagggtggtggtgcacacctg

SEQ ID NO: 5909319 - DNA, 23 bp, Homo sapiens
gccagggtgtggccctgccatct

SEQ ID NO: 5909320 - DNA, 16 bp, Homo sapiens
gccagggttccagaca

SEQ ID NO: 5909321 - DNA, 17 bp, Homo sapiens
gccagggttccagacag

SEQ ID NO: 5909322 - DNA, 22 bp, Homo sapiens
gccagggttccagacagggtgg

SEQ ID NO: 5909323 - DNA, 18 bp, Homo sapiens
gccagggttgtgctttct

SEQ ID NO: 5909324 - DNA, 19 bp, Homo sapiens
gccagggtttacccagtgg

SEQ ID NO: 5909325 - DNA, 21 bp, Homo sapiens
gccaggtacaaccggatgcca

SEQ ID NO: 5909326 - DNA, 20 bp, Homo sapiens
gccaggtacaggagaggcag

SEQ ID NO: 5909327 - DNA, 20 bp, Homo sapiens
gccaggtaccttctcacctg

SEQ ID NO: 5909328 - DNA, 23 bp, Homo sapiens
gccaggtactgcattctctccca

SEQ ID NO: 5909329 - DNA, 20 bp, Homo sapiens
gccaggtagcaagagagcag

SEQ ID NO: 5909330 - DNA, 22 bp, Homo sapiens
gccaggtaggatgaacacaggc

SEQ ID NO: 5909331 - DNA, 16 bp, Homo sapiens
gccaggtatggctctg

SEQ ID NO: 5909332 - DNA, 15 bp, Homo sapiens
gccaggtccagagag

SEQ ID NO: 5909333 - DNA, 15 bp, Homo sapiens
gccaggtccccctgc

SEQ ID NO: 5909334 - DNA, 16 bp, Homo sapiens
gccaggtccccctgca

SEQ ID NO: 5909335 - DNA, 13 bp, Homo sapiens
gccaggtccctct

SEQ ID NO: 5909336 - DNA, 17 bp, Homo sapiens
gccaggtccctggacca

SEQ ID NO: 5909337 - DNA, 20 bp, Homo sapiens
gccaggtccctggaccagcc

SEQ ID NO: 5909338 - DNA, 14 bp, Homo sapiens
gccaggtctcctgg

SEQ ID NO: 5909339 - DNA, 16 bp, Homo sapiens
gccaggtctgactcca

SEQ ID NO: 5909340 - DNA, 17 bp, Homo sapiens
gccaggtctggcgccag

SEQ ID NO: 5909341 - DNA, 16 bp, Homo sapiens
gccaggtgagaaactg

SEQ ID NO: 5909342 - DNA, 16 bp, Homo sapiens
gccaggtgagctctga

SEQ ID NO: 5909343 - DNA, 18 bp, Homo sapiens
gccaggtgaggtcagcac

SEQ ID NO: 5909344 - DNA, 15 bp, Homo sapiens
gccaggtgaggtcca

SEQ ID NO: 5909345 - DNA, 16 bp, Homo sapiens
gccaggtgatctcctg

SEQ ID NO: 5909346 - DNA, 19 bp, Homo sapiens
gccaggtgcaatctactgg

SEQ ID NO: 5909347 - DNA, 14 bp, Homo sapiens
gccaggtgcagacc

SEQ ID NO: 5909348 - DNA, 13 bp, Homo sapiens
gccaggtgcagtg

SEQ ID NO: 5909349 - DNA, 14 bp, Homo sapiens
gccaggtgcagtgg

SEQ ID NO: 5909350 - DNA, 14 bp, Homo sapiens
gccaggtgcccagg

SEQ ID NO: 5909351 - DNA, 15 bp, Homo sapiens
gccaggtgcccagga

SEQ ID NO: 5909352 - DNA, 22 bp, Homo sapiens
gccaggtgccgacactgagctg

SEQ ID NO: 5909353 - DNA, 15 bp, Homo sapiens
gccaggtgcctcctg

SEQ ID NO: 5909354 - DNA, 15 bp, Homo sapiens
gccaggtgccttgga

SEQ ID NO: 5909355 - DNA, 14 bp, Homo sapiens
gccaggtgcggcct

SEQ ID NO: 5909356 - DNA, 15 bp, Homo sapiens
gccaggtgctgggaa

SEQ ID NO: 5909357 - DNA, 17 bp, Homo sapiens
gccaggtgctgtgacac

SEQ ID NO: 5909358 - DNA, 16 bp, Homo sapiens
gccaggtgggcggaca

SEQ ID NO: 5909359 - DNA, 18 bp, Homo sapiens
gccaggtgggcgggcagc

SEQ ID NO: 5909360 - DNA, 19 bp, Homo sapiens
gccaggtgggcgggcagca

SEQ ID NO: 5909361 - DNA, 13 bp, Homo sapiens
gccaggtgtcctg

SEQ ID NO: 5909362 - DNA, 18 bp, Homo sapiens
gccaggttaggaaggcag

SEQ ID NO: 5909363 - DNA, 16 bp, Homo sapiens
gccatgctcctcttcc

SEQ ID NO: 5909364 - DNA, 11 bp, Homo sapiens
gccatgctctt

SEQ ID NO: 5909365 - DNA, 15 bp, Homo sapiens
gccatgctgaaggga

SEQ ID NO: 5909366 - DNA, 18 bp, Homo sapiens
gccatgctgaggcctggg

SEQ ID NO: 5909367 - DNA, 12 bp, Homo sapiens
gccatgctgcta

SEQ ID NO: 5909368 - DNA, 14 bp, Homo sapiens
gccatgctgctatg

SEQ ID NO: 5909369 - DNA, 20 bp, Homo sapiens
gccatgctgctatgaagact

SEQ ID NO: 5909370 - DNA, 20 bp, Homo sapiens
gccatgctgctttgcacaca

SEQ ID NO: 5909371 - DNA, 21 bp, Homo sapiens
gccatgctggccaggctggtc

SEQ ID NO: 5909372 - DNA, 15 bp, Homo sapiens
gccatgctgggccac

SEQ ID NO: 5909373 - DNA, 15 bp, Homo sapiens
gccatgctgtccctg

SEQ ID NO: 5909374 - DNA, 20 bp, Homo sapiens
gccatgctgtgtgagaccag

SEQ ID NO: 5909375 - DNA, 14 bp, Homo sapiens
gccatgcttcttgc

SEQ ID NO: 5909376 - DNA, 15 bp, Homo sapiens
gccatgcttcttgcc

SEQ ID NO: 5909377 - DNA, 16 bp, Homo sapiens
gccatgcttcttgccc

SEQ ID NO: 5909378 - DNA, 17 bp, Homo sapiens
gccatgcttcttgcccc

SEQ ID NO: 5909379 - DNA, 20 bp, Homo sapiens
gccatgcttcttgccccttg

SEQ ID NO: 5909380 - DNA, 23 bp, Homo sapiens
gccatgcttcttgccccttgggc

SEQ ID NO: 5909381 - DNA, 15 bp, Homo sapiens
gccatgctttgagtc

SEQ ID NO: 5909382 - DNA, 22 bp, Homo sapiens
gccatgctttgagtccacgccc

SEQ ID NO: 5909383 - DNA, 16 bp, Homo sapiens
gccatggaaggtgcca

SEQ ID NO: 5909384 - DNA, 17 bp, Homo sapiens
gccatggaaggtgccag

SEQ ID NO: 5909385 - DNA, 23 bp, Homo sapiens
gccatggactctacactgtgaac

SEQ ID NO: 5909386 - DNA, 16 bp, Homo sapiens
gccatggactctgtcc

SEQ ID NO: 5909387 - DNA, 17 bp, Homo sapiens
gccatggactctgtcct

SEQ ID NO: 5909388 - DNA, 16 bp, Homo sapiens
gccatggagaaagctg

SEQ ID NO: 5909389 - DNA, 17 bp, Homo sapiens
gccatggagaaagctga

SEQ ID NO: 5909390 - DNA, 18 bp, Homo sapiens
gccatggaggcacacagc

SEQ ID NO: 5909391 - DNA, 21 bp, Homo sapiens
gccatggaggcacacagctgc

SEQ ID NO: 5909392 - DNA, 19 bp, Homo sapiens
gccatggagttgtgatcat

SEQ ID NO: 5909393 - DNA, 23 bp, Homo sapiens
gccatggatctgatctgtaccat

SEQ ID NO: 5909394 - DNA, 12 bp, Homo sapiens
gccatggccccc

SEQ ID NO: 5909395 - DNA, 21 bp, Homo sapiens
gccatggcctgcaaactggga

SEQ ID NO: 5909396 - DNA, 21 bp, Homo sapiens
gccatggcctgtgctgggcca

SEQ ID NO: 5909397 - DNA, 18 bp, Homo sapiens
gccatggcgagatactgc

SEQ ID NO: 5909398 - DNA, 17 bp, Homo sapiens
gccatggcgtgtccctc

SEQ ID NO: 5909399 - DNA, 14 bp, Homo sapiens
gccatggctcaggc

SEQ ID NO: 5909400 - DNA, 15 bp, Homo sapiens
gccatggctcaggca

SEQ ID NO: 5909401 - DNA, 18 bp, Homo sapiens
gccatggctcaggcaagc

SEQ ID NO: 5909402 - DNA, 20 bp, Homo sapiens
gccatggctcaggcaagccc

SEQ ID NO: 5909403 - DNA, 20 bp, Homo sapiens
gccatggctggatgtgcatc

SEQ ID NO: 5909404 - DNA, 14 bp, Homo sapiens
gccatggctggggg

SEQ ID NO: 5909405 - DNA, 22 bp, Homo sapiens
gccatggctggggggtctcagc

SEQ ID NO: 5909406 - DNA, 23 bp, Homo sapiens
gccatggctggggggtctcagca

SEQ ID NO: 5909407 - DNA, 21 bp, Homo sapiens
gccatggctgtgacacagacg

SEQ ID NO: 5909408 - DNA, 19 bp, Homo sapiens
gccatggctttcatcctgt

SEQ ID NO: 5909409 - DNA, 21 bp, Homo sapiens
gccatggctttcatcctgtgt

SEQ ID NO: 5909410 - DNA, 14 bp, Homo sapiens
gccatgggacaggg

SEQ ID NO: 5909411 - DNA, 22 bp, Homo sapiens
gccatgggacagggaggacgct

SEQ ID NO: 5909412 - DNA, 23 bp, Homo sapiens
gccatgggacagggaggacgctc

SEQ ID NO: 5909413 - DNA, 12 bp, Homo sapiens
gccatgggacca

SEQ ID NO: 5909414 - DNA, 21 bp, Homo sapiens
gccatgggaccaaacctagcc

SEQ ID NO: 5909415 - DNA, 15 bp, Homo sapiens
gccatgggacctcct

SEQ ID NO: 5909416 - DNA, 16 bp, Homo sapiens
gccatgggagagtcca

SEQ ID NO: 5909417 - DNA, 17 bp, Homo sapiens
gccatgggagagtccag

SEQ ID NO: 5909418 - DNA, 15 bp, Homo sapiens
gccatgggaggcctt

SEQ ID NO: 5909419 - DNA, 12 bp, Homo sapiens
gccatgggccag

SEQ ID NO: 5909420 - DNA, 17 bp, Homo sapiens
gccatgggccagcctag

SEQ ID NO: 5909421 - DNA, 16 bp, Homo sapiens
gccatgggcctcctgt

SEQ ID NO: 5909422 - DNA, 13 bp, Homo sapiens
gccatgggcctgc

SEQ ID NO: 5909423 - DNA, 16 bp, Homo sapiens
gccatgggcctgctgc

SEQ ID NO: 5909424 - DNA, 18 bp, Homo sapiens
gccatgggcctgggcctg

SEQ ID NO: 5909425 - DNA, 19 bp, Homo sapiens
gccatgggcctgggcctgc

SEQ ID NO: 5909426 - DNA, 15 bp, Homo sapiens
gccatggggcagcct

SEQ ID NO: 5909427 - DNA, 17 bp, Homo sapiens
gccatggggcagcctcc

SEQ ID NO: 5909428 - DNA, 20 bp, Homo sapiens
gccatggggcagcctccagt

SEQ ID NO: 5909429 - DNA, 23 bp, Homo sapiens
gccatggggcagcctccagtctg

SEQ ID NO: 5909430 - DNA, 17 bp, Homo sapiens
gccatgggggcccctcg

SEQ ID NO: 5909431 - DNA, 18 bp, Homo sapiens
gccatgggggcccctcgg

SEQ ID NO: 5909432 - DNA, 18 bp, Homo sapiens
gccatggggtccatcccc

SEQ ID NO: 5909433 - DNA, 14 bp, Homo sapiens
gccatgggtgcttg

SEQ ID NO: 5909434 - DNA, 19 bp, Homo sapiens
gccatggtacccccttctg

SEQ ID NO: 5909435 - DNA, 21 bp, Homo sapiens
gccatggtacccccttctggg

SEQ ID NO: 5909436 - DNA, 17 bp, Homo sapiens
gccatggtcaccctcag

SEQ ID NO: 5909437 - DNA, 18 bp, Homo sapiens
gccatggtcaccctcagg

SEQ ID NO: 5909438 - DNA, 24 bp, Homo sapiens
gccatggtcccgaagtgtagggca

SEQ ID NO: 5909439 - DNA, 16 bp, Homo sapiens
gccatggtggagggca

SEQ ID NO: 5909440 - DNA, 18 bp, Homo sapiens
gccatggtggagggcact

SEQ ID NO: 5909441 - DNA, 22 bp, Homo sapiens
gccatggtgggagagactgtga

SEQ ID NO: 5909442 - DNA, 17 bp, Homo sapiens
gccatggtgttggaggg

SEQ ID NO: 5909443 - DNA, 14 bp, Homo sapiens
gccatgtaaggttg

SEQ ID NO: 5909444 - DNA, 16 bp, Homo sapiens
gccatgtacctcccct

SEQ ID NO: 5909445 - DNA, 21 bp, Homo sapiens
gccatgtacctcccctgcctt

SEQ ID NO: 5909446 - DNA, 16 bp, Homo sapiens
gccatgtagaagctgc

SEQ ID NO: 5909447 - DNA, 16 bp, Homo sapiens
gccatgtataattttt

SEQ ID NO: 5909448 - DNA, 15 bp, Homo sapiens
gccatgtatgaagcc

SEQ ID NO: 5909449 - DNA, 16 bp, Homo sapiens
gccatgtatgttgcat

SEQ ID NO: 5909450 - DNA, 20 bp, Homo sapiens
gccatgtatgttgcatgaat

SEQ ID NO: 5909451 - DNA, 15 bp, Homo sapiens
gccatgtattatgaa

SEQ ID NO: 5909452 - DNA, 18 bp, Homo sapiens
gccatgtatttcagggac

SEQ ID NO: 5909453 - DNA, 17 bp, Homo sapiens
gccatgtcaaacaaata

SEQ ID NO: 5909454 - DNA, 16 bp, Homo sapiens
gccatgtcagacacag

SEQ ID NO: 5909455 - DNA, 22 bp, Homo sapiens
gccatgtccaaacccatcttca

SEQ ID NO: 5909456 - DNA, 22 bp, Homo sapiens
gccatgtccaaagaggctgccc

SEQ ID NO: 5909457 - DNA, 15 bp, Homo sapiens
gccatgtcgcctgcc

SEQ ID NO: 5909458 - DNA, 14 bp, Homo sapiens
gccatgtctcctgc

SEQ ID NO: 5909459 - DNA, 22 bp, Homo sapiens
gccatgtcttctccctggaatg

SEQ ID NO: 5909460 - DNA, 12 bp, Homo sapiens
gccatgtcttta

SEQ ID NO: 5909461 - DNA, 20 bp, Homo sapiens
gccatgtgaaactcatctca

SEQ ID NO: 5909462 - DNA, 17 bp, Homo sapiens
gccatgtgaagagggag

SEQ ID NO: 5909463 - DNA, 14 bp, Homo sapiens
gccatgtgactctg

SEQ ID NO: 5909464 - DNA, 18 bp, Homo sapiens
gccatgtgactctggctt

SEQ ID NO: 5909465 - DNA, 18 bp, Homo sapiens
gccatgtgagccaccgct

SEQ ID NO: 5909466 - DNA, 21 bp, Homo sapiens
gccatgtgcacctatggccca

SEQ ID NO: 5909467 - DNA, 22 bp, Homo sapiens
gccatgtgcacctatggcccag

SEQ ID NO: 5909468 - DNA, 23 bp, Homo sapiens
gccatgtgcaggtggattccatg

SEQ ID NO: 5909469 - DNA, 19 bp, Homo sapiens
gccatgtgcatagtttctt

SEQ ID NO: 5909470 - DNA, 20 bp, Homo sapiens
gccatgtgctgccctgttgc

SEQ ID NO: 5909471 - DNA, 17 bp, Homo sapiens
gccatgtgctgcggtca

SEQ ID NO: 5909472 - DNA, 18 bp, Homo sapiens
gccatgtgcttattatat

SEQ ID NO: 5909473 - DNA, 16 bp, Homo sapiens
gccatgtgcttctgcc

SEQ ID NO: 5909474 - DNA, 23 bp, Homo sapiens
gccatgtggaaggcaagccaggc

SEQ ID NO: 5909475 - DNA, 21 bp, Homo sapiens
gccatgtggaccatattttgt

SEQ ID NO: 5909476 - DNA, 15 bp, Homo sapiens
gccatgtggagtgga

SEQ ID NO: 5909477 - DNA, 16 bp, Homo sapiens
gccatgtggcctgccc

SEQ ID NO: 5909478 - DNA, 22 bp, Homo sapiens
gccatgtggcctgcccagcctc

SEQ ID NO: 5909479 - DNA, 18 bp, Homo sapiens
gccatgtggggttgctga

SEQ ID NO: 5909480 - DNA, 15 bp, Homo sapiens
gccatgtgttccaag

SEQ ID NO: 5909481 - DNA, 17 bp, Homo sapiens
gccatgttaacatgaca

SEQ ID NO: 5909482 - DNA, 19 bp, Homo sapiens
gccatgttaatatttgaat

SEQ ID NO: 5909483 - DNA, 22 bp, Homo sapiens
gccatgttcccagaaccttgat

SEQ ID NO: 5909484 - DNA, 16 bp, Homo sapiens
gccatgttggccaggc

SEQ ID NO: 5909485 - DNA, 19 bp, Homo sapiens
gccatgttggccaggctgg

SEQ ID NO: 5909486 - DNA, 15 bp, Homo sapiens
gccatgtttaagatt

SEQ ID NO: 5909487 - DNA, 21 bp, Homo sapiens
gccatgtttaagatttaattt

SEQ ID NO: 5909488 - DNA, 21 bp, Homo sapiens
gccatgtttagattccaggat

SEQ ID NO: 5909489 - DNA, 14 bp, Homo sapiens
gccatgtttattac

SEQ ID NO: 5909490 - DNA, 18 bp, Homo sapiens
gccatgtttattacagta

SEQ ID NO: 5909491 - DNA, 20 bp, Homo sapiens
gccatgtttggttgtaaatg

SEQ ID NO: 5909492 - DNA, 18 bp, Homo sapiens
gccatgtttttcccctgc

SEQ ID NO: 5909493 - DNA, 23 bp, Homo sapiens
gccattaaaaaacagcttgttct

SEQ ID NO: 5909494 - DNA, 12 bp, Homo sapiens
gccattaaaata

SEQ ID NO: 5909495 - DNA, 13 bp, Homo sapiens
gccattaaaataa

SEQ ID NO: 5909496 - DNA, 15 bp, Homo sapiens
gccattaaaataaaa

SEQ ID NO: 5909497 - DNA, 20 bp, Homo sapiens
gccattaaaataaaacaagc

SEQ ID NO: 5909498 - DNA, 21 bp, Homo sapiens
gccattaaaataaaacaagcc

SEQ ID NO: 5909499 - DNA, 22 bp, Homo sapiens
gccattaaaataaaacaagcct

SEQ ID NO: 5909500 - DNA, 23 bp, Homo sapiens
gccattaaaataaaacaagcctt

SEQ ID NO: 5909501 - DNA, 21 bp, Homo sapiens
gccattaaatgaatattttga

SEQ ID NO: 5909502 - DNA, 16 bp, Homo sapiens
gccattacactccagc

SEQ ID NO: 5909503 - DNA, 19 bp, Homo sapiens
gccattacactccagcctg

SEQ ID NO: 5909504 - DNA, 19 bp, Homo sapiens
gccattacccagctaaata

SEQ ID NO: 5909505 - DNA, 14 bp, Homo sapiens
gccattactactgt

SEQ ID NO: 5909506 - DNA, 17 bp, Homo sapiens
gccattactactgtaca

SEQ ID NO: 5909507 - DNA, 17 bp, Homo sapiens
gccattagagcacagct

SEQ ID NO: 5909508 - DNA, 16 bp, Homo sapiens
gccattataattttga

SEQ ID NO: 5909509 - DNA, 16 bp, Homo sapiens
gccattatagcgcctg

SEQ ID NO: 5909510 - DNA, 17 bp, Homo sapiens
gccattatatttgcatt

SEQ ID NO: 5909511 - DNA, 18 bp, Homo sapiens
gccattatgcaaatggag

SEQ ID NO: 5909512 - DNA, 14 bp, Homo sapiens
gccattattatgat

SEQ ID NO: 5909513 - DNA, 16 bp, Homo sapiens
gccattattctatgta

SEQ ID NO: 5909514 - DNA, 22 bp, Homo sapiens
gccattattttctgtcagatga

SEQ ID NO: 5909515 - DNA, 22 bp, Homo sapiens
gccattcacttcataatccagt

SEQ ID NO: 5909516 - DNA, 21 bp, Homo sapiens
gccattcatctgggctggcag

SEQ ID NO: 5909517 - DNA, 14 bp, Homo sapiens
gccattccaacagc

SEQ ID NO: 5909518 - DNA, 13 bp, Homo sapiens
gccattcccagcg

SEQ ID NO: 5909519 - DNA, 22 bp, Homo sapiens
gccattccccaacggggtgggg

SEQ ID NO: 5909520 - DNA, 17 bp, Homo sapiens
gccattccccgtctctg

SEQ ID NO: 5909521 - DNA, 15 bp, Homo sapiens
gccattcccttggaa

SEQ ID NO: 5909522 - DNA, 22 bp, Homo sapiens
gccattcctggtacccagccat

SEQ ID NO: 5909523 - DNA, 21 bp, Homo sapiens
gccattcctgttctctttgcc

SEQ ID NO: 5909524 - DNA, 16 bp, Homo sapiens
gccattctcaagccct

SEQ ID NO: 5909525 - DNA, 18 bp, Homo sapiens
gccattctcctgcctcag

SEQ ID NO: 5909526 - DNA, 22 bp, Homo sapiens
gccattctcctgcctcagcctc

SEQ ID NO: 5909527 - DNA, 16 bp, Homo sapiens
gccattctcttgcatt

SEQ ID NO: 5909528 - DNA, 19 bp, Homo sapiens
gccattctgcatgagctga

SEQ ID NO: 5909529 - DNA, 23 bp, Homo sapiens
gccattctgcctcagcctcctga

SEQ ID NO: 5909530 - DNA, 19 bp, Homo sapiens
gccattctggcactttaat

SEQ ID NO: 5909531 - DNA, 13 bp, Homo sapiens
gccattctgtgca

SEQ ID NO: 5909532 - DNA, 14 bp, Homo sapiens
gccattctgtgcag

SEQ ID NO: 5909533 - DNA, 18 bp, Homo sapiens
gccattctgtgcaggctg

SEQ ID NO: 5909534 - DNA, 19 bp, Homo sapiens
gccattctttcccaacacc

SEQ ID NO: 5909535 - DNA, 20 bp, Homo sapiens
gccattgaacactgcaccct

SEQ ID NO: 5909536 - DNA, 16 bp, Homo sapiens
gccattgaacagctgt

SEQ ID NO: 5909537 - DNA, 14 bp, Homo sapiens
gccattgaccaccc

SEQ ID NO: 5909538 - DNA, 14 bp, Homo sapiens
gccattgcactcca

SEQ ID NO: 5909539 - DNA, 21 bp, Homo sapiens
gcccacggccacccacccttc

SEQ ID NO: 5909540 - DNA, 18 bp, Homo sapiens
gcccacggggatcacagc

SEQ ID NO: 5909541 - DNA, 18 bp, Homo sapiens
gcccacggggcaaagctg

SEQ ID NO: 5909542 - DNA, 22 bp, Homo sapiens
gcccacggggcaaagctgctgg

SEQ ID NO: 5909543 - DNA, 17 bp, Homo sapiens
gcccacgtagggcggca

SEQ ID NO: 5909544 - DNA, 15 bp, Homo sapiens
gcccacgtcacgtgt

SEQ ID NO: 5909545 - DNA, 22 bp, Homo sapiens
gcccacgtcaggcctggcctca

SEQ ID NO: 5909546 - DNA, 15 bp, Homo sapiens
gcccacgtcctgggt

SEQ ID NO: 5909547 - DNA, 23 bp, Homo sapiens
gcccacgtcctgggtgctgtcat

SEQ ID NO: 5909548 - DNA, 13 bp, Homo sapiens
gcccacgtcctgt

SEQ ID NO: 5909549 - DNA, 14 bp, Homo sapiens
gcccacgtcctgtc

SEQ ID NO: 5909550 - DNA, 16 bp, Homo sapiens
gcccacgtcctgtcag

SEQ ID NO: 5909551 - DNA, 18 bp, Homo sapiens
gcccacgtgtgcagactg

SEQ ID NO: 5909552 - DNA, 17 bp, Homo sapiens
gcccactagacccactg

SEQ ID NO: 5909553 - DNA, 23 bp, Homo sapiens
gcccactagacccactggactca

SEQ ID NO: 5909554 - DNA, 15 bp, Homo sapiens
gcccactagagggcc

SEQ ID NO: 5909555 - DNA, 23 bp, Homo sapiens
gcccactagagggcccatcaggc

SEQ ID NO: 5909556 - DNA, 18 bp, Homo sapiens
gcccactatggtcatctt

SEQ ID NO: 5909557 - DNA, 12 bp, Homo sapiens
gcccactcagcc

SEQ ID NO: 5909558 - DNA, 18 bp, Homo sapiens
gcccactccatctggtag

SEQ ID NO: 5909559 - DNA, 20 bp, Homo sapiens
gcccactccccagccccagc

SEQ ID NO: 5909560 - DNA, 15 bp, Homo sapiens
gcccactcccccagg

SEQ ID NO: 5909561 - DNA, 17 bp, Homo sapiens
gcccactcccccaggag

SEQ ID NO: 5909562 - DNA, 19 bp, Homo sapiens
gcccactcccccaggagca

SEQ ID NO: 5909563 - DNA, 20 bp, Homo sapiens
gcccactcccccaggagcag

SEQ ID NO: 5909564 - DNA, 21 bp, Homo sapiens
gcccactcccccaggagcagc

SEQ ID NO: 5909565 - DNA, 19 bp, Homo sapiens
gcccactccctgcaacctg

SEQ ID NO: 5909566 - DNA, 16 bp, Homo sapiens
gcccactccgccagcc

SEQ ID NO: 5909567 - DNA, 13 bp, Homo sapiens
gcccactcctgct

SEQ ID NO: 5909568 - DNA, 18 bp, Homo sapiens
gcccactcctgctctgct

SEQ ID NO: 5909569 - DNA, 17 bp, Homo sapiens
gcccactctccacctca

SEQ ID NO: 5909570 - DNA, 14 bp, Homo sapiens
gcccactctgaccg

SEQ ID NO: 5909571 - DNA, 22 bp, Homo sapiens
gcccactctgtaatagttcagt

SEQ ID NO: 5909572 - DNA, 18 bp, Homo sapiens
gcccactgaggggccagg

SEQ ID NO: 5909573 - DNA, 18 bp, Homo sapiens
gcccactgcccaccccct

SEQ ID NO: 5909574 - DNA, 20 bp, Homo sapiens
gcccactgcctcctgcctgg

SEQ ID NO: 5909575 - DNA, 16 bp, Homo sapiens
gcccactgcctgcctc

SEQ ID NO: 5909576 - DNA, 18 bp, Homo sapiens
gcccactgcctgcctccc

SEQ ID NO: 5909577 - DNA, 21 bp, Homo sapiens
gcccactgcctgcctcccctc

SEQ ID NO: 5909578 - DNA, 13 bp, Homo sapiens
gcccactgctggc

SEQ ID NO: 5909579 - DNA, 14 bp, Homo sapiens
gcccactgctggct

SEQ ID NO: 5909580 - DNA, 23 bp, Homo sapiens
gcccactgctggctgcagcggca

SEQ ID NO: 5909581 - DNA, 18 bp, Homo sapiens
gcccactgctggtgccag

SEQ ID NO: 5909582 - DNA, 22 bp, Homo sapiens
gcccactgctggtgccagggtg

SEQ ID NO: 5909583 - DNA, 15 bp, Homo sapiens
gcccactgggccctg

SEQ ID NO: 5909584 - DNA, 18 bp, Homo sapiens
gcccactgggccctgggg

SEQ ID NO: 5909585 - DNA, 20 bp, Homo sapiens
gcccactgggccctggggct

SEQ ID NO: 5909586 - DNA, 22 bp, Homo sapiens
gcccactgtacttgctcttgat

SEQ ID NO: 5909587 - DNA, 23 bp, Homo sapiens
gcccactgtcctgggcctgcaga

SEQ ID NO: 5909588 - DNA, 23 bp, Homo sapiens
gcccactgtgcgtggggctcccg

SEQ ID NO: 5909589 - DNA, 17 bp, Homo sapiens
gcccacttaccctgggc

SEQ ID NO: 5909590 - DNA, 23 bp, Homo sapiens
gcccacttagccgtccatggcac

SEQ ID NO: 5909591 - DNA, 14 bp, Homo sapiens
gcccacttcacaca

SEQ ID NO: 5909592 - DNA, 19 bp, Homo sapiens
gcccacttcacacatttat

SEQ ID NO: 5909593 - DNA, 11 bp, Homo sapiens
gcccacttccc

SEQ ID NO: 5909594 - DNA, 18 bp, Homo sapiens
gcccacttctccttcgct

SEQ ID NO: 5909595 - DNA, 14 bp, Homo sapiens
gcccacttctgcca

SEQ ID NO: 5909596 - DNA, 19 bp, Homo sapiens
gcccacttctgtgtagaca

SEQ ID NO: 5909597 - DNA, 17 bp, Homo sapiens
gcccacttgattgagaa

SEQ ID NO: 5909598 - DNA, 14 bp, Homo sapiens
gcccacttggggcc

SEQ ID NO: 5909599 - DNA, 23 bp, Homo sapiens
gcccacttgtatcctctggttct

SEQ ID NO: 5909600 - DNA, 15 bp, Homo sapiens
gcccactttcctgag

SEQ ID NO: 5909601 - DNA, 18 bp, Homo sapiens
gcccactttcctgagctg

SEQ ID NO: 5909602 - DNA, 18 bp, Homo sapiens
gcccagaaaacctccagt

SEQ ID NO: 5909603 - DNA, 16 bp, Homo sapiens
gcccagaaagctgcgg

SEQ ID NO: 5909604 - DNA, 14 bp, Homo sapiens
gcccagaaccacag

SEQ ID NO: 5909605 - DNA, 19 bp, Homo sapiens
gcccagaaccacagatgtg

SEQ ID NO: 5909606 - DNA, 15 bp, Homo sapiens
gcccagaactgcccc

SEQ ID NO: 5909607 - DNA, 21 bp, Homo sapiens
gcccagaagaaaattctcctg

SEQ ID NO: 5909608 - DNA, 17 bp, Homo sapiens
gcccagaagaactttgc

SEQ ID NO: 5909609 - DNA, 11 bp, Homo sapiens
gcccagaagag

SEQ ID NO: 5909610 - DNA, 20 bp, Homo sapiens
gcccagaataagttattgca

SEQ ID NO: 5909611 - DNA, 13 bp, Homo sapiens
gcccagaatactg

SEQ ID NO: 5909612 - DNA, 16 bp, Homo sapiens
gcccagaatgaggctg

SEQ ID NO: 5909613 - DNA, 17 bp, Homo sapiens
gcccagaatgaggctgc

SEQ ID NO: 5909614 - DNA, 21 bp, Homo sapiens
gcccagaattcccagctgtct

SEQ ID NO: 5909615 - DNA, 23 bp, Homo sapiens
gcccagaattcccagctgtctgt

SEQ ID NO: 5909616 - DNA, 19 bp, Homo sapiens
gcccagacacagactggca

SEQ ID NO: 5909617 - DNA, 15 bp, Homo sapiens
gcccagacacatggg

SEQ ID NO: 5909618 - DNA, 16 bp, Homo sapiens
gcccagacaccacaga

SEQ ID NO: 5909619 - DNA, 20 bp, Homo sapiens
gcccagacaccacagacgcc

SEQ ID NO: 5909620 - DNA, 15 bp, Homo sapiens
gcccagacagcaagg

SEQ ID NO: 5909621 - DNA, 19 bp, Homo sapiens
gcccagacccctctggcca

SEQ ID NO: 5909622 - DNA, 20 bp, Homo sapiens
gcccagacccctctggccag

SEQ ID NO: 5909623 - DNA, 14 bp, Homo sapiens
gcccagaccctgga

SEQ ID NO: 5909624 - DNA, 15 bp, Homo sapiens
gcccagaccctgggc

SEQ ID NO: 5909625 - DNA, 16 bp, Homo sapiens
gcccagaccctgggca

SEQ ID NO: 5909626 - DNA, 17 bp, Homo sapiens
gcccagaccggcttctc

SEQ ID NO: 5909627 - DNA, 18 bp, Homo sapiens
gcccagacctggcctctg

SEQ ID NO: 5909628 - DNA, 21 bp, Homo sapiens
gcccagactttagtgccctgc

SEQ ID NO: 5909629 - DNA, 22 bp, Homo sapiens
gcccagagaagctggaagcctg

SEQ ID NO: 5909630 - DNA, 20 bp, Homo sapiens
gcccagagacatacttgaag

SEQ ID NO: 5909631 - DNA, 17 bp, Homo sapiens
gcccagagaccccttcc

SEQ ID NO: 5909632 - DNA, 18 bp, Homo sapiens
gcccagagaccccttcct

SEQ ID NO: 5909633 - DNA, 23 bp, Homo sapiens
gcccagagaccccttcctttcct

SEQ ID NO: 5909634 - DNA, 19 bp, Homo sapiens
gcccagagagaagagcccc

SEQ ID NO: 5909635 - DNA, 21 bp, Homo sapiens
gcccagagagaagagccccac

SEQ ID NO: 5909636 - DNA, 19 bp, Homo sapiens
gcccagagagaccctgcca

SEQ ID NO: 5909637 - DNA, 20 bp, Homo sapiens
gcccagagatgcctccaccg

SEQ ID NO: 5909638 - DNA, 22 bp, Homo sapiens
gcccagagatgcctccaccgct

SEQ ID NO: 5909639 - DNA, 14 bp, Homo sapiens
gcccagagcaggaa

SEQ ID NO: 5909640 - DNA, 16 bp, Homo sapiens
gcccagagcaggaagc

SEQ ID NO: 5909641 - DNA, 15 bp, Homo sapiens
gcccagagccacctg

SEQ ID NO: 5909642 - DNA, 11 bp, Homo sapiens
gcccagagccc

SEQ ID NO: 5909643 - DNA, 15 bp, Homo sapiens
gcccagagcccttga

SEQ ID NO: 5909644 - DNA, 13 bp, Homo sapiens
gcccagagctgag

SEQ ID NO: 5909645 - DNA, 13 bp, Homo sapiens
gcccagagctgct

SEQ ID NO: 5909646 - DNA, 15 bp, Homo sapiens
gcccagagctgctgg

SEQ ID NO: 5909647 - DNA, 16 bp, Homo sapiens
gcccagagctggaaca

SEQ ID NO: 5909648 - DNA, 17 bp, Homo sapiens
gcccagagctggcctcc

SEQ ID NO: 5909649 - DNA, 13 bp, Homo sapiens
gcccagagctggg

SEQ ID NO: 5909650 - DNA, 16 bp, Homo sapiens
gcccagagctgggtga

SEQ ID NO: 5909651 - DNA, 20 bp, Homo sapiens
gcccagaggagaggagacag

SEQ ID NO: 5909652 - DNA, 21 bp, Homo sapiens
gcccagaggagaggagacaga

SEQ ID NO: 5909653 - DNA, 23 bp, Homo sapiens
gcccagaggagaggagacagaca

SEQ ID NO: 5909654 - DNA, 17 bp, Homo sapiens
gcccagaggagccaagt

SEQ ID NO: 5909655 - DNA, 22 bp, Homo sapiens
gcccagaggagctgggagccgg

SEQ ID NO: 5909656 - DNA, 16 bp, Homo sapiens
gcccagaggagggcag

SEQ ID NO: 5909657 - DNA, 23 bp, Homo sapiens
gcccagaggccaacactgtgggt

SEQ ID NO: 5909658 - DNA, 13 bp, Homo sapiens
gcccagaggctga

SEQ ID NO: 5909659 - DNA, 15 bp, Homo sapiens
gcccagagggcctgc

SEQ ID NO: 5909660 - DNA, 19 bp, Homo sapiens
gcccagaggggcggggcca

SEQ ID NO: 5909661 - DNA, 12 bp, Homo sapiens
gcccagaggtaa

SEQ ID NO: 5909662 - DNA, 22 bp, Homo sapiens
gcccagaggtaacagaacagct

SEQ ID NO: 5909663 - DNA, 13 bp, Homo sapiens
gcccagagtagcc

SEQ ID NO: 5909664 - DNA, 15 bp, Homo sapiens
gcccagagtagccca

SEQ ID NO: 5909665 - DNA, 21 bp, Homo sapiens
gcccagagtatgggcactcag

SEQ ID NO: 5909666 - DNA, 16 bp, Homo sapiens
gcccagagtcccccca

SEQ ID NO: 5909667 - DNA, 14 bp, Homo sapiens
gcccagagttgctg

SEQ ID NO: 5909668 - DNA, 21 bp, Homo sapiens
gcccagatacgggggctgtga

SEQ ID NO: 5909669 - DNA, 15 bp, Homo sapiens
gcccagatccaaggc

SEQ ID NO: 5909670 - DNA, 16 bp, Homo sapiens
gcccagatccaaggcc

SEQ ID NO: 5909671 - DNA, 17 bp, Homo sapiens
gcccagatgaactgact

SEQ ID NO: 5909672 - DNA, 20 bp, Homo sapiens
gcccagatggctccctgggc

SEQ ID NO: 5909673 - DNA, 21 bp, Homo sapiens
gcccagatggctccctgggct

SEQ ID NO: 5909674 - DNA, 21 bp, Homo sapiens
gcccagatgtgtcccccccag

SEQ ID NO: 5909675 - DNA, 22 bp, Homo sapiens
gcccagattaaagtctttatcc

SEQ ID NO: 5909676 - DNA, 15 bp, Homo sapiens
gcccagattcccaga

SEQ ID NO: 5909677 - DNA, 21 bp, Homo sapiens
gcccagattcccctgtgtcat

SEQ ID NO: 5909678 - DNA, 22 bp, Homo sapiens
gcccagcaccccctctcctgga

SEQ ID NO: 5909679 - DNA, 15 bp, Homo sapiens
gcccagcacctcctc

SEQ ID NO: 5909680 - DNA, 13 bp, Homo sapiens
gcccagcacctgc

SEQ ID NO: 5909681 - DNA, 16 bp, Homo sapiens
gcccagcacctgctcc

SEQ ID NO: 5909682 - DNA, 16 bp, Homo sapiens
gcccagcacctggagg

SEQ ID NO: 5909683 - DNA, 16 bp, Homo sapiens
gcccagcactgcccat

SEQ ID NO: 5909684 - DNA, 20 bp, Homo sapiens
gcccagcactgcttgaggaa

SEQ ID NO: 5909685 - DNA, 23 bp, Homo sapiens
gcccagcagacatcaagctcaag

SEQ ID NO: 5909686 - DNA, 13 bp, Homo sapiens
gcccagcagagcc

SEQ ID NO: 5909687 - DNA, 22 bp, Homo sapiens
gcccagcagagccgttcctggg

SEQ ID NO: 5909688 - DNA, 18 bp, Homo sapiens
gcccagcagcccctgaga

SEQ ID NO: 5909689 - DNA, 14 bp, Homo sapiens
gcccagcagcctgc

SEQ ID NO: 5909690 - DNA, 16 bp, Homo sapiens
gcccagcagcctgcca

SEQ ID NO: 5909691 - DNA, 18 bp, Homo sapiens
gcccagcagcctgccagc

SEQ ID NO: 5909692 - DNA, 20 bp, Homo sapiens
gcccagcagcggcccagatt

SEQ ID NO: 5909693 - DNA, 14 bp, Homo sapiens
gcccagcagcttgg

SEQ ID NO: 5909694 - DNA, 23 bp, Homo sapiens
gcccagcaggagagactgagcag

SEQ ID NO: 5909695 - DNA, 16 bp, Homo sapiens
gcccagcaggcccagc

SEQ ID NO: 5909696 - DNA, 14 bp, Homo sapiens
gcccagcaggggcc

SEQ ID NO: 5909697 - DNA, 21 bp, Homo sapiens
gcccagcaggggccctcactc

SEQ ID NO: 5909698 - DNA, 19 bp, Homo sapiens
gcccagcattgctggttct

SEQ ID NO: 5909699 - DNA, 21 bp, Homo sapiens
gcccagcatttggttttacac

SEQ ID NO: 5909700 - DNA, 17 bp, Homo sapiens
gcccagccaaaccctgt

SEQ ID NO: 5909701 - DNA, 20 bp, Homo sapiens
gcccagccaaaccctgtctg

SEQ ID NO: 5909702 - DNA, 20 bp, Homo sapiens
gcccagccacctcccaagga

SEQ ID NO: 5909703 - DNA, 14 bp, Homo sapiens
gcccagccactcca

SEQ ID NO: 5909704 - DNA, 23 bp, Homo sapiens
gcccagccactccaagccccctg

SEQ ID NO: 5909705 - DNA, 19 bp, Homo sapiens
gcccagccactccaggagg

SEQ ID NO: 5909706 - DNA, 12 bp, Homo sapiens
gcccagccagca

SEQ ID NO: 5909707 - DNA, 13 bp, Homo sapiens
gcccagccagcag

SEQ ID NO: 5909708 - DNA, 15 bp, Homo sapiens
gcccagccagcaggt

SEQ ID NO: 5909709 - DNA, 14 bp, Homo sapiens
gcccagccagccac

SEQ ID NO: 5909710 - DNA, 15 bp, Homo sapiens
gcccagccagccagg

SEQ ID NO: 5909711 - DNA, 13 bp, Homo sapiens
gcccagccaggcc

SEQ ID NO: 5909712 - DNA, 17 bp, Homo sapiens
gcccagccaggccaaca

SEQ ID NO: 5909713 - DNA, 14 bp, Homo sapiens
gcccagccagggaa

SEQ ID NO: 5909714 - DNA, 17 bp, Homo sapiens
gcccagccagggaaggc

SEQ ID NO: 5909715 - DNA, 20 bp, Homo sapiens
gcccagccattaccatggag

SEQ ID NO: 5909716 - DNA, 14 bp, Homo sapiens
gcccaggccacaga

SEQ ID NO: 5909717 - DNA, 11 bp, Homo sapiens
gcccaggccag

SEQ ID NO: 5909718 - DNA, 20 bp, Homo sapiens
gcccaggccagagtgcagtg

SEQ ID NO: 5909719 - DNA, 12 bp, Homo sapiens
gcccaggccagc

SEQ ID NO: 5909720 - DNA, 13 bp, Homo sapiens
gcccaggccagcc

SEQ ID NO: 5909721 - DNA, 15 bp, Homo sapiens
gcccaggccagcccc

SEQ ID NO: 5909722 - DNA, 22 bp, Homo sapiens
gcccaggccagcccccccaccc

SEQ ID NO: 5909723 - DNA, 21 bp, Homo sapiens
gcccaggccaggactctgcag

SEQ ID NO: 5909724 - DNA, 15 bp, Homo sapiens
gcccaggccaggtgc

SEQ ID NO: 5909725 - DNA, 20 bp, Homo sapiens
gcccaggccaggtgcccagg

SEQ ID NO: 5909726 - DNA, 18 bp, Homo sapiens
gcccaggccagtgctgtg

SEQ ID NO: 5909727 - DNA, 19 bp, Homo sapiens
gcccaggccatcttccagg

SEQ ID NO: 5909728 - DNA, 23 bp, Homo sapiens
gcccaggccatcttccaggtggg

SEQ ID NO: 5909729 - DNA, 13 bp, Homo sapiens
gcccaggccatgt

SEQ ID NO: 5909730 - DNA, 16 bp, Homo sapiens
gcccaggccatgtggc

SEQ ID NO: 5909731 - DNA, 23 bp, Homo sapiens
gcccaggccatgtggcctgccca

SEQ ID NO: 5909732 - DNA, 11 bp, Homo sapiens
gcccaggcccc

SEQ ID NO: 5909733 - DNA, 15 bp, Homo sapiens
gcccaggcccccggc

SEQ ID NO: 5909734 - DNA, 17 bp, Homo sapiens
gcccaggcccccggctt

SEQ ID NO: 5909735 - DNA, 21 bp, Homo sapiens
gcccaggcccccggctttcct

SEQ ID NO: 5909736 - DNA, 12 bp, Homo sapiens
gcccaggcccct

SEQ ID NO: 5909737 - DNA, 15 bp, Homo sapiens
gcccaggcccctgcc

SEQ ID NO: 5909738 - DNA, 17 bp, Homo sapiens
gcccaggcccctgccac

SEQ ID NO: 5909739 - DNA, 20 bp, Homo sapiens
gcccaggcccctgccaccct

SEQ ID NO: 5909740 - DNA, 16 bp, Homo sapiens
gcccaggcccttggct

SEQ ID NO: 5909741 - DNA, 18 bp, Homo sapiens
gcccaggccggccagcct

SEQ ID NO: 5909742 - DNA, 19 bp, Homo sapiens
gcccaggccggccagcctc

SEQ ID NO: 5909743 - DNA, 18 bp, Homo sapiens
gcccaggccgggaagagc

SEQ ID NO: 5909744 - DNA, 23 bp, Homo sapiens
gcccaggccgggaagagccacct

SEQ ID NO: 5909745 - DNA, 23 bp, Homo sapiens
gcccaggccggggtggagcatgg

SEQ ID NO: 5909746 - DNA, 12 bp, Homo sapiens
gcccaggcctca

SEQ ID NO: 5909747 - DNA, 20 bp, Homo sapiens
gcccaggcctcaccacctga

SEQ ID NO: 5909748 - DNA, 15 bp, Homo sapiens
gcccaggcctccagc

SEQ ID NO: 5909749 - DNA, 17 bp, Homo sapiens
gcccaggcctccagctc

SEQ ID NO: 5909750 - DNA, 14 bp, Homo sapiens
gcccaggcctcccc

SEQ ID NO: 5909751 - DNA, 16 bp, Homo sapiens
gcccaggcctgctggc

SEQ ID NO: 5909752 - DNA, 17 bp, Homo sapiens
gcccaggcctgctggca

SEQ ID NO: 5909753 - DNA, 17 bp, Homo sapiens
gcccaggcctggcctcg

SEQ ID NO: 5909754 - DNA, 19 bp, Homo sapiens
gcccaggcctggcctcggg

SEQ ID NO: 5909755 - DNA, 21 bp, Homo sapiens
gcccaggcctggcctcggggc

SEQ ID NO: 5909756 - DNA, 15 bp, Homo sapiens
gcccaggcctgggtt

SEQ ID NO: 5909757 - DNA, 22 bp, Homo sapiens
gcccaggcgggagcggtggccc

SEQ ID NO: 5909758 - DNA, 19 bp, Homo sapiens
gcccaggctagagtgcagt

SEQ ID NO: 5909759 - DNA, 20 bp, Homo sapiens
gcccaggctcccctgcccgc

SEQ ID NO: 5909760 - DNA, 23 bp, Homo sapiens
gcccaggctcggaggaccctgga

SEQ ID NO: 5909761 - DNA, 13 bp, Homo sapiens
gcccaggctctgg

SEQ ID NO: 5909762 - DNA, 22 bp, Homo sapiens
gcccaggctctgggaaggggtg

SEQ ID NO: 5909763 - DNA, 12 bp, Homo sapiens
gcccaggctgcc

SEQ ID NO: 5909764 - DNA, 13 bp, Homo sapiens
gcccaggctgccg

SEQ ID NO: 5909765 - DNA, 18 bp, Homo sapiens
gcccaggctggactgcag

SEQ ID NO: 5909766 - DNA, 19 bp, Homo sapiens
gcccaggctggagtgcaat

SEQ ID NO: 5909767 - DNA, 12 bp, Homo sapiens
gcccaggctggc

SEQ ID NO: 5909768 - DNA, 17 bp, Homo sapiens
gcccaggctggccagcc

SEQ ID NO: 5909769 - DNA, 22 bp, Homo sapiens
gcccaggctggccagccccaca

SEQ ID NO: 5909770 - DNA, 21 bp, Homo sapiens
gcccaggctggcccccaccca

SEQ ID NO: 5909771 - DNA, 14 bp, Homo sapiens
gcccaggctggcgt

SEQ ID NO: 5909772 - DNA, 20 bp, Homo sapiens
gcccaggctggcgtgcagtg

SEQ ID NO: 5909773 - DNA, 15 bp, Homo sapiens
gcccaggctgggaac

SEQ ID NO: 5909774 - DNA, 16 bp, Homo sapiens
gcccaggctggtttcg

SEQ ID NO: 5909775 - DNA, 19 bp, Homo sapiens
gcccaggcttagtcactga

SEQ ID NO: 5909776 - DNA, 21 bp, Homo sapiens
gcccaggcttagtcactgaga

SEQ ID NO: 5909777 - DNA, 23 bp, Homo sapiens
gcccaggcttagtcactgagaca

SEQ ID NO: 5909778 - DNA, 14 bp, Homo sapiens
gcccaggcttcctg

SEQ ID NO: 5909779 - DNA, 17 bp, Homo sapiens
gcccaggcttctcacca

SEQ ID NO: 5909780 - DNA, 22 bp, Homo sapiens
gcccagggaatcagggagcact

SEQ ID NO: 5909781 - DNA, 18 bp, Homo sapiens
gcccagggacaccagcca

SEQ ID NO: 5909782 - DNA, 19 bp, Homo sapiens
gcccagggacaccagccag

SEQ ID NO: 5909783 - DNA, 23 bp, Homo sapiens
gcccagggacaccagccaggctc

SEQ ID NO: 5909784 - DNA, 19 bp, Homo sapiens
gcccagggacattgcagag

SEQ ID NO: 5909785 - DNA, 20 bp, Homo sapiens
gcccagggagcaatgggagg

SEQ ID NO: 5909786 - DNA, 12 bp, Homo sapiens
gcccagggaggc

SEQ ID NO: 5909787 - DNA, 19 bp, Homo sapiens
gcccagggaggcagcgtgg

SEQ ID NO: 5909788 - DNA, 20 bp, Homo sapiens
gcccagggaggcagcgtggg

SEQ ID NO: 5909789 - DNA, 21 bp, Homo sapiens
gcccagggaggcagcgtgggc

SEQ ID NO: 5909790 - DNA, 21 bp, Homo sapiens
gcccagggagggaagtgtgag

SEQ ID NO: 5909791 - DNA, 13 bp, Homo sapiens
gcccagggagggt

SEQ ID NO: 5909792 - DNA, 21 bp, Homo sapiens
gcccagggaggtggcagggaa

SEQ ID NO: 5909793 - DNA, 22 bp, Homo sapiens
gcccagggaggtggcagggaag

SEQ ID NO: 5909794 - DNA, 19 bp, Homo sapiens
gcccagggcaagctccgca

SEQ ID NO: 5909795 - DNA, 17 bp, Homo sapiens
gcccagggcatcccatg

SEQ ID NO: 5909796 - DNA, 21 bp, Homo sapiens
gcccagggcatcttgctggct

SEQ ID NO: 5909797 - DNA, 20 bp, Homo sapiens
gcccagggccactctgcctc

SEQ ID NO: 5909798 - DNA, 21 bp, Homo sapiens
gcccagggcccagagcccagc

SEQ ID NO: 5909799 - DNA, 20 bp, Homo sapiens
gcccagggcccgggcaccca

SEQ ID NO: 5909800 - DNA, 12 bp, Homo sapiens
gcccagggcctc

SEQ ID NO: 5909801 - DNA, 16 bp, Homo sapiens
gcccagggcctctggc

SEQ ID NO: 5909802 - DNA, 23 bp, Homo sapiens
gcccagggcctctggcttccctg

SEQ ID NO: 5909803 - DNA, 14 bp, Homo sapiens
gcccagggctcagc

SEQ ID NO: 5909804 - DNA, 15 bp, Homo sapiens
gcccagggctcctgc

SEQ ID NO: 5909805 - DNA, 18 bp, Homo sapiens
gcccagggctcctgcact

SEQ ID NO: 5909806 - DNA, 15 bp, Homo sapiens
gcccagggctgggag

SEQ ID NO: 5909807 - DNA, 17 bp, Homo sapiens
gcccagggctgggagga

SEQ ID NO: 5909808 - DNA, 19 bp, Homo sapiens
gcccaggggacgtggcgct

SEQ ID NO: 5909809 - DNA, 22 bp, Homo sapiens
gcccaggggagaatgcagccca

SEQ ID NO: 5909810 - DNA, 12 bp, Homo sapiens
gcccaggggctg

SEQ ID NO: 5909811 - DNA, 15 bp, Homo sapiens
gcccagggggcctgg

SEQ ID NO: 5909812 - DNA, 17 bp, Homo sapiens
gcccagggggcctggag

SEQ ID NO: 5909813 - DNA, 20 bp, Homo sapiens
gcccagggggcctggagcat

SEQ ID NO: 5909814 - DNA, 14 bp, Homo sapiens
gcccaggggtgccc

SEQ ID NO: 5909815 - DNA, 17 bp, Homo sapiens
gcccaggggtgccccct

SEQ ID NO: 5909816 - DNA, 19 bp, Homo sapiens
gcccaggggtgccccctcc

SEQ ID NO: 5909817 - DNA, 22 bp, Homo sapiens
gcccaggggtgccccctcctct

SEQ ID NO: 5909818 - DNA, 16 bp, Homo sapiens
gcccagggtcctgtgc

SEQ ID NO: 5909819 - DNA, 14 bp, Homo sapiens
gcccagggtgctgg

SEQ ID NO: 5909820 - DNA, 20 bp, Homo sapiens
gcccagggtgctgggatggc

SEQ ID NO: 5909821 - DNA, 21 bp, Homo sapiens
gcccagggtgctgggatggct

SEQ ID NO: 5909822 - DNA, 19 bp, Homo sapiens
gcccagggttcccccagcc

SEQ ID NO: 5909823 - DNA, 20 bp, Homo sapiens
gcccagggttcccccagccc

SEQ ID NO: 5909824 - DNA, 22 bp, Homo sapiens
gcccagggttcccccagccctg

SEQ ID NO: 5909825 - DNA, 23 bp, Homo sapiens
gcccagggttcccccagccctgt

SEQ ID NO: 5909826 - DNA, 16 bp, Homo sapiens
gcccaggtaccaccct

SEQ ID NO: 5909827 - DNA, 18 bp, Homo sapiens
gcccaggtaccacccttc

SEQ ID NO: 5909828 - DNA, 17 bp, Homo sapiens
gcccaggtatcctgggg

SEQ ID NO: 5909829 - DNA, 23 bp, Homo sapiens
gcccaggtatcctgggggaagag

SEQ ID NO: 5909830 - DNA, 13 bp, Homo sapiens
gcccaggtcccag

SEQ ID NO: 5909831 - DNA, 18 bp, Homo sapiens
gcccaggtcccagtgcca

SEQ ID NO: 5909832 - DNA, 12 bp, Homo sapiens
gcccaggtcctc

SEQ ID NO: 5909833 - DNA, 15 bp, Homo sapiens
gcccaggtcctctga

SEQ ID NO: 5909834 - DNA, 13 bp, Homo sapiens
gcccaggtctcct

SEQ ID NO: 5909835 - DNA, 15 bp, Homo sapiens
gcccaggtctcctgg

SEQ ID NO: 5909836 - DNA, 18 bp, Homo sapiens
gcccaggtctcctgggca

SEQ ID NO: 5909837 - DNA, 23 bp, Homo sapiens
gcccaggtgagggaaggagacag

SEQ ID NO: 5909838 - DNA, 17 bp, Homo sapiens
gcccaggtggcctcctg

SEQ ID NO: 5909839 - DNA, 19 bp, Homo sapiens
gcccaggtggcctcctggc

SEQ ID NO: 5909840 - DNA, 23 bp, Homo sapiens
gcccaggtttctggtctctaggc

SEQ ID NO: 5909841 - DNA, 22 bp, Homo sapiens
gcccagtaactgccctttccct

SEQ ID NO: 5909842 - DNA, 14 bp, Homo sapiens
gcccagtacattta

SEQ ID NO: 5909843 - DNA, 22 bp, Homo sapiens
gcccagtacctagctggctctg

SEQ ID NO: 5909844 - DNA, 17 bp, Homo sapiens
gcccagtagaccttgtt

SEQ ID NO: 5909845 - DNA, 17 bp, Homo sapiens
gcccagtagccattttg

SEQ ID NO: 5909846 - DNA, 23 bp, Homo sapiens
gcccagtagccattttgtaactg

SEQ ID NO: 5909847 - DNA, 15 bp, Homo sapiens
gcccagtagccccaa

SEQ ID NO: 5909848 - DNA, 16 bp, Homo sapiens
gcccagtcattgggtt

SEQ ID NO: 5909849 - DNA, 12 bp, Homo sapiens
gcccagtcccag

SEQ ID NO: 5909850 - DNA, 17 bp, Homo sapiens
gcccagtcccagcagcc

SEQ ID NO: 5909851 - DNA, 19 bp, Homo sapiens
gcccagtcccagcagccag

SEQ ID NO: 5909852 - DNA, 15 bp, Homo sapiens
gcccagtcccccaac

SEQ ID NO: 5909853 - DNA, 21 bp, Homo sapiens
gcccagtcccccaaccccagc

SEQ ID NO: 5909854 - DNA, 19 bp, Homo sapiens
gcccagtccctggagctgt

SEQ ID NO: 5909855 - DNA, 15 bp, Homo sapiens
gcccagtcctggcct

SEQ ID NO: 5909856 - DNA, 17 bp, Homo sapiens
gcccagtcctggcctgg

SEQ ID NO: 5909857 - DNA, 18 bp, Homo sapiens
gcccagtcctggcctggc

SEQ ID NO: 5909858 - DNA, 14 bp, Homo sapiens
gcccagtcctgggt

SEQ ID NO: 5909859 - DNA, 15 bp, Homo sapiens
gcccagtccttccac

SEQ ID NO: 5909860 - DNA, 16 bp, Homo sapiens
gcccagtcgaccccaa

SEQ ID NO: 5909861 - DNA, 20 bp, Homo sapiens
gcccagtcgtccgctcagcc

SEQ ID NO: 5909862 - DNA, 21 bp, Homo sapiens
gcccagtcgtccgctcagcca

SEQ ID NO: 5909863 - DNA, 20 bp, Homo sapiens
gcccagtctggaatgcagtg

SEQ ID NO: 5909864 - DNA, 14 bp, Homo sapiens
gcccagtcttgagt

SEQ ID NO: 5909865 - DNA, 17 bp, Homo sapiens
gcccagtcttgagtggg

SEQ ID NO: 5909866 - DNA, 18 bp, Homo sapiens
gcccagtctttggagagc

SEQ ID NO: 5909867 - DNA, 15 bp, Homo sapiens
gcccagtgacctgac

SEQ ID NO: 5909868 - DNA, 17 bp, Homo sapiens
gcccagtgacctgaccg

SEQ ID NO: 5909869 - DNA, 22 bp, Homo sapiens
gcccagtgagccctgctcttct

SEQ ID NO: 5909870 - DNA, 12 bp, Homo sapiens
gcccagtgcatg

SEQ ID NO: 5909871 - DNA, 23 bp, Homo sapiens
gcccagtgccacgcacaggtgct

SEQ ID NO: 5909872 - DNA, 14 bp, Homo sapiens
gcccagtgccagca

SEQ ID NO: 5909873 - DNA, 15 bp, Homo sapiens
gcccagtgccagctc

SEQ ID NO: 5909874 - DNA, 16 bp, Homo sapiens
gcccagtgccagctcc

SEQ ID NO: 5909875 - DNA, 17 bp, Homo sapiens
gcccagtgccagctcca

SEQ ID NO: 5909876 - DNA, 19 bp, Homo sapiens
gcccagtgctgctgtaaat

SEQ ID NO: 5909877 - DNA, 18 bp, Homo sapiens
gcccagtgctggccacac

SEQ ID NO: 5909878 - DNA, 23 bp, Homo sapiens
gcccagtgcttctccaacactga

SEQ ID NO: 5909879 - DNA, 22 bp, Homo sapiens
gcccagtggaacagtcaccctt

SEQ ID NO: 5909880 - DNA, 15 bp, Homo sapiens
gcccagtggagcctg

SEQ ID NO: 5909881 - DNA, 20 bp, Homo sapiens
gcccagtggagcctgccgcc

SEQ ID NO: 5909882 - DNA, 16 bp, Homo sapiens
gcccagtgttttcttt

SEQ ID NO: 5909883 - DNA, 22 bp, Homo sapiens
gcccagtgttttctttgaggac

SEQ ID NO: 5909884 - DNA, 15 bp, Homo sapiens
gcccagttaatcttg

SEQ ID NO: 5909885 - DNA, 13 bp, Homo sapiens
gcccagttagccc

SEQ ID NO: 5909886 - DNA, 20 bp, Homo sapiens
gcccagttagcccggccaag

SEQ ID NO: 5909887 - DNA, 21 bp, Homo sapiens
gcccagttagcccggccaagg

SEQ ID NO: 5909888 - DNA, 23 bp, Homo sapiens
gcccagttagcccggccaaggac

SEQ ID NO: 5909889 - DNA, 15 bp, Homo sapiens
gcccagttcatccca

SEQ ID NO: 5909890 - DNA, 16 bp, Homo sapiens
gcccagtttcagggct

SEQ ID NO: 5909891 - DNA, 21 bp, Homo sapiens
gcccagtttctgcctctgagg

SEQ ID NO: 5909892 - DNA, 12 bp, Homo sapiens
gccccaattcaa

SEQ ID NO: 5909893 - DNA, 19 bp, Homo sapiens
gccccacaaggcctggtct

SEQ ID NO: 5909894 - DNA, 20 bp, Homo sapiens
gccccacaaggcctggtctg

SEQ ID NO: 5909895 - DNA, 22 bp, Homo sapiens
gccccacaaggcctggtctggg

SEQ ID NO: 5909896 - DNA, 22 bp, Homo sapiens
gccccacaccagggccagcctc

SEQ ID NO: 5909897 - DNA, 18 bp, Homo sapiens
gccccacacccagccagc

SEQ ID NO: 5909898 - DNA, 21 bp, Homo sapiens
gccccacacggactcccgggc

SEQ ID NO: 5909899 - DNA, 23 bp, Homo sapiens
gccccacacggactcccgggcca

SEQ ID NO: 5909900 - DNA, 18 bp, Homo sapiens
gccccacactccccgcct

SEQ ID NO: 5909901 - DNA, 22 bp, Homo sapiens
gccccacactggggtgccgcct

SEQ ID NO: 5909902 - DNA, 15 bp, Homo sapiens
gccccacagcaccca

SEQ ID NO: 5909903 - DNA, 17 bp, Homo sapiens
gccccacagcacccagg

SEQ ID NO: 5909904 - DNA, 19 bp, Homo sapiens
gccccacagcacccaggct

SEQ ID NO: 5909905 - DNA, 23 bp, Homo sapiens
gccccacagcccacgtcctgtca

SEQ ID NO: 5909906 - DNA, 22 bp, Homo sapiens
gccccacagcccctcaaagact

SEQ ID NO: 5909907 - DNA, 21 bp, Homo sapiens
gccccacagcctggcacgaag

SEQ ID NO: 5909908 - DNA, 15 bp, Homo sapiens
gccccacagctacct

SEQ ID NO: 5909909 - DNA, 17 bp, Homo sapiens
gccccacagctacctga

SEQ ID NO: 5909910 - DNA, 13 bp, Homo sapiens
gccccacaggagt

SEQ ID NO: 5909911 - DNA, 13 bp, Homo sapiens
gccccacaggcca

SEQ ID NO: 5909912 - DNA, 23 bp, Homo sapiens
gccccacagtctccggcctctcc

SEQ ID NO: 5909913 - DNA, 16 bp, Homo sapiens
gccccacagtggtcag

SEQ ID NO: 5909914 - DNA, 17 bp, Homo sapiens
gccccacagtggtcagc

SEQ ID NO: 5909915 - DNA, 20 bp, Homo sapiens
gccccacagttgtgttcatg

SEQ ID NO: 5909916 - DNA, 13 bp, Homo sapiens
gccccaccaccta

SEQ ID NO: 5909917 - DNA, 15 bp, Homo sapiens
gccccaccacctagg

SEQ ID NO: 5909918 - DNA, 19 bp, Homo sapiens
gccccaccactccccaacc

SEQ ID NO: 5909919 - DNA, 15 bp, Homo sapiens
gccccaccagccacc

SEQ ID NO: 5909920 - DNA, 23 bp, Homo sapiens
gccccaccagccacctcttgggc

SEQ ID NO: 5909921 - DNA, 18 bp, Homo sapiens
gccccaccagtgcctctc

SEQ ID NO: 5909922 - DNA, 22 bp, Homo sapiens
gccccaccagtgcctctccctg

SEQ ID NO: 5909923 - DNA, 21 bp, Homo sapiens
gccccacccacccctcctggg

SEQ ID NO: 5909924 - DNA, 19 bp, Homo sapiens
gccccacccaccctctggt

SEQ ID NO: 5909925 - DNA, 14 bp, Homo sapiens
gccccacccagagg

SEQ ID NO: 5909926 - DNA, 14 bp, Homo sapiens
gccccaccccacct

SEQ ID NO: 5909927 - DNA, 21 bp, Homo sapiens
gccccaccccacctcacagct

SEQ ID NO: 5909928 - DNA, 17 bp, Homo sapiens
gccccaccccaggtcct

SEQ ID NO: 5909929 - DNA, 20 bp, Homo sapiens
gccccaccccatccagccag

SEQ ID NO: 5909930 - DNA, 22 bp, Homo sapiens
gccccaccccatccagccagac

SEQ ID NO: 5909931 - DNA, 19 bp, Homo sapiens
gccccacccccagccaggc

SEQ ID NO: 5909932 - DNA, 13 bp, Homo sapiens
gccccacccccct

SEQ ID NO: 5909933 - DNA, 14 bp, Homo sapiens
gccccacccccctc

SEQ ID NO: 5909934 - DNA, 18 bp, Homo sapiens
gccccacccccctcctcc

SEQ ID NO: 5909935 - DNA, 19 bp, Homo sapiens
gccccaccccctgggcaga

SEQ ID NO: 5909936 - DNA, 23 bp, Homo sapiens
gccccacccctaagtgcccaaag

SEQ ID NO: 5909937 - DNA, 16 bp, Homo sapiens
gccccaccccttccct

SEQ ID NO: 5909938 - DNA, 18 bp, Homo sapiens
gccccaccctcagatgca

SEQ ID NO: 5909939 - DNA, 13 bp, Homo sapiens
gccccaccctcgg

SEQ ID NO: 5909940 - DNA, 16 bp, Homo sapiens
gccccaccctcgggga

SEQ ID NO: 5909941 - DNA, 21 bp, Homo sapiens
gccccaccctcgtggacacct

SEQ ID NO: 5909942 - DNA, 23 bp, Homo sapiens
gccccaccctcgtggacacctgc

SEQ ID NO: 5909943 - DNA, 15 bp, Homo sapiens
gccccacctccacct

SEQ ID NO: 5909944 - DNA, 19 bp, Homo sapiens
gccccacctcccatttctg

SEQ ID NO: 5909945 - DNA, 20 bp, Homo sapiens
gccccacctcccccttcccc

SEQ ID NO: 5909946 - DNA, 16 bp, Homo sapiens
gccccacctcccgccc

SEQ ID NO: 5909947 - DNA, 21 bp, Homo sapiens
gccccacctcggcacacactg

SEQ ID NO: 5909948 - DNA, 22 bp, Homo sapiens
gccccacctcggcacacactgt

SEQ ID NO: 5909949 - DNA, 11 bp, Homo sapiens
gccccacctgc

SEQ ID NO: 5909950 - DNA, 18 bp, Homo sapiens
gccccacctgcagctccc

SEQ ID NO: 5909951 - DNA, 12 bp, Homo sapiens
gccccacctgcc

SEQ ID NO: 5909952 - DNA, 17 bp, Homo sapiens
gccccacctgccactag

SEQ ID NO: 5909953 - DNA, 20 bp, Homo sapiens
gccccacctgccactaggct

SEQ ID NO: 5909954 - DNA, 13 bp, Homo sapiens
gccccacctgccg

SEQ ID NO: 5909955 - DNA, 15 bp, Homo sapiens
gccccacctgcctgg

SEQ ID NO: 5909956 - DNA, 18 bp, Homo sapiens
gccccacctgcctggtgc

SEQ ID NO: 5909957 - DNA, 14 bp, Homo sapiens
gccccacctggccc

SEQ ID NO: 5909958 - DNA, 14 bp, Homo sapiens
gccccacctgtgtc

SEQ ID NO: 5909959 - DNA, 18 bp, Homo sapiens
gccccacctttaagtcct

SEQ ID NO: 5909960 - DNA, 20 bp, Homo sapiens
gccccacctttattaaaatc

SEQ ID NO: 5909961 - DNA, 15 bp, Homo sapiens
gccccacgccctctc

SEQ ID NO: 5909962 - DNA, 16 bp, Homo sapiens
gccccacgtggagctc

SEQ ID NO: 5909963 - DNA, 16 bp, Homo sapiens
gccccactacaggccc

SEQ ID NO: 5909964 - DNA, 12 bp, Homo sapiens
gccccactccag

SEQ ID NO: 5909965 - DNA, 14 bp, Homo sapiens
gccccactccagcc

SEQ ID NO: 5909966 - DNA, 20 bp, Homo sapiens
gccccactccagcctgggga

SEQ ID NO: 5909967 - DNA, 22 bp, Homo sapiens
gccccactcccttgctggcccc

SEQ ID NO: 5909968 - DNA, 12 bp, Homo sapiens
gccccactcctc

SEQ ID NO: 5909969 - DNA, 13 bp, Homo sapiens
gccccactcctct

SEQ ID NO: 5909970 - DNA, 22 bp, Homo sapiens
gccccactcctgtcagcccctc

SEQ ID NO: 5909971 - DNA, 22 bp, Homo sapiens
gccccactctcagaggccccaa

SEQ ID NO: 5909972 - DNA, 13 bp, Homo sapiens
gccccactctgct

SEQ ID NO: 5909973 - DNA, 14 bp, Homo sapiens
gccccactctgctg

SEQ ID NO: 5909974 - DNA, 15 bp, Homo sapiens
gccccactctgctga

SEQ ID NO: 5909975 - DNA, 17 bp, Homo sapiens
gccccactctgctgagg

SEQ ID NO: 5909976 - DNA, 22 bp, Homo sapiens
gccccactgacacccagtgtcc

SEQ ID NO: 5909977 - DNA, 12 bp, Homo sapiens
gccccactgatg

SEQ ID NO: 5909978 - DNA, 14 bp, Homo sapiens
gccccactgccagc

SEQ ID NO: 5909979 - DNA, 15 bp, Homo sapiens
gccccactgccagca

SEQ ID NO: 5909980 - DNA, 23 bp, Homo sapiens
gccccactgccagcagcagcagg

SEQ ID NO: 5909981 - DNA, 13 bp, Homo sapiens
gccccactgccct

SEQ ID NO: 5909982 - DNA, 19 bp, Homo sapiens
gccccactgccctccaggg

SEQ ID NO: 5909983 - DNA, 19 bp, Homo sapiens
gccccactggacaacactg

SEQ ID NO: 5909984 - DNA, 13 bp, Homo sapiens
gccccactggctg

SEQ ID NO: 5909985 - DNA, 18 bp, Homo sapiens
gccccactggctggagga

SEQ ID NO: 5909986 - DNA, 14 bp, Homo sapiens
gccccactgggaga

SEQ ID NO: 5909987 - DNA, 23 bp, Homo sapiens
gccccactgggagagtccttagc

SEQ ID NO: 5909988 - DNA, 14 bp, Homo sapiens
gccccacttctggc

SEQ ID NO: 5909989 - DNA, 20 bp, Homo sapiens
gccccacttctggcatggga

SEQ ID NO: 5909990 - DNA, 17 bp, Homo sapiens
gccccacttctggccac

SEQ ID NO: 5909991 - DNA, 18 bp, Homo sapiens
gccccacttctggccaca

SEQ ID NO: 5909992 - DNA, 21 bp, Homo sapiens
gccccacttctggccacatca

SEQ ID NO: 5909993 - DNA, 18 bp, Homo sapiens
gccccactttgaagggca

SEQ ID NO: 5909994 - DNA, 13 bp, Homo sapiens
gccccagaaaatg

SEQ ID NO: 5909995 - DNA, 14 bp, Homo sapiens
gccccagaaaatga

SEQ ID NO: 5909996 - DNA, 17 bp, Homo sapiens
gccccagaaagcctcag

SEQ ID NO: 5909997 - DNA, 20 bp, Homo sapiens
gccccagaacaattctgcag

SEQ ID NO: 5909998 - DNA, 18 bp, Homo sapiens
gccccagaaggcagggaa

SEQ ID NO: 5909999 - DNA, 19 bp, Homo sapiens
gccccagacaacagcccag

SEQ ID NO: 5910000 - DNA, 20 bp, Homo sapiens
gccccagacaacagcccagg

SEQ ID NO: 5910001 - DNA, 13 bp, Homo sapiens
gccccagacacac

SEQ ID NO: 5910002 - DNA, 12 bp, Homo sapiens
gccccagacagg

SEQ ID NO: 5910003 - DNA, 21 bp, Homo sapiens
gccccagacagggtgggcttc

SEQ ID NO: 5910004 - DNA, 19 bp, Homo sapiens
gccccagacagttcttttc

SEQ ID NO: 5910005 - DNA, 21 bp, Homo sapiens
gccccagacagttcttttcta

SEQ ID NO: 5910006 - DNA, 18 bp, Homo sapiens
gccccagaccccagggca

SEQ ID NO: 5910007 - DNA, 16 bp, Homo sapiens
gccccagacctggaag

SEQ ID NO: 5910008 - DNA, 18 bp, Homo sapiens
gccccagactgggcccag

SEQ ID NO: 5910009 - DNA, 19 bp, Homo sapiens
gccccagactgggcccagg

SEQ ID NO: 5910010 - DNA, 18 bp, Homo sapiens
gccccagagaaactgcca

SEQ ID NO: 5910011 - DNA, 18 bp, Homo sapiens
gccccagagaagcctcag

SEQ ID NO: 5910012 - DNA, 21 bp, Homo sapiens
gccccagagaagcctcagtcc

SEQ ID NO: 5910013 - DNA, 24 bp, Homo sapiens
gccccagagaagcctcagtccctc

SEQ ID NO: 5910014 - DNA, 17 bp, Homo sapiens
gccccagagactcagag

SEQ ID NO: 5910015 - DNA, 14 bp, Homo sapiens
gccccagagactgc

SEQ ID NO: 5910016 - DNA, 18 bp, Homo sapiens
gccccagagactgcccac

SEQ ID NO: 5910017 - DNA, 22 bp, Homo sapiens
gccccagagactgcccaccctg

SEQ ID NO: 5910018 - DNA, 18 bp, Homo sapiens
gccccagagatgccagcc

SEQ ID NO: 5910019 - DNA, 12 bp, Homo sapiens
gccccagagccc

SEQ ID NO: 5910020 - DNA, 13 bp, Homo sapiens
gccccagagcccc

SEQ ID NO: 5910021 - DNA, 11 bp, Homo sapiens
gccccagagct

SEQ ID NO: 5910022 - DNA, 12 bp, Homo sapiens
gccccagagctc

SEQ ID NO: 5910023 - DNA, 14 bp, Homo sapiens
gccccagagctccg

SEQ ID NO: 5910024 - DNA, 17 bp, Homo sapiens
gccccagagctccgatg

SEQ ID NO: 5910025 - DNA, 13 bp, Homo sapiens
gccccagagctgt

SEQ ID NO: 5910026 - DNA, 23 bp, Homo sapiens
gccccagagctgtttatggcctc

SEQ ID NO: 5910027 - DNA, 12 bp, Homo sapiens
gccccagaggac

SEQ ID NO: 5910028 - DNA, 13 bp, Homo sapiens
gccccagaggacc

SEQ ID NO: 5910029 - DNA, 14 bp, Homo sapiens
gccccagaggccct

SEQ ID NO: 5910030 - DNA, 16 bp, Homo sapiens
gccccagaggccctgg

SEQ ID NO: 5910031 - DNA, 15 bp, Homo sapiens
gccccagaggcctct

SEQ ID NO: 5910032 - DNA, 19 bp, Homo sapiens
gccccagaggcctctctct

SEQ ID NO: 5910033 - DNA, 23 bp, Homo sapiens
gccccagaggtcgcagctaccct

SEQ ID NO: 5910034 - DNA, 15 bp, Homo sapiens
gccccagagtggccc

SEQ ID NO: 5910035 - DNA, 17 bp, Homo sapiens
gccccagagtggcccac

SEQ ID NO: 5910036 - DNA, 17 bp, Homo sapiens
gccccagataccagccc

SEQ ID NO: 5910037 - DNA, 19 bp, Homo sapiens
gccccagataccagcccct

SEQ ID NO: 5910038 - DNA, 18 bp, Homo sapiens
gccccagatcaccagccc

SEQ ID NO: 5910039 - DNA, 16 bp, Homo sapiens
gccccagatctgcctg

SEQ ID NO: 5910040 - DNA, 17 bp, Homo sapiens
gccccagatctgcctgg

SEQ ID NO: 5910041 - DNA, 22 bp, Homo sapiens
gccccagatctgcctgggcctg

SEQ ID NO: 5910042 - DNA, 21 bp, Homo sapiens
gccccagcacctcagcctgca

SEQ ID NO: 5910043 - DNA, 23 bp, Homo sapiens
gccccagcactaaagcagtggac

SEQ ID NO: 5910044 - DNA, 19 bp, Homo sapiens
gccccagcactaacgtaaa

SEQ ID NO: 5910045 - DNA, 15 bp, Homo sapiens
gccccagcagccctc

SEQ ID NO: 5910046 - DNA, 10 bp, Homo sapiens
gccccagcca

SEQ ID NO: 5910047 - DNA, 14 bp, Homo sapiens
gccccagccagccc

SEQ ID NO: 5910048 - DNA, 15 bp, Homo sapiens
gccccagccagccct

SEQ ID NO: 5910049 - DNA, 16 bp, Homo sapiens
gccccagcccaccctc

SEQ ID NO: 5910050 - DNA, 20 bp, Homo sapiens
gccccagcccaccctcctgt

SEQ ID NO: 5910051 - DNA, 21 bp, Homo sapiens
gccccagcccaccctcctgtc

SEQ ID NO: 5910052 - DNA, 12 bp, Homo sapiens
gccccagcccag

SEQ ID NO: 5910053 - DNA, 13 bp, Homo sapiens
gccccagcccaga

SEQ ID NO: 5910054 - DNA, 14 bp, Homo sapiens
gccccagcccagcc

SEQ ID NO: 5910055 - DNA, 19 bp, Homo sapiens
gccccagcccagccccact

SEQ ID NO: 5910056 - DNA, 12 bp, Homo sapiens
gccccagcccca

SEQ ID NO: 5910057 - DNA, 14 bp, Homo sapiens
gccccagccccaat

SEQ ID NO: 5910058 - DNA, 12 bp, Homo sapiens
gccccagccccc

SEQ ID NO: 5910059 - DNA, 16 bp, Homo sapiens
gccccagcccccacct

SEQ ID NO: 5910060 - DNA, 17 bp, Homo sapiens
gccccagccccctttgg

SEQ ID NO: 5910061 - DNA, 21 bp, Homo sapiens
gccccagccccgtcccagagg

SEQ ID NO: 5910062 - DNA, 22 bp, Homo sapiens
gccccagccccgtcccagaggc

SEQ ID NO: 5910063 - DNA, 18 bp, Homo sapiens
gccccagcccctaagccc

SEQ ID NO: 5910064 - DNA, 12 bp, Homo sapiens
gccccagccctc

SEQ ID NO: 5910065 - DNA, 14 bp, Homo sapiens
gccccagccctcag

SEQ ID NO: 5910066 - DNA, 16 bp, Homo sapiens
gccccagccctcagtc

SEQ ID NO: 5910067 - DNA, 22 bp, Homo sapiens
gccccagccctcagtcaccccc

SEQ ID NO: 5910068 - DNA, 14 bp, Homo sapiens
gccccagccctgct

SEQ ID NO: 5910069 - DNA, 18 bp, Homo sapiens
gccccagccctgctgggg

SEQ ID NO: 5910070 - DNA, 20 bp, Homo sapiens
gccccctccctgctcccagc

SEQ ID NO: 5910071 - DNA, 18 bp, Homo sapiens
gccccctccgccctgcca

SEQ ID NO: 5910072 - DNA, 19 bp, Homo sapiens
gccccctcctctcccatcc

SEQ ID NO: 5910073 - DNA, 15 bp, Homo sapiens
gccccctcctgaccc

SEQ ID NO: 5910074 - DNA, 17 bp, Homo sapiens
gccccctcctgacccca

SEQ ID NO: 5910075 - DNA, 22 bp, Homo sapiens
gccccctcgcgcccctgtccat

SEQ ID NO: 5910076 - DNA, 17 bp, Homo sapiens
gccccctcggcccctca

SEQ ID NO: 5910077 - DNA, 14 bp, Homo sapiens
gccccctcgtgcca

SEQ ID NO: 5910078 - DNA, 15 bp, Homo sapiens
gccccctctcaggag

SEQ ID NO: 5910079 - DNA, 11 bp, Homo sapiens
gccccctctct

SEQ ID NO: 5910080 - DNA, 14 bp, Homo sapiens
gccccctctgccct

SEQ ID NO: 5910081 - DNA, 16 bp, Homo sapiens
gccccctctgccctgc

SEQ ID NO: 5910082 - DNA, 20 bp, Homo sapiens
gccccctctttgtagctcct

SEQ ID NO: 5910083 - DNA, 11 bp, Homo sapiens
gccccctgaaa

SEQ ID NO: 5910084 - DNA, 18 bp, Homo sapiens
gccccctgcacccacccc

SEQ ID NO: 5910085 - DNA, 15 bp, Homo sapiens
gccccctgcaggaag

SEQ ID NO: 5910086 - DNA, 13 bp, Homo sapiens
gccccctgcatct

SEQ ID NO: 5910087 - DNA, 13 bp, Homo sapiens
gccccctgccccc

SEQ ID NO: 5910088 - DNA, 14 bp, Homo sapiens
gccccctgcccccc

SEQ ID NO: 5910089 - DNA, 12 bp, Homo sapiens
gccccctgccct

SEQ ID NO: 5910090 - DNA, 16 bp, Homo sapiens
gccccctgcctgccat

SEQ ID NO: 5910091 - DNA, 15 bp, Homo sapiens
gccccctgctgccat

SEQ ID NO: 5910092 - DNA, 15 bp, Homo sapiens
gccccctgctggctc

SEQ ID NO: 5910093 - DNA, 20 bp, Homo sapiens
gccccctgcttacttggtga

SEQ ID NO: 5910094 - DNA, 11 bp, Homo sapiens
gccccctggca

SEQ ID NO: 5910095 - DNA, 15 bp, Homo sapiens
gccccctggcagctg

SEQ ID NO: 5910096 - DNA, 20 bp, Homo sapiens
gccccctggcagctgcccct

SEQ ID NO: 5910097 - DNA, 21 bp, Homo sapiens
gccccctggcagctgcccctc

SEQ ID NO: 5910098 - DNA, 15 bp, Homo sapiens
gccccctggcccctc

SEQ ID NO: 5910099 - DNA, 20 bp, Homo sapiens
gccccctggcccctcccaca

SEQ ID NO: 5910100 - DNA, 17 bp, Homo sapiens
gccccctggcggcaggg

SEQ ID NO: 5910101 - DNA, 18 bp, Homo sapiens
gccccctggcggcagggg

SEQ ID NO: 5910102 - DNA, 17 bp, Homo sapiens
gccccctgggctggggc

SEQ ID NO: 5910103 - DNA, 21 bp, Homo sapiens
gccccctgggctggggcctca

SEQ ID NO: 5910104 - DNA, 21 bp, Homo sapiens
gccccctggggggcacagcca

SEQ ID NO: 5910105 - DNA, 13 bp, Homo sapiens
gccccctggtggg

SEQ ID NO: 5910106 - DNA, 13 bp, Homo sapiens
gccccctgtcctt

SEQ ID NO: 5910107 - DNA, 14 bp, Homo sapiens
gccccctgtccttc

SEQ ID NO: 5910108 - DNA, 17 bp, Homo sapiens
gccccctgtctctcagg

SEQ ID NO: 5910109 - DNA, 13 bp, Homo sapiens
gccccctgtgcca

SEQ ID NO: 5910110 - DNA, 20 bp, Homo sapiens
gccccctgtgccagctcagg

SEQ ID NO: 5910111 - DNA, 18 bp, Homo sapiens
gccccctgtgcccaccca

SEQ ID NO: 5910112 - DNA, 12 bp, Homo sapiens
gccccctgtggc

SEQ ID NO: 5910113 - DNA, 15 bp, Homo sapiens
gcccccttcaggagc

SEQ ID NO: 5910114 - DNA, 16 bp, Homo sapiens
gcccccttcaggagcc

SEQ ID NO: 5910115 - DNA, 17 bp, Homo sapiens
gcccccttccccagccc

SEQ ID NO: 5910116 - DNA, 18 bp, Homo sapiens
gcccccttccccagccct

SEQ ID NO: 5910117 - DNA, 13 bp, Homo sapiens
gcccccttcctgg

SEQ ID NO: 5910118 - DNA, 14 bp, Homo sapiens
gcccccttcctggc

SEQ ID NO: 5910119 - DNA, 16 bp, Homo sapiens
gcccccttcgctcctc

SEQ ID NO: 5910120 - DNA, 19 bp, Homo sapiens
gcccccttcggttacagga

SEQ ID NO: 5910121 - DNA, 18 bp, Homo sapiens
gcccccttctcccacact

SEQ ID NO: 5910122 - DNA, 14 bp, Homo sapiens
gcccccttgccctc

SEQ ID NO: 5910123 - DNA, 17 bp, Homo sapiens
gccccctttgaccttcc

SEQ ID NO: 5910124 - DNA, 22 bp, Homo sapiens
gccccgaaaggtcacctcactc

SEQ ID NO: 5910125 - DNA, 16 bp, Homo sapiens
gccccgaagggccccc

SEQ ID NO: 5910126 - DNA, 22 bp, Homo sapiens
gccccgaccccacctgaggcag

SEQ ID NO: 5910127 - DNA, 20 bp, Homo sapiens
gccccgacccctgtccagcg

SEQ ID NO: 5910128 - DNA, 18 bp, Homo sapiens
gccccgactccagccagc

SEQ ID NO: 5910129 - DNA, 21 bp, Homo sapiens
gccccgactccagccagcgcc

SEQ ID NO: 5910130 - DNA, 20 bp, Homo sapiens
gccccgagacaccatcctga

SEQ ID NO: 5910131 - DNA, 21 bp, Homo sapiens
gccccgagacaccatcctgag

SEQ ID NO: 5910132 - DNA, 20 bp, Homo sapiens
gccccgagagcaggctcgac

SEQ ID NO: 5910133 - DNA, 19 bp, Homo sapiens
gccccgaggacccagaccc

SEQ ID NO: 5910134 - DNA, 22 bp, Homo sapiens
gccccgaggcctagagtggcag

SEQ ID NO: 5910135 - DNA, 22 bp, Homo sapiens
gccccgaggccttctctgaagg

SEQ ID NO: 5910136 - DNA, 23 bp, Homo sapiens
gccccgaggccttctctgaagga

SEQ ID NO: 5910137 - DNA, 22 bp, Homo sapiens
gccccgaggctgggacactgtg

SEQ ID NO: 5910138 - DNA, 17 bp, Homo sapiens
gccccgatggactcctg

SEQ ID NO: 5910139 - DNA, 17 bp, Homo sapiens
gccccgcacccccgcca

SEQ ID NO: 5910140 - DNA, 23 bp, Homo sapiens
gccccgcacccccgccaggcgca

SEQ ID NO: 5910141 - DNA, 13 bp, Homo sapiens
gccccgcacccct

SEQ ID NO: 5910142 - DNA, 19 bp, Homo sapiens
gccccgcacgggctgtctg

SEQ ID NO: 5910143 - DNA, 22 bp, Homo sapiens
gccccgcacgggctgtctgggt

SEQ ID NO: 5910144 - DNA, 18 bp, Homo sapiens
gccccgcagacctcccca

SEQ ID NO: 5910145 - DNA, 20 bp, Homo sapiens
gccccgcagacctccccagc

SEQ ID NO: 5910146 - DNA, 13 bp, Homo sapiens
gccccgccagggc

SEQ ID NO: 5910147 - DNA, 14 bp, Homo sapiens
gccccgccagggct

SEQ ID NO: 5910148 - DNA, 17 bp, Homo sapiens
gccccgccccaccccgt

SEQ ID NO: 5910149 - DNA, 15 bp, Homo sapiens
gccccgccccagagc

SEQ ID NO: 5910150 - DNA, 16 bp, Homo sapiens
gccccgccccagccct

SEQ ID NO: 5910151 - DNA, 14 bp, Homo sapiens
gccccgcccccacc

SEQ ID NO: 5910152 - DNA, 15 bp, Homo sapiens
gccccgcccccaccc

SEQ ID NO: 5910153 - DNA, 14 bp, Homo sapiens
gccccgccccccag

SEQ ID NO: 5910154 - DNA, 15 bp, Homo sapiens
gccccgccccccaga

SEQ ID NO: 5910155 - DNA, 16 bp, Homo sapiens
gccccgccccccagag

SEQ ID NO: 5910156 - DNA, 17 bp, Homo sapiens
gccccgccccccagagc

SEQ ID NO: 5910157 - DNA, 20 bp, Homo sapiens
gccccgccccccagagccag

SEQ ID NO: 5910158 - DNA, 18 bp, Homo sapiens
gccccgccccctccctgc

SEQ ID NO: 5910159 - DNA, 21 bp, Homo sapiens
gccccgccccctcggcccctc

SEQ ID NO: 5910160 - DNA, 15 bp, Homo sapiens
gccccgccccgttgt

SEQ ID NO: 5910161 - DNA, 12 bp, Homo sapiens
gccccgcccctc

SEQ ID NO: 5910162 - DNA, 23 bp, Homo sapiens
gccccgcccctcccacgcctcac

SEQ ID NO: 5910163 - DNA, 15 bp, Homo sapiens
gccccgcccgagccc

SEQ ID NO: 5910164 - DNA, 16 bp, Homo sapiens
gccccgcccgagcccc

SEQ ID NO: 5910165 - DNA, 19 bp, Homo sapiens
gccccgcccgtctctgctc

SEQ ID NO: 5910166 - DNA, 24 bp, Homo sapiens
gccccgcccgtctctgctctgctc

SEQ ID NO: 5910167 - DNA, 15 bp, Homo sapiens
gccccgccctgcccc

SEQ ID NO: 5910168 - DNA, 12 bp, Homo sapiens
gccccgccggcc

SEQ ID NO: 5910169 - DNA, 13 bp, Homo sapiens
gccccgccgtgtc

SEQ ID NO: 5910170 - DNA, 19 bp, Homo sapiens
gccccgccgtgtctgtggc

SEQ ID NO: 5910171 - DNA, 12 bp, Homo sapiens
gccccgcctcaa

SEQ ID NO: 5910172 - DNA, 14 bp, Homo sapiens
gccccgcctgacct

SEQ ID NO: 5910173 - DNA, 15 bp, Homo sapiens
gccccgcctgagtca

SEQ ID NO: 5910174 - DNA, 18 bp, Homo sapiens
gccccgcctgcctgccac

SEQ ID NO: 5910175 - DNA, 17 bp, Homo sapiens
gccccgccttcgtgtgc

SEQ ID NO: 5910176 - DNA, 21 bp, Homo sapiens
gccccgccttcgtgtgctgct

SEQ ID NO: 5910177 - DNA, 19 bp, Homo sapiens
gccccgccttttcccccac

SEQ ID NO: 5910178 - DNA, 16 bp, Homo sapiens
gccccgcgaccacccc

SEQ ID NO: 5910179 - DNA, 20 bp, Homo sapiens
gccccgcgcgccggtccggc

SEQ ID NO: 5910180 - DNA, 19 bp, Homo sapiens
gccccgcgcgtgcccccag

SEQ ID NO: 5910181 - DNA, 13 bp, Homo sapiens
gccccgcggagcc

SEQ ID NO: 5910182 - DNA, 14 bp, Homo sapiens
gccccgcggagccc

SEQ ID NO: 5910183 - DNA, 22 bp, Homo sapiens
gccccgcgggctttgttgctgg

SEQ ID NO: 5910184 - DNA, 15 bp, Homo sapiens
gccccgcgtcttcag

SEQ ID NO: 5910185 - DNA, 22 bp, Homo sapiens
gccccgctcaggcctaggaggc

SEQ ID NO: 5910186 - DNA, 14 bp, Homo sapiens
gccccgctcccacc

SEQ ID NO: 5910187 - DNA, 23 bp, Homo sapiens
gccccgctgggatttcttcgctg

SEQ ID NO: 5910188 - DNA, 17 bp, Homo sapiens
gccccgctgtgtcctcc

SEQ ID NO: 5910189 - DNA, 21 bp, Homo sapiens
gccccgctgtgtcctccctcc

SEQ ID NO: 5910190 - DNA, 15 bp, Homo sapiens
gccccgcttccccac

SEQ ID NO: 5910191 - DNA, 14 bp, Homo sapiens
gccccgcttgtcca

SEQ ID NO: 5910192 - DNA, 18 bp, Homo sapiens
gccccggacctacctccc

SEQ ID NO: 5910193 - DNA, 13 bp, Homo sapiens
gccccggagcacc

SEQ ID NO: 5910194 - DNA, 19 bp, Homo sapiens
gccccggaggaagcttggg

SEQ ID NO: 5910195 - DNA, 18 bp, Homo sapiens
gccccggatcagagcagg

SEQ ID NO: 5910196 - DNA, 23 bp, Homo sapiens
gccccggcaactctggctccagg

SEQ ID NO: 5910197 - DNA, 13 bp, Homo sapiens
gccccggccacct

SEQ ID NO: 5910198 - DNA, 14 bp, Homo sapiens
gccccggccacctc

SEQ ID NO: 5910199 - DNA, 15 bp, Homo sapiens
gccccggccacctct

SEQ ID NO: 5910200 - DNA, 16 bp, Homo sapiens
gccccggccacctctg

SEQ ID NO: 5910201 - DNA, 19 bp, Homo sapiens
gccccggccactccctgcc

SEQ ID NO: 5910202 - DNA, 14 bp, Homo sapiens
gccccggccactct

SEQ ID NO: 5910203 - DNA, 15 bp, Homo sapiens
gccccggccactctg

SEQ ID NO: 5910204 - DNA, 17 bp, Homo sapiens
gccccggccactctgtt

SEQ ID NO: 5910205 - DNA, 19 bp, Homo sapiens
gccccggccactctgtttg

SEQ ID NO: 5910206 - DNA, 20 bp, Homo sapiens
gccccggccactctgtttgc

SEQ ID NO: 5910207 - DNA, 14 bp, Homo sapiens
gccccggccccagc

SEQ ID NO: 5910208 - DNA, 15 bp, Homo sapiens
gccccggccttgctt

SEQ ID NO: 5910209 - DNA, 15 bp, Homo sapiens
gccccggctcccacc

SEQ ID NO: 5910210 - DNA, 16 bp, Homo sapiens
gccccggctcccaccg

SEQ ID NO: 5910211 - DNA, 22 bp, Homo sapiens
gccccgggacccacggagccct

SEQ ID NO: 5910212 - DNA, 16 bp, Homo sapiens
gccccgggccgcgagc

SEQ ID NO: 5910213 - DNA, 17 bp, Homo sapiens
gccccgggcctgcctct

SEQ ID NO: 5910214 - DNA, 24 bp, Homo sapiens
gccccgggcctgcctctgactcac

SEQ ID NO: 5910215 - DNA, 16 bp, Homo sapiens
gccccgggcggagcct

SEQ ID NO: 5910216 - DNA, 15 bp, Homo sapiens
gccccgggctgaccc

SEQ ID NO: 5910217 - DNA, 16 bp, Homo sapiens
gccccgggctgaccca

SEQ ID NO: 5910218 - DNA, 18 bp, Homo sapiens
gccccgggctgacccagt

SEQ ID NO: 5910219 - DNA, 12 bp, Homo sapiens
gccccgggctgg

SEQ ID NO: 5910220 - DNA, 13 bp, Homo sapiens
gccccgggctggc

SEQ ID NO: 5910221 - DNA, 15 bp, Homo sapiens
gccccggggccccct

SEQ ID NO: 5910222 - DNA, 20 bp, Homo sapiens
gccccggggccccctggtca

SEQ ID NO: 5910223 - DNA, 21 bp, Homo sapiens
gccccggggccccctggtcac

SEQ ID NO: 5910224 - DNA, 13 bp, Homo sapiens
gccccggggctgg

SEQ ID NO: 5910225 - DNA, 16 bp, Homo sapiens
gccccggggctggcaa

SEQ ID NO: 5910226 - DNA, 19 bp, Homo sapiens
gccccggggctggcaagca

SEQ ID NO: 5910227 - DNA, 19 bp, Homo sapiens
gccccggggtgagtccatt

SEQ ID NO: 5910228 - DNA, 19 bp, Homo sapiens
gccccgggtccaggagaag

SEQ ID NO: 5910229 - DNA, 18 bp, Homo sapiens
gccccgggtccccagctc

SEQ ID NO: 5910230 - DNA, 19 bp, Homo sapiens
gccccgggtccccagctcc

SEQ ID NO: 5910231 - DNA, 21 bp, Homo sapiens
gccccgggtccccagctcccc

SEQ ID NO: 5910232 - DNA, 17 bp, Homo sapiens
gccccgggttcagcctg

SEQ ID NO: 5910233 - DNA, 22 bp, Homo sapiens
gccccgggttcagcctggcctg

SEQ ID NO: 5910234 - DNA, 23 bp, Homo sapiens
gccccgggttcagcctggcctgc

SEQ ID NO: 5910235 - DNA, 18 bp, Homo sapiens
gccccggtcacctagcaa

SEQ ID NO: 5910236 - DNA, 14 bp, Homo sapiens
gccccggtccccca

SEQ ID NO: 5910237 - DNA, 18 bp, Homo sapiens
gccccggtcccccagagc

SEQ ID NO: 5910238 - DNA, 23 bp, Homo sapiens
gccccgtcaccatctcaggccac

SEQ ID NO: 5910239 - DNA, 19 bp, Homo sapiens
gccccgtccccccatcccg

SEQ ID NO: 5910240 - DNA, 17 bp, Homo sapiens
gccccgtccccctctgg

SEQ ID NO: 5910241 - DNA, 17 bp, Homo sapiens
gccccgtcccctaaccc

SEQ ID NO: 5910242 - DNA, 20 bp, Homo sapiens
gccccgtcccctgggccacc

SEQ ID NO: 5910243 - DNA, 23 bp, Homo sapiens
gccccgtcggactgcccccagaa

SEQ ID NO: 5910244 - DNA, 18 bp, Homo sapiens
gccccgtctacagctccc

SEQ ID NO: 5910245 - DNA, 13 bp, Homo sapiens
gccccgtctcagg

SEQ ID NO: 5910246 - DNA, 17 bp, Homo sapiens
gccccgtctcaggtctg

SEQ ID NO: 5910247 - DNA, 21 bp, Homo sapiens
gccccgtctcctgagggtcct

SEQ ID NO: 5910248 - DNA, 18 bp, Homo sapiens
gccccgtctgaccccagc

SEQ ID NO: 5910249 - DNA, 19 bp, Homo sapiens
gcccctctgcccagcttgg

SEQ ID NO: 5910250 - DNA, 21 bp, Homo sapiens
gcccctctgcccagcttgggc

SEQ ID NO: 5910251 - DNA, 13 bp, Homo sapiens
gcccctctgcctt

SEQ ID NO: 5910252 - DNA, 18 bp, Homo sapiens
gcccctctgcgccccagc

SEQ ID NO: 5910253 - DNA, 12 bp, Homo sapiens
gcccctctggat

SEQ ID NO: 5910254 - DNA, 20 bp, Homo sapiens
gcccctctggtcgctcctgc

SEQ ID NO: 5910255 - DNA, 22 bp, Homo sapiens
gcccctctggtcgctcctgccc

SEQ ID NO: 5910256 - DNA, 20 bp, Homo sapiens
gcccctctgttctctcccct

SEQ ID NO: 5910257 - DNA, 23 bp, Homo sapiens
gcccctcttattcctctaggcaa

SEQ ID NO: 5910258 - DNA, 14 bp, Homo sapiens
gcccctcttcccca

SEQ ID NO: 5910259 - DNA, 13 bp, Homo sapiens
gcccctcttccct

SEQ ID NO: 5910260 - DNA, 13 bp, Homo sapiens
gcccctcttgccc

SEQ ID NO: 5910261 - DNA, 17 bp, Homo sapiens
gcccctgaagtgacccc

SEQ ID NO: 5910262 - DNA, 13 bp, Homo sapiens
gcccctgacatca

SEQ ID NO: 5910263 - DNA, 22 bp, Homo sapiens
gcccctgagacaaatggaggcc

SEQ ID NO: 5910264 - DNA, 19 bp, Homo sapiens
gcccctgagagcctgtgga

SEQ ID NO: 5910265 - DNA, 22 bp, Homo sapiens
gcccctgagagtggtgccctgg

SEQ ID NO: 5910266 - DNA, 20 bp, Homo sapiens
gcccctgagcaatgtctgtg

SEQ ID NO: 5910267 - DNA, 12 bp, Homo sapiens
gcccctgagccc

SEQ ID NO: 5910268 - DNA, 15 bp, Homo sapiens
gcccctgagcccact

SEQ ID NO: 5910269 - DNA, 16 bp, Homo sapiens
gcccctgagcccactg

SEQ ID NO: 5910270 - DNA, 13 bp, Homo sapiens
gcccctgagcctg

SEQ ID NO: 5910271 - DNA, 15 bp, Homo sapiens
gcccctgaggagctt

SEQ ID NO: 5910272 - DNA, 20 bp, Homo sapiens
gcccctgagggacgagcaga

SEQ ID NO: 5910273 - DNA, 21 bp, Homo sapiens
gcccctgagggacgagcagag

SEQ ID NO: 5910274 - DNA, 24 bp, Homo sapiens
gcccctgagtccgcctgcgcctcc

SEQ ID NO: 5910275 - DNA, 19 bp, Homo sapiens
gcccctgagtcctgagcga

SEQ ID NO: 5910276 - DNA, 20 bp, Homo sapiens
gcccctgatcactcccagca

SEQ ID NO: 5910277 - DNA, 21 bp, Homo sapiens
gcccctgatcactcccagcac

SEQ ID NO: 5910278 - DNA, 23 bp, Homo sapiens
gcccctgatgacgggatgctctt

SEQ ID NO: 5910279 - DNA, 17 bp, Homo sapiens
gcccctgatgcagcctg

SEQ ID NO: 5910280 - DNA, 14 bp, Homo sapiens
gcccctgcaaagac

SEQ ID NO: 5910281 - DNA, 16 bp, Homo sapiens
gcccctgcaaagacag

SEQ ID NO: 5910282 - DNA, 13 bp, Homo sapiens
gcccctgcacaaa

SEQ ID NO: 5910283 - DNA, 17 bp, Homo sapiens
gcccctgcacagcaggc

SEQ ID NO: 5910284 - DNA, 22 bp, Homo sapiens
gcccctgcacagcaggctgcca

SEQ ID NO: 5910285 - DNA, 15 bp, Homo sapiens
gcccctgcacaggca

SEQ ID NO: 5910286 - DNA, 16 bp, Homo sapiens
gcccctgcacaggcac

SEQ ID NO: 5910287 - DNA, 19 bp, Homo sapiens
gcccctgcacctgcttctc

SEQ ID NO: 5910288 - DNA, 19 bp, Homo sapiens
gcccctgcagattctgagc

SEQ ID NO: 5910289 - DNA, 15 bp, Homo sapiens
gcccctgcagcacgg

SEQ ID NO: 5910290 - DNA, 14 bp, Homo sapiens
gcccctgcagctgg

SEQ ID NO: 5910291 - DNA, 15 bp, Homo sapiens
gcccctgcaggggag

SEQ ID NO: 5910292 - DNA, 14 bp, Homo sapiens
gcccctgcagttgg

SEQ ID NO: 5910293 - DNA, 17 bp, Homo sapiens
gcccctgcagttggcag

SEQ ID NO: 5910294 - DNA, 19 bp, Homo sapiens
gcccctgcagtttggccct

SEQ ID NO: 5910295 - DNA, 14 bp, Homo sapiens
gcccctgcatcccc

SEQ ID NO: 5910296 - DNA, 20 bp, Homo sapiens
gcccctgcatccccttggct

SEQ ID NO: 5910297 - DNA, 12 bp, Homo sapiens
gcccctgcatgc

SEQ ID NO: 5910298 - DNA, 14 bp, Homo sapiens
gcccctgcatgcct

SEQ ID NO: 5910299 - DNA, 20 bp, Homo sapiens
gcccctgcatgcctggcccc

SEQ ID NO: 5910300 - DNA, 22 bp, Homo sapiens
gcccctgcatgcctggcccctc

SEQ ID NO: 5910301 - DNA, 14 bp, Homo sapiens
gcccctgccaaggc

SEQ ID NO: 5910302 - DNA, 15 bp, Homo sapiens
gcccctgccaccctg

SEQ ID NO: 5910303 - DNA, 11 bp, Homo sapiens
gcccctgccag

SEQ ID NO: 5910304 - DNA, 16 bp, Homo sapiens
gcccctgccagacccc

SEQ ID NO: 5910305 - DNA, 19 bp, Homo sapiens
gcccctgcccagcacctcc

SEQ ID NO: 5910306 - DNA, 20 bp, Homo sapiens
gcccctgcccagcacctcct

SEQ ID NO: 5910307 - DNA, 11 bp, Homo sapiens
gcccctgcccc

SEQ ID NO: 5910308 - DNA, 14 bp, Homo sapiens
gcccctgccccaac

SEQ ID NO: 5910309 - DNA, 20 bp, Homo sapiens
gcccctgccccagcccaagt

SEQ ID NO: 5910310 - DNA, 17 bp, Homo sapiens
gcccctgcccccaaagg

SEQ ID NO: 5910311 - DNA, 15 bp, Homo sapiens
gcccctgccccgccc

SEQ ID NO: 5910312 - DNA, 18 bp, Homo sapiens
gcccctgccccgccccca

SEQ ID NO: 5910313 - DNA, 14 bp, Homo sapiens
gcccctgccccgtc

SEQ ID NO: 5910314 - DNA, 16 bp, Homo sapiens
gcccctgccccgtcac

SEQ ID NO: 5910315 - DNA, 20 bp, Homo sapiens
gcccctgcccctgcccgaga

SEQ ID NO: 5910316 - DNA, 15 bp, Homo sapiens
gcccctgcccgagag

SEQ ID NO: 5910317 - DNA, 19 bp, Homo sapiens
gcccctgcccgagagctct

SEQ ID NO: 5910318 - DNA, 13 bp, Homo sapiens
gcccctgcccggc

SEQ ID NO: 5910319 - DNA, 14 bp, Homo sapiens
gcccctgcccggct

SEQ ID NO: 5910320 - DNA, 16 bp, Homo sapiens
gcccctgccctgagga

SEQ ID NO: 5910321 - DNA, 15 bp, Homo sapiens
gcccctgcctctctg

SEQ ID NO: 5910322 - DNA, 16 bp, Homo sapiens
gcccctgcctctctgc

SEQ ID NO: 5910323 - DNA, 17 bp, Homo sapiens
gcccctgcctctctgca

SEQ ID NO: 5910324 - DNA, 22 bp, Homo sapiens
gcccctgcctgacagccttccc

SEQ ID NO: 5910325 - DNA, 15 bp, Homo sapiens
gcccctgcctgccat

SEQ ID NO: 5910326 - DNA, 15 bp, Homo sapiens
gcccctgcctgggtc

SEQ ID NO: 5910327 - DNA, 23 bp, Homo sapiens
gcccctgcctgggtctccacatc

SEQ ID NO: 5910328 - DNA, 16 bp, Homo sapiens
gcccctgcgtggcctg

SEQ ID NO: 5910329 - DNA, 23 bp, Homo sapiens
gcccctgcgtggcctgagtcctg

SEQ ID NO: 5910330 - DNA, 21 bp, Homo sapiens
gcccctgcgtgggggccagtc

SEQ ID NO: 5910331 - DNA, 12 bp, Homo sapiens
gcccctgctcac

SEQ ID NO: 5910332 - DNA, 20 bp, Homo sapiens
gcccctgctcactgggcccg

SEQ ID NO: 5910333 - DNA, 11 bp, Homo sapiens
gcccctgctct

SEQ ID NO: 5910334 - DNA, 10 bp, Homo sapiens
gcccctgctg

SEQ ID NO: 5910335 - DNA, 15 bp, Homo sapiens
gcccctgctgcctcc

SEQ ID NO: 5910336 - DNA, 14 bp, Homo sapiens
gcccctgctggacc

SEQ ID NO: 5910337 - DNA, 17 bp, Homo sapiens
gcccctgctggaccaag

SEQ ID NO: 5910338 - DNA, 15 bp, Homo sapiens
gcccctgctggttca

SEQ ID NO: 5910339 - DNA, 16 bp, Homo sapiens
gcccctgctggttcag

SEQ ID NO: 5910340 - DNA, 21 bp, Homo sapiens
gcccctgctggttcagggttg

SEQ ID NO: 5910341 - DNA, 13 bp, Homo sapiens
gcccctgctgtct

SEQ ID NO: 5910342 - DNA, 17 bp, Homo sapiens
gcccctgctgtctctct

SEQ ID NO: 5910343 - DNA, 21 bp, Homo sapiens
gcccctgctgtctctctgggc

SEQ ID NO: 5910344 - DNA, 20 bp, Homo sapiens
gcccctgctgtgctgctcaa

SEQ ID NO: 5910345 - DNA, 16 bp, Homo sapiens
gcccctgcttctccag

SEQ ID NO: 5910346 - DNA, 21 bp, Homo sapiens
gcccctggaacctttcccttg

SEQ ID NO: 5910347 - DNA, 19 bp, Homo sapiens
gcccctggacaagcagagg

SEQ ID NO: 5910348 - DNA, 23 bp, Homo sapiens
gcccctggacatgcctgtcctga

SEQ ID NO: 5910349 - DNA, 17 bp, Homo sapiens
gcccctggacctgggaa

SEQ ID NO: 5910350 - DNA, 18 bp, Homo sapiens
gcccctggagctcctgct

SEQ ID NO: 5910351 - DNA, 21 bp, Homo sapiens
gcccctggaggctgcctccca

SEQ ID NO: 5910352 - DNA, 22 bp, Homo sapiens
gcccctggaggctgcctcccaa

SEQ ID NO: 5910353 - DNA, 19 bp, Homo sapiens
gcccctggatctcctccct

SEQ ID NO: 5910354 - DNA, 15 bp, Homo sapiens
gcccctggatgcagc

SEQ ID NO: 5910355 - DNA, 22 bp, Homo sapiens
gcccctggatgcagcctcacag

SEQ ID NO: 5910356 - DNA, 22 bp, Homo sapiens
gcccctggcacgtcctccaccg

SEQ ID NO: 5910357 - DNA, 23 bp, Homo sapiens
gcccctggcacgtcctccaccgg

SEQ ID NO: 5910358 - DNA, 21 bp, Homo sapiens
gcccctggcagagatgcctcc

SEQ ID NO: 5910359 - DNA, 23 bp, Homo sapiens
gcccctggcagagatgcctccct

SEQ ID NO: 5910360 - DNA, 12 bp, Homo sapiens
gcccctggcagc

SEQ ID NO: 5910361 - DNA, 23 bp, Homo sapiens
gcccctggcagcccctgttctgg

SEQ ID NO: 5910362 - DNA, 16 bp, Homo sapiens
gcccctggcccagcgg

SEQ ID NO: 5910363 - DNA, 18 bp, Homo sapiens
gcccctggcccagcggcc

SEQ ID NO: 5910364 - DNA, 15 bp, Homo sapiens
gcccctggcccagga

SEQ ID NO: 5910365 - DNA, 20 bp, Homo sapiens
gcccctggcccaggaggagg

SEQ ID NO: 5910366 - DNA, 13 bp, Homo sapiens
gcccctggcccca

SEQ ID NO: 5910367 - DNA, 14 bp, Homo sapiens
gcccctggccccag

SEQ ID NO: 5910368 - DNA, 14 bp, Homo sapiens
gcccctggctggga

SEQ ID NO: 5910369 - DNA, 23 bp, Homo sapiens
gcccctggctgggacgtggctca

SEQ ID NO: 5910370 - DNA, 17 bp, Homo sapiens
gcccctggctttgcctc

SEQ ID NO: 5910371 - DNA, 20 bp, Homo sapiens
gcccctggctttgcctcttc

SEQ ID NO: 5910372 - DNA, 19 bp, Homo sapiens
gcccctgggaacaggcccc

SEQ ID NO: 5910373 - DNA, 20 bp, Homo sapiens
gcccctgggaacaggcccca

SEQ ID NO: 5910374 - DNA, 12 bp, Homo sapiens
gcccctgggact

SEQ ID NO: 5910375 - DNA, 20 bp, Homo sapiens
gcccctgggatgggaccagg

SEQ ID NO: 5910376 - DNA, 18 bp, Homo sapiens
gcccctgggcccttgtgc

SEQ ID NO: 5910377 - DNA, 22 bp, Homo sapiens
gcccctgggcccttgtgctcct

SEQ ID NO: 5910378 - DNA, 22 bp, Homo sapiens
gcccctgggctaccatctgcat

SEQ ID NO: 5910379 - DNA, 12 bp, Homo sapiens
gcccctgggctc

SEQ ID NO: 5910380 - DNA, 15 bp, Homo sapiens
gcccctgggctctca

SEQ ID NO: 5910381 - DNA, 17 bp, Homo sapiens
gcccctgggctctcacc

SEQ ID NO: 5910382 - DNA, 19 bp, Homo sapiens
gcccctgggctctcaccca

SEQ ID NO: 5910383 - DNA, 23 bp, Homo sapiens
gcccctgggcttggcctgctgtg

SEQ ID NO: 5910384 - DNA, 12 bp, Homo sapiens
gcccctggggaa

SEQ ID NO: 5910385 - DNA, 20 bp, Homo sapiens
gcccctggggacagagccac

SEQ ID NO: 5910386 - DNA, 20 bp, Homo sapiens
gcccctggggctcccgaaga

SEQ ID NO: 5910387 - DNA, 23 bp, Homo sapiens
gcccctggggctgtatttatctc

SEQ ID NO: 5910388 - DNA, 17 bp, Homo sapiens
gcccctgggtccttcta

SEQ ID NO: 5910389 - DNA, 20 bp, Homo sapiens
gcccctggtccctctgcagt

SEQ ID NO: 5910390 - DNA, 17 bp, Homo sapiens
gcccctggtctgccctg

SEQ ID NO: 5910391 - DNA, 19 bp, Homo sapiens
gcccctggtcttctctaca

SEQ ID NO: 5910392 - DNA, 11 bp, Homo sapiens
gcccctggtgg

SEQ ID NO: 5910393 - DNA, 23 bp, Homo sapiens
gcccctggtggtcacaggctgtg

SEQ ID NO: 5910394 - DNA, 18 bp, Homo sapiens
gcccctgtaggttgctta

SEQ ID NO: 5910395 - DNA, 15 bp, Homo sapiens
gcccctgtccatccg

SEQ ID NO: 5910396 - DNA, 14 bp, Homo sapiens
gcccctgtccccag

SEQ ID NO: 5910397 - DNA, 16 bp, Homo sapiens
gcccctgtcgcccacc

SEQ ID NO: 5910398 - DNA, 19 bp, Homo sapiens
gcccctgtctagagaggga

SEQ ID NO: 5910399 - DNA, 20 bp, Homo sapiens
gcccctgtctgttcccagcc

SEQ ID NO: 5910400 - DNA, 23 bp, Homo sapiens
gcccctgtctgttcccagcccct

SEQ ID NO: 5910401 - DNA, 21 bp, Homo sapiens
gcccctgtcttcggccgagct

SEQ ID NO: 5910402 - DNA, 14 bp, Homo sapiens
gcccctgtgcagta

SEQ ID NO: 5910403 - DNA, 21 bp, Homo sapiens
gcccctgtgcagtagagagcc

SEQ ID NO: 5910404 - DNA, 22 bp, Homo sapiens
gcccctgtgcagtagagagcct

SEQ ID NO: 5910405 - DNA, 15 bp, Homo sapiens
gcccctgtgcctctg

SEQ ID NO: 5910406 - DNA, 17 bp, Homo sapiens
gcccctgtgctgcgggg

SEQ ID NO: 5910407 - DNA, 18 bp, Homo sapiens
gcccctgtggagactggg

SEQ ID NO: 5910408 - DNA, 11 bp, Homo sapiens
gcccctgtggc

SEQ ID NO: 5910409 - DNA, 17 bp, Homo sapiens
gcccctgtggccctggc

SEQ ID NO: 5910410 - DNA, 24 bp, Homo sapiens
gcccctgtgtgagttgagtctcct

SEQ ID NO: 5910411 - DNA, 17 bp, Homo sapiens
gcccctgtgtgggaggg

SEQ ID NO: 5910412 - DNA, 18 bp, Homo sapiens
gcccctgtgttggggggc

SEQ ID NO: 5910413 - DNA, 22 bp, Homo sapiens
gcccctgtgttggggggcaagg

SEQ ID NO: 5910414 - DNA, 22 bp, Homo sapiens
gcccctgttacctaattagagc

SEQ ID NO: 5910415 - DNA, 16 bp, Homo sapiens
gcccctgtttctcctc

SEQ ID NO: 5910416 - DNA, 18 bp, Homo sapiens
gcccctgtttctcctcca

SEQ ID NO: 5910417 - DNA, 19 bp, Homo sapiens
gcccctgtttctcctccat

SEQ ID NO: 5910418 - DNA, 21 bp, Homo sapiens
gccccttaaacacaggctgtc

SEQ ID NO: 5910419 - DNA, 23 bp, Homo sapiens
gccccttaaatttctgccctgag

SEQ ID NO: 5910420 - DNA, 19 bp, Homo sapiens
gccccttaaccccaaggac

SEQ ID NO: 5910421 - DNA, 23 bp, Homo sapiens
gccccttaagggttgaaggcagt

SEQ ID NO: 5910422 - DNA, 17 bp, Homo sapiens
gccccttagacagaggc

SEQ ID NO: 5910423 - DNA, 17 bp, Homo sapiens
gccccttagcccccacc

SEQ ID NO: 5910424 - DNA, 18 bp, Homo sapiens
gccccttcactcattttt

SEQ ID NO: 5910425 - DNA, 21 bp, Homo sapiens
gccccttcacttctgaccaca

SEQ ID NO: 5910426 - DNA, 14 bp, Homo sapiens
gcccgcggcctgga

SEQ ID NO: 5910427 - DNA, 15 bp, Homo sapiens
gcccgcggcctggac

SEQ ID NO: 5910428 - DNA, 20 bp, Homo sapiens
gcccgcggcgcgaccctccc

SEQ ID NO: 5910429 - DNA, 17 bp, Homo sapiens
gcccgcgtctgtgccgc

SEQ ID NO: 5910430 - DNA, 18 bp, Homo sapiens
gcccgctcaacctctcag

SEQ ID NO: 5910431 - DNA, 23 bp, Homo sapiens
gcccgctcccaacccccctcctg

SEQ ID NO: 5910432 - DNA, 12 bp, Homo sapiens
gcccgctcccac

SEQ ID NO: 5910433 - DNA, 21 bp, Homo sapiens
gcccgctcccttcctgccact

SEQ ID NO: 5910434 - DNA, 22 bp, Homo sapiens
gcccgctcccttcctgccactg

SEQ ID NO: 5910435 - DNA, 17 bp, Homo sapiens
gcccgctcctgccgcag

SEQ ID NO: 5910436 - DNA, 18 bp, Homo sapiens
gcccgctcctgccgcaga

SEQ ID NO: 5910437 - DNA, 22 bp, Homo sapiens
gcccgctcctgccgcagacggg

SEQ ID NO: 5910438 - DNA, 21 bp, Homo sapiens
gcccgctgagctgagtggcca

SEQ ID NO: 5910439 - DNA, 22 bp, Homo sapiens
gcccgctgagctgagtggccag

SEQ ID NO: 5910440 - DNA, 13 bp, Homo sapiens
gcccgctgcctct

SEQ ID NO: 5910441 - DNA, 15 bp, Homo sapiens
gcccgctgcgctgcc

SEQ ID NO: 5910442 - DNA, 21 bp, Homo sapiens
gcccgctgcgtgccatcactc

SEQ ID NO: 5910443 - DNA, 12 bp, Homo sapiens
gcccgctgggct

SEQ ID NO: 5910444 - DNA, 13 bp, Homo sapiens
gcccgctggggac

SEQ ID NO: 5910445 - DNA, 12 bp, Homo sapiens
gcccgcttgcct

SEQ ID NO: 5910446 - DNA, 18 bp, Homo sapiens
gcccgcttgcctcggctc

SEQ ID NO: 5910447 - DNA, 19 bp, Homo sapiens
gcccgcttgctcgcttgct

SEQ ID NO: 5910448 - DNA, 21 bp, Homo sapiens
gcccgcttgctcgcttgctgg

SEQ ID NO: 5910449 - DNA, 12 bp, Homo sapiens
gcccgcttggcc

SEQ ID NO: 5910450 - DNA, 15 bp, Homo sapiens
gcccgcttggccacc

SEQ ID NO: 5910451 - DNA, 16 bp, Homo sapiens
gcccgctttgcctgct

SEQ ID NO: 5910452 - DNA, 15 bp, Homo sapiens
gcccgcttttgttct

SEQ ID NO: 5910453 - DNA, 21 bp, Homo sapiens
gcccggaagcgccaggctgga

SEQ ID NO: 5910454 - DNA, 18 bp, Homo sapiens
gcccggaagttgctgtgc

SEQ ID NO: 5910455 - DNA, 17 bp, Homo sapiens
gcccggactcaccaact

SEQ ID NO: 5910456 - DNA, 15 bp, Homo sapiens
gcccggagaaacctg

SEQ ID NO: 5910457 - DNA, 22 bp, Homo sapiens
gcccggagatgcatctgtggcc

SEQ ID NO: 5910458 - DNA, 14 bp, Homo sapiens
gcccggagcagcag

SEQ ID NO: 5910459 - DNA, 20 bp, Homo sapiens
gcccggagtaatcaggcagc

SEQ ID NO: 5910460 - DNA, 15 bp, Homo sapiens
gcccggatgctgctt

SEQ ID NO: 5910461 - DNA, 19 bp, Homo sapiens
gcccggcagccccttctgg

SEQ ID NO: 5910462 - DNA, 17 bp, Homo sapiens
gcccggcagggcgggca

SEQ ID NO: 5910463 - DNA, 15 bp, Homo sapiens
gcccggcatgaggcc

SEQ ID NO: 5910464 - DNA, 16 bp, Homo sapiens
gcccggcatgaggccc

SEQ ID NO: 5910465 - DNA, 14 bp, Homo sapiens
gcccggccacaccc

SEQ ID NO: 5910466 - DNA, 11 bp, Homo sapiens
gcccggccagc

SEQ ID NO: 5910467 - DNA, 18 bp, Homo sapiens
gcccggccagcgggcaca

SEQ ID NO: 5910468 - DNA, 15 bp, Homo sapiens
gcccggccagggcct

SEQ ID NO: 5910469 - DNA, 16 bp, Homo sapiens
gcccggccagggcctg

SEQ ID NO: 5910470 - DNA, 20 bp, Homo sapiens
gcccggcccacacccgacac

SEQ ID NO: 5910471 - DNA, 21 bp, Homo sapiens
gcccggcccaccagggactgc

SEQ ID NO: 5910472 - DNA, 23 bp, Homo sapiens
gcccggcccacgcagagccccgg

SEQ ID NO: 5910473 - DNA, 15 bp, Homo sapiens
gcccggcccaggagc

SEQ ID NO: 5910474 - DNA, 20 bp, Homo sapiens
gcccggccccatcagaggct

SEQ ID NO: 5910475 - DNA, 19 bp, Homo sapiens
gcccggcccctcaccctct

SEQ ID NO: 5910476 - DNA, 23 bp, Homo sapiens
gcccggcccctcaccctctgtcc

SEQ ID NO: 5910477 - DNA, 21 bp, Homo sapiens
gcccggccctcccccagctcc

SEQ ID NO: 5910478 - DNA, 22 bp, Homo sapiens
gcccggccgccccgccccagag

SEQ ID NO: 5910479 - DNA, 20 bp, Homo sapiens
gcccggccgctccaccagca

SEQ ID NO: 5910480 - DNA, 14 bp, Homo sapiens
gcccggccggaggg

SEQ ID NO: 5910481 - DNA, 15 bp, Homo sapiens
gcccggccggcctgg

SEQ ID NO: 5910482 - DNA, 17 bp, Homo sapiens
gcccggcctcctagcct

SEQ ID NO: 5910483 - DNA, 19 bp, Homo sapiens
gcccggcctcctagcctct

SEQ ID NO: 5910484 - DNA, 22 bp, Homo sapiens
gcccggcctgctcccagcagcc

SEQ ID NO: 5910485 - DNA, 16 bp, Homo sapiens
gcccggcgccgggcac

SEQ ID NO: 5910486 - DNA, 20 bp, Homo sapiens
gcccggcgccgggcaccaac

SEQ ID NO: 5910487 - DNA, 14 bp, Homo sapiens
gcccggcgcctgcc

SEQ ID NO: 5910488 - DNA, 15 bp, Homo sapiens
gcccggcgcctgccc

SEQ ID NO: 5910489 - DNA, 17 bp, Homo sapiens
gcccggcgcctgccctg

SEQ ID NO: 5910490 - DNA, 18 bp, Homo sapiens
gcccggcgcctggcctcc

SEQ ID NO: 5910491 - DNA, 20 bp, Homo sapiens
gcccggcgcctggcctccag

SEQ ID NO: 5910492 - DNA, 21 bp, Homo sapiens
gcccggcgcctggcctccagg

SEQ ID NO: 5910493 - DNA, 20 bp, Homo sapiens
gcccggcgctgattcctcgt

SEQ ID NO: 5910494 - DNA, 22 bp, Homo sapiens
gcccggctaatgtttgtatttt

SEQ ID NO: 5910495 - DNA, 18 bp, Homo sapiens
gcccggctaatttttgta

SEQ ID NO: 5910496 - DNA, 15 bp, Homo sapiens
gcccggctccaggct

SEQ ID NO: 5910497 - DNA, 16 bp, Homo sapiens
gcccggctccaggctc

SEQ ID NO: 5910498 - DNA, 17 bp, Homo sapiens
gcccggctccaggctcc

SEQ ID NO: 5910499 - DNA, 18 bp, Homo sapiens
gcccggctcggcccagca

SEQ ID NO: 5910500 - DNA, 13 bp, Homo sapiens
gcccggctgagcc

SEQ ID NO: 5910501 - DNA, 23 bp, Homo sapiens
gcccggctgagccccccatgccc

SEQ ID NO: 5910502 - DNA, 16 bp, Homo sapiens
gcccggctgggcccga

SEQ ID NO: 5910503 - DNA, 18 bp, Homo sapiens
gcccgggaaggtcaccag

SEQ ID NO: 5910504 - DNA, 14 bp, Homo sapiens
gcccgggagagact

SEQ ID NO: 5910505 - DNA, 16 bp, Homo sapiens
gcccgggagagactcg

SEQ ID NO: 5910506 - DNA, 13 bp, Homo sapiens
gcccgggagccta

SEQ ID NO: 5910507 - DNA, 20 bp, Homo sapiens
gcccgggagcctaggaccac

SEQ ID NO: 5910508 - DNA, 15 bp, Homo sapiens
gcccgggagctcagg

SEQ ID NO: 5910509 - DNA, 14 bp, Homo sapiens
gcccgggagctgct

SEQ ID NO: 5910510 - DNA, 21 bp, Homo sapiens
gcccgggagctttgagacagg

SEQ ID NO: 5910511 - DNA, 21 bp, Homo sapiens
gcccgggaggaggatccgggc

SEQ ID NO: 5910512 - DNA, 13 bp, Homo sapiens
gcccgggatcctg

SEQ ID NO: 5910513 - DNA, 20 bp, Homo sapiens
gcccgggatcctgatggcac

SEQ ID NO: 5910514 - DNA, 13 bp, Homo sapiens
gcccgggcagggg

SEQ ID NO: 5910515 - DNA, 14 bp, Homo sapiens
gcccgggcaggggc

SEQ ID NO: 5910516 - DNA, 14 bp, Homo sapiens
gcccgggcccagag

SEQ ID NO: 5910517 - DNA, 15 bp, Homo sapiens
gcccgggcccaggca

SEQ ID NO: 5910518 - DNA, 13 bp, Homo sapiens
gcccgggcccctg

SEQ ID NO: 5910519 - DNA, 17 bp, Homo sapiens
gcccgggcccctggcac

SEQ ID NO: 5910520 - DNA, 20 bp, Homo sapiens
gcccgggccgaccctgcggc

SEQ ID NO: 5910521 - DNA, 22 bp, Homo sapiens
gcccgggccgaccctgcggcct

SEQ ID NO: 5910522 - DNA, 14 bp, Homo sapiens
gcccgggctctgcc

SEQ ID NO: 5910523 - DNA, 15 bp, Homo sapiens
gcccgggctctgcct

SEQ ID NO: 5910524 - DNA, 23 bp, Homo sapiens
gcccgggctctgcctcccatcac

SEQ ID NO: 5910525 - DNA, 13 bp, Homo sapiens
gcccgggctgcct

SEQ ID NO: 5910526 - DNA, 16 bp, Homo sapiens
gcccgggctgcctggg

SEQ ID NO: 5910527 - DNA, 17 bp, Homo sapiens
gcccgggctgcctgggc

SEQ ID NO: 5910528 - DNA, 14 bp, Homo sapiens
gcccggggagctgc

SEQ ID NO: 5910529 - DNA, 17 bp, Homo sapiens
gcccggggagctgcaga

SEQ ID NO: 5910530 - DNA, 16 bp, Homo sapiens
gcccggggcagagctc

SEQ ID NO: 5910531 - DNA, 20 bp, Homo sapiens
gcccggggcagagctcagag

SEQ ID NO: 5910532 - DNA, 23 bp, Homo sapiens
gcccggggcagcagcagccctgc

SEQ ID NO: 5910533 - DNA, 17 bp, Homo sapiens
gcccggggcagctgcca

SEQ ID NO: 5910534 - DNA, 22 bp, Homo sapiens
gcccggggcagctgccagagaa

SEQ ID NO: 5910535 - DNA, 13 bp, Homo sapiens
gcccggggtgggg

SEQ ID NO: 5910536 - DNA, 20 bp, Homo sapiens
gcccgggtgtgcctgccctg

SEQ ID NO: 5910537 - DNA, 14 bp, Homo sapiens
gcccggtccacagg

SEQ ID NO: 5910538 - DNA, 16 bp, Homo sapiens
gcccggtccacaggtc

SEQ ID NO: 5910539 - DNA, 16 bp, Homo sapiens
gcccggtcccacccct

SEQ ID NO: 5910540 - DNA, 19 bp, Homo sapiens
gcccggtgcagggcctggc

SEQ ID NO: 5910541 - DNA, 20 bp, Homo sapiens
gcccggtgcagggcctggca

SEQ ID NO: 5910542 - DNA, 21 bp, Homo sapiens
gcccggtgcagggcctggcat

SEQ ID NO: 5910543 - DNA, 15 bp, Homo sapiens
gcccggtgccatctt

SEQ ID NO: 5910544 - DNA, 17 bp, Homo sapiens
gcccggtgccatcttcc

SEQ ID NO: 5910545 - DNA, 18 bp, Homo sapiens
gcccggtgccatcttcca

SEQ ID NO: 5910546 - DNA, 19 bp, Homo sapiens
gcccggtggcggcagggcc

SEQ ID NO: 5910547 - DNA, 19 bp, Homo sapiens
gcccggtgggggggcagag

SEQ ID NO: 5910548 - DNA, 14 bp, Homo sapiens
gcccggtgtgagga

SEQ ID NO: 5910549 - DNA, 15 bp, Homo sapiens
gcccggtgttcagtg

SEQ ID NO: 5910550 - DNA, 17 bp, Homo sapiens
gcccggttgccatggag

SEQ ID NO: 5910551 - DNA, 17 bp, Homo sapiens
gcccgtaaacacgcctg

SEQ ID NO: 5910552 - DNA, 16 bp, Homo sapiens
gcccgtaatcccagct

SEQ ID NO: 5910553 - DNA, 17 bp, Homo sapiens
gcccgtaatcccagcta

SEQ ID NO: 5910554 - DNA, 23 bp, Homo sapiens
gcccgtagatcatccccgagggc

SEQ ID NO: 5910555 - DNA, 21 bp, Homo sapiens
gcccgtcacccttatttatta

SEQ ID NO: 5910556 - DNA, 13 bp, Homo sapiens
gcccgtcagcgtg

SEQ ID NO: 5910557 - DNA, 14 bp, Homo sapiens
gcccgtcaggccac

SEQ ID NO: 5910558 - DNA, 18 bp, Homo sapiens
gcccgtcaggccacagcc

SEQ ID NO: 5910559 - DNA, 14 bp, Homo sapiens
gcccgtcctgcctg

SEQ ID NO: 5910560 - DNA, 16 bp, Homo sapiens
gcccgtcctgcctgtg

SEQ ID NO: 5910561 - DNA, 17 bp, Homo sapiens
gcccgtcctgcctgtgg

SEQ ID NO: 5910562 - DNA, 18 bp, Homo sapiens
gcccgtcctgcctgtggc

SEQ ID NO: 5910563 - DNA, 18 bp, Homo sapiens
gcccgtcgcgctggacag

SEQ ID NO: 5910564 - DNA, 21 bp, Homo sapiens
gcccgtcgcgctggacagctt

SEQ ID NO: 5910565 - DNA, 14 bp, Homo sapiens
gcccgtcggagctg

SEQ ID NO: 5910566 - DNA, 18 bp, Homo sapiens
gcccgtcggagctgcctg

SEQ ID NO: 5910567 - DNA, 16 bp, Homo sapiens
gcccgtctctttctca

SEQ ID NO: 5910568 - DNA, 18 bp, Homo sapiens
gcccgtctgtccatctgc

SEQ ID NO: 5910569 - DNA, 19 bp, Homo sapiens
gcccgtctgtccatctgcc

SEQ ID NO: 5910570 - DNA, 21 bp, Homo sapiens
gcccgtctgtccatctgcccg

SEQ ID NO: 5910571 - DNA, 16 bp, Homo sapiens
gcccgtcttcagccta

SEQ ID NO: 5910572 - DNA, 17 bp, Homo sapiens
gcccgtcttcagcctag

SEQ ID NO: 5910573 - DNA, 13 bp, Homo sapiens
gcccgtgaagcag

SEQ ID NO: 5910574 - DNA, 14 bp, Homo sapiens
gcccgtgaagcagt

SEQ ID NO: 5910575 - DNA, 20 bp, Homo sapiens
gcccgtgaagcagtgcctcg

SEQ ID NO: 5910576 - DNA, 21 bp, Homo sapiens
gcccgtgacagatgccaactt

SEQ ID NO: 5910577 - DNA, 18 bp, Homo sapiens
gcccgtgcagtacaggca

SEQ ID NO: 5910578 - DNA, 22 bp, Homo sapiens
gcccgtgcccagccctaaagtt

SEQ ID NO: 5910579 - DNA, 23 bp, Homo sapiens
gcccgtgcccccgcctgccaccg

SEQ ID NO: 5910580 - DNA, 23 bp, Homo sapiens
gcccgtgccctggtgaatcacct

SEQ ID NO: 5910581 - DNA, 21 bp, Homo sapiens
gcccgtgcgcagccgcgctct

SEQ ID NO: 5910582 - DNA, 24 bp, Homo sapiens
gcccgtgcgcagccgcgctctgcc

SEQ ID NO: 5910583 - DNA, 21 bp, Homo sapiens
gcccgtggacaccccagacct

SEQ ID NO: 5910584 - DNA, 18 bp, Homo sapiens
gcccgtggcctggcatct

SEQ ID NO: 5910585 - DNA, 22 bp, Homo sapiens
gcccgtggcttggcatctgtgt

SEQ ID NO: 5910586 - DNA, 15 bp, Homo sapiens
gcccgtggggccggg

SEQ ID NO: 5910587 - DNA, 22 bp, Homo sapiens
gcccgtggtggcggtggctgcc

SEQ ID NO: 5910588 - DNA, 17 bp, Homo sapiens
gcccgtgtacatagtgc

SEQ ID NO: 5910589 - DNA, 14 bp, Homo sapiens
gcccgtgtcctgcc

SEQ ID NO: 5910590 - DNA, 15 bp, Homo sapiens
gcccgtgtcctgcct

SEQ ID NO: 5910591 - DNA, 18 bp, Homo sapiens
gcccgtgtggcctgggtc

SEQ ID NO: 5910592 - DNA, 24 bp, Homo sapiens
gcccgtgtggcctgggtcctcggc

SEQ ID NO: 5910593 - DNA, 13 bp, Homo sapiens
gcccgtgtgtgtg

SEQ ID NO: 5910594 - DNA, 17 bp, Homo sapiens
gcccgttgaggatgagg

SEQ ID NO: 5910595 - DNA, 20 bp, Homo sapiens
gcccgttgccgggcctggac

SEQ ID NO: 5910596 - DNA, 16 bp, Homo sapiens
gcccgttgtctccctg

SEQ ID NO: 5910597 - DNA, 17 bp, Homo sapiens
gcccgttgtctccctgg

SEQ ID NO: 5910598 - DNA, 18 bp, Homo sapiens
gcccgttgtctccctggc

SEQ ID NO: 5910599 - DNA, 21 bp, Homo sapiens
gcccgttgtctccctggccct

SEQ ID NO: 5910600 - DNA, 15 bp, Homo sapiens
gcccgtttcagaagg

SEQ ID NO: 5910601 - DNA, 18 bp, Homo sapiens
gcccgttttaccaataaa

SEQ ID NO: 5910602 - DNA, 22 bp, Homo sapiens
gcccgttttaccaataaactga

SEQ ID NO: 5910603 - DNA, 12 bp, Homo sapiens
gccctcttgcca

SEQ ID NO: 5910604 - DNA, 14 bp, Homo sapiens
gccctcttgccagc

SEQ ID NO: 5910605 - DNA, 20 bp, Homo sapiens
gccctcttgccagcctcctt

SEQ ID NO: 5910606 - DNA, 23 bp, Homo sapiens
gccctcttgccagcctccttgct

SEQ ID NO: 5910607 - DNA, 17 bp, Homo sapiens
gccctcttgcgggcctg

SEQ ID NO: 5910608 - DNA, 14 bp, Homo sapiens
gccctcttgggggc

SEQ ID NO: 5910609 - DNA, 13 bp, Homo sapiens
gccctctttccct

SEQ ID NO: 5910610 - DNA, 15 bp, Homo sapiens
gccctctttctctct

SEQ ID NO: 5910611 - DNA, 21 bp, Homo sapiens
gccctgaaagtcccagatcaa

SEQ ID NO: 5910612 - DNA, 17 bp, Homo sapiens
gccctgaaccacgaggc

SEQ ID NO: 5910613 - DNA, 14 bp, Homo sapiens
gccctgaagggggc

SEQ ID NO: 5910614 - DNA, 18 bp, Homo sapiens
gccctgacaggccttcct

SEQ ID NO: 5910615 - DNA, 21 bp, Homo sapiens
gccctgacatgctaacctctc

SEQ ID NO: 5910616 - DNA, 12 bp, Homo sapiens
gccctgacctcc

SEQ ID NO: 5910617 - DNA, 15 bp, Homo sapiens
gccctgacctcccag

SEQ ID NO: 5910618 - DNA, 20 bp, Homo sapiens
gccctgactaaactaccacc

SEQ ID NO: 5910619 - DNA, 17 bp, Homo sapiens
gccctgactcctctggc

SEQ ID NO: 5910620 - DNA, 13 bp, Homo sapiens
gccctgactcctg

SEQ ID NO: 5910621 - DNA, 20 bp, Homo sapiens
gccctgactgtcagggaggg

SEQ ID NO: 5910622 - DNA, 22 bp, Homo sapiens
gccctgactgtcagggagggcc

SEQ ID NO: 5910623 - DNA, 16 bp, Homo sapiens
gccctgacttctggag

SEQ ID NO: 5910624 - DNA, 17 bp, Homo sapiens
gccctgacttctggaga

SEQ ID NO: 5910625 - DNA, 19 bp, Homo sapiens
gccctgacttctggagatg

SEQ ID NO: 5910626 - DNA, 16 bp, Homo sapiens
gccctgagaagatcta

SEQ ID NO: 5910627 - DNA, 11 bp, Homo sapiens
gccctgagact

SEQ ID NO: 5910628 - DNA, 22 bp, Homo sapiens
gccctgagactcccgcctttga

SEQ ID NO: 5910629 - DNA, 23 bp, Homo sapiens
gccctgagagtctggtctgcgcc

SEQ ID NO: 5910630 - DNA, 19 bp, Homo sapiens
gccctgagccagggtctcc

SEQ ID NO: 5910631 - DNA, 13 bp, Homo sapiens
gccctgagccatg

SEQ ID NO: 5910632 - DNA, 21 bp, Homo sapiens
gccctgagcccggccctcccc

SEQ ID NO: 5910633 - DNA, 16 bp, Homo sapiens
gccctgagcctggcag

SEQ ID NO: 5910634 - DNA, 17 bp, Homo sapiens
gccctgagcctggcagg

SEQ ID NO: 5910635 - DNA, 18 bp, Homo sapiens
gccctgagcctggcaggt

SEQ ID NO: 5910636 - DNA, 19 bp, Homo sapiens
gccctgagcctggcaggtc

SEQ ID NO: 5910637 - DNA, 21 bp, Homo sapiens
gccctgagctagtgtcacctg

SEQ ID NO: 5910638 - DNA, 23 bp, Homo sapiens
gccctgagctagtgtcacctgca

SEQ ID NO: 5910639 - DNA, 12 bp, Homo sapiens
gccctgagctca

SEQ ID NO: 5910640 - DNA, 14 bp, Homo sapiens
gccctgagctcagg

SEQ ID NO: 5910641 - DNA, 18 bp, Homo sapiens
gccctgagctcaggctga

SEQ ID NO: 5910642 - DNA, 21 bp, Homo sapiens
gccctgagctcaggctgagcc

SEQ ID NO: 5910643 - DNA, 22 bp, Homo sapiens
gccctgagctggcgtcacctgt

SEQ ID NO: 5910644 - DNA, 20 bp, Homo sapiens
gccctgagctttccggggag

SEQ ID NO: 5910645 - DNA, 14 bp, Homo sapiens
gccctgagctttct

SEQ ID NO: 5910646 - DNA, 16 bp, Homo sapiens
gccctgaggaataaag

SEQ ID NO: 5910647 - DNA, 21 bp, Homo sapiens
gccctgaggacagatgcctcc

SEQ ID NO: 5910648 - DNA, 20 bp, Homo sapiens
gccctgaggacctctcagca

SEQ ID NO: 5910649 - DNA, 16 bp, Homo sapiens
gccctgaggaggcctt

SEQ ID NO: 5910650 - DNA, 17 bp, Homo sapiens
gccctgaggagggccct

SEQ ID NO: 5910651 - DNA, 22 bp, Homo sapiens
gccctgaggagggccctgagga

SEQ ID NO: 5910652 - DNA, 20 bp, Homo sapiens
gccctgaggcctagactctg

SEQ ID NO: 5910653 - DNA, 14 bp, Homo sapiens
gccctgaggcctga

SEQ ID NO: 5910654 - DNA, 16 bp, Homo sapiens
gccctgaggcctgagg

SEQ ID NO: 5910655 - DNA, 19 bp, Homo sapiens
gccctgaggcctgaggcct

SEQ ID NO: 5910656 - DNA, 23 bp, Homo sapiens
gccctgaggcctgaggcctgtgc

SEQ ID NO: 5910657 - DNA, 17 bp, Homo sapiens
gccctgaggggcctgcc

SEQ ID NO: 5910658 - DNA, 16 bp, Homo sapiens
gccctgaggggctggg

SEQ ID NO: 5910659 - DNA, 18 bp, Homo sapiens
gccctgaggggctgggct

SEQ ID NO: 5910660 - DNA, 20 bp, Homo sapiens
gccctgaggggctgggctgg

SEQ ID NO: 5910661 - DNA, 21 bp, Homo sapiens
gccctgaggggctggggaggg

SEQ ID NO: 5910662 - DNA, 22 bp, Homo sapiens
gccctgaggggctggggagggg

SEQ ID NO: 5910663 - DNA, 12 bp, Homo sapiens
gccctgaggggt

SEQ ID NO: 5910664 - DNA, 23 bp, Homo sapiens
gccctgaggtgtgggggctgcag

SEQ ID NO: 5910665 - DNA, 22 bp, Homo sapiens
gccctgagtaatcgcttaaaga

SEQ ID NO: 5910666 - DNA, 23 bp, Homo sapiens
gccctgagtcctggtttcctggc

SEQ ID NO: 5910667 - DNA, 23 bp, Homo sapiens
gccctgagtggatctccaaggac

SEQ ID NO: 5910668 - DNA, 16 bp, Homo sapiens
gccctgagtgtcccaa

SEQ ID NO: 5910669 - DNA, 21 bp, Homo sapiens
gccctgatccaggaaaatgtg

SEQ ID NO: 5910670 - DNA, 22 bp, Homo sapiens
gccctgatgtgtcctcagggag

SEQ ID NO: 5910671 - DNA, 19 bp, Homo sapiens
gccctgattgcgcaaaact

SEQ ID NO: 5910672 - DNA, 12 bp, Homo sapiens
gccctgcacaga

SEQ ID NO: 5910673 - DNA, 20 bp, Homo sapiens
gccctgcacagatatttcca

SEQ ID NO: 5910674 - DNA, 17 bp, Homo sapiens
gccctgcaccatgctgc

SEQ ID NO: 5910675 - DNA, 13 bp, Homo sapiens
gccctgcaccttc

SEQ ID NO: 5910676 - DNA, 22 bp, Homo sapiens
gccctgcaccttgggcacggga

SEQ ID NO: 5910677 - DNA, 23 bp, Homo sapiens
gccctgcacgacccctgaatctg

SEQ ID NO: 5910678 - DNA, 16 bp, Homo sapiens
gccctgcactgtcctg

SEQ ID NO: 5910679 - DNA, 20 bp, Homo sapiens
gccctgcactgtcctgctcc

SEQ ID NO: 5910680 - DNA, 13 bp, Homo sapiens
gccctgcagaccc

SEQ ID NO: 5910681 - DNA, 14 bp, Homo sapiens
gccctgcagaccct

SEQ ID NO: 5910682 - DNA, 16 bp, Homo sapiens
gccctgcagaccctgc

SEQ ID NO: 5910683 - DNA, 17 bp, Homo sapiens
gccctgcagaccctgcc

SEQ ID NO: 5910684 - DNA, 16 bp, Homo sapiens
gccctgcagagggacc

SEQ ID NO: 5910685 - DNA, 19 bp, Homo sapiens
gccctgcagagggaccaga

SEQ ID NO: 5910686 - DNA, 14 bp, Homo sapiens
gccctgcagagggc

SEQ ID NO: 5910687 - DNA, 19 bp, Homo sapiens
gccctgcagctctcatgct

SEQ ID NO: 5910688 - DNA, 12 bp, Homo sapiens
gccctgcaggag

SEQ ID NO: 5910689 - DNA, 14 bp, Homo sapiens
gccctgcaggagca

SEQ ID NO: 5910690 - DNA, 18 bp, Homo sapiens
gccctgcaggagcagggc

SEQ ID NO: 5910691 - DNA, 18 bp, Homo sapiens
gccctgcaggaggcctgg

SEQ ID NO: 5910692 - DNA, 21 bp, Homo sapiens
gccctgcaggaggcctgggag

SEQ ID NO: 5910693 - DNA, 15 bp, Homo sapiens
gccctgcaggcacag

SEQ ID NO: 5910694 - DNA, 17 bp, Homo sapiens
gccctgcaggctgcagg

SEQ ID NO: 5910695 - DNA, 23 bp, Homo sapiens
gccctgcaggctgcaggagggca

SEQ ID NO: 5910696 - DNA, 13 bp, Homo sapiens
gccctgcagggcc

SEQ ID NO: 5910697 - DNA, 17 bp, Homo sapiens
gccctgcatctgtctgc

SEQ ID NO: 5910698 - DNA, 21 bp, Homo sapiens
gccctgcatctgtctgctctg

SEQ ID NO: 5910699 - DNA, 22 bp, Homo sapiens
gccctgcatctgtctgctctgc

SEQ ID NO: 5910700 - DNA, 23 bp, Homo sapiens
gccctgcatgctgcccagccact

SEQ ID NO: 5910701 - DNA, 16 bp, Homo sapiens
gccctgcattggcctg

SEQ ID NO: 5910702 - DNA, 18 bp, Homo sapiens
gccctgccaagcagcaga

SEQ ID NO: 5910703 - DNA, 15 bp, Homo sapiens
gccctgccaagcctg

SEQ ID NO: 5910704 - DNA, 17 bp, Homo sapiens
gccctgccaagcctgga

SEQ ID NO: 5910705 - DNA, 21 bp, Homo sapiens
gccctgccaagcctggagccc

SEQ ID NO: 5910706 - DNA, 22 bp, Homo sapiens
gccctgccaagcctggagcccc

SEQ ID NO: 5910707 - DNA, 13 bp, Homo sapiens
gccctgccacctg

SEQ ID NO: 5910708 - DNA, 18 bp, Homo sapiens
gccctgccagagcagggg

SEQ ID NO: 5910709 - DNA, 16 bp, Homo sapiens
gccctgccagctgcag

SEQ ID NO: 5910710 - DNA, 21 bp, Homo sapiens
gccctgccagctgcagcctgg

SEQ ID NO: 5910711 - DNA, 12 bp, Homo sapiens
gccctgccaggc

SEQ ID NO: 5910712 - DNA, 13 bp, Homo sapiens
gccctgccaggct

SEQ ID NO: 5910713 - DNA, 19 bp, Homo sapiens
gccctgccaggctgtcagc

SEQ ID NO: 5910714 - DNA, 12 bp, Homo sapiens
gccctgccatta

SEQ ID NO: 5910715 - DNA, 22 bp, Homo sapiens
gccctgccattctgcatgagct

SEQ ID NO: 5910716 - DNA, 11 bp, Homo sapiens
gccctgcccaa

SEQ ID NO: 5910717 - DNA, 13 bp, Homo sapiens
gccctgcccaagt

SEQ ID NO: 5910718 - DNA, 13 bp, Homo sapiens
gccctgcccacag

SEQ ID NO: 5910719 - DNA, 15 bp, Homo sapiens
gccctgcccacagaa

SEQ ID NO: 5910720 - DNA, 18 bp, Homo sapiens
gccctgcccagccagcca

SEQ ID NO: 5910721 - DNA, 14 bp, Homo sapiens
gccctgcccaggta

SEQ ID NO: 5910722 - DNA, 19 bp, Homo sapiens
gccctgcccatactgagcc

SEQ ID NO: 5910723 - DNA, 14 bp, Homo sapiens
gccctgccccacac

SEQ ID NO: 5910724 - DNA, 19 bp, Homo sapiens
gccctgccccacacaggcc

SEQ ID NO: 5910725 - DNA, 15 bp, Homo sapiens
gccctgccccacacc

SEQ ID NO: 5910726 - DNA, 14 bp, Homo sapiens
gccctgccccaccc

SEQ ID NO: 5910727 - DNA, 15 bp, Homo sapiens
gccctgccccagccc

SEQ ID NO: 5910728 - DNA, 13 bp, Homo sapiens
gccctgccccagg

SEQ ID NO: 5910729 - DNA, 14 bp, Homo sapiens
gccctgccccaggc

SEQ ID NO: 5910730 - DNA, 18 bp, Homo sapiens
gccctgccccaggcctgg

SEQ ID NO: 5910731 - DNA, 21 bp, Homo sapiens
gccctgccccaggcctggacg

SEQ ID NO: 5910732 - DNA, 17 bp, Homo sapiens
gccctgccccatcctgg

SEQ ID NO: 5910733 - DNA, 20 bp, Homo sapiens
gccctgccccatcctgggcc

SEQ ID NO: 5910734 - DNA, 20 bp, Homo sapiens
gccctgcccccaccccttcc

SEQ ID NO: 5910735 - DNA, 21 bp, Homo sapiens
gccctgcccccatctccccag

SEQ ID NO: 5910736 - DNA, 22 bp, Homo sapiens
gccctgcccccatctccccagg

SEQ ID NO: 5910737 - DNA, 12 bp, Homo sapiens
gccctgcccccc

SEQ ID NO: 5910738 - DNA, 22 bp, Homo sapiens
gccctgccccctcgggggcctg

SEQ ID NO: 5910739 - DNA, 17 bp, Homo sapiens
gccctgccccctggctg

SEQ ID NO: 5910740 - DNA, 13 bp, Homo sapiens
gccctgcccctcc

SEQ ID NO: 5910741 - DNA, 16 bp, Homo sapiens
gccctgcccctcccta

SEQ ID NO: 5910742 - DNA, 22 bp, Homo sapiens
gccctgcccctccctagatcca

SEQ ID NO: 5910743 - DNA, 12 bp, Homo sapiens
gccctgcccctg

SEQ ID NO: 5910744 - DNA, 17 bp, Homo sapiens
gccctgcccctgcccca

SEQ ID NO: 5910745 - DNA, 15 bp, Homo sapiens
gccctgcccgcgccc

SEQ ID NO: 5910746 - DNA, 15 bp, Homo sapiens
gccctgccctagctc

SEQ ID NO: 5910747 - DNA, 18 bp, Homo sapiens
gccctgccctcccaagtc

SEQ ID NO: 5910748 - DNA, 15 bp, Homo sapiens
gccctgccctccccc

SEQ ID NO: 5910749 - DNA, 13 bp, Homo sapiens
gccctgccctgag

SEQ ID NO: 5910750 - DNA, 22 bp, Homo sapiens
gccctgccctggccactggccc

SEQ ID NO: 5910751 - DNA, 18 bp, Homo sapiens
gccctgccctggtttcct

SEQ ID NO: 5910752 - DNA, 20 bp, Homo sapiens
gccctgcccttcagcatcct

SEQ ID NO: 5910753 - DNA, 15 bp, Homo sapiens
gccctgcccttccct

SEQ ID NO: 5910754 - DNA, 15 bp, Homo sapiens
gccctgcccttggca

SEQ ID NO: 5910755 - DNA, 21 bp, Homo sapiens
gccctgcccttggcaccacca

SEQ ID NO: 5910756 - DNA, 23 bp, Homo sapiens
gccctgcccttggcaccaccagg

SEQ ID NO: 5910757 - DNA, 14 bp, Homo sapiens
gccctgccgtgggc

SEQ ID NO: 5910758 - DNA, 17 bp, Homo sapiens
gccctgccgtgggcaag

SEQ ID NO: 5910759 - DNA, 23 bp, Homo sapiens
gccctgcctcactgtgacctgct

SEQ ID NO: 5910760 - DNA, 11 bp, Homo sapiens
gccctgcctcc

SEQ ID NO: 5910761 - DNA, 23 bp, Homo sapiens
gccctgcctccaccgagccagct

SEQ ID NO: 5910762 - DNA, 12 bp, Homo sapiens
gccctgcctccc

SEQ ID NO: 5910763 - DNA, 20 bp, Homo sapiens
gccctgcctccctttctggg

SEQ ID NO: 5910764 - DNA, 14 bp, Homo sapiens
gccctgcctcctgg

SEQ ID NO: 5910765 - DNA, 16 bp, Homo sapiens
gccctgcctcctggga

SEQ ID NO: 5910766 - DNA, 17 bp, Homo sapiens
gccctgcctcctgggaa

SEQ ID NO: 5910767 - DNA, 22 bp, Homo sapiens
gccctgcctcctgggaagatga

SEQ ID NO: 5910768 - DNA, 13 bp, Homo sapiens
gccctgcctcttc

SEQ ID NO: 5910769 - DNA, 13 bp, Homo sapiens
gccctgcctgacc

SEQ ID NO: 5910770 - DNA, 13 bp, Homo sapiens
gccctgcctgagg

SEQ ID NO: 5910771 - DNA, 14 bp, Homo sapiens
gccctgcctgagga

SEQ ID NO: 5910772 - DNA, 15 bp, Homo sapiens
gccctgcctgaggag

SEQ ID NO: 5910773 - DNA, 19 bp, Homo sapiens
gccctgcctgagggcccct

SEQ ID NO: 5910774 - DNA, 23 bp, Homo sapiens
gccctgcctgagggcccctctgc

SEQ ID NO: 5910775 - DNA, 15 bp, Homo sapiens
gccctgcctgagggt

SEQ ID NO: 5910776 - DNA, 17 bp, Homo sapiens
gccctgcctgagggtgg

SEQ ID NO: 5910777 - DNA, 12 bp, Homo sapiens
gccctgcctgca

SEQ ID NO: 5910778 - DNA, 14 bp, Homo sapiens
gccctgcctgcagc

SEQ ID NO: 5910779 - DNA, 21 bp, Homo sapiens
gccctgcctgcagccagggct

SEQ ID NO: 5910780 - DNA, 23 bp, Homo sapiens
gccctgcctgcagccagggctgg

SEQ ID NO: 5910781 - DNA, 17 bp, Homo sapiens
gccctgggctgcctcct

SEQ ID NO: 5910782 - DNA, 18 bp, Homo sapiens
gccctgggctggaatcag

SEQ ID NO: 5910783 - DNA, 16 bp, Homo sapiens
gccctgggctggcaca

SEQ ID NO: 5910784 - DNA, 18 bp, Homo sapiens
gccctgggctggcacagc

SEQ ID NO: 5910785 - DNA, 22 bp, Homo sapiens
gccctgggctggcacagcccct

SEQ ID NO: 5910786 - DNA, 21 bp, Homo sapiens
gccctgggctgtctgtcacca

SEQ ID NO: 5910787 - DNA, 14 bp, Homo sapiens
gccctgggcttggc

SEQ ID NO: 5910788 - DNA, 15 bp, Homo sapiens
gccctgggcttggct

SEQ ID NO: 5910789 - DNA, 16 bp, Homo sapiens
gccctgggcttggctc

SEQ ID NO: 5910790 - DNA, 20 bp, Homo sapiens
gccctgggcttggctcttgg

SEQ ID NO: 5910791 - DNA, 22 bp, Homo sapiens
gccctggggagcttttgcccac

SEQ ID NO: 5910792 - DNA, 17 bp, Homo sapiens
gccctggggaggggtgg

SEQ ID NO: 5910793 - DNA, 16 bp, Homo sapiens
gccctggggagtgagc

SEQ ID NO: 5910794 - DNA, 18 bp, Homo sapiens
gccctggggcagggtggg

SEQ ID NO: 5910795 - DNA, 21 bp, Homo sapiens
gccctggggcccctcccctcc

SEQ ID NO: 5910796 - DNA, 18 bp, Homo sapiens
gccctggggcccctcgac

SEQ ID NO: 5910797 - DNA, 19 bp, Homo sapiens
gccctggggcccctcgaca

SEQ ID NO: 5910798 - DNA, 12 bp, Homo sapiens
gccctggggcct

SEQ ID NO: 5910799 - DNA, 18 bp, Homo sapiens
gccctggggcctgtactg

SEQ ID NO: 5910800 - DNA, 19 bp, Homo sapiens
gccctggggcctgtactgc

SEQ ID NO: 5910801 - DNA, 23 bp, Homo sapiens
gccctggggcctgtactgcctgc

SEQ ID NO: 5910802 - DNA, 16 bp, Homo sapiens
gccctggggctgccct

SEQ ID NO: 5910803 - DNA, 15 bp, Homo sapiens
gccctgggggagcct

SEQ ID NO: 5910804 - DNA, 20 bp, Homo sapiens
gccctgggggataccagctg

SEQ ID NO: 5910805 - DNA, 18 bp, Homo sapiens
gccctgggggccagctgg

SEQ ID NO: 5910806 - DNA, 22 bp, Homo sapiens
gccctgggggtctgggcgtcca

SEQ ID NO: 5910807 - DNA, 23 bp, Homo sapiens
gccctgggggtttaagctctgcc

SEQ ID NO: 5910808 - DNA, 14 bp, Homo sapiens
gccctggggtcccc

SEQ ID NO: 5910809 - DNA, 17 bp, Homo sapiens
gccctggggtccccact

SEQ ID NO: 5910810 - DNA, 19 bp, Homo sapiens
gccctggggtccccactcc

SEQ ID NO: 5910811 - DNA, 22 bp, Homo sapiens
gccctggggtccccactccctg

SEQ ID NO: 5910812 - DNA, 20 bp, Homo sapiens
gccctggggtctctgagcag

SEQ ID NO: 5910813 - DNA, 18 bp, Homo sapiens
gccctgggtaccctgagc

SEQ ID NO: 5910814 - DNA, 17 bp, Homo sapiens
gccctgggtcctgcctg

SEQ ID NO: 5910815 - DNA, 23 bp, Homo sapiens
gccctggtaaaagggatacacag

SEQ ID NO: 5910816 - DNA, 17 bp, Homo sapiens
gccctggtatgtgcctg

SEQ ID NO: 5910817 - DNA, 14 bp, Homo sapiens
gccctggtccaggg

SEQ ID NO: 5910818 - DNA, 14 bp, Homo sapiens
gccctggtcctggc

SEQ ID NO: 5910819 - DNA, 19 bp, Homo sapiens
gccctggtcctggcctcct

SEQ ID NO: 5910820 - DNA, 17 bp, Homo sapiens
gccctggtctcagcagc

SEQ ID NO: 5910821 - DNA, 21 bp, Homo sapiens
gccctggtgaccagaccaagg

SEQ ID NO: 5910822 - DNA, 21 bp, Homo sapiens
gccctggtgcgaatggacttt

SEQ ID NO: 5910823 - DNA, 16 bp, Homo sapiens
gccctggtgctgccac

SEQ ID NO: 5910824 - DNA, 21 bp, Homo sapiens
gccctggtgctgccacacttc

SEQ ID NO: 5910825 - DNA, 13 bp, Homo sapiens
gccctggtggaga

SEQ ID NO: 5910826 - DNA, 14 bp, Homo sapiens
gccctggtggagaa

SEQ ID NO: 5910827 - DNA, 18 bp, Homo sapiens
gccctggtggagaaagca

SEQ ID NO: 5910828 - DNA, 21 bp, Homo sapiens
gccctggtggagaaagcactg

SEQ ID NO: 5910829 - DNA, 14 bp, Homo sapiens
gccctggtggcagt

SEQ ID NO: 5910830 - DNA, 18 bp, Homo sapiens
gccctggtggcagtggga

SEQ ID NO: 5910831 - DNA, 19 bp, Homo sapiens
gccctggtggcagtgggag

SEQ ID NO: 5910832 - DNA, 23 bp, Homo sapiens
gccctggtggcagtgggagctgc

SEQ ID NO: 5910833 - DNA, 14 bp, Homo sapiens
gccctggtggccct

SEQ ID NO: 5910834 - DNA, 19 bp, Homo sapiens
gccctggtggcctgcccca

SEQ ID NO: 5910835 - DNA, 24 bp, Homo sapiens
gccctggttagctgacagtcagct

SEQ ID NO: 5910836 - DNA, 14 bp, Homo sapiens
gccctggttcccag

SEQ ID NO: 5910837 - DNA, 12 bp, Homo sapiens
gccctggttcct

SEQ ID NO: 5910838 - DNA, 22 bp, Homo sapiens
gccctggtttcactggcccaag

SEQ ID NO: 5910839 - DNA, 18 bp, Homo sapiens
gccctggtttcctgccct

SEQ ID NO: 5910840 - DNA, 14 bp, Homo sapiens
gccctggtttgttt

SEQ ID NO: 5910841 - DNA, 16 bp, Homo sapiens
gccctggtttgttttc

SEQ ID NO: 5910842 - DNA, 14 bp, Homo sapiens
gccctgtacagtga

SEQ ID NO: 5910843 - DNA, 16 bp, Homo sapiens
gccctgtacagtgaat

SEQ ID NO: 5910844 - DNA, 17 bp, Homo sapiens
gccctgtacccacccca

SEQ ID NO: 5910845 - DNA, 18 bp, Homo sapiens
gccctgtacccaccccag

SEQ ID NO: 5910846 - DNA, 16 bp, Homo sapiens
gccctgtagccctggc

SEQ ID NO: 5910847 - DNA, 17 bp, Homo sapiens
gccctgtagttaggcct

SEQ ID NO: 5910848 - DNA, 19 bp, Homo sapiens
gccctgtagttaggcctgg

SEQ ID NO: 5910849 - DNA, 23 bp, Homo sapiens
gccctgtagttaggcctggctca

SEQ ID NO: 5910850 - DNA, 20 bp, Homo sapiens
gccctgtcagcatgaatttg

SEQ ID NO: 5910851 - DNA, 22 bp, Homo sapiens
gccctgtcagcatgaatttgta

SEQ ID NO: 5910852 - DNA, 15 bp, Homo sapiens
gccctgtccaaaagc

SEQ ID NO: 5910853 - DNA, 23 bp, Homo sapiens
gccctgtccaaaagcgccctcac

SEQ ID NO: 5910854 - DNA, 11 bp, Homo sapiens
gccctgtccag

SEQ ID NO: 5910855 - DNA, 14 bp, Homo sapiens
gccctgtccagccc

SEQ ID NO: 5910856 - DNA, 21 bp, Homo sapiens
gccctgtccagcccccagtgc

SEQ ID NO: 5910857 - DNA, 14 bp, Homo sapiens
gccctgtccagggc

SEQ ID NO: 5910858 - DNA, 12 bp, Homo sapiens
gccctgtcccag

SEQ ID NO: 5910859 - DNA, 16 bp, Homo sapiens
gccctgtcccagcaga

SEQ ID NO: 5910860 - DNA, 18 bp, Homo sapiens
gccctgtcccagcagaag

SEQ ID NO: 5910861 - DNA, 14 bp, Homo sapiens
gccctgtcccctga

SEQ ID NO: 5910862 - DNA, 13 bp, Homo sapiens
gccctgtccctag

SEQ ID NO: 5910863 - DNA, 15 bp, Homo sapiens
gccctgtccctccca

SEQ ID NO: 5910864 - DNA, 16 bp, Homo sapiens
gccctgtccctcccac

SEQ ID NO: 5910865 - DNA, 17 bp, Homo sapiens
gccctgtccctcccacc

SEQ ID NO: 5910866 - DNA, 19 bp, Homo sapiens
gccctgtccctcccacctc

SEQ ID NO: 5910867 - DNA, 20 bp, Homo sapiens
gccctgtccctcccacctct

SEQ ID NO: 5910868 - DNA, 21 bp, Homo sapiens
gccctgtccctcccacctctg

SEQ ID NO: 5910869 - DNA, 22 bp, Homo sapiens
gccctgtccctcccacctctgt

SEQ ID NO: 5910870 - DNA, 20 bp, Homo sapiens
gccctgtccctgtccccctc

SEQ ID NO: 5910871 - DNA, 15 bp, Homo sapiens
gccctgtcctccagc

SEQ ID NO: 5910872 - DNA, 15 bp, Homo sapiens
gccctgtcctgccat

SEQ ID NO: 5910873 - DNA, 14 bp, Homo sapiens
gccctgtcgcccct

SEQ ID NO: 5910874 - DNA, 19 bp, Homo sapiens
gccctgtcgggctttgtgt

SEQ ID NO: 5910875 - DNA, 16 bp, Homo sapiens
gccctgtctctggcta

SEQ ID NO: 5910876 - DNA, 22 bp, Homo sapiens
gccctgtctctggctactccct

SEQ ID NO: 5910877 - DNA, 13 bp, Homo sapiens
gccctgtctggaa

SEQ ID NO: 5910878 - DNA, 19 bp, Homo sapiens
gccctgtgagagccacgct

SEQ ID NO: 5910879 - DNA, 23 bp, Homo sapiens
gccctgtgagagccacgctggcc

SEQ ID NO: 5910880 - DNA, 19 bp, Homo sapiens
gccctgtgaggctgggtcc

SEQ ID NO: 5910881 - DNA, 20 bp, Homo sapiens
gccctgtgcagaccttactc

SEQ ID NO: 5910882 - DNA, 20 bp, Homo sapiens
gccctgtgccccttgacaac

SEQ ID NO: 5910883 - DNA, 22 bp, Homo sapiens
gccctgtgccccttgacaactg

SEQ ID NO: 5910884 - DNA, 15 bp, Homo sapiens
gccctgtgccctctc

SEQ ID NO: 5910885 - DNA, 17 bp, Homo sapiens
gccctgtgccctctcac

SEQ ID NO: 5910886 - DNA, 13 bp, Homo sapiens
gccctgtgcctgg

SEQ ID NO: 5910887 - DNA, 15 bp, Homo sapiens
gccctgtgcctgggc

SEQ ID NO: 5910888 - DNA, 16 bp, Homo sapiens
gccctgtgcctgggcc

SEQ ID NO: 5910889 - DNA, 14 bp, Homo sapiens
gccctgtgctttgg

SEQ ID NO: 5910890 - DNA, 16 bp, Homo sapiens
gccctgtggaagggac

SEQ ID NO: 5910891 - DNA, 17 bp, Homo sapiens
gccctgtggacaggatg

SEQ ID NO: 5910892 - DNA, 24 bp, Homo sapiens
gccctgtggacaggatgaggacag

SEQ ID NO: 5910893 - DNA, 18 bp, Homo sapiens
gccctgtggagtccagct

SEQ ID NO: 5910894 - DNA, 23 bp, Homo sapiens
gccctgtggagtccagctctact

SEQ ID NO: 5910895 - DNA, 23 bp, Homo sapiens
gccctgtggccgactctgcactc

SEQ ID NO: 5910896 - DNA, 14 bp, Homo sapiens
gccctgtggccgcc

SEQ ID NO: 5910897 - DNA, 19 bp, Homo sapiens
gccctgtggccgccacctg

SEQ ID NO: 5910898 - DNA, 21 bp, Homo sapiens
gccctgtggctccaggagcag

SEQ ID NO: 5910899 - DNA, 11 bp, Homo sapiens
gccctgtggga

SEQ ID NO: 5910900 - DNA, 19 bp, Homo sapiens
gccctgtgggaccccaggc

SEQ ID NO: 5910901 - DNA, 18 bp, Homo sapiens
gccctgtgggagccgcag

SEQ ID NO: 5910902 - DNA, 22 bp, Homo sapiens
gccctgtgggagccgcagagcc

SEQ ID NO: 5910903 - DNA, 17 bp, Homo sapiens
gccctgtggtctgggga

SEQ ID NO: 5910904 - DNA, 23 bp, Homo sapiens
gccctgtgtctgtcacaggctgg

SEQ ID NO: 5910905 - DNA, 17 bp, Homo sapiens
gccctgtgttctttccc

SEQ ID NO: 5910906 - DNA, 21 bp, Homo sapiens
gccctgttcacgctcacccag

SEQ ID NO: 5910907 - DNA, 20 bp, Homo sapiens
gccctgttcagctactccca

SEQ ID NO: 5910908 - DNA, 21 bp, Homo sapiens
gccctgttcatgtgcctctgc

SEQ ID NO: 5910909 - DNA, 13 bp, Homo sapiens
gccctgttccctg

SEQ ID NO: 5910910 - DNA, 15 bp, Homo sapiens
gccctgttccctgga

SEQ ID NO: 5910911 - DNA, 16 bp, Homo sapiens
gccctgttccctggag

SEQ ID NO: 5910912 - DNA, 19 bp, Homo sapiens
gccctgttccgcctcactg

SEQ ID NO: 5910913 - DNA, 23 bp, Homo sapiens
gccctgttcctccctcccacact

SEQ ID NO: 5910914 - DNA, 17 bp, Homo sapiens
gccctgttctcctcccc

SEQ ID NO: 5910915 - DNA, 15 bp, Homo sapiens
gccctgttctcctgt

SEQ ID NO: 5910916 - DNA, 16 bp, Homo sapiens
gccctgttcttgaggt

SEQ ID NO: 5910917 - DNA, 16 bp, Homo sapiens
gccctgttgacacagg

SEQ ID NO: 5910918 - DNA, 20 bp, Homo sapiens
gccctgttgacacaggtctt

SEQ ID NO: 5910919 - DNA, 16 bp, Homo sapiens
gccctgttgtgccaca

SEQ ID NO: 5910920 - DNA, 19 bp, Homo sapiens
gccctgtttcctgctgctt

SEQ ID NO: 5910921 - DNA, 20 bp, Homo sapiens
gcccttaaaataatgattta

SEQ ID NO: 5910922 - DNA, 22 bp, Homo sapiens
gcccttaaacaactgcagaaag

SEQ ID NO: 5910923 - DNA, 20 bp, Homo sapiens
gcccttaactatcaccagtg

SEQ ID NO: 5910924 - DNA, 23 bp, Homo sapiens
gcccttaagccaaactcaggccc

SEQ ID NO: 5910925 - DNA, 18 bp, Homo sapiens
gcccttaaggatcacccc

SEQ ID NO: 5910926 - DNA, 23 bp, Homo sapiens
gcccttaaggatcaccccagccc

SEQ ID NO: 5910927 - DNA, 20 bp, Homo sapiens
gcccttacacgtgcgtgtga

SEQ ID NO: 5910928 - DNA, 20 bp, Homo sapiens
gcccttacacttactgttgt

SEQ ID NO: 5910929 - DNA, 22 bp, Homo sapiens
gcccttacctgccaggaagcca

SEQ ID NO: 5910930 - DNA, 18 bp, Homo sapiens
gcccttacttcttgccct

SEQ ID NO: 5910931 - DNA, 14 bp, Homo sapiens
gcccttagcacaga

SEQ ID NO: 5910932 - DNA, 16 bp, Homo sapiens
gcccttagcacagaga

SEQ ID NO: 5910933 - DNA, 16 bp, Homo sapiens
gcccttagtcccccaa

SEQ ID NO: 5910934 - DNA, 18 bp, Homo sapiens
gcccttagtcccccaact

SEQ ID NO: 5910935 - DNA, 20 bp, Homo sapiens
gcccttagtcccccaactct

SEQ ID NO: 5910936 - DNA, 19 bp, Homo sapiens
gcccttatgactgccaaga

SEQ ID NO: 5910937 - DNA, 19 bp, Homo sapiens
gcccttatgcccggcgccg

SEQ ID NO: 5910938 - DNA, 15 bp, Homo sapiens
gcccttcaatgctgc

SEQ ID NO: 5910939 - DNA, 17 bp, Homo sapiens
gcccttcaatgctgcag

SEQ ID NO: 5910940 - DNA, 18 bp, Homo sapiens
gcccttcaatgctgcagg

SEQ ID NO: 5910941 - DNA, 16 bp, Homo sapiens
gcccttcacagtgttt

SEQ ID NO: 5910942 - DNA, 15 bp, Homo sapiens
gcccttcactgccat

SEQ ID NO: 5910943 - DNA, 17 bp, Homo sapiens
gcccttcactgccatga

SEQ ID NO: 5910944 - DNA, 23 bp, Homo sapiens
gcccttcactttctcctggtgtt

SEQ ID NO: 5910945 - DNA, 21 bp, Homo sapiens
gcccttcagcccaccaccctg

SEQ ID NO: 5910946 - DNA, 19 bp, Homo sapiens
gcccttcaggacccttcta

SEQ ID NO: 5910947 - DNA, 14 bp, Homo sapiens
gcccttcagtctgc

SEQ ID NO: 5910948 - DNA, 21 bp, Homo sapiens
gcccttcagtctgctccacca

SEQ ID NO: 5910949 - DNA, 12 bp, Homo sapiens
gcccttccagcc

SEQ ID NO: 5910950 - DNA, 16 bp, Homo sapiens
gcccttccagcctggg

SEQ ID NO: 5910951 - DNA, 17 bp, Homo sapiens
gcccttccagcctggga

SEQ ID NO: 5910952 - DNA, 18 bp, Homo sapiens
gcccttccagcctgggac

SEQ ID NO: 5910953 - DNA, 19 bp, Homo sapiens
gcccttccagcctgggaca

SEQ ID NO: 5910954 - DNA, 23 bp, Homo sapiens
gcccttccagcctgggacacaca

SEQ ID NO: 5910955 - DNA, 12 bp, Homo sapiens
gcccttccagtg

SEQ ID NO: 5910956 - DNA, 16 bp, Homo sapiens
gcccttccagtggtac

SEQ ID NO: 5910957 - DNA, 19 bp, Homo sapiens
gccgcctgccctgccttgc

SEQ ID NO: 5910958 - DNA, 14 bp, Homo sapiens
gccgcctgctcctc

SEQ ID NO: 5910959 - DNA, 15 bp, Homo sapiens
gccgcctgctcctca

SEQ ID NO: 5910960 - DNA, 19 bp, Homo sapiens
gccgcctgctcctcactgg

SEQ ID NO: 5910961 - DNA, 15 bp, Homo sapiens
gccgcctggcaggtg

SEQ ID NO: 5910962 - DNA, 13 bp, Homo sapiens
gccgcctggggct

SEQ ID NO: 5910963 - DNA, 18 bp, Homo sapiens
gccgcctggggctccggt

SEQ ID NO: 5910964 - DNA, 13 bp, Homo sapiens
gccgcctggtact

SEQ ID NO: 5910965 - DNA, 15 bp, Homo sapiens
gccgcctggtactca

SEQ ID NO: 5910966 - DNA, 18 bp, Homo sapiens
gccgcctggtactcaagc

SEQ ID NO: 5910967 - DNA, 18 bp, Homo sapiens
gccgcctgtcaataaatg

SEQ ID NO: 5910968 - DNA, 13 bp, Homo sapiens
gccgcctgtgccc

SEQ ID NO: 5910969 - DNA, 15 bp, Homo sapiens
gccgccttcacagca

SEQ ID NO: 5910970 - DNA, 22 bp, Homo sapiens
gccgccttccttgaccttcctc

SEQ ID NO: 5910971 - DNA, 19 bp, Homo sapiens
gccgccttctcccctctcc

SEQ ID NO: 5910972 - DNA, 13 bp, Homo sapiens
gccgcgagaggcc

SEQ ID NO: 5910973 - DNA, 18 bp, Homo sapiens
gccgcgccagtccccgct

SEQ ID NO: 5910974 - DNA, 14 bp, Homo sapiens
gccgcgcccagcag

SEQ ID NO: 5910975 - DNA, 14 bp, Homo sapiens
gccgcgctctgccc

SEQ ID NO: 5910976 - DNA, 18 bp, Homo sapiens
gccgcgctctgcccctcc

SEQ ID NO: 5910977 - DNA, 19 bp, Homo sapiens
gccgcgctctgcccctccg

SEQ ID NO: 5910978 - DNA, 14 bp, Homo sapiens
gccgcggcccagac

SEQ ID NO: 5910979 - DNA, 17 bp, Homo sapiens
gccgcgggccaggaggc

SEQ ID NO: 5910980 - DNA, 18 bp, Homo sapiens
gccgcgggcgagaagggc

SEQ ID NO: 5910981 - DNA, 20 bp, Homo sapiens
gccgcggtaggtaagggccg

SEQ ID NO: 5910982 - DNA, 13 bp, Homo sapiens
gccgcgtccctgc

SEQ ID NO: 5910983 - DNA, 16 bp, Homo sapiens
gccgcgtgccgggccc

SEQ ID NO: 5910984 - DNA, 17 bp, Homo sapiens
gccgcgtttagaccaag

SEQ ID NO: 5910985 - DNA, 11 bp, Homo sapiens
gccgctacctc

SEQ ID NO: 5910986 - DNA, 18 bp, Homo sapiens
gccgctagatgggcatgg

SEQ ID NO: 5910987 - DNA, 18 bp, Homo sapiens
gccgctaggagagactga

SEQ ID NO: 5910988 - DNA, 22 bp, Homo sapiens
gccgctaggagagactgaaagc

SEQ ID NO: 5910989 - DNA, 13 bp, Homo sapiens
gccgctaggtaga

SEQ ID NO: 5910990 - DNA, 23 bp, Homo sapiens
gccgctaggtagagtctgagggc

SEQ ID NO: 5910991 - DNA, 23 bp, Homo sapiens
gccgctccccttggacctccagg

SEQ ID NO: 5910992 - DNA, 20 bp, Homo sapiens
gccgctcccggttccctccc

SEQ ID NO: 5910993 - DNA, 22 bp, Homo sapiens
gccgctcccggttccctcccca

SEQ ID NO: 5910994 - DNA, 14 bp, Homo sapiens
gccgctcctccctg

SEQ ID NO: 5910995 - DNA, 21 bp, Homo sapiens
gccgctcctccctgctcctca

SEQ ID NO: 5910996 - DNA, 22 bp, Homo sapiens
gccgctcctccctgctcctcat

SEQ ID NO: 5910997 - DNA, 19 bp, Homo sapiens
gccgctcctgtctgccagc

SEQ ID NO: 5910998 - DNA, 18 bp, Homo sapiens
gccgctcggaggccccaa

SEQ ID NO: 5910999 - DNA, 20 bp, Homo sapiens
gccgctcggaggccccaaag

SEQ ID NO: 5911000 - DNA, 20 bp, Homo sapiens
gccgctctccccctgcagcc

SEQ ID NO: 5911001 - DNA, 19 bp, Homo sapiens
gccgctctccgccccccgg

SEQ ID NO: 5911002 - DNA, 13 bp, Homo sapiens
gccgctctgattt

SEQ ID NO: 5911003 - DNA, 18 bp, Homo sapiens
gccgctcttctgtcatcc

SEQ ID NO: 5911004 - DNA, 23 bp, Homo sapiens
gccgctctttgctccagacctgc

SEQ ID NO: 5911005 - DNA, 16 bp, Homo sapiens
gccgctgaccctgggc

SEQ ID NO: 5911006 - DNA, 22 bp, Homo sapiens
gccgctgaccctgggcctggag

SEQ ID NO: 5911007 - DNA, 21 bp, Homo sapiens
gccgctgagcgcccccgagcc

SEQ ID NO: 5911008 - DNA, 23 bp, Homo sapiens
gccgctgagcgcccccgagccct

SEQ ID NO: 5911009 - DNA, 15 bp, Homo sapiens
gccgctgcaggaaac

SEQ ID NO: 5911010 - DNA, 12 bp, Homo sapiens
gccgctgcaggg

SEQ ID NO: 5911011 - DNA, 18 bp, Homo sapiens
gccgctgcagggctccca

SEQ ID NO: 5911012 - DNA, 20 bp, Homo sapiens
gccgctgcagggctcccatg

SEQ ID NO: 5911013 - DNA, 22 bp, Homo sapiens
gccgctgcagggctcccatggg

SEQ ID NO: 5911014 - DNA, 14 bp, Homo sapiens
gccgctgcagggtg

SEQ ID NO: 5911015 - DNA, 15 bp, Homo sapiens
gccgctgcagggtgg

SEQ ID NO: 5911016 - DNA, 19 bp, Homo sapiens
gccgctgcagggtggcatc

SEQ ID NO: 5911017 - DNA, 12 bp, Homo sapiens
gccgctgcccac

SEQ ID NO: 5911018 - DNA, 14 bp, Homo sapiens
gccgctgcccacgt

SEQ ID NO: 5911019 - DNA, 19 bp, Homo sapiens
gccgctgcccccaccctgc

SEQ ID NO: 5911020 - DNA, 22 bp, Homo sapiens
gccgctgcccccaccctgcttc

SEQ ID NO: 5911021 - DNA, 12 bp, Homo sapiens
gccgctgccctg

SEQ ID NO: 5911022 - DNA, 14 bp, Homo sapiens
gccgctgccctggg

SEQ ID NO: 5911023 - DNA, 15 bp, Homo sapiens
gccgctgccctgggt

SEQ ID NO: 5911024 - DNA, 17 bp, Homo sapiens
gccgctgccgctgcacc

SEQ ID NO: 5911025 - DNA, 17 bp, Homo sapiens
gccgctgctctcccagg

SEQ ID NO: 5911026 - DNA, 19 bp, Homo sapiens
gccgctgcttccaggctgg

SEQ ID NO: 5911027 - DNA, 20 bp, Homo sapiens
gccgctgcttgagtggacag

SEQ ID NO: 5911028 - DNA, 12 bp, Homo sapiens
gccgctggcaac

SEQ ID NO: 5911029 - DNA, 15 bp, Homo sapiens
gccgctggcccaggg

SEQ ID NO: 5911030 - DNA, 20 bp, Homo sapiens
gccgctgggagaaaagccag

SEQ ID NO: 5911031 - DNA, 22 bp, Homo sapiens
gccgctgggagaaaagccagat

SEQ ID NO: 5911032 - DNA, 15 bp, Homo sapiens
gccgctgggagagcc

SEQ ID NO: 5911033 - DNA, 19 bp, Homo sapiens
gccgctgtataaagcatgt

SEQ ID NO: 5911034 - DNA, 23 bp, Homo sapiens
gccgctgtcaaggccgagggcca

SEQ ID NO: 5911035 - DNA, 17 bp, Homo sapiens
gccgctgtgcccccctc

SEQ ID NO: 5911036 - DNA, 20 bp, Homo sapiens
gccgctgtgcccccctcctc

SEQ ID NO: 5911037 - DNA, 21 bp, Homo sapiens
gccgcttaaacatttccctgc

SEQ ID NO: 5911038 - DNA, 22 bp, Homo sapiens
gccgcttaaacatttccctgct

SEQ ID NO: 5911039 - DNA, 14 bp, Homo sapiens
gccgcttcgccatg

SEQ ID NO: 5911040 - DNA, 19 bp, Homo sapiens
gccgcttggcgatgccagc

SEQ ID NO: 5911041 - DNA, 18 bp, Homo sapiens
gccgctttgatggaggag

SEQ ID NO: 5911042 - DNA, 17 bp, Homo sapiens
gccgctttgtctgtcca

SEQ ID NO: 5911043 - DNA, 17 bp, Homo sapiens
gccggaaagagagctgg

SEQ ID NO: 5911044 - DNA, 22 bp, Homo sapiens
gccggaaggaatgtcagggcca

SEQ ID NO: 5911045 - DNA, 17 bp, Homo sapiens
gccggaaggccgaggtc

SEQ ID NO: 5911046 - DNA, 16 bp, Homo sapiens
gccggaagtggctccg

SEQ ID NO: 5911047 - DNA, 23 bp, Homo sapiens
gccggaatagagcctcgtctggc

SEQ ID NO: 5911048 - DNA, 18 bp, Homo sapiens
gccggacacttctcagga

SEQ ID NO: 5911049 - DNA, 16 bp, Homo sapiens
gccggacagagtgggg

SEQ ID NO: 5911050 - DNA, 14 bp, Homo sapiens
gccggacagctgcc

SEQ ID NO: 5911051 - DNA, 17 bp, Homo sapiens
gccggacagctgcccag

SEQ ID NO: 5911052 - DNA, 18 bp, Homo sapiens
gccggacagctgcccaga

SEQ ID NO: 5911053 - DNA, 23 bp, Homo sapiens
gccggacagctgcccagacacat

SEQ ID NO: 5911054 - DNA, 21 bp, Homo sapiens
gccggacccccgtcagctgct

SEQ ID NO: 5911055 - DNA, 14 bp, Homo sapiens
gccggacctctgag

SEQ ID NO: 5911056 - DNA, 17 bp, Homo sapiens
gccggacctgagcccgc

SEQ ID NO: 5911057 - DNA, 21 bp, Homo sapiens
gccggacctgagcccgcagcc

SEQ ID NO: 5911058 - DNA, 17 bp, Homo sapiens
gccggagacccacagcc

SEQ ID NO: 5911059 - DNA, 18 bp, Homo sapiens
gccggagaggaagagaca

SEQ ID NO: 5911060 - DNA, 21 bp, Homo sapiens
gccggagaggagttcaggaac

SEQ ID NO: 5911061 - DNA, 18 bp, Homo sapiens
gccggagcagttggcctg

SEQ ID NO: 5911062 - DNA, 13 bp, Homo sapiens
gccggagcccaga

SEQ ID NO: 5911063 - DNA, 19 bp, Homo sapiens
gccggagccccaagactct

SEQ ID NO: 5911064 - DNA, 15 bp, Homo sapiens
gccggagccgcccac

SEQ ID NO: 5911065 - DNA, 12 bp, Homo sapiens
gccggaggaagg

SEQ ID NO: 5911066 - DNA, 23 bp, Homo sapiens
gccggaggccttggggtgggggc

SEQ ID NO: 5911067 - DNA, 21 bp, Homo sapiens
gccggagggacgcggaggagg

SEQ ID NO: 5911068 - DNA, 19 bp, Homo sapiens
gccggagggcaccagggac

SEQ ID NO: 5911069 - DNA, 21 bp, Homo sapiens
gccggagtccactcccagtgc

SEQ ID NO: 5911070 - DNA, 17 bp, Homo sapiens
gccggatctgagggaga

SEQ ID NO: 5911071 - DNA, 14 bp, Homo sapiens
gccggatcttggag

SEQ ID NO: 5911072 - DNA, 18 bp, Homo sapiens
gccggatgaaacttctca

SEQ ID NO: 5911073 - DNA, 20 bp, Homo sapiens
gccggatgaaacttctcagt

SEQ ID NO: 5911074 - DNA, 19 bp, Homo sapiens
gccggcaaccccagttctg

SEQ ID NO: 5911075 - DNA, 23 bp, Homo sapiens
gccggcaaccccagttctgctcc

SEQ ID NO: 5911076 - DNA, 13 bp, Homo sapiens
gccggcacagctg

SEQ ID NO: 5911077 - DNA, 13 bp, Homo sapiens
gccggcacagggt

SEQ ID NO: 5911078 - DNA, 20 bp, Homo sapiens
gccggcacctacatccccag

SEQ ID NO: 5911079 - DNA, 22 bp, Homo sapiens
gccggcacctacatccccaggt

SEQ ID NO: 5911080 - DNA, 16 bp, Homo sapiens
gccggcacggcccgtg

SEQ ID NO: 5911081 - DNA, 15 bp, Homo sapiens
gccggcagccccagc

SEQ ID NO: 5911082 - DNA, 17 bp, Homo sapiens
gccggcagccccagcct

SEQ ID NO: 5911083 - DNA, 19 bp, Homo sapiens
gccggcagccccagcctgc

SEQ ID NO: 5911084 - DNA, 14 bp, Homo sapiens
gccggcagcctggt

SEQ ID NO: 5911085 - DNA, 13 bp, Homo sapiens
gccggcagtgctg

SEQ ID NO: 5911086 - DNA, 13 bp, Homo sapiens
gccggcatctccc

SEQ ID NO: 5911087 - DNA, 18 bp, Homo sapiens
gccggcatctcccctagc

SEQ ID NO: 5911088 - DNA, 15 bp, Homo sapiens
gccggcatggctggg

SEQ ID NO: 5911089 - DNA, 23 bp, Homo sapiens
gccggccacacccctctgctgca

SEQ ID NO: 5911090 - DNA, 13 bp, Homo sapiens
gccggccagccag

SEQ ID NO: 5911091 - DNA, 13 bp, Homo sapiens
gccggccaggtgg

SEQ ID NO: 5911092 - DNA, 15 bp, Homo sapiens
gccggcccacgtcct

SEQ ID NO: 5911093 - DNA, 18 bp, Homo sapiens
gccggcccacgtcctggg

SEQ ID NO: 5911094 - DNA, 22 bp, Homo sapiens
gccggcccagatgtgtcccccc

SEQ ID NO: 5911095 - DNA, 13 bp, Homo sapiens
gccggccccaggc

SEQ ID NO: 5911096 - DNA, 16 bp, Homo sapiens
gccggccccaggctcc

SEQ ID NO: 5911097 - DNA, 22 bp, Homo sapiens
gccggccccaggctcccctggt

SEQ ID NO: 5911098 - DNA, 23 bp, Homo sapiens
gccggccccaggctcccctggtc

SEQ ID NO: 5911099 - DNA, 15 bp, Homo sapiens
gccggccccccctct

SEQ ID NO: 5911100 - DNA, 20 bp, Homo sapiens
gccggcccccttcctggccc

SEQ ID NO: 5911101 - DNA, 11 bp, Homo sapiens
gccggccctgc

SEQ ID NO: 5911102 - DNA, 13 bp, Homo sapiens
gccggccctgccc

SEQ ID NO: 5911103 - DNA, 16 bp, Homo sapiens
gccggccctgcccccc

SEQ ID NO: 5911104 - DNA, 16 bp, Homo sapiens
gccggccctgcccctc

SEQ ID NO: 5911105 - DNA, 15 bp, Homo sapiens
gccggccctggcttg

SEQ ID NO: 5911106 - DNA, 14 bp, Homo sapiens
gccggccctggggc

SEQ ID NO: 5911107 - DNA, 13 bp, Homo sapiens
gccggccctgtgt

SEQ ID NO: 5911108 - DNA, 14 bp, Homo sapiens
gccggccctgtgtg

SEQ ID NO: 5911109 - DNA, 18 bp, Homo sapiens
gccggccctgtgtgcagg

SEQ ID NO: 5911110 - DNA, 16 bp, Homo sapiens
gccggccgagctgcct

SEQ ID NO: 5911111 - DNA, 17 bp, Homo sapiens
gccggccggacctctga

SEQ ID NO: 5911112 - DNA, 21 bp, Homo sapiens
gccggccggacctctgagcac

SEQ ID NO: 5911113 - DNA, 13 bp, Homo sapiens
gccggcctcctcc

SEQ ID NO: 5911114 - DNA, 14 bp, Homo sapiens
gccggcctcctcct

SEQ ID NO: 5911115 - DNA, 23 bp, Homo sapiens
gccggcctctctggcctcccacc

SEQ ID NO: 5911116 - DNA, 22 bp, Homo sapiens
gccggcctctgctgcccccttc

SEQ ID NO: 5911117 - DNA, 15 bp, Homo sapiens
gccggcctggcaccg

SEQ ID NO: 5911118 - DNA, 14 bp, Homo sapiens
gccggcgagggggc

SEQ ID NO: 5911119 - DNA, 20 bp, Homo sapiens
gccggcgagggggccggggg

SEQ ID NO: 5911120 - DNA, 13 bp, Homo sapiens
gccggcgccccgg

SEQ ID NO: 5911121 - DNA, 14 bp, Homo sapiens
gccggcggctctga

SEQ ID NO: 5911122 - DNA, 17 bp, Homo sapiens
gccggcggctctgagca

SEQ ID NO: 5911123 - DNA, 19 bp, Homo sapiens
gccggcggctctgagcagg

SEQ ID NO: 5911124 - DNA, 23 bp, Homo sapiens
gccggcgtggcaaatataaaact

SEQ ID NO: 5911125 - DNA, 22 bp, Homo sapiens
gccggctatgaaagggagcgag

SEQ ID NO: 5911126 - DNA, 13 bp, Homo sapiens
gccggctccttgg

SEQ ID NO: 5911127 - DNA, 11 bp, Homo sapiens
gccggctctgg

SEQ ID NO: 5911128 - DNA, 13 bp, Homo sapiens
gccggctctgggc

SEQ ID NO: 5911129 - DNA, 19 bp, Homo sapiens
gccggctctgggcctgagg

SEQ ID NO: 5911130 - DNA, 14 bp, Homo sapiens
gccggctctgggct

SEQ ID NO: 5911131 - DNA, 16 bp, Homo sapiens
gccggctctgggctgg

SEQ ID NO: 5911132 - DNA, 21 bp, Homo sapiens
gccggctctgggctggctgct

SEQ ID NO: 5911133 - DNA, 17 bp, Homo sapiens
gccggctctggtggcca

SEQ ID NO: 5911134 - DNA, 14 bp, Homo sapiens
gccggctgagtggc

SEQ ID NO: 5911135 - DNA, 13 bp, Homo sapiens
gccggctggaaat

SEQ ID NO: 5911136 - DNA, 13 bp, Homo sapiens
gccggctggcctg

SEQ ID NO: 5911137 - DNA, 17 bp, Homo sapiens
gccggctgtgctcagag

SEQ ID NO: 5911138 - DNA, 15 bp, Homo sapiens
gccggctgtggagca

SEQ ID NO: 5911139 - DNA, 17 bp, Homo sapiens
gccggcttctgcctggg

SEQ ID NO: 5911140 - DNA, 11 bp, Homo sapiens
gccgggaaagc

SEQ ID NO: 5911141 - DNA, 22 bp, Homo sapiens
gccgggaacagacaacagaagt

SEQ ID NO: 5911142 - DNA, 22 bp, Homo sapiens
gccgggaagagccacctggcag

SEQ ID NO: 5911143 - DNA, 20 bp, Homo sapiens
gccgggaccaccctgagccg

SEQ ID NO: 5911144 - DNA, 19 bp, Homo sapiens
gccgggaccccgagcctgg

SEQ ID NO: 5911145 - DNA, 23 bp, Homo sapiens
gccgggaccccgagcctggctcc

SEQ ID NO: 5911146 - DNA, 16 bp, Homo sapiens
gccgggaccctcaggt

SEQ ID NO: 5911147 - DNA, 19 bp, Homo sapiens
gccgggactgctgctctcc

SEQ ID NO: 5911148 - DNA, 13 bp, Homo sapiens
gccgggactgggg

SEQ ID NO: 5911149 - DNA, 18 bp, Homo sapiens
gccgggagaagccacctt

SEQ ID NO: 5911150 - DNA, 19 bp, Homo sapiens
gccgggagactgccagtgg

SEQ ID NO: 5911151 - DNA, 21 bp, Homo sapiens
gccgggagactgccagtggag

SEQ ID NO: 5911152 - DNA, 18 bp, Homo sapiens
gccgggagaggactctgc

SEQ ID NO: 5911153 - DNA, 14 bp, Homo sapiens
gccgggagaggatg

SEQ ID NO: 5911154 - DNA, 18 bp, Homo sapiens
gccgggaggcagccacag

SEQ ID NO: 5911155 - DNA, 16 bp, Homo sapiens
gccgggcaaactggcc

SEQ ID NO: 5911156 - DNA, 13 bp, Homo sapiens
gccgggcacagct

SEQ ID NO: 5911157 - DNA, 20 bp, Homo sapiens
gccgggcacagtggctcacg

SEQ ID NO: 5911158 - DNA, 17 bp, Homo sapiens
gccgggcagagcacagc

SEQ ID NO: 5911159 - DNA, 13 bp, Homo sapiens
gccgggcagaggg

SEQ ID NO: 5911160 - DNA, 13 bp, Homo sapiens
gccgggcaggcct

SEQ ID NO: 5911161 - DNA, 13 bp, Homo sapiens
gccgggcaggcgt

SEQ ID NO: 5911162 - DNA, 12 bp, Homo sapiens
gccgggccagga

SEQ ID NO: 5911163 - DNA, 17 bp, Homo sapiens
gccgggcccccaccgcc

SEQ ID NO: 5911164 - DNA, 17 bp, Homo sapiens
gccgggccctctgtagc

SEQ ID NO: 5911165 - DNA, 18 bp, Homo sapiens
gccgggccctctgtagct

SEQ ID NO: 5911166 - DNA, 19 bp, Homo sapiens
gccgggccgaatcccctcc

SEQ ID NO: 5911167 - DNA, 24 bp, Homo sapiens
gccgggcctcccaccgcagcgtcc

SEQ ID NO: 5911168 - DNA, 15 bp, Homo sapiens
gccgggcctggactg

SEQ ID NO: 5911169 - DNA, 20 bp, Homo sapiens
gccgggcgccaggacagcag

SEQ ID NO: 5911170 - DNA, 14 bp, Homo sapiens
gccgggcgcggtgg

SEQ ID NO: 5911171 - DNA, 21 bp, Homo sapiens
gccgggcgcggtggctcacgc

SEQ ID NO: 5911172 - DNA, 20 bp, Homo sapiens
gccgggcgtggtggtgagtg

SEQ ID NO: 5911173 - DNA, 21 bp, Homo sapiens
gccgggctacccgtgagccct

SEQ ID NO: 5911174 - DNA, 16 bp, Homo sapiens
gccgggctagagcctt

SEQ ID NO: 5911175 - DNA, 13 bp, Homo sapiens
gccgggctccagg

SEQ ID NO: 5911176 - DNA, 15 bp, Homo sapiens
gccgggctccaggga

SEQ ID NO: 5911177 - DNA, 15 bp, Homo sapiens
gccgggctctgcacc

SEQ ID NO: 5911178 - DNA, 21 bp, Homo sapiens
gccgggctctgcacccacgtg

SEQ ID NO: 5911179 - DNA, 22 bp, Homo sapiens
gccgggctgcccttcgctgcca

SEQ ID NO: 5911180 - DNA, 13 bp, Homo sapiens
gccgggctgtaga

SEQ ID NO: 5911181 - DNA, 16 bp, Homo sapiens
gccggggaactggcca

SEQ ID NO: 5911182 - DNA, 22 bp, Homo sapiens
gccggggaactggccaagctga

SEQ ID NO: 5911183 - DNA, 23 bp, Homo sapiens
gccggggaactggccaagctgag

SEQ ID NO: 5911184 - DNA, 12 bp, Homo sapiens
gccggggaagag

SEQ ID NO: 5911185 - DNA, 17 bp, Homo sapiens
gccggggaagctggcag

SEQ ID NO: 5911186 - DNA, 20 bp, Homo sapiens
gccggggaagctggcagcac

SEQ ID NO: 5911187 - DNA, 20 bp, Homo sapiens
gccggggactcccaggctgg

SEQ ID NO: 5911188 - DNA, 17 bp, Homo sapiens
gccggggactggccact

SEQ ID NO: 5911189 - DNA, 15 bp, Homo sapiens
gccggggagctgagg

SEQ ID NO: 5911190 - DNA, 13 bp, Homo sapiens
gccggggaggggg

SEQ ID NO: 5911191 - DNA, 16 bp, Homo sapiens
gccggggagggggcac

SEQ ID NO: 5911192 - DNA, 18 bp, Homo sapiens
gccggggagggggcacgg

SEQ ID NO: 5911193 - DNA, 14 bp, Homo sapiens
gccggggctgaagc

SEQ ID NO: 5911194 - DNA, 15 bp, Homo sapiens
gccggggctgagact

SEQ ID NO: 5911195 - DNA, 16 bp, Homo sapiens
gccggggctggccctg

SEQ ID NO: 5911196 - DNA, 16 bp, Homo sapiens
gccgggggaggggccc

SEQ ID NO: 5911197 - DNA, 20 bp, Homo sapiens
gccgggggaggggccctcag

SEQ ID NO: 5911198 - DNA, 22 bp, Homo sapiens
gccgggggaggggccctcaggc

SEQ ID NO: 5911199 - DNA, 23 bp, Homo sapiens
gccgggggaggggcgcgggaggg

SEQ ID NO: 5911200 - DNA, 15 bp, Homo sapiens
gccgggggaggtggg

SEQ ID NO: 5911201 - DNA, 15 bp, Homo sapiens
gccgggggcggggcc

SEQ ID NO: 5911202 - DNA, 13 bp, Homo sapiens
gccggggggaggg

SEQ ID NO: 5911203 - DNA, 15 bp, Homo sapiens
gccggggggagggga

SEQ ID NO: 5911204 - DNA, 16 bp, Homo sapiens
gccggggggaggggac

SEQ ID NO: 5911205 - DNA, 17 bp, Homo sapiens
gccggggggaggggaca

SEQ ID NO: 5911206 - DNA, 23 bp, Homo sapiens
gccggggggaggggacagagctg

SEQ ID NO: 5911207 - DNA, 21 bp, Homo sapiens
gccggggggggtaggagagga

SEQ ID NO: 5911208 - DNA, 22 bp, Homo sapiens
gccggggggggtaggagaggag

SEQ ID NO: 5911209 - DNA, 23 bp, Homo sapiens
gccgggggtgggggcctgctgtg

SEQ ID NO: 5911210 - DNA, 20 bp, Homo sapiens
gccggggtcctgggaggctg

SEQ ID NO: 5911211 - DNA, 23 bp, Homo sapiens
gccggggtcctgggaggctgcag

SEQ ID NO: 5911212 - DNA, 18 bp, Homo sapiens
gccggggtggggtgcctg

SEQ ID NO: 5911213 - DNA, 19 bp, Homo sapiens
gccggggtgtaacttcctg

SEQ ID NO: 5911214 - DNA, 23 bp, Homo sapiens
gccggggtgtaacttcctgctgc

SEQ ID NO: 5911215 - DNA, 18 bp, Homo sapiens
gccgggtacctcagtttc

SEQ ID NO: 5911216 - DNA, 18 bp, Homo sapiens
gccgggtcgcctgccctg

SEQ ID NO: 5911217 - DNA, 21 bp, Homo sapiens
gccgggtctgcctcttctggg

SEQ ID NO: 5911218 - DNA, 15 bp, Homo sapiens
gccgggtgcgaaagg

SEQ ID NO: 5911219 - DNA, 19 bp, Homo sapiens
gccgggtggggggagggca

SEQ ID NO: 5911220 - DNA, 18 bp, Homo sapiens
gccgggttggaggcctca

SEQ ID NO: 5911221 - DNA, 20 bp, Homo sapiens
gccgggttggaggcctcacc

SEQ ID NO: 5911222 - DNA, 24 bp, Homo sapiens
gccgggttggaggcctcaccctgc

SEQ ID NO: 5911223 - DNA, 14 bp, Homo sapiens
gccggtacacagcc

SEQ ID NO: 5911224 - DNA, 22 bp, Homo sapiens
gccggtagaggctccccagggc

SEQ ID NO: 5911225 - DNA, 24 bp, Homo sapiens
gccggtcacactctacacggactg

SEQ ID NO: 5911226 - DNA, 13 bp, Homo sapiens
gccggtccacccc

SEQ ID NO: 5911227 - DNA, 14 bp, Homo sapiens
gccggtccaccccg

SEQ ID NO: 5911228 - DNA, 23 bp, Homo sapiens
gccggtccaccccgtcccggccc

SEQ ID NO: 5911229 - DNA, 17 bp, Homo sapiens
gccggtcccccatgcca

SEQ ID NO: 5911230 - DNA, 22 bp, Homo sapiens
gccggtcccccatgccaccacc

SEQ ID NO: 5911231 - DNA, 21 bp, Homo sapiens
gccggtcgccctttgctgcat

SEQ ID NO: 5911232 - DNA, 24 bp, Homo sapiens
gccggtcgccctttgctgcatggc

SEQ ID NO: 5911233 - DNA, 14 bp, Homo sapiens
gccggtcgggcagc

SEQ ID NO: 5911234 - DNA, 17 bp, Homo sapiens
gccggtcgggcagccag

SEQ ID NO: 5911235 - DNA, 19 bp, Homo sapiens
gccggtcgggcagccagca

SEQ ID NO: 5911236 - DNA, 15 bp, Homo sapiens
gccggtgcacaggcc

SEQ ID NO: 5911237 - DNA, 19 bp, Homo sapiens
gccggtgcacaggcctctg

SEQ ID NO: 5911238 - DNA, 23 bp, Homo sapiens
gccggtgcacaggcctctgcctg

SEQ ID NO: 5911239 - DNA, 15 bp, Homo sapiens
gccggtgccagctgc

SEQ ID NO: 5911240 - DNA, 22 bp, Homo sapiens
gccggtgccagctgcccttgca

SEQ ID NO: 5911241 - DNA, 22 bp, Homo sapiens
gccggtgcctgggtggccatcc

SEQ ID NO: 5911242 - DNA, 13 bp, Homo sapiens
gccggtgctgggt

SEQ ID NO: 5911243 - DNA, 21 bp, Homo sapiens
gccggtgctgggttcccactc

SEQ ID NO: 5911244 - DNA, 16 bp, Homo sapiens
gccggtgggaccctgt

SEQ ID NO: 5911245 - DNA, 20 bp, Homo sapiens
gccggtgggaccctgtccgg

SEQ ID NO: 5911246 - DNA, 19 bp, Homo sapiens
gccggtggggccagcgctg

SEQ ID NO: 5911247 - DNA, 15 bp, Homo sapiens
gccggtgtaaatatg

SEQ ID NO: 5911248 - DNA, 16 bp, Homo sapiens
gccggtgtccctggat

SEQ ID NO: 5911249 - DNA, 21 bp, Homo sapiens
gccggtgtgcctgactgccca

SEQ ID NO: 5911250 - DNA, 16 bp, Homo sapiens
gccggtgtgggggccc

SEQ ID NO: 5911251 - DNA, 17 bp, Homo sapiens
gccggttcattttgcac

SEQ ID NO: 5911252 - DNA, 20 bp, Homo sapiens
gccggttgcagagaatctgt

SEQ ID NO: 5911253 - DNA, 19 bp, Homo sapiens
gccggttggccggctggcc

SEQ ID NO: 5911254 - DNA, 23 bp, Homo sapiens
gccgtaatggggactctccaggc

SEQ ID NO: 5911255 - DNA, 13 bp, Homo sapiens
gccgtaattatgt

SEQ ID NO: 5911256 - DNA, 17 bp, Homo sapiens
gccgtaattctttctgt

SEQ ID NO: 5911257 - DNA, 14 bp, Homo sapiens
gccgtaatttaact

SEQ ID NO: 5911258 - DNA, 13 bp, Homo sapiens
gccgtacatctct

SEQ ID NO: 5911259 - DNA, 18 bp, Homo sapiens
gccgtaccccaccctcag

SEQ ID NO: 5911260 - DNA, 22 bp, Homo sapiens
gccgtaccccaccctcagcacc

SEQ ID NO: 5911261 - DNA, 13 bp, Homo sapiens
gccgtagcttcag

SEQ ID NO: 5911262 - DNA, 19 bp, Homo sapiens
gccgtagggagtacctgct

SEQ ID NO: 5911263 - DNA, 15 bp, Homo sapiens
gccgtaggggctcct

SEQ ID NO: 5911264 - DNA, 23 bp, Homo sapiens
gccgtatctgtcacaataaatgg

SEQ ID NO: 5911265 - DNA, 20 bp, Homo sapiens
gccgtcaaggaaagggcagt

SEQ ID NO: 5911266 - DNA, 13 bp, Homo sapiens
gccgtcacacgta

SEQ ID NO: 5911267 - DNA, 13 bp, Homo sapiens
gccgtcaccacca

SEQ ID NO: 5911268 - DNA, 15 bp, Homo sapiens
gccgtcaccaccacc

SEQ ID NO: 5911269 - DNA, 16 bp, Homo sapiens
gccgtcaccaccaccc

SEQ ID NO: 5911270 - DNA, 17 bp, Homo sapiens
gccgtcaccaccacccc

SEQ ID NO: 5911271 - DNA, 16 bp, Homo sapiens
gccgtcaccccgccag

SEQ ID NO: 5911272 - DNA, 17 bp, Homo sapiens
gccgtcaccccgccagc

SEQ ID NO: 5911273 - DNA, 16 bp, Homo sapiens
gccgtcacccctgcct

SEQ ID NO: 5911274 - DNA, 21 bp, Homo sapiens
gccgtccatggcaccagcccc

SEQ ID NO: 5911275 - DNA, 23 bp, Homo sapiens
gccgtccatggcaccagccccct

SEQ ID NO: 5911276 - DNA, 16 bp, Homo sapiens
gccgtcccctctcccc

SEQ ID NO: 5911277 - DNA, 16 bp, Homo sapiens
gccgtccctcccaggt

SEQ ID NO: 5911278 - DNA, 15 bp, Homo sapiens
gccgtccctctgcct

SEQ ID NO: 5911279 - DNA, 19 bp, Homo sapiens
gccgtccctgacttcccag

SEQ ID NO: 5911280 - DNA, 22 bp, Homo sapiens
gccgtccctgacttcccagctg

SEQ ID NO: 5911281 - DNA, 20 bp, Homo sapiens
gccgtcctcccgggccctcc

SEQ ID NO: 5911282 - DNA, 21 bp, Homo sapiens
gccgtcctcccgggccctccc

SEQ ID NO: 5911283 - DNA, 18 bp, Homo sapiens
gccgtcctgctggagtga

SEQ ID NO: 5911284 - DNA, 16 bp, Homo sapiens
gccgtcctggactctg

SEQ ID NO: 5911285 - DNA, 18 bp, Homo sapiens
gccgtcctggactctgtg

SEQ ID NO: 5911286 - DNA, 22 bp, Homo sapiens
gccgtccttctaatgaagacaa

SEQ ID NO: 5911287 - DNA, 23 bp, Homo sapiens
gccgtccttctaatgaagacaat

SEQ ID NO: 5911288 - DNA, 19 bp, Homo sapiens
gccgtcgtggaattaaatc

SEQ ID NO: 5911289 - DNA, 19 bp, Homo sapiens
gccgtctgactccagagtc

SEQ ID NO: 5911290 - DNA, 16 bp, Homo sapiens
gccgtctgcacttctg

SEQ ID NO: 5911291 - DNA, 19 bp, Homo sapiens
gccgtcttcactcgccccc

SEQ ID NO: 5911292 - DNA, 14 bp, Homo sapiens
gccgtcttctgccc

SEQ ID NO: 5911293 - DNA, 15 bp, Homo sapiens
gccgtgaactgtgca

SEQ ID NO: 5911294 - DNA, 16 bp, Homo sapiens
gccgtgaatgggtgcc

SEQ ID NO: 5911295 - DNA, 14 bp, Homo sapiens
gccgtgagcatgca

SEQ ID NO: 5911296 - DNA, 16 bp, Homo sapiens
gccgtgagttctcagg

SEQ ID NO: 5911297 - DNA, 18 bp, Homo sapiens
gccgtgagttctcagggc

SEQ ID NO: 5911298 - DNA, 17 bp, Homo sapiens
gccgtgcacggggccag

SEQ ID NO: 5911299 - DNA, 17 bp, Homo sapiens
gccgtgcactccctaag

SEQ ID NO: 5911300 - DNA, 23 bp, Homo sapiens
gccgtgcactccctaagaaaccc

SEQ ID NO: 5911301 - DNA, 13 bp, Homo sapiens
gccgtgcaggact

SEQ ID NO: 5911302 - DNA, 22 bp, Homo sapiens
gccgtgcccgcccacctctgct

SEQ ID NO: 5911303 - DNA, 13 bp, Homo sapiens
gccgtgcccttgc

SEQ ID NO: 5911304 - DNA, 15 bp, Homo sapiens
gccgtgcctggtggg

SEQ ID NO: 5911305 - DNA, 23 bp, Homo sapiens
gccgtgcctttctctggctccag

SEQ ID NO: 5911306 - DNA, 23 bp, Homo sapiens
gccgtgctcgcccacaaactgat

SEQ ID NO: 5911307 - DNA, 17 bp, Homo sapiens
gccgtgctgagcacaca

SEQ ID NO: 5911308 - DNA, 17 bp, Homo sapiens
gccgtgctgggcagccc

SEQ ID NO: 5911309 - DNA, 18 bp, Homo sapiens
gccgtgctgggcagcccg

SEQ ID NO: 5911310 - DNA, 12 bp, Homo sapiens
gccgtggaagga

SEQ ID NO: 5911311 - DNA, 23 bp, Homo sapiens
gcctcaccctgcttggggcctgg

SEQ ID NO: 5911312 - DNA, 15 bp, Homo sapiens
gcctcacctcccagg

SEQ ID NO: 5911313 - DNA, 16 bp, Homo sapiens
gcctcacctcccaggg

SEQ ID NO: 5911314 - DNA, 15 bp, Homo sapiens
gcctcacctgcatcc

SEQ ID NO: 5911315 - DNA, 21 bp, Homo sapiens
gcctcacctgcatcctctccc

SEQ ID NO: 5911316 - DNA, 21 bp, Homo sapiens
gcctcacctgcccctctgttc

SEQ ID NO: 5911317 - DNA, 15 bp, Homo sapiens
gcctcacctggcttc

SEQ ID NO: 5911318 - DNA, 16 bp, Homo sapiens
gcctcacctggcttcc

SEQ ID NO: 5911319 - DNA, 18 bp, Homo sapiens
gcctcacctggcttccca

SEQ ID NO: 5911320 - DNA, 20 bp, Homo sapiens
gcctcacctggcttcccagg

SEQ ID NO: 5911321 - DNA, 21 bp, Homo sapiens
gcctcacctggcttcccagga

SEQ ID NO: 5911322 - DNA, 22 bp, Homo sapiens
gcctcacctggcttcccaggac

SEQ ID NO: 5911323 - DNA, 23 bp, Homo sapiens
gcctcacctgggttccccacccc

SEQ ID NO: 5911324 - DNA, 15 bp, Homo sapiens
gcctcaccttggggc

SEQ ID NO: 5911325 - DNA, 17 bp, Homo sapiens
gcctcacgcccagcctc

SEQ ID NO: 5911326 - DNA, 18 bp, Homo sapiens
gcctcacgcccagcctcc

SEQ ID NO: 5911327 - DNA, 20 bp, Homo sapiens
gcctcacgtatttcacagag

SEQ ID NO: 5911328 - DNA, 22 bp, Homo sapiens
gcctcacgtatttcacagagca

SEQ ID NO: 5911329 - DNA, 23 bp, Homo sapiens
gcctcacgtatttcacagagcac

SEQ ID NO: 5911330 - DNA, 15 bp, Homo sapiens
gcctcactaccagaa

SEQ ID NO: 5911331 - DNA, 20 bp, Homo sapiens
gcctcactatgttgcctagg

SEQ ID NO: 5911332 - DNA, 13 bp, Homo sapiens
gcctcactcctcc

SEQ ID NO: 5911333 - DNA, 16 bp, Homo sapiens
gcctcactgagctaat

SEQ ID NO: 5911334 - DNA, 18 bp, Homo sapiens
gcctcactgcatctttct

SEQ ID NO: 5911335 - DNA, 17 bp, Homo sapiens
gcctcactggctcatgc

SEQ ID NO: 5911336 - DNA, 19 bp, Homo sapiens
gcctcactggctcatgccc

SEQ ID NO: 5911337 - DNA, 13 bp, Homo sapiens
gcctcactggggc

SEQ ID NO: 5911338 - DNA, 17 bp, Homo sapiens
gcctcactggggcagac

SEQ ID NO: 5911339 - DNA, 14 bp, Homo sapiens
gcctcactgggggc

SEQ ID NO: 5911340 - DNA, 15 bp, Homo sapiens
gcctcactgggggct

SEQ ID NO: 5911341 - DNA, 20 bp, Homo sapiens
gcctcactgggggctttggg

SEQ ID NO: 5911342 - DNA, 22 bp, Homo sapiens
gcctcactgggggctttgggcc

SEQ ID NO: 5911343 - DNA, 19 bp, Homo sapiens
gcctcactgggtgtggcct

SEQ ID NO: 5911344 - DNA, 23 bp, Homo sapiens
gcctcactgtgacctgctcctgc

SEQ ID NO: 5911345 - DNA, 18 bp, Homo sapiens
gcctcacttccctgggaa

SEQ ID NO: 5911346 - DNA, 15 bp, Homo sapiens
gcctcacttcctttg

SEQ ID NO: 5911347 - DNA, 20 bp, Homo sapiens
gcctcacttgattcatctct

SEQ ID NO: 5911348 - DNA, 21 bp, Homo sapiens
gcctcacttgattcatctctg

SEQ ID NO: 5911349 - DNA, 22 bp, Homo sapiens
gcctcacttgattcatctctgg

SEQ ID NO: 5911350 - DNA, 22 bp, Homo sapiens
gcctcacttggtctgccaggcc

SEQ ID NO: 5911351 - DNA, 13 bp, Homo sapiens
gcctcactttcca

SEQ ID NO: 5911352 - DNA, 20 bp, Homo sapiens
gcctcactttccaccaagtg

SEQ ID NO: 5911353 - DNA, 17 bp, Homo sapiens
gcctcagaaaccagact

SEQ ID NO: 5911354 - DNA, 16 bp, Homo sapiens
gcctcagaaagggatt

SEQ ID NO: 5911355 - DNA, 17 bp, Homo sapiens
gcctcagaagccttctt

SEQ ID NO: 5911356 - DNA, 20 bp, Homo sapiens
gcctcagaagccttcttgct

SEQ ID NO: 5911357 - DNA, 15 bp, Homo sapiens
gcctcagaaggcccc

SEQ ID NO: 5911358 - DNA, 13 bp, Homo sapiens
gcctcagaagtgc

SEQ ID NO: 5911359 - DNA, 23 bp, Homo sapiens
gcctcagaattgatcattttccc

SEQ ID NO: 5911360 - DNA, 20 bp, Homo sapiens
gcctcagaccaactctctcc

SEQ ID NO: 5911361 - DNA, 18 bp, Homo sapiens
gcctcagaccccctcagc

SEQ ID NO: 5911362 - DNA, 17 bp, Homo sapiens
gcctcagacgttgcctg

SEQ ID NO: 5911363 - DNA, 19 bp, Homo sapiens
gcctcagacgttgcctgag

SEQ ID NO: 5911364 - DNA, 16 bp, Homo sapiens
gcctcagactcataca

SEQ ID NO: 5911365 - DNA, 17 bp, Homo sapiens
gcctcagactccgccct

SEQ ID NO: 5911366 - DNA, 19 bp, Homo sapiens
gcctcagactccgccctcc

SEQ ID NO: 5911367 - DNA, 18 bp, Homo sapiens
gcctcagagatctccctt

SEQ ID NO: 5911368 - DNA, 10 bp, Homo sapiens
gcctcagagc

SEQ ID NO: 5911369 - DNA, 12 bp, Homo sapiens
gcctcagagcct

SEQ ID NO: 5911370 - DNA, 14 bp, Homo sapiens
gcctcagagcctga

SEQ ID NO: 5911371 - DNA, 11 bp, Homo sapiens
gcctcagagct

SEQ ID NO: 5911372 - DNA, 12 bp, Homo sapiens
gcctcagagctt

SEQ ID NO: 5911373 - DNA, 16 bp, Homo sapiens
gcctcagagcttcctg

SEQ ID NO: 5911374 - DNA, 17 bp, Homo sapiens
gcctcagagcttcctgg

SEQ ID NO: 5911375 - DNA, 18 bp, Homo sapiens
gcctcagagcttcctggg

SEQ ID NO: 5911376 - DNA, 21 bp, Homo sapiens
gcctcagagcttcctggggac

SEQ ID NO: 5911377 - DNA, 11 bp, Homo sapiens
gcctcagagga

SEQ ID NO: 5911378 - DNA, 20 bp, Homo sapiens
gcctcagaggagctctaccc

SEQ ID NO: 5911379 - DNA, 22 bp, Homo sapiens
gcctcagaggccccttgctgct

SEQ ID NO: 5911380 - DNA, 20 bp, Homo sapiens
gcctcagaggccttgggagc

SEQ ID NO: 5911381 - DNA, 16 bp, Homo sapiens
gcctcagagtcctgcc

SEQ ID NO: 5911382 - DNA, 13 bp, Homo sapiens
gcctcagatccag

SEQ ID NO: 5911383 - DNA, 14 bp, Homo sapiens
gcctcagatccagg

SEQ ID NO: 5911384 - DNA, 22 bp, Homo sapiens
gcctcagatccaggcaggagca

SEQ ID NO: 5911385 - DNA, 15 bp, Homo sapiens
gcctcagattccttc

SEQ ID NO: 5911386 - DNA, 18 bp, Homo sapiens
gcctcagattccttccca

SEQ ID NO: 5911387 - DNA, 22 bp, Homo sapiens
gcctcagcaaacccaaagatgt

SEQ ID NO: 5911388 - DNA, 17 bp, Homo sapiens
gcctcagcaggaacctg

SEQ ID NO: 5911389 - DNA, 22 bp, Homo sapiens
gcctcagcaggaacctgtactg

SEQ ID NO: 5911390 - DNA, 15 bp, Homo sapiens
gcctcagcatcctgg

SEQ ID NO: 5911391 - DNA, 18 bp, Homo sapiens
gcctcagcatcctggcac

SEQ ID NO: 5911392 - DNA, 14 bp, Homo sapiens
gcctcagccacaaa

SEQ ID NO: 5911393 - DNA, 15 bp, Homo sapiens
gcctcagccacaaaa

SEQ ID NO: 5911394 - DNA, 20 bp, Homo sapiens
gcctcagccactcccagggg

SEQ ID NO: 5911395 - DNA, 13 bp, Homo sapiens
gcctcagccagag

SEQ ID NO: 5911396 - DNA, 14 bp, Homo sapiens
gcctcagccagaga

SEQ ID NO: 5911397 - DNA, 17 bp, Homo sapiens
gcctcagccagccctgg

SEQ ID NO: 5911398 - DNA, 18 bp, Homo sapiens
gcctcagccagctgccca

SEQ ID NO: 5911399 - DNA, 14 bp, Homo sapiens
gcctcagccaggcc

SEQ ID NO: 5911400 - DNA, 15 bp, Homo sapiens
gcctcagccaggccc

SEQ ID NO: 5911401 - DNA, 16 bp, Homo sapiens
gcctcagcccaacttc

SEQ ID NO: 5911402 - DNA, 16 bp, Homo sapiens
gcctcagccctcagaa

SEQ ID NO: 5911403 - DNA, 15 bp, Homo sapiens
gcctcagccctcagt

SEQ ID NO: 5911404 - DNA, 22 bp, Homo sapiens
gcctcagccctgaccctgtgga

SEQ ID NO: 5911405 - DNA, 22 bp, Homo sapiens
gcctcagccctgctccctgcct

SEQ ID NO: 5911406 - DNA, 12 bp, Homo sapiens
gcctcagcctcc

SEQ ID NO: 5911407 - DNA, 13 bp, Homo sapiens
gcctcagcctccc

SEQ ID NO: 5911408 - DNA, 21 bp, Homo sapiens
gcctcagcctcccatagctgg

SEQ ID NO: 5911409 - DNA, 23 bp, Homo sapiens
gcctcagcctcccatagctggga

SEQ ID NO: 5911410 - DNA, 17 bp, Homo sapiens
gcctcagcctccctggt

SEQ ID NO: 5911411 - DNA, 23 bp, Homo sapiens
gcctcagcctcctgaacagctgg

SEQ ID NO: 5911412 - DNA, 13 bp, Homo sapiens
gcctcagcctctc

SEQ ID NO: 5911413 - DNA, 12 bp, Homo sapiens
gcctcagcctgg

SEQ ID NO: 5911414 - DNA, 16 bp, Homo sapiens
gcctcagcctggggct

SEQ ID NO: 5911415 - DNA, 16 bp, Homo sapiens
gcctcagcgcggccct

SEQ ID NO: 5911416 - DNA, 15 bp, Homo sapiens
gcctcagcgctgccc

SEQ ID NO: 5911417 - DNA, 17 bp, Homo sapiens
gcctcagcgctgcccac

SEQ ID NO: 5911418 - DNA, 20 bp, Homo sapiens
gcctcagcgctgcccacacc

SEQ ID NO: 5911419 - DNA, 23 bp, Homo sapiens
gcctcagcggaccactcttctct

SEQ ID NO: 5911420 - DNA, 23 bp, Homo sapiens
gcctcagctacccactatccttc

SEQ ID NO: 5911421 - DNA, 18 bp, Homo sapiens
gcctcagctcagcctccc

SEQ ID NO: 5911422 - DNA, 19 bp, Homo sapiens
gcctcagctcagcctcccc

SEQ ID NO: 5911423 - DNA, 12 bp, Homo sapiens
gcctcagctcat

SEQ ID NO: 5911424 - DNA, 21 bp, Homo sapiens
gcctcagctcccacaagcctc

SEQ ID NO: 5911425 - DNA, 22 bp, Homo sapiens
gcctcagctcttggtgggccca

SEQ ID NO: 5911426 - DNA, 19 bp, Homo sapiens
gcctcagctgaatgcctcc

SEQ ID NO: 5911427 - DNA, 16 bp, Homo sapiens
gcctcagctgctcgca

SEQ ID NO: 5911428 - DNA, 17 bp, Homo sapiens
gcctcagctgctcgcac

SEQ ID NO: 5911429 - DNA, 15 bp, Homo sapiens
gcctcagctggctgt

SEQ ID NO: 5911430 - DNA, 16 bp, Homo sapiens
gcctcaggaggcagtg

SEQ ID NO: 5911431 - DNA, 13 bp, Homo sapiens
gcctcaggcactc

SEQ ID NO: 5911432 - DNA, 18 bp, Homo sapiens
gcctcaggccagggctca

SEQ ID NO: 5911433 - DNA, 13 bp, Homo sapiens
gcctcaggctctg

SEQ ID NO: 5911434 - DNA, 14 bp, Homo sapiens
gcctcaggctctgc

SEQ ID NO: 5911435 - DNA, 19 bp, Homo sapiens
gcctcaggcttgagggagg

SEQ ID NO: 5911436 - DNA, 17 bp, Homo sapiens
gcctcaggctttttcca

SEQ ID NO: 5911437 - DNA, 18 bp, Homo sapiens
gcctcaggctttttccat

SEQ ID NO: 5911438 - DNA, 21 bp, Homo sapiens
gcctcagggcagcctgcctgg

SEQ ID NO: 5911439 - DNA, 21 bp, Homo sapiens
gcctcagggccaagccggccc

SEQ ID NO: 5911440 - DNA, 18 bp, Homo sapiens
gcctcagggccaggaagg

SEQ ID NO: 5911441 - DNA, 15 bp, Homo sapiens
gcctcagggccaggc

SEQ ID NO: 5911442 - DNA, 16 bp, Homo sapiens
gcctcagggccaggcc

SEQ ID NO: 5911443 - DNA, 18 bp, Homo sapiens
gcctcagggccaggccca

SEQ ID NO: 5911444 - DNA, 12 bp, Homo sapiens
gcctcaggggag

SEQ ID NO: 5911445 - DNA, 16 bp, Homo sapiens
gcctcagggtgggaga

SEQ ID NO: 5911446 - DNA, 12 bp, Homo sapiens
gcctcaggtcct

SEQ ID NO: 5911447 - DNA, 17 bp, Homo sapiens
gcctcaggtgctgtcca

SEQ ID NO: 5911448 - DNA, 16 bp, Homo sapiens
gcctcaggtgggccgc

SEQ ID NO: 5911449 - DNA, 14 bp, Homo sapiens
gcctcaggttccta

SEQ ID NO: 5911450 - DNA, 15 bp, Homo sapiens
gcctcagtatattta

SEQ ID NO: 5911451 - DNA, 16 bp, Homo sapiens
gcctcagtatatttaa

SEQ ID NO: 5911452 - DNA, 16 bp, Homo sapiens
gcctcagtccctccct

SEQ ID NO: 5911453 - DNA, 17 bp, Homo sapiens
gcctcagtccctccctc

SEQ ID NO: 5911454 - DNA, 22 bp, Homo sapiens
gcctcagtccctccctcctggc

SEQ ID NO: 5911455 - DNA, 24 bp, Homo sapiens
gcctcagtcctcccctcacagcct

SEQ ID NO: 5911456 - DNA, 12 bp, Homo sapiens
gcctcagtgaaa

SEQ ID NO: 5911457 - DNA, 21 bp, Homo sapiens
gcctcagtgcagccccctcct

SEQ ID NO: 5911458 - DNA, 14 bp, Homo sapiens
gcctcagtgccact

SEQ ID NO: 5911459 - DNA, 16 bp, Homo sapiens
gcctcagtgccacttg

SEQ ID NO: 5911460 - DNA, 14 bp, Homo sapiens
gcctcagtggcagc

SEQ ID NO: 5911461 - DNA, 19 bp, Homo sapiens
gcctcagtggctctgggta

SEQ ID NO: 5911462 - DNA, 16 bp, Homo sapiens
gcctcagtgtgcccat

SEQ ID NO: 5911463 - DNA, 23 bp, Homo sapiens
gcctcagttaaatctcctgtgga

SEQ ID NO: 5911464 - DNA, 16 bp, Homo sapiens
gcctcagttacacagg

SEQ ID NO: 5911465 - DNA, 20 bp, Homo sapiens
gcctcagtttccccatttgt

SEQ ID NO: 5911466 - DNA, 19 bp, Homo sapiens
gcctcagtttctccatcag

SEQ ID NO: 5911467 - DNA, 17 bp, Homo sapiens
gcctcagttttccttct

SEQ ID NO: 5911468 - DNA, 18 bp, Homo sapiens
gcctcagttttccttctg

SEQ ID NO: 5911469 - DNA, 19 bp, Homo sapiens
gcctcagttttccttctgt

SEQ ID NO: 5911470 - DNA, 15 bp, Homo sapiens
gcctcatactcctgg

SEQ ID NO: 5911471 - DNA, 20 bp, Homo sapiens
gcctcatactcctgggctca

SEQ ID NO: 5911472 - DNA, 22 bp, Homo sapiens
gcctcatactcctgggctcaag

SEQ ID NO: 5911473 - DNA, 16 bp, Homo sapiens
gcctcatagcatagcc

SEQ ID NO: 5911474 - DNA, 20 bp, Homo sapiens
gcctcatagcatagccagca

SEQ ID NO: 5911475 - DNA, 14 bp, Homo sapiens
gcctcatccagggc

SEQ ID NO: 5911476 - DNA, 13 bp, Homo sapiens
gcctcatccctcg

SEQ ID NO: 5911477 - DNA, 24 bp, Homo sapiens
gcctcatccctcggaagccgtctg

SEQ ID NO: 5911478 - DNA, 20 bp, Homo sapiens
gcctcatcctccccaggacc

SEQ ID NO: 5911479 - DNA, 16 bp, Homo sapiens
gcctcatcctcctcct

SEQ ID NO: 5911480 - DNA, 19 bp, Homo sapiens
gcctcatcctcctcctcat

SEQ ID NO: 5911481 - DNA, 13 bp, Homo sapiens
gcctcatctcacc

SEQ ID NO: 5911482 - DNA, 16 bp, Homo sapiens
gcctcatctcacctct

SEQ ID NO: 5911483 - DNA, 23 bp, Homo sapiens
gcctcatctctgcctgacaaggc

SEQ ID NO: 5911484 - DNA, 21 bp, Homo sapiens
gcctcatcttccccagccctc

SEQ ID NO: 5911485 - DNA, 20 bp, Homo sapiens
gcctcatgaacactggctgc

SEQ ID NO: 5911486 - DNA, 21 bp, Homo sapiens
gcctcatgaccctcctgtcca

SEQ ID NO: 5911487 - DNA, 16 bp, Homo sapiens
gcctcatgccacacct

SEQ ID NO: 5911488 - DNA, 21 bp, Homo sapiens
gcctcctgagtagctgggact

SEQ ID NO: 5911489 - DNA, 12 bp, Homo sapiens
gcctcctgcagt

SEQ ID NO: 5911490 - DNA, 13 bp, Homo sapiens
gcctcctgcagtt

SEQ ID NO: 5911491 - DNA, 13 bp, Homo sapiens
gcctcctgccacc

SEQ ID NO: 5911492 - DNA, 14 bp, Homo sapiens
gcctcctgccaccc

SEQ ID NO: 5911493 - DNA, 22 bp, Homo sapiens
gcctcctgccaccccttcctcc

SEQ ID NO: 5911494 - DNA, 17 bp, Homo sapiens
gcctcctgcccagtccc

SEQ ID NO: 5911495 - DNA, 17 bp, Homo sapiens
gcctcctgccccctgcc

SEQ ID NO: 5911496 - DNA, 24 bp, Homo sapiens
gcctcctgccccctgccagtgaag

SEQ ID NO: 5911497 - DNA, 13 bp, Homo sapiens
gcctcctgccggc

SEQ ID NO: 5911498 - DNA, 17 bp, Homo sapiens
gcctcctgccggctcct

SEQ ID NO: 5911499 - DNA, 12 bp, Homo sapiens
gcctcctgcctc

SEQ ID NO: 5911500 - DNA, 14 bp, Homo sapiens
gcctcctgcctgcc

SEQ ID NO: 5911501 - DNA, 16 bp, Homo sapiens
gcctcctgctctctgg

SEQ ID NO: 5911502 - DNA, 16 bp, Homo sapiens
gcctcctgctgagtgg

SEQ ID NO: 5911503 - DNA, 20 bp, Homo sapiens
gcctcctgctgagtggtcca

SEQ ID NO: 5911504 - DNA, 15 bp, Homo sapiens
gcctcctgctttggg

SEQ ID NO: 5911505 - DNA, 19 bp, Homo sapiens
gcctcctgctttgggaaga

SEQ ID NO: 5911506 - DNA, 20 bp, Homo sapiens
gcctcctggaatcagtattt

SEQ ID NO: 5911507 - DNA, 21 bp, Homo sapiens
gcctcctggaggaccagattg

SEQ ID NO: 5911508 - DNA, 11 bp, Homo sapiens
gcctcctggcc

SEQ ID NO: 5911509 - DNA, 20 bp, Homo sapiens
gcctcctggccaagcaggct

SEQ ID NO: 5911510 - DNA, 14 bp, Homo sapiens
gcctcctggccaga

SEQ ID NO: 5911511 - DNA, 16 bp, Homo sapiens
gcctcctggccagacg

SEQ ID NO: 5911512 - DNA, 19 bp, Homo sapiens
gcctcctggccagacgctg

SEQ ID NO: 5911513 - DNA, 21 bp, Homo sapiens
gcctcctgggggacctttgta

SEQ ID NO: 5911514 - DNA, 14 bp, Homo sapiens
gcctcctgggttca

SEQ ID NO: 5911515 - DNA, 15 bp, Homo sapiens
gcctcctgtacctca

SEQ ID NO: 5911516 - DNA, 13 bp, Homo sapiens
gcctcctgtctta

SEQ ID NO: 5911517 - DNA, 15 bp, Homo sapiens
gcctcctgtgcctgg

SEQ ID NO: 5911518 - DNA, 14 bp, Homo sapiens
gcctcctgtggcct

SEQ ID NO: 5911519 - DNA, 14 bp, Homo sapiens
gcctcctgtgtgtc

SEQ ID NO: 5911520 - DNA, 17 bp, Homo sapiens
gcctcctgttctgccca

SEQ ID NO: 5911521 - DNA, 13 bp, Homo sapiens
gcctcctgtttgg

SEQ ID NO: 5911522 - DNA, 18 bp, Homo sapiens
gcctcctgttttctccct

SEQ ID NO: 5911523 - DNA, 19 bp, Homo sapiens
gcctcctgttttctccctc

SEQ ID NO: 5911524 - DNA, 18 bp, Homo sapiens
gcctccttacattaaaaa

SEQ ID NO: 5911525 - DNA, 17 bp, Homo sapiens
gcctccttccacctccc

SEQ ID NO: 5911526 - DNA, 14 bp, Homo sapiens
gcctccttcctctt

SEQ ID NO: 5911527 - DNA, 20 bp, Homo sapiens
gcctccttccttgctgtcct

SEQ ID NO: 5911528 - DNA, 22 bp, Homo sapiens
gcctccttcttccacttctcca

SEQ ID NO: 5911529 - DNA, 20 bp, Homo sapiens
gcctccttgatatttgtatt

SEQ ID NO: 5911530 - DNA, 15 bp, Homo sapiens
gcctccttgcctgga

SEQ ID NO: 5911531 - DNA, 20 bp, Homo sapiens
gcctccttgctgaccccagg

SEQ ID NO: 5911532 - DNA, 17 bp, Homo sapiens
gcctccttggccaccag

SEQ ID NO: 5911533 - DNA, 19 bp, Homo sapiens
gcctccttggtaaatacaa

SEQ ID NO: 5911534 - DNA, 15 bp, Homo sapiens
gcctccttgtccagg

SEQ ID NO: 5911535 - DNA, 22 bp, Homo sapiens
gcctccttgtgagagtggcttt

SEQ ID NO: 5911536 - DNA, 12 bp, Homo sapiens
gcctcctttttt

SEQ ID NO: 5911537 - DNA, 16 bp, Homo sapiens
gcctcgaactcctggg

SEQ ID NO: 5911538 - DNA, 16 bp, Homo sapiens
gcctcgaactggctgc

SEQ ID NO: 5911539 - DNA, 21 bp, Homo sapiens
gcctcgacacccccccaaccc

SEQ ID NO: 5911540 - DNA, 17 bp, Homo sapiens
gcctcgacctccccacc

SEQ ID NO: 5911541 - DNA, 20 bp, Homo sapiens
gcctcgacctccctggcttg

SEQ ID NO: 5911542 - DNA, 16 bp, Homo sapiens
gcctcgacgtcccttg

SEQ ID NO: 5911543 - DNA, 16 bp, Homo sapiens
gcctcgaggcaccggc

SEQ ID NO: 5911544 - DNA, 21 bp, Homo sapiens
gcctcgaggcaccggcgctgc

SEQ ID NO: 5911545 - DNA, 14 bp, Homo sapiens
gcctcgaggctggt

SEQ ID NO: 5911546 - DNA, 20 bp, Homo sapiens
gcctcgaggggcccagggaa

SEQ ID NO: 5911547 - DNA, 18 bp, Homo sapiens
gcctcgatgtcctcctct

SEQ ID NO: 5911548 - DNA, 20 bp, Homo sapiens
gcctcgatgtcctcctctgt

SEQ ID NO: 5911549 - DNA, 22 bp, Homo sapiens
gcctcgatgtcctcctctgtga

SEQ ID NO: 5911550 - DNA, 18 bp, Homo sapiens
gcctcgcaacccgtgcca

SEQ ID NO: 5911551 - DNA, 16 bp, Homo sapiens
gcctcgcacaggccct

SEQ ID NO: 5911552 - DNA, 17 bp, Homo sapiens
gcctcgcacttgcagag

SEQ ID NO: 5911553 - DNA, 18 bp, Homo sapiens
gcctcgcaggcctccctg

SEQ ID NO: 5911554 - DNA, 15 bp, Homo sapiens
gcctcgcccaccgca

SEQ ID NO: 5911555 - DNA, 20 bp, Homo sapiens
gcctcgcccaccgcatgccc

SEQ ID NO: 5911556 - DNA, 23 bp, Homo sapiens
gcctcgcccaccgcatgccccct

SEQ ID NO: 5911557 - DNA, 13 bp, Homo sapiens
gcctcgccccagc

SEQ ID NO: 5911558 - DNA, 20 bp, Homo sapiens
gcctcgccccagccaagcct

SEQ ID NO: 5911559 - DNA, 18 bp, Homo sapiens
gcctcgcccccgccccca

SEQ ID NO: 5911560 - DNA, 13 bp, Homo sapiens
gcctcgcccccgg

SEQ ID NO: 5911561 - DNA, 15 bp, Homo sapiens
gcctcgcccctccag

SEQ ID NO: 5911562 - DNA, 13 bp, Homo sapiens
gcctcgcccctgg

SEQ ID NO: 5911563 - DNA, 20 bp, Homo sapiens
gcctcgcctccccaccctcc

SEQ ID NO: 5911564 - DNA, 12 bp, Homo sapiens
gcctcgcctgcc

SEQ ID NO: 5911565 - DNA, 13 bp, Homo sapiens
gcctcgcctgccc

SEQ ID NO: 5911566 - DNA, 16 bp, Homo sapiens
gcctcgcctgccctcc

SEQ ID NO: 5911567 - DNA, 17 bp, Homo sapiens
gcctcgcctgccctcct

SEQ ID NO: 5911568 - DNA, 18 bp, Homo sapiens
gcctcgcctgccctcctc

SEQ ID NO: 5911569 - DNA, 16 bp, Homo sapiens
gcctcgcctgggccca

SEQ ID NO: 5911570 - DNA, 18 bp, Homo sapiens
gcctcgcctgggcccagg

SEQ ID NO: 5911571 - DNA, 12 bp, Homo sapiens
gcctcgcctgtc

SEQ ID NO: 5911572 - DNA, 13 bp, Homo sapiens
gcctcgcctgtca

SEQ ID NO: 5911573 - DNA, 15 bp, Homo sapiens
gcctcgctcaccgct

SEQ ID NO: 5911574 - DNA, 19 bp, Homo sapiens
gcctcgctcaccgctggcc

SEQ ID NO: 5911575 - DNA, 16 bp, Homo sapiens
gcctcgctccccactc

SEQ ID NO: 5911576 - DNA, 15 bp, Homo sapiens
gcctcgctcccttca

SEQ ID NO: 5911577 - DNA, 23 bp, Homo sapiens
gcctcgctctgttacccagggtg

SEQ ID NO: 5911578 - DNA, 16 bp, Homo sapiens
gcctcgctttttcatc

SEQ ID NO: 5911579 - DNA, 19 bp, Homo sapiens
gcctcgctttttcatcctt

SEQ ID NO: 5911580 - DNA, 13 bp, Homo sapiens
gcctcggactcca

SEQ ID NO: 5911581 - DNA, 14 bp, Homo sapiens
gcctcggaggctcc

SEQ ID NO: 5911582 - DNA, 15 bp, Homo sapiens
gcctcggaggctcct

SEQ ID NO: 5911583 - DNA, 23 bp, Homo sapiens
gcctcggaggctcctccctctgc

SEQ ID NO: 5911584 - DNA, 20 bp, Homo sapiens
gcctcggagtgtggcctgga

SEQ ID NO: 5911585 - DNA, 21 bp, Homo sapiens
gcctcggagtgtggcctggat

SEQ ID NO: 5911586 - DNA, 17 bp, Homo sapiens
gcctcggatccccttcc

SEQ ID NO: 5911587 - DNA, 21 bp, Homo sapiens
gcctcggcagaactctctgtc

SEQ ID NO: 5911588 - DNA, 22 bp, Homo sapiens
gcctcggcagaactctctgtct

SEQ ID NO: 5911589 - DNA, 18 bp, Homo sapiens
gcctcggcccctcccaca

SEQ ID NO: 5911590 - DNA, 16 bp, Homo sapiens
gcctcggcctcccaaa

SEQ ID NO: 5911591 - DNA, 14 bp, Homo sapiens
gcctcggcctggct

SEQ ID NO: 5911592 - DNA, 17 bp, Homo sapiens
gcctcggcctggctggc

SEQ ID NO: 5911593 - DNA, 21 bp, Homo sapiens
gcctcggcctggctggccagg

SEQ ID NO: 5911594 - DNA, 17 bp, Homo sapiens
gcctcggcctggcttca

SEQ ID NO: 5911595 - DNA, 22 bp, Homo sapiens
gcctcggctaggggtcctcggg

SEQ ID NO: 5911596 - DNA, 15 bp, Homo sapiens
gcctcggctcctgct

SEQ ID NO: 5911597 - DNA, 18 bp, Homo sapiens
gcctcggctggctcccct

SEQ ID NO: 5911598 - DNA, 22 bp, Homo sapiens
gcctcggctggctcccctgcag

SEQ ID NO: 5911599 - DNA, 17 bp, Homo sapiens
gcctcggctgtctcctg

SEQ ID NO: 5911600 - DNA, 18 bp, Homo sapiens
gcctcggcttttctcagc

SEQ ID NO: 5911601 - DNA, 21 bp, Homo sapiens
gcctcgggacacctgccctgc

SEQ ID NO: 5911602 - DNA, 14 bp, Homo sapiens
gcctcgggccgcct

SEQ ID NO: 5911603 - DNA, 18 bp, Homo sapiens
gcctcgggccgcctcctc

SEQ ID NO: 5911604 - DNA, 19 bp, Homo sapiens
gcctcgggccgcctcctcc

SEQ ID NO: 5911605 - DNA, 14 bp, Homo sapiens
gcctcggggcaggg

SEQ ID NO: 5911606 - DNA, 17 bp, Homo sapiens
gcctcggggcagggcag

SEQ ID NO: 5911607 - DNA, 17 bp, Homo sapiens
gcctcggtatctggctt

SEQ ID NO: 5911608 - DNA, 19 bp, Homo sapiens
gcctcggtatctggcttcc

SEQ ID NO: 5911609 - DNA, 17 bp, Homo sapiens
gcctcggtggccatgct

SEQ ID NO: 5911610 - DNA, 15 bp, Homo sapiens
gcctcgtaccagcca

SEQ ID NO: 5911611 - DNA, 19 bp, Homo sapiens
gcctcgtagagtgacctcg

SEQ ID NO: 5911612 - DNA, 14 bp, Homo sapiens
gcctcgtgaggggc

SEQ ID NO: 5911613 - DNA, 18 bp, Homo sapiens
gcctcgtgaggggcaagc

SEQ ID NO: 5911614 - DNA, 19 bp, Homo sapiens
gcctcgtgaggggcaagct

SEQ ID NO: 5911615 - DNA, 13 bp, Homo sapiens
gcctcgtgccagc

SEQ ID NO: 5911616 - DNA, 15 bp, Homo sapiens
gcctcgtgccagcag

SEQ ID NO: 5911617 - DNA, 14 bp, Homo sapiens
gcctcgtgccatga

SEQ ID NO: 5911618 - DNA, 19 bp, Homo sapiens
gcctcgtgccatgatctgt

SEQ ID NO: 5911619 - DNA, 22 bp, Homo sapiens
gcctcgtggagctcgcccctcc

SEQ ID NO: 5911620 - DNA, 22 bp, Homo sapiens
gcctcgtggttattagcaaggc

SEQ ID NO: 5911621 - DNA, 23 bp, Homo sapiens
gcctcgtggttattagcaaggct

SEQ ID NO: 5911622 - DNA, 16 bp, Homo sapiens
gcctcgtgtcctgcta

SEQ ID NO: 5911623 - DNA, 18 bp, Homo sapiens
gcctcgttaggacaaggc

SEQ ID NO: 5911624 - DNA, 20 bp, Homo sapiens
gcctcgttaggacaaggctg

SEQ ID NO: 5911625 - DNA, 22 bp, Homo sapiens
gcctcgttaggacaaggctgtg

SEQ ID NO: 5911626 - DNA, 19 bp, Homo sapiens
gcctcgttggagagcagca

SEQ ID NO: 5911627 - DNA, 18 bp, Homo sapiens
gcctctaacaaatgatct

SEQ ID NO: 5911628 - DNA, 15 bp, Homo sapiens
gcctctaaccccagg

SEQ ID NO: 5911629 - DNA, 17 bp, Homo sapiens
gcctctaaccccaggcc

SEQ ID NO: 5911630 - DNA, 19 bp, Homo sapiens
gcctctaaccccaggcccc

SEQ ID NO: 5911631 - DNA, 20 bp, Homo sapiens
gcctctaaccccaggccccg

SEQ ID NO: 5911632 - DNA, 21 bp, Homo sapiens
gcctctaaccccaggccccga

SEQ ID NO: 5911633 - DNA, 18 bp, Homo sapiens
gcctctaactccctcctc

SEQ ID NO: 5911634 - DNA, 19 bp, Homo sapiens
gcctctaactccctcctca

SEQ ID NO: 5911635 - DNA, 20 bp, Homo sapiens
gcctctaactccctcctcac

SEQ ID NO: 5911636 - DNA, 16 bp, Homo sapiens
gcctctaactcctggg

SEQ ID NO: 5911637 - DNA, 16 bp, Homo sapiens
gcctctacagccgtcc

SEQ ID NO: 5911638 - DNA, 17 bp, Homo sapiens
gcctctacagccgtccc

SEQ ID NO: 5911639 - DNA, 15 bp, Homo sapiens
gcctctactaggtct

SEQ ID NO: 5911640 - DNA, 16 bp, Homo sapiens
gcctctactgggaagg

SEQ ID NO: 5911641 - DNA, 22 bp, Homo sapiens
gcctctagaacacccactggcc

SEQ ID NO: 5911642 - DNA, 11 bp, Homo sapiens
gcctctagctg

SEQ ID NO: 5911643 - DNA, 19 bp, Homo sapiens
gcctctagggacccctcct

SEQ ID NO: 5911644 - DNA, 22 bp, Homo sapiens
gcctctagtccccaaggcctct

SEQ ID NO: 5911645 - DNA, 22 bp, Homo sapiens
gcctctagtgtaccaagtgctt

SEQ ID NO: 5911646 - DNA, 13 bp, Homo sapiens
gcctctatgccct

SEQ ID NO: 5911647 - DNA, 16 bp, Homo sapiens
gcctctatgccctgca

SEQ ID NO: 5911648 - DNA, 20 bp, Homo sapiens
gcctctatgccctgcagagc

SEQ ID NO: 5911649 - DNA, 21 bp, Homo sapiens
gcctctatgccctgcagagca

SEQ ID NO: 5911650 - DNA, 22 bp, Homo sapiens
gcctctatgccctgcagagcaa

SEQ ID NO: 5911651 - DNA, 13 bp, Homo sapiens
gcctctcaagtag

SEQ ID NO: 5911652 - DNA, 18 bp, Homo sapiens
gcctctcaagtagctggg

SEQ ID NO: 5911653 - DNA, 13 bp, Homo sapiens
gcctctcacacac

SEQ ID NO: 5911654 - DNA, 16 bp, Homo sapiens
gcctctcaccccactt

SEQ ID NO: 5911655 - DNA, 23 bp, Homo sapiens
gcctctcacctctgtgcctctgt

SEQ ID NO: 5911656 - DNA, 15 bp, Homo sapiens
gcctctcagaaaact

SEQ ID NO: 5911657 - DNA, 14 bp, Homo sapiens
gcctctcaggttca

SEQ ID NO: 5911658 - DNA, 21 bp, Homo sapiens
gcctctcagtatcttaaaatt

SEQ ID NO: 5911659 - DNA, 19 bp, Homo sapiens
gcctctcagtgccctccag

SEQ ID NO: 5911660 - DNA, 13 bp, Homo sapiens
gcctctccaaggg

SEQ ID NO: 5911661 - DNA, 14 bp, Homo sapiens
gcctctccagcctc

SEQ ID NO: 5911662 - DNA, 16 bp, Homo sapiens
gcctctccatttgctc

SEQ ID NO: 5911663 - DNA, 13 bp, Homo sapiens
gcctctcccaccc

SEQ ID NO: 5911664 - DNA, 14 bp, Homo sapiens
gcctctcccaggca

SEQ ID NO: 5911665 - DNA, 20 bp, Homo sapiens
gcctctcccaggcaggggcc

SEQ ID NO: 5911666 - DNA, 18 bp, Homo sapiens
gcctctcccaggctgtcc

SEQ ID NO: 5911667 - DNA, 15 bp, Homo sapiens
gcctctcccatcact

SEQ ID NO: 5911668 - DNA, 23 bp, Homo sapiens
gcctctcccatggctttgtgctg

SEQ ID NO: 5911669 - DNA, 14 bp, Homo sapiens
gcctctccccacct

SEQ ID NO: 5911670 - DNA, 16 bp, Homo sapiens
gcctctccccaccttc

SEQ ID NO: 5911671 - DNA, 19 bp, Homo sapiens
gcctctccccagagcattt

SEQ ID NO: 5911672 - DNA, 18 bp, Homo sapiens
gcctctccccaggtccag

SEQ ID NO: 5911673 - DNA, 19 bp, Homo sapiens
gcctctccccgctctggat

SEQ ID NO: 5911674 - DNA, 12 bp, Homo sapiens
gcctctcccctg

SEQ ID NO: 5911675 - DNA, 13 bp, Homo sapiens
gcctctcccctga

SEQ ID NO: 5911676 - DNA, 18 bp, Homo sapiens
gcctctcccctgcctgcc

SEQ ID NO: 5911677 - DNA, 13 bp, Homo sapiens
gcctctcccgcac

SEQ ID NO: 5911678 - DNA, 18 bp, Homo sapiens
gcctctcccgcaccaggc

SEQ ID NO: 5911679 - DNA, 17 bp, Homo sapiens
gcctctcccgtcagggc

SEQ ID NO: 5911680 - DNA, 24 bp, Homo sapiens
gcctctccctgcactccctcctgg

SEQ ID NO: 5911681 - DNA, 13 bp, Homo sapiens
gcctctccctgcc

SEQ ID NO: 5911682 - DNA, 14 bp, Homo sapiens
gcctctccctgcct

SEQ ID NO: 5911683 - DNA, 16 bp, Homo sapiens
gcctctccctgcctgt

SEQ ID NO: 5911684 - DNA, 17 bp, Homo sapiens
gcctctccctgcctgtg

SEQ ID NO: 5911685 - DNA, 22 bp, Homo sapiens
gcctctccctgctgctcctagg

SEQ ID NO: 5911686 - DNA, 13 bp, Homo sapiens
gcctctccctggg

SEQ ID NO: 5911687 - DNA, 14 bp, Homo sapiens
gcctctccctgggt

SEQ ID NO: 5911688 - DNA, 16 bp, Homo sapiens
gcctctccctgggtct

SEQ ID NO: 5911689 - DNA, 16 bp, Homo sapiens
gcctctccgcccacgc

SEQ ID NO: 5911690 - DNA, 20 bp, Homo sapiens
gcctctccgcccctgagccc

SEQ ID NO: 5911691 - DNA, 21 bp, Homo sapiens
gcctctcctccttgggcaggg

SEQ ID NO: 5911692 - DNA, 22 bp, Homo sapiens
gcctctcctgccctctgctctg

SEQ ID NO: 5911693 - DNA, 17 bp, Homo sapiens
gcctctccttgccccag

SEQ ID NO: 5911694 - DNA, 18 bp, Homo sapiens
gcctctccttgccccagt

SEQ ID NO: 5911695 - DNA, 22 bp, Homo sapiens
gcctctccttgccccagtcctg

SEQ ID NO: 5911696 - DNA, 20 bp, Homo sapiens
gcctctccttggaaggtctt

SEQ ID NO: 5911697 - DNA, 12 bp, Homo sapiens
gcctctcctttg

SEQ ID NO: 5911698 - DNA, 15 bp, Homo sapiens
gcctctcctttgtat

SEQ ID NO: 5911699 - DNA, 17 bp, Homo sapiens
gcctctcggtgacctcc

SEQ ID NO: 5911700 - DNA, 18 bp, Homo sapiens
gcctctcggttgaaacct

SEQ ID NO: 5911701 - DNA, 21 bp, Homo sapiens
gcctctcgtcccgtccctccc

SEQ ID NO: 5911702 - DNA, 21 bp, Homo sapiens
gcctctctatcctctcttcct

SEQ ID NO: 5911703 - DNA, 17 bp, Homo sapiens
gcctctctcagcccagg

SEQ ID NO: 5911704 - DNA, 16 bp, Homo sapiens
gcctctctcccagtct

SEQ ID NO: 5911705 - DNA, 17 bp, Homo sapiens
gcctctctcccagtcta

SEQ ID NO: 5911706 - DNA, 13 bp, Homo sapiens
gcctctctccctc

SEQ ID NO: 5911707 - DNA, 14 bp, Homo sapiens
gcctctctccttgg

SEQ ID NO: 5911708 - DNA, 21 bp, Homo sapiens
gcctctctccttggccacaga

SEQ ID NO: 5911709 - DNA, 14 bp, Homo sapiens
gcctctctctccca

SEQ ID NO: 5911710 - DNA, 15 bp, Homo sapiens
gcctctctctcccaa

SEQ ID NO: 5911711 - DNA, 15 bp, Homo sapiens
gcctctctctctctc

SEQ ID NO: 5911712 - DNA, 17 bp, Homo sapiens
gcctctctctctctcct

SEQ ID NO: 5911713 - DNA, 23 bp, Homo sapiens
gcctctctctctctcctcaggac

SEQ ID NO: 5911714 - DNA, 14 bp, Homo sapiens
gcctctctctgcct

SEQ ID NO: 5911715 - DNA, 15 bp, Homo sapiens
gcctctctctgcctg

SEQ ID NO: 5911716 - DNA, 13 bp, Homo sapiens
gcctctctctgct

SEQ ID NO: 5911717 - DNA, 13 bp, Homo sapiens
gcctctctctttt

SEQ ID NO: 5911718 - DNA, 17 bp, Homo sapiens
gcctctctgcaggtccc

SEQ ID NO: 5911719 - DNA, 19 bp, Homo sapiens
gcctctctgcaggtcccta

SEQ ID NO: 5911720 - DNA, 15 bp, Homo sapiens
gcctctctgccagcc

SEQ ID NO: 5911721 - DNA, 16 bp, Homo sapiens
gcctctctgccagccg

SEQ ID NO: 5911722 - DNA, 18 bp, Homo sapiens
gcctctctgccagccgct

SEQ ID NO: 5911723 - DNA, 19 bp, Homo sapiens
gcctctctgccagccgctg

SEQ ID NO: 5911724 - DNA, 12 bp, Homo sapiens
gcctctctgccc

SEQ ID NO: 5911725 - DNA, 17 bp, Homo sapiens
gcctctctgccccaccc

SEQ ID NO: 5911726 - DNA, 14 bp, Homo sapiens
gcctctctgcctgg

SEQ ID NO: 5911727 - DNA, 14 bp, Homo sapiens
gcctctctgctata

SEQ ID NO: 5911728 - DNA, 16 bp, Homo sapiens
gcctctctgctccaga

SEQ ID NO: 5911729 - DNA, 23 bp, Homo sapiens
gcctctctggaaagaggctctgg

SEQ ID NO: 5911730 - DNA, 18 bp, Homo sapiens
gcctctctggaagaggga

SEQ ID NO: 5911731 - DNA, 17 bp, Homo sapiens
gcctctctggcctccca

SEQ ID NO: 5911732 - DNA, 18 bp, Homo sapiens
gcctctctggcctcccac

SEQ ID NO: 5911733 - DNA, 19 bp, Homo sapiens
gcctctctggcctcccacc

SEQ ID NO: 5911734 - DNA, 21 bp, Homo sapiens
gcctctctggctcagcccggg

SEQ ID NO: 5911735 - DNA, 13 bp, Homo sapiens
gcctctctggctg

SEQ ID NO: 5911736 - DNA, 13 bp, Homo sapiens
gcctctctggggg

SEQ ID NO: 5911737 - DNA, 15 bp, Homo sapiens
gcctctctgggggag

SEQ ID NO: 5911738 - DNA, 20 bp, Homo sapiens
gcctctctgggggaggcagg

SEQ ID NO: 5911739 - DNA, 16 bp, Homo sapiens
gcctctcttctgtgtc

SEQ ID NO: 5911740 - DNA, 16 bp, Homo sapiens
gcctctcttgcccctt

SEQ ID NO: 5911741 - DNA, 19 bp, Homo sapiens
gcctctcttggtttccttc

SEQ ID NO: 5911742 - DNA, 23 bp, Homo sapiens
gcctctcttgtaatttggatctc

SEQ ID NO: 5911743 - DNA, 17 bp, Homo sapiens
gcctctctttcacacaa

SEQ ID NO: 5911744 - DNA, 16 bp, Homo sapiens
gcctctgaaaagtgtg

SEQ ID NO: 5911745 - DNA, 16 bp, Homo sapiens
gcctctgaaatttccc

SEQ ID NO: 5911746 - DNA, 19 bp, Homo sapiens
gcctctgaaatttcccaca

SEQ ID NO: 5911747 - DNA, 18 bp, Homo sapiens
gcctctgaactgctgctg

SEQ ID NO: 5911748 - DNA, 18 bp, Homo sapiens
gcctctgaagttggacag

SEQ ID NO: 5911749 - DNA, 23 bp, Homo sapiens
gcctctgacagtccacaggggcc

SEQ ID NO: 5911750 - DNA, 13 bp, Homo sapiens
gcctctgacccct

SEQ ID NO: 5911751 - DNA, 14 bp, Homo sapiens
gcctctgacccctc

SEQ ID NO: 5911752 - DNA, 20 bp, Homo sapiens
gcctctgacccctcctcact

SEQ ID NO: 5911753 - DNA, 15 bp, Homo sapiens
gcctctgactcacca

SEQ ID NO: 5911754 - DNA, 16 bp, Homo sapiens
gcctctgactcaccac

SEQ ID NO: 5911755 - DNA, 15 bp, Homo sapiens
gcctctgagatgcta

SEQ ID NO: 5911756 - DNA, 12 bp, Homo sapiens
gcctctgagcca

SEQ ID NO: 5911757 - DNA, 15 bp, Homo sapiens
gcctctgagccactg

SEQ ID NO: 5911758 - DNA, 17 bp, Homo sapiens
gcctctgagcccaagct

SEQ ID NO: 5911759 - DNA, 18 bp, Homo sapiens
gcctctgagcccaagcta

SEQ ID NO: 5911760 - DNA, 19 bp, Homo sapiens
gcctctgagcttctaaact

SEQ ID NO: 5911761 - DNA, 14 bp, Homo sapiens
gcctctgaggagcc

SEQ ID NO: 5911762 - DNA, 16 bp, Homo sapiens
gcctctgaggagccca

SEQ ID NO: 5911763 - DNA, 20 bp, Homo sapiens
gcctctgaggagcccacggg

SEQ ID NO: 5911764 - DNA, 13 bp, Homo sapiens
gcctctgaggcca

SEQ ID NO: 5911765 - DNA, 14 bp, Homo sapiens
gcctctgaggccag

SEQ ID NO: 5911766 - DNA, 15 bp, Homo sapiens
gcctctgaggccagc

SEQ ID NO: 5911767 - DNA, 18 bp, Homo sapiens
gcctctgaggccagcctg

SEQ ID NO: 5911768 - DNA, 23 bp, Homo sapiens
gcctctgaggccagcctggcctc

SEQ ID NO: 5911769 - DNA, 22 bp, Homo sapiens
gcctctgagggaaagcccagaa

SEQ ID NO: 5911770 - DNA, 20 bp, Homo sapiens
gcctctgagttttgatgctg

SEQ ID NO: 5911771 - DNA, 17 bp, Homo sapiens
gcctctgatatgggact

SEQ ID NO: 5911772 - DNA, 16 bp, Homo sapiens
gcctctgatctgtgca

SEQ ID NO: 5911773 - DNA, 23 bp, Homo sapiens
gcctctgattctatgtaacttgt

SEQ ID NO: 5911774 - DNA, 17 bp, Homo sapiens
gcctctgattttctcca

SEQ ID NO: 5911775 - DNA, 18 bp, Homo sapiens
gcctctgcaactgcaaga

SEQ ID NO: 5911776 - DNA, 21 bp, Homo sapiens
gcctctgcacaccctccagag

SEQ ID NO: 5911777 - DNA, 22 bp, Homo sapiens
gcctctgcacgtgcacacacct

SEQ ID NO: 5911778 - DNA, 18 bp, Homo sapiens
gcctctgcactcccctgc

SEQ ID NO: 5911779 - DNA, 13 bp, Homo sapiens
gcctctgcagaag

SEQ ID NO: 5911780 - DNA, 20 bp, Homo sapiens
gcctctgcagtcgcttgcca

SEQ ID NO: 5911781 - DNA, 21 bp, Homo sapiens
gcctctgcagtcgcttgccaa

SEQ ID NO: 5911782 - DNA, 22 bp, Homo sapiens
gcctctgcagtcgcttgccaaa

SEQ ID NO: 5911783 - DNA, 15 bp, Homo sapiens
gcctctgcattcagg

SEQ ID NO: 5911784 - DNA, 23 bp, Homo sapiens
gcctctgccaaaggatgtgatat

SEQ ID NO: 5911785 - DNA, 14 bp, Homo sapiens
gcctctgccacagc

SEQ ID NO: 5911786 - DNA, 16 bp, Homo sapiens
gcctctgccactgact

SEQ ID NO: 5911787 - DNA, 12 bp, Homo sapiens
gcctctgccagg

SEQ ID NO: 5911788 - DNA, 18 bp, Homo sapiens
gcctctgccaggcctgta

SEQ ID NO: 5911789 - DNA, 21 bp, Homo sapiens
gcctctgccatcctccctgtt

SEQ ID NO: 5911790 - DNA, 20 bp, Homo sapiens
gcctctgccatgcccagaga

SEQ ID NO: 5911791 - DNA, 20 bp, Homo sapiens
gcctctgcccaagcagcctg

SEQ ID NO: 5911792 - DNA, 14 bp, Homo sapiens
gcctctgccccaag

SEQ ID NO: 5911793 - DNA, 23 bp, Homo sapiens
gcctctgccccaaggggcccaca

SEQ ID NO: 5911794 - DNA, 16 bp, Homo sapiens
gcctctgccccgtctc

SEQ ID NO: 5911795 - DNA, 22 bp, Homo sapiens
gcctctgcccctcccaacccag

SEQ ID NO: 5911796 - DNA, 14 bp, Homo sapiens
gcctctgcccgcag

SEQ ID NO: 5911797 - DNA, 15 bp, Homo sapiens
gcctctgcccgcaga

SEQ ID NO: 5911798 - DNA, 22 bp, Homo sapiens
gcctctgcccgcagagcccacg

SEQ ID NO: 5911799 - DNA, 17 bp, Homo sapiens
gcctctgccctggattg

SEQ ID NO: 5911800 - DNA, 16 bp, Homo sapiens
gcctctgcccttgggg

SEQ ID NO: 5911801 - DNA, 18 bp, Homo sapiens
gcctctgccgctgccatg

SEQ ID NO: 5911802 - DNA, 12 bp, Homo sapiens
gcctctgcctcc

SEQ ID NO: 5911803 - DNA, 13 bp, Homo sapiens
gcctctgcctccc

SEQ ID NO: 5911804 - DNA, 14 bp, Homo sapiens
gcctctgcctccca

SEQ ID NO: 5911805 - DNA, 15 bp, Homo sapiens
gcctctgcctcccag

SEQ ID NO: 5911806 - DNA, 11 bp, Homo sapiens
gcctctgcctg

SEQ ID NO: 5911807 - DNA, 12 bp, Homo sapiens
gcctctgcctgg

SEQ ID NO: 5911808 - DNA, 15 bp, Homo sapiens
gcctctgcctggggc

SEQ ID NO: 5911809 - DNA, 16 bp, Homo sapiens
gcctctgcctgtgcac

SEQ ID NO: 5911810 - DNA, 18 bp, Homo sapiens
gcctctgccttagaggag

SEQ ID NO: 5911811 - DNA, 20 bp, Homo sapiens
gcctctgccttgatggagaa

SEQ ID NO: 5911812 - DNA, 19 bp, Homo sapiens
gcctctgcgagtggtttct

SEQ ID NO: 5911813 - DNA, 22 bp, Homo sapiens
gcctctgcgcctctccactgtt

SEQ ID NO: 5911814 - DNA, 13 bp, Homo sapiens
gcctctgctccct

SEQ ID NO: 5911815 - DNA, 16 bp, Homo sapiens
gcctctgctccctctg

SEQ ID NO: 5911816 - DNA, 23 bp, Homo sapiens
gcctctgctggaaggggcagcag

SEQ ID NO: 5911817 - DNA, 15 bp, Homo sapiens
gcctctgctggctca

SEQ ID NO: 5911818 - DNA, 16 bp, Homo sapiens
gcctctgctggctcag

SEQ ID NO: 5911819 - DNA, 21 bp, Homo sapiens
gcctctgctggtctctggctc

SEQ ID NO: 5911820 - DNA, 18 bp, Homo sapiens
gcctctgcttacttttta

SEQ ID NO: 5911821 - DNA, 21 bp, Homo sapiens
gcctctgcttgccagccagga

SEQ ID NO: 5911822 - DNA, 17 bp, Homo sapiens
gcctctggaaaactatt

SEQ ID NO: 5911823 - DNA, 15 bp, Homo sapiens
gcctctggaaagcaa

SEQ ID NO: 5911824 - DNA, 20 bp, Homo sapiens
gcctctggaatgcatggggc

SEQ ID NO: 5911825 - DNA, 21 bp, Homo sapiens
gcctctggacagatgggtgtc

SEQ ID NO: 5911826 - DNA, 20 bp, Homo sapiens
gcctctggacagccagtgac

SEQ ID NO: 5911827 - DNA, 23 bp, Homo sapiens
gcctctggacctcggtgatgcct

SEQ ID NO: 5911828 - DNA, 21 bp, Homo sapiens
gcctctggaggcctctggccc

SEQ ID NO: 5911829 - DNA, 20 bp, Homo sapiens
gcctctggaggcctctgggc

SEQ ID NO: 5911830 - DNA, 13 bp, Homo sapiens
gcctctggatcta

SEQ ID NO: 5911831 - DNA, 12 bp, Homo sapiens
gcctctggccag

SEQ ID NO: 5911832 - DNA, 13 bp, Homo sapiens
gcctctggccaga

SEQ ID NO: 5911833 - DNA, 24 bp, Homo sapiens
gcctctggcccctcacccaccatg

SEQ ID NO: 5911834 - DNA, 16 bp, Homo sapiens
gcctctggccgccacc

SEQ ID NO: 5911835 - DNA, 12 bp, Homo sapiens
gcctctggctag

SEQ ID NO: 5911836 - DNA, 13 bp, Homo sapiens
gcctctggctaga

SEQ ID NO: 5911837 - DNA, 18 bp, Homo sapiens
gcctctggctagaggcca

SEQ ID NO: 5911838 - DNA, 22 bp, Homo sapiens
gcctctggctagaggccagccc

SEQ ID NO: 5911839 - DNA, 23 bp, Homo sapiens
gcctctggctagaggccagcccc

SEQ ID NO: 5911840 - DNA, 11 bp, Homo sapiens
gcctctggctc

SEQ ID NO: 5911841 - DNA, 18 bp, Homo sapiens
gcctctggctccacacct

SEQ ID NO: 5911842 - DNA, 17 bp, Homo sapiens
gcctctggctgcctggc

SEQ ID NO: 5911843 - DNA, 19 bp, Homo sapiens
gcctctggctgcctggccc

SEQ ID NO: 5911844 - DNA, 17 bp, Homo sapiens
gcctgcaggcaggtggg

SEQ ID NO: 5911845 - DNA, 23 bp, Homo sapiens
gcctgcaggcaggtgggggctgc

SEQ ID NO: 5911846 - DNA, 13 bp, Homo sapiens
gcctgcaggcatg

SEQ ID NO: 5911847 - DNA, 14 bp, Homo sapiens
gcctgcaggccagt

SEQ ID NO: 5911848 - DNA, 12 bp, Homo sapiens
gcctgcaggccc

SEQ ID NO: 5911849 - DNA, 14 bp, Homo sapiens
gcctgcaggcccca

SEQ ID NO: 5911850 - DNA, 18 bp, Homo sapiens
gcctgcaggccccagcca

SEQ ID NO: 5911851 - DNA, 18 bp, Homo sapiens
gcctgcaggctggagact

SEQ ID NO: 5911852 - DNA, 12 bp, Homo sapiens
gcctgcagggaa

SEQ ID NO: 5911853 - DNA, 15 bp, Homo sapiens
gcctgcagggaagcc

SEQ ID NO: 5911854 - DNA, 19 bp, Homo sapiens
gcctgcagggaataacata

SEQ ID NO: 5911855 - DNA, 21 bp, Homo sapiens
gcctgcagggccatggctcag

SEQ ID NO: 5911856 - DNA, 21 bp, Homo sapiens
gcctgcagggtggtgctggga

SEQ ID NO: 5911857 - DNA, 23 bp, Homo sapiens
gcctgcagggtggtgctgggact

SEQ ID NO: 5911858 - DNA, 16 bp, Homo sapiens
gcctgcaggtgctgct

SEQ ID NO: 5911859 - DNA, 19 bp, Homo sapiens
gcctgcaggtgctgctgcg

SEQ ID NO: 5911860 - DNA, 17 bp, Homo sapiens
gcctgcagtcttctggg

SEQ ID NO: 5911861 - DNA, 21 bp, Homo sapiens
gcctgcagtcttctgggctgc

SEQ ID NO: 5911862 - DNA, 18 bp, Homo sapiens
gcctgcagtgattcagca

SEQ ID NO: 5911863 - DNA, 16 bp, Homo sapiens
gcctgcagtggtgtga

SEQ ID NO: 5911864 - DNA, 11 bp, Homo sapiens
gcctgcagttt

SEQ ID NO: 5911865 - DNA, 16 bp, Homo sapiens
gcctgcataggctcct

SEQ ID NO: 5911866 - DNA, 17 bp, Homo sapiens
gcctgcataggctcctt

SEQ ID NO: 5911867 - DNA, 21 bp, Homo sapiens
gcctgcataggctccttcctg

SEQ ID NO: 5911868 - DNA, 22 bp, Homo sapiens
gcctgcatcattctttctgcta

SEQ ID NO: 5911869 - DNA, 21 bp, Homo sapiens
gcctgcatccattctcctgag

SEQ ID NO: 5911870 - DNA, 23 bp, Homo sapiens
gcctgcatcccaggatgctgggt

SEQ ID NO: 5911871 - DNA, 20 bp, Homo sapiens
gcctgcatctagctggagcc

SEQ ID NO: 5911872 - DNA, 15 bp, Homo sapiens
gcctgcatggagaag

SEQ ID NO: 5911873 - DNA, 13 bp, Homo sapiens
gcctgcattctgc

SEQ ID NO: 5911874 - DNA, 16 bp, Homo sapiens
gcctgcattgagcttg

SEQ ID NO: 5911875 - DNA, 21 bp, Homo sapiens
gcctgccacctccccccacaa

SEQ ID NO: 5911876 - DNA, 13 bp, Homo sapiens
gcctgccacctct

SEQ ID NO: 5911877 - DNA, 18 bp, Homo sapiens
gcctgccacctctcccag

SEQ ID NO: 5911878 - DNA, 12 bp, Homo sapiens
gcctgccacctg

SEQ ID NO: 5911879 - DNA, 16 bp, Homo sapiens
gcctgccacctggacc

SEQ ID NO: 5911880 - DNA, 17 bp, Homo sapiens
gcctgccacctggaccc

SEQ ID NO: 5911881 - DNA, 23 bp, Homo sapiens
gcctgccacctggacccctgcat

SEQ ID NO: 5911882 - DNA, 15 bp, Homo sapiens
gcctgccactctcct

SEQ ID NO: 5911883 - DNA, 17 bp, Homo sapiens
gcctgccactctcctga

SEQ ID NO: 5911884 - DNA, 19 bp, Homo sapiens
gcctgccactctcctgagg

SEQ ID NO: 5911885 - DNA, 18 bp, Homo sapiens
gcctgccactctctggga

SEQ ID NO: 5911886 - DNA, 20 bp, Homo sapiens
gcctgccactctctgggact

SEQ ID NO: 5911887 - DNA, 14 bp, Homo sapiens
gcctgccactgtgt

SEQ ID NO: 5911888 - DNA, 15 bp, Homo sapiens
gcctgccactgtgtg

SEQ ID NO: 5911889 - DNA, 18 bp, Homo sapiens
gcctgccaggaggaccca

SEQ ID NO: 5911890 - DNA, 20 bp, Homo sapiens
gcctgccaggaggacccagg

SEQ ID NO: 5911891 - DNA, 23 bp, Homo sapiens
gcctgccaggaggacccagggct

SEQ ID NO: 5911892 - DNA, 15 bp, Homo sapiens
gcctgccaggccctc

SEQ ID NO: 5911893 - DNA, 17 bp, Homo sapiens
gcctgccagggcccctg

SEQ ID NO: 5911894 - DNA, 18 bp, Homo sapiens
gcctgccagggcccctgt

SEQ ID NO: 5911895 - DNA, 19 bp, Homo sapiens
gcctgccagtcctagctgc

SEQ ID NO: 5911896 - DNA, 20 bp, Homo sapiens
gcctgccagtcctagctgca

SEQ ID NO: 5911897 - DNA, 20 bp, Homo sapiens
gcctgccatagccaggagcg

SEQ ID NO: 5911898 - DNA, 12 bp, Homo sapiens
gcctgccatctt

SEQ ID NO: 5911899 - DNA, 10 bp, Homo sapiens
gcctgccatg

SEQ ID NO: 5911900 - DNA, 13 bp, Homo sapiens
gcctgccatggct

SEQ ID NO: 5911901 - DNA, 15 bp, Homo sapiens
gcctgccatggctgt

SEQ ID NO: 5911902 - DNA, 16 bp, Homo sapiens
gcctgccatggctgtg

SEQ ID NO: 5911903 - DNA, 19 bp, Homo sapiens
gcctgccatgggccagcct

SEQ ID NO: 5911904 - DNA, 20 bp, Homo sapiens
gcctgccatgggccagccta

SEQ ID NO: 5911905 - DNA, 14 bp, Homo sapiens
gcctgccatgtacc

SEQ ID NO: 5911906 - DNA, 20 bp, Homo sapiens
gcctgccatgtacctcccct

SEQ ID NO: 5911907 - DNA, 20 bp, Homo sapiens
gcctgcccaagcccaggcca

SEQ ID NO: 5911908 - DNA, 18 bp, Homo sapiens
gcctgcccaatgctttgg

SEQ ID NO: 5911909 - DNA, 12 bp, Homo sapiens
gcctgcccacct

SEQ ID NO: 5911910 - DNA, 19 bp, Homo sapiens
gcctgcccacctgcctggc

SEQ ID NO: 5911911 - DNA, 21 bp, Homo sapiens
gcctgcccacctgcctggccg

SEQ ID NO: 5911912 - DNA, 15 bp, Homo sapiens
gcctgcccagacaag

SEQ ID NO: 5911913 - DNA, 14 bp, Homo sapiens
gcctgcccagactg

SEQ ID NO: 5911914 - DNA, 13 bp, Homo sapiens
gcctgcccaggcc

SEQ ID NO: 5911915 - DNA, 18 bp, Homo sapiens
gcctgcccaggcccctgc

SEQ ID NO: 5911916 - DNA, 19 bp, Homo sapiens
gcctgcccaggcccctgcc

SEQ ID NO: 5911917 - DNA, 20 bp, Homo sapiens
gcctgcccaggcccctgcca

SEQ ID NO: 5911918 - DNA, 22 bp, Homo sapiens
gcctgcccaggcccctgccacc

SEQ ID NO: 5911919 - DNA, 22 bp, Homo sapiens
gcctgcccattctgccctgtgg

SEQ ID NO: 5911920 - DNA, 18 bp, Homo sapiens
gcctgccccagcctccca

SEQ ID NO: 5911921 - DNA, 14 bp, Homo sapiens
gcctgccccagctg

SEQ ID NO: 5911922 - DNA, 16 bp, Homo sapiens
gcctgccccagctggg

SEQ ID NO: 5911923 - DNA, 19 bp, Homo sapiens
gcctgccccagctgggctg

SEQ ID NO: 5911924 - DNA, 15 bp, Homo sapiens
gcctgcccccacacc

SEQ ID NO: 5911925 - DNA, 13 bp, Homo sapiens
gcctgcccccagc

SEQ ID NO: 5911926 - DNA, 19 bp, Homo sapiens
gcctgccccccagtctccc

SEQ ID NO: 5911927 - DNA, 12 bp, Homo sapiens
gcctgcccccct

SEQ ID NO: 5911928 - DNA, 16 bp, Homo sapiens
gcctgcccccctcatc

SEQ ID NO: 5911929 - DNA, 14 bp, Homo sapiens
gcctgccccccttc

SEQ ID NO: 5911930 - DNA, 15 bp, Homo sapiens
gcctgccccctgggc

SEQ ID NO: 5911931 - DNA, 18 bp, Homo sapiens
gcctgcccctcccagaac

SEQ ID NO: 5911932 - DNA, 17 bp, Homo sapiens
gcctgcccctctcccgc

SEQ ID NO: 5911933 - DNA, 15 bp, Homo sapiens
gcctgcccctgctgc

SEQ ID NO: 5911934 - DNA, 14 bp, Homo sapiens
gcctgcccgcacag

SEQ ID NO: 5911935 - DNA, 19 bp, Homo sapiens
gcctgcccgcacagcagcc

SEQ ID NO: 5911936 - DNA, 17 bp, Homo sapiens
gcctgcccgcaccctgg

SEQ ID NO: 5911937 - DNA, 18 bp, Homo sapiens
gcctgcccgcaccctggc

SEQ ID NO: 5911938 - DNA, 20 bp, Homo sapiens
gcctgcccgcaccctggcct

SEQ ID NO: 5911939 - DNA, 22 bp, Homo sapiens
gcctgcccgcaccctggcctgg

SEQ ID NO: 5911940 - DNA, 17 bp, Homo sapiens
gcctgcccgcccgccgg

SEQ ID NO: 5911941 - DNA, 16 bp, Homo sapiens
gcctgcccgtgccctg

SEQ ID NO: 5911942 - DNA, 17 bp, Homo sapiens
gcctgcccgtgccctgg

SEQ ID NO: 5911943 - DNA, 14 bp, Homo sapiens
gcctgccctcccct

SEQ ID NO: 5911944 - DNA, 19 bp, Homo sapiens
gcctgccctcccgcacctt

SEQ ID NO: 5911945 - DNA, 22 bp, Homo sapiens
gcctgccctcccgcaccttcct

SEQ ID NO: 5911946 - DNA, 17 bp, Homo sapiens
gcctgccctccctgggg

SEQ ID NO: 5911947 - DNA, 16 bp, Homo sapiens
gcctgccctcctctcc

SEQ ID NO: 5911948 - DNA, 21 bp, Homo sapiens
gcctgccctcctctcccgtct

SEQ ID NO: 5911949 - DNA, 12 bp, Homo sapiens
gcctgccctctg

SEQ ID NO: 5911950 - DNA, 20 bp, Homo sapiens
gcctgccctctgccccatca

SEQ ID NO: 5911951 - DNA, 18 bp, Homo sapiens
gcctgccctctgtctgtc

SEQ ID NO: 5911952 - DNA, 24 bp, Homo sapiens
gcctgccctgaaagtcccagatca

SEQ ID NO: 5911953 - DNA, 12 bp, Homo sapiens
gcctgccctgcc

SEQ ID NO: 5911954 - DNA, 14 bp, Homo sapiens
gcctgccctgccca

SEQ ID NO: 5911955 - DNA, 15 bp, Homo sapiens
gcctgccctgcccaa

SEQ ID NO: 5911956 - DNA, 16 bp, Homo sapiens
gcctgccctgcccaag

SEQ ID NO: 5911957 - DNA, 17 bp, Homo sapiens
gcctgccctgcccaagt

SEQ ID NO: 5911958 - DNA, 16 bp, Homo sapiens
gcctgccctgccttgc

SEQ ID NO: 5911959 - DNA, 21 bp, Homo sapiens
gcctgccctgccttgccgctc

SEQ ID NO: 5911960 - DNA, 14 bp, Homo sapiens
gcctgccctgctat

SEQ ID NO: 5911961 - DNA, 14 bp, Homo sapiens
gcctgccctggtga

SEQ ID NO: 5911962 - DNA, 12 bp, Homo sapiens
gcctgccgagca

SEQ ID NO: 5911963 - DNA, 19 bp, Homo sapiens
gcctgccgagcaaccgtgg

SEQ ID NO: 5911964 - DNA, 17 bp, Homo sapiens
gcctgccgcccaaagag

SEQ ID NO: 5911965 - DNA, 23 bp, Homo sapiens
gcctgccgcccccgcctgggcac

SEQ ID NO: 5911966 - DNA, 21 bp, Homo sapiens
gcctgccgccgtctctgtccc

SEQ ID NO: 5911967 - DNA, 21 bp, Homo sapiens
gcctgccggtaaacacgcctg

SEQ ID NO: 5911968 - DNA, 14 bp, Homo sapiens
gcctgccgtgcatg

SEQ ID NO: 5911969 - DNA, 16 bp, Homo sapiens
gcctgccgtgcatggc

SEQ ID NO: 5911970 - DNA, 18 bp, Homo sapiens
gcctgcctaaccaggccc

SEQ ID NO: 5911971 - DNA, 19 bp, Homo sapiens
gcctgcctaaccaggccca

SEQ ID NO: 5911972 - DNA, 17 bp, Homo sapiens
gcctgcctagcactcac

SEQ ID NO: 5911973 - DNA, 13 bp, Homo sapiens
gcctgcctcaccc

SEQ ID NO: 5911974 - DNA, 14 bp, Homo sapiens
gcctgcctcaccca

SEQ ID NO: 5911975 - DNA, 20 bp, Homo sapiens
gcctgcctcagctgctcgca

SEQ ID NO: 5911976 - DNA, 23 bp, Homo sapiens
gcctgcctcagctgctcgcacag

SEQ ID NO: 5911977 - DNA, 12 bp, Homo sapiens
gcctgcctcagt

SEQ ID NO: 5911978 - DNA, 17 bp, Homo sapiens
gcctgcctcagtggcag

SEQ ID NO: 5911979 - DNA, 19 bp, Homo sapiens
gcctgcctcagtggcagca

SEQ ID NO: 5911980 - DNA, 23 bp, Homo sapiens
gcctgcctcagtggcagcatcct

SEQ ID NO: 5911981 - DNA, 10 bp, Homo sapiens
gcctgcctcc

SEQ ID NO: 5911982 - DNA, 14 bp, Homo sapiens
gcctgcctccaccc

SEQ ID NO: 5911983 - DNA, 16 bp, Homo sapiens
gcctgcctccagggct

SEQ ID NO: 5911984 - DNA, 18 bp, Homo sapiens
gcctgcctccagggctgg

SEQ ID NO: 5911985 - DNA, 13 bp, Homo sapiens
gcctgcctcccaa

SEQ ID NO: 5911986 - DNA, 15 bp, Homo sapiens
gcctgcctcccagcc

SEQ ID NO: 5911987 - DNA, 22 bp, Homo sapiens
gcctgcctcccagccctgccag

SEQ ID NO: 5911988 - DNA, 23 bp, Homo sapiens
gcctgcctcccagccctgccagg

SEQ ID NO: 5911989 - DNA, 24 bp, Homo sapiens
gcctgcctcccagccctgccagga

SEQ ID NO: 5911990 - DNA, 15 bp, Homo sapiens
gcctgcctcctccct

SEQ ID NO: 5911991 - DNA, 16 bp, Homo sapiens
gcctgcctcctccctc

SEQ ID NO: 5911992 - DNA, 13 bp, Homo sapiens
gcctgcctcctgg

SEQ ID NO: 5911993 - DNA, 16 bp, Homo sapiens
gcctgcctcctggctc

SEQ ID NO: 5911994 - DNA, 13 bp, Homo sapiens
gcctgcctccttc

SEQ ID NO: 5911995 - DNA, 17 bp, Homo sapiens
gcctgcctccttcagtg

SEQ ID NO: 5911996 - DNA, 17 bp, Homo sapiens
gcctgcctcgccttgtg

SEQ ID NO: 5911997 - DNA, 16 bp, Homo sapiens
gcctgcctctgactca

SEQ ID NO: 5911998 - DNA, 13 bp, Homo sapiens
gcctgcctctgcc

SEQ ID NO: 5911999 - DNA, 15 bp, Homo sapiens
gcctgcctctgcctc

SEQ ID NO: 5912000 - DNA, 13 bp, Homo sapiens
gcctgcctcttgg

SEQ ID NO: 5912001 - DNA, 13 bp, Homo sapiens
gcctgcctgaaga

SEQ ID NO: 5912002 - DNA, 13 bp, Homo sapiens
gcctgcctgcagc

SEQ ID NO: 5912003 - DNA, 16 bp, Homo sapiens
gcctgcctgcctccac

SEQ ID NO: 5912004 - DNA, 12 bp, Homo sapiens
gcctgcctggag

SEQ ID NO: 5912005 - DNA, 13 bp, Homo sapiens
gcctgcctggcag

SEQ ID NO: 5912006 - DNA, 16 bp, Homo sapiens
gcctgcctggcaggct

SEQ ID NO: 5912007 - DNA, 13 bp, Homo sapiens
gcctgcctgggaa

SEQ ID NO: 5912008 - DNA, 13 bp, Homo sapiens
gcctgcctgtctg

SEQ ID NO: 5912009 - DNA, 18 bp, Homo sapiens
gcctgcctgtggagacag

SEQ ID NO: 5912010 - DNA, 20 bp, Homo sapiens
gcctgcctgtggagacagcc

SEQ ID NO: 5912011 - DNA, 20 bp, Homo sapiens
gcctgccttaagtgaggaaa

SEQ ID NO: 5912012 - DNA, 21 bp, Homo sapiens
gcctgccttaagtgaggaaat

SEQ ID NO: 5912013 - DNA, 20 bp, Homo sapiens
gcctgccttaccgagagcca

SEQ ID NO: 5912014 - DNA, 13 bp, Homo sapiens
gcctgccttctcc

SEQ ID NO: 5912015 - DNA, 16 bp, Homo sapiens
gcctgccttgaagcca

SEQ ID NO: 5912016 - DNA, 22 bp, Homo sapiens
gcctgccttgcccactcctgct

SEQ ID NO: 5912017 - DNA, 20 bp, Homo sapiens
gcctgcctttggcactctga

SEQ ID NO: 5912018 - DNA, 20 bp, Homo sapiens
gcctgccttttctagtttta

SEQ ID NO: 5912019 - DNA, 14 bp, Homo sapiens
gcctgcgaccctgg

SEQ ID NO: 5912020 - DNA, 15 bp, Homo sapiens
gcctgcgaccctggg

SEQ ID NO: 5912021 - DNA, 14 bp, Homo sapiens
gcctgcgagaccca

SEQ ID NO: 5912022 - DNA, 18 bp, Homo sapiens
gcctgcgatggtgctgca

SEQ ID NO: 5912023 - DNA, 15 bp, Homo sapiens
gcctggcctggccct

SEQ ID NO: 5912024 - DNA, 13 bp, Homo sapiens
gcctggcctggct

SEQ ID NO: 5912025 - DNA, 14 bp, Homo sapiens
gcctggcctggctc

SEQ ID NO: 5912026 - DNA, 14 bp, Homo sapiens
gcctggcctgtggc

SEQ ID NO: 5912027 - DNA, 18 bp, Homo sapiens
gcctggcggagatgcttc

SEQ ID NO: 5912028 - DNA, 14 bp, Homo sapiens
gcctggcggcaggg

SEQ ID NO: 5912029 - DNA, 16 bp, Homo sapiens
gcctggcggcaggggt

SEQ ID NO: 5912030 - DNA, 13 bp, Homo sapiens
gcctggcggcctg

SEQ ID NO: 5912031 - DNA, 16 bp, Homo sapiens
gcctggcggcctgtgg

SEQ ID NO: 5912032 - DNA, 17 bp, Homo sapiens
gcctggcggcctgtggg

SEQ ID NO: 5912033 - DNA, 18 bp, Homo sapiens
gcctggcggcctgtgggt

SEQ ID NO: 5912034 - DNA, 15 bp, Homo sapiens
gcctggcgggatggg

SEQ ID NO: 5912035 - DNA, 20 bp, Homo sapiens
gcctggcgggatgggccacc

SEQ ID NO: 5912036 - DNA, 23 bp, Homo sapiens
gcctggcgggatgggccaccgcc

SEQ ID NO: 5912037 - DNA, 15 bp, Homo sapiens
gcctggcgggcagcc

SEQ ID NO: 5912038 - DNA, 17 bp, Homo sapiens
gcctggcgggcagcccc

SEQ ID NO: 5912039 - DNA, 19 bp, Homo sapiens
gcctggcgggcagcccctg

SEQ ID NO: 5912040 - DNA, 20 bp, Homo sapiens
gcctggcgggcagcccctgc

SEQ ID NO: 5912041 - DNA, 23 bp, Homo sapiens
gcctggcgggcagcccctgctgg

SEQ ID NO: 5912042 - DNA, 21 bp, Homo sapiens
gcctggcggggttggcccttg

SEQ ID NO: 5912043 - DNA, 17 bp, Homo sapiens
gcctggctccaggctcc

SEQ ID NO: 5912044 - DNA, 20 bp, Homo sapiens
gcctggctcccacaggcagc

SEQ ID NO: 5912045 - DNA, 16 bp, Homo sapiens
gcctggctcccaggac

SEQ ID NO: 5912046 - DNA, 13 bp, Homo sapiens
gcctggctcccca

SEQ ID NO: 5912047 - DNA, 22 bp, Homo sapiens
gcctggctccccgagggctcag

SEQ ID NO: 5912048 - DNA, 13 bp, Homo sapiens
gcctggctcccct

SEQ ID NO: 5912049 - DNA, 14 bp, Homo sapiens
gcctggctcccctg

SEQ ID NO: 5912050 - DNA, 15 bp, Homo sapiens
gcctggctcccctgg

SEQ ID NO: 5912051 - DNA, 19 bp, Homo sapiens
gcctggctccgctgtgtgg

SEQ ID NO: 5912052 - DNA, 10 bp, Homo sapiens
gcctggctct

SEQ ID NO: 5912053 - DNA, 13 bp, Homo sapiens
gcctggctctgcc

SEQ ID NO: 5912054 - DNA, 14 bp, Homo sapiens
gcctggctctgccc

SEQ ID NO: 5912055 - DNA, 17 bp, Homo sapiens
gcctggctgattcagca

SEQ ID NO: 5912056 - DNA, 12 bp, Homo sapiens
gcctggctggaa

SEQ ID NO: 5912057 - DNA, 17 bp, Homo sapiens
gcctggctggaggagca

SEQ ID NO: 5912058 - DNA, 23 bp, Homo sapiens
gcctggctggaggagcagcagct

SEQ ID NO: 5912059 - DNA, 14 bp, Homo sapiens
gcctggctggccag

SEQ ID NO: 5912060 - DNA, 15 bp, Homo sapiens
gcctggctggccagg

SEQ ID NO: 5912061 - DNA, 16 bp, Homo sapiens
gcctggctggccagga

SEQ ID NO: 5912062 - DNA, 17 bp, Homo sapiens
gcctggctggccaggac

SEQ ID NO: 5912063 - DNA, 18 bp, Homo sapiens
gcctggctggccaggaca

SEQ ID NO: 5912064 - DNA, 11 bp, Homo sapiens
gcctggctggg

SEQ ID NO: 5912065 - DNA, 12 bp, Homo sapiens
gcctggctgggc

SEQ ID NO: 5912066 - DNA, 13 bp, Homo sapiens
gcctggctgggct

SEQ ID NO: 5912067 - DNA, 14 bp, Homo sapiens
gcctggctgggctt

SEQ ID NO: 5912068 - DNA, 21 bp, Homo sapiens
gcctggctgggctttggggct

SEQ ID NO: 5912069 - DNA, 21 bp, Homo sapiens
gcctggctgggtggtattctg

SEQ ID NO: 5912070 - DNA, 19 bp, Homo sapiens
gcctggctggtcctcccat

SEQ ID NO: 5912071 - DNA, 21 bp, Homo sapiens
gcctggctggtttgcccagag

SEQ ID NO: 5912072 - DNA, 14 bp, Homo sapiens
gcctggctgtggag

SEQ ID NO: 5912073 - DNA, 19 bp, Homo sapiens
gcctggctgtggaggcctg

SEQ ID NO: 5912074 - DNA, 13 bp, Homo sapiens
gcctggcttctcc

SEQ ID NO: 5912075 - DNA, 16 bp, Homo sapiens
gcctggcttctccttt

SEQ ID NO: 5912076 - DNA, 17 bp, Homo sapiens
gcctggcttctggagcc

SEQ ID NO: 5912077 - DNA, 17 bp, Homo sapiens
gcctggcttctgggaca

SEQ ID NO: 5912078 - DNA, 20 bp, Homo sapiens
gcctggcttctttctctcag

SEQ ID NO: 5912079 - DNA, 23 bp, Homo sapiens
gcctggctttggtccccagcatt

SEQ ID NO: 5912080 - DNA, 16 bp, Homo sapiens
gcctggcttttctggc

SEQ ID NO: 5912081 - DNA, 19 bp, Homo sapiens
gcctggcttttctggctgg

SEQ ID NO: 5912082 - DNA, 18 bp, Homo sapiens
gcctgggaaaagggcagg

SEQ ID NO: 5912083 - DNA, 19 bp, Homo sapiens
gcctgggaaaagggcagga

SEQ ID NO: 5912084 - DNA, 16 bp, Homo sapiens
gcctgggaaaccctct

SEQ ID NO: 5912085 - DNA, 16 bp, Homo sapiens
gcctgggaaagcccct

SEQ ID NO: 5912086 - DNA, 18 bp, Homo sapiens
gcctgggaaataagcccc

SEQ ID NO: 5912087 - DNA, 19 bp, Homo sapiens
gcctgggaaattgctccat

SEQ ID NO: 5912088 - DNA, 16 bp, Homo sapiens
gcctgggaatcctgct

SEQ ID NO: 5912089 - DNA, 19 bp, Homo sapiens
gcctgggaatcctgctgcc

SEQ ID NO: 5912090 - DNA, 20 bp, Homo sapiens
gcctgggaatcctgctgcca

SEQ ID NO: 5912091 - DNA, 23 bp, Homo sapiens
gcctgggaatgtattattctgca

SEQ ID NO: 5912092 - DNA, 16 bp, Homo sapiens
gcctgggacaactgct

SEQ ID NO: 5912093 - DNA, 16 bp, Homo sapiens
gcctgggacacacaca

SEQ ID NO: 5912094 - DNA, 22 bp, Homo sapiens
gcctgggacacttccctgggcc

SEQ ID NO: 5912095 - DNA, 16 bp, Homo sapiens
gcctgggactcccagt

SEQ ID NO: 5912096 - DNA, 17 bp, Homo sapiens
gcctgggactcccagtg

SEQ ID NO: 5912097 - DNA, 21 bp, Homo sapiens
gcctgggacttccatgcctta

SEQ ID NO: 5912098 - DNA, 10 bp, Homo sapiens
gcctgggaga

SEQ ID NO: 5912099 - DNA, 23 bp, Homo sapiens
gcctgggagagtggacctgtgct

SEQ ID NO: 5912100 - DNA, 17 bp, Homo sapiens
gcctgggagatgcagct

SEQ ID NO: 5912101 - DNA, 18 bp, Homo sapiens
gcctgggagatgcagctg

SEQ ID NO: 5912102 - DNA, 14 bp, Homo sapiens
gcctgggagcccag

SEQ ID NO: 5912103 - DNA, 16 bp, Homo sapiens
gcctgggagcccagag

SEQ ID NO: 5912104 - DNA, 13 bp, Homo sapiens
gcctgggagggtg

SEQ ID NO: 5912105 - DNA, 14 bp, Homo sapiens
gcctgggagggtgg

SEQ ID NO: 5912106 - DNA, 21 bp, Homo sapiens
gcctgggagggttcccctggc

SEQ ID NO: 5912107 - DNA, 13 bp, Homo sapiens
gcctgggatctcg

SEQ ID NO: 5912108 - DNA, 15 bp, Homo sapiens
gcctgggatgcagtg

SEQ ID NO: 5912109 - DNA, 14 bp, Homo sapiens
gcctgggatgccct

SEQ ID NO: 5912110 - DNA, 16 bp, Homo sapiens
gcctgggatgcccttc

SEQ ID NO: 5912111 - DNA, 19 bp, Homo sapiens
gcctgggatgcccttcccc

SEQ ID NO: 5912112 - DNA, 20 bp, Homo sapiens
gcctgggatgctagccccag

SEQ ID NO: 5912113 - DNA, 21 bp, Homo sapiens
gcctgggatgctagccccaga

SEQ ID NO: 5912114 - DNA, 21 bp, Homo sapiens
gcctgggatttctatgcagtg

SEQ ID NO: 5912115 - DNA, 23 bp, Homo sapiens
gcctgggcaacaaagtgagactc

SEQ ID NO: 5912116 - DNA, 19 bp, Homo sapiens
gcctgggcaacagagcaag

SEQ ID NO: 5912117 - DNA, 21 bp, Homo sapiens
gcctgggcaacagagcaagac

SEQ ID NO: 5912118 - DNA, 22 bp, Homo sapiens
gcctgggcaataaagtgagacc

SEQ ID NO: 5912119 - DNA, 23 bp, Homo sapiens
gcctgggcaatggccaggggcca

SEQ ID NO: 5912120 - DNA, 13 bp, Homo sapiens
gcctgggcagagg

SEQ ID NO: 5912121 - DNA, 17 bp, Homo sapiens
gcctgggcagccaggct

SEQ ID NO: 5912122 - DNA, 15 bp, Homo sapiens
gcctgggcagcttct

SEQ ID NO: 5912123 - DNA, 16 bp, Homo sapiens
gcctgggcagcttctg

SEQ ID NO: 5912124 - DNA, 12 bp, Homo sapiens
gcctgggcagga

SEQ ID NO: 5912125 - DNA, 17 bp, Homo sapiens
gcctgggcaggaccctg

SEQ ID NO: 5912126 - DNA, 13 bp, Homo sapiens
gcctgggcagtgc

SEQ ID NO: 5912127 - DNA, 14 bp, Homo sapiens
gcctgggcagtgcc

SEQ ID NO: 5912128 - DNA, 13 bp, Homo sapiens
gcctgggccacac

SEQ ID NO: 5912129 - DNA, 13 bp, Homo sapiens
gcctgggccagag

SEQ ID NO: 5912130 - DNA, 19 bp, Homo sapiens
gcctgggcccaggcccagc

SEQ ID NO: 5912131 - DNA, 20 bp, Homo sapiens
gcctgggcccaggcccagcc

SEQ ID NO: 5912132 - DNA, 22 bp, Homo sapiens
gcctgggcccaggcccagcctc

SEQ ID NO: 5912133 - DNA, 21 bp, Homo sapiens
gcctgggcccaggctctggga

SEQ ID NO: 5912134 - DNA, 23 bp, Homo sapiens
gcctgggcccaggctctgggaag

SEQ ID NO: 5912135 - DNA, 16 bp, Homo sapiens
gcctgggcccatctcc

SEQ ID NO: 5912136 - DNA, 18 bp, Homo sapiens
gcctgggcccatctccct

SEQ ID NO: 5912137 - DNA, 21 bp, Homo sapiens
gcctgggcccatctccctgct

SEQ ID NO: 5912138 - DNA, 23 bp, Homo sapiens
gcctgggcccatctccctgcttt

SEQ ID NO: 5912139 - DNA, 15 bp, Homo sapiens
gcctgggccccagct

SEQ ID NO: 5912140 - DNA, 17 bp, Homo sapiens
gcctgggcccctcagcc

SEQ ID NO: 5912141 - DNA, 15 bp, Homo sapiens
gcctgggcccctccc

SEQ ID NO: 5912142 - DNA, 17 bp, Homo sapiens
gcctgggcccctcccct

SEQ ID NO: 5912143 - DNA, 16 bp, Homo sapiens
gcctgggccctgggct

SEQ ID NO: 5912144 - DNA, 17 bp, Homo sapiens
gcctgggccctgggctg

SEQ ID NO: 5912145 - DNA, 22 bp, Homo sapiens
gcctgggccctgggctgatgga

SEQ ID NO: 5912146 - DNA, 16 bp, Homo sapiens
gcctgggccgcccaga

SEQ ID NO: 5912147 - DNA, 18 bp, Homo sapiens
gcctgggccgctgccacg

SEQ ID NO: 5912148 - DNA, 20 bp, Homo sapiens
gcctgggccggcgagggggc

SEQ ID NO: 5912149 - DNA, 14 bp, Homo sapiens
gcctgggcctatgg

SEQ ID NO: 5912150 - DNA, 22 bp, Homo sapiens
gcctgggcctatggagagccct

SEQ ID NO: 5912151 - DNA, 23 bp, Homo sapiens
gcctgggcctatggagagccctg

SEQ ID NO: 5912152 - DNA, 14 bp, Homo sapiens
gcctgggcctcatg

SEQ ID NO: 5912153 - DNA, 13 bp, Homo sapiens
gcctgggcctcct

SEQ ID NO: 5912154 - DNA, 14 bp, Homo sapiens
gcctgggcctcctc

SEQ ID NO: 5912155 - DNA, 21 bp, Homo sapiens
gcctgggcctcctcacaacat

SEQ ID NO: 5912156 - DNA, 21 bp, Homo sapiens
gcctgggcctcctcctagctg

SEQ ID NO: 5912157 - DNA, 15 bp, Homo sapiens
gcctgggcctggctc

SEQ ID NO: 5912158 - DNA, 17 bp, Homo sapiens
gcctgggcctggctccc

SEQ ID NO: 5912159 - DNA, 14 bp, Homo sapiens
gcctgggcctgggt

SEQ ID NO: 5912160 - DNA, 20 bp, Homo sapiens
gcctgggcctgtgcagcagc

SEQ ID NO: 5912161 - DNA, 21 bp, Homo sapiens
gcctgggcctgtgcagcagcc

SEQ ID NO: 5912162 - DNA, 20 bp, Homo sapiens
gcctgggcgaaagggtgaga

SEQ ID NO: 5912163 - DNA, 23 bp, Homo sapiens
gcctgggcgaaagggtgagactc

SEQ ID NO: 5912164 - DNA, 19 bp, Homo sapiens
gcctgggcgacagagcaag

SEQ ID NO: 5912165 - DNA, 17 bp, Homo sapiens
gcctgggcgctggtcct

SEQ ID NO: 5912166 - DNA, 23 bp, Homo sapiens
gcctgggctccctcttgtgggat

SEQ ID NO: 5912167 - DNA, 12 bp, Homo sapiens
gcctgggctcct

SEQ ID NO: 5912168 - DNA, 19 bp, Homo sapiens
gcctgggctcctctgcatc

SEQ ID NO: 5912169 - DNA, 13 bp, Homo sapiens
gcctgggctcctg

SEQ ID NO: 5912170 - DNA, 15 bp, Homo sapiens
gcctgggctcctgga

SEQ ID NO: 5912171 - DNA, 16 bp, Homo sapiens
gcctgggctcctggac

SEQ ID NO: 5912172 - DNA, 17 bp, Homo sapiens
gcctgggctcctggacc

SEQ ID NO: 5912173 - DNA, 17 bp, Homo sapiens
gcctgggctgtgaggac

SEQ ID NO: 5912174 - DNA, 15 bp, Homo sapiens
gcctgggctgttggc

SEQ ID NO: 5912175 - DNA, 21 bp, Homo sapiens
gcctgggcttccacagtgtga

SEQ ID NO: 5912176 - DNA, 13 bp, Homo sapiens
gcctggggacgga

SEQ ID NO: 5912177 - DNA, 17 bp, Homo sapiens
gcctggggatgagacac

SEQ ID NO: 5912178 - DNA, 20 bp, Homo sapiens
gcctggggatgtaaccaagc

SEQ ID NO: 5912179 - DNA, 22 bp, Homo sapiens
gcctggggatgtaaccaagctg

SEQ ID NO: 5912180 - DNA, 23 bp, Homo sapiens
gcctggggatgtaaccaagctgt

SEQ ID NO: 5912181 - DNA, 14 bp, Homo sapiens
gcctggggattggg

SEQ ID NO: 5912182 - DNA, 21 bp, Homo sapiens
gcctggggattgggagggaca

SEQ ID NO: 5912183 - DNA, 22 bp, Homo sapiens
gcctggggccggtagaggctcc

SEQ ID NO: 5912184 - DNA, 15 bp, Homo sapiens
gcctggggcctgaga

SEQ ID NO: 5912185 - DNA, 16 bp, Homo sapiens
gcctggggcctgagag

SEQ ID NO: 5912186 - DNA, 16 bp, Homo sapiens
gcctggggccttcctg

SEQ ID NO: 5912187 - DNA, 18 bp, Homo sapiens
gcctggggccttcctggc

SEQ ID NO: 5912188 - DNA, 23 bp, Homo sapiens
gcctggggctccgaaattccaag

SEQ ID NO: 5912189 - DNA, 21 bp, Homo sapiens
gcctggggctctaacgcctga

SEQ ID NO: 5912190 - DNA, 16 bp, Homo sapiens
gcctggggctctctga

SEQ ID NO: 5912191 - DNA, 14 bp, Homo sapiens
gcctggggctgccg

SEQ ID NO: 5912192 - DNA, 17 bp, Homo sapiens
gcctggggctggcctcc

SEQ ID NO: 5912193 - DNA, 18 bp, Homo sapiens
gcctggggctggctgcag

SEQ ID NO: 5912194 - DNA, 20 bp, Homo sapiens
gcctggggctggctgcagac

SEQ ID NO: 5912195 - DNA, 22 bp, Homo sapiens
gcctgggggacccctggctctg

SEQ ID NO: 5912196 - DNA, 19 bp, Homo sapiens
gcctgggggagttttcctc

SEQ ID NO: 5912197 - DNA, 17 bp, Homo sapiens
gcctgggggcagtgact

SEQ ID NO: 5912198 - DNA, 19 bp, Homo sapiens
gcctgggggcagtgactgg

SEQ ID NO: 5912199 - DNA, 14 bp, Homo sapiens
gcctgggggcctgg

SEQ ID NO: 5912200 - DNA, 16 bp, Homo sapiens
gcctgggggcctggct

SEQ ID NO: 5912201 - DNA, 14 bp, Homo sapiens
gcctgtcacctggg

SEQ ID NO: 5912202 - DNA, 21 bp, Homo sapiens
gcctgtcagatccaggagctc

SEQ ID NO: 5912203 - DNA, 23 bp, Homo sapiens
gcctgtcagccaacattgccttg

SEQ ID NO: 5912204 - DNA, 19 bp, Homo sapiens
gcctgtcaggaccatttta

SEQ ID NO: 5912205 - DNA, 15 bp, Homo sapiens
gcctgtcaggctctg

SEQ ID NO: 5912206 - DNA, 19 bp, Homo sapiens
gcctgtcatccttggtctt

SEQ ID NO: 5912207 - DNA, 15 bp, Homo sapiens
gcctgtcatgcgcaa

SEQ ID NO: 5912208 - DNA, 15 bp, Homo sapiens
gcctgtccacagccc

SEQ ID NO: 5912209 - DNA, 16 bp, Homo sapiens
gcctgtccacagcccc

SEQ ID NO: 5912210 - DNA, 15 bp, Homo sapiens
gcctgtccacaggct

SEQ ID NO: 5912211 - DNA, 20 bp, Homo sapiens
gcctgtccacaggcttctga

SEQ ID NO: 5912212 - DNA, 22 bp, Homo sapiens
gcctgtccacctgtgctgctgc

SEQ ID NO: 5912213 - DNA, 12 bp, Homo sapiens
gcctgtccagcc

SEQ ID NO: 5912214 - DNA, 13 bp, Homo sapiens
gcctgtccagcct

SEQ ID NO: 5912215 - DNA, 15 bp, Homo sapiens
gcctgtccagcctgg

SEQ ID NO: 5912216 - DNA, 17 bp, Homo sapiens
gcctgtcccaattctgc

SEQ ID NO: 5912217 - DNA, 19 bp, Homo sapiens
gcctgtcccactggctcct

SEQ ID NO: 5912218 - DNA, 17 bp, Homo sapiens
gcctgtcccaggactca

SEQ ID NO: 5912219 - DNA, 21 bp, Homo sapiens
gcctgtcccaggactcaccct

SEQ ID NO: 5912220 - DNA, 24 bp, Homo sapiens
gcctgtcccaggactcaccctcca

SEQ ID NO: 5912221 - DNA, 12 bp, Homo sapiens
gcctgtccccag

SEQ ID NO: 5912222 - DNA, 13 bp, Homo sapiens
gcctgtccccaga

SEQ ID NO: 5912223 - DNA, 14 bp, Homo sapiens
gcctgtccccagac

SEQ ID NO: 5912224 - DNA, 13 bp, Homo sapiens
gcctgtccccgcc

SEQ ID NO: 5912225 - DNA, 19 bp, Homo sapiens
gcctgtccccgccttccct

SEQ ID NO: 5912226 - DNA, 13 bp, Homo sapiens
gcctgtcccctca

SEQ ID NO: 5912227 - DNA, 17 bp, Homo sapiens
gcctgtccctagggctc

SEQ ID NO: 5912228 - DNA, 19 bp, Homo sapiens
gcctgtccctagggctctc

SEQ ID NO: 5912229 - DNA, 21 bp, Homo sapiens
gcctgtccctagggctctcca

SEQ ID NO: 5912230 - DNA, 23 bp, Homo sapiens
gcctgtccctagggctctccaag

SEQ ID NO: 5912231 - DNA, 14 bp, Homo sapiens
gcctgtccctctca

SEQ ID NO: 5912232 - DNA, 13 bp, Homo sapiens
gcctgtccctggc

SEQ ID NO: 5912233 - DNA, 15 bp, Homo sapiens
gcctgtccctgggag

SEQ ID NO: 5912234 - DNA, 16 bp, Homo sapiens
gcctgtcccttgcctc

SEQ ID NO: 5912235 - DNA, 20 bp, Homo sapiens
gcctgtcccttgcctctgcc

SEQ ID NO: 5912236 - DNA, 12 bp, Homo sapiens
gcctgtcctcac

SEQ ID NO: 5912237 - DNA, 22 bp, Homo sapiens
gcctgtcctccaacaccaagca

SEQ ID NO: 5912238 - DNA, 17 bp, Homo sapiens
gcctgtcctcctggaag

SEQ ID NO: 5912239 - DNA, 14 bp, Homo sapiens
gcctgtcctgaaag

SEQ ID NO: 5912240 - DNA, 14 bp, Homo sapiens
gcctgtcctgcctg

SEQ ID NO: 5912241 - DNA, 19 bp, Homo sapiens
gcctgtcctgcctgtggcc

SEQ ID NO: 5912242 - DNA, 13 bp, Homo sapiens
gcctgtcctgggc

SEQ ID NO: 5912243 - DNA, 12 bp, Homo sapiens
gcctgtcctggt

SEQ ID NO: 5912244 - DNA, 20 bp, Homo sapiens
gcctgtccttgaaaaacaaa

SEQ ID NO: 5912245 - DNA, 16 bp, Homo sapiens
gcctgtcggccacacc

SEQ ID NO: 5912246 - DNA, 20 bp, Homo sapiens
gcctgtcggccacaccccag

SEQ ID NO: 5912247 - DNA, 13 bp, Homo sapiens
gcctgtcgggccc

SEQ ID NO: 5912248 - DNA, 17 bp, Homo sapiens
gcctgtcgggcccgcac

SEQ ID NO: 5912249 - DNA, 18 bp, Homo sapiens
gcctgtcgtgccagtcct

SEQ ID NO: 5912250 - DNA, 17 bp, Homo sapiens
gcctgtcgtgttctctc

SEQ ID NO: 5912251 - DNA, 13 bp, Homo sapiens
gcctgtctaaagc

SEQ ID NO: 5912252 - DNA, 21 bp, Homo sapiens
gcctgtctaaagccttaacta

SEQ ID NO: 5912253 - DNA, 12 bp, Homo sapiens
gcctgtctcaag

SEQ ID NO: 5912254 - DNA, 13 bp, Homo sapiens
gcctgtctcagtg

SEQ ID NO: 5912255 - DNA, 22 bp, Homo sapiens
gcctgtctcatccccaggggtc

SEQ ID NO: 5912256 - DNA, 21 bp, Homo sapiens
gcctgtctcccaccctttctg

SEQ ID NO: 5912257 - DNA, 21 bp, Homo sapiens
gcctgtctcctttgcaggctc

SEQ ID NO: 5912258 - DNA, 20 bp, Homo sapiens
gcctgtctctattagctggg

SEQ ID NO: 5912259 - DNA, 21 bp, Homo sapiens
gcctgtctctgttcagatgtg

SEQ ID NO: 5912260 - DNA, 14 bp, Homo sapiens
gcctgtctcttcca

SEQ ID NO: 5912261 - DNA, 15 bp, Homo sapiens
gcctgtctgagactc

SEQ ID NO: 5912262 - DNA, 21 bp, Homo sapiens
gcctgtctgccccagcccaga

SEQ ID NO: 5912263 - DNA, 13 bp, Homo sapiens
gcctgtctggagc

SEQ ID NO: 5912264 - DNA, 13 bp, Homo sapiens
gcctgtctgtcca

SEQ ID NO: 5912265 - DNA, 20 bp, Homo sapiens
gcctgtctgtctctccatct

SEQ ID NO: 5912266 - DNA, 15 bp, Homo sapiens
gcctgtctgtgacct

SEQ ID NO: 5912267 - DNA, 18 bp, Homo sapiens
gcctgtcttgagtagact

SEQ ID NO: 5912268 - DNA, 23 bp, Homo sapiens
gcctgtgaagcagtcagccctta

SEQ ID NO: 5912269 - DNA, 22 bp, Homo sapiens
gcctgtgaataaaaaccctgta

SEQ ID NO: 5912270 - DNA, 19 bp, Homo sapiens
gcctgtgaccggggtcctg

SEQ ID NO: 5912271 - DNA, 23 bp, Homo sapiens
gcctgtgaccggggtcctgaggc

SEQ ID NO: 5912272 - DNA, 16 bp, Homo sapiens
gcctgtgactgaggcg

SEQ ID NO: 5912273 - DNA, 17 bp, Homo sapiens
gcctgtgagcaagagcc

SEQ ID NO: 5912274 - DNA, 20 bp, Homo sapiens
gcctgtgagcaagagccagg

SEQ ID NO: 5912275 - DNA, 18 bp, Homo sapiens
gcctgtgagcatggggcc

SEQ ID NO: 5912276 - DNA, 14 bp, Homo sapiens
gcctgtgagccatt

SEQ ID NO: 5912277 - DNA, 16 bp, Homo sapiens
gcctgtgaggggcccc

SEQ ID NO: 5912278 - DNA, 23 bp, Homo sapiens
gcctgtgaggtgcagagtgccca

SEQ ID NO: 5912279 - DNA, 14 bp, Homo sapiens
gcctgtgatccagg

SEQ ID NO: 5912280 - DNA, 14 bp, Homo sapiens
gcctgtgatgtttt

SEQ ID NO: 5912281 - DNA, 16 bp, Homo sapiens
gcctgtgatgttttat

SEQ ID NO: 5912282 - DNA, 19 bp, Homo sapiens
gcctgtgattaacttgctt

SEQ ID NO: 5912283 - DNA, 20 bp, Homo sapiens
gcctgtgattaacttgctta

SEQ ID NO: 5912284 - DNA, 23 bp, Homo sapiens
gcctgtgcacacacacacacatg

SEQ ID NO: 5912285 - DNA, 13 bp, Homo sapiens
gcctgtgcactgg

SEQ ID NO: 5912286 - DNA, 14 bp, Homo sapiens
gcctgtgcactggg

SEQ ID NO: 5912287 - DNA, 15 bp, Homo sapiens
gcctgtgcagcagcc

SEQ ID NO: 5912288 - DNA, 18 bp, Homo sapiens
gcctgtgcagcagcccag

SEQ ID NO: 5912289 - DNA, 21 bp, Homo sapiens
gcctgtgcagcagcccagctt

SEQ ID NO: 5912290 - DNA, 12 bp, Homo sapiens
gcctgtgcagtg

SEQ ID NO: 5912291 - DNA, 22 bp, Homo sapiens
gcctgtgccaccccttcctcag

SEQ ID NO: 5912292 - DNA, 13 bp, Homo sapiens
gcctgtgccacct

SEQ ID NO: 5912293 - DNA, 16 bp, Homo sapiens
gcctgtgccagcacct

SEQ ID NO: 5912294 - DNA, 15 bp, Homo sapiens
gcctgtgcccactcc

SEQ ID NO: 5912295 - DNA, 14 bp, Homo sapiens
gcctgtgcccgctg

SEQ ID NO: 5912296 - DNA, 19 bp, Homo sapiens
gcctgtgcccgctgcgctg

SEQ ID NO: 5912297 - DNA, 22 bp, Homo sapiens
gcctgtgcccgctgcgctgccc

SEQ ID NO: 5912298 - DNA, 16 bp, Homo sapiens
gcctgtgcctctggga

SEQ ID NO: 5912299 - DNA, 19 bp, Homo sapiens
gcctgtgcctctgggactg

SEQ ID NO: 5912300 - DNA, 12 bp, Homo sapiens
gcctgtgcctgc

SEQ ID NO: 5912301 - DNA, 16 bp, Homo sapiens
gcctgtgcctgccatg

SEQ ID NO: 5912302 - DNA, 13 bp, Homo sapiens
gcctgtgccttcc

SEQ ID NO: 5912303 - DNA, 14 bp, Homo sapiens
gcctgtgctgcccg

SEQ ID NO: 5912304 - DNA, 21 bp, Homo sapiens
gcctgtgctgggccagtggct

SEQ ID NO: 5912305 - DNA, 13 bp, Homo sapiens
gcctgtgctgtga

SEQ ID NO: 5912306 - DNA, 15 bp, Homo sapiens
gcctgtgctgtggca

SEQ ID NO: 5912307 - DNA, 16 bp, Homo sapiens
gcctgtgcttggaggc

SEQ ID NO: 5912308 - DNA, 18 bp, Homo sapiens
gcctgtgcttggaggcct

SEQ ID NO: 5912309 - DNA, 16 bp, Homo sapiens
gcctgtggaatgagtg

SEQ ID NO: 5912310 - DNA, 19 bp, Homo sapiens
gcctgtggaatgagtgtgc

SEQ ID NO: 5912311 - DNA, 15 bp, Homo sapiens
gcctgtggagacagc

SEQ ID NO: 5912312 - DNA, 21 bp, Homo sapiens
gcctgtggagacagccctgcc

SEQ ID NO: 5912313 - DNA, 22 bp, Homo sapiens
gcctgtggagacagccctgcct

SEQ ID NO: 5912314 - DNA, 15 bp, Homo sapiens
gcctgtggagagaaa

SEQ ID NO: 5912315 - DNA, 18 bp, Homo sapiens
gcctgtggagctcagccc

SEQ ID NO: 5912316 - DNA, 18 bp, Homo sapiens
gcctgtggaggggcttgg

SEQ ID NO: 5912317 - DNA, 19 bp, Homo sapiens
gcctgtggaggtgacctgt

SEQ ID NO: 5912318 - DNA, 22 bp, Homo sapiens
gcctgtggatgatcaatccttt

SEQ ID NO: 5912319 - DNA, 18 bp, Homo sapiens
gcctgtggcacagccctg

SEQ ID NO: 5912320 - DNA, 19 bp, Homo sapiens
gcctgtggcacagccctga

SEQ ID NO: 5912321 - DNA, 19 bp, Homo sapiens
gcctgtggcagaaaagagg

SEQ ID NO: 5912322 - DNA, 15 bp, Homo sapiens
gcctgtggcaggcct

SEQ ID NO: 5912323 - DNA, 17 bp, Homo sapiens
gcctgtggcaggcctag

SEQ ID NO: 5912324 - DNA, 22 bp, Homo sapiens
gcctgtggcatctttgccttgg

SEQ ID NO: 5912325 - DNA, 10 bp, Homo sapiens
gcctgtggcc

SEQ ID NO: 5912326 - DNA, 21 bp, Homo sapiens
gcctgtggccagcagccccca

SEQ ID NO: 5912327 - DNA, 12 bp, Homo sapiens
gcctgtggcccc

SEQ ID NO: 5912328 - DNA, 16 bp, Homo sapiens
gcctgtggccccaccg

SEQ ID NO: 5912329 - DNA, 23 bp, Homo sapiens
gcctgtggccccaccgagctgga

SEQ ID NO: 5912330 - DNA, 13 bp, Homo sapiens
gcctgtggcccct

SEQ ID NO: 5912331 - DNA, 15 bp, Homo sapiens
gcctgtggccctgtc

SEQ ID NO: 5912332 - DNA, 15 bp, Homo sapiens
gcctgtggcctcagc

SEQ ID NO: 5912333 - DNA, 17 bp, Homo sapiens
gcctgtggccttgcccg

SEQ ID NO: 5912334 - DNA, 16 bp, Homo sapiens
gcctgtggctgtggag

SEQ ID NO: 5912335 - DNA, 13 bp, Homo sapiens
gcctgtggcttgg

SEQ ID NO: 5912336 - DNA, 11 bp, Homo sapiens
gcctgtgggag

SEQ ID NO: 5912337 - DNA, 15 bp, Homo sapiens
gcctgtgggagaagg

SEQ ID NO: 5912338 - DNA, 17 bp, Homo sapiens
gcctgtgggagggggag

SEQ ID NO: 5912339 - DNA, 22 bp, Homo sapiens
gcctgtgggagggggaggaagt

SEQ ID NO: 5912340 - DNA, 13 bp, Homo sapiens
gcctgtgggcagc

SEQ ID NO: 5912341 - DNA, 14 bp, Homo sapiens
gcctgtgggcctca

SEQ ID NO: 5912342 - DNA, 20 bp, Homo sapiens
gcctgtgggcctcacctgcc

SEQ ID NO: 5912343 - DNA, 15 bp, Homo sapiens
gcctgtggggagccg

SEQ ID NO: 5912344 - DNA, 15 bp, Homo sapiens
gcctgtggtgaagtg

SEQ ID NO: 5912345 - DNA, 21 bp, Homo sapiens
gcctgtggtgaagtgtggctg

SEQ ID NO: 5912346 - DNA, 22 bp, Homo sapiens
gcctgtggtgaagtgtggctgg

SEQ ID NO: 5912347 - DNA, 15 bp, Homo sapiens
gcctgtggtggctcc

SEQ ID NO: 5912348 - DNA, 19 bp, Homo sapiens
gcctgtggttacagtgcag

SEQ ID NO: 5912349 - DNA, 16 bp, Homo sapiens
gcctgtgtaacagctc

SEQ ID NO: 5912350 - DNA, 23 bp, Homo sapiens
gcctgtgtaacagctccttggga

SEQ ID NO: 5912351 - DNA, 13 bp, Homo sapiens
gcctgtgtacaac

SEQ ID NO: 5912352 - DNA, 14 bp, Homo sapiens
gcctgtgtagccag

SEQ ID NO: 5912353 - DNA, 15 bp, Homo sapiens
gcctgtgtagccagt

SEQ ID NO: 5912354 - DNA, 20 bp, Homo sapiens
gcctgtgtagctgtgacctg

SEQ ID NO: 5912355 - DNA, 18 bp, Homo sapiens
gcctgtgtccagcagctg

SEQ ID NO: 5912356 - DNA, 19 bp, Homo sapiens
gcctgtgtccagcagctgc

SEQ ID NO: 5912357 - DNA, 22 bp, Homo sapiens
gcctgtgtccagcagctgcggg

SEQ ID NO: 5912358 - DNA, 19 bp, Homo sapiens
gcctgtgtccatgcgctca

SEQ ID NO: 5912359 - DNA, 15 bp, Homo sapiens
gcctgtgtcccatga

SEQ ID NO: 5912360 - DNA, 19 bp, Homo sapiens
gcctgtgtcccatgaccca

SEQ ID NO: 5912361 - DNA, 20 bp, Homo sapiens
gcctgtgtcccatgacccac

SEQ ID NO: 5912362 - DNA, 16 bp, Homo sapiens
gcctgtgtcctgaaga

SEQ ID NO: 5912363 - DNA, 14 bp, Homo sapiens
gcctgtgtctttaa

SEQ ID NO: 5912364 - DNA, 21 bp, Homo sapiens
gcctgtgtgacatcagtggca

SEQ ID NO: 5912365 - DNA, 13 bp, Homo sapiens
gcctgtgtgagca

SEQ ID NO: 5912366 - DNA, 16 bp, Homo sapiens
gcctgtgtgagcatct

SEQ ID NO: 5912367 - DNA, 15 bp, Homo sapiens
gcctgtgtgcagtgg

SEQ ID NO: 5912368 - DNA, 22 bp, Homo sapiens
gcctgtgtgcagtggagctggc

SEQ ID NO: 5912369 - DNA, 15 bp, Homo sapiens
gcctgtgtgctccgg

SEQ ID NO: 5912370 - DNA, 15 bp, Homo sapiens
gcctgtgtgtgggtg

SEQ ID NO: 5912371 - DNA, 21 bp, Homo sapiens
gcctgtgtgttgccaggcagg

SEQ ID NO: 5912372 - DNA, 20 bp, Homo sapiens
gcctgtgttagtgtctgtcc

SEQ ID NO: 5912373 - DNA, 21 bp, Homo sapiens
gcctgtgttagtgtctgtcca

SEQ ID NO: 5912374 - DNA, 20 bp, Homo sapiens
gcctgtgttcttcctggccg

SEQ ID NO: 5912375 - DNA, 23 bp, Homo sapiens
gcctgtgtttcatgttctgtgtc

SEQ ID NO: 5912376 - DNA, 19 bp, Homo sapiens
gcctgttaatttataatgt

SEQ ID NO: 5912377 - DNA, 21 bp, Homo sapiens
gcctgttaatttataatgtat

SEQ ID NO: 5912378 - DNA, 22 bp, Homo sapiens
gcctgttagactcttacttttt

SEQ ID NO: 5912379 - DNA, 19 bp, Homo sapiens
gccttgcaaatagccagtg

SEQ ID NO: 5912380 - DNA, 19 bp, Homo sapiens
gccttgcacggctgctcgg

SEQ ID NO: 5912381 - DNA, 20 bp, Homo sapiens
gccttgcacggctgctcggc

SEQ ID NO: 5912382 - DNA, 13 bp, Homo sapiens
gccttgcagaact

SEQ ID NO: 5912383 - DNA, 21 bp, Homo sapiens
gccttgcagcactcacacagg

SEQ ID NO: 5912384 - DNA, 19 bp, Homo sapiens
gccttgcagcggctcctgc

SEQ ID NO: 5912385 - DNA, 20 bp, Homo sapiens
gccttgccacatctgtgtct

SEQ ID NO: 5912386 - DNA, 21 bp, Homo sapiens
gccttgccacatctgtgtctc

SEQ ID NO: 5912387 - DNA, 13 bp, Homo sapiens
gccttgccagaga

SEQ ID NO: 5912388 - DNA, 18 bp, Homo sapiens
gccttgcccactcctgct

SEQ ID NO: 5912389 - DNA, 17 bp, Homo sapiens
gccttgcccagcctgga

SEQ ID NO: 5912390 - DNA, 14 bp, Homo sapiens
gccttgcccattct

SEQ ID NO: 5912391 - DNA, 14 bp, Homo sapiens
gccttgccccacct

SEQ ID NO: 5912392 - DNA, 17 bp, Homo sapiens
gccttgcccgccagcct

SEQ ID NO: 5912393 - DNA, 23 bp, Homo sapiens
gccttgccctcctgggccctggg

SEQ ID NO: 5912394 - DNA, 15 bp, Homo sapiens
gccttgccgctcccc

SEQ ID NO: 5912395 - DNA, 16 bp, Homo sapiens
gccttgccgctcccct

SEQ ID NO: 5912396 - DNA, 21 bp, Homo sapiens
gccttgccgctccccttggac

SEQ ID NO: 5912397 - DNA, 12 bp, Homo sapiens
gccttgcctcct

SEQ ID NO: 5912398 - DNA, 16 bp, Homo sapiens
gccttgcgctgtccca

SEQ ID NO: 5912399 - DNA, 20 bp, Homo sapiens
gccttgcgctgtcccaggca

SEQ ID NO: 5912400 - DNA, 22 bp, Homo sapiens
gccttgcgctgtcccaggcatg

SEQ ID NO: 5912401 - DNA, 14 bp, Homo sapiens
gccttgcggaagcc

SEQ ID NO: 5912402 - DNA, 17 bp, Homo sapiens
gccttgcggaagccata

SEQ ID NO: 5912403 - DNA, 19 bp, Homo sapiens
gccttgcggtatccgcccc

SEQ ID NO: 5912404 - DNA, 18 bp, Homo sapiens
gccttgctcattcttgag

SEQ ID NO: 5912405 - DNA, 19 bp, Homo sapiens
gccttgctcctagcagaca

SEQ ID NO: 5912406 - DNA, 12 bp, Homo sapiens
gccttgctctga

SEQ ID NO: 5912407 - DNA, 12 bp, Homo sapiens
gccttgctgacc

SEQ ID NO: 5912408 - DNA, 17 bp, Homo sapiens
gccttgctgacctccca

SEQ ID NO: 5912409 - DNA, 12 bp, Homo sapiens
gccttgctgcct

SEQ ID NO: 5912410 - DNA, 15 bp, Homo sapiens
gccttgctgctctgc

SEQ ID NO: 5912411 - DNA, 13 bp, Homo sapiens
gccttgctgctgc

SEQ ID NO: 5912412 - DNA, 17 bp, Homo sapiens
gccttgctgctgctgca

SEQ ID NO: 5912413 - DNA, 22 bp, Homo sapiens
gccttgctgctgctgcacccaa

SEQ ID NO: 5912414 - DNA, 14 bp, Homo sapiens
gccttgctgggcca

SEQ ID NO: 5912415 - DNA, 15 bp, Homo sapiens
gccttgctgggccag

SEQ ID NO: 5912416 - DNA, 16 bp, Homo sapiens
gccttgctgggccagg

SEQ ID NO: 5912417 - DNA, 18 bp, Homo sapiens
gccttgctgggccaggga

SEQ ID NO: 5912418 - DNA, 21 bp, Homo sapiens
gccttgctggggtccagggct

SEQ ID NO: 5912419 - DNA, 17 bp, Homo sapiens
gccttgctgtttgtcct

SEQ ID NO: 5912420 - DNA, 11 bp, Homo sapiens
gccttgcttct

SEQ ID NO: 5912421 - DNA, 14 bp, Homo sapiens
gccttgcttctctt

SEQ ID NO: 5912422 - DNA, 15 bp, Homo sapiens
gccttgcttctcttc

SEQ ID NO: 5912423 - DNA, 21 bp, Homo sapiens
gccttgcttctgtatttcctt

SEQ ID NO: 5912424 - DNA, 17 bp, Homo sapiens
gccttggaaccagcccc

SEQ ID NO: 5912425 - DNA, 18 bp, Homo sapiens
gccttggaaccagcccca

SEQ ID NO: 5912426 - DNA, 23 bp, Homo sapiens
gccttggaaccagccccatcaga

SEQ ID NO: 5912427 - DNA, 19 bp, Homo sapiens
gccttggaagttgcatggc

SEQ ID NO: 5912428 - DNA, 20 bp, Homo sapiens
gccttggaatatggccaagg

SEQ ID NO: 5912429 - DNA, 12 bp, Homo sapiens
gccttggagcag

SEQ ID NO: 5912430 - DNA, 22 bp, Homo sapiens
gccttggagcagaaagccaggg

SEQ ID NO: 5912431 - DNA, 20 bp, Homo sapiens
gccttggaggaaatgtgctc

SEQ ID NO: 5912432 - DNA, 19 bp, Homo sapiens
gccttggagggtcccaagc

SEQ ID NO: 5912433 - DNA, 20 bp, Homo sapiens
gccttggagggtcccaagct

SEQ ID NO: 5912434 - DNA, 17 bp, Homo sapiens
gccttggcatgggcgca

SEQ ID NO: 5912435 - DNA, 19 bp, Homo sapiens
gccttggcccacctgaggc

SEQ ID NO: 5912436 - DNA, 13 bp, Homo sapiens
gccttggccctga

SEQ ID NO: 5912437 - DNA, 21 bp, Homo sapiens
gccttggccgcataggcccag

SEQ ID NO: 5912438 - DNA, 20 bp, Homo sapiens
gccttggcctcccctgctga

SEQ ID NO: 5912439 - DNA, 15 bp, Homo sapiens
gccttggcctggagc

SEQ ID NO: 5912440 - DNA, 20 bp, Homo sapiens
gccttggctgacatgaagct

SEQ ID NO: 5912441 - DNA, 20 bp, Homo sapiens
gccttggctgttggcagtga

SEQ ID NO: 5912442 - DNA, 14 bp, Homo sapiens
gccttgggagccac

SEQ ID NO: 5912443 - DNA, 16 bp, Homo sapiens
gccttgggagccactg

SEQ ID NO: 5912444 - DNA, 17 bp, Homo sapiens
gccttgggagccactgc

SEQ ID NO: 5912445 - DNA, 19 bp, Homo sapiens
gccttgggagctcatccct

SEQ ID NO: 5912446 - DNA, 23 bp, Homo sapiens
gccttgggaggacatgcgtgtgt

SEQ ID NO: 5912447 - DNA, 17 bp, Homo sapiens
gccttgggccggtgctg

SEQ ID NO: 5912448 - DNA, 19 bp, Homo sapiens
gccttgggccggtgctggg

SEQ ID NO: 5912449 - DNA, 20 bp, Homo sapiens
gccttgggccggtgctgggg

SEQ ID NO: 5912450 - DNA, 19 bp, Homo sapiens
gccttgggcctcatctgct

SEQ ID NO: 5912451 - DNA, 13 bp, Homo sapiens
gccttgggccttg

SEQ ID NO: 5912452 - DNA, 15 bp, Homo sapiens
gccttgggcctttca

SEQ ID NO: 5912453 - DNA, 17 bp, Homo sapiens
gccttgggcctttcagt

SEQ ID NO: 5912454 - DNA, 22 bp, Homo sapiens
gccttgggcctttcagtcccaa

SEQ ID NO: 5912455 - DNA, 22 bp, Homo sapiens
gccttgggctatttggactcag

SEQ ID NO: 5912456 - DNA, 22 bp, Homo sapiens
gccttgggctccgtgtgggaga

SEQ ID NO: 5912457 - DNA, 15 bp, Homo sapiens
gccttgggctctgct

SEQ ID NO: 5912458 - DNA, 18 bp, Homo sapiens
gccttgggctgctcctca

SEQ ID NO: 5912459 - DNA, 22 bp, Homo sapiens
gccttgggctgctcctcatggt

SEQ ID NO: 5912460 - DNA, 18 bp, Homo sapiens
gccttggggccagactgg

SEQ ID NO: 5912461 - DNA, 19 bp, Homo sapiens
gccttggggccagactggc

SEQ ID NO: 5912462 - DNA, 23 bp, Homo sapiens
gccttggggccagactggctgca

SEQ ID NO: 5912463 - DNA, 24 bp, Homo sapiens
gccttggggctcagccacagcctg

SEQ ID NO: 5912464 - DNA, 21 bp, Homo sapiens
gccttgggggggctgcctttg

SEQ ID NO: 5912465 - DNA, 22 bp, Homo sapiens
gccttgggggtctgctctgtgc

SEQ ID NO: 5912466 - DNA, 17 bp, Homo sapiens
gccttggggtcaggttg

SEQ ID NO: 5912467 - DNA, 20 bp, Homo sapiens
gccttggggtgggggccagg

SEQ ID NO: 5912468 - DNA, 22 bp, Homo sapiens
gccttggggtgggggccaggcc

SEQ ID NO: 5912469 - DNA, 15 bp, Homo sapiens
gccttgggtgttcca

SEQ ID NO: 5912470 - DNA, 22 bp, Homo sapiens
gccttgggttccaaccaggcag

SEQ ID NO: 5912471 - DNA, 19 bp, Homo sapiens
gccttgggtttctgtgcag

SEQ ID NO: 5912472 - DNA, 17 bp, Homo sapiens
gccttggtatgtgccag

SEQ ID NO: 5912473 - DNA, 18 bp, Homo sapiens
gccttggtatgtgccagg

SEQ ID NO: 5912474 - DNA, 16 bp, Homo sapiens
gccttggtcccagaca

SEQ ID NO: 5912475 - DNA, 18 bp, Homo sapiens
gccttggtcccagacagc

SEQ ID NO: 5912476 - DNA, 12 bp, Homo sapiens
gccttggtcctt

SEQ ID NO: 5912477 - DNA, 18 bp, Homo sapiens
gccttggtggagcagcca

SEQ ID NO: 5912478 - DNA, 19 bp, Homo sapiens
gccttggtggagcagccag

SEQ ID NO: 5912479 - DNA, 20 bp, Homo sapiens
gccttggtgggggagcctct

SEQ ID NO: 5912480 - DNA, 16 bp, Homo sapiens
gccttggtgtccacct

SEQ ID NO: 5912481 - DNA, 22 bp, Homo sapiens
gccttggtgtccacctggcccc

SEQ ID NO: 5912482 - DNA, 17 bp, Homo sapiens
gccttggttctggccac

SEQ ID NO: 5912483 - DNA, 15 bp, Homo sapiens
gccttggttcttcct

SEQ ID NO: 5912484 - DNA, 23 bp, Homo sapiens
gccttgtaaataaccacaaggtc

SEQ ID NO: 5912485 - DNA, 16 bp, Homo sapiens
gccttgtacagtctgc

SEQ ID NO: 5912486 - DNA, 14 bp, Homo sapiens
gccttgtacttgct

SEQ ID NO: 5912487 - DNA, 17 bp, Homo sapiens
gccttgtagatggagca

SEQ ID NO: 5912488 - DNA, 19 bp, Homo sapiens
gccttgtataatattgaaa

SEQ ID NO: 5912489 - DNA, 21 bp, Homo sapiens
gccttgtataatattgaaaat

SEQ ID NO: 5912490 - DNA, 22 bp, Homo sapiens
gccttgtatgcaaatgagttca

SEQ ID NO: 5912491 - DNA, 19 bp, Homo sapiens
gccttgtcaggacccaggc

SEQ ID NO: 5912492 - DNA, 20 bp, Homo sapiens
gccttgtcaggacccaggcc

SEQ ID NO: 5912493 - DNA, 13 bp, Homo sapiens
gccttgtcagtgt

SEQ ID NO: 5912494 - DNA, 23 bp, Homo sapiens
gccttgtcagtgtgtcagttttt

SEQ ID NO: 5912495 - DNA, 14 bp, Homo sapiens
gccttgtccaggaa

SEQ ID NO: 5912496 - DNA, 17 bp, Homo sapiens
gccttgtcccagaggct

SEQ ID NO: 5912497 - DNA, 15 bp, Homo sapiens
gccttgtccctctca

SEQ ID NO: 5912498 - DNA, 23 bp, Homo sapiens
gccttgtccctctcactccccag

SEQ ID NO: 5912499 - DNA, 23 bp, Homo sapiens
gccttgtctcctactcctgactc

SEQ ID NO: 5912500 - DNA, 17 bp, Homo sapiens
gccttgtctcttcctct

SEQ ID NO: 5912501 - DNA, 23 bp, Homo sapiens
gccttgtctgtgtatttctattt

SEQ ID NO: 5912502 - DNA, 22 bp, Homo sapiens
gccttgtgatgtcatacagaga

SEQ ID NO: 5912503 - DNA, 14 bp, Homo sapiens
gccttgtgccctgc

SEQ ID NO: 5912504 - DNA, 17 bp, Homo sapiens
gccttgtggtccaaata

SEQ ID NO: 5912505 - DNA, 13 bp, Homo sapiens
gccttgtgtatat

SEQ ID NO: 5912506 - DNA, 17 bp, Homo sapiens
gccttgtgtctacagag

SEQ ID NO: 5912507 - DNA, 19 bp, Homo sapiens
gccttgtgtgctggcttcc

SEQ ID NO: 5912508 - DNA, 16 bp, Homo sapiens
gccttgttcctgctct

SEQ ID NO: 5912509 - DNA, 21 bp, Homo sapiens
gccttgttgatgggccttcag

SEQ ID NO: 5912510 - DNA, 16 bp, Homo sapiens
gccttgttgtattcct

SEQ ID NO: 5912511 - DNA, 13 bp, Homo sapiens
gccttgtttctga

SEQ ID NO: 5912512 - DNA, 23 bp, Homo sapiens
gcctttaaaacgcgtctgcctgg

SEQ ID NO: 5912513 - DNA, 17 bp, Homo sapiens
gcctttaaaggttttta

SEQ ID NO: 5912514 - DNA, 15 bp, Homo sapiens
gcctttaaagtatga

SEQ ID NO: 5912515 - DNA, 18 bp, Homo sapiens
gcctttaaagtatgaatc

SEQ ID NO: 5912516 - DNA, 17 bp, Homo sapiens
gcctttaagaaccttaa

SEQ ID NO: 5912517 - DNA, 21 bp, Homo sapiens
gcctttaagccaaagaaacaa

SEQ ID NO: 5912518 - DNA, 18 bp, Homo sapiens
gcctttaatattttgtaa

SEQ ID NO: 5912519 - DNA, 20 bp, Homo sapiens
gcctttaatattttgtaata

SEQ ID NO: 5912520 - DNA, 15 bp, Homo sapiens
gcctttacaagggag

SEQ ID NO: 5912521 - DNA, 20 bp, Homo sapiens
gcctttacatggacagaatt

SEQ ID NO: 5912522 - DNA, 22 bp, Homo sapiens
gcctttaccctcctctatttct

SEQ ID NO: 5912523 - DNA, 16 bp, Homo sapiens
gcctttactgaccctg

SEQ ID NO: 5912524 - DNA, 17 bp, Homo sapiens
gcctttaggcaggaagt

SEQ ID NO: 5912525 - DNA, 16 bp, Homo sapiens
gcctttaggtctttag

SEQ ID NO: 5912526 - DNA, 10 bp, Homo sapiens
gcctttatat

SEQ ID NO: 5912527 - DNA, 22 bp, Homo sapiens
gcctttatctaccaactttcaa

SEQ ID NO: 5912528 - DNA, 18 bp, Homo sapiens
gcctttatctcagccatc

SEQ ID NO: 5912529 - DNA, 19 bp, Homo sapiens
gcctttatgttttttgtaa

SEQ ID NO: 5912530 - DNA, 19 bp, Homo sapiens
gcctttatttccactgtgc

SEQ ID NO: 5912531 - DNA, 20 bp, Homo sapiens
gcctttatttccactgtgca

SEQ ID NO: 5912532 - DNA, 19 bp, Homo sapiens
gcctttcaaagtgcacaca

SEQ ID NO: 5912533 - DNA, 21 bp, Homo sapiens
gcctttcaaagtgcacacaca

SEQ ID NO: 5912534 - DNA, 17 bp, Homo sapiens
gcctttcagcaggcagc

SEQ ID NO: 5912535 - DNA, 14 bp, Homo sapiens
gcctttcaggatct

SEQ ID NO: 5912536 - DNA, 14 bp, Homo sapiens
gcctttcagtgtag

SEQ ID NO: 5912537 - DNA, 12 bp, Homo sapiens
gcctttcatagt

SEQ ID NO: 5912538 - DNA, 18 bp, Homo sapiens
gcctttcattttgcttta

SEQ ID NO: 5912539 - DNA, 23 bp, Homo sapiens
gcctttccacctgctttctcctg

SEQ ID NO: 5912540 - DNA, 20 bp, Homo sapiens
gcctttccagagaactgcag

SEQ ID NO: 5912541 - DNA, 22 bp, Homo sapiens
gcctttccagcccaacccactg

SEQ ID NO: 5912542 - DNA, 22 bp, Homo sapiens
gcctttccataaggaatgtagc

SEQ ID NO: 5912543 - DNA, 20 bp, Homo sapiens
gcctttccatccatggccag

SEQ ID NO: 5912544 - DNA, 19 bp, Homo sapiens
gcctttcccaactctagct

SEQ ID NO: 5912545 - DNA, 17 bp, Homo sapiens
gcctttcccaccctcct

SEQ ID NO: 5912546 - DNA, 21 bp, Homo sapiens
gcctttcccaccgccctccct

SEQ ID NO: 5912547 - DNA, 16 bp, Homo sapiens
gcctttcccgggccct

SEQ ID NO: 5912548 - DNA, 20 bp, Homo sapiens
gcctttccggggctgctggc

SEQ ID NO: 5912549 - DNA, 22 bp, Homo sapiens
gcctttccggggctgctggcct

SEQ ID NO: 5912550 - DNA, 21 bp, Homo sapiens
gcctttcctcaaaactggagt

SEQ ID NO: 5912551 - DNA, 14 bp, Homo sapiens
gcctttcctctcta

SEQ ID NO: 5912552 - DNA, 17 bp, Homo sapiens
gcctttcctctgcacgc

SEQ ID NO: 5912553 - DNA, 18 bp, Homo sapiens
gcctttcctctgcacgct

SEQ ID NO: 5912554 - DNA, 10 bp, Homo sapiens
gcgacctcct

SEQ ID NO: 5912555 - DNA, 23 bp, Homo sapiens
gcgacctctctgcctctcttctt

SEQ ID NO: 5912556 - DNA, 12 bp, Homo sapiens
gcgacgcggccc

SEQ ID NO: 5912557 - DNA, 16 bp, Homo sapiens
gcgacggagagaaaaa

SEQ ID NO: 5912558 - DNA, 19 bp, Homo sapiens
gcgacggctcctccccgat

SEQ ID NO: 5912559 - DNA, 17 bp, Homo sapiens
gcgacgtgagggtcctg

SEQ ID NO: 5912560 - DNA, 21 bp, Homo sapiens
gcgacgttagtcgtgagctct

SEQ ID NO: 5912561 - DNA, 15 bp, Homo sapiens
gcgactcccagctcc

SEQ ID NO: 5912562 - DNA, 20 bp, Homo sapiens
gcgactccgttggccactcc

SEQ ID NO: 5912563 - DNA, 23 bp, Homo sapiens
gcgactcggccccgtctcctgag

SEQ ID NO: 5912564 - DNA, 21 bp, Homo sapiens
gcgactctatagactctagga

SEQ ID NO: 5912565 - DNA, 18 bp, Homo sapiens
gcgactgtgaaactggaa

SEQ ID NO: 5912566 - DNA, 18 bp, Homo sapiens
gcgacttctcaggacgac

SEQ ID NO: 5912567 - DNA, 14 bp, Homo sapiens
gcgactttctgcct

SEQ ID NO: 5912568 - DNA, 14 bp, Homo sapiens
gcgagaaacagaga

SEQ ID NO: 5912569 - DNA, 20 bp, Homo sapiens
gcgagaacacaagccacgcc

SEQ ID NO: 5912570 - DNA, 23 bp, Homo sapiens
gcgagaacacaagccacgcctgc

SEQ ID NO: 5912571 - DNA, 23 bp, Homo sapiens
gcgagacccaaggctcactgcag

SEQ ID NO: 5912572 - DNA, 22 bp, Homo sapiens
gcgagacgcacacagctgagca

SEQ ID NO: 5912573 - DNA, 16 bp, Homo sapiens
gcgagactctgtctca

SEQ ID NO: 5912574 - DNA, 14 bp, Homo sapiens
gcgagagaggagcc

SEQ ID NO: 5912575 - DNA, 17 bp, Homo sapiens
gcgagagagtttcaaaa

SEQ ID NO: 5912576 - DNA, 12 bp, Homo sapiens
gcgagagatgtg

SEQ ID NO: 5912577 - DNA, 13 bp, Homo sapiens
gcgagagatgtgt

SEQ ID NO: 5912578 - DNA, 14 bp, Homo sapiens
gcgagagatgtgtg

SEQ ID NO: 5912579 - DNA, 16 bp, Homo sapiens
gcgagagatgtgtgtt

SEQ ID NO: 5912580 - DNA, 16 bp, Homo sapiens
gcgagaggcagagaaa

SEQ ID NO: 5912581 - DNA, 17 bp, Homo sapiens
gcgagatactgcatgtt

SEQ ID NO: 5912582 - DNA, 17 bp, Homo sapiens
gcgagatcgctggcaga

SEQ ID NO: 5912583 - DNA, 18 bp, Homo sapiens
gcgagatcgctggcagag

SEQ ID NO: 5912584 - DNA, 21 bp, Homo sapiens
gcgagatcgctggcagagaag

SEQ ID NO: 5912585 - DNA, 16 bp, Homo sapiens
gcgagattgggcctcc

SEQ ID NO: 5912586 - DNA, 17 bp, Homo sapiens
gcgagcagggcaggccc

SEQ ID NO: 5912587 - DNA, 15 bp, Homo sapiens
gcgagcatcccccaa

SEQ ID NO: 5912588 - DNA, 16 bp, Homo sapiens
gcgagcatcctggcca

SEQ ID NO: 5912589 - DNA, 13 bp, Homo sapiens
gcgagcatttccc

SEQ ID NO: 5912590 - DNA, 14 bp, Homo sapiens
gcgagcatttccct

SEQ ID NO: 5912591 - DNA, 14 bp, Homo sapiens
gcgagccacaggaa

SEQ ID NO: 5912592 - DNA, 21 bp, Homo sapiens
gcgagccagattaggcctgga

SEQ ID NO: 5912593 - DNA, 22 bp, Homo sapiens
gcgagccagattaggcctggag

SEQ ID NO: 5912594 - DNA, 23 bp, Homo sapiens
gcgagccagattaggcctggagt

SEQ ID NO: 5912595 - DNA, 12 bp, Homo sapiens
gcgagccaggca

SEQ ID NO: 5912596 - DNA, 14 bp, Homo sapiens
gcgagccaggcaag

SEQ ID NO: 5912597 - DNA, 20 bp, Homo sapiens
gcgagccatttgtcccaagt

SEQ ID NO: 5912598 - DNA, 24 bp, Homo sapiens
gcgagccatttgtcccaagtgcca

SEQ ID NO: 5912599 - DNA, 12 bp, Homo sapiens
gcgagcctgcta

SEQ ID NO: 5912600 - DNA, 21 bp, Homo sapiens
gcgagctatgatcgcgccact

SEQ ID NO: 5912601 - DNA, 23 bp, Homo sapiens
gcgagctctcaaatccctctcca

SEQ ID NO: 5912602 - DNA, 14 bp, Homo sapiens
gcgagctgagaagc

SEQ ID NO: 5912603 - DNA, 12 bp, Homo sapiens
gcgagctgcagg

SEQ ID NO: 5912604 - DNA, 13 bp, Homo sapiens
gcgagctgcagga

SEQ ID NO: 5912605 - DNA, 13 bp, Homo sapiens
gcgagcttggcct

SEQ ID NO: 5912606 - DNA, 17 bp, Homo sapiens
gcgagcttggccttggg

SEQ ID NO: 5912607 - DNA, 22 bp, Homo sapiens
gcgagcttggccttgggccggt

SEQ ID NO: 5912608 - DNA, 18 bp, Homo sapiens
gcgaggaggcgcggcctc

SEQ ID NO: 5912609 - DNA, 18 bp, Homo sapiens
gcgaggaggctccagagg

SEQ ID NO: 5912610 - DNA, 14 bp, Homo sapiens
gcgaggcagaggac

SEQ ID NO: 5912611 - DNA, 12 bp, Homo sapiens
gcgaggcccctc

SEQ ID NO: 5912612 - DNA, 17 bp, Homo sapiens
gcgaggccggagagctg

SEQ ID NO: 5912613 - DNA, 23 bp, Homo sapiens
gcgaggcctattgttgaataaat

SEQ ID NO: 5912614 - DNA, 23 bp, Homo sapiens
gcgaggcctgacacaggccagcc

SEQ ID NO: 5912615 - DNA, 14 bp, Homo sapiens
gcgaggcgaggctg

SEQ ID NO: 5912616 - DNA, 18 bp, Homo sapiens
gcgaggcgggggagcctg

SEQ ID NO: 5912617 - DNA, 21 bp, Homo sapiens
gcgaggcgggggatcctggag

SEQ ID NO: 5912618 - DNA, 17 bp, Homo sapiens
gcgaggctcggagcacc

SEQ ID NO: 5912619 - DNA, 18 bp, Homo sapiens
gcgaggctgcctctgggt

SEQ ID NO: 5912620 - DNA, 16 bp, Homo sapiens
gcgagggaggggaggt

SEQ ID NO: 5912621 - DNA, 12 bp, Homo sapiens
gcgagggcagct

SEQ ID NO: 5912622 - DNA, 15 bp, Homo sapiens
gcgagggccccacgt

SEQ ID NO: 5912623 - DNA, 22 bp, Homo sapiens
gcgagggctactcagcagtaag

SEQ ID NO: 5912624 - DNA, 13 bp, Homo sapiens
gcgaggggaaagg

SEQ ID NO: 5912625 - DNA, 14 bp, Homo sapiens
gcgaggggagggtg

SEQ ID NO: 5912626 - DNA, 12 bp, Homo sapiens
gcgaggggccag

SEQ ID NO: 5912627 - DNA, 16 bp, Homo sapiens
gcgaggtcaacagaga

SEQ ID NO: 5912628 - DNA, 22 bp, Homo sapiens
gcgaggtcaacagagaaggcag

SEQ ID NO: 5912629 - DNA, 13 bp, Homo sapiens
gcgaggtgtaaag

SEQ ID NO: 5912630 - DNA, 19 bp, Homo sapiens
gcgagtaccccagccactc

SEQ ID NO: 5912631 - DNA, 17 bp, Homo sapiens
gcgagtccaggagctca

SEQ ID NO: 5912632 - DNA, 14 bp, Homo sapiens
gcgagtcccctgcc

SEQ ID NO: 5912633 - DNA, 16 bp, Homo sapiens
gcgagtcgggtcccca

SEQ ID NO: 5912634 - DNA, 15 bp, Homo sapiens
gcgagtggatgctgt

SEQ ID NO: 5912635 - DNA, 18 bp, Homo sapiens
gcgagtggatgctgtgct

SEQ ID NO: 5912636 - DNA, 19 bp, Homo sapiens
gcgagtggatgctgtgcta

SEQ ID NO: 5912637 - DNA, 22 bp, Homo sapiens
gcgagtgtgagagtgtgagcag

SEQ ID NO: 5912638 - DNA, 20 bp, Homo sapiens
gcgagtgtgtgcatgtgtgt

SEQ ID NO: 5912639 - DNA, 15 bp, Homo sapiens
gcgagttcctcgctc

SEQ ID NO: 5912640 - DNA, 22 bp, Homo sapiens
gcgagttcctcgctctgggatg

SEQ ID NO: 5912641 - DNA, 15 bp, Homo sapiens
gcgataacttaacaa

SEQ ID NO: 5912642 - DNA, 14 bp, Homo sapiens
gcgatagctgactt

SEQ ID NO: 5912643 - DNA, 13 bp, Homo sapiens
gcgatatacagat

SEQ ID NO: 5912644 - DNA, 21 bp, Homo sapiens
gcgatcatggctcactgcagc

SEQ ID NO: 5912645 - DNA, 22 bp, Homo sapiens
gcgatcatggctcactgcagcc

SEQ ID NO: 5912646 - DNA, 17 bp, Homo sapiens
gcgatccacctgtctca

SEQ ID NO: 5912647 - DNA, 18 bp, Homo sapiens
gcgatccctcccctcagc

SEQ ID NO: 5912648 - DNA, 12 bp, Homo sapiens
gcgatctcccag

SEQ ID NO: 5912649 - DNA, 17 bp, Homo sapiens
gcgatctctccactgtg

SEQ ID NO: 5912650 - DNA, 16 bp, Homo sapiens
gcgatctctcctggcc

SEQ ID NO: 5912651 - DNA, 18 bp, Homo sapiens
gcgatgacacttgtacaa

SEQ ID NO: 5912652 - DNA, 21 bp, Homo sapiens
gcgatgccctgggggccgtgc

SEQ ID NO: 5912653 - DNA, 16 bp, Homo sapiens
gcgatggatgtttaca

SEQ ID NO: 5912654 - DNA, 19 bp, Homo sapiens
gcgatggcaggcctgaccc

SEQ ID NO: 5912655 - DNA, 23 bp, Homo sapiens
gcgatggggactctgccgctgtg

SEQ ID NO: 5912656 - DNA, 18 bp, Homo sapiens
gcgatggggcaagacaga

SEQ ID NO: 5912657 - DNA, 22 bp, Homo sapiens
gcgatgggtcaggtagggggga

SEQ ID NO: 5912658 - DNA, 15 bp, Homo sapiens
gcgatggtctcagaa

SEQ ID NO: 5912659 - DNA, 14 bp, Homo sapiens
gcgatgtgcaggaa

SEQ ID NO: 5912660 - DNA, 19 bp, Homo sapiens
gcgatgtgcaggaagaaaa

SEQ ID NO: 5912661 - DNA, 13 bp, Homo sapiens
gcgatgtggaact

SEQ ID NO: 5912662 - DNA, 20 bp, Homo sapiens
gcgatgtggaactgctgcca

SEQ ID NO: 5912663 - DNA, 21 bp, Homo sapiens
gcgatgttagttttagaatta

SEQ ID NO: 5912664 - DNA, 14 bp, Homo sapiens
gcgattattgatca

SEQ ID NO: 5912665 - DNA, 18 bp, Homo sapiens
gcgattccctctcccagg

SEQ ID NO: 5912666 - DNA, 23 bp, Homo sapiens
gcgattctcccgcctcagcctcc

SEQ ID NO: 5912667 - DNA, 14 bp, Homo sapiens
gcgattctcctgcc

SEQ ID NO: 5912668 - DNA, 17 bp, Homo sapiens
gcgattctcctgcctca

SEQ ID NO: 5912669 - DNA, 18 bp, Homo sapiens
gcgattctcttgcctcaa

SEQ ID NO: 5912670 - DNA, 20 bp, Homo sapiens
gcgattctggataaagccac

SEQ ID NO: 5912671 - DNA, 14 bp, Homo sapiens
gcgattcttctgct

SEQ ID NO: 5912672 - DNA, 22 bp, Homo sapiens
gcgattcttctgcttcagcctc

SEQ ID NO: 5912673 - DNA, 13 bp, Homo sapiens
gcgcaaaactgaa

SEQ ID NO: 5912674 - DNA, 23 bp, Homo sapiens
gcgcaaaactgcctgaaagcaac

SEQ ID NO: 5912675 - DNA, 15 bp, Homo sapiens
gcgcaaagggcgggc

SEQ ID NO: 5912676 - DNA, 17 bp, Homo sapiens
gcgcaaaggtgcctcat

SEQ ID NO: 5912677 - DNA, 20 bp, Homo sapiens
gcgcaaagtgctagccactg

SEQ ID NO: 5912678 - DNA, 16 bp, Homo sapiens
gcgcaaatacaaaatg

SEQ ID NO: 5912679 - DNA, 18 bp, Homo sapiens
gcgcaacaacaaggaccc

SEQ ID NO: 5912680 - DNA, 17 bp, Homo sapiens
gcgcaagccacagcctg

SEQ ID NO: 5912681 - DNA, 18 bp, Homo sapiens
gcgcaagccacagcctgt

SEQ ID NO: 5912682 - DNA, 12 bp, Homo sapiens
gcgcaagcctgt

SEQ ID NO: 5912683 - DNA, 13 bp, Homo sapiens
gcgcaagcctgta

SEQ ID NO: 5912684 - DNA, 18 bp, Homo sapiens
gcgcaagggaggcccagc

SEQ ID NO: 5912685 - DNA, 12 bp, Homo sapiens
gcgcacacacac

SEQ ID NO: 5912686 - DNA, 16 bp, Homo sapiens
gcgcacacacacacat

SEQ ID NO: 5912687 - DNA, 22 bp, Homo sapiens
gcgcacaccaccacacacagct

SEQ ID NO: 5912688 - DNA, 19 bp, Homo sapiens
gcgcacagagggaagccat

SEQ ID NO: 5912689 - DNA, 16 bp, Homo sapiens
gcgcacagccccagct

SEQ ID NO: 5912690 - DNA, 21 bp, Homo sapiens
gcgcacagccccagctaattt

SEQ ID NO: 5912691 - DNA, 14 bp, Homo sapiens
gcgcacagctgctc

SEQ ID NO: 5912692 - DNA, 13 bp, Homo sapiens
gcgcaccccacag

SEQ ID NO: 5912693 - DNA, 18 bp, Homo sapiens
gcgcaccccacagctggg

SEQ ID NO: 5912694 - DNA, 20 bp, Homo sapiens
gcgcaccccacagctggggc

SEQ ID NO: 5912695 - DNA, 17 bp, Homo sapiens
gcgcaccccacgccctg

SEQ ID NO: 5912696 - DNA, 21 bp, Homo sapiens
gcgcacccggcagccccccag

SEQ ID NO: 5912697 - DNA, 15 bp, Homo sapiens
gcgcaccctcccctc

SEQ ID NO: 5912698 - DNA, 18 bp, Homo sapiens
gcgcaccctcccctcccg

SEQ ID NO: 5912699 - DNA, 14 bp, Homo sapiens
gcgcaccgccatgc

SEQ ID NO: 5912700 - DNA, 23 bp, Homo sapiens
gcgcaccgcccaacccccacctc

SEQ ID NO: 5912701 - DNA, 18 bp, Homo sapiens
gcgcacctgccccctggt

SEQ ID NO: 5912702 - DNA, 15 bp, Homo sapiens
gcgcacctgcttccc

SEQ ID NO: 5912703 - DNA, 13 bp, Homo sapiens
gcgcactgcctct

SEQ ID NO: 5912704 - DNA, 19 bp, Homo sapiens
gcgcacttaccgccctgcg

SEQ ID NO: 5912705 - DNA, 22 bp, Homo sapiens
gcgcacttaccgccctgcgggc

SEQ ID NO: 5912706 - DNA, 16 bp, Homo sapiens
gcgcagagccctccag

SEQ ID NO: 5912707 - DNA, 18 bp, Homo sapiens
gcgcagagccctccaggc

SEQ ID NO: 5912708 - DNA, 14 bp, Homo sapiens
gcgcagaggtccca

SEQ ID NO: 5912709 - DNA, 23 bp, Homo sapiens
gcgcagagtagctgcttcctgga

SEQ ID NO: 5912710 - DNA, 17 bp, Homo sapiens
gcgcagatctgtgcctg

SEQ ID NO: 5912711 - DNA, 20 bp, Homo sapiens
gcgcagatgaggggccactg

SEQ ID NO: 5912712 - DNA, 12 bp, Homo sapiens
gcgcagcccctg

SEQ ID NO: 5912713 - DNA, 16 bp, Homo sapiens
gcgcagcccgcggcaa

SEQ ID NO: 5912714 - DNA, 15 bp, Homo sapiens
gcgcagccctagtgg

SEQ ID NO: 5912715 - DNA, 20 bp, Homo sapiens
gcgcagccgcgctctgcccc

SEQ ID NO: 5912716 - DNA, 23 bp, Homo sapiens
gcgcagccgcgctctgcccctcc

SEQ ID NO: 5912717 - DNA, 22 bp, Homo sapiens
gcgcagcgcctccaccctgccc

SEQ ID NO: 5912718 - DNA, 15 bp, Homo sapiens
gcgcagctccttccc

SEQ ID NO: 5912719 - DNA, 17 bp, Homo sapiens
gcgcagctgaagcctgg

SEQ ID NO: 5912720 - DNA, 13 bp, Homo sapiens
gcgcagctgccta

SEQ ID NO: 5912721 - DNA, 14 bp, Homo sapiens
gcgcaggcagcgca

SEQ ID NO: 5912722 - DNA, 20 bp, Homo sapiens
gcgcaggcagcgcagggctg

SEQ ID NO: 5912723 - DNA, 17 bp, Homo sapiens
gcgcaggccctggtgga

SEQ ID NO: 5912724 - DNA, 13 bp, Homo sapiens
gcgcaggctgcag

SEQ ID NO: 5912725 - DNA, 20 bp, Homo sapiens
gcgcaggctgcagagcccgg

SEQ ID NO: 5912726 - DNA, 14 bp, Homo sapiens
gcgcaggctggccc

SEQ ID NO: 5912727 - DNA, 16 bp, Homo sapiens
gcgcaggctggccctg

SEQ ID NO: 5912728 - DNA, 18 bp, Homo sapiens
gcgcaggctggccctgcc

SEQ ID NO: 5912729 - DNA, 17 bp, Homo sapiens
gcgcagggacatggggc

SEQ ID NO: 5912730 - DNA, 22 bp, Homo sapiens
gcgcagggacatggggcaagcc

SEQ ID NO: 5912731 - DNA, 19 bp, Homo sapiens
gcgcagggaggatgccaca

SEQ ID NO: 5912732 - DNA, 15 bp, Homo sapiens
gcgcgcgctctctct

SEQ ID NO: 5912733 - DNA, 21 bp, Homo sapiens
gcgcgcgggacagcggccccg

SEQ ID NO: 5912734 - DNA, 20 bp, Homo sapiens
gcgcgctctctctctttctc

SEQ ID NO: 5912735 - DNA, 11 bp, Homo sapiens
gcgcgctgtgg

SEQ ID NO: 5912736 - DNA, 17 bp, Homo sapiens
gcgcggacgtgctgggc

SEQ ID NO: 5912737 - DNA, 23 bp, Homo sapiens
gcgcggatttctctttctctctc

SEQ ID NO: 5912738 - DNA, 18 bp, Homo sapiens
gcgcggcggctctgccca

SEQ ID NO: 5912739 - DNA, 16 bp, Homo sapiens
gcgcggctggctctgt

SEQ ID NO: 5912740 - DNA, 12 bp, Homo sapiens
gcgcgggacagg

SEQ ID NO: 5912741 - DNA, 22 bp, Homo sapiens
gcgcgggaggcaccagctctgt

SEQ ID NO: 5912742 - DNA, 16 bp, Homo sapiens
gcgcgggcagccaccc

SEQ ID NO: 5912743 - DNA, 19 bp, Homo sapiens
gcgcgggccccggcgcccc

SEQ ID NO: 5912744 - DNA, 14 bp, Homo sapiens
gcgcgggcggaggc

SEQ ID NO: 5912745 - DNA, 18 bp, Homo sapiens
gcgcgggcggaggcggct

SEQ ID NO: 5912746 - DNA, 20 bp, Homo sapiens
gcgcggtggcgggcacctgt

SEQ ID NO: 5912747 - DNA, 13 bp, Homo sapiens
gcgcggtggctca

SEQ ID NO: 5912748 - DNA, 20 bp, Homo sapiens
gcgcggtggctcacgcctgt

SEQ ID NO: 5912749 - DNA, 15 bp, Homo sapiens
gcgcgtatcaccata

SEQ ID NO: 5912750 - DNA, 14 bp, Homo sapiens
gcgcgtctcccatc

SEQ ID NO: 5912751 - DNA, 13 bp, Homo sapiens
gcgcgtctgcccc

SEQ ID NO: 5912752 - DNA, 15 bp, Homo sapiens
gcgcgtgcccccagc

SEQ ID NO: 5912753 - DNA, 16 bp, Homo sapiens
gcgcgtgcccccagcg

SEQ ID NO: 5912754 - DNA, 13 bp, Homo sapiens
gcgcgtgccttcc

SEQ ID NO: 5912755 - DNA, 14 bp, Homo sapiens
gcgcgtgccttccc

SEQ ID NO: 5912756 - DNA, 22 bp, Homo sapiens
gcgcgtttgtgcatatctgcct

SEQ ID NO: 5912757 - DNA, 21 bp, Homo sapiens
gcgctaagtaaaaatattaac

SEQ ID NO: 5912758 - DNA, 16 bp, Homo sapiens
gcgctacccacttcta

SEQ ID NO: 5912759 - DNA, 13 bp, Homo sapiens
gcgctagaggcca

SEQ ID NO: 5912760 - DNA, 16 bp, Homo sapiens
gcgctagcagcccttg

SEQ ID NO: 5912761 - DNA, 13 bp, Homo sapiens
gcgctagtgcctt

SEQ ID NO: 5912762 - DNA, 14 bp, Homo sapiens
gcgctatcttcaca

SEQ ID NO: 5912763 - DNA, 14 bp, Homo sapiens
gcgctattacaaat

SEQ ID NO: 5912764 - DNA, 22 bp, Homo sapiens
gcgctattgcactccagtctgg

SEQ ID NO: 5912765 - DNA, 13 bp, Homo sapiens
gcgctcacctgca

SEQ ID NO: 5912766 - DNA, 13 bp, Homo sapiens
gcgctcagacccc

SEQ ID NO: 5912767 - DNA, 22 bp, Homo sapiens
gcgctcagacggcggccaggca

SEQ ID NO: 5912768 - DNA, 13 bp, Homo sapiens
gcgctcagaggcc

SEQ ID NO: 5912769 - DNA, 19 bp, Homo sapiens
gcgctcagatgccggagcc

SEQ ID NO: 5912770 - DNA, 15 bp, Homo sapiens
gcgctcagcagccct

SEQ ID NO: 5912771 - DNA, 11 bp, Homo sapiens
gcgctcaggac

SEQ ID NO: 5912772 - DNA, 19 bp, Homo sapiens
gcgctcaggacccaggccc

SEQ ID NO: 5912773 - DNA, 13 bp, Homo sapiens
gcgctcaggcatg

SEQ ID NO: 5912774 - DNA, 10 bp, Homo sapiens
gcgctcaggg

SEQ ID NO: 5912775 - DNA, 17 bp, Homo sapiens
gcgctcaggggctccat

SEQ ID NO: 5912776 - DNA, 16 bp, Homo sapiens
gcgctcccagcctgcc

SEQ ID NO: 5912777 - DNA, 20 bp, Homo sapiens
gcgctcccagcctgccctcc

SEQ ID NO: 5912778 - DNA, 18 bp, Homo sapiens
gcgctccgaaccccgggc

SEQ ID NO: 5912779 - DNA, 15 bp, Homo sapiens
gcgctccggcagagg

SEQ ID NO: 5912780 - DNA, 16 bp, Homo sapiens
gcgctccggcagaggc

SEQ ID NO: 5912781 - DNA, 20 bp, Homo sapiens
gcgctccggcagaggcaggg

SEQ ID NO: 5912782 - DNA, 23 bp, Homo sapiens
gcgctccggcagaggcagggccc

SEQ ID NO: 5912783 - DNA, 13 bp, Homo sapiens
gcgctcctcccag

SEQ ID NO: 5912784 - DNA, 13 bp, Homo sapiens
gcgctcctcctgt

SEQ ID NO: 5912785 - DNA, 15 bp, Homo sapiens
gcgctcctcctgtgt

SEQ ID NO: 5912786 - DNA, 21 bp, Homo sapiens
gcgctcctctgcagcctgagc

SEQ ID NO: 5912787 - DNA, 16 bp, Homo sapiens
gcgctcctctgccttg

SEQ ID NO: 5912788 - DNA, 23 bp, Homo sapiens
gcgctcgaagttgatctccccag

SEQ ID NO: 5912789 - DNA, 20 bp, Homo sapiens
gcgctcgatggacctcagca

SEQ ID NO: 5912790 - DNA, 15 bp, Homo sapiens
gcgctcgccacgctc

SEQ ID NO: 5912791 - DNA, 16 bp, Homo sapiens
gcgctcgccacgctca

SEQ ID NO: 5912792 - DNA, 18 bp, Homo sapiens
gcgctcgccacgctcagt

SEQ ID NO: 5912793 - DNA, 20 bp, Homo sapiens
gcgctcgccacgctcagtgc

SEQ ID NO: 5912794 - DNA, 12 bp, Homo sapiens
gcgctctcaaga

SEQ ID NO: 5912795 - DNA, 21 bp, Homo sapiens
gcgctctcagctttccctgcc

SEQ ID NO: 5912796 - DNA, 16 bp, Homo sapiens
gcgctctccaccaccc

SEQ ID NO: 5912797 - DNA, 23 bp, Homo sapiens
gcgctctccctaccttgcctcct

SEQ ID NO: 5912798 - DNA, 14 bp, Homo sapiens
gcgctctcctggac

SEQ ID NO: 5912799 - DNA, 16 bp, Homo sapiens
gcgctctctttgcaac

SEQ ID NO: 5912800 - DNA, 22 bp, Homo sapiens
gcgctctgcatgctcctctgcc

SEQ ID NO: 5912801 - DNA, 22 bp, Homo sapiens
gcgctctgccctccctggcctc

SEQ ID NO: 5912802 - DNA, 14 bp, Homo sapiens
gcgctctggacaga

SEQ ID NO: 5912803 - DNA, 22 bp, Homo sapiens
gcgctctggacagatggacgca

SEQ ID NO: 5912804 - DNA, 19 bp, Homo sapiens
gcgctcttcaccaggaaga

SEQ ID NO: 5912805 - DNA, 16 bp, Homo sapiens
gcgctcttggtccctg

SEQ ID NO: 5912806 - DNA, 17 bp, Homo sapiens
gcgctcttggtccctgg

SEQ ID NO: 5912807 - DNA, 19 bp, Homo sapiens
gcgctgacaaccaccgctc

SEQ ID NO: 5912808 - DNA, 22 bp, Homo sapiens
gcgctgagtggcggggcccctg

SEQ ID NO: 5912809 - DNA, 13 bp, Homo sapiens
gcgctgcccacac

SEQ ID NO: 5912810 - DNA, 21 bp, Homo sapiens
gcgctgcccacaccaccgccc

SEQ ID NO: 5912811 - DNA, 16 bp, Homo sapiens
gcgctgcccccacaga

SEQ ID NO: 5912812 - DNA, 21 bp, Homo sapiens
gcgctgcccccacagatccat

SEQ ID NO: 5912813 - DNA, 14 bp, Homo sapiens
gcgctgcccctggc

SEQ ID NO: 5912814 - DNA, 15 bp, Homo sapiens
gcgctgccctgtgag

SEQ ID NO: 5912815 - DNA, 22 bp, Homo sapiens
gcgctgccgagtccgggccggg

SEQ ID NO: 5912816 - DNA, 19 bp, Homo sapiens
gcgctgccgcaccccagag

SEQ ID NO: 5912817 - DNA, 15 bp, Homo sapiens
gcgctgcctggccag

SEQ ID NO: 5912818 - DNA, 19 bp, Homo sapiens
gcgctgcgcggactcgccc

SEQ ID NO: 5912819 - DNA, 23 bp, Homo sapiens
gcgctgctcttatgccatttgtt

SEQ ID NO: 5912820 - DNA, 13 bp, Homo sapiens
gcgctgctggtgt

SEQ ID NO: 5912821 - DNA, 22 bp, Homo sapiens
gcgctggacacctacagcagca

SEQ ID NO: 5912822 - DNA, 19 bp, Homo sapiens
gcgctggcagcgctcctgg

SEQ ID NO: 5912823 - DNA, 14 bp, Homo sapiens
gcgctggcccagcc

SEQ ID NO: 5912824 - DNA, 18 bp, Homo sapiens
gcgctggcccccccagcc

SEQ ID NO: 5912825 - DNA, 11 bp, Homo sapiens
gcgctggctca

SEQ ID NO: 5912826 - DNA, 16 bp, Homo sapiens
gcgctggctcaggaag

SEQ ID NO: 5912827 - DNA, 21 bp, Homo sapiens
gcgctggctccctgggcagtg

SEQ ID NO: 5912828 - DNA, 16 bp, Homo sapiens
gcgctggctgcactca

SEQ ID NO: 5912829 - DNA, 15 bp, Homo sapiens
gcgctgggcacttcc

SEQ ID NO: 5912830 - DNA, 20 bp, Homo sapiens
gcgctgggcacttccctgct

SEQ ID NO: 5912831 - DNA, 23 bp, Homo sapiens
gcgctggggaagtacgtcccagc

SEQ ID NO: 5912832 - DNA, 13 bp, Homo sapiens
gcgctggggagac

SEQ ID NO: 5912833 - DNA, 18 bp, Homo sapiens
gcgctgggggctggacct

SEQ ID NO: 5912834 - DNA, 19 bp, Homo sapiens
gcgctgggggctggacctg

SEQ ID NO: 5912835 - DNA, 21 bp, Homo sapiens
gcgctgggggctggacctgct

SEQ ID NO: 5912836 - DNA, 22 bp, Homo sapiens
gcgctgggggctggacctgctg

SEQ ID NO: 5912837 - DNA, 17 bp, Homo sapiens
gcgctgggtattggaaa

SEQ ID NO: 5912838 - DNA, 16 bp, Homo sapiens
gcgctgggtgcctgca

SEQ ID NO: 5912839 - DNA, 13 bp, Homo sapiens
gcgctggtggacc

SEQ ID NO: 5912840 - DNA, 17 bp, Homo sapiens
gcgctgtcccaggcatg

SEQ ID NO: 5912841 - DNA, 11 bp, Homo sapiens
gcgctgtcctg

SEQ ID NO: 5912842 - DNA, 12 bp, Homo sapiens
gcgctgtgctcc

SEQ ID NO: 5912843 - DNA, 22 bp, Homo sapiens
gcgctgtgctccagcagtgctg

SEQ ID NO: 5912844 - DNA, 24 bp, Homo sapiens
gcgctgtgctccagcagtgctggg

SEQ ID NO: 5912845 - DNA, 12 bp, Homo sapiens
gcgctgtggact

SEQ ID NO: 5912846 - DNA, 13 bp, Homo sapiens
gcgctgtggactg

SEQ ID NO: 5912847 - DNA, 19 bp, Homo sapiens
gcgctgtggactgtcctga

SEQ ID NO: 5912848 - DNA, 17 bp, Homo sapiens
gcgctgtggctcctgcc

SEQ ID NO: 5912849 - DNA, 18 bp, Homo sapiens
gcgctgtggctcctgcct

SEQ ID NO: 5912850 - DNA, 22 bp, Homo sapiens
gcgctgtgtaaatgctccagca

SEQ ID NO: 5912851 - DNA, 13 bp, Homo sapiens
gcgctgtgtacaa

SEQ ID NO: 5912852 - DNA, 15 bp, Homo sapiens
gcgctgttccacagt

SEQ ID NO: 5912853 - DNA, 16 bp, Homo sapiens
gcgctgttccacagtg

SEQ ID NO: 5912854 - DNA, 21 bp, Homo sapiens
gcgctgtttttgttgtgtgtg

SEQ ID NO: 5912855 - DNA, 22 bp, Homo sapiens
gcgctgtttttgttgtgtgtgc

SEQ ID NO: 5912856 - DNA, 15 bp, Homo sapiens
gcgcttactcctctg

SEQ ID NO: 5912857 - DNA, 11 bp, Homo sapiens
gcgcttcctgg

SEQ ID NO: 5912858 - DNA, 16 bp, Homo sapiens
gcgcttctgcagcctc

SEQ ID NO: 5912859 - DNA, 14 bp, Homo sapiens
gcgcttctgctgaa

SEQ ID NO: 5912860 - DNA, 16 bp, Homo sapiens
gcgcttggtaggtgtg

SEQ ID NO: 5912861 - DNA, 21 bp, Homo sapiens
gcgcttggtaggtgtggtggc

SEQ ID NO: 5912862 - DNA, 22 bp, Homo sapiens
gcgctttcattttttgacctca

SEQ ID NO: 5912863 - DNA, 16 bp, Homo sapiens
gcgctttctcctgtgc

SEQ ID NO: 5912864 - DNA, 17 bp, Homo sapiens
gcggaaaccttgcagca

SEQ ID NO: 5912865 - DNA, 21 bp, Homo sapiens
gcggaaagtgagagccagcag

SEQ ID NO: 5912866 - DNA, 23 bp, Homo sapiens
gcggaacaggagtgactctggct

SEQ ID NO: 5912867 - DNA, 13 bp, Homo sapiens
gcggaaggggacg

SEQ ID NO: 5912868 - DNA, 19 bp, Homo sapiens
gcggaagtacttccctcag

SEQ ID NO: 5912869 - DNA, 17 bp, Homo sapiens
gcggacaaaagggccag

SEQ ID NO: 5912870 - DNA, 10 bp, Homo sapiens
gcggacacac

SEQ ID NO: 5912871 - DNA, 19 bp, Homo sapiens
gcggacaccgtggcctggg

SEQ ID NO: 5912872 - DNA, 15 bp, Homo sapiens
gcggacagccacggc

SEQ ID NO: 5912873 - DNA, 20 bp, Homo sapiens
gcggacatcccctgctggcc

SEQ ID NO: 5912874 - DNA, 22 bp, Homo sapiens
gcggacatcccctgctggccgg

SEQ ID NO: 5912875 - DNA, 16 bp, Homo sapiens
gcggaccaagggactc

SEQ ID NO: 5912876 - DNA, 21 bp, Homo sapiens
gcggaccggagcggctgagga

SEQ ID NO: 5912877 - DNA, 16 bp, Homo sapiens
gcggacgtgctggcct

SEQ ID NO: 5912878 - DNA, 19 bp, Homo sapiens
gcggactccatggcccttc

SEQ ID NO: 5912879 - DNA, 18 bp, Homo sapiens
gcggagaaccttgtgcct

SEQ ID NO: 5912880 - DNA, 13 bp, Homo sapiens
gcggagagagcca

SEQ ID NO: 5912881 - DNA, 14 bp, Homo sapiens
gcggagagagccaa

SEQ ID NO: 5912882 - DNA, 16 bp, Homo sapiens
gcggagagagccaaga

SEQ ID NO: 5912883 - DNA, 22 bp, Homo sapiens
gcggagagaggccttgtcccag

SEQ ID NO: 5912884 - DNA, 20 bp, Homo sapiens
gcggagagggctagccctga

SEQ ID NO: 5912885 - DNA, 22 bp, Homo sapiens
gcggagagggctagccctgagc

SEQ ID NO: 5912886 - DNA, 13 bp, Homo sapiens
gcggagcagcctc

SEQ ID NO: 5912887 - DNA, 16 bp, Homo sapiens
gcggagcccccgcccc

SEQ ID NO: 5912888 - DNA, 18 bp, Homo sapiens
gcggagcccccgcccctc

SEQ ID NO: 5912889 - DNA, 21 bp, Homo sapiens
gcggagcccccgcccctcccc

SEQ ID NO: 5912890 - DNA, 18 bp, Homo sapiens
gcggagctccaggatggg

SEQ ID NO: 5912891 - DNA, 23 bp, Homo sapiens
gcggagctgcatggacgcctggc

SEQ ID NO: 5912892 - DNA, 21 bp, Homo sapiens
gcggagctgctgagtgacagc

SEQ ID NO: 5912893 - DNA, 17 bp, Homo sapiens
gcggagctggccccgcc

SEQ ID NO: 5912894 - DNA, 19 bp, Homo sapiens
gcggagctggggtctgggc

SEQ ID NO: 5912895 - DNA, 14 bp, Homo sapiens
gcggagcttctcca

SEQ ID NO: 5912896 - DNA, 19 bp, Homo sapiens
gcggagcttgcagtgagcc

SEQ ID NO: 5912897 - DNA, 17 bp, Homo sapiens
gcggagcttggccctgc

SEQ ID NO: 5912898 - DNA, 18 bp, Homo sapiens
gcggagcttggccctgcg

SEQ ID NO: 5912899 - DNA, 22 bp, Homo sapiens
gcggaggagaccagctcagagg

SEQ ID NO: 5912900 - DNA, 13 bp, Homo sapiens
gcggaggagctcc

SEQ ID NO: 5912901 - DNA, 13 bp, Homo sapiens
gcggaggagctgc

SEQ ID NO: 5912902 - DNA, 17 bp, Homo sapiens
gcggaggaggagggagg

SEQ ID NO: 5912903 - DNA, 22 bp, Homo sapiens
gcggaggccatgggggcccctc

SEQ ID NO: 5912904 - DNA, 12 bp, Homo sapiens
gcggaggcccct

SEQ ID NO: 5912905 - DNA, 12 bp, Homo sapiens
gcggaggcggct

SEQ ID NO: 5912906 - DNA, 17 bp, Homo sapiens
gcggaggcggctccagg

SEQ ID NO: 5912907 - DNA, 20 bp, Homo sapiens
gcggaggctgctcagatggc

SEQ ID NO: 5912908 - DNA, 17 bp, Homo sapiens
gcggaggggacagagcg

SEQ ID NO: 5912909 - DNA, 20 bp, Homo sapiens
gcggaggggatccagccact

SEQ ID NO: 5912910 - DNA, 16 bp, Homo sapiens
gcgtagggccagggct

SEQ ID NO: 5912911 - DNA, 19 bp, Homo sapiens
gcgtagtgcagcagggcag

SEQ ID NO: 5912912 - DNA, 20 bp, Homo sapiens
gcgtatatgtgcgtctctct

SEQ ID NO: 5912913 - DNA, 18 bp, Homo sapiens
gcgtatggctttattttt

SEQ ID NO: 5912914 - DNA, 21 bp, Homo sapiens
gcgtatgtctgttaccatgtc

SEQ ID NO: 5912915 - DNA, 13 bp, Homo sapiens
gcgtcaagacatt

SEQ ID NO: 5912916 - DNA, 14 bp, Homo sapiens
gcgtcaagacattt

SEQ ID NO: 5912917 - DNA, 22 bp, Homo sapiens
gcgtcacctgtgcagggccctc

SEQ ID NO: 5912918 - DNA, 14 bp, Homo sapiens
gcgtcactccagtg

SEQ ID NO: 5912919 - DNA, 18 bp, Homo sapiens
gcgtcactccagtgctca

SEQ ID NO: 5912920 - DNA, 20 bp, Homo sapiens
gcgtcactccagtgctcagc

SEQ ID NO: 5912921 - DNA, 21 bp, Homo sapiens
gcgtcactccagtgctcagct

SEQ ID NO: 5912922 - DNA, 21 bp, Homo sapiens
gcgtcagagagacccgggaag

SEQ ID NO: 5912923 - DNA, 17 bp, Homo sapiens
gcgtcagaggccctgga

SEQ ID NO: 5912924 - DNA, 15 bp, Homo sapiens
gcgtcagcctccagc

SEQ ID NO: 5912925 - DNA, 17 bp, Homo sapiens
gcgtcagcctccagcct

SEQ ID NO: 5912926 - DNA, 14 bp, Homo sapiens
gcgtcagctgctcc

SEQ ID NO: 5912927 - DNA, 12 bp, Homo sapiens
gcgtcaggagca

SEQ ID NO: 5912928 - DNA, 19 bp, Homo sapiens
gcgtcaggagcagcatcat

SEQ ID NO: 5912929 - DNA, 20 bp, Homo sapiens
gcgtcaggcacgtctcctgc

SEQ ID NO: 5912930 - DNA, 22 bp, Homo sapiens
gcgtcaggcacgtctcctgctg

SEQ ID NO: 5912931 - DNA, 23 bp, Homo sapiens
gcgtcaggggtgcacagtccaca

SEQ ID NO: 5912932 - DNA, 21 bp, Homo sapiens
gcgtcagtcgatattcccagg

SEQ ID NO: 5912933 - DNA, 18 bp, Homo sapiens
gcgtcagtctttttctgt

SEQ ID NO: 5912934 - DNA, 23 bp, Homo sapiens
gcgtcagtctttttctgttgtaa

SEQ ID NO: 5912935 - DNA, 20 bp, Homo sapiens
gcgtcagtttcactccctct

SEQ ID NO: 5912936 - DNA, 14 bp, Homo sapiens
gcgtcatctggtcc

SEQ ID NO: 5912937 - DNA, 17 bp, Homo sapiens
gcgtccaccaggcctca

SEQ ID NO: 5912938 - DNA, 21 bp, Homo sapiens
gcgtccaccaggcctcactgg

SEQ ID NO: 5912939 - DNA, 20 bp, Homo sapiens
gcgtccaccctgagctcggg

SEQ ID NO: 5912940 - DNA, 17 bp, Homo sapiens
gcgtccagctcagccct

SEQ ID NO: 5912941 - DNA, 12 bp, Homo sapiens
gcgtcccagctc

SEQ ID NO: 5912942 - DNA, 13 bp, Homo sapiens
gcgtcccagctcc

SEQ ID NO: 5912943 - DNA, 14 bp, Homo sapiens
gcgtcccagctccc

SEQ ID NO: 5912944 - DNA, 17 bp, Homo sapiens
gcgtcccagctcccctc

SEQ ID NO: 5912945 - DNA, 16 bp, Homo sapiens
gcgtcccagggtaccc

SEQ ID NO: 5912946 - DNA, 17 bp, Homo sapiens
gcgtccccactcccttg

SEQ ID NO: 5912947 - DNA, 19 bp, Homo sapiens
gcgtcccccagccctcagg

SEQ ID NO: 5912948 - DNA, 23 bp, Homo sapiens
gcgtcccccagccctcaggccag

SEQ ID NO: 5912949 - DNA, 18 bp, Homo sapiens
gcgtccccctgccggccg

SEQ ID NO: 5912950 - DNA, 20 bp, Homo sapiens
gcgtcccctgctactcctgt

SEQ ID NO: 5912951 - DNA, 14 bp, Homo sapiens
gcgtccctgctcag

SEQ ID NO: 5912952 - DNA, 17 bp, Homo sapiens
gcgtccctgctcagccc

SEQ ID NO: 5912953 - DNA, 18 bp, Homo sapiens
gcgtccctggcgcaggtg

SEQ ID NO: 5912954 - DNA, 21 bp, Homo sapiens
gcgtccggggtggtggacagg

SEQ ID NO: 5912955 - DNA, 17 bp, Homo sapiens
gcgtcctcagcacccca

SEQ ID NO: 5912956 - DNA, 22 bp, Homo sapiens
gcgtcctcagcaccccactcct

SEQ ID NO: 5912957 - DNA, 17 bp, Homo sapiens
gcgtcctcatttcccct

SEQ ID NO: 5912958 - DNA, 15 bp, Homo sapiens
gcgtcctcctctgtg

SEQ ID NO: 5912959 - DNA, 20 bp, Homo sapiens
gcgtcctctccctcctggcc

SEQ ID NO: 5912960 - DNA, 17 bp, Homo sapiens
gcgtcctgacggcgccc

SEQ ID NO: 5912961 - DNA, 12 bp, Homo sapiens
gcgtcctgagga

SEQ ID NO: 5912962 - DNA, 15 bp, Homo sapiens
gcgtcctgccctgcc

SEQ ID NO: 5912963 - DNA, 13 bp, Homo sapiens
gcgtcctgggctc

SEQ ID NO: 5912964 - DNA, 13 bp, Homo sapiens
gcgtcctgtccac

SEQ ID NO: 5912965 - DNA, 19 bp, Homo sapiens
gcgtcctgtccacacccag

SEQ ID NO: 5912966 - DNA, 21 bp, Homo sapiens
gcgtcctgtccacacccagct

SEQ ID NO: 5912967 - DNA, 24 bp, Homo sapiens
gcgtcctgtccacacccagctcag

SEQ ID NO: 5912968 - DNA, 15 bp, Homo sapiens
gcgtcctttcctctc

SEQ ID NO: 5912969 - DNA, 21 bp, Homo sapiens
gcgtcctttcctctcctctct

SEQ ID NO: 5912970 - DNA, 16 bp, Homo sapiens
gcgtcgccctcccagg

SEQ ID NO: 5912971 - DNA, 23 bp, Homo sapiens
gcgtcgggcgtgggtctctgggg

SEQ ID NO: 5912972 - DNA, 13 bp, Homo sapiens
gcgtctcccatcc

SEQ ID NO: 5912973 - DNA, 18 bp, Homo sapiens
gcgtctcccatcttaact

SEQ ID NO: 5912974 - DNA, 13 bp, Homo sapiens
gcgtctcccccag

SEQ ID NO: 5912975 - DNA, 21 bp, Homo sapiens
gcgtctctctttctccctcac

SEQ ID NO: 5912976 - DNA, 15 bp, Homo sapiens
gcgtctctggccctc

SEQ ID NO: 5912977 - DNA, 22 bp, Homo sapiens
gcgtctgactccctccccaccc

SEQ ID NO: 5912978 - DNA, 23 bp, Homo sapiens
gcgtctgagcggccgcctgtcct

SEQ ID NO: 5912979 - DNA, 17 bp, Homo sapiens
gcgtctgagctggggtg

SEQ ID NO: 5912980 - DNA, 20 bp, Homo sapiens
gcgtctgcagggtgacgcct

SEQ ID NO: 5912981 - DNA, 13 bp, Homo sapiens
gcgtctgccccac

SEQ ID NO: 5912982 - DNA, 12 bp, Homo sapiens
gcgtctgcctgg

SEQ ID NO: 5912983 - DNA, 13 bp, Homo sapiens
gcgtctgcctggg

SEQ ID NO: 5912984 - DNA, 16 bp, Homo sapiens
gcgtctgcgcggatgt

SEQ ID NO: 5912985 - DNA, 22 bp, Homo sapiens
gcgtctgcgttaggcagggcag

SEQ ID NO: 5912986 - DNA, 19 bp, Homo sapiens
gcgtctgctcataggacct

SEQ ID NO: 5912987 - DNA, 21 bp, Homo sapiens
gcgtctggaagtccaatgtgg

SEQ ID NO: 5912988 - DNA, 23 bp, Homo sapiens
gcgtctggaggggcccctgcttc

SEQ ID NO: 5912989 - DNA, 13 bp, Homo sapiens
gcgtctgtgtgcg

SEQ ID NO: 5912990 - DNA, 16 bp, Homo sapiens
gcgtctgttccccctt

SEQ ID NO: 5912991 - DNA, 17 bp, Homo sapiens
gcgtctgttcccccttc

SEQ ID NO: 5912992 - DNA, 23 bp, Homo sapiens
gcgtcttcatctccctgccatcc

SEQ ID NO: 5912993 - DNA, 16 bp, Homo sapiens
gcgtcttccgcccctg

SEQ ID NO: 5912994 - DNA, 18 bp, Homo sapiens
gcgtcttccgcccctgcc

SEQ ID NO: 5912995 - DNA, 12 bp, Homo sapiens
gcgtcttcctga

SEQ ID NO: 5912996 - DNA, 16 bp, Homo sapiens
gcgtcttgcccagcag

SEQ ID NO: 5912997 - DNA, 17 bp, Homo sapiens
gcgtcttgcccagcagc

SEQ ID NO: 5912998 - DNA, 18 bp, Homo sapiens
gcgtcttgcccagcagct

SEQ ID NO: 5912999 - DNA, 13 bp, Homo sapiens
gcgtcttgtgaaa

SEQ ID NO: 5913000 - DNA, 15 bp, Homo sapiens
gcgtcttgtgaaatt

SEQ ID NO: 5913001 - DNA, 17 bp, Homo sapiens
gcgtcttgtgaaattgt

SEQ ID NO: 5913002 - DNA, 18 bp, Homo sapiens
gcgtcttttttctcttcc

SEQ ID NO: 5913003 - DNA, 12 bp, Homo sapiens
gcgtgaaacaca

SEQ ID NO: 5913004 - DNA, 14 bp, Homo sapiens
gcgtgaaacacaat

SEQ ID NO: 5913005 - DNA, 23 bp, Homo sapiens
gcgtgaaacacaccaggctgtgg

SEQ ID NO: 5913006 - DNA, 20 bp, Homo sapiens
gcgtgaacccaggaggcgga

SEQ ID NO: 5913007 - DNA, 13 bp, Homo sapiens
gcgtgaaggccga

SEQ ID NO: 5913008 - DNA, 13 bp, Homo sapiens
gcgtgacaataaa

SEQ ID NO: 5913009 - DNA, 15 bp, Homo sapiens
gcgtgacaatatact

SEQ ID NO: 5913010 - DNA, 15 bp, Homo sapiens
gcgtgaccggcccgc

SEQ ID NO: 5913011 - DNA, 19 bp, Homo sapiens
gcgtgactattttttaata

SEQ ID NO: 5913012 - DNA, 16 bp, Homo sapiens
gcgtgagacccagtgc

SEQ ID NO: 5913013 - DNA, 11 bp, Homo sapiens
gcgtgagacgc

SEQ ID NO: 5913014 - DNA, 14 bp, Homo sapiens
gcgtgagccactgc

SEQ ID NO: 5913015 - DNA, 23 bp, Homo sapiens
gcgtgagccactgcgcccggccc

SEQ ID NO: 5913016 - DNA, 23 bp, Homo sapiens
gcgtgagcttaaaatacaagact

SEQ ID NO: 5913017 - DNA, 16 bp, Homo sapiens
gcgtgaggcctgggct

SEQ ID NO: 5913018 - DNA, 19 bp, Homo sapiens
gcgtgataaaactgggttg

SEQ ID NO: 5913019 - DNA, 15 bp, Homo sapiens
gcgtgatcaaagcca

SEQ ID NO: 5913020 - DNA, 20 bp, Homo sapiens
gcgtgatcaaagccacactc

SEQ ID NO: 5913021 - DNA, 13 bp, Homo sapiens
gcgtgattctgtt

SEQ ID NO: 5913022 - DNA, 15 bp, Homo sapiens
gcgtgattgaccctt

SEQ ID NO: 5913023 - DNA, 17 bp, Homo sapiens
gcgtgattgtggcattt

SEQ ID NO: 5913024 - DNA, 18 bp, Homo sapiens
gcgtgcaaggggctcagc

SEQ ID NO: 5913025 - DNA, 16 bp, Homo sapiens
gcgtgcaccaccatgc

SEQ ID NO: 5913026 - DNA, 14 bp, Homo sapiens
gcgtgcaccccgcc

SEQ ID NO: 5913027 - DNA, 16 bp, Homo sapiens
gcgtgcaccccgccgg

SEQ ID NO: 5913028 - DNA, 22 bp, Homo sapiens
gcgtgcaccccgccggaggaag

SEQ ID NO: 5913029 - DNA, 13 bp, Homo sapiens
gcgtgcataaaaa

SEQ ID NO: 5913030 - DNA, 23 bp, Homo sapiens
gcgtgccagtcaagaagaaaaag

SEQ ID NO: 5913031 - DNA, 18 bp, Homo sapiens
gcgtgccatgagtccatg

SEQ ID NO: 5913032 - DNA, 14 bp, Homo sapiens
gcgtgcccccagcg

SEQ ID NO: 5913033 - DNA, 21 bp, Homo sapiens
gcgtgcccccctcctccagta

SEQ ID NO: 5913034 - DNA, 17 bp, Homo sapiens
gcgtgcccggggcagca

SEQ ID NO: 5913035 - DNA, 14 bp, Homo sapiens
gcgtgccctcgctg

SEQ ID NO: 5913036 - DNA, 14 bp, Homo sapiens
gcgtgccgggcccc

SEQ ID NO: 5913037 - DNA, 17 bp, Homo sapiens
gcgtgccgtgtgagtgt

SEQ ID NO: 5913038 - DNA, 22 bp, Homo sapiens
gcgtgccgtgtgagtgtgacag

SEQ ID NO: 5913039 - DNA, 22 bp, Homo sapiens
gcgtgccttccccgtgcggccc

SEQ ID NO: 5913040 - DNA, 15 bp, Homo sapiens
gcgtgcgcactgcat

SEQ ID NO: 5913041 - DNA, 22 bp, Homo sapiens
gcgtgcgcatcttgcctccagg

SEQ ID NO: 5913042 - DNA, 16 bp, Homo sapiens
gcgtgcgcgtgagtgt

SEQ ID NO: 5913043 - DNA, 15 bp, Homo sapiens
gcgtgctcagaccca

SEQ ID NO: 5913044 - DNA, 14 bp, Homo sapiens
gcgtgctgacatca

SEQ ID NO: 5913045 - DNA, 16 bp, Homo sapiens
gcgtgctgagaggcga

SEQ ID NO: 5913046 - DNA, 17 bp, Homo sapiens
gcgtgctgagaggcgag

SEQ ID NO: 5913047 - DNA, 21 bp, Homo sapiens
gcgtgctggcgacactcaggg

SEQ ID NO: 5913048 - DNA, 16 bp, Homo sapiens
gcgtgctgggacagct

SEQ ID NO: 5913049 - DNA, 19 bp, Homo sapiens
gcgtgctgtctgtcctatg

SEQ ID NO: 5913050 - DNA, 12 bp, Homo sapiens
gcgtggaaaaag

SEQ ID NO: 5913051 - DNA, 17 bp, Homo sapiens
gcgtggacagccggagc

SEQ ID NO: 5913052 - DNA, 23 bp, Homo sapiens
gcgtggaccacccgccctggcag

SEQ ID NO: 5913053 - DNA, 16 bp, Homo sapiens
gcgtggaccccgacaa

SEQ ID NO: 5913054 - DNA, 17 bp, Homo sapiens
gcgtggactctgctaga

SEQ ID NO: 5913055 - DNA, 18 bp, Homo sapiens
gcgtggagactggcaggc

SEQ ID NO: 5913056 - DNA, 16 bp, Homo sapiens
gcgtggagctgcctga

SEQ ID NO: 5913057 - DNA, 14 bp, Homo sapiens
gcgtggaggagagg

SEQ ID NO: 5913058 - DNA, 15 bp, Homo sapiens
gcgtggaggagagga

SEQ ID NO: 5913059 - DNA, 17 bp, Homo sapiens
gcgtggagggaggcccc

SEQ ID NO: 5913060 - DNA, 22 bp, Homo sapiens
gcgtggatcgagtgtagctgtg

SEQ ID NO: 5913061 - DNA, 14 bp, Homo sapiens
gcgtggattaaact

SEQ ID NO: 5913062 - DNA, 17 bp, Homo sapiens
gcgtggcaaatataaaa

SEQ ID NO: 5913063 - DNA, 17 bp, Homo sapiens
gcgtggccacgggggca

SEQ ID NO: 5913064 - DNA, 15 bp, Homo sapiens
gcgtggcccaaggct

SEQ ID NO: 5913065 - DNA, 18 bp, Homo sapiens
gcgtggccttgggaggac

SEQ ID NO: 5913066 - DNA, 20 bp, Homo sapiens
gcgtggcgcagtggccctga

SEQ ID NO: 5913067 - DNA, 13 bp, Homo sapiens
gcgtgggaggcag

SEQ ID NO: 5913068 - DNA, 19 bp, Homo sapiens
gcgtgggaggcagaaacct

SEQ ID NO: 5913069 - DNA, 16 bp, Homo sapiens
gcgtgggatccagaga

SEQ ID NO: 5913070 - DNA, 19 bp, Homo sapiens
gcgtgggcatgggcgcaga

SEQ ID NO: 5913071 - DNA, 19 bp, Homo sapiens
gcgtgggctgaccaggctt

SEQ ID NO: 5913072 - DNA, 20 bp, Homo sapiens
gcgtgggctgaccaggcttc

SEQ ID NO: 5913073 - DNA, 15 bp, Homo sapiens
gcgtgggggaaagga

SEQ ID NO: 5913074 - DNA, 16 bp, Homo sapiens
gcgtgggggacaagaa

SEQ ID NO: 5913075 - DNA, 13 bp, Homo sapiens
gcgtgggtcagaa

SEQ ID NO: 5913076 - DNA, 15 bp, Homo sapiens
gcgtggtagtgcaag

SEQ ID NO: 5913077 - DNA, 21 bp, Homo sapiens
gcgtggtataatctccatttc

SEQ ID NO: 5913078 - DNA, 15 bp, Homo sapiens
gcgtggtgtggcccg

SEQ ID NO: 5913079 - DNA, 21 bp, Homo sapiens
gcgtggtgtgtccctggacac

SEQ ID NO: 5913080 - DNA, 15 bp, Homo sapiens
gcgtggttcctttct

SEQ ID NO: 5913081 - DNA, 15 bp, Homo sapiens
gcgtggttctgccac

SEQ ID NO: 5913082 - DNA, 16 bp, Homo sapiens
gcgtgtatatgtgctt

SEQ ID NO: 5913083 - DNA, 20 bp, Homo sapiens
gcgtgtcaactttcatttga

SEQ ID NO: 5913084 - DNA, 20 bp, Homo sapiens
gcgtgtccccggggcccagg

SEQ ID NO: 5913085 - DNA, 17 bp, Homo sapiens
gcgtgtccgtctgtctg

SEQ ID NO: 5913086 - DNA, 16 bp, Homo sapiens
gcgtgtctctgccatg

SEQ ID NO: 5913087 - DNA, 22 bp, Homo sapiens
gcgtgtctgtttccttctcttt

SEQ ID NO: 5913088 - DNA, 16 bp, Homo sapiens
gctaaggcgtggagct

SEQ ID NO: 5913089 - DNA, 15 bp, Homo sapiens
gctaaggctgctggc

SEQ ID NO: 5913090 - DNA, 16 bp, Homo sapiens
gctaaggctgctggct

SEQ ID NO: 5913091 - DNA, 18 bp, Homo sapiens
gctaaggctgctggcttc

SEQ ID NO: 5913092 - DNA, 21 bp, Homo sapiens
gctaaggctgctggcttcagg

SEQ ID NO: 5913093 - DNA, 19 bp, Homo sapiens
gctaagggcttgtttttct

SEQ ID NO: 5913094 - DNA, 22 bp, Homo sapiens
gctaagggggaccatggggagg

SEQ ID NO: 5913095 - DNA, 15 bp, Homo sapiens
gctaaggtccctggg

SEQ ID NO: 5913096 - DNA, 14 bp, Homo sapiens
gctaaggttctaag

SEQ ID NO: 5913097 - DNA, 15 bp, Homo sapiens
gctaaggttctaagg

SEQ ID NO: 5913098 - DNA, 19 bp, Homo sapiens
gctaagtaaaaatattaac

SEQ ID NO: 5913099 - DNA, 22 bp, Homo sapiens
gctaagtcacccagagcacagg

SEQ ID NO: 5913100 - DNA, 15 bp, Homo sapiens
gctaagtccagctct

SEQ ID NO: 5913101 - DNA, 14 bp, Homo sapiens
gctaagtctttccc

SEQ ID NO: 5913102 - DNA, 18 bp, Homo sapiens
gctaagtggaagacagag

SEQ ID NO: 5913103 - DNA, 13 bp, Homo sapiens
gctaagtgtgaac

SEQ ID NO: 5913104 - DNA, 23 bp, Homo sapiens
gctaagttgtcttacacttctca

SEQ ID NO: 5913105 - DNA, 21 bp, Homo sapiens
gctaataaaaagcttttgtct

SEQ ID NO: 5913106 - DNA, 16 bp, Homo sapiens
gctaataaaagtcaga

SEQ ID NO: 5913107 - DNA, 17 bp, Homo sapiens
gctaataaaagtcagag

SEQ ID NO: 5913108 - DNA, 23 bp, Homo sapiens
gctaataaaagtcagagctcagg

SEQ ID NO: 5913109 - DNA, 23 bp, Homo sapiens
gctaataaaatatcattcagcaa

SEQ ID NO: 5913110 - DNA, 11 bp, Homo sapiens
gctaataaact

SEQ ID NO: 5913111 - DNA, 13 bp, Homo sapiens
gctaataaactgt

SEQ ID NO: 5913112 - DNA, 15 bp, Homo sapiens
gctaataaactgtat

SEQ ID NO: 5913113 - DNA, 19 bp, Homo sapiens
gctaataaactgtattaaa

SEQ ID NO: 5913114 - DNA, 15 bp, Homo sapiens
gctaataaactgttt

SEQ ID NO: 5913115 - DNA, 11 bp, Homo sapiens
gctaataaatc

SEQ ID NO: 5913116 - DNA, 13 bp, Homo sapiens
gctaataaatgac

SEQ ID NO: 5913117 - DNA, 14 bp, Homo sapiens
gctaataaatgacc

SEQ ID NO: 5913118 - DNA, 15 bp, Homo sapiens
gctaataaatgacca

SEQ ID NO: 5913119 - DNA, 18 bp, Homo sapiens
gctaataaatgaccagtt

SEQ ID NO: 5913120 - DNA, 21 bp, Homo sapiens
gctaataaatgaccagtttac

SEQ ID NO: 5913121 - DNA, 12 bp, Homo sapiens
gctaataataaa

SEQ ID NO: 5913122 - DNA, 14 bp, Homo sapiens
gctaataataaatg

SEQ ID NO: 5913123 - DNA, 18 bp, Homo sapiens
gctaataatgagctatta

SEQ ID NO: 5913124 - DNA, 17 bp, Homo sapiens
gctaataatgttaacca

SEQ ID NO: 5913125 - DNA, 14 bp, Homo sapiens
gctaatacaaaact

SEQ ID NO: 5913126 - DNA, 20 bp, Homo sapiens
gctaatatcaatagaaggat

SEQ ID NO: 5913127 - DNA, 17 bp, Homo sapiens
gctaatattaaaccttt

SEQ ID NO: 5913128 - DNA, 14 bp, Homo sapiens
gctaatattttatt

SEQ ID NO: 5913129 - DNA, 19 bp, Homo sapiens
gctaatattttatttgaaa

SEQ ID NO: 5913130 - DNA, 23 bp, Homo sapiens
gctaatattttcctcctgagtgc

SEQ ID NO: 5913131 - DNA, 17 bp, Homo sapiens
gctaatatttttaacaa

SEQ ID NO: 5913132 - DNA, 18 bp, Homo sapiens
gctaatcaaagccagggt

SEQ ID NO: 5913133 - DNA, 14 bp, Homo sapiens
gctaatcagcattc

SEQ ID NO: 5913134 - DNA, 17 bp, Homo sapiens
gctaatcagcattctca

SEQ ID NO: 5913135 - DNA, 16 bp, Homo sapiens
gctaatcagtgtctca

SEQ ID NO: 5913136 - DNA, 23 bp, Homo sapiens
gctaatcatgtgggtgagccagt

SEQ ID NO: 5913137 - DNA, 18 bp, Homo sapiens
gctaatctcttctaggat

SEQ ID NO: 5913138 - DNA, 22 bp, Homo sapiens
gctaatctgaccgttctattgt

SEQ ID NO: 5913139 - DNA, 17 bp, Homo sapiens
gctaatctgtagggctg

SEQ ID NO: 5913140 - DNA, 17 bp, Homo sapiens
gctaatcttgtgaaaat

SEQ ID NO: 5913141 - DNA, 16 bp, Homo sapiens
gctaatgaaattgaga

SEQ ID NO: 5913142 - DNA, 19 bp, Homo sapiens
gctaatgaactctttcaaa

SEQ ID NO: 5913143 - DNA, 21 bp, Homo sapiens
gctaatgaagggaaaggatat

SEQ ID NO: 5913144 - DNA, 18 bp, Homo sapiens
gctaatgaattttaaaag

SEQ ID NO: 5913145 - DNA, 20 bp, Homo sapiens
gctaatgaattttaaaagca

SEQ ID NO: 5913146 - DNA, 23 bp, Homo sapiens
gctaatgaattttaaaagcatat

SEQ ID NO: 5913147 - DNA, 13 bp, Homo sapiens
gctaatgaccaac

SEQ ID NO: 5913148 - DNA, 18 bp, Homo sapiens
gctaatgggctgctgtca

SEQ ID NO: 5913149 - DNA, 13 bp, Homo sapiens
gctaatgtaaact

SEQ ID NO: 5913150 - DNA, 12 bp, Homo sapiens
gctaatgtgtct

SEQ ID NO: 5913151 - DNA, 22 bp, Homo sapiens
gctaatgttgctggatcaggaa

SEQ ID NO: 5913152 - DNA, 14 bp, Homo sapiens
gctaattaaaaagt

SEQ ID NO: 5913153 - DNA, 21 bp, Homo sapiens
gctaattacacacgtgtgatg

SEQ ID NO: 5913154 - DNA, 16 bp, Homo sapiens
gctaattagaaatcaa

SEQ ID NO: 5913155 - DNA, 16 bp, Homo sapiens
gctaattaggaagctt

SEQ ID NO: 5913156 - DNA, 17 bp, Homo sapiens
gctaattattttaatta

SEQ ID NO: 5913157 - DNA, 20 bp, Homo sapiens
gctaattcccagagtgtgaa

SEQ ID NO: 5913158 - DNA, 18 bp, Homo sapiens
gctaattctgggaaggga

SEQ ID NO: 5913159 - DNA, 22 bp, Homo sapiens
gctaattctttgacctgttggg

SEQ ID NO: 5913160 - DNA, 23 bp, Homo sapiens
gctaattgctgttgaaagcaaaa

SEQ ID NO: 5913161 - DNA, 19 bp, Homo sapiens
gctaattgtgtatatgttg

SEQ ID NO: 5913162 - DNA, 15 bp, Homo sapiens
gctaatttaaagaga

SEQ ID NO: 5913163 - DNA, 23 bp, Homo sapiens
gctaatttagagataggaaactg

SEQ ID NO: 5913164 - DNA, 15 bp, Homo sapiens
gctaatttatagcaa

SEQ ID NO: 5913165 - DNA, 20 bp, Homo sapiens
gctaatttatcctgaaattt

SEQ ID NO: 5913166 - DNA, 15 bp, Homo sapiens
gctaatttgcattaa

SEQ ID NO: 5913167 - DNA, 13 bp, Homo sapiens
gctaatttgtgaa

SEQ ID NO: 5913168 - DNA, 13 bp, Homo sapiens
gctaattttctca

SEQ ID NO: 5913169 - DNA, 17 bp, Homo sapiens
gctaattttctcaaaag

SEQ ID NO: 5913170 - DNA, 19 bp, Homo sapiens
gctaattttctcaaaagca

SEQ ID NO: 5913171 - DNA, 17 bp, Homo sapiens
gctaatttttacttttt

SEQ ID NO: 5913172 - DNA, 12 bp, Homo sapiens
gctaatttttat

SEQ ID NO: 5913173 - DNA, 15 bp, Homo sapiens
gctaatttttatatt

SEQ ID NO: 5913174 - DNA, 16 bp, Homo sapiens
gctaatttttgtatgt

SEQ ID NO: 5913175 - DNA, 20 bp, Homo sapiens
gctaattttttgttgtttct

SEQ ID NO: 5913176 - DNA, 17 bp, Homo sapiens
gctacaaaaacacagca

SEQ ID NO: 5913177 - DNA, 22 bp, Homo sapiens
gctacaaaataaagctgttctc

SEQ ID NO: 5913178 - DNA, 16 bp, Homo sapiens
gctacaaaccaggagc

SEQ ID NO: 5913179 - DNA, 17 bp, Homo sapiens
gctacaaaccaggagca

SEQ ID NO: 5913180 - DNA, 13 bp, Homo sapiens
gctacaaactttt

SEQ ID NO: 5913181 - DNA, 16 bp, Homo sapiens
gctacaaagaagacat

SEQ ID NO: 5913182 - DNA, 18 bp, Homo sapiens
gctacaaagaagacatgt

SEQ ID NO: 5913183 - DNA, 20 bp, Homo sapiens
gctacaaagaagacatgttt

SEQ ID NO: 5913184 - DNA, 15 bp, Homo sapiens
gctacaaagcagaga

SEQ ID NO: 5913185 - DNA, 18 bp, Homo sapiens
gctacaaaggaggacaag

SEQ ID NO: 5913186 - DNA, 23 bp, Homo sapiens
gctacaaaggaggacaagaccct

SEQ ID NO: 5913187 - DNA, 18 bp, Homo sapiens
gctacaaatttatgcatt

SEQ ID NO: 5913188 - DNA, 12 bp, Homo sapiens
gctacaacagcc

SEQ ID NO: 5913189 - DNA, 20 bp, Homo sapiens
gctacaaccctaccctggca

SEQ ID NO: 5913190 - DNA, 21 bp, Homo sapiens
gctacaaccctaccctggcag

SEQ ID NO: 5913191 - DNA, 22 bp, Homo sapiens
gctacaaccctaccctggcagg

SEQ ID NO: 5913192 - DNA, 22 bp, Homo sapiens
gctacaagagggcaaagctgat

SEQ ID NO: 5913193 - DNA, 14 bp, Homo sapiens
gctacaagtaactc

SEQ ID NO: 5913194 - DNA, 18 bp, Homo sapiens
gctacaataaatgctgaa

SEQ ID NO: 5913195 - DNA, 21 bp, Homo sapiens
gctacaatcctaccttttgat

SEQ ID NO: 5913196 - DNA, 16 bp, Homo sapiens
gctacaattctgcaga

SEQ ID NO: 5913197 - DNA, 14 bp, Homo sapiens
gctacaatttgttt

SEQ ID NO: 5913198 - DNA, 18 bp, Homo sapiens
gctacaatttgtttttgc

SEQ ID NO: 5913199 - DNA, 15 bp, Homo sapiens
gctacaattttctcc

SEQ ID NO: 5913200 - DNA, 22 bp, Homo sapiens
gctacaattttctcccaggaag

SEQ ID NO: 5913201 - DNA, 12 bp, Homo sapiens
gctacacacaca

SEQ ID NO: 5913202 - DNA, 19 bp, Homo sapiens
gctacacagaccctgccca

SEQ ID NO: 5913203 - DNA, 20 bp, Homo sapiens
gctacacagcagctgttcaa

SEQ ID NO: 5913204 - DNA, 16 bp, Homo sapiens
gctacacaggcaggaa

SEQ ID NO: 5913205 - DNA, 14 bp, Homo sapiens
gctacacaggggaa

SEQ ID NO: 5913206 - DNA, 16 bp, Homo sapiens
gctacaccactctggc

SEQ ID NO: 5913207 - DNA, 21 bp, Homo sapiens
gctacaccactctggcagcca

SEQ ID NO: 5913208 - DNA, 17 bp, Homo sapiens
gctacactcgccttctg

SEQ ID NO: 5913209 - DNA, 16 bp, Homo sapiens
gctacactgtataact

SEQ ID NO: 5913210 - DNA, 15 bp, Homo sapiens
gctacacttacaagt

SEQ ID NO: 5913211 - DNA, 14 bp, Homo sapiens
gctacacttctgat

SEQ ID NO: 5913212 - DNA, 14 bp, Homo sapiens
gctacagaaaccac

SEQ ID NO: 5913213 - DNA, 21 bp, Homo sapiens
gctacagaaaccacagtcttc

SEQ ID NO: 5913214 - DNA, 13 bp, Homo sapiens
gctacagaaagca

SEQ ID NO: 5913215 - DNA, 16 bp, Homo sapiens
gctacagaagaaactg

SEQ ID NO: 5913216 - DNA, 11 bp, Homo sapiens
gctacagagaa

SEQ ID NO: 5913217 - DNA, 15 bp, Homo sapiens
gctacagagaaacca

SEQ ID NO: 5913218 - DNA, 16 bp, Homo sapiens
gctacagagaaaccag

SEQ ID NO: 5913219 - DNA, 17 bp, Homo sapiens
gctacagagaaaccagc

SEQ ID NO: 5913220 - DNA, 12 bp, Homo sapiens
gctacagagaag

SEQ ID NO: 5913221 - DNA, 16 bp, Homo sapiens
gctacagagaagcctt

SEQ ID NO: 5913222 - DNA, 18 bp, Homo sapiens
gctacagagaagccttca

SEQ ID NO: 5913223 - DNA, 20 bp, Homo sapiens
gctacagatgtacattaaat

SEQ ID NO: 5913224 - DNA, 21 bp, Homo sapiens
gctacagattgggcggggctt

SEQ ID NO: 5913225 - DNA, 19 bp, Homo sapiens
gctacagctccacacgccc

SEQ ID NO: 5913226 - DNA, 21 bp, Homo sapiens
gctacagctttcttgctccct

SEQ ID NO: 5913227 - DNA, 11 bp, Homo sapiens
gctacaggagg

SEQ ID NO: 5913228 - DNA, 20 bp, Homo sapiens
gctacaggaggggtctcatg

SEQ ID NO: 5913229 - DNA, 20 bp, Homo sapiens
gctacaggatggtgggcagg

SEQ ID NO: 5913230 - DNA, 17 bp, Homo sapiens
gctacaggggaggctga

SEQ ID NO: 5913231 - DNA, 12 bp, Homo sapiens
gctacaggtgcc

SEQ ID NO: 5913232 - DNA, 17 bp, Homo sapiens
gctacaggtgccccacc

SEQ ID NO: 5913233 - DNA, 20 bp, Homo sapiens
gctacaggttacaacagatt

SEQ ID NO: 5913234 - DNA, 13 bp, Homo sapiens
gctacagtaataa

SEQ ID NO: 5913235 - DNA, 21 bp, Homo sapiens
gctacagttgaacagaactgc

SEQ ID NO: 5913236 - DNA, 22 bp, Homo sapiens
gctacagttgatatttaaaaga

SEQ ID NO: 5913237 - DNA, 22 bp, Homo sapiens
gctacagttgggaagtctcagc

SEQ ID NO: 5913238 - DNA, 20 bp, Homo sapiens
gctacagttttgtgaatctt

SEQ ID NO: 5913239 - DNA, 15 bp, Homo sapiens
gctacatcagactct

SEQ ID NO: 5913240 - DNA, 16 bp, Homo sapiens
gctacatcagactcta

SEQ ID NO: 5913241 - DNA, 17 bp, Homo sapiens
gctacatcagccttcaa

SEQ ID NO: 5913242 - DNA, 19 bp, Homo sapiens
gctacatggggctcactca

SEQ ID NO: 5913243 - DNA, 15 bp, Homo sapiens
gctacattataaacg

SEQ ID NO: 5913244 - DNA, 11 bp, Homo sapiens
gctacattcct

SEQ ID NO: 5913245 - DNA, 13 bp, Homo sapiens
gctacattgtaat

SEQ ID NO: 5913246 - DNA, 14 bp, Homo sapiens
gctacattttcaga

SEQ ID NO: 5913247 - DNA, 14 bp, Homo sapiens
gctaccaaaacagt

SEQ ID NO: 5913248 - DNA, 21 bp, Homo sapiens
gctaccaacttgtatccaggc

SEQ ID NO: 5913249 - DNA, 15 bp, Homo sapiens
gctaccaatctgtga

SEQ ID NO: 5913250 - DNA, 13 bp, Homo sapiens
gctaccaccagct

SEQ ID NO: 5913251 - DNA, 20 bp, Homo sapiens
gctaccaccagctgtgtcca

SEQ ID NO: 5913252 - DNA, 21 bp, Homo sapiens
gctaccactggtacttccttt

SEQ ID NO: 5913253 - DNA, 13 bp, Homo sapiens
gctaccaggaaag

SEQ ID NO: 5913254 - DNA, 15 bp, Homo sapiens
gctaccagtatttag

SEQ ID NO: 5913255 - DNA, 18 bp, Homo sapiens
gctaccagtatttagaag

SEQ ID NO: 5913256 - DNA, 19 bp, Homo sapiens
gctaccatgttaatacatc

SEQ ID NO: 5913257 - DNA, 19 bp, Homo sapiens
gctacccaaaagagaaaaa

SEQ ID NO: 5913258 - DNA, 23 bp, Homo sapiens
gctacccaaaagagaaaaaaaat

SEQ ID NO: 5913259 - DNA, 17 bp, Homo sapiens
gctacccacttctaaat

SEQ ID NO: 5913260 - DNA, 18 bp, Homo sapiens
gctacccatttacaaata

SEQ ID NO: 5913261 - DNA, 19 bp, Homo sapiens
gctaccccattctctagac

SEQ ID NO: 5913262 - DNA, 20 bp, Homo sapiens
gctacccccatgctggaggt

SEQ ID NO: 5913263 - DNA, 22 bp, Homo sapiens
gctaccccccctcctgctgcct

SEQ ID NO: 5913264 - DNA, 15 bp, Homo sapiens
gctaccccccgtctc

SEQ ID NO: 5913265 - DNA, 21 bp, Homo sapiens
gctacccctcgactcagcacc

SEQ ID NO: 5913266 - DNA, 14 bp, Homo sapiens
gctagattaaaata

SEQ ID NO: 5913267 - DNA, 17 bp, Homo sapiens
gctagcaaaagaagtaa

SEQ ID NO: 5913268 - DNA, 22 bp, Homo sapiens
gctagcaaaagaagtaacaaga

SEQ ID NO: 5913269 - DNA, 19 bp, Homo sapiens
gctagcaaagcttaaatgc

SEQ ID NO: 5913270 - DNA, 18 bp, Homo sapiens
gctagcacagaggcctga

SEQ ID NO: 5913271 - DNA, 19 bp, Homo sapiens
gctagcacagaggcctgac

SEQ ID NO: 5913272 - DNA, 16 bp, Homo sapiens
gctagcacatgcccta

SEQ ID NO: 5913273 - DNA, 18 bp, Homo sapiens
gctagcacctccccagac

SEQ ID NO: 5913274 - DNA, 21 bp, Homo sapiens
gctagcacctccccagacagg

SEQ ID NO: 5913275 - DNA, 23 bp, Homo sapiens
gctagcagaaatctagaagactg

SEQ ID NO: 5913276 - DNA, 14 bp, Homo sapiens
gctagcatccctga

SEQ ID NO: 5913277 - DNA, 18 bp, Homo sapiens
gctagccaactcctcctt

SEQ ID NO: 5913278 - DNA, 13 bp, Homo sapiens
gctagccagagga

SEQ ID NO: 5913279 - DNA, 18 bp, Homo sapiens
gctagccagaggactgtg

SEQ ID NO: 5913280 - DNA, 11 bp, Homo sapiens
gctagccccag

SEQ ID NO: 5913281 - DNA, 13 bp, Homo sapiens
gctagccccagag

SEQ ID NO: 5913282 - DNA, 22 bp, Homo sapiens
gctagccccagagatgccagcc

SEQ ID NO: 5913283 - DNA, 11 bp, Homo sapiens
gctagccctga

SEQ ID NO: 5913284 - DNA, 13 bp, Homo sapiens
gctagccctgccc

SEQ ID NO: 5913285 - DNA, 12 bp, Homo sapiens
gctagccctggg

SEQ ID NO: 5913286 - DNA, 16 bp, Homo sapiens
gctagcctttcttgta

SEQ ID NO: 5913287 - DNA, 15 bp, Homo sapiens
gctagcgctgccgca

SEQ ID NO: 5913288 - DNA, 20 bp, Homo sapiens
gctagcgctgccgcacccca

SEQ ID NO: 5913289 - DNA, 22 bp, Homo sapiens
gctagcgctgccgcaccccaga

SEQ ID NO: 5913290 - DNA, 12 bp, Homo sapiens
gctagcggctga

SEQ ID NO: 5913291 - DNA, 19 bp, Homo sapiens
gctagcggggccaggagcc

SEQ ID NO: 5913292 - DNA, 19 bp, Homo sapiens
gctagctaagccaagaggc

SEQ ID NO: 5913293 - DNA, 22 bp, Homo sapiens
gctagctatttctatgtatgtg

SEQ ID NO: 5913294 - DNA, 16 bp, Homo sapiens
gctagctcccctcctc

SEQ ID NO: 5913295 - DNA, 22 bp, Homo sapiens
gctagctctttggtctattttc

SEQ ID NO: 5913296 - DNA, 13 bp, Homo sapiens
gctagctgctttt

SEQ ID NO: 5913297 - DNA, 17 bp, Homo sapiens
gctagcttctgcttttc

SEQ ID NO: 5913298 - DNA, 20 bp, Homo sapiens
gctagcttgacacagtcagc

SEQ ID NO: 5913299 - DNA, 16 bp, Homo sapiens
gctagcttttaggaaa

SEQ ID NO: 5913300 - DNA, 21 bp, Homo sapiens
gctagcttttaggaaaatcac

SEQ ID NO: 5913301 - DNA, 14 bp, Homo sapiens
gctaggaaaggcag

SEQ ID NO: 5913302 - DNA, 17 bp, Homo sapiens
gctaggaaaggcagaaa

SEQ ID NO: 5913303 - DNA, 20 bp, Homo sapiens
gctaggaaaggcagaaacac

SEQ ID NO: 5913304 - DNA, 21 bp, Homo sapiens
gctaggaacactccttcacag

SEQ ID NO: 5913305 - DNA, 15 bp, Homo sapiens
gctaggaaccctgga

SEQ ID NO: 5913306 - DNA, 17 bp, Homo sapiens
gctaggaaccctggagg

SEQ ID NO: 5913307 - DNA, 20 bp, Homo sapiens
gctaggaagagcaggactcc

SEQ ID NO: 5913308 - DNA, 13 bp, Homo sapiens
gctaggaagagtc

SEQ ID NO: 5913309 - DNA, 18 bp, Homo sapiens
gctaggaatatagattaa

SEQ ID NO: 5913310 - DNA, 12 bp, Homo sapiens
gctaggaatgaa

SEQ ID NO: 5913311 - DNA, 16 bp, Homo sapiens
gctaggaatgaaatct

SEQ ID NO: 5913312 - DNA, 21 bp, Homo sapiens
gctaggaattgtgtttataat

SEQ ID NO: 5913313 - DNA, 12 bp, Homo sapiens
gctaggactgag

SEQ ID NO: 5913314 - DNA, 15 bp, Homo sapiens
gctaggactgaggag

SEQ ID NO: 5913315 - DNA, 17 bp, Homo sapiens
gctaggactgaggagtg

SEQ ID NO: 5913316 - DNA, 18 bp, Homo sapiens
gctaggactgaggagtgg

SEQ ID NO: 5913317 - DNA, 20 bp, Homo sapiens
gctaggactgtggaggggag

SEQ ID NO: 5913318 - DNA, 21 bp, Homo sapiens
gctaggactgtggaggggagc

SEQ ID NO: 5913319 - DNA, 17 bp, Homo sapiens
gctaggagaagggctga

SEQ ID NO: 5913320 - DNA, 16 bp, Homo sapiens
gctaggagcaaagcct

SEQ ID NO: 5913321 - DNA, 17 bp, Homo sapiens
gctaggagcaaagcctg

SEQ ID NO: 5913322 - DNA, 18 bp, Homo sapiens
gctaggagcaaagcctgt

SEQ ID NO: 5913323 - DNA, 12 bp, Homo sapiens
gctaggagcccc

SEQ ID NO: 5913324 - DNA, 11 bp, Homo sapiens
gctaggcaggg

SEQ ID NO: 5913325 - DNA, 14 bp, Homo sapiens
gctaggcagggagg

SEQ ID NO: 5913326 - DNA, 18 bp, Homo sapiens
gctaggcagggagggggc

SEQ ID NO: 5913327 - DNA, 18 bp, Homo sapiens
gctaggcatacaagtagg

SEQ ID NO: 5913328 - DNA, 20 bp, Homo sapiens
gctaggcataggtctctttg

SEQ ID NO: 5913329 - DNA, 14 bp, Homo sapiens
gctaggcatgcctg

SEQ ID NO: 5913330 - DNA, 16 bp, Homo sapiens
gctaggccagagccca

SEQ ID NO: 5913331 - DNA, 14 bp, Homo sapiens
gctaggccagcagg

SEQ ID NO: 5913332 - DNA, 16 bp, Homo sapiens
gctaggccccagaggc

SEQ ID NO: 5913333 - DNA, 18 bp, Homo sapiens
gctaggccccagaggccc

SEQ ID NO: 5913334 - DNA, 21 bp, Homo sapiens
gctaggccccagaggccctgg

SEQ ID NO: 5913335 - DNA, 14 bp, Homo sapiens
gctaggcccctgtg

SEQ ID NO: 5913336 - DNA, 18 bp, Homo sapiens
gctaggcccctgtgtagt

SEQ ID NO: 5913337 - DNA, 14 bp, Homo sapiens
gctaggcctggcca

SEQ ID NO: 5913338 - DNA, 16 bp, Homo sapiens
gctaggcctggccaga

SEQ ID NO: 5913339 - DNA, 21 bp, Homo sapiens
gctaggcgagtgccaggactc

SEQ ID NO: 5913340 - DNA, 19 bp, Homo sapiens
gctaggctcgccttccctc

SEQ ID NO: 5913341 - DNA, 22 bp, Homo sapiens
gctaggctcgccttccctcctg

SEQ ID NO: 5913342 - DNA, 23 bp, Homo sapiens
gctaggctctgtctggaagatgg

SEQ ID NO: 5913343 - DNA, 19 bp, Homo sapiens
gctaggctgagatgcacca

SEQ ID NO: 5913344 - DNA, 16 bp, Homo sapiens
gctaggctgtctgcga

SEQ ID NO: 5913345 - DNA, 18 bp, Homo sapiens
gctagggagaatgcagag

SEQ ID NO: 5913346 - DNA, 19 bp, Homo sapiens
gctagggagaatgcagaga

SEQ ID NO: 5913347 - DNA, 17 bp, Homo sapiens
gctaggggacatcagag

SEQ ID NO: 5913348 - DNA, 17 bp, Homo sapiens
gctaggggacttgggga

SEQ ID NO: 5913349 - DNA, 14 bp, Homo sapiens
gctaggggaggggg

SEQ ID NO: 5913350 - DNA, 16 bp, Homo sapiens
gctaggggagggggga

SEQ ID NO: 5913351 - DNA, 18 bp, Homo sapiens
gctaggggaggggggagc

SEQ ID NO: 5913352 - DNA, 23 bp, Homo sapiens
gctaggggccgagtccaggagcc

SEQ ID NO: 5913353 - DNA, 16 bp, Homo sapiens
gctaggggctggggcc

SEQ ID NO: 5913354 - DNA, 14 bp, Homo sapiens
gctaggtctgacca

SEQ ID NO: 5913355 - DNA, 17 bp, Homo sapiens
gctaggtgggccagccc

SEQ ID NO: 5913356 - DNA, 18 bp, Homo sapiens
gctaggttaaatggttgg

SEQ ID NO: 5913357 - DNA, 18 bp, Homo sapiens
gctaggttaataggagga

SEQ ID NO: 5913358 - DNA, 21 bp, Homo sapiens
gctagtaattggaaaggcagc

SEQ ID NO: 5913359 - DNA, 15 bp, Homo sapiens
gctagtatttgaatt

SEQ ID NO: 5913360 - DNA, 18 bp, Homo sapiens
gctagtatttgaattaaa

SEQ ID NO: 5913361 - DNA, 21 bp, Homo sapiens
gctagtcaagctcctcctccc

SEQ ID NO: 5913362 - DNA, 16 bp, Homo sapiens
gctagtcactggcagc

SEQ ID NO: 5913363 - DNA, 22 bp, Homo sapiens
gctagtcactggcagcctgcac

SEQ ID NO: 5913364 - DNA, 18 bp, Homo sapiens
gctagtcagagagagtgt

SEQ ID NO: 5913365 - DNA, 22 bp, Homo sapiens
gctagtcctttctgtgaagcta

SEQ ID NO: 5913366 - DNA, 19 bp, Homo sapiens
gctagtcgcccctcagagc

SEQ ID NO: 5913367 - DNA, 22 bp, Homo sapiens
gctagtcgcccctcagagcatg

SEQ ID NO: 5913368 - DNA, 18 bp, Homo sapiens
gctagtctcttctcagag

SEQ ID NO: 5913369 - DNA, 15 bp, Homo sapiens
gctagtctgtgcctc

SEQ ID NO: 5913370 - DNA, 16 bp, Homo sapiens
gctagtctgtgcctca

SEQ ID NO: 5913371 - DNA, 22 bp, Homo sapiens
gctagtcttttgcttttgccca

SEQ ID NO: 5913372 - DNA, 14 bp, Homo sapiens
gctagtgacttgtg

SEQ ID NO: 5913373 - DNA, 18 bp, Homo sapiens
gctagtgagccttcccat

SEQ ID NO: 5913374 - DNA, 18 bp, Homo sapiens
gctagtgatacactgtat

SEQ ID NO: 5913375 - DNA, 11 bp, Homo sapiens
gctagtgcctt

SEQ ID NO: 5913376 - DNA, 23 bp, Homo sapiens
gctagtgggccctctctctgggc

SEQ ID NO: 5913377 - DNA, 19 bp, Homo sapiens
gctagtggtagtatctcgt

SEQ ID NO: 5913378 - DNA, 21 bp, Homo sapiens
gctagtggtgagcatgtaagt

SEQ ID NO: 5913379 - DNA, 22 bp, Homo sapiens
gctagtgtacctcctctcagtg

SEQ ID NO: 5913380 - DNA, 20 bp, Homo sapiens
gctagtgtctcctctctggt

SEQ ID NO: 5913381 - DNA, 17 bp, Homo sapiens
gctagtgtgagtggcag

SEQ ID NO: 5913382 - DNA, 18 bp, Homo sapiens
gctagtgtgagtggcagc

SEQ ID NO: 5913383 - DNA, 22 bp, Homo sapiens
gctagtgtgagtggcagccatg

SEQ ID NO: 5913384 - DNA, 21 bp, Homo sapiens
gctagtgtggtgtttcctggc

SEQ ID NO: 5913385 - DNA, 14 bp, Homo sapiens
gctagtgttctgtc

SEQ ID NO: 5913386 - DNA, 17 bp, Homo sapiens
gctagtgttgtatttct

SEQ ID NO: 5913387 - DNA, 13 bp, Homo sapiens
gctagtgtttcta

SEQ ID NO: 5913388 - DNA, 22 bp, Homo sapiens
gctagttatacttatttgtata

SEQ ID NO: 5913389 - DNA, 15 bp, Homo sapiens
gctagttctcagctt

SEQ ID NO: 5913390 - DNA, 20 bp, Homo sapiens
gctagttctcagcttgcagc

SEQ ID NO: 5913391 - DNA, 12 bp, Homo sapiens
gctagttctgct

SEQ ID NO: 5913392 - DNA, 15 bp, Homo sapiens
gctagttctgctgcc

SEQ ID NO: 5913393 - DNA, 15 bp, Homo sapiens
gctagttgaatactt

SEQ ID NO: 5913394 - DNA, 19 bp, Homo sapiens
gctagttgaatacttgaac

SEQ ID NO: 5913395 - DNA, 14 bp, Homo sapiens
gctagttgaatcta

SEQ ID NO: 5913396 - DNA, 18 bp, Homo sapiens
gctagttggttgaatttt

SEQ ID NO: 5913397 - DNA, 14 bp, Homo sapiens
gctagtttaaaatt

SEQ ID NO: 5913398 - DNA, 15 bp, Homo sapiens
gctagttttacagat

SEQ ID NO: 5913399 - DNA, 15 bp, Homo sapiens
gctagttttttgctt

SEQ ID NO: 5913400 - DNA, 15 bp, Homo sapiens
gctataaagaaaaga

SEQ ID NO: 5913401 - DNA, 21 bp, Homo sapiens
gctataaagcagtatttttct

SEQ ID NO: 5913402 - DNA, 13 bp, Homo sapiens
gctataaatatat

SEQ ID NO: 5913403 - DNA, 17 bp, Homo sapiens
gctataaatgccagagc

SEQ ID NO: 5913404 - DNA, 19 bp, Homo sapiens
gctataaatgccagagcca

SEQ ID NO: 5913405 - DNA, 18 bp, Homo sapiens
gctataaattcctctttg

SEQ ID NO: 5913406 - DNA, 17 bp, Homo sapiens
gctataaattttttgaa

SEQ ID NO: 5913407 - DNA, 18 bp, Homo sapiens
gctataaattttttgaaa

SEQ ID NO: 5913408 - DNA, 22 bp, Homo sapiens
gctataaattttttgaaacaca

SEQ ID NO: 5913409 - DNA, 20 bp, Homo sapiens
gctataactatgttgataaa

SEQ ID NO: 5913410 - DNA, 16 bp, Homo sapiens
gctataagttttagaa

SEQ ID NO: 5913411 - DNA, 15 bp, Homo sapiens
gctataataaataaa

SEQ ID NO: 5913412 - DNA, 22 bp, Homo sapiens
gctataatcattagttttagag

SEQ ID NO: 5913413 - DNA, 20 bp, Homo sapiens
gctatacacaagcaatgcaa

SEQ ID NO: 5913414 - DNA, 22 bp, Homo sapiens
gctatacatgttggaaatgtgt

SEQ ID NO: 5913415 - DNA, 15 bp, Homo sapiens
gctatacctgtgcct

SEQ ID NO: 5913416 - DNA, 16 bp, Homo sapiens
gctatacctgtgcctc

SEQ ID NO: 5913417 - DNA, 18 bp, Homo sapiens
gctatagctacaggaagc

SEQ ID NO: 5913418 - DNA, 16 bp, Homo sapiens
gctataggctggagaa

SEQ ID NO: 5913419 - DNA, 21 bp, Homo sapiens
gctataggtgctacaaaaaca

SEQ ID NO: 5913420 - DNA, 13 bp, Homo sapiens
gctatagtatttg

SEQ ID NO: 5913421 - DNA, 14 bp, Homo sapiens
gctatagtatttga

SEQ ID NO: 5913422 - DNA, 17 bp, Homo sapiens
gctatagtgaagaatag

SEQ ID NO: 5913423 - DNA, 22 bp, Homo sapiens
gctatagtgtataccacctgta

SEQ ID NO: 5913424 - DNA, 22 bp, Homo sapiens
gctatagttgcagcccaaggac

SEQ ID NO: 5913425 - DNA, 20 bp, Homo sapiens
gctatatataaagacaacaa

SEQ ID NO: 5913426 - DNA, 14 bp, Homo sapiens
gctatatatataaa

SEQ ID NO: 5913427 - DNA, 18 bp, Homo sapiens
gctatatccatgtactgt

SEQ ID NO: 5913428 - DNA, 20 bp, Homo sapiens
gctatatcctgatgctggat

SEQ ID NO: 5913429 - DNA, 15 bp, Homo sapiens
gctatatctatatat

SEQ ID NO: 5913430 - DNA, 12 bp, Homo sapiens
gctatatgcatt

SEQ ID NO: 5913431 - DNA, 22 bp, Homo sapiens
gctatatgcctatatttataaa

SEQ ID NO: 5913432 - DNA, 19 bp, Homo sapiens
gctatatgccttaagccaa

SEQ ID NO: 5913433 - DNA, 21 bp, Homo sapiens
gctatattaggcatgttcagg

SEQ ID NO: 5913434 - DNA, 19 bp, Homo sapiens
gctatatttgattatgtat

SEQ ID NO: 5913435 - DNA, 17 bp, Homo sapiens
gctatatttttaaagaa

SEQ ID NO: 5913436 - DNA, 18 bp, Homo sapiens
gctatatttttaaagaag

SEQ ID NO: 5913437 - DNA, 19 bp, Homo sapiens
gctatatttttaaagaagg

SEQ ID NO: 5913438 - DNA, 20 bp, Homo sapiens
gctatcaaaagaaatagaaa

SEQ ID NO: 5913439 - DNA, 23 bp, Homo sapiens
gctatcaaaagaaatagaaaagg

SEQ ID NO: 5913440 - DNA, 22 bp, Homo sapiens
gctatcaatcaccgtctgtgtt

SEQ ID NO: 5913441 - DNA, 13 bp, Homo sapiens
gctatcacacagt

SEQ ID NO: 5913442 - DNA, 20 bp, Homo sapiens
gctatcacctagcagcctca

SEQ ID NO: 5913443 - DNA, 14 bp, Homo sapiens
gctcactgtgacct

SEQ ID NO: 5913444 - DNA, 17 bp, Homo sapiens
gctcactgtggtgtctg

SEQ ID NO: 5913445 - DNA, 18 bp, Homo sapiens
gctcactgtggtgtctgt

SEQ ID NO: 5913446 - DNA, 16 bp, Homo sapiens
gctcacttcaagctca

SEQ ID NO: 5913447 - DNA, 22 bp, Homo sapiens
gctcacttcaagctcaccctgc

SEQ ID NO: 5913448 - DNA, 20 bp, Homo sapiens
gctcactttattatccctat

SEQ ID NO: 5913449 - DNA, 19 bp, Homo sapiens
gctcacttttgtgaaagct

SEQ ID NO: 5913450 - DNA, 11 bp, Homo sapiens
gctcagaaaat

SEQ ID NO: 5913451 - DNA, 17 bp, Homo sapiens
gctcagaaaatatccct

SEQ ID NO: 5913452 - DNA, 20 bp, Homo sapiens
gctcagaacaccccgctctg

SEQ ID NO: 5913453 - DNA, 17 bp, Homo sapiens
gctcagaacagtatctt

SEQ ID NO: 5913454 - DNA, 15 bp, Homo sapiens
gctcagaaccacagc

SEQ ID NO: 5913455 - DNA, 14 bp, Homo sapiens
gctcagaacccagg

SEQ ID NO: 5913456 - DNA, 17 bp, Homo sapiens
gctcagaacccagggct

SEQ ID NO: 5913457 - DNA, 18 bp, Homo sapiens
gctcagaacccagggctc

SEQ ID NO: 5913458 - DNA, 16 bp, Homo sapiens
gctcagaacttgctgc

SEQ ID NO: 5913459 - DNA, 17 bp, Homo sapiens
gctcagaacttgctgct

SEQ ID NO: 5913460 - DNA, 19 bp, Homo sapiens
gctcagaacttgctgctgt

SEQ ID NO: 5913461 - DNA, 13 bp, Homo sapiens
gctcagaagagca

SEQ ID NO: 5913462 - DNA, 13 bp, Homo sapiens
gctcagaagccag

SEQ ID NO: 5913463 - DNA, 16 bp, Homo sapiens
gctcagaagccagtct

SEQ ID NO: 5913464 - DNA, 17 bp, Homo sapiens
gctcagaatagatctga

SEQ ID NO: 5913465 - DNA, 18 bp, Homo sapiens
gctcagaatccaagtgaa

SEQ ID NO: 5913466 - DNA, 13 bp, Homo sapiens
gctcagaatccac

SEQ ID NO: 5913467 - DNA, 12 bp, Homo sapiens
gctcagaattca

SEQ ID NO: 5913468 - DNA, 12 bp, Homo sapiens
gctcagacattt

SEQ ID NO: 5913469 - DNA, 19 bp, Homo sapiens
gctcagacattttcttttt

SEQ ID NO: 5913470 - DNA, 16 bp, Homo sapiens
gctcagaccagctctt

SEQ ID NO: 5913471 - DNA, 11 bp, Homo sapiens
gctcagacccc

SEQ ID NO: 5913472 - DNA, 16 bp, Homo sapiens
gctcagaccccaccct

SEQ ID NO: 5913473 - DNA, 21 bp, Homo sapiens
gctcagaccccaccctacgct

SEQ ID NO: 5913474 - DNA, 16 bp, Homo sapiens
gctcagacccctcagc

SEQ ID NO: 5913475 - DNA, 17 bp, Homo sapiens
gctcagacccctcagcc

SEQ ID NO: 5913476 - DNA, 19 bp, Homo sapiens
gctcagacccctcagcccc

SEQ ID NO: 5913477 - DNA, 22 bp, Homo sapiens
gctcagacccctcagccccagc

SEQ ID NO: 5913478 - DNA, 17 bp, Homo sapiens
gctcagacggcggccag

SEQ ID NO: 5913479 - DNA, 21 bp, Homo sapiens
gctcagacggcggccaggcac

SEQ ID NO: 5913480 - DNA, 22 bp, Homo sapiens
gctcagacttgccaggctccct

SEQ ID NO: 5913481 - DNA, 19 bp, Homo sapiens
gctcagagactgcaagctg

SEQ ID NO: 5913482 - DNA, 16 bp, Homo sapiens
gctcagagagggcagg

SEQ ID NO: 5913483 - DNA, 13 bp, Homo sapiens
gctcagagagggt

SEQ ID NO: 5913484 - DNA, 20 bp, Homo sapiens
gctcagagagggtgggagtg

SEQ ID NO: 5913485 - DNA, 23 bp, Homo sapiens
gctcagagaggtagcactctcag

SEQ ID NO: 5913486 - DNA, 18 bp, Homo sapiens
gctcagagagtacactgt

SEQ ID NO: 5913487 - DNA, 19 bp, Homo sapiens
gctcagagagtacactgtg

SEQ ID NO: 5913488 - DNA, 17 bp, Homo sapiens
gctcagagatgaaacta

SEQ ID NO: 5913489 - DNA, 18 bp, Homo sapiens
gctcagagatgtgcaccc

SEQ ID NO: 5913490 - DNA, 16 bp, Homo sapiens
gctcagagcagcctct

SEQ ID NO: 5913491 - DNA, 17 bp, Homo sapiens
gctcagagccaaggggg

SEQ ID NO: 5913492 - DNA, 17 bp, Homo sapiens
gctcagagctgctgagc

SEQ ID NO: 5913493 - DNA, 18 bp, Homo sapiens
gctcagagctgctgagca

SEQ ID NO: 5913494 - DNA, 12 bp, Homo sapiens
gctcagagcttt

SEQ ID NO: 5913495 - DNA, 16 bp, Homo sapiens
gctcagagctttaaaa

SEQ ID NO: 5913496 - DNA, 13 bp, Homo sapiens
gctcagagctttg

SEQ ID NO: 5913497 - DNA, 15 bp, Homo sapiens
gctcagaggcccagg

SEQ ID NO: 5913498 - DNA, 13 bp, Homo sapiens
gctcagaggccgc

SEQ ID NO: 5913499 - DNA, 17 bp, Homo sapiens
gctcagaggccgctctg

SEQ ID NO: 5913500 - DNA, 20 bp, Homo sapiens
gctcagaggccgctctgggg

SEQ ID NO: 5913501 - DNA, 20 bp, Homo sapiens
gctcagaggccttgctgtgg

SEQ ID NO: 5913502 - DNA, 19 bp, Homo sapiens
gctcagaggcgcactgtga

SEQ ID NO: 5913503 - DNA, 16 bp, Homo sapiens
gctcagaggggcctca

SEQ ID NO: 5913504 - DNA, 19 bp, Homo sapiens
gctcagagggggactgctg

SEQ ID NO: 5913505 - DNA, 21 bp, Homo sapiens
gctcagagggtgtcctgcacc

SEQ ID NO: 5913506 - DNA, 21 bp, Homo sapiens
gctcagagtgaagagtgaaga

SEQ ID NO: 5913507 - DNA, 16 bp, Homo sapiens
gctcagagtgaccctc

SEQ ID NO: 5913508 - DNA, 17 bp, Homo sapiens
gctcagagtgaccctca

SEQ ID NO: 5913509 - DNA, 18 bp, Homo sapiens
gctcagagtgaccctcag

SEQ ID NO: 5913510 - DNA, 23 bp, Homo sapiens
gctcagagtgaccctcagctgtc

SEQ ID NO: 5913511 - DNA, 15 bp, Homo sapiens
gctcagatagaatga

SEQ ID NO: 5913512 - DNA, 21 bp, Homo sapiens
gctcagatcccacttttgcca

SEQ ID NO: 5913513 - DNA, 18 bp, Homo sapiens
gctcagatgaagagaaat

SEQ ID NO: 5913514 - DNA, 19 bp, Homo sapiens
gctcagatgacatttcgtt

SEQ ID NO: 5913515 - DNA, 18 bp, Homo sapiens
gctcagatgccggagccc

SEQ ID NO: 5913516 - DNA, 17 bp, Homo sapiens
gctcagatgctggtcat

SEQ ID NO: 5913517 - DNA, 18 bp, Homo sapiens
gctcagatgctggtcatc

SEQ ID NO: 5913518 - DNA, 17 bp, Homo sapiens
gctcagatggactggga

SEQ ID NO: 5913519 - DNA, 19 bp, Homo sapiens
gctcagatggactgggagg

SEQ ID NO: 5913520 - DNA, 23 bp, Homo sapiens
gctcagcaaaagatgcttctcac

SEQ ID NO: 5913521 - DNA, 15 bp, Homo sapiens
gctcagcaaggtgtg

SEQ ID NO: 5913522 - DNA, 16 bp, Homo sapiens
gctcagcaaggtgtga

SEQ ID NO: 5913523 - DNA, 18 bp, Homo sapiens
gctcagcagccagtctca

SEQ ID NO: 5913524 - DNA, 21 bp, Homo sapiens
gctcagcagccagtctcagag

SEQ ID NO: 5913525 - DNA, 22 bp, Homo sapiens
gctcagcagccagtctcagaga

SEQ ID NO: 5913526 - DNA, 23 bp, Homo sapiens
gctcagcagccagtctcagagac

SEQ ID NO: 5913527 - DNA, 13 bp, Homo sapiens
gctcagcagccct

SEQ ID NO: 5913528 - DNA, 14 bp, Homo sapiens
gctcagcagcccta

SEQ ID NO: 5913529 - DNA, 17 bp, Homo sapiens
gctcagcagccctagcg

SEQ ID NO: 5913530 - DNA, 11 bp, Homo sapiens
gctcagcagct

SEQ ID NO: 5913531 - DNA, 15 bp, Homo sapiens
gctcagcagggctgg

SEQ ID NO: 5913532 - DNA, 18 bp, Homo sapiens
gctcagcagtgagagcag

SEQ ID NO: 5913533 - DNA, 15 bp, Homo sapiens
gctcagcatcctcca

SEQ ID NO: 5913534 - DNA, 21 bp, Homo sapiens
gctcagccaaggagtcagatg

SEQ ID NO: 5913535 - DNA, 19 bp, Homo sapiens
gctcagccaccactcagtg

SEQ ID NO: 5913536 - DNA, 12 bp, Homo sapiens
gctcagccagca

SEQ ID NO: 5913537 - DNA, 14 bp, Homo sapiens
gctcagccagcact

SEQ ID NO: 5913538 - DNA, 14 bp, Homo sapiens
gctcagccagtggg

SEQ ID NO: 5913539 - DNA, 18 bp, Homo sapiens
gctcagcccacccccctc

SEQ ID NO: 5913540 - DNA, 19 bp, Homo sapiens
gctcagcccatcccctgcc

SEQ ID NO: 5913541 - DNA, 21 bp, Homo sapiens
gctcagcccatcccctgcctc

SEQ ID NO: 5913542 - DNA, 16 bp, Homo sapiens
gctcagccccaactct

SEQ ID NO: 5913543 - DNA, 15 bp, Homo sapiens
gctcagccccacccc

SEQ ID NO: 5913544 - DNA, 22 bp, Homo sapiens
gctcagccccaccccagggcag

SEQ ID NO: 5913545 - DNA, 14 bp, Homo sapiens
gctcagccccacgg

SEQ ID NO: 5913546 - DNA, 17 bp, Homo sapiens
gctcagccccagacctg

SEQ ID NO: 5913547 - DNA, 17 bp, Homo sapiens
gctcagccccagcccag

SEQ ID NO: 5913548 - DNA, 15 bp, Homo sapiens
gctcagccccaggcc

SEQ ID NO: 5913549 - DNA, 20 bp, Homo sapiens
gctcagccccaggccagctg

SEQ ID NO: 5913550 - DNA, 18 bp, Homo sapiens
gctcagccccgagctgtc

SEQ ID NO: 5913551 - DNA, 20 bp, Homo sapiens
gctcagccccgagctgtccc

SEQ ID NO: 5913552 - DNA, 23 bp, Homo sapiens
gctcagcccgggatcctgatggc

SEQ ID NO: 5913553 - DNA, 18 bp, Homo sapiens
gctcagccctccctgccc

SEQ ID NO: 5913554 - DNA, 11 bp, Homo sapiens
gctcagccctg

SEQ ID NO: 5913555 - DNA, 19 bp, Homo sapiens
gctcagccctgactggtgc

SEQ ID NO: 5913556 - DNA, 15 bp, Homo sapiens
gctcagccctgagct

SEQ ID NO: 5913557 - DNA, 12 bp, Homo sapiens
gctcagccctgg

SEQ ID NO: 5913558 - DNA, 14 bp, Homo sapiens
gctcagccctggag

SEQ ID NO: 5913559 - DNA, 16 bp, Homo sapiens
gctcagccctggaggt

SEQ ID NO: 5913560 - DNA, 21 bp, Homo sapiens
gctcagccctggcctggctgg

SEQ ID NO: 5913561 - DNA, 19 bp, Homo sapiens
gctcagcctccccctgctg

SEQ ID NO: 5913562 - DNA, 20 bp, Homo sapiens
gctcagcctccccctgctgc

SEQ ID NO: 5913563 - DNA, 14 bp, Homo sapiens
gctcagcctggtgg

SEQ ID NO: 5913564 - DNA, 15 bp, Homo sapiens
gctcagcctggtggg

SEQ ID NO: 5913565 - DNA, 22 bp, Homo sapiens
gctcagcctggtttctgggtgc

SEQ ID NO: 5913566 - DNA, 14 bp, Homo sapiens
gctcagcctgtctc

SEQ ID NO: 5913567 - DNA, 16 bp, Homo sapiens
gctcagccttctcctc

SEQ ID NO: 5913568 - DNA, 19 bp, Homo sapiens
gctcagccttctcctccca

SEQ ID NO: 5913569 - DNA, 22 bp, Homo sapiens
gctcagccttgcacacccactg

SEQ ID NO: 5913570 - DNA, 18 bp, Homo sapiens
gctcagccttgctgctct

SEQ ID NO: 5913571 - DNA, 20 bp, Homo sapiens
gctcagccttgctgctctgc

SEQ ID NO: 5913572 - DNA, 15 bp, Homo sapiens
gctcagcgctggcag

SEQ ID NO: 5913573 - DNA, 15 bp, Homo sapiens
gctcagcggggacag

SEQ ID NO: 5913574 - DNA, 21 bp, Homo sapiens
gctcagcggggacagctcctt

SEQ ID NO: 5913575 - DNA, 22 bp, Homo sapiens
gctcagcggggacagctccttc

SEQ ID NO: 5913576 - DNA, 17 bp, Homo sapiens
gctcagctcccacaaat

SEQ ID NO: 5913577 - DNA, 11 bp, Homo sapiens
gctcagctcct

SEQ ID NO: 5913578 - DNA, 13 bp, Homo sapiens
gctcagctctggc

SEQ ID NO: 5913579 - DNA, 21 bp, Homo sapiens
gctcagctctggctcacagac

SEQ ID NO: 5913580 - DNA, 13 bp, Homo sapiens
gctcagctgagca

SEQ ID NO: 5913581 - DNA, 23 bp, Homo sapiens
gctcagctgagcatggagacagc

SEQ ID NO: 5913582 - DNA, 12 bp, Homo sapiens
gctcagctgccc

SEQ ID NO: 5913583 - DNA, 19 bp, Homo sapiens
gctcagctgcccatcccag

SEQ ID NO: 5913584 - DNA, 21 bp, Homo sapiens
gctcagctgcgcccccttctt

SEQ ID NO: 5913585 - DNA, 13 bp, Homo sapiens
gctcagctgggcc

SEQ ID NO: 5913586 - DNA, 14 bp, Homo sapiens
gctcagctgggcca

SEQ ID NO: 5913587 - DNA, 16 bp, Homo sapiens
gctcagctgggccact

SEQ ID NO: 5913588 - DNA, 19 bp, Homo sapiens
gctcagctgtcaaggctca

SEQ ID NO: 5913589 - DNA, 12 bp, Homo sapiens
gctcagctgtgg

SEQ ID NO: 5913590 - DNA, 14 bp, Homo sapiens
gctcagctgtggct

SEQ ID NO: 5913591 - DNA, 19 bp, Homo sapiens
gctcagctgtggctggagg

SEQ ID NO: 5913592 - DNA, 20 bp, Homo sapiens
gctcagctgtggctggagga

SEQ ID NO: 5913593 - DNA, 21 bp, Homo sapiens
gctcagctgtggtcccaccca

SEQ ID NO: 5913594 - DNA, 12 bp, Homo sapiens
gctcagcttctc

SEQ ID NO: 5913595 - DNA, 16 bp, Homo sapiens
gctcagcttctcctgt

SEQ ID NO: 5913596 - DNA, 23 bp, Homo sapiens
gctcagcttcttcctaggtccaa

SEQ ID NO: 5913597 - DNA, 21 bp, Homo sapiens
gctcagctttttgtcttttct

SEQ ID NO: 5913598 - DNA, 11 bp, Homo sapiens
gctcaggaaaa

SEQ ID NO: 5913599 - DNA, 19 bp, Homo sapiens
gctcaggaaccgaggcagg

SEQ ID NO: 5913600 - DNA, 20 bp, Homo sapiens
gctcaggaagaaaccccaag

SEQ ID NO: 5913601 - DNA, 18 bp, Homo sapiens
gctcaggaagaagagatg

SEQ ID NO: 5913602 - DNA, 17 bp, Homo sapiens
gctcaggaattgaagat

SEQ ID NO: 5913603 - DNA, 17 bp, Homo sapiens
gctcaggacagatgcca

SEQ ID NO: 5913604 - DNA, 21 bp, Homo sapiens
gctcaggacccaggccctcca

SEQ ID NO: 5913605 - DNA, 16 bp, Homo sapiens
gctcaggactcagaag

SEQ ID NO: 5913606 - DNA, 18 bp, Homo sapiens
gctcaggactcagaagcc

SEQ ID NO: 5913607 - DNA, 12 bp, Homo sapiens
gctcaggagaag

SEQ ID NO: 5913608 - DNA, 15 bp, Homo sapiens
gctcaggagaagcca

SEQ ID NO: 5913609 - DNA, 16 bp, Homo sapiens
gctcaggagagggcct

SEQ ID NO: 5913610 - DNA, 14 bp, Homo sapiens
gctcaggaggaggg

SEQ ID NO: 5913611 - DNA, 11 bp, Homo sapiens
gctcaggaggg

SEQ ID NO: 5913612 - DNA, 23 bp, Homo sapiens
gctcaggaggtcaagaccagcct

SEQ ID NO: 5913613 - DNA, 20 bp, Homo sapiens
gctcaggatgagggaaaaga

SEQ ID NO: 5913614 - DNA, 14 bp, Homo sapiens
gctcaggcaagccc

SEQ ID NO: 5913615 - DNA, 17 bp, Homo sapiens
gctcaggcaagcccctc

SEQ ID NO: 5913616 - DNA, 21 bp, Homo sapiens
gctcaggcaagcccctcagcc

SEQ ID NO: 5913617 - DNA, 22 bp, Homo sapiens
gctcaggcaagcccctcagccc

SEQ ID NO: 5913618 - DNA, 11 bp, Homo sapiens
gctcaggcaga

SEQ ID NO: 5913619 - DNA, 22 bp, Homo sapiens
gctcaggcagacaagagctgct

SEQ ID NO: 5913620 - DNA, 23 bp, Homo sapiens
gctcaggcagacaagagctgctg

SEQ ID NO: 5913621 - DNA, 16 bp, Homo sapiens
gctcaggcaggggcct

SEQ ID NO: 5913622 - DNA, 22 bp, Homo sapiens
gctcaggcatgcaaccatgggc

SEQ ID NO: 5913623 - DNA, 12 bp, Homo sapiens
gctcaggccagt

SEQ ID NO: 5913624 - DNA, 21 bp, Homo sapiens
gctcaggccagtaatcccagt

SEQ ID NO: 5913625 - DNA, 14 bp, Homo sapiens
gctcaggcctagga

SEQ ID NO: 5913626 - DNA, 20 bp, Homo sapiens
gctcaggcctcacctcccag

SEQ ID NO: 5913627 - DNA, 19 bp, Homo sapiens
gctcaggcctcacctggct

SEQ ID NO: 5913628 - DNA, 19 bp, Homo sapiens
gctcaggcgatccacctgt

SEQ ID NO: 5913629 - DNA, 14 bp, Homo sapiens
gctcaggcgcagcc

SEQ ID NO: 5913630 - DNA, 18 bp, Homo sapiens
gctcaggcgcagccctag

SEQ ID NO: 5913631 - DNA, 16 bp, Homo sapiens
gctcaggctccccaag

SEQ ID NO: 5913632 - DNA, 18 bp, Homo sapiens
gctcaggctccccaagac

SEQ ID NO: 5913633 - DNA, 14 bp, Homo sapiens
gctcaggctctgct

SEQ ID NO: 5913634 - DNA, 16 bp, Homo sapiens
gctcaggctctgctgg

SEQ ID NO: 5913635 - DNA, 15 bp, Homo sapiens
gctcaggctgagccc

SEQ ID NO: 5913636 - DNA, 17 bp, Homo sapiens
gctcaggctgagcccag

SEQ ID NO: 5913637 - DNA, 18 bp, Homo sapiens
gctcaggctgagcccagc

SEQ ID NO: 5913638 - DNA, 21 bp, Homo sapiens
gctcaggctgagcccagccac

SEQ ID NO: 5913639 - DNA, 12 bp, Homo sapiens
gctcaggctgca

SEQ ID NO: 5913640 - DNA, 17 bp, Homo sapiens
gctcaggctgcagctgg

SEQ ID NO: 5913641 - DNA, 21 bp, Homo sapiens
gctcaggctgcagctggacag

SEQ ID NO: 5913642 - DNA, 12 bp, Homo sapiens
gctcaggctgcc

SEQ ID NO: 5913643 - DNA, 15 bp, Homo sapiens
gctcaggctgcccag

SEQ ID NO: 5913644 - DNA, 20 bp, Homo sapiens
gctcaggctggagtgcagtg

SEQ ID NO: 5913645 - DNA, 21 bp, Homo sapiens
gctcaggctggagtgcagtga

SEQ ID NO: 5913646 - DNA, 12 bp, Homo sapiens
gctcagggaaat

SEQ ID NO: 5913647 - DNA, 21 bp, Homo sapiens
gctcagggaaatggccttccc

SEQ ID NO: 5913648 - DNA, 22 bp, Homo sapiens
gctcagggaaatggccttcccg

SEQ ID NO: 5913649 - DNA, 18 bp, Homo sapiens
gctcagggaccatggctt

SEQ ID NO: 5913650 - DNA, 21 bp, Homo sapiens
gctcagggatcttctccctcc

SEQ ID NO: 5913651 - DNA, 15 bp, Homo sapiens
gctcagggcatgctt

SEQ ID NO: 5913652 - DNA, 23 bp, Homo sapiens
gctcagggccatgctgaggcctg

SEQ ID NO: 5913653 - DNA, 20 bp, Homo sapiens
gctcagggcccacctcctcc

SEQ ID NO: 5913654 - DNA, 18 bp, Homo sapiens
gctcagggccctgtgcca

SEQ ID NO: 5913655 - DNA, 11 bp, Homo sapiens
gctcagggccg

SEQ ID NO: 5913656 - DNA, 19 bp, Homo sapiens
gctcagggcctggctcagg

SEQ ID NO: 5913657 - DNA, 12 bp, Homo sapiens
gctcagggctgg

SEQ ID NO: 5913658 - DNA, 16 bp, Homo sapiens
gctcaggggccctgga

SEQ ID NO: 5913659 - DNA, 18 bp, Homo sapiens
gctcaggggccctggagc

SEQ ID NO: 5913660 - DNA, 18 bp, Homo sapiens
gctcaggggcctggaggt

SEQ ID NO: 5913661 - DNA, 22 bp, Homo sapiens
gctcaggggcctggaggtctgg

SEQ ID NO: 5913662 - DNA, 18 bp, Homo sapiens
gctcaggggcgtgtggct

SEQ ID NO: 5913663 - DNA, 20 bp, Homo sapiens
gctcaggggcgtgtggctca

SEQ ID NO: 5913664 - DNA, 18 bp, Homo sapiens
gctcagggtaagctgctc

SEQ ID NO: 5913665 - DNA, 17 bp, Homo sapiens
gctcagggtcactgaac

SEQ ID NO: 5913666 - DNA, 23 bp, Homo sapiens
gctcagggtcactgaaccactgc

SEQ ID NO: 5913667 - DNA, 21 bp, Homo sapiens
gctcaggtacagagaaggaat

SEQ ID NO: 5913668 - DNA, 19 bp, Homo sapiens
gctcaggtgccttacatct

SEQ ID NO: 5913669 - DNA, 16 bp, Homo sapiens
gctcaggtgtccctgc

SEQ ID NO: 5913670 - DNA, 13 bp, Homo sapiens
gctcaggttccct

SEQ ID NO: 5913671 - DNA, 14 bp, Homo sapiens
gctcaggttccctg

SEQ ID NO: 5913672 - DNA, 17 bp, Homo sapiens
gctcaggttccctgcca

SEQ ID NO: 5913673 - DNA, 16 bp, Homo sapiens
gctcaggtttctggac

SEQ ID NO: 5913674 - DNA, 12 bp, Homo sapiens
gctcagtaaacg

SEQ ID NO: 5913675 - DNA, 22 bp, Homo sapiens
gctcagtaaacgggaacatgcc

SEQ ID NO: 5913676 - DNA, 22 bp, Homo sapiens
gctcagtaacacagtgcagtgc

SEQ ID NO: 5913677 - DNA, 16 bp, Homo sapiens
gctcagtaatttgagg

SEQ ID NO: 5913678 - DNA, 12 bp, Homo sapiens
gctcagtacagg

SEQ ID NO: 5913679 - DNA, 14 bp, Homo sapiens
gctcagtacagggc

SEQ ID NO: 5913680 - DNA, 15 bp, Homo sapiens
gctcagtacagggca

SEQ ID NO: 5913681 - DNA, 16 bp, Homo sapiens
gctcagtatgtgacct

SEQ ID NO: 5913682 - DNA, 15 bp, Homo sapiens
gctcagtattacttt

SEQ ID NO: 5913683 - DNA, 23 bp, Homo sapiens
gctcagtattactttctgccgct

SEQ ID NO: 5913684 - DNA, 11 bp, Homo sapiens
gctcagtattg

SEQ ID NO: 5913685 - DNA, 15 bp, Homo sapiens
gctcagtcatcaaag

SEQ ID NO: 5913686 - DNA, 15 bp, Homo sapiens
gctcagtcccacagc

SEQ ID NO: 5913687 - DNA, 17 bp, Homo sapiens
gctcagtcccacagccc

SEQ ID NO: 5913688 - DNA, 18 bp, Homo sapiens
gctcagtcccacagcccc

SEQ ID NO: 5913689 - DNA, 16 bp, Homo sapiens
gctcagtcgccctgtt

SEQ ID NO: 5913690 - DNA, 15 bp, Homo sapiens
gctcagtctccttgg

SEQ ID NO: 5913691 - DNA, 18 bp, Homo sapiens
gctcagtctgttcactgc

SEQ ID NO: 5913692 - DNA, 15 bp, Homo sapiens
gctcagtgaagtaca

SEQ ID NO: 5913693 - DNA, 19 bp, Homo sapiens
gctcagtgaagttgctgct

SEQ ID NO: 5913694 - DNA, 15 bp, Homo sapiens
gctcagtgccaccta

SEQ ID NO: 5913695 - DNA, 13 bp, Homo sapiens
gctcagtgcctcc

SEQ ID NO: 5913696 - DNA, 13 bp, Homo sapiens
gctcagtgccttc

SEQ ID NO: 5913697 - DNA, 12 bp, Homo sapiens
gctcagtgctct

SEQ ID NO: 5913698 - DNA, 15 bp, Homo sapiens
gctcagtgctctctc

SEQ ID NO: 5913699 - DNA, 16 bp, Homo sapiens
gctcagtgctctctcc

SEQ ID NO: 5913700 - DNA, 17 bp, Homo sapiens
gctcagtgcttgggctc

SEQ ID NO: 5913701 - DNA, 18 bp, Homo sapiens
gctcagtgtccagcttcc

SEQ ID NO: 5913702 - DNA, 22 bp, Homo sapiens
gctcagtgtccagcttccaaag

SEQ ID NO: 5913703 - DNA, 23 bp, Homo sapiens
gctcagtgtccagcttccaaagc

SEQ ID NO: 5913704 - DNA, 19 bp, Homo sapiens
gctcagtgtttttgtgaat

SEQ ID NO: 5913705 - DNA, 17 bp, Homo sapiens
gctcagttcagaatcac

SEQ ID NO: 5913706 - DNA, 15 bp, Homo sapiens
gctcagttctgcctt

SEQ ID NO: 5913707 - DNA, 19 bp, Homo sapiens
gctcagttgagaaacagtt

SEQ ID NO: 5913708 - DNA, 21 bp, Homo sapiens
gctcataaagatgttaaatgg

SEQ ID NO: 5913709 - DNA, 18 bp, Homo sapiens
gctcataacggatcagaa

SEQ ID NO: 5913710 - DNA, 19 bp, Homo sapiens
gctcataagctgtagaact

SEQ ID NO: 5913711 - DNA, 17 bp, Homo sapiens
gctcatagcacatgttt

SEQ ID NO: 5913712 - DNA, 14 bp, Homo sapiens
gctcatcacccagt

SEQ ID NO: 5913713 - DNA, 15 bp, Homo sapiens
gctcatcacccagtc

SEQ ID NO: 5913714 - DNA, 18 bp, Homo sapiens
gctcatcacccagtcctg

SEQ ID NO: 5913715 - DNA, 23 bp, Homo sapiens
gctcatcacccggatagaggaca

SEQ ID NO: 5913716 - DNA, 13 bp, Homo sapiens
gctcatcactgtg

SEQ ID NO: 5913717 - DNA, 20 bp, Homo sapiens
gctcatcattctctgtctca

SEQ ID NO: 5913718 - DNA, 17 bp, Homo sapiens
gctcatcccccctgctg

SEQ ID NO: 5913719 - DNA, 19 bp, Homo sapiens
gctcatcccccctgctgcc

SEQ ID NO: 5913720 - DNA, 21 bp, Homo sapiens
gctcatcccccctgctgccca

SEQ ID NO: 5913721 - DNA, 23 bp, Homo sapiens
gctcatcccccctgctgcccagt

SEQ ID NO: 5913722 - DNA, 20 bp, Homo sapiens
gctcatccctctcacccaga

SEQ ID NO: 5913723 - DNA, 16 bp, Homo sapiens
gctcatccttaatgta

SEQ ID NO: 5913724 - DNA, 19 bp, Homo sapiens
gctcatctacacatataaa

SEQ ID NO: 5913725 - DNA, 22 bp, Homo sapiens
gctcatctctgtcccacttggc

SEQ ID NO: 5913726 - DNA, 20 bp, Homo sapiens
gctcatctgagccagcaccg

SEQ ID NO: 5913727 - DNA, 21 bp, Homo sapiens
gctcatctgctggtccgtggg

SEQ ID NO: 5913728 - DNA, 23 bp, Homo sapiens
gctcatctgctggtccgtgggac

SEQ ID NO: 5913729 - DNA, 14 bp, Homo sapiens
gctcatgagctcct

SEQ ID NO: 5913730 - DNA, 19 bp, Homo sapiens
gctcatgcctgtaaccctg

SEQ ID NO: 5913731 - DNA, 20 bp, Homo sapiens
gctcatgcctgtaatcccag

SEQ ID NO: 5913732 - DNA, 13 bp, Homo sapiens
gctcatggccctc

SEQ ID NO: 5913733 - DNA, 18 bp, Homo sapiens
gctcatggcgtaatgggc

SEQ ID NO: 5913734 - DNA, 20 bp, Homo sapiens
gctcatgggcccctctgact

SEQ ID NO: 5913735 - DNA, 21 bp, Homo sapiens
gctcatgggcccctctgactc

SEQ ID NO: 5913736 - DNA, 15 bp, Homo sapiens
gctcatgtatattta

SEQ ID NO: 5913737 - DNA, 23 bp, Homo sapiens
gctcatgtccctgtccccaggcc

SEQ ID NO: 5913738 - DNA, 16 bp, Homo sapiens
gctcatgtcctgtcct

SEQ ID NO: 5913739 - DNA, 19 bp, Homo sapiens
gctcatgtcctgtcctggt

SEQ ID NO: 5913740 - DNA, 21 bp, Homo sapiens
gctcatgtcctgtcctggtcc

SEQ ID NO: 5913741 - DNA, 17 bp, Homo sapiens
gctcatgtgtgcaacag

SEQ ID NO: 5913742 - DNA, 22 bp, Homo sapiens
gctcatgtgtgcaacagggtat

SEQ ID NO: 5913743 - DNA, 17 bp, Homo sapiens
gctcatgttcaggcaga

SEQ ID NO: 5913744 - DNA, 17 bp, Homo sapiens
gctcatgttgagccagt

SEQ ID NO: 5913745 - DNA, 17 bp, Homo sapiens
gctcatgtttttaactt

SEQ ID NO: 5913746 - DNA, 19 bp, Homo sapiens
gctcattacagttctttcc

SEQ ID NO: 5913747 - DNA, 16 bp, Homo sapiens
gctcattcatattcct

SEQ ID NO: 5913748 - DNA, 23 bp, Homo sapiens
gctcattcatattcctgcctttc

SEQ ID NO: 5913749 - DNA, 15 bp, Homo sapiens
gctcattcattttat

SEQ ID NO: 5913750 - DNA, 18 bp, Homo sapiens
gctcattcattttatatt

SEQ ID NO: 5913751 - DNA, 23 bp, Homo sapiens
gctcattcattttatattgaaaa

SEQ ID NO: 5913752 - DNA, 20 bp, Homo sapiens
gctcattctgcaccttgcca

SEQ ID NO: 5913753 - DNA, 20 bp, Homo sapiens
gctcattctgtctcttttct

SEQ ID NO: 5913754 - DNA, 22 bp, Homo sapiens
gctcattcttgtgacttacagt

SEQ ID NO: 5913755 - DNA, 15 bp, Homo sapiens
gctcattgtaaccat

SEQ ID NO: 5913756 - DNA, 20 bp, Homo sapiens
gctcattgtagcacaatcct

SEQ ID NO: 5913757 - DNA, 11 bp, Homo sapiens
gctcatttaaa

SEQ ID NO: 5913758 - DNA, 19 bp, Homo sapiens
gctcatttaatcccaggaa

SEQ ID NO: 5913759 - DNA, 12 bp, Homo sapiens
gctcatttactg

SEQ ID NO: 5913760 - DNA, 20 bp, Homo sapiens
gctcatttacttgaaatgta

SEQ ID NO: 5913761 - DNA, 17 bp, Homo sapiens
gctcatttcagtttcta

SEQ ID NO: 5913762 - DNA, 18 bp, Homo sapiens
gctcattttaggcctcct

SEQ ID NO: 5913763 - DNA, 21 bp, Homo sapiens
gctcattttctacgtcatgta

SEQ ID NO: 5913764 - DNA, 22 bp, Homo sapiens
gctcattttctacgtcatgtat

SEQ ID NO: 5913765 - DNA, 15 bp, Homo sapiens
gctcattttctttag

SEQ ID NO: 5913766 - DNA, 16 bp, Homo sapiens
gctccaaaccccaggg

SEQ ID NO: 5913767 - DNA, 16 bp, Homo sapiens
gctccaaaccctcgag

SEQ ID NO: 5913768 - DNA, 17 bp, Homo sapiens
gctccaaaccctcgagg

SEQ ID NO: 5913769 - DNA, 14 bp, Homo sapiens
gctccaaaccttca

SEQ ID NO: 5913770 - DNA, 19 bp, Homo sapiens
gctccaaagtcataattgc

SEQ ID NO: 5913771 - DNA, 12 bp, Homo sapiens
gctccaacagaa

SEQ ID NO: 5913772 - DNA, 15 bp, Homo sapiens
gctccaacagacacc

SEQ ID NO: 5913773 - DNA, 17 bp, Homo sapiens
gctccaacagacaccct

SEQ ID NO: 5913774 - DNA, 20 bp, Homo sapiens
gctccaacagacaccctcca

SEQ ID NO: 5913775 - DNA, 22 bp, Homo sapiens
gctccaacagcttgaccagacc

SEQ ID NO: 5913776 - DNA, 22 bp, Homo sapiens
gctccaacccgttgggtccctt

SEQ ID NO: 5913777 - DNA, 18 bp, Homo sapiens
gctccaacctgcaaagat

SEQ ID NO: 5913778 - DNA, 21 bp, Homo sapiens
gctccaacctgcaaagatctg

SEQ ID NO: 5913779 - DNA, 15 bp, Homo sapiens
gctccaacctggagg

SEQ ID NO: 5913780 - DNA, 18 bp, Homo sapiens
gctccaagacctgttggt

SEQ ID NO: 5913781 - DNA, 14 bp, Homo sapiens
gctccaagaggctg

SEQ ID NO: 5913782 - DNA, 16 bp, Homo sapiens
gctccaagattctaga

SEQ ID NO: 5913783 - DNA, 17 bp, Homo sapiens
gctccaagattctagat

SEQ ID NO: 5913784 - DNA, 15 bp, Homo sapiens
gctccaagctcccag

SEQ ID NO: 5913785 - DNA, 17 bp, Homo sapiens
gctccaagctcccaggc

SEQ ID NO: 5913786 - DNA, 16 bp, Homo sapiens
gctccaagggacaggt

SEQ ID NO: 5913787 - DNA, 20 bp, Homo sapiens
gctccaaggggaatcagaac

SEQ ID NO: 5913788 - DNA, 17 bp, Homo sapiens
gctccaataaaggaaca

SEQ ID NO: 5913789 - DNA, 17 bp, Homo sapiens
gctccaatgactgagca

SEQ ID NO: 5913790 - DNA, 18 bp, Homo sapiens
gctccaatggggcggggc

SEQ ID NO: 5913791 - DNA, 14 bp, Homo sapiens
gctccacaagagag

SEQ ID NO: 5913792 - DNA, 17 bp, Homo sapiens
gctccacacacacaaaa

SEQ ID NO: 5913793 - DNA, 16 bp, Homo sapiens
gctccacacagcagtg

SEQ ID NO: 5913794 - DNA, 24 bp, Homo sapiens
gctccacacagcagtgtcccctgc

SEQ ID NO: 5913795 - DNA, 21 bp, Homo sapiens
gctccacacattccagccagg

SEQ ID NO: 5913796 - DNA, 19 bp, Homo sapiens
gctccacaccctctcccag

SEQ ID NO: 5913797 - DNA, 23 bp, Homo sapiens
gctccacaccctctcccaggacc

SEQ ID NO: 5913798 - DNA, 15 bp, Homo sapiens
gctccctctccccct

SEQ ID NO: 5913799 - DNA, 15 bp, Homo sapiens
gctccctctcctgta

SEQ ID NO: 5913800 - DNA, 16 bp, Homo sapiens
gctccctctctcctgg

SEQ ID NO: 5913801 - DNA, 20 bp, Homo sapiens
gctccctctctcctggactg

SEQ ID NO: 5913802 - DNA, 22 bp, Homo sapiens
gctccctctctcctggactggt

SEQ ID NO: 5913803 - DNA, 17 bp, Homo sapiens
gctccctctctggtttc

SEQ ID NO: 5913804 - DNA, 15 bp, Homo sapiens
gctccctgaagccag

SEQ ID NO: 5913805 - DNA, 17 bp, Homo sapiens
gctccctgaagccagcc

SEQ ID NO: 5913806 - DNA, 13 bp, Homo sapiens
gctccctgaccac

SEQ ID NO: 5913807 - DNA, 17 bp, Homo sapiens
gctccctgaccaccctg

SEQ ID NO: 5913808 - DNA, 23 bp, Homo sapiens
gctccctgaccaccctgcctgtg

SEQ ID NO: 5913809 - DNA, 13 bp, Homo sapiens
gctccctgacccc

SEQ ID NO: 5913810 - DNA, 16 bp, Homo sapiens
gctccctgaccccctg

SEQ ID NO: 5913811 - DNA, 19 bp, Homo sapiens
gctccctgaccccctgtcc

SEQ ID NO: 5913812 - DNA, 16 bp, Homo sapiens
gctccctgactgggag

SEQ ID NO: 5913813 - DNA, 18 bp, Homo sapiens
gctccctgacttctcccc

SEQ ID NO: 5913814 - DNA, 19 bp, Homo sapiens
gctccctgacttctccccc

SEQ ID NO: 5913815 - DNA, 15 bp, Homo sapiens
gctccctgagggcgg

SEQ ID NO: 5913816 - DNA, 23 bp, Homo sapiens
gctccctgagggcggagcgcctc

SEQ ID NO: 5913817 - DNA, 14 bp, Homo sapiens
gctccctgaggtac

SEQ ID NO: 5913818 - DNA, 16 bp, Homo sapiens
gctccctgatgacacc

SEQ ID NO: 5913819 - DNA, 13 bp, Homo sapiens
gctccctgcaccg

SEQ ID NO: 5913820 - DNA, 15 bp, Homo sapiens
gctccctgcaccgcc

SEQ ID NO: 5913821 - DNA, 17 bp, Homo sapiens
gctccctgcctcctgcc

SEQ ID NO: 5913822 - DNA, 18 bp, Homo sapiens
gctccctgcctcctgcct

SEQ ID NO: 5913823 - DNA, 15 bp, Homo sapiens
gctccctgcctgttt

SEQ ID NO: 5913824 - DNA, 19 bp, Homo sapiens
gctccctgctcccagggac

SEQ ID NO: 5913825 - DNA, 21 bp, Homo sapiens
gctccctgctttggctgaggg

SEQ ID NO: 5913826 - DNA, 14 bp, Homo sapiens
gctccctggagccc

SEQ ID NO: 5913827 - DNA, 13 bp, Homo sapiens
gctccctggagga

SEQ ID NO: 5913828 - DNA, 23 bp, Homo sapiens
gctccctggaggcacgcaccact

SEQ ID NO: 5913829 - DNA, 15 bp, Homo sapiens
gctccctggcccagc

SEQ ID NO: 5913830 - DNA, 19 bp, Homo sapiens
gctccctggcccagccagc

SEQ ID NO: 5913831 - DNA, 15 bp, Homo sapiens
gctccctgggctggc

SEQ ID NO: 5913832 - DNA, 21 bp, Homo sapiens
gctccctggggttctctacag

SEQ ID NO: 5913833 - DNA, 20 bp, Homo sapiens
gctccctggtgagggagcct

SEQ ID NO: 5913834 - DNA, 22 bp, Homo sapiens
gctccctggtgagggagcctcg

SEQ ID NO: 5913835 - DNA, 16 bp, Homo sapiens
gctccctgtagctctg

SEQ ID NO: 5913836 - DNA, 19 bp, Homo sapiens
gctccctgtagctctgcct

SEQ ID NO: 5913837 - DNA, 17 bp, Homo sapiens
gctccctgtagggtcca

SEQ ID NO: 5913838 - DNA, 22 bp, Homo sapiens
gctccctgtctgtgtcccagcc

SEQ ID NO: 5913839 - DNA, 18 bp, Homo sapiens
gctccctgtggggcagga

SEQ ID NO: 5913840 - DNA, 19 bp, Homo sapiens
gctccctgtggggcaggag

SEQ ID NO: 5913841 - DNA, 22 bp, Homo sapiens
gctcccttcaagacgaggggca

SEQ ID NO: 5913842 - DNA, 12 bp, Homo sapiens
gctcccttcagc

SEQ ID NO: 5913843 - DNA, 19 bp, Homo sapiens
gctcccttcaggcccgctg

SEQ ID NO: 5913844 - DNA, 18 bp, Homo sapiens
gctcccttccacctgtca

SEQ ID NO: 5913845 - DNA, 13 bp, Homo sapiens
gctcccttcctga

SEQ ID NO: 5913846 - DNA, 16 bp, Homo sapiens
gctcccttctctgtag

SEQ ID NO: 5913847 - DNA, 18 bp, Homo sapiens
gctcccttgacctgctga

SEQ ID NO: 5913848 - DNA, 15 bp, Homo sapiens
gctcccttgagctgg

SEQ ID NO: 5913849 - DNA, 21 bp, Homo sapiens
gctcccttgagctggttttct

SEQ ID NO: 5913850 - DNA, 14 bp, Homo sapiens
gctcccttggcttt

SEQ ID NO: 5913851 - DNA, 21 bp, Homo sapiens
gctcccttgggaaggacacag

SEQ ID NO: 5913852 - DNA, 15 bp, Homo sapiens
gctcccttggtgccc

SEQ ID NO: 5913853 - DNA, 17 bp, Homo sapiens
gctccctttaagccaag

SEQ ID NO: 5913854 - DNA, 14 bp, Homo sapiens
gctccctttctcag

SEQ ID NO: 5913855 - DNA, 17 bp, Homo sapiens
gctccctttctcaggag

SEQ ID NO: 5913856 - DNA, 21 bp, Homo sapiens
gctcccttttacattctgtgt

SEQ ID NO: 5913857 - DNA, 12 bp, Homo sapiens
gctcccttttca

SEQ ID NO: 5913858 - DNA, 15 bp, Homo sapiens
gctccctttttgaat

SEQ ID NO: 5913859 - DNA, 15 bp, Homo sapiens
gctccgaaccccggg

SEQ ID NO: 5913860 - DNA, 16 bp, Homo sapiens
gctccgacctctctca

SEQ ID NO: 5913861 - DNA, 23 bp, Homo sapiens
gctccgacttgtgcacaggcaga

SEQ ID NO: 5913862 - DNA, 13 bp, Homo sapiens
gctccgaggactg

SEQ ID NO: 5913863 - DNA, 14 bp, Homo sapiens
gctccgaggactgg

SEQ ID NO: 5913864 - DNA, 15 bp, Homo sapiens
gctccgaggactgga

SEQ ID NO: 5913865 - DNA, 16 bp, Homo sapiens
gctccgagggcggcca

SEQ ID NO: 5913866 - DNA, 15 bp, Homo sapiens
gctccgaggggctca

SEQ ID NO: 5913867 - DNA, 16 bp, Homo sapiens
gctccgcaggacttcc

SEQ ID NO: 5913868 - DNA, 15 bp, Homo sapiens
gctccgcagggcgcc

SEQ ID NO: 5913869 - DNA, 12 bp, Homo sapiens
gctccgccagga

SEQ ID NO: 5913870 - DNA, 20 bp, Homo sapiens
gctccgccatggtgtcccgg

SEQ ID NO: 5913871 - DNA, 16 bp, Homo sapiens
gctccgcccttagtcc

SEQ ID NO: 5913872 - DNA, 14 bp, Homo sapiens
gctccgcctctgct

SEQ ID NO: 5913873 - DNA, 17 bp, Homo sapiens
gctccgcctctgctggc

SEQ ID NO: 5913874 - DNA, 23 bp, Homo sapiens
gctccgcgctcggggctgggcag

SEQ ID NO: 5913875 - DNA, 24 bp, Homo sapiens
gctccgcgctcggggctgggcaga

SEQ ID NO: 5913876 - DNA, 13 bp, Homo sapiens
gctccgctcccac

SEQ ID NO: 5913877 - DNA, 13 bp, Homo sapiens
gctccgctgcctg

SEQ ID NO: 5913878 - DNA, 15 bp, Homo sapiens
gctccgctgcctgga

SEQ ID NO: 5913879 - DNA, 18 bp, Homo sapiens
gctccgctgcctggaaca

SEQ ID NO: 5913880 - DNA, 16 bp, Homo sapiens
gctccgctgcttactg

SEQ ID NO: 5913881 - DNA, 22 bp, Homo sapiens
gctccgctttctacccagcgag

SEQ ID NO: 5913882 - DNA, 14 bp, Homo sapiens
gctccggaatagat

SEQ ID NO: 5913883 - DNA, 20 bp, Homo sapiens
gctccggagggggtcctcct

SEQ ID NO: 5913884 - DNA, 12 bp, Homo sapiens
gctccggcagag

SEQ ID NO: 5913885 - DNA, 15 bp, Homo sapiens
gctccggcagaggca

SEQ ID NO: 5913886 - DNA, 15 bp, Homo sapiens
gctccggcctgcgtc

SEQ ID NO: 5913887 - DNA, 17 bp, Homo sapiens
gctccgggaacagtgca

SEQ ID NO: 5913888 - DNA, 15 bp, Homo sapiens
gctccgggcaccagg

SEQ ID NO: 5913889 - DNA, 18 bp, Homo sapiens
gctccgggtcactgctgt

SEQ ID NO: 5913890 - DNA, 20 bp, Homo sapiens
gctccggtttgggctgtctt

SEQ ID NO: 5913891 - DNA, 19 bp, Homo sapiens
gctccgtcatctgcggggc

SEQ ID NO: 5913892 - DNA, 16 bp, Homo sapiens
gctccgtgagcccttg

SEQ ID NO: 5913893 - DNA, 22 bp, Homo sapiens
gctccgtgagtgaaccatcatt

SEQ ID NO: 5913894 - DNA, 13 bp, Homo sapiens
gctccgtgcctcc

SEQ ID NO: 5913895 - DNA, 17 bp, Homo sapiens
gctccgtgcctccacca

SEQ ID NO: 5913896 - DNA, 22 bp, Homo sapiens
gctccgtggccccgccctcagg

SEQ ID NO: 5913897 - DNA, 22 bp, Homo sapiens
gctccgtgtgggagaccggcct

SEQ ID NO: 5913898 - DNA, 16 bp, Homo sapiens
gctccgtgtttctcta

SEQ ID NO: 5913899 - DNA, 20 bp, Homo sapiens
gctcctaaacccccgctcca

SEQ ID NO: 5913900 - DNA, 22 bp, Homo sapiens
gctcctaaacccccgctccaga

SEQ ID NO: 5913901 - DNA, 16 bp, Homo sapiens
gctcctaaaggcagca

SEQ ID NO: 5913902 - DNA, 17 bp, Homo sapiens
gctcctaaagtaacatc

SEQ ID NO: 5913903 - DNA, 15 bp, Homo sapiens
gctcctaactccacc

SEQ ID NO: 5913904 - DNA, 17 bp, Homo sapiens
gctcctaactccaccgc

SEQ ID NO: 5913905 - DNA, 18 bp, Homo sapiens
gctcctaactccaccgcc

SEQ ID NO: 5913906 - DNA, 18 bp, Homo sapiens
gctcctacatccagctcc

SEQ ID NO: 5913907 - DNA, 19 bp, Homo sapiens
gctcctacatccagctcct

SEQ ID NO: 5913908 - DNA, 15 bp, Homo sapiens
gctcctaccagcaaa

SEQ ID NO: 5913909 - DNA, 21 bp, Homo sapiens
gctcctacccctgtcctgggg

SEQ ID NO: 5913910 - DNA, 17 bp, Homo sapiens
gctcctacctctgtgcc

SEQ ID NO: 5913911 - DNA, 19 bp, Homo sapiens
gctcctacctctgtgccag

SEQ ID NO: 5913912 - DNA, 17 bp, Homo sapiens
gctcctacctgtctgct

SEQ ID NO: 5913913 - DNA, 20 bp, Homo sapiens
gctcctacctgtctgctgcc

SEQ ID NO: 5913914 - DNA, 21 bp, Homo sapiens
gctcctacctgtctgctgcca

SEQ ID NO: 5913915 - DNA, 22 bp, Homo sapiens
gctcctacctgtctgctgccag

SEQ ID NO: 5913916 - DNA, 15 bp, Homo sapiens
gctcctagcaccctg

SEQ ID NO: 5913917 - DNA, 17 bp, Homo sapiens
gctcctagcaccctgga

SEQ ID NO: 5913918 - DNA, 19 bp, Homo sapiens
gctcctagcaccctggaga

SEQ ID NO: 5913919 - DNA, 22 bp, Homo sapiens
gctcctagcagacagaaactgg

SEQ ID NO: 5913920 - DNA, 17 bp, Homo sapiens
gctcctaggggaacaga

SEQ ID NO: 5913921 - DNA, 23 bp, Homo sapiens
gctcctaggggaacagaccagtg

SEQ ID NO: 5913922 - DNA, 19 bp, Homo sapiens
gctcctataaagggcccac

SEQ ID NO: 5913923 - DNA, 15 bp, Homo sapiens
gctcctatctgtgtt

SEQ ID NO: 5913924 - DNA, 14 bp, Homo sapiens
gctcctattgaaag

SEQ ID NO: 5913925 - DNA, 21 bp, Homo sapiens
gctcctcaacccctcccctcc

SEQ ID NO: 5913926 - DNA, 22 bp, Homo sapiens
gctcctcaacccctcccctcca

SEQ ID NO: 5913927 - DNA, 22 bp, Homo sapiens
gctcctcacccccacccctgta

SEQ ID NO: 5913928 - DNA, 15 bp, Homo sapiens
gctcctcacctgtct

SEQ ID NO: 5913929 - DNA, 16 bp, Homo sapiens
gctcctcacctgtcta

SEQ ID NO: 5913930 - DNA, 23 bp, Homo sapiens
gctcctcactgcccgcacaccct

SEQ ID NO: 5913931 - DNA, 14 bp, Homo sapiens
gctcctcactggag

SEQ ID NO: 5913932 - DNA, 13 bp, Homo sapiens
gctcctcagagcg

SEQ ID NO: 5913933 - DNA, 18 bp, Homo sapiens
gctcctcagccctctctt

SEQ ID NO: 5913934 - DNA, 20 bp, Homo sapiens
gctcctcagggactcaggtg

SEQ ID NO: 5913935 - DNA, 13 bp, Homo sapiens
gctcctccagccc

SEQ ID NO: 5913936 - DNA, 14 bp, Homo sapiens
gctcctccagccct

SEQ ID NO: 5913937 - DNA, 16 bp, Homo sapiens
gctcctccagccctgc

SEQ ID NO: 5913938 - DNA, 15 bp, Homo sapiens
gctcctccagccctt

SEQ ID NO: 5913939 - DNA, 16 bp, Homo sapiens
gctcctccagcccttc

SEQ ID NO: 5913940 - DNA, 14 bp, Homo sapiens
gctcctccagggcc

SEQ ID NO: 5913941 - DNA, 18 bp, Homo sapiens
gctcctccagggccacgt

SEQ ID NO: 5913942 - DNA, 23 bp, Homo sapiens
gctcctccagggccacgtgccag

SEQ ID NO: 5913943 - DNA, 22 bp, Homo sapiens
gctcctccagggtggcagcaac

SEQ ID NO: 5913944 - DNA, 17 bp, Homo sapiens
gctcctccagtacaata

SEQ ID NO: 5913945 - DNA, 11 bp, Homo sapiens
gctcctcccag

SEQ ID NO: 5913946 - DNA, 19 bp, Homo sapiens
gctcctcccagcacaggca

SEQ ID NO: 5913947 - DNA, 13 bp, Homo sapiens
gctcctcccagct

SEQ ID NO: 5913948 - DNA, 16 bp, Homo sapiens
gctcctcccagctgta

SEQ ID NO: 5913949 - DNA, 15 bp, Homo sapiens
gctcctcccattccc

SEQ ID NO: 5913950 - DNA, 15 bp, Homo sapiens
gctcctcccctgccg

SEQ ID NO: 5913951 - DNA, 19 bp, Homo sapiens
gctcctcccctgccgcctc

SEQ ID NO: 5913952 - DNA, 23 bp, Homo sapiens
gctcctccccttcctcttgtctg

SEQ ID NO: 5913953 - DNA, 14 bp, Homo sapiens
gctcctccctccag

SEQ ID NO: 5913954 - DNA, 14 bp, Homo sapiens
gctcctccctctca

SEQ ID NO: 5913955 - DNA, 15 bp, Homo sapiens
gctcctccctctgac

SEQ ID NO: 5913956 - DNA, 17 bp, Homo sapiens
gctcctccctctgaggc

SEQ ID NO: 5913957 - DNA, 20 bp, Homo sapiens
gctcctccctctgaggctgt

SEQ ID NO: 5913958 - DNA, 14 bp, Homo sapiens
gctcctccctctgc

SEQ ID NO: 5913959 - DNA, 17 bp, Homo sapiens
gctcctccctctgcctc

SEQ ID NO: 5913960 - DNA, 20 bp, Homo sapiens
gctcctccctctgcctcatc

SEQ ID NO: 5913961 - DNA, 23 bp, Homo sapiens
gctcctccctctgcctcatcctc

SEQ ID NO: 5913962 - DNA, 11 bp, Homo sapiens
gctcctccctg

SEQ ID NO: 5913963 - DNA, 12 bp, Homo sapiens
gctcctccctgc

SEQ ID NO: 5913964 - DNA, 14 bp, Homo sapiens
gctcctccctgccc

SEQ ID NO: 5913965 - DNA, 18 bp, Homo sapiens
gctcctccctgcccccca

SEQ ID NO: 5913966 - DNA, 13 bp, Homo sapiens
gctcctccctgct

SEQ ID NO: 5913967 - DNA, 19 bp, Homo sapiens
gctcctccctgctcctcat

SEQ ID NO: 5913968 - DNA, 13 bp, Homo sapiens
gctcctccctgga

SEQ ID NO: 5913969 - DNA, 15 bp, Homo sapiens
gctcctccctggagc

SEQ ID NO: 5913970 - DNA, 14 bp, Homo sapiens
gctcctccctggct

SEQ ID NO: 5913971 - DNA, 21 bp, Homo sapiens
gctcctccctggctgccctgg

SEQ ID NO: 5913972 - DNA, 13 bp, Homo sapiens
gctcctccctgtg

SEQ ID NO: 5913973 - DNA, 16 bp, Homo sapiens
gctcctccgcagaagg

SEQ ID NO: 5913974 - DNA, 15 bp, Homo sapiens
gctcctccgggtctg

SEQ ID NO: 5913975 - DNA, 20 bp, Homo sapiens
gctcctccgtgcttcctcag

SEQ ID NO: 5913976 - DNA, 14 bp, Homo sapiens
gctcctcctaggaa

SEQ ID NO: 5913977 - DNA, 14 bp, Homo sapiens
gctctagtgggaca

SEQ ID NO: 5913978 - DNA, 19 bp, Homo sapiens
gctctagttttcagccttg

SEQ ID NO: 5913979 - DNA, 19 bp, Homo sapiens
gctctatcgcccaggctgg

SEQ ID NO: 5913980 - DNA, 14 bp, Homo sapiens
gctctatctctcaa

SEQ ID NO: 5913981 - DNA, 12 bp, Homo sapiens
gctctatctgca

SEQ ID NO: 5913982 - DNA, 21 bp, Homo sapiens
gctctatcttgctctgtaatc

SEQ ID NO: 5913983 - DNA, 18 bp, Homo sapiens
gctctatgagtctagatg

SEQ ID NO: 5913984 - DNA, 14 bp, Homo sapiens
gctctatgccaggc

SEQ ID NO: 5913985 - DNA, 16 bp, Homo sapiens
gctctatgcctgcact

SEQ ID NO: 5913986 - DNA, 18 bp, Homo sapiens
gctctatgggcagatcta

SEQ ID NO: 5913987 - DNA, 14 bp, Homo sapiens
gctctatgtctgcc

SEQ ID NO: 5913988 - DNA, 20 bp, Homo sapiens
gctctatgttagtataagct

SEQ ID NO: 5913989 - DNA, 15 bp, Homo sapiens
gctctatgtttacaa

SEQ ID NO: 5913990 - DNA, 14 bp, Homo sapiens
gctctatgtttgta

SEQ ID NO: 5913991 - DNA, 18 bp, Homo sapiens
gctctattatgaatgtga

SEQ ID NO: 5913992 - DNA, 21 bp, Homo sapiens
gctctattatgaatgtgaagc

SEQ ID NO: 5913993 - DNA, 15 bp, Homo sapiens
gctctattctctaaa

SEQ ID NO: 5913994 - DNA, 16 bp, Homo sapiens
gctctattgagccaag

SEQ ID NO: 5913995 - DNA, 20 bp, Homo sapiens
gctctattgagccaagacca

SEQ ID NO: 5913996 - DNA, 13 bp, Homo sapiens
gctctatttactt

SEQ ID NO: 5913997 - DNA, 19 bp, Homo sapiens
gctctatttccccacccca

SEQ ID NO: 5913998 - DNA, 16 bp, Homo sapiens
gctctcaaatccctct

SEQ ID NO: 5913999 - DNA, 14 bp, Homo sapiens
gctctcaaatgtga

SEQ ID NO: 5914000 - DNA, 21 bp, Homo sapiens
gctctcaaggcttggagaggt

SEQ ID NO: 5914001 - DNA, 13 bp, Homo sapiens
gctctcaatttta

SEQ ID NO: 5914002 - DNA, 21 bp, Homo sapiens
gctctcacccagtccccaccc

SEQ ID NO: 5914003 - DNA, 22 bp, Homo sapiens
gctctcacccagtccccacccg

SEQ ID NO: 5914004 - DNA, 14 bp, Homo sapiens
gctctcacccccat

SEQ ID NO: 5914005 - DNA, 18 bp, Homo sapiens
gctctcacccccatccct

SEQ ID NO: 5914006 - DNA, 14 bp, Homo sapiens
gctctcactggcca

SEQ ID NO: 5914007 - DNA, 15 bp, Homo sapiens
gctctcagagcagca

SEQ ID NO: 5914008 - DNA, 13 bp, Homo sapiens
gctctcagcaagt

SEQ ID NO: 5914009 - DNA, 14 bp, Homo sapiens
gctctcagcctccc

SEQ ID NO: 5914010 - DNA, 16 bp, Homo sapiens
gctctcagcctcccac

SEQ ID NO: 5914011 - DNA, 18 bp, Homo sapiens
gctctcagcctcccacaa

SEQ ID NO: 5914012 - DNA, 16 bp, Homo sapiens
gctctcagctcagcgc

SEQ ID NO: 5914013 - DNA, 13 bp, Homo sapiens
gctctcagcttgt

SEQ ID NO: 5914014 - DNA, 16 bp, Homo sapiens
gctctcagcttgtgcc

SEQ ID NO: 5914015 - DNA, 16 bp, Homo sapiens
gctctcagctttccct

SEQ ID NO: 5914016 - DNA, 15 bp, Homo sapiens
gctctcaggccagct

SEQ ID NO: 5914017 - DNA, 17 bp, Homo sapiens
gctctcaggccagctgc

SEQ ID NO: 5914018 - DNA, 13 bp, Homo sapiens
gctctcaggccga

SEQ ID NO: 5914019 - DNA, 20 bp, Homo sapiens
gctctcaggccgagagcctt

SEQ ID NO: 5914020 - DNA, 20 bp, Homo sapiens
gctctcagggaaagcctctg

SEQ ID NO: 5914021 - DNA, 12 bp, Homo sapiens
gctctcagggct

SEQ ID NO: 5914022 - DNA, 12 bp, Homo sapiens
gctctcagttct

SEQ ID NO: 5914023 - DNA, 16 bp, Homo sapiens
gctctcatccattcct

SEQ ID NO: 5914024 - DNA, 17 bp, Homo sapiens
gctctcatgaagccctt

SEQ ID NO: 5914025 - DNA, 18 bp, Homo sapiens
gctctcatgaagccctta

SEQ ID NO: 5914026 - DNA, 17 bp, Homo sapiens
gctctcatgctgcccct

SEQ ID NO: 5914027 - DNA, 16 bp, Homo sapiens
gctctccaaaccactt

SEQ ID NO: 5914028 - DNA, 16 bp, Homo sapiens
gctctccaaaggggct

SEQ ID NO: 5914029 - DNA, 15 bp, Homo sapiens
gctctccaagcccag

SEQ ID NO: 5914030 - DNA, 17 bp, Homo sapiens
gctctccaagtgccaga

SEQ ID NO: 5914031 - DNA, 15 bp, Homo sapiens
gctctccacctcagc

SEQ ID NO: 5914032 - DNA, 18 bp, Homo sapiens
gctctccacctcagcctt

SEQ ID NO: 5914033 - DNA, 21 bp, Homo sapiens
gctctccacctcagccttgga

SEQ ID NO: 5914034 - DNA, 13 bp, Homo sapiens
gctctccaccttg

SEQ ID NO: 5914035 - DNA, 17 bp, Homo sapiens
gctctccagcctgggag

SEQ ID NO: 5914036 - DNA, 14 bp, Homo sapiens
gctctccaggccag

SEQ ID NO: 5914037 - DNA, 16 bp, Homo sapiens
gctctccaggccaggt

SEQ ID NO: 5914038 - DNA, 18 bp, Homo sapiens
gctctccaggccaggtgg

SEQ ID NO: 5914039 - DNA, 20 bp, Homo sapiens
gctctccagtcaggaggcat

SEQ ID NO: 5914040 - DNA, 22 bp, Homo sapiens
gctctccatcataggctgacac

SEQ ID NO: 5914041 - DNA, 19 bp, Homo sapiens
gctctccattcaatttcag

SEQ ID NO: 5914042 - DNA, 14 bp, Homo sapiens
gctctccattctgc

SEQ ID NO: 5914043 - DNA, 18 bp, Homo sapiens
gctctccattctgctcct

SEQ ID NO: 5914044 - DNA, 11 bp, Homo sapiens
gctctcccacc

SEQ ID NO: 5914045 - DNA, 12 bp, Homo sapiens
gctctcccaggt

SEQ ID NO: 5914046 - DNA, 14 bp, Homo sapiens
gctctcccagtgaa

SEQ ID NO: 5914047 - DNA, 22 bp, Homo sapiens
gctctcccagtgaactcctgcc

SEQ ID NO: 5914048 - DNA, 13 bp, Homo sapiens
gctctccccctgc

SEQ ID NO: 5914049 - DNA, 17 bp, Homo sapiens
gctctcccctcctgctg

SEQ ID NO: 5914050 - DNA, 20 bp, Homo sapiens
gctctcccggttcttccagt

SEQ ID NO: 5914051 - DNA, 22 bp, Homo sapiens
gctctccctaccttgcctcctt

SEQ ID NO: 5914052 - DNA, 23 bp, Homo sapiens
gctctccctctggccctgccttc

SEQ ID NO: 5914053 - DNA, 17 bp, Homo sapiens
gctctccgccccccggc

SEQ ID NO: 5914054 - DNA, 13 bp, Homo sapiens
gctctccgtgcag

SEQ ID NO: 5914055 - DNA, 20 bp, Homo sapiens
gctctcctccagccctgggc

SEQ ID NO: 5914056 - DNA, 14 bp, Homo sapiens
gctctcctcctcca

SEQ ID NO: 5914057 - DNA, 19 bp, Homo sapiens
gctctcctcgagccctccc

SEQ ID NO: 5914058 - DNA, 22 bp, Homo sapiens
gctctcctcttgccactgcctc

SEQ ID NO: 5914059 - DNA, 19 bp, Homo sapiens
gctctcctgacagccacac

SEQ ID NO: 5914060 - DNA, 16 bp, Homo sapiens
gctctcctgactttta

SEQ ID NO: 5914061 - DNA, 22 bp, Homo sapiens
gctctcctgagaggtgctgcag

SEQ ID NO: 5914062 - DNA, 20 bp, Homo sapiens
gctctcctgcctacatccca

SEQ ID NO: 5914063 - DNA, 11 bp, Homo sapiens
gctctcctgga

SEQ ID NO: 5914064 - DNA, 14 bp, Homo sapiens
gctctcctggacgc

SEQ ID NO: 5914065 - DNA, 22 bp, Homo sapiens
gctctcctggacgcccccgccc

SEQ ID NO: 5914066 - DNA, 16 bp, Homo sapiens
gctctcctggagcaag

SEQ ID NO: 5914067 - DNA, 19 bp, Homo sapiens
gctctcctggagcaagctc

SEQ ID NO: 5914068 - DNA, 15 bp, Homo sapiens
gctctcctggctccc

SEQ ID NO: 5914069 - DNA, 18 bp, Homo sapiens
gctctcctggctccctcc

SEQ ID NO: 5914070 - DNA, 13 bp, Homo sapiens
gctctcctggctt

SEQ ID NO: 5914071 - DNA, 17 bp, Homo sapiens
gctctcctggcttccca

SEQ ID NO: 5914072 - DNA, 19 bp, Homo sapiens
gctctcctgggccagggtc

SEQ ID NO: 5914073 - DNA, 12 bp, Homo sapiens
gctctcctgggg

SEQ ID NO: 5914074 - DNA, 11 bp, Homo sapiens
gctctccttcc

SEQ ID NO: 5914075 - DNA, 12 bp, Homo sapiens
gctctccttcct

SEQ ID NO: 5914076 - DNA, 22 bp, Homo sapiens
gctctccttcctggagcccaga

SEQ ID NO: 5914077 - DNA, 19 bp, Homo sapiens
gctctccttgccctgggcc

SEQ ID NO: 5914078 - DNA, 20 bp, Homo sapiens
gctctccttgccctgggcca

SEQ ID NO: 5914079 - DNA, 22 bp, Homo sapiens
gctctcgaccggccctgcattc

SEQ ID NO: 5914080 - DNA, 16 bp, Homo sapiens
gctctcgcggcctctt

SEQ ID NO: 5914081 - DNA, 21 bp, Homo sapiens
gctctcggaactgcatgctgc

SEQ ID NO: 5914082 - DNA, 19 bp, Homo sapiens
gctctcgggttgtgtgtct

SEQ ID NO: 5914083 - DNA, 15 bp, Homo sapiens
gctctcgtctctcgt

SEQ ID NO: 5914084 - DNA, 17 bp, Homo sapiens
gctctcgttctccttcc

SEQ ID NO: 5914085 - DNA, 16 bp, Homo sapiens
gctctctaagaattca

SEQ ID NO: 5914086 - DNA, 13 bp, Homo sapiens
gctctctacccag

SEQ ID NO: 5914087 - DNA, 18 bp, Homo sapiens
gctctctattccctcagc

SEQ ID NO: 5914088 - DNA, 22 bp, Homo sapiens
gctctctcacctgctcccagtc

SEQ ID NO: 5914089 - DNA, 23 bp, Homo sapiens
gctctctcagacccttgaagatg

SEQ ID NO: 5914090 - DNA, 13 bp, Homo sapiens
gctctctcatgtg

SEQ ID NO: 5914091 - DNA, 20 bp, Homo sapiens
gctctctcattcccaggcac

SEQ ID NO: 5914092 - DNA, 19 bp, Homo sapiens
gctctctcattgtctgtgt

SEQ ID NO: 5914093 - DNA, 20 bp, Homo sapiens
gctctctccactaccccaca

SEQ ID NO: 5914094 - DNA, 12 bp, Homo sapiens
gctctctccagg

SEQ ID NO: 5914095 - DNA, 14 bp, Homo sapiens
gctctctctagaat

SEQ ID NO: 5914096 - DNA, 18 bp, Homo sapiens
gctctctctagctcccca

SEQ ID NO: 5914097 - DNA, 14 bp, Homo sapiens
gctctctctcctgg

SEQ ID NO: 5914098 - DNA, 16 bp, Homo sapiens
gctctctcttcttatt

SEQ ID NO: 5914099 - DNA, 17 bp, Homo sapiens
gctctctgaggcaaggc

SEQ ID NO: 5914100 - DNA, 21 bp, Homo sapiens
gctctctgagtcctggcccaa

SEQ ID NO: 5914101 - DNA, 16 bp, Homo sapiens
gctctctgctcatggg

SEQ ID NO: 5914102 - DNA, 11 bp, Homo sapiens
gctctctggcc

SEQ ID NO: 5914103 - DNA, 18 bp, Homo sapiens
gctctctggccttttcct

SEQ ID NO: 5914104 - DNA, 23 bp, Homo sapiens
gctctctgtataaacattaaatg

SEQ ID NO: 5914105 - DNA, 13 bp, Homo sapiens
gctctctgtctgg

SEQ ID NO: 5914106 - DNA, 16 bp, Homo sapiens
gctctcttaaatgaag

SEQ ID NO: 5914107 - DNA, 15 bp, Homo sapiens
gctctcttcaataaa

SEQ ID NO: 5914108 - DNA, 16 bp, Homo sapiens
gctctcttcaataaac

SEQ ID NO: 5914109 - DNA, 12 bp, Homo sapiens
gctctcttcagg

SEQ ID NO: 5914110 - DNA, 16 bp, Homo sapiens
gctctcttcaggaggc

SEQ ID NO: 5914111 - DNA, 22 bp, Homo sapiens
gctctcttcaggaggccctggt

SEQ ID NO: 5914112 - DNA, 12 bp, Homo sapiens
gctctcttcctg

SEQ ID NO: 5914113 - DNA, 18 bp, Homo sapiens
gctctcttcctgcccctc

SEQ ID NO: 5914114 - DNA, 22 bp, Homo sapiens
gctctcttcctgcccctctttc

SEQ ID NO: 5914115 - DNA, 16 bp, Homo sapiens
gctctcttcctgtctt

SEQ ID NO: 5914116 - DNA, 14 bp, Homo sapiens
gctctcttctggct

SEQ ID NO: 5914117 - DNA, 14 bp, Homo sapiens
gctctcttcttact

SEQ ID NO: 5914118 - DNA, 21 bp, Homo sapiens
gctctcttgtgacgtgcactg

SEQ ID NO: 5914119 - DNA, 23 bp, Homo sapiens
gctctcttgtgacgtgcactgtg

SEQ ID NO: 5914120 - DNA, 14 bp, Homo sapiens
gctctctttgcaac

SEQ ID NO: 5914121 - DNA, 14 bp, Homo sapiens
gctctgaaaacaag

SEQ ID NO: 5914122 - DNA, 17 bp, Homo sapiens
gctctgaaagagaaaca

SEQ ID NO: 5914123 - DNA, 15 bp, Homo sapiens
gctctgaaagccagc

SEQ ID NO: 5914124 - DNA, 16 bp, Homo sapiens
gctctgaaagctgctt

SEQ ID NO: 5914125 - DNA, 21 bp, Homo sapiens
gctctgaacttccaagctcca

SEQ ID NO: 5914126 - DNA, 19 bp, Homo sapiens
gctctgaagcaaggcggtg

SEQ ID NO: 5914127 - DNA, 18 bp, Homo sapiens
gctctgaagggaggggaa

SEQ ID NO: 5914128 - DNA, 22 bp, Homo sapiens
gctctgaatagttaaaaattaa

SEQ ID NO: 5914129 - DNA, 17 bp, Homo sapiens
gctctgaatattttgta

SEQ ID NO: 5914130 - DNA, 23 bp, Homo sapiens
gctctgaatctctcaaaatgtgc

SEQ ID NO: 5914131 - DNA, 18 bp, Homo sapiens
gctctgaatgtagccagc

SEQ ID NO: 5914132 - DNA, 21 bp, Homo sapiens
gctctgaattagtccttgctt

SEQ ID NO: 5914133 - DNA, 14 bp, Homo sapiens
gctctgacaagatg

SEQ ID NO: 5914134 - DNA, 16 bp, Homo sapiens
gctctgacaagatggt

SEQ ID NO: 5914135 - DNA, 20 bp, Homo sapiens
gctctgacagaaagcagata

SEQ ID NO: 5914136 - DNA, 21 bp, Homo sapiens
gctctgaccacttgaggcctg

SEQ ID NO: 5914137 - DNA, 21 bp, Homo sapiens
gctctgacccacagcctccaa

SEQ ID NO: 5914138 - DNA, 15 bp, Homo sapiens
gctctgacccagtga

SEQ ID NO: 5914139 - DNA, 14 bp, Homo sapiens
gctctgaccctggg

SEQ ID NO: 5914140 - DNA, 12 bp, Homo sapiens
gctctgacctgc

SEQ ID NO: 5914141 - DNA, 18 bp, Homo sapiens
gctctgacctgcccccgc

SEQ ID NO: 5914142 - DNA, 19 bp, Homo sapiens
gctctgaccttccagagcc

SEQ ID NO: 5914143 - DNA, 15 bp, Homo sapiens
gctctgacgtagaaa

SEQ ID NO: 5914144 - DNA, 9 bp, Homo sapiens
gctctgaga

SEQ ID NO: 5914145 - DNA, 11 bp, Homo sapiens
gctctgagaac

SEQ ID NO: 5914146 - DNA, 14 bp, Homo sapiens
gctctgagaatcac

SEQ ID NO: 5914147 - DNA, 20 bp, Homo sapiens
gctctgagacggatggaagg

SEQ ID NO: 5914148 - DNA, 21 bp, Homo sapiens
gctctgagacggatggaagga

SEQ ID NO: 5914149 - DNA, 23 bp, Homo sapiens
gctctgagacggatggaaggaga

SEQ ID NO: 5914150 - DNA, 17 bp, Homo sapiens
gctctgagagccccagg

SEQ ID NO: 5914151 - DNA, 15 bp, Homo sapiens
gctctgagaggccct

SEQ ID NO: 5914152 - DNA, 17 bp, Homo sapiens
gctctgagaggccctgg

SEQ ID NO: 5914153 - DNA, 13 bp, Homo sapiens
gctctgagagtct

SEQ ID NO: 5914154 - DNA, 17 bp, Homo sapiens
gctctgagatcctggag

SEQ ID NO: 5914155 - DNA, 21 bp, Homo sapiens
gctctgagcaaatgtggctcc

SEQ ID NO: 5914156 - DNA, 15 bp, Homo sapiens
gctctgagcacaggt

SEQ ID NO: 5914157 - DNA, 18 bp, Homo sapiens
gctcttggaagagctctt

SEQ ID NO: 5914158 - DNA, 17 bp, Homo sapiens
gctcttggcaggagtgg

SEQ ID NO: 5914159 - DNA, 13 bp, Homo sapiens
gctcttggctgac

SEQ ID NO: 5914160 - DNA, 17 bp, Homo sapiens
gctcttggctgacccct

SEQ ID NO: 5914161 - DNA, 14 bp, Homo sapiens
gctcttggctggac

SEQ ID NO: 5914162 - DNA, 20 bp, Homo sapiens
gctcttggctggacccagcc

SEQ ID NO: 5914163 - DNA, 23 bp, Homo sapiens
gctcttggctggacccagccagg

SEQ ID NO: 5914164 - DNA, 16 bp, Homo sapiens
gctcttggcttccaga

SEQ ID NO: 5914165 - DNA, 13 bp, Homo sapiens
gctcttgggacaa

SEQ ID NO: 5914166 - DNA, 12 bp, Homo sapiens
gctcttgggcct

SEQ ID NO: 5914167 - DNA, 14 bp, Homo sapiens
gctcttgggcctga

SEQ ID NO: 5914168 - DNA, 21 bp, Homo sapiens
gctcttgggcctgacctccag

SEQ ID NO: 5914169 - DNA, 14 bp, Homo sapiens
gctcttggggaagg

SEQ ID NO: 5914170 - DNA, 15 bp, Homo sapiens
gctcttggtccctgg

SEQ ID NO: 5914171 - DNA, 18 bp, Homo sapiens
gctcttggtgggcccagg

SEQ ID NO: 5914172 - DNA, 16 bp, Homo sapiens
gctcttgtgaggaaag

SEQ ID NO: 5914173 - DNA, 19 bp, Homo sapiens
gctcttgtgttcagaagaa

SEQ ID NO: 5914174 - DNA, 20 bp, Homo sapiens
gctcttgtttcactccacca

SEQ ID NO: 5914175 - DNA, 11 bp, Homo sapiens
gctctttaaat

SEQ ID NO: 5914176 - DNA, 12 bp, Homo sapiens
gctctttaaata

SEQ ID NO: 5914177 - DNA, 21 bp, Homo sapiens
gctctttaatttgttgtagat

SEQ ID NO: 5914178 - DNA, 22 bp, Homo sapiens
gctctttacatttcttttaaaa

SEQ ID NO: 5914179 - DNA, 21 bp, Homo sapiens
gctctttatgaatgaaaaaac

SEQ ID NO: 5914180 - DNA, 18 bp, Homo sapiens
gctctttcaccctgccac

SEQ ID NO: 5914181 - DNA, 21 bp, Homo sapiens
gctctttcacctgggtgtctg

SEQ ID NO: 5914182 - DNA, 14 bp, Homo sapiens
gctctttcagagag

SEQ ID NO: 5914183 - DNA, 13 bp, Homo sapiens
gctctttccaaat

SEQ ID NO: 5914184 - DNA, 13 bp, Homo sapiens
gctctttcccagg

SEQ ID NO: 5914185 - DNA, 14 bp, Homo sapiens
gctctttcccagga

SEQ ID NO: 5914186 - DNA, 12 bp, Homo sapiens
gctctttccctt

SEQ ID NO: 5914187 - DNA, 17 bp, Homo sapiens
gctctttcccttttctg

SEQ ID NO: 5914188 - DNA, 22 bp, Homo sapiens
gctctttcccttttctgtttag

SEQ ID NO: 5914189 - DNA, 23 bp, Homo sapiens
gctctttcccttttctgtttagg

SEQ ID NO: 5914190 - DNA, 13 bp, Homo sapiens
gctctttcctgcc

SEQ ID NO: 5914191 - DNA, 22 bp, Homo sapiens
gctctttcctgcccttttcctg

SEQ ID NO: 5914192 - DNA, 18 bp, Homo sapiens
gctctttcctgtcttcct

SEQ ID NO: 5914193 - DNA, 15 bp, Homo sapiens
gctctttccttgctc

SEQ ID NO: 5914194 - DNA, 17 bp, Homo sapiens
gctctttcgtcaccctt

SEQ ID NO: 5914195 - DNA, 19 bp, Homo sapiens
gctctttctacatgactgg

SEQ ID NO: 5914196 - DNA, 17 bp, Homo sapiens
gctctttctactctgaa

SEQ ID NO: 5914197 - DNA, 12 bp, Homo sapiens
gctctttctctg

SEQ ID NO: 5914198 - DNA, 18 bp, Homo sapiens
gctctttctctgccagtg

SEQ ID NO: 5914199 - DNA, 13 bp, Homo sapiens
gctctttctgggc

SEQ ID NO: 5914200 - DNA, 10 bp, Homo sapiens
gctctttctt

SEQ ID NO: 5914201 - DNA, 23 bp, Homo sapiens
gctctttgaaatagtctgtgtga

SEQ ID NO: 5914202 - DNA, 19 bp, Homo sapiens
gctctttgacaactaaaat

SEQ ID NO: 5914203 - DNA, 12 bp, Homo sapiens
gctctttgagaa

SEQ ID NO: 5914204 - DNA, 14 bp, Homo sapiens
gctctttggagatc

SEQ ID NO: 5914205 - DNA, 24 bp, Homo sapiens
gctctttggcctgatgaccaattt

SEQ ID NO: 5914206 - DNA, 18 bp, Homo sapiens
gctctttggggtcagcca

SEQ ID NO: 5914207 - DNA, 15 bp, Homo sapiens
gctctttgtcaggga

SEQ ID NO: 5914208 - DNA, 18 bp, Homo sapiens
gctctttgtcagggagtg

SEQ ID NO: 5914209 - DNA, 12 bp, Homo sapiens
gctcttttacta

SEQ ID NO: 5914210 - DNA, 20 bp, Homo sapiens
gctcttttactgggttctta

SEQ ID NO: 5914211 - DNA, 19 bp, Homo sapiens
gctcttttagggtaagaag

SEQ ID NO: 5914212 - DNA, 16 bp, Homo sapiens
gctcttttaggtaact

SEQ ID NO: 5914213 - DNA, 12 bp, Homo sapiens
gctcttttccta

SEQ ID NO: 5914214 - DNA, 19 bp, Homo sapiens
gctcttttcctggtgctct

SEQ ID NO: 5914215 - DNA, 17 bp, Homo sapiens
gctcttttgcacaagga

SEQ ID NO: 5914216 - DNA, 19 bp, Homo sapiens
gctctttttagctggcttt

SEQ ID NO: 5914217 - DNA, 14 bp, Homo sapiens
gctcttttttactc

SEQ ID NO: 5914218 - DNA, 17 bp, Homo sapiens
gctcttttttactcatt

SEQ ID NO: 5914219 - DNA, 21 bp, Homo sapiens
gctcttttttactcattgaaa

SEQ ID NO: 5914220 - DNA, 14 bp, Homo sapiens
gctgaaaaaaaatt

SEQ ID NO: 5914221 - DNA, 13 bp, Homo sapiens
gctgaaaaagaaa

SEQ ID NO: 5914222 - DNA, 15 bp, Homo sapiens
gctgaaaaagaaaaa

SEQ ID NO: 5914223 - DNA, 22 bp, Homo sapiens
gctgaaaaccatctggcctggc

SEQ ID NO: 5914224 - DNA, 14 bp, Homo sapiens
gctgaaaatgcaaa

SEQ ID NO: 5914225 - DNA, 21 bp, Homo sapiens
gctgaaaatgcaaagctgaag

SEQ ID NO: 5914226 - DNA, 13 bp, Homo sapiens
gctgaaaatgtgt

SEQ ID NO: 5914227 - DNA, 18 bp, Homo sapiens
gctgaaacacctcccagg

SEQ ID NO: 5914228 - DNA, 17 bp, Homo sapiens
gctgaaacaggagagaa

SEQ ID NO: 5914229 - DNA, 20 bp, Homo sapiens
gctgaaacattccgaagagg

SEQ ID NO: 5914230 - DNA, 23 bp, Homo sapiens
gctgaaagaacatggacttgtat

SEQ ID NO: 5914231 - DNA, 14 bp, Homo sapiens
gctgaaagagaaaa

SEQ ID NO: 5914232 - DNA, 14 bp, Homo sapiens
gctgaaagaggagg

SEQ ID NO: 5914233 - DNA, 13 bp, Homo sapiens
gctgaaagccatt

SEQ ID NO: 5914234 - DNA, 19 bp, Homo sapiens
gctgaaagtcctgctttcc

SEQ ID NO: 5914235 - DNA, 13 bp, Homo sapiens
gctgaaagttctt

SEQ ID NO: 5914236 - DNA, 13 bp, Homo sapiens
gctgaaataaact

SEQ ID NO: 5914237 - DNA, 19 bp, Homo sapiens
gctgaaatatccacccagc

SEQ ID NO: 5914238 - DNA, 16 bp, Homo sapiens
gctgaaatgctgcatt

SEQ ID NO: 5914239 - DNA, 19 bp, Homo sapiens
gctgaaattcaccaagaac

SEQ ID NO: 5914240 - DNA, 20 bp, Homo sapiens
gctgaaattcaccaagaaca

SEQ ID NO: 5914241 - DNA, 17 bp, Homo sapiens
gctgaaattccagttta

SEQ ID NO: 5914242 - DNA, 14 bp, Homo sapiens
gctgaaattctcct

SEQ ID NO: 5914243 - DNA, 15 bp, Homo sapiens
gctgaaattctcctg

SEQ ID NO: 5914244 - DNA, 11 bp, Homo sapiens
gctgaaattga

SEQ ID NO: 5914245 - DNA, 17 bp, Homo sapiens
gctgaaattgaaaagtt

SEQ ID NO: 5914246 - DNA, 21 bp, Homo sapiens
gctgaaattgcttatttttgg

SEQ ID NO: 5914247 - DNA, 23 bp, Homo sapiens
gctgaaattgggtggaggaccgt

SEQ ID NO: 5914248 - DNA, 13 bp, Homo sapiens
gctgaaatttacc

SEQ ID NO: 5914249 - DNA, 19 bp, Homo sapiens
gctgaaattttagaaatat

SEQ ID NO: 5914250 - DNA, 17 bp, Homo sapiens
gctgaaattttatatgc

SEQ ID NO: 5914251 - DNA, 19 bp, Homo sapiens
gctgaacacatttcttttt

SEQ ID NO: 5914252 - DNA, 22 bp, Homo sapiens
gctgaacacatttgcccaattc

SEQ ID NO: 5914253 - DNA, 23 bp, Homo sapiens
gctgaacaggaaagagctaggaa

SEQ ID NO: 5914254 - DNA, 19 bp, Homo sapiens
gctgaacatgcctgccaaa

SEQ ID NO: 5914255 - DNA, 20 bp, Homo sapiens
gctgaacatgcctgccaaag

SEQ ID NO: 5914256 - DNA, 20 bp, Homo sapiens
gctgaaccaaagcctcttca

SEQ ID NO: 5914257 - DNA, 13 bp, Homo sapiens
gctgaaccacaga

SEQ ID NO: 5914258 - DNA, 15 bp, Homo sapiens
gctgaaccacagaaa

SEQ ID NO: 5914259 - DNA, 14 bp, Homo sapiens
gctgaacccacccg

SEQ ID NO: 5914260 - DNA, 15 bp, Homo sapiens
gctgaactccttgtt

SEQ ID NO: 5914261 - DNA, 19 bp, Homo sapiens
gctgaactcttcagaacac

SEQ ID NO: 5914262 - DNA, 18 bp, Homo sapiens
gctgaactgacaatgaag

SEQ ID NO: 5914263 - DNA, 16 bp, Homo sapiens
gctgaactgagaaggc

SEQ ID NO: 5914264 - DNA, 22 bp, Homo sapiens
gctgaactgagaaggcaggcct

SEQ ID NO: 5914265 - DNA, 17 bp, Homo sapiens
gctgaactgagcctagc

SEQ ID NO: 5914266 - DNA, 20 bp, Homo sapiens
gctgaacttgttttctggga

SEQ ID NO: 5914267 - DNA, 18 bp, Homo sapiens
gctgaagaaacacagcat

SEQ ID NO: 5914268 - DNA, 16 bp, Homo sapiens
gctgaagaatgaagac

SEQ ID NO: 5914269 - DNA, 18 bp, Homo sapiens
gctgaagacaaaccactg

SEQ ID NO: 5914270 - DNA, 15 bp, Homo sapiens
gctgaagacattcaa

SEQ ID NO: 5914271 - DNA, 22 bp, Homo sapiens
gctgaagacattcaaaacgtga

SEQ ID NO: 5914272 - DNA, 19 bp, Homo sapiens
gctgaagaccatggatttc

SEQ ID NO: 5914273 - DNA, 17 bp, Homo sapiens
gctgaagagagggacag

SEQ ID NO: 5914274 - DNA, 21 bp, Homo sapiens
gctgaagaggcaagagacaga

SEQ ID NO: 5914275 - DNA, 15 bp, Homo sapiens
gctgaagatccccaa

SEQ ID NO: 5914276 - DNA, 20 bp, Homo sapiens
gctgaagatccccattcttt

SEQ ID NO: 5914277 - DNA, 18 bp, Homo sapiens
gctgaagatgaatcaatg

SEQ ID NO: 5914278 - DNA, 15 bp, Homo sapiens
gctgaagatgccttg

SEQ ID NO: 5914279 - DNA, 17 bp, Homo sapiens
gctgaagcaaagtgccc

SEQ ID NO: 5914280 - DNA, 22 bp, Homo sapiens
gctgaagccacacagcccagaa

SEQ ID NO: 5914281 - DNA, 14 bp, Homo sapiens
gctgaagcccccct

SEQ ID NO: 5914282 - DNA, 20 bp, Homo sapiens
gctgaagcctatttatttga

SEQ ID NO: 5914283 - DNA, 21 bp, Homo sapiens
gctgaagcctatttatttgaa

SEQ ID NO: 5914284 - DNA, 16 bp, Homo sapiens
gctgaagctgcctgct

SEQ ID NO: 5914285 - DNA, 14 bp, Homo sapiens
gctgaagctgctgc

SEQ ID NO: 5914286 - DNA, 15 bp, Homo sapiens
gctgaagctgctgca

SEQ ID NO: 5914287 - DNA, 17 bp, Homo sapiens
gctgaagctgctgcagc

SEQ ID NO: 5914288 - DNA, 22 bp, Homo sapiens
gctgaagcttattaatgctaag

SEQ ID NO: 5914289 - DNA, 17 bp, Homo sapiens
gctgaaggagaaaaaga

SEQ ID NO: 5914290 - DNA, 21 bp, Homo sapiens
gctgaaggattatatgtatta

SEQ ID NO: 5914291 - DNA, 15 bp, Homo sapiens
gctgaaggcagtggc

SEQ ID NO: 5914292 - DNA, 23 bp, Homo sapiens
gctgaaggctcgagcatgcctgg

SEQ ID NO: 5914293 - DNA, 13 bp, Homo sapiens
gctgaagggggca

SEQ ID NO: 5914294 - DNA, 22 bp, Homo sapiens
gctgaagggtaatatggactca

SEQ ID NO: 5914295 - DNA, 15 bp, Homo sapiens
gctgaaggttgaaga

SEQ ID NO: 5914296 - DNA, 16 bp, Homo sapiens
gctgaaggttgaagag

SEQ ID NO: 5914297 - DNA, 17 bp, Homo sapiens
gctgaaggttgtggcct

SEQ ID NO: 5914298 - DNA, 20 bp, Homo sapiens
gctgaaggttgtggcctttg

SEQ ID NO: 5914299 - DNA, 23 bp, Homo sapiens
gctgaagtagaggggacgtgaga

SEQ ID NO: 5914300 - DNA, 22 bp, Homo sapiens
gctgaagtctccccgcagccct

SEQ ID NO: 5914301 - DNA, 18 bp, Homo sapiens
gctgaagtctctttttct

SEQ ID NO: 5914302 - DNA, 20 bp, Homo sapiens
gctgaagtctctttttcttc

SEQ ID NO: 5914303 - DNA, 14 bp, Homo sapiens
gctgaagttggcca

SEQ ID NO: 5914304 - DNA, 21 bp, Homo sapiens
gctgaataacctgcacaggct

SEQ ID NO: 5914305 - DNA, 23 bp, Homo sapiens
gctgaatagagggagtagaaagc

SEQ ID NO: 5914306 - DNA, 16 bp, Homo sapiens
gctgaatagcttctcc

SEQ ID NO: 5914307 - DNA, 14 bp, Homo sapiens
gctgaatatctgtt

SEQ ID NO: 5914308 - DNA, 15 bp, Homo sapiens
gctgaatcaaagaca

SEQ ID NO: 5914309 - DNA, 19 bp, Homo sapiens
gctgaatcaaagacatttc

SEQ ID NO: 5914310 - DNA, 17 bp, Homo sapiens
gctgaatcccatcaggc

SEQ ID NO: 5914311 - DNA, 16 bp, Homo sapiens
gctgaatgaagctgcc

SEQ ID NO: 5914312 - DNA, 20 bp, Homo sapiens
gctgaatgtatgtcagtgct

SEQ ID NO: 5914313 - DNA, 17 bp, Homo sapiens
gctgaatgttcttgaat

SEQ ID NO: 5914314 - DNA, 22 bp, Homo sapiens
gctgaatgttcttgaattatat

SEQ ID NO: 5914315 - DNA, 13 bp, Homo sapiens
gctgaatgttttt

SEQ ID NO: 5914316 - DNA, 13 bp, Homo sapiens
gctgaattatttt

SEQ ID NO: 5914317 - DNA, 11 bp, Homo sapiens
gctgaattcct

SEQ ID NO: 5914318 - DNA, 13 bp, Homo sapiens
gctgaattccttt

SEQ ID NO: 5914319 - DNA, 20 bp, Homo sapiens
gctgaatttacagtagttaa

SEQ ID NO: 5914320 - DNA, 19 bp, Homo sapiens
gctgaatttataaaaatta

SEQ ID NO: 5914321 - DNA, 12 bp, Homo sapiens
gctgaattttca

SEQ ID NO: 5914322 - DNA, 21 bp, Homo sapiens
gctgaattttcacatgaacat

SEQ ID NO: 5914323 - DNA, 15 bp, Homo sapiens
gctgaattttctgga

SEQ ID NO: 5914324 - DNA, 18 bp, Homo sapiens
gctgacaaaaatattttc

SEQ ID NO: 5914325 - DNA, 21 bp, Homo sapiens
gctgacaaccaccgctcccca

SEQ ID NO: 5914326 - DNA, 20 bp, Homo sapiens
gctgacaaccattaaagtca

SEQ ID NO: 5914327 - DNA, 20 bp, Homo sapiens
gctgacaacttagctcaggt

SEQ ID NO: 5914328 - DNA, 12 bp, Homo sapiens
gctgacaataaa

SEQ ID NO: 5914329 - DNA, 19 bp, Homo sapiens
gctgacacaaacctgcctg

SEQ ID NO: 5914330 - DNA, 20 bp, Homo sapiens
gctgacacaaacctgcctgg

SEQ ID NO: 5914331 - DNA, 17 bp, Homo sapiens
gctgacacctaccatgc

SEQ ID NO: 5914332 - DNA, 21 bp, Homo sapiens
gctgacacctaccatgctgct

SEQ ID NO: 5914333 - DNA, 19 bp, Homo sapiens
gctgacacgctcagttgaa

SEQ ID NO: 5914334 - DNA, 19 bp, Homo sapiens
gctgacacgtccaccccag

SEQ ID NO: 5914335 - DNA, 15 bp, Homo sapiens
gctgagctgaagaaa

SEQ ID NO: 5914336 - DNA, 16 bp, Homo sapiens
gctgagctgaagaaat

SEQ ID NO: 5914337 - DNA, 15 bp, Homo sapiens
gctgagctgagcttc

SEQ ID NO: 5914338 - DNA, 19 bp, Homo sapiens
gctgagctgcccctgctgc

SEQ ID NO: 5914339 - DNA, 21 bp, Homo sapiens
gctgagctgcccctgctgctt

SEQ ID NO: 5914340 - DNA, 11 bp, Homo sapiens
gctgagctgga

SEQ ID NO: 5914341 - DNA, 22 bp, Homo sapiens
gctgagctggaaggggccacgt

SEQ ID NO: 5914342 - DNA, 11 bp, Homo sapiens
gctgagctggc

SEQ ID NO: 5914343 - DNA, 12 bp, Homo sapiens
gctgagctggca

SEQ ID NO: 5914344 - DNA, 12 bp, Homo sapiens
gctgagctggct

SEQ ID NO: 5914345 - DNA, 14 bp, Homo sapiens
gctgagctgggccc

SEQ ID NO: 5914346 - DNA, 15 bp, Homo sapiens
gctgagctgggccca

SEQ ID NO: 5914347 - DNA, 13 bp, Homo sapiens
gctgagctgggga

SEQ ID NO: 5914348 - DNA, 13 bp, Homo sapiens
gctgagctgtgac

SEQ ID NO: 5914349 - DNA, 14 bp, Homo sapiens
gctgagctgtgcca

SEQ ID NO: 5914350 - DNA, 20 bp, Homo sapiens
gctgagctgtgccagctgct

SEQ ID NO: 5914351 - DNA, 20 bp, Homo sapiens
gctgagcttcggttctccag

SEQ ID NO: 5914352 - DNA, 18 bp, Homo sapiens
gctgagcttgagctcccc

SEQ ID NO: 5914353 - DNA, 19 bp, Homo sapiens
gctgagcttgagctcccct

SEQ ID NO: 5914354 - DNA, 15 bp, Homo sapiens
gctgaggacgagacc

SEQ ID NO: 5914355 - DNA, 17 bp, Homo sapiens
gctgaggacggggcaga

SEQ ID NO: 5914356 - DNA, 20 bp, Homo sapiens
gctgaggacggggcagagct

SEQ ID NO: 5914357 - DNA, 22 bp, Homo sapiens
gctgaggacggggcagagctga

SEQ ID NO: 5914358 - DNA, 23 bp, Homo sapiens
gctgaggacggggcagagctgag

SEQ ID NO: 5914359 - DNA, 21 bp, Homo sapiens
gctgaggactccctccatgtg

SEQ ID NO: 5914360 - DNA, 15 bp, Homo sapiens
gctgaggactctgca

SEQ ID NO: 5914361 - DNA, 23 bp, Homo sapiens
gctgaggactttgcccaggatga

SEQ ID NO: 5914362 - DNA, 15 bp, Homo sapiens
gctgaggagcagcca

SEQ ID NO: 5914363 - DNA, 17 bp, Homo sapiens
gctgaggagcagccagg

SEQ ID NO: 5914364 - DNA, 16 bp, Homo sapiens
gctgaggagtgaggaa

SEQ ID NO: 5914365 - DNA, 18 bp, Homo sapiens
gctgaggagtgaggaata

SEQ ID NO: 5914366 - DNA, 21 bp, Homo sapiens
gctgaggatacagctcttctc

SEQ ID NO: 5914367 - DNA, 19 bp, Homo sapiens
gctgaggataccccaaagt

SEQ ID NO: 5914368 - DNA, 17 bp, Homo sapiens
gctgaggatcctcacag

SEQ ID NO: 5914369 - DNA, 21 bp, Homo sapiens
gctgaggatcctcacaggagc

SEQ ID NO: 5914370 - DNA, 18 bp, Homo sapiens
gctgaggatgattgaggt

SEQ ID NO: 5914371 - DNA, 16 bp, Homo sapiens
gctgaggatttcctgg

SEQ ID NO: 5914372 - DNA, 17 bp, Homo sapiens
gctgaggatttcctgga

SEQ ID NO: 5914373 - DNA, 15 bp, Homo sapiens
gctgaggcagaagaa

SEQ ID NO: 5914374 - DNA, 16 bp, Homo sapiens
gctgaggcaggagact

SEQ ID NO: 5914375 - DNA, 16 bp, Homo sapiens
gctgaggcatgagaat

SEQ ID NO: 5914376 - DNA, 20 bp, Homo sapiens
gctgaggcatgagaatcgct

SEQ ID NO: 5914377 - DNA, 14 bp, Homo sapiens
gctgaggccagagg

SEQ ID NO: 5914378 - DNA, 15 bp, Homo sapiens
gctgaggccagagga

SEQ ID NO: 5914379 - DNA, 20 bp, Homo sapiens
gctgaggccagaggaaggga

SEQ ID NO: 5914380 - DNA, 17 bp, Homo sapiens
gctgaggcccagcccct

SEQ ID NO: 5914381 - DNA, 19 bp, Homo sapiens
gctgaggcccagcccctcc

SEQ ID NO: 5914382 - DNA, 16 bp, Homo sapiens
gctgaggcccatggcc

SEQ ID NO: 5914383 - DNA, 20 bp, Homo sapiens
gctgaggcccatggccacat

SEQ ID NO: 5914384 - DNA, 13 bp, Homo sapiens
gctgaggccccta

SEQ ID NO: 5914385 - DNA, 16 bp, Homo sapiens
gctgaggcccctaggt

SEQ ID NO: 5914386 - DNA, 14 bp, Homo sapiens
gctgaggcctctca

SEQ ID NO: 5914387 - DNA, 13 bp, Homo sapiens
gctgaggcctgga

SEQ ID NO: 5914388 - DNA, 14 bp, Homo sapiens
gctgaggcctgggc

SEQ ID NO: 5914389 - DNA, 15 bp, Homo sapiens
gctgaggcctgggcc

SEQ ID NO: 5914390 - DNA, 16 bp, Homo sapiens
gctgaggcgggagaat

SEQ ID NO: 5914391 - DNA, 19 bp, Homo sapiens
gctgaggctgagaaagcta

SEQ ID NO: 5914392 - DNA, 21 bp, Homo sapiens
gctgaggctgctgccaggccc

SEQ ID NO: 5914393 - DNA, 23 bp, Homo sapiens
gctgaggctgctgccaggcccgg

SEQ ID NO: 5914394 - DNA, 13 bp, Homo sapiens
gctgaggctggca

SEQ ID NO: 5914395 - DNA, 15 bp, Homo sapiens
gctgaggctggcaca

SEQ ID NO: 5914396 - DNA, 15 bp, Homo sapiens
gctgaggctggggga

SEQ ID NO: 5914397 - DNA, 17 bp, Homo sapiens
gctgaggcttgggccca

SEQ ID NO: 5914398 - DNA, 15 bp, Homo sapiens
gctgagggaccagcc

SEQ ID NO: 5914399 - DNA, 15 bp, Homo sapiens
gctgagggaccttgg

SEQ ID NO: 5914400 - DNA, 12 bp, Homo sapiens
gctgagggaggg

SEQ ID NO: 5914401 - DNA, 16 bp, Homo sapiens
gctgagggatgactta

SEQ ID NO: 5914402 - DNA, 23 bp, Homo sapiens
gctgagggatggactgatgcttt

SEQ ID NO: 5914403 - DNA, 13 bp, Homo sapiens
gctgagggcagct

SEQ ID NO: 5914404 - DNA, 19 bp, Homo sapiens
gctgagggccaatacccta

SEQ ID NO: 5914405 - DNA, 15 bp, Homo sapiens
gctgagggccctgtg

SEQ ID NO: 5914406 - DNA, 17 bp, Homo sapiens
gctgagggccctgtgga

SEQ ID NO: 5914407 - DNA, 12 bp, Homo sapiens
gctgagggcctg

SEQ ID NO: 5914408 - DNA, 14 bp, Homo sapiens
gctgagggcctgct

SEQ ID NO: 5914409 - DNA, 18 bp, Homo sapiens
gctgagggcctgctggag

SEQ ID NO: 5914410 - DNA, 12 bp, Homo sapiens
gctgaggggacg

SEQ ID NO: 5914411 - DNA, 17 bp, Homo sapiens
gctgaggggacgggcaa

SEQ ID NO: 5914412 - DNA, 14 bp, Homo sapiens
gctgaggggcaggg

SEQ ID NO: 5914413 - DNA, 24 bp, Homo sapiens
gctgaggggcctgcgcccagagct

SEQ ID NO: 5914414 - DNA, 14 bp, Homo sapiens
gctgaggggcttgg

SEQ ID NO: 5914415 - DNA, 17 bp, Homo sapiens
gctgaggggtctcggat

SEQ ID NO: 5914416 - DNA, 14 bp, Homo sapiens
gctgagggtcgtgg

SEQ ID NO: 5914417 - DNA, 19 bp, Homo sapiens
gctgagggtcgtgggaaag

SEQ ID NO: 5914418 - DNA, 15 bp, Homo sapiens
gctgaggtgagagga

SEQ ID NO: 5914419 - DNA, 15 bp, Homo sapiens
gctgaggtgcccagg

SEQ ID NO: 5914420 - DNA, 14 bp, Homo sapiens
gctgaggtgggagg

SEQ ID NO: 5914421 - DNA, 12 bp, Homo sapiens
gctgaggtgggc

SEQ ID NO: 5914422 - DNA, 17 bp, Homo sapiens
gctgaggtggggaagga

SEQ ID NO: 5914423 - DNA, 22 bp, Homo sapiens
gctgaggtggtaggatcacctg

SEQ ID NO: 5914424 - DNA, 14 bp, Homo sapiens
gctgaggtgtctgg

SEQ ID NO: 5914425 - DNA, 16 bp, Homo sapiens
gctgaggttagagaga

SEQ ID NO: 5914426 - DNA, 19 bp, Homo sapiens
gctgaggttcctctgcctg

SEQ ID NO: 5914427 - DNA, 21 bp, Homo sapiens
gctgaggttcctctgcctgcc

SEQ ID NO: 5914428 - DNA, 23 bp, Homo sapiens
gctgaggttgggaaggcacctgc

SEQ ID NO: 5914429 - DNA, 17 bp, Homo sapiens
gctgaggtttcaccctt

SEQ ID NO: 5914430 - DNA, 15 bp, Homo sapiens
gctgagtactcaggc

SEQ ID NO: 5914431 - DNA, 14 bp, Homo sapiens
gctgagtactggaa

SEQ ID NO: 5914432 - DNA, 17 bp, Homo sapiens
gctgagtaggaggcctc

SEQ ID NO: 5914433 - DNA, 21 bp, Homo sapiens
gctgagtatgttaagctcttt

SEQ ID NO: 5914434 - DNA, 15 bp, Homo sapiens
gctgagtcacctcct

SEQ ID NO: 5914435 - DNA, 16 bp, Homo sapiens
gctgagtcacctcctc

SEQ ID NO: 5914436 - DNA, 17 bp, Homo sapiens
gctgagtcacctcctcc

SEQ ID NO: 5914437 - DNA, 15 bp, Homo sapiens
gctgagtcatctgtt

SEQ ID NO: 5914438 - DNA, 17 bp, Homo sapiens
gctgagtcccaggctga

SEQ ID NO: 5914439 - DNA, 22 bp, Homo sapiens
gctgagtccctcacgtttcttc

SEQ ID NO: 5914440 - DNA, 13 bp, Homo sapiens
gctgagtcctggg

SEQ ID NO: 5914441 - DNA, 15 bp, Homo sapiens
gctgagtcctggggt

SEQ ID NO: 5914442 - DNA, 16 bp, Homo sapiens
gctgagtcggctgggc

SEQ ID NO: 5914443 - DNA, 18 bp, Homo sapiens
gctgagtcggctgggcag

SEQ ID NO: 5914444 - DNA, 21 bp, Homo sapiens
gctgagtcggctgggcagggc

SEQ ID NO: 5914445 - DNA, 23 bp, Homo sapiens
gctgagtcggctgggcagggccg

SEQ ID NO: 5914446 - DNA, 18 bp, Homo sapiens
gctgagtctccagggccc

SEQ ID NO: 5914447 - DNA, 15 bp, Homo sapiens
gctgagtctcccaag

SEQ ID NO: 5914448 - DNA, 15 bp, Homo sapiens
gctgagtctgaaggc

SEQ ID NO: 5914449 - DNA, 19 bp, Homo sapiens
gctgagtctgaaggctggg

SEQ ID NO: 5914450 - DNA, 17 bp, Homo sapiens
gctgagtctggctaggg

SEQ ID NO: 5914451 - DNA, 20 bp, Homo sapiens
gctgagtgacacaagcactt

SEQ ID NO: 5914452 - DNA, 17 bp, Homo sapiens
gctgagtgacagctttc

SEQ ID NO: 5914453 - DNA, 16 bp, Homo sapiens
gctgagtgagccacag

SEQ ID NO: 5914454 - DNA, 17 bp, Homo sapiens
gctgagtgagccacaga

SEQ ID NO: 5914455 - DNA, 15 bp, Homo sapiens
gctgagtgagctgaa

SEQ ID NO: 5914456 - DNA, 12 bp, Homo sapiens
gctgagtgcagc

SEQ ID NO: 5914457 - DNA, 14 bp, Homo sapiens
gctgagtgcagcca

SEQ ID NO: 5914458 - DNA, 15 bp, Homo sapiens
gctgagtgcagccaa

SEQ ID NO: 5914459 - DNA, 18 bp, Homo sapiens
gctgagtgcaggcccacc

SEQ ID NO: 5914460 - DNA, 14 bp, Homo sapiens
gctgagtgcgacca

SEQ ID NO: 5914461 - DNA, 17 bp, Homo sapiens
gctgagtgctatgtgtg

SEQ ID NO: 5914462 - DNA, 14 bp, Homo sapiens
gctgagtgctgggc

SEQ ID NO: 5914463 - DNA, 18 bp, Homo sapiens
gctgagtggaatgcaggg

SEQ ID NO: 5914464 - DNA, 19 bp, Homo sapiens
gctgagtggaatgcaggga

SEQ ID NO: 5914465 - DNA, 20 bp, Homo sapiens
gctgagtggaatgcagggaa

SEQ ID NO: 5914466 - DNA, 19 bp, Homo sapiens
gctgagtggcaggggacag

SEQ ID NO: 5914467 - DNA, 17 bp, Homo sapiens
gctgagtgggaaccgga

SEQ ID NO: 5914468 - DNA, 17 bp, Homo sapiens
gctgagtgggagaaggc

SEQ ID NO: 5914469 - DNA, 22 bp, Homo sapiens
gctgagtggggggtcgtgggcc

SEQ ID NO: 5914470 - DNA, 14 bp, Homo sapiens
gctgagttggcctg

SEQ ID NO: 5914471 - DNA, 15 bp, Homo sapiens
gctgagttggcctgg

SEQ ID NO: 5914472 - DNA, 21 bp, Homo sapiens
gctgagttgttgagtctgttt

SEQ ID NO: 5914473 - DNA, 12 bp, Homo sapiens
gctgagtttcct

SEQ ID NO: 5914474 - DNA, 18 bp, Homo sapiens
gctgataaggaaacttta

SEQ ID NO: 5914475 - DNA, 18 bp, Homo sapiens
gctgataattgtgtattt

SEQ ID NO: 5914476 - DNA, 12 bp, Homo sapiens
gctgataatttt

SEQ ID NO: 5914477 - DNA, 13 bp, Homo sapiens
gctgataatttta

SEQ ID NO: 5914478 - DNA, 14 bp, Homo sapiens
gctgataattttaa

SEQ ID NO: 5914479 - DNA, 20 bp, Homo sapiens
gctgataccatatgaatgaa

SEQ ID NO: 5914480 - DNA, 19 bp, Homo sapiens
gctgatagtgtttcgttaa

SEQ ID NO: 5914481 - DNA, 15 bp, Homo sapiens
gctgatataaattct

SEQ ID NO: 5914482 - DNA, 18 bp, Homo sapiens
gctgatatatgtgttttt

SEQ ID NO: 5914483 - DNA, 18 bp, Homo sapiens
gctgatatcaacagcttc

SEQ ID NO: 5914484 - DNA, 16 bp, Homo sapiens
gctgatattatttctt

SEQ ID NO: 5914485 - DNA, 18 bp, Homo sapiens
gctgatattatttcttct

SEQ ID NO: 5914486 - DNA, 20 bp, Homo sapiens
gctgatattatttcttctct

SEQ ID NO: 5914487 - DNA, 17 bp, Homo sapiens
gctgatattttctctag

SEQ ID NO: 5914488 - DNA, 16 bp, Homo sapiens
gctgatcagtgggcct

SEQ ID NO: 5914489 - DNA, 22 bp, Homo sapiens
gctgatcatcgccagaggtgct

SEQ ID NO: 5914490 - DNA, 14 bp, Homo sapiens
gctgatccaggcaa

SEQ ID NO: 5914491 - DNA, 17 bp, Homo sapiens
gctgatcgccttcccca

SEQ ID NO: 5914492 - DNA, 19 bp, Homo sapiens
gctgatcgccttccccacc

SEQ ID NO: 5914493 - DNA, 16 bp, Homo sapiens
gctgatcgtgctaaat

SEQ ID NO: 5914494 - DNA, 14 bp, Homo sapiens
gctgatctaaaaat

SEQ ID NO: 5914495 - DNA, 14 bp, Homo sapiens
gctgatctcaggga

SEQ ID NO: 5914496 - DNA, 17 bp, Homo sapiens
gctgatctcagggaagc

SEQ ID NO: 5914497 - DNA, 13 bp, Homo sapiens
gctgatctctgta

SEQ ID NO: 5914498 - DNA, 17 bp, Homo sapiens
gctgatgaaactcctga

SEQ ID NO: 5914499 - DNA, 21 bp, Homo sapiens
gctgatgaacttattctgtag

SEQ ID NO: 5914500 - DNA, 14 bp, Homo sapiens
gctgatgaggaata

SEQ ID NO: 5914501 - DNA, 15 bp, Homo sapiens
gctgatgaggatcag

SEQ ID NO: 5914502 - DNA, 22 bp, Homo sapiens
gctgatgatgtctcttgtagaa

SEQ ID NO: 5914503 - DNA, 19 bp, Homo sapiens
gctgatgatgtcttctggt

SEQ ID NO: 5914504 - DNA, 12 bp, Homo sapiens
gctgatgcagac

SEQ ID NO: 5914505 - DNA, 23 bp, Homo sapiens
gctgatgcagccgtccatagcag

SEQ ID NO: 5914506 - DNA, 16 bp, Homo sapiens
gctgatgccccttctc

SEQ ID NO: 5914507 - DNA, 16 bp, Homo sapiens
gctgatgcgctgggat

SEQ ID NO: 5914508 - DNA, 17 bp, Homo sapiens
gctgatgctcctccggg

SEQ ID NO: 5914509 - DNA, 19 bp, Homo sapiens
gctgatgctgggctgggtg

SEQ ID NO: 5914510 - DNA, 16 bp, Homo sapiens
gctgatggagaaggaa

SEQ ID NO: 5914511 - DNA, 17 bp, Homo sapiens
gctgatggagaaggaag

SEQ ID NO: 5914512 - DNA, 15 bp, Homo sapiens
gctgatggagcccca

SEQ ID NO: 5914513 - DNA, 15 bp, Homo sapiens
gctgatggcagctgg

SEQ ID NO: 5914514 - DNA, 13 bp, Homo sapiens
gctgatggcccct

SEQ ID NO: 5914515 - DNA, 19 bp, Homo sapiens
gctgccccaggccggagcc

SEQ ID NO: 5914516 - DNA, 22 bp, Homo sapiens
gctgccccaggccggagcccag

SEQ ID NO: 5914517 - DNA, 23 bp, Homo sapiens
gctgccccaggccggagcccaga

SEQ ID NO: 5914518 - DNA, 23 bp, Homo sapiens
gctgccccattccagctctccca

SEQ ID NO: 5914519 - DNA, 23 bp, Homo sapiens
gctgccccatttatccacctcca

SEQ ID NO: 5914520 - DNA, 19 bp, Homo sapiens
gctgcccccaacactccag

SEQ ID NO: 5914521 - DNA, 22 bp, Homo sapiens
gctgcccccaacactccaggcc

SEQ ID NO: 5914522 - DNA, 15 bp, Homo sapiens
gctgcccccacagat

SEQ ID NO: 5914523 - DNA, 22 bp, Homo sapiens
gctgcccccacagatccatcct

SEQ ID NO: 5914524 - DNA, 20 bp, Homo sapiens
gctgcccccaccccggggac

SEQ ID NO: 5914525 - DNA, 17 bp, Homo sapiens
gctgcccccaccctgct

SEQ ID NO: 5914526 - DNA, 19 bp, Homo sapiens
gctgcccccatccagccac

SEQ ID NO: 5914527 - DNA, 18 bp, Homo sapiens
gctgcccccggccccctg

SEQ ID NO: 5914528 - DNA, 14 bp, Homo sapiens
gctgccccctggct

SEQ ID NO: 5914529 - DNA, 15 bp, Homo sapiens
gctgcccccttcccc

SEQ ID NO: 5914530 - DNA, 21 bp, Homo sapiens
gctgcccccttccccagccct

SEQ ID NO: 5914531 - DNA, 22 bp, Homo sapiens
gctgcccccttccccagccctt

SEQ ID NO: 5914532 - DNA, 13 bp, Homo sapiens
gctgccccgcttc

SEQ ID NO: 5914533 - DNA, 20 bp, Homo sapiens
gctgccccgcttccccacag

SEQ ID NO: 5914534 - DNA, 23 bp, Homo sapiens
gctgccccgcttccccacagaac

SEQ ID NO: 5914535 - DNA, 13 bp, Homo sapiens
gctgccccggccc

SEQ ID NO: 5914536 - DNA, 16 bp, Homo sapiens
gctgccccggcccctc

SEQ ID NO: 5914537 - DNA, 22 bp, Homo sapiens
gctgcccctcatctctctgccc

SEQ ID NO: 5914538 - DNA, 14 bp, Homo sapiens
gctgcccctccccg

SEQ ID NO: 5914539 - DNA, 20 bp, Homo sapiens
gctgcccctccccgtccctg

SEQ ID NO: 5914540 - DNA, 21 bp, Homo sapiens
gctgcccctccccgtccctgt

SEQ ID NO: 5914541 - DNA, 22 bp, Homo sapiens
gctgcccctccccgtccctgtc

SEQ ID NO: 5914542 - DNA, 23 bp, Homo sapiens
gctgcccctccccgtccctgtcc

SEQ ID NO: 5914543 - DNA, 22 bp, Homo sapiens
gctgcccctccctgccagcacc

SEQ ID NO: 5914544 - DNA, 20 bp, Homo sapiens
gctgcccctcgcacacaggg

SEQ ID NO: 5914545 - DNA, 21 bp, Homo sapiens
gctgcccctcgcacacagggc

SEQ ID NO: 5914546 - DNA, 23 bp, Homo sapiens
gctgcccctctctgggcctcaga

SEQ ID NO: 5914547 - DNA, 13 bp, Homo sapiens
gctgcccctgcag

SEQ ID NO: 5914548 - DNA, 21 bp, Homo sapiens
gctgcccctgcgtggcctgag

SEQ ID NO: 5914549 - DNA, 12 bp, Homo sapiens
gctgcccctgct

SEQ ID NO: 5914550 - DNA, 15 bp, Homo sapiens
gctgcccctgctgct

SEQ ID NO: 5914551 - DNA, 16 bp, Homo sapiens
gctgcccctgctgctt

SEQ ID NO: 5914552 - DNA, 15 bp, Homo sapiens
gctgcccctggcacc

SEQ ID NO: 5914553 - DNA, 15 bp, Homo sapiens
gctgcccctggcagc

SEQ ID NO: 5914554 - DNA, 18 bp, Homo sapiens
gctgcccctggcagcccc

SEQ ID NO: 5914555 - DNA, 17 bp, Homo sapiens
gctgcccctggctctga

SEQ ID NO: 5914556 - DNA, 20 bp, Homo sapiens
gctgcccctggtgcactggc

SEQ ID NO: 5914557 - DNA, 13 bp, Homo sapiens
gctgcccctgtag

SEQ ID NO: 5914558 - DNA, 13 bp, Homo sapiens
gctgcccctgtct

SEQ ID NO: 5914559 - DNA, 18 bp, Homo sapiens
gctgcccctgtctggaag

SEQ ID NO: 5914560 - DNA, 18 bp, Homo sapiens
gctgccccttgcaagcca

SEQ ID NO: 5914561 - DNA, 19 bp, Homo sapiens
gctgcccggcctccctccc

SEQ ID NO: 5914562 - DNA, 19 bp, Homo sapiens
gctgcccggcgcctgccct

SEQ ID NO: 5914563 - DNA, 23 bp, Homo sapiens
gctgcccggttgccatggagatc

SEQ ID NO: 5914564 - DNA, 16 bp, Homo sapiens
gctgcccgtcttcagc

SEQ ID NO: 5914565 - DNA, 19 bp, Homo sapiens
gctgcccgtcttcagccta

SEQ ID NO: 5914566 - DNA, 21 bp, Homo sapiens
gctgccctaaataacccttca

SEQ ID NO: 5914567 - DNA, 14 bp, Homo sapiens
gctgccctagctga

SEQ ID NO: 5914568 - DNA, 16 bp, Homo sapiens
gctgccctaggctccg

SEQ ID NO: 5914569 - DNA, 17 bp, Homo sapiens
gctgccctatgggcctg

SEQ ID NO: 5914570 - DNA, 13 bp, Homo sapiens
gctgccctcccac

SEQ ID NO: 5914571 - DNA, 21 bp, Homo sapiens
gctgccctcccacagcctcct

SEQ ID NO: 5914572 - DNA, 21 bp, Homo sapiens
gctgccctccttgtccaccca

SEQ ID NO: 5914573 - DNA, 22 bp, Homo sapiens
gctgccctccttgtccacccac

SEQ ID NO: 5914574 - DNA, 13 bp, Homo sapiens
gctgccctctcct

SEQ ID NO: 5914575 - DNA, 14 bp, Homo sapiens
gctgccctctcctg

SEQ ID NO: 5914576 - DNA, 13 bp, Homo sapiens
gctgccctgagaa

SEQ ID NO: 5914577 - DNA, 18 bp, Homo sapiens
gctgccctgagaagctgc

SEQ ID NO: 5914578 - DNA, 22 bp, Homo sapiens
gctgccctgagcgcctggattt

SEQ ID NO: 5914579 - DNA, 12 bp, Homo sapiens
gctgccctgagg

SEQ ID NO: 5914580 - DNA, 13 bp, Homo sapiens
gctgccctgaggg

SEQ ID NO: 5914581 - DNA, 15 bp, Homo sapiens
gctgccctgaggggc

SEQ ID NO: 5914582 - DNA, 23 bp, Homo sapiens
gctgccctgaggggctggggagg

SEQ ID NO: 5914583 - DNA, 11 bp, Homo sapiens
gctgccctgca

SEQ ID NO: 5914584 - DNA, 18 bp, Homo sapiens
gctgccctgcatgctgcc

SEQ ID NO: 5914585 - DNA, 13 bp, Homo sapiens
gctgccctgccca

SEQ ID NO: 5914586 - DNA, 14 bp, Homo sapiens
gctgccctgcccac

SEQ ID NO: 5914587 - DNA, 18 bp, Homo sapiens
gctgccctgcccacctgg

SEQ ID NO: 5914588 - DNA, 20 bp, Homo sapiens
gctgccctgcccacctggcc

SEQ ID NO: 5914589 - DNA, 14 bp, Homo sapiens
gctgccctgcccca

SEQ ID NO: 5914590 - DNA, 15 bp, Homo sapiens
gctgccctgcgccct

SEQ ID NO: 5914591 - DNA, 15 bp, Homo sapiens
gctgccctgcggccc

SEQ ID NO: 5914592 - DNA, 18 bp, Homo sapiens
gctgccctgctctgggga

SEQ ID NO: 5914593 - DNA, 12 bp, Homo sapiens
gctgccctgctg

SEQ ID NO: 5914594 - DNA, 16 bp, Homo sapiens
gctgccctgctgtgga

SEQ ID NO: 5914595 - DNA, 14 bp, Homo sapiens
gctgccctggccct

SEQ ID NO: 5914596 - DNA, 17 bp, Homo sapiens
gctgccctggccctgag

SEQ ID NO: 5914597 - DNA, 12 bp, Homo sapiens
gctgccctggct

SEQ ID NO: 5914598 - DNA, 13 bp, Homo sapiens
gctgccctggctg

SEQ ID NO: 5914599 - DNA, 11 bp, Homo sapiens
gctgccctggg

SEQ ID NO: 5914600 - DNA, 12 bp, Homo sapiens
gctgccctgggg

SEQ ID NO: 5914601 - DNA, 13 bp, Homo sapiens
gctgccctggggc

SEQ ID NO: 5914602 - DNA, 15 bp, Homo sapiens
gctgccctgggtcct

SEQ ID NO: 5914603 - DNA, 20 bp, Homo sapiens
gctgccctgggtcctgcctg

SEQ ID NO: 5914604 - DNA, 13 bp, Homo sapiens
gctgccctggtgc

SEQ ID NO: 5914605 - DNA, 23 bp, Homo sapiens
gctgccctggtgctgccacactt

SEQ ID NO: 5914606 - DNA, 14 bp, Homo sapiens
gctgccctgtgaga

SEQ ID NO: 5914607 - DNA, 18 bp, Homo sapiens
gctgccctgtgagagcca

SEQ ID NO: 5914608 - DNA, 14 bp, Homo sapiens
gctgccctgtgtac

SEQ ID NO: 5914609 - DNA, 16 bp, Homo sapiens
gctgcccttcgctgcc

SEQ ID NO: 5914610 - DNA, 20 bp, Homo sapiens
gctgcccttcgctgccagga

SEQ ID NO: 5914611 - DNA, 19 bp, Homo sapiens
gctgcccttgcagggtggg

SEQ ID NO: 5914612 - DNA, 13 bp, Homo sapiens
gctgcccttgggc

SEQ ID NO: 5914613 - DNA, 18 bp, Homo sapiens
gctgcccttgttgcctgc

SEQ ID NO: 5914614 - DNA, 14 bp, Homo sapiens
gctgccctttggcc

SEQ ID NO: 5914615 - DNA, 16 bp, Homo sapiens
gctgccctttggccaa

SEQ ID NO: 5914616 - DNA, 20 bp, Homo sapiens
gctgccctttggccaacagg

SEQ ID NO: 5914617 - DNA, 22 bp, Homo sapiens
gctgccgagacagaccctctgc

SEQ ID NO: 5914618 - DNA, 13 bp, Homo sapiens
gctgccgagccac

SEQ ID NO: 5914619 - DNA, 15 bp, Homo sapiens
gctgccgagccacca

SEQ ID NO: 5914620 - DNA, 16 bp, Homo sapiens
gctgccgagggctggc

SEQ ID NO: 5914621 - DNA, 14 bp, Homo sapiens
gctgccgcaaggcc

SEQ ID NO: 5914622 - DNA, 15 bp, Homo sapiens
gctgccgcaccagcc

SEQ ID NO: 5914623 - DNA, 15 bp, Homo sapiens
gctgccgcaccccag

SEQ ID NO: 5914624 - DNA, 22 bp, Homo sapiens
gctgccgcaccccagagtgtgg

SEQ ID NO: 5914625 - DNA, 17 bp, Homo sapiens
gctgccgcatctgcctg

SEQ ID NO: 5914626 - DNA, 21 bp, Homo sapiens
gctgccgcatctgcctggagc

SEQ ID NO: 5914627 - DNA, 22 bp, Homo sapiens
gctgccgcatctgcctggagcc

SEQ ID NO: 5914628 - DNA, 18 bp, Homo sapiens
gctgccgcctcccagcct

SEQ ID NO: 5914629 - DNA, 13 bp, Homo sapiens
gctgccgctgcac

SEQ ID NO: 5914630 - DNA, 21 bp, Homo sapiens
gctgccggaggagcatgcgca

SEQ ID NO: 5914631 - DNA, 15 bp, Homo sapiens
gctgccggagggagc

SEQ ID NO: 5914632 - DNA, 21 bp, Homo sapiens
gctgccggagggagccctgag

SEQ ID NO: 5914633 - DNA, 13 bp, Homo sapiens
gctgccggcacag

SEQ ID NO: 5914634 - DNA, 18 bp, Homo sapiens
gctgccggcacagctggg

SEQ ID NO: 5914635 - DNA, 21 bp, Homo sapiens
gctgccggcagtgctggttct

SEQ ID NO: 5914636 - DNA, 15 bp, Homo sapiens
gctgccggctgcacc

SEQ ID NO: 5914637 - DNA, 19 bp, Homo sapiens
gctgccgggagactgccag

SEQ ID NO: 5914638 - DNA, 17 bp, Homo sapiens
gctgccgggccaggcgc

SEQ ID NO: 5914639 - DNA, 15 bp, Homo sapiens
gctgccgggcctgat

SEQ ID NO: 5914640 - DNA, 19 bp, Homo sapiens
gctgccggggcagccccct

SEQ ID NO: 5914641 - DNA, 22 bp, Homo sapiens
gctgccgggtggggggagggca

SEQ ID NO: 5914642 - DNA, 21 bp, Homo sapiens
gctgccgtgcacggggccagc

SEQ ID NO: 5914643 - DNA, 13 bp, Homo sapiens
gctgccgtggggc

SEQ ID NO: 5914644 - DNA, 22 bp, Homo sapiens
gctgcctaaatccactctgcag

SEQ ID NO: 5914645 - DNA, 15 bp, Homo sapiens
gctgcctaagaggca

SEQ ID NO: 5914646 - DNA, 16 bp, Homo sapiens
gctgcctaagtggctg

SEQ ID NO: 5914647 - DNA, 17 bp, Homo sapiens
gctgcctaagtggctgc

SEQ ID NO: 5914648 - DNA, 15 bp, Homo sapiens
gctgcctaataaaga

SEQ ID NO: 5914649 - DNA, 22 bp, Homo sapiens
gctgcctagcaagctggcctct

SEQ ID NO: 5914650 - DNA, 21 bp, Homo sapiens
gctgcctatgcccagcctcca

SEQ ID NO: 5914651 - DNA, 14 bp, Homo sapiens
gctgcctcagccag

SEQ ID NO: 5914652 - DNA, 22 bp, Homo sapiens
gctgcctcagccagtggcacag

SEQ ID NO: 5914653 - DNA, 20 bp, Homo sapiens
gctgcctcatgaccctcctg

SEQ ID NO: 5914654 - DNA, 23 bp, Homo sapiens
gctgcctcatgaccctcctgtcc

SEQ ID NO: 5914655 - DNA, 14 bp, Homo sapiens
gctgcctccaagtc

SEQ ID NO: 5914656 - DNA, 12 bp, Homo sapiens
gctgcctccact

SEQ ID NO: 5914657 - DNA, 18 bp, Homo sapiens
gctgcctccactcccact

SEQ ID NO: 5914658 - DNA, 21 bp, Homo sapiens
gctgcctccatggcagcagcc

SEQ ID NO: 5914659 - DNA, 13 bp, Homo sapiens
gctgcctccccaa

SEQ ID NO: 5914660 - DNA, 21 bp, Homo sapiens
gctgcctccccaaccctgccc

SEQ ID NO: 5914661 - DNA, 17 bp, Homo sapiens
gctgcctccccaatcca

SEQ ID NO: 5914662 - DNA, 14 bp, Homo sapiens
gctgcctcccccca

SEQ ID NO: 5914663 - DNA, 12 bp, Homo sapiens
gctgcctccctg

SEQ ID NO: 5914664 - DNA, 14 bp, Homo sapiens
gctgcctccctggg

SEQ ID NO: 5914665 - DNA, 21 bp, Homo sapiens
gctgcctccgggcctcggcct

SEQ ID NO: 5914666 - DNA, 16 bp, Homo sapiens
gctgcctcctcctgag

SEQ ID NO: 5914667 - DNA, 15 bp, Homo sapiens
gctgcctcctgccct

SEQ ID NO: 5914668 - DNA, 16 bp, Homo sapiens
gctgcctcggactcca

SEQ ID NO: 5914669 - DNA, 14 bp, Homo sapiens
gctgcctctgaaaa

SEQ ID NO: 5914670 - DNA, 18 bp, Homo sapiens
gctgcctctgaaaatatt

SEQ ID NO: 5914671 - DNA, 19 bp, Homo sapiens
gctgcctctgaaaatattt

SEQ ID NO: 5914672 - DNA, 11 bp, Homo sapiens
gctgcctctgc

SEQ ID NO: 5914673 - DNA, 16 bp, Homo sapiens
gctgcctctgtggaag

SEQ ID NO: 5914674 - DNA, 23 bp, Homo sapiens
gctgcctcttggcttctcagccc

SEQ ID NO: 5914675 - DNA, 15 bp, Homo sapiens
gctgcctgaaaacca

SEQ ID NO: 5914676 - DNA, 18 bp, Homo sapiens
gctgcctgagcacctccc

SEQ ID NO: 5914677 - DNA, 21 bp, Homo sapiens
gctgcctgagtcgtgacctgc

SEQ ID NO: 5914678 - DNA, 16 bp, Homo sapiens
gctgcctgcagcacat

SEQ ID NO: 5914679 - DNA, 13 bp, Homo sapiens
gctgcctgccatg

SEQ ID NO: 5914680 - DNA, 18 bp, Homo sapiens
gctgcctgccatgtgtga

SEQ ID NO: 5914681 - DNA, 14 bp, Homo sapiens
gctgcctgcccaca

SEQ ID NO: 5914682 - DNA, 18 bp, Homo sapiens
gctgcctgcccacacagg

SEQ ID NO: 5914683 - DNA, 17 bp, Homo sapiens
gctgcctgccccatccc

SEQ ID NO: 5914684 - DNA, 21 bp, Homo sapiens
gctgcctgccggccgcccaga

SEQ ID NO: 5914685 - DNA, 19 bp, Homo sapiens
gctgcctgcctccggccct

SEQ ID NO: 5914686 - DNA, 22 bp, Homo sapiens
gctgcctgcctccggccctgcc

SEQ ID NO: 5914687 - DNA, 23 bp, Homo sapiens
gctgcctgcctccggccctgccc

SEQ ID NO: 5914688 - DNA, 14 bp, Homo sapiens
gctgcctgcctgtc

SEQ ID NO: 5914689 - DNA, 16 bp, Homo sapiens
gctgcctgctctgcag

SEQ ID NO: 5914690 - DNA, 13 bp, Homo sapiens
gctgcctggaccc

SEQ ID NO: 5914691 - DNA, 12 bp, Homo sapiens
gctgcctggaga

SEQ ID NO: 5914692 - DNA, 16 bp, Homo sapiens
gctgcctggagaaagg

SEQ ID NO: 5914693 - DNA, 21 bp, Homo sapiens
gctgctctgaccttccagagc

SEQ ID NO: 5914694 - DNA, 13 bp, Homo sapiens
gctgctctgaggt

SEQ ID NO: 5914695 - DNA, 18 bp, Homo sapiens
gctgctctgcaggctggg

SEQ ID NO: 5914696 - DNA, 20 bp, Homo sapiens
gctgctctgcaggctgggga

SEQ ID NO: 5914697 - DNA, 23 bp, Homo sapiens
gctgctctgcaggctggggaggt

SEQ ID NO: 5914698 - DNA, 16 bp, Homo sapiens
gctgctctgcccagag

SEQ ID NO: 5914699 - DNA, 13 bp, Homo sapiens
gctgctctgcccc

SEQ ID NO: 5914700 - DNA, 17 bp, Homo sapiens
gctgctctgccccagct

SEQ ID NO: 5914701 - DNA, 23 bp, Homo sapiens
gctgctctgccccagcttgggca

SEQ ID NO: 5914702 - DNA, 20 bp, Homo sapiens
gctgctctgccccttgggca

SEQ ID NO: 5914703 - DNA, 22 bp, Homo sapiens
gctgctctgccccttgggcatc

SEQ ID NO: 5914704 - DNA, 15 bp, Homo sapiens
gctgctctgcgtggc

SEQ ID NO: 5914705 - DNA, 21 bp, Homo sapiens
gctgctctgctatatgcctta

SEQ ID NO: 5914706 - DNA, 10 bp, Homo sapiens
gctgctcttc

SEQ ID NO: 5914707 - DNA, 22 bp, Homo sapiens
gctgctcttggctggacccagc

SEQ ID NO: 5914708 - DNA, 22 bp, Homo sapiens
gctgctgaaaaccatctggcct

SEQ ID NO: 5914709 - DNA, 17 bp, Homo sapiens
gctgctgaaatttggaa

SEQ ID NO: 5914710 - DNA, 18 bp, Homo sapiens
gctgctgaaatttggaaa

SEQ ID NO: 5914711 - DNA, 16 bp, Homo sapiens
gctgctgaagaggcaa

SEQ ID NO: 5914712 - DNA, 17 bp, Homo sapiens
gctgctgaagaggcaag

SEQ ID NO: 5914713 - DNA, 15 bp, Homo sapiens
gctgctgaaggctcg

SEQ ID NO: 5914714 - DNA, 14 bp, Homo sapiens
gctgctgacaggat

SEQ ID NO: 5914715 - DNA, 10 bp, Homo sapiens
gctgctgacc

SEQ ID NO: 5914716 - DNA, 12 bp, Homo sapiens
gctgctgaccaa

SEQ ID NO: 5914717 - DNA, 23 bp, Homo sapiens
gctgctgacgtttgacaccaggg

SEQ ID NO: 5914718 - DNA, 13 bp, Homo sapiens
gctgctgagaacc

SEQ ID NO: 5914719 - DNA, 16 bp, Homo sapiens
gctgctgagaacctgg

SEQ ID NO: 5914720 - DNA, 18 bp, Homo sapiens
gctgctgagaacctggcc

SEQ ID NO: 5914721 - DNA, 20 bp, Homo sapiens
gctgctgagaacctggcctt

SEQ ID NO: 5914722 - DNA, 18 bp, Homo sapiens
gctgctgagatcctggac

SEQ ID NO: 5914723 - DNA, 17 bp, Homo sapiens
gctgctgatcgccttcc

SEQ ID NO: 5914724 - DNA, 16 bp, Homo sapiens
gctgctgatgtaggag

SEQ ID NO: 5914725 - DNA, 13 bp, Homo sapiens
gctgctgcacacc

SEQ ID NO: 5914726 - DNA, 14 bp, Homo sapiens
gctgctgcacacca

SEQ ID NO: 5914727 - DNA, 21 bp, Homo sapiens
gctgctgcacaccaaggccct

SEQ ID NO: 5914728 - DNA, 14 bp, Homo sapiens
gctgctgcaccaac

SEQ ID NO: 5914729 - DNA, 15 bp, Homo sapiens
gctgctgcaccaacc

SEQ ID NO: 5914730 - DNA, 12 bp, Homo sapiens
gctgctgcaccc

SEQ ID NO: 5914731 - DNA, 21 bp, Homo sapiens
gctgctgcacccaactactga

SEQ ID NO: 5914732 - DNA, 12 bp, Homo sapiens
gctgctgcactg

SEQ ID NO: 5914733 - DNA, 17 bp, Homo sapiens
gctgctgcactgccctc

SEQ ID NO: 5914734 - DNA, 13 bp, Homo sapiens
gctgctgcagccc

SEQ ID NO: 5914735 - DNA, 15 bp, Homo sapiens
gctgctgcagccctg

SEQ ID NO: 5914736 - DNA, 13 bp, Homo sapiens
gctgctgccaggc

SEQ ID NO: 5914737 - DNA, 18 bp, Homo sapiens
gctgctgccagggcttcc

SEQ ID NO: 5914738 - DNA, 16 bp, Homo sapiens
gctgctgccatccatg

SEQ ID NO: 5914739 - DNA, 12 bp, Homo sapiens
gctgctgcccag

SEQ ID NO: 5914740 - DNA, 13 bp, Homo sapiens
gctgctgcccagg

SEQ ID NO: 5914741 - DNA, 15 bp, Homo sapiens
gctgctgcccaggcc

SEQ ID NO: 5914742 - DNA, 17 bp, Homo sapiens
gctgctgcccccacccc

SEQ ID NO: 5914743 - DNA, 16 bp, Homo sapiens
gctgctgccccctggc

SEQ ID NO: 5914744 - DNA, 15 bp, Homo sapiens
gctgctgcccctgca

SEQ ID NO: 5914745 - DNA, 23 bp, Homo sapiens
gctgctgcccctgcacagcaggc

SEQ ID NO: 5914746 - DNA, 17 bp, Homo sapiens
gctgctgccctgctgtg

SEQ ID NO: 5914747 - DNA, 18 bp, Homo sapiens
gctgctgccgcctcacct

SEQ ID NO: 5914748 - DNA, 17 bp, Homo sapiens
gctgctgcctccctggg

SEQ ID NO: 5914749 - DNA, 13 bp, Homo sapiens
gctgctgcctctt

SEQ ID NO: 5914750 - DNA, 12 bp, Homo sapiens
gctgctgcctgc

SEQ ID NO: 5914751 - DNA, 16 bp, Homo sapiens
gctgctgcctgcctgg

SEQ ID NO: 5914752 - DNA, 15 bp, Homo sapiens
gctgctgcggctgtg

SEQ ID NO: 5914753 - DNA, 14 bp, Homo sapiens
gctgctgctaccag

SEQ ID NO: 5914754 - DNA, 16 bp, Homo sapiens
gctgctgctaccagcg

SEQ ID NO: 5914755 - DNA, 15 bp, Homo sapiens
gctgctgctactgct

SEQ ID NO: 5914756 - DNA, 15 bp, Homo sapiens
gctgctgctcctccc

SEQ ID NO: 5914757 - DNA, 20 bp, Homo sapiens
gctgctgctcctctcttggg

SEQ ID NO: 5914758 - DNA, 14 bp, Homo sapiens
gctgctgctctccc

SEQ ID NO: 5914759 - DNA, 13 bp, Homo sapiens
gctgctgctgatg

SEQ ID NO: 5914760 - DNA, 12 bp, Homo sapiens
gctgctgctgct

SEQ ID NO: 5914761 - DNA, 14 bp, Homo sapiens
gctgctgctgctat

SEQ ID NO: 5914762 - DNA, 14 bp, Homo sapiens
gctgctgctgctgc

SEQ ID NO: 5914763 - DNA, 15 bp, Homo sapiens
gctgctgcttctgct

SEQ ID NO: 5914764 - DNA, 18 bp, Homo sapiens
gctgctgcttctgctcca

SEQ ID NO: 5914765 - DNA, 21 bp, Homo sapiens
gctgctgcttctgctccagcc

SEQ ID NO: 5914766 - DNA, 22 bp, Homo sapiens
gctgctgcttctgctccagccc

SEQ ID NO: 5914767 - DNA, 13 bp, Homo sapiens
gctgctgctttcc

SEQ ID NO: 5914768 - DNA, 14 bp, Homo sapiens
gctgctggagactc

SEQ ID NO: 5914769 - DNA, 14 bp, Homo sapiens
gctgctggaggaaa

SEQ ID NO: 5914770 - DNA, 23 bp, Homo sapiens
gctgctggagtgcagtggcacaa

SEQ ID NO: 5914771 - DNA, 16 bp, Homo sapiens
gctgctggcacagact

SEQ ID NO: 5914772 - DNA, 21 bp, Homo sapiens
gctgctggccaaatagcaaag

SEQ ID NO: 5914773 - DNA, 22 bp, Homo sapiens
gctgctggccaaatagcaaaga

SEQ ID NO: 5914774 - DNA, 14 bp, Homo sapiens
gctgctggccaggg

SEQ ID NO: 5914775 - DNA, 17 bp, Homo sapiens
gctgctggccatggctg

SEQ ID NO: 5914776 - DNA, 18 bp, Homo sapiens
gctgctggcccacagctc

SEQ ID NO: 5914777 - DNA, 21 bp, Homo sapiens
gctgctggcccacagctctgc

SEQ ID NO: 5914778 - DNA, 16 bp, Homo sapiens
gctgctggcctccctc

SEQ ID NO: 5914779 - DNA, 12 bp, Homo sapiens
gctgctggcgcc

SEQ ID NO: 5914780 - DNA, 14 bp, Homo sapiens
gctgctggcgcctc

SEQ ID NO: 5914781 - DNA, 16 bp, Homo sapiens
gctgctggcgcctctg

SEQ ID NO: 5914782 - DNA, 12 bp, Homo sapiens
gctgctggctga

SEQ ID NO: 5914783 - DNA, 19 bp, Homo sapiens
gctgctggctgacctgggc

SEQ ID NO: 5914784 - DNA, 13 bp, Homo sapiens
gctgctggcttca

SEQ ID NO: 5914785 - DNA, 16 bp, Homo sapiens
gctgctggcttcaggg

SEQ ID NO: 5914786 - DNA, 19 bp, Homo sapiens
gctgctgggacttgaacaa

SEQ ID NO: 5914787 - DNA, 13 bp, Homo sapiens
gctgctgggccag

SEQ ID NO: 5914788 - DNA, 19 bp, Homo sapiens
gctgctgggcgtctgttct

SEQ ID NO: 5914789 - DNA, 16 bp, Homo sapiens
gctgctgggctcagtg

SEQ ID NO: 5914790 - DNA, 19 bp, Homo sapiens
gctgctggggaagacagtg

SEQ ID NO: 5914791 - DNA, 20 bp, Homo sapiens
gctgctggggaagacagtgg

SEQ ID NO: 5914792 - DNA, 12 bp, Homo sapiens
gctgctggggca

SEQ ID NO: 5914793 - DNA, 17 bp, Homo sapiens
gctgctggggcagggcc

SEQ ID NO: 5914794 - DNA, 18 bp, Homo sapiens
gctgctggggcagggccc

SEQ ID NO: 5914795 - DNA, 23 bp, Homo sapiens
gctgctggggcatgtgtgcctgt

SEQ ID NO: 5914796 - DNA, 20 bp, Homo sapiens
gctgctggggcctcagacga

SEQ ID NO: 5914797 - DNA, 22 bp, Homo sapiens
gctgctgggggcaactggccat

SEQ ID NO: 5914798 - DNA, 17 bp, Homo sapiens
gctgctgggggctcccc

SEQ ID NO: 5914799 - DNA, 16 bp, Homo sapiens
gctgctgggtggcagg

SEQ ID NO: 5914800 - DNA, 20 bp, Homo sapiens
gctgctggtcacccccaccc

SEQ ID NO: 5914801 - DNA, 23 bp, Homo sapiens
gctgctgtaaagttgaggggaga

SEQ ID NO: 5914802 - DNA, 13 bp, Homo sapiens
gctgctgtaaata

SEQ ID NO: 5914803 - DNA, 17 bp, Homo sapiens
gctgctgtaactgctga

SEQ ID NO: 5914804 - DNA, 18 bp, Homo sapiens
gctgctgtaactgctgag

SEQ ID NO: 5914805 - DNA, 19 bp, Homo sapiens
gctgctgtaactgctgagc

SEQ ID NO: 5914806 - DNA, 21 bp, Homo sapiens
gctgctgtaactgctgagcca

SEQ ID NO: 5914807 - DNA, 16 bp, Homo sapiens
gctgctgtactgaagt

SEQ ID NO: 5914808 - DNA, 14 bp, Homo sapiens
gctgctgtccagtg

SEQ ID NO: 5914809 - DNA, 15 bp, Homo sapiens
gctgctgtccagtgc

SEQ ID NO: 5914810 - DNA, 21 bp, Homo sapiens
gctgctgtccagtgcctacat

SEQ ID NO: 5914811 - DNA, 18 bp, Homo sapiens
gctgctgtccctccccct

SEQ ID NO: 5914812 - DNA, 22 bp, Homo sapiens
gctgctgtccctcccccttgtc

SEQ ID NO: 5914813 - DNA, 23 bp, Homo sapiens
gctgctgtccctcccccttgtcc

SEQ ID NO: 5914814 - DNA, 12 bp, Homo sapiens
gctgctgtcctt

SEQ ID NO: 5914815 - DNA, 21 bp, Homo sapiens
gctgctgtctgagtagtggcc

SEQ ID NO: 5914816 - DNA, 16 bp, Homo sapiens
gctgctgtctgggtgc

SEQ ID NO: 5914817 - DNA, 20 bp, Homo sapiens
gctgctgtctgggtgctact

SEQ ID NO: 5914818 - DNA, 21 bp, Homo sapiens
gctgctgtctgggtgctactg

SEQ ID NO: 5914819 - DNA, 24 bp, Homo sapiens
gctgctgtctgggtgctactgggg

SEQ ID NO: 5914820 - DNA, 10 bp, Homo sapiens
gctgctgtga

SEQ ID NO: 5914821 - DNA, 20 bp, Homo sapiens
gctgctgtgaaaactctggt

SEQ ID NO: 5914822 - DNA, 22 bp, Homo sapiens
gctgctgtgcaacggtctcctg

SEQ ID NO: 5914823 - DNA, 14 bp, Homo sapiens
gctgctgtgcctgc

SEQ ID NO: 5914824 - DNA, 18 bp, Homo sapiens
gctgctgtgctctgggga

SEQ ID NO: 5914825 - DNA, 17 bp, Homo sapiens
gctgctgtgctgggtgc

SEQ ID NO: 5914826 - DNA, 20 bp, Homo sapiens
gctgctgtggccatcaacct

SEQ ID NO: 5914827 - DNA, 16 bp, Homo sapiens
gctgctgtggcccagt

SEQ ID NO: 5914828 - DNA, 17 bp, Homo sapiens
gctgctgtgtagctctg

SEQ ID NO: 5914829 - DNA, 15 bp, Homo sapiens
gctgctgtgtgtgag

SEQ ID NO: 5914830 - DNA, 24 bp, Homo sapiens
gctgctgtgtgtgagcagtggaca

SEQ ID NO: 5914831 - DNA, 20 bp, Homo sapiens
gctgctgttctcaggacagc

SEQ ID NO: 5914832 - DNA, 16 bp, Homo sapiens
gctgctgtttgggttg

SEQ ID NO: 5914833 - DNA, 17 bp, Homo sapiens
gctgcttaaaatgcaag

SEQ ID NO: 5914834 - DNA, 19 bp, Homo sapiens
gctgcttaagtgcatgcat

SEQ ID NO: 5914835 - DNA, 18 bp, Homo sapiens
gctgcttagacataacaa

SEQ ID NO: 5914836 - DNA, 19 bp, Homo sapiens
gctgcttaggtctcatgga

SEQ ID NO: 5914837 - DNA, 16 bp, Homo sapiens
gctgcttcactaggga

SEQ ID NO: 5914838 - DNA, 15 bp, Homo sapiens
gctgcttcatgtttg

SEQ ID NO: 5914839 - DNA, 10 bp, Homo sapiens
gctgcttcca

SEQ ID NO: 5914840 - DNA, 14 bp, Homo sapiens
gctgcttccactca

SEQ ID NO: 5914841 - DNA, 16 bp, Homo sapiens
gctgcttccaggctgg

SEQ ID NO: 5914842 - DNA, 17 bp, Homo sapiens
gctgcttccaggctggg

SEQ ID NO: 5914843 - DNA, 18 bp, Homo sapiens
gctgcttccaggctgggc

SEQ ID NO: 5914844 - DNA, 13 bp, Homo sapiens
gctgcttccagtg

SEQ ID NO: 5914845 - DNA, 11 bp, Homo sapiens
gctgcttccca

SEQ ID NO: 5914846 - DNA, 21 bp, Homo sapiens
gctgcttccccaggctgccca

SEQ ID NO: 5914847 - DNA, 15 bp, Homo sapiens
gctgcttccctctgc

SEQ ID NO: 5914848 - DNA, 23 bp, Homo sapiens
gctgcttccggtagggaggcagc

SEQ ID NO: 5914849 - DNA, 13 bp, Homo sapiens
gctgcttcctaac

SEQ ID NO: 5914850 - DNA, 14 bp, Homo sapiens
gctgcttcctaact

SEQ ID NO: 5914851 - DNA, 14 bp, Homo sapiens
gctgcttcctggac

SEQ ID NO: 5914852 - DNA, 22 bp, Homo sapiens
gctgcttctacggccatgagac

SEQ ID NO: 5914853 - DNA, 18 bp, Homo sapiens
gctgcttctcccaggcaa

SEQ ID NO: 5914854 - DNA, 23 bp, Homo sapiens
gctgcttctcccaggcaaggctg

SEQ ID NO: 5914855 - DNA, 13 bp, Homo sapiens
gctgcttctcccc

SEQ ID NO: 5914856 - DNA, 14 bp, Homo sapiens
gctgcttctccccc

SEQ ID NO: 5914857 - DNA, 16 bp, Homo sapiens
gctgcttctcccccca

SEQ ID NO: 5914858 - DNA, 18 bp, Homo sapiens
gctgcttctccccccatc

SEQ ID NO: 5914859 - DNA, 16 bp, Homo sapiens
gctgcttctccctggg

SEQ ID NO: 5914860 - DNA, 17 bp, Homo sapiens
gctgcttctccctgggg

SEQ ID NO: 5914861 - DNA, 23 bp, Homo sapiens
gctgcttctcctcccagcgtgtg

SEQ ID NO: 5914862 - DNA, 19 bp, Homo sapiens
gctgcttctgctccagccc

SEQ ID NO: 5914863 - DNA, 20 bp, Homo sapiens
gctgcttctgctccagcccc

SEQ ID NO: 5914864 - DNA, 21 bp, Homo sapiens
gctgcttctgctccagcccct

SEQ ID NO: 5914865 - DNA, 15 bp, Homo sapiens
gctgcttctgctgcc

SEQ ID NO: 5914866 - DNA, 11 bp, Homo sapiens
gctgcttctgt

SEQ ID NO: 5914867 - DNA, 13 bp, Homo sapiens
gctgcttctgtct

SEQ ID NO: 5914868 - DNA, 13 bp, Homo sapiens
gctgcttcttgct

SEQ ID NO: 5914869 - DNA, 19 bp, Homo sapiens
gctgcttgaaacttcagcc

SEQ ID NO: 5914870 - DNA, 22 bp, Homo sapiens
gctgcttgaaacttcagccctg

SEQ ID NO: 5914871 - DNA, 16 bp, Homo sapiens
gctgcttgagtggaca

SEQ ID NO: 5914872 - DNA, 21 bp, Homo sapiens
gctgcttgagtggacagcagc

SEQ ID NO: 5914873 - DNA, 14 bp, Homo sapiens
gctggagctctgcc

SEQ ID NO: 5914874 - DNA, 17 bp, Homo sapiens
gctggagctctgcccat

SEQ ID NO: 5914875 - DNA, 22 bp, Homo sapiens
gctggagctcttggaagagctc

SEQ ID NO: 5914876 - DNA, 11 bp, Homo sapiens
gctggagctgt

SEQ ID NO: 5914877 - DNA, 14 bp, Homo sapiens
gctggaggaatcag

SEQ ID NO: 5914878 - DNA, 21 bp, Homo sapiens
gctggaggactagaacctgga

SEQ ID NO: 5914879 - DNA, 22 bp, Homo sapiens
gctggaggagcagcagcttggg

SEQ ID NO: 5914880 - DNA, 13 bp, Homo sapiens
gctggaggagccc

SEQ ID NO: 5914881 - DNA, 16 bp, Homo sapiens
gctggaggagcccagg

SEQ ID NO: 5914882 - DNA, 21 bp, Homo sapiens
gctggaggagctggcctgtgg

SEQ ID NO: 5914883 - DNA, 19 bp, Homo sapiens
gctggaggaggggaagctg

SEQ ID NO: 5914884 - DNA, 17 bp, Homo sapiens
gctggaggatgtgggca

SEQ ID NO: 5914885 - DNA, 13 bp, Homo sapiens
gctggaggcagac

SEQ ID NO: 5914886 - DNA, 15 bp, Homo sapiens
gctggaggcagactc

SEQ ID NO: 5914887 - DNA, 20 bp, Homo sapiens
gctggaggcagactcgaggg

SEQ ID NO: 5914888 - DNA, 14 bp, Homo sapiens
gctggaggcagggc

SEQ ID NO: 5914889 - DNA, 16 bp, Homo sapiens
gctggaggcagggcct

SEQ ID NO: 5914890 - DNA, 22 bp, Homo sapiens
gctggaggcaggggcttcctgg

SEQ ID NO: 5914891 - DNA, 16 bp, Homo sapiens
gctggaggcccaggct

SEQ ID NO: 5914892 - DNA, 12 bp, Homo sapiens
gctggaggcctc

SEQ ID NO: 5914893 - DNA, 19 bp, Homo sapiens
gctggaggctccaggactc

SEQ ID NO: 5914894 - DNA, 17 bp, Homo sapiens
gctggagggagaaccca

SEQ ID NO: 5914895 - DNA, 23 bp, Homo sapiens
gctggagggaggcgggggctgcc

SEQ ID NO: 5914896 - DNA, 19 bp, Homo sapiens
gctggagggctgggcaggg

SEQ ID NO: 5914897 - DNA, 13 bp, Homo sapiens
gctggaggggctg

SEQ ID NO: 5914898 - DNA, 19 bp, Homo sapiens
gctggaggggctgtcctcc

SEQ ID NO: 5914899 - DNA, 18 bp, Homo sapiens
gctggagggggcagagtg

SEQ ID NO: 5914900 - DNA, 19 bp, Homo sapiens
gctggaggggtggcccaga

SEQ ID NO: 5914901 - DNA, 21 bp, Homo sapiens
gctggaggggtggcccagagc

SEQ ID NO: 5914902 - DNA, 23 bp, Homo sapiens
gctggaggggtggcccagagcca

SEQ ID NO: 5914903 - DNA, 15 bp, Homo sapiens
gctggaggggtgggg

SEQ ID NO: 5914904 - DNA, 16 bp, Homo sapiens
gctggaggtaaggcct

SEQ ID NO: 5914905 - DNA, 19 bp, Homo sapiens
gctggaggtgggagcagga

SEQ ID NO: 5914906 - DNA, 23 bp, Homo sapiens
gctggaggtggggcgaggcaggc

SEQ ID NO: 5914907 - DNA, 14 bp, Homo sapiens
gctggagtacccag

SEQ ID NO: 5914908 - DNA, 18 bp, Homo sapiens
gctggagtacccagccta

SEQ ID NO: 5914909 - DNA, 13 bp, Homo sapiens
gctggagtccagt

SEQ ID NO: 5914910 - DNA, 14 bp, Homo sapiens
gctggagtccagtg

SEQ ID NO: 5914911 - DNA, 22 bp, Homo sapiens
gctggagtcctctccagagagg

SEQ ID NO: 5914912 - DNA, 16 bp, Homo sapiens
gctggagtcctgttct

SEQ ID NO: 5914913 - DNA, 17 bp, Homo sapiens
gctggagtcctgttctc

SEQ ID NO: 5914914 - DNA, 19 bp, Homo sapiens
gctggagtcctgttctcag

SEQ ID NO: 5914915 - DNA, 22 bp, Homo sapiens
gctggagtcctgttctcagagc

SEQ ID NO: 5914916 - DNA, 15 bp, Homo sapiens
gctggagtctcagag

SEQ ID NO: 5914917 - DNA, 17 bp, Homo sapiens
gctggagtctcagagca

SEQ ID NO: 5914918 - DNA, 20 bp, Homo sapiens
gctggagtctcagagcacag

SEQ ID NO: 5914919 - DNA, 15 bp, Homo sapiens
gctggagtgcagtgg

SEQ ID NO: 5914920 - DNA, 18 bp, Homo sapiens
gctggagtgcagtggtgc

SEQ ID NO: 5914921 - DNA, 19 bp, Homo sapiens
gctggagtgcagtggtgcg

SEQ ID NO: 5914922 - DNA, 12 bp, Homo sapiens
gctggagtgcca

SEQ ID NO: 5914923 - DNA, 21 bp, Homo sapiens
gctggagtgccatggctgggg

SEQ ID NO: 5914924 - DNA, 15 bp, Homo sapiens
gctggagtgctgctt

SEQ ID NO: 5914925 - DNA, 16 bp, Homo sapiens
gctggagtgctggctc

SEQ ID NO: 5914926 - DNA, 18 bp, Homo sapiens
gctggagtgctggctcca

SEQ ID NO: 5914927 - DNA, 14 bp, Homo sapiens
gctggagtgggctc

SEQ ID NO: 5914928 - DNA, 17 bp, Homo sapiens
gctggagttagggactg

SEQ ID NO: 5914929 - DNA, 17 bp, Homo sapiens
gctggatactggacaca

SEQ ID NO: 5914930 - DNA, 19 bp, Homo sapiens
gctggatagacttgggatg

SEQ ID NO: 5914931 - DNA, 20 bp, Homo sapiens
gctggatagacttgggatgg

SEQ ID NO: 5914932 - DNA, 23 bp, Homo sapiens
gctggatcacagctgctttctgt

SEQ ID NO: 5914933 - DNA, 20 bp, Homo sapiens
gctggatctcccagggctac

SEQ ID NO: 5914934 - DNA, 14 bp, Homo sapiens
gctggatctgcttg

SEQ ID NO: 5914935 - DNA, 12 bp, Homo sapiens
gctggatgagca

SEQ ID NO: 5914936 - DNA, 19 bp, Homo sapiens
gctggatgagcaactcctg

SEQ ID NO: 5914937 - DNA, 15 bp, Homo sapiens
gctggatgagctccc

SEQ ID NO: 5914938 - DNA, 22 bp, Homo sapiens
gctggatgctgggttctggggc

SEQ ID NO: 5914939 - DNA, 13 bp, Homo sapiens
gctggatggacag

SEQ ID NO: 5914940 - DNA, 15 bp, Homo sapiens
gctggatggacagac

SEQ ID NO: 5914941 - DNA, 22 bp, Homo sapiens
gctggatggacagacacctccc

SEQ ID NO: 5914942 - DNA, 16 bp, Homo sapiens
gctggatggagcccag

SEQ ID NO: 5914943 - DNA, 12 bp, Homo sapiens
gctggatggcac

SEQ ID NO: 5914944 - DNA, 22 bp, Homo sapiens
gctggatgtctgccaatttttg

SEQ ID NO: 5914945 - DNA, 21 bp, Homo sapiens
gctggatgtgcatctggccta

SEQ ID NO: 5914946 - DNA, 15 bp, Homo sapiens
gctggatgtgctttc

SEQ ID NO: 5914947 - DNA, 16 bp, Homo sapiens
gctggattacaggcat

SEQ ID NO: 5914948 - DNA, 15 bp, Homo sapiens
gctggattgtgcttt

SEQ ID NO: 5914949 - DNA, 16 bp, Homo sapiens
gctggatttgggagct

SEQ ID NO: 5914950 - DNA, 21 bp, Homo sapiens
gctggatttgggagctctgct

SEQ ID NO: 5914951 - DNA, 17 bp, Homo sapiens
gctggcaaatccaggct

SEQ ID NO: 5914952 - DNA, 15 bp, Homo sapiens
gctggcaagcaggga

SEQ ID NO: 5914953 - DNA, 15 bp, Homo sapiens
gctggcacaaaagac

SEQ ID NO: 5914954 - DNA, 18 bp, Homo sapiens
gctggcacaaaagacagc

SEQ ID NO: 5914955 - DNA, 22 bp, Homo sapiens
gctggcacaaaagacagctggc

SEQ ID NO: 5914956 - DNA, 12 bp, Homo sapiens
gctggcacagac

SEQ ID NO: 5914957 - DNA, 21 bp, Homo sapiens
gctggcacagcccctggagcc

SEQ ID NO: 5914958 - DNA, 14 bp, Homo sapiens
gctggcaccagcag

SEQ ID NO: 5914959 - DNA, 16 bp, Homo sapiens
gctggcaccagcaggc

SEQ ID NO: 5914960 - DNA, 12 bp, Homo sapiens
gctggcaccatg

SEQ ID NO: 5914961 - DNA, 21 bp, Homo sapiens
gctggcacccaccgtggagga

SEQ ID NO: 5914962 - DNA, 23 bp, Homo sapiens
gctggcacccaccgtggaggagg

SEQ ID NO: 5914963 - DNA, 11 bp, Homo sapiens
gctggcacctc

SEQ ID NO: 5914964 - DNA, 12 bp, Homo sapiens
gctggcacctca

SEQ ID NO: 5914965 - DNA, 12 bp, Homo sapiens
gctggcactccc

SEQ ID NO: 5914966 - DNA, 13 bp, Homo sapiens
gctggcactgaca

SEQ ID NO: 5914967 - DNA, 17 bp, Homo sapiens
gctggcactgacagcct

SEQ ID NO: 5914968 - DNA, 19 bp, Homo sapiens
gctggcactgacagcctgg

SEQ ID NO: 5914969 - DNA, 23 bp, Homo sapiens
gctggcagagggcatcggtcagc

SEQ ID NO: 5914970 - DNA, 15 bp, Homo sapiens
gctggcagcagagtg

SEQ ID NO: 5914971 - DNA, 13 bp, Homo sapiens
gctggcagccacc

SEQ ID NO: 5914972 - DNA, 14 bp, Homo sapiens
gctggcagcgcctc

SEQ ID NO: 5914973 - DNA, 16 bp, Homo sapiens
gctggcagcgcctccc

SEQ ID NO: 5914974 - DNA, 19 bp, Homo sapiens
gctggcagcgcctcccgcc

SEQ ID NO: 5914975 - DNA, 13 bp, Homo sapiens
gctggcagctctc

SEQ ID NO: 5914976 - DNA, 14 bp, Homo sapiens
gctggcagctctcc

SEQ ID NO: 5914977 - DNA, 16 bp, Homo sapiens
gctggcagctctccag

SEQ ID NO: 5914978 - DNA, 23 bp, Homo sapiens
gctggcaggagacactggtctca

SEQ ID NO: 5914979 - DNA, 20 bp, Homo sapiens
gctggcaggattcttcccgc

SEQ ID NO: 5914980 - DNA, 20 bp, Homo sapiens
gctggcaggcagttctagaa

SEQ ID NO: 5914981 - DNA, 15 bp, Homo sapiens
gctggcagggccagg

SEQ ID NO: 5914982 - DNA, 17 bp, Homo sapiens
gctggcagggccagggc

SEQ ID NO: 5914983 - DNA, 21 bp, Homo sapiens
gctggcagggtccctccagca

SEQ ID NO: 5914984 - DNA, 19 bp, Homo sapiens
gctggcaggtcatggagca

SEQ ID NO: 5914985 - DNA, 22 bp, Homo sapiens
gctggcaggtcatggagcagcc

SEQ ID NO: 5914986 - DNA, 23 bp, Homo sapiens
gctggcaggtcatggagcagccc

SEQ ID NO: 5914987 - DNA, 12 bp, Homo sapiens
gctggcaggtgt

SEQ ID NO: 5914988 - DNA, 17 bp, Homo sapiens
gctggcagtacagagtg

SEQ ID NO: 5914989 - DNA, 16 bp, Homo sapiens
gctggcatagagcagc

SEQ ID NO: 5914990 - DNA, 15 bp, Homo sapiens
gctggcatcctggct

SEQ ID NO: 5914991 - DNA, 21 bp, Homo sapiens
gctggcatcctggctggctgt

SEQ ID NO: 5914992 - DNA, 17 bp, Homo sapiens
gctggcatctcccccac

SEQ ID NO: 5914993 - DNA, 20 bp, Homo sapiens
gctggcatctcccccaccct

SEQ ID NO: 5914994 - DNA, 23 bp, Homo sapiens
gctggcatgtttcactcctgctt

SEQ ID NO: 5914995 - DNA, 16 bp, Homo sapiens
gctggcattacaggtg

SEQ ID NO: 5914996 - DNA, 12 bp, Homo sapiens
gctggccaagga

SEQ ID NO: 5914997 - DNA, 18 bp, Homo sapiens
gctggccaaggtgtccag

SEQ ID NO: 5914998 - DNA, 24 bp, Homo sapiens
gctggccaaggtgtccagggtcct

SEQ ID NO: 5914999 - DNA, 20 bp, Homo sapiens
gctggccaatttttgtactt

SEQ ID NO: 5915000 - DNA, 21 bp, Homo sapiens
gctggccaatttttgtacttt

SEQ ID NO: 5915001 - DNA, 23 bp, Homo sapiens
gctggccacaaggaaaaggagga

SEQ ID NO: 5915002 - DNA, 14 bp, Homo sapiens
gctggccacacagc

SEQ ID NO: 5915003 - DNA, 20 bp, Homo sapiens
gctggccactgcacagagct

SEQ ID NO: 5915004 - DNA, 21 bp, Homo sapiens
gctggccactgcacagagctc

SEQ ID NO: 5915005 - DNA, 20 bp, Homo sapiens
gctggccagcaaggcaggtt

SEQ ID NO: 5915006 - DNA, 13 bp, Homo sapiens
gctggccagcacc

SEQ ID NO: 5915007 - DNA, 15 bp, Homo sapiens
gctggccagcaccct

SEQ ID NO: 5915008 - DNA, 19 bp, Homo sapiens
gctggccagcaccctctcc

SEQ ID NO: 5915009 - DNA, 23 bp, Homo sapiens
gctggccagcaccctctcctggg

SEQ ID NO: 5915010 - DNA, 19 bp, Homo sapiens
gctggccagccccacagcc

SEQ ID NO: 5915011 - DNA, 22 bp, Homo sapiens
gctggccagccccacagcccac

SEQ ID NO: 5915012 - DNA, 21 bp, Homo sapiens
gctggccagccgctctcctgc

SEQ ID NO: 5915013 - DNA, 22 bp, Homo sapiens
gctggccagcctggggcctggc

SEQ ID NO: 5915014 - DNA, 23 bp, Homo sapiens
gctggccagcctggggcctggca

SEQ ID NO: 5915015 - DNA, 12 bp, Homo sapiens
gctggccagctg

SEQ ID NO: 5915016 - DNA, 14 bp, Homo sapiens
gctggccagctgtg

SEQ ID NO: 5915017 - DNA, 16 bp, Homo sapiens
gctggccaggccctga

SEQ ID NO: 5915018 - DNA, 23 bp, Homo sapiens
gctggccatctggttaggatggc

SEQ ID NO: 5915019 - DNA, 21 bp, Homo sapiens
gctggccatgaatctctgcct

SEQ ID NO: 5915020 - DNA, 21 bp, Homo sapiens
gctggcccacagctctgctgg

SEQ ID NO: 5915021 - DNA, 12 bp, Homo sapiens
gctggcccagca

SEQ ID NO: 5915022 - DNA, 17 bp, Homo sapiens
gctggcccagcatggaa

SEQ ID NO: 5915023 - DNA, 14 bp, Homo sapiens
gctggcccagccaa

SEQ ID NO: 5915024 - DNA, 13 bp, Homo sapiens
gctggcccagccg

SEQ ID NO: 5915025 - DNA, 16 bp, Homo sapiens
gctggcccagccggcc

SEQ ID NO: 5915026 - DNA, 20 bp, Homo sapiens
gctggcccagccggcctctc

SEQ ID NO: 5915027 - DNA, 17 bp, Homo sapiens
gctggcccagggcccag

SEQ ID NO: 5915028 - DNA, 19 bp, Homo sapiens
gctggcccagggcccagag

SEQ ID NO: 5915029 - DNA, 15 bp, Homo sapiens
gctggcccagggggc

SEQ ID NO: 5915030 - DNA, 18 bp, Homo sapiens
gctggcccagggggcctg

SEQ ID NO: 5915031 - DNA, 13 bp, Homo sapiens
gctggcccagggt

SEQ ID NO: 5915032 - DNA, 14 bp, Homo sapiens
gctggcccagggta

SEQ ID NO: 5915033 - DNA, 16 bp, Homo sapiens
gctggccccagccctg

SEQ ID NO: 5915034 - DNA, 20 bp, Homo sapiens
gctggccccagggcaccctg

SEQ ID NO: 5915035 - DNA, 15 bp, Homo sapiens
gctggcccccaccca

SEQ ID NO: 5915036 - DNA, 16 bp, Homo sapiens
gctggcccccacccac

SEQ ID NO: 5915037 - DNA, 17 bp, Homo sapiens
gctggcccccacccacc

SEQ ID NO: 5915038 - DNA, 19 bp, Homo sapiens
gctggcccccacccacctt

SEQ ID NO: 5915039 - DNA, 15 bp, Homo sapiens
gctggcccccactgg

SEQ ID NO: 5915040 - DNA, 12 bp, Homo sapiens
gctggcccccag

SEQ ID NO: 5915041 - DNA, 13 bp, Homo sapiens
gctggcccccagc

SEQ ID NO: 5915042 - DNA, 14 bp, Homo sapiens
gctggcccccagga

SEQ ID NO: 5915043 - DNA, 20 bp, Homo sapiens
gctggccccgcccctgcccc

SEQ ID NO: 5915044 - DNA, 11 bp, Homo sapiens
gctggcccctc

SEQ ID NO: 5915045 - DNA, 19 bp, Homo sapiens
gctggcccctcacctgggc

SEQ ID NO: 5915046 - DNA, 14 bp, Homo sapiens
gctggcccctttgg

SEQ ID NO: 5915047 - DNA, 13 bp, Homo sapiens
gctggcccgggga

SEQ ID NO: 5915048 - DNA, 19 bp, Homo sapiens
gctggcccgtgacagactc

SEQ ID NO: 5915049 - DNA, 19 bp, Homo sapiens
gctggccctacttccagga

SEQ ID NO: 5915050 - DNA, 22 bp, Homo sapiens
gctggccctacttccaggatgg

SEQ ID NO: 5915051 - DNA, 14 bp, Homo sapiens
gctggggagcccta

SEQ ID NO: 5915052 - DNA, 22 bp, Homo sapiens
gctggggagccctattgctgct

SEQ ID NO: 5915053 - DNA, 13 bp, Homo sapiens
gctggggagcgaa

SEQ ID NO: 5915054 - DNA, 21 bp, Homo sapiens
gctggggagcgaaagtttctt

SEQ ID NO: 5915055 - DNA, 22 bp, Homo sapiens
gctggggaggaccagggccctg

SEQ ID NO: 5915056 - DNA, 13 bp, Homo sapiens
gctggggaggagc

SEQ ID NO: 5915057 - DNA, 13 bp, Homo sapiens
gctggggaggtgc

SEQ ID NO: 5915058 - DNA, 14 bp, Homo sapiens
gctggggaggtgct

SEQ ID NO: 5915059 - DNA, 22 bp, Homo sapiens
gctggggaggtgggaggccagg

SEQ ID NO: 5915060 - DNA, 23 bp, Homo sapiens
gctggggaggtgggaggccaggc

SEQ ID NO: 5915061 - DNA, 14 bp, Homo sapiens
gctggggagtccct

SEQ ID NO: 5915062 - DNA, 16 bp, Homo sapiens
gctggggatgcgcctg

SEQ ID NO: 5915063 - DNA, 12 bp, Homo sapiens
gctggggcagag

SEQ ID NO: 5915064 - DNA, 13 bp, Homo sapiens
gctggggcagagg

SEQ ID NO: 5915065 - DNA, 14 bp, Homo sapiens
gctggggcagaggg

SEQ ID NO: 5915066 - DNA, 22 bp, Homo sapiens
gctggggcagaggggcagccgc

SEQ ID NO: 5915067 - DNA, 21 bp, Homo sapiens
gctggggcagagtggagccca

SEQ ID NO: 5915068 - DNA, 22 bp, Homo sapiens
gctggggcagagtggagcccag

SEQ ID NO: 5915069 - DNA, 14 bp, Homo sapiens
gctggggcaggctc

SEQ ID NO: 5915070 - DNA, 17 bp, Homo sapiens
gctggggcagggggtga

SEQ ID NO: 5915071 - DNA, 18 bp, Homo sapiens
gctggggcatgtgtgcct

SEQ ID NO: 5915072 - DNA, 18 bp, Homo sapiens
gctggggccaagaggaaa

SEQ ID NO: 5915073 - DNA, 13 bp, Homo sapiens
gctggggccacaa

SEQ ID NO: 5915074 - DNA, 16 bp, Homo sapiens
gctggggccagaggct

SEQ ID NO: 5915075 - DNA, 12 bp, Homo sapiens
gctggggccagg

SEQ ID NO: 5915076 - DNA, 14 bp, Homo sapiens
gctggggccaggcc

SEQ ID NO: 5915077 - DNA, 15 bp, Homo sapiens
gctggggccaggccc

SEQ ID NO: 5915078 - DNA, 22 bp, Homo sapiens
gctggggccagtgtaaggcata

SEQ ID NO: 5915079 - DNA, 20 bp, Homo sapiens
gctggggccccatcttgatc

SEQ ID NO: 5915080 - DNA, 21 bp, Homo sapiens
gctggggccgccacggcctgg

SEQ ID NO: 5915081 - DNA, 15 bp, Homo sapiens
gctggggccggagcc

SEQ ID NO: 5915082 - DNA, 12 bp, Homo sapiens
gctggggccggg

SEQ ID NO: 5915083 - DNA, 18 bp, Homo sapiens
gctggggccggggctgcc

SEQ ID NO: 5915084 - DNA, 20 bp, Homo sapiens
gctggggcctatcagtgtgc

SEQ ID NO: 5915085 - DNA, 17 bp, Homo sapiens
gctggggcctggaggcc

SEQ ID NO: 5915086 - DNA, 14 bp, Homo sapiens
gctggggcctggcc

SEQ ID NO: 5915087 - DNA, 13 bp, Homo sapiens
gctggggcctggg

SEQ ID NO: 5915088 - DNA, 14 bp, Homo sapiens
gctggggcggggcc

SEQ ID NO: 5915089 - DNA, 17 bp, Homo sapiens
gctggggcgtggggagg

SEQ ID NO: 5915090 - DNA, 19 bp, Homo sapiens
gctggggcgtggggagggc

SEQ ID NO: 5915091 - DNA, 12 bp, Homo sapiens
gctggggctagg

SEQ ID NO: 5915092 - DNA, 17 bp, Homo sapiens
gctggggctctctgaga

SEQ ID NO: 5915093 - DNA, 15 bp, Homo sapiens
gctggggctgacctt

SEQ ID NO: 5915094 - DNA, 16 bp, Homo sapiens
gctggggctgccagcc

SEQ ID NO: 5915095 - DNA, 17 bp, Homo sapiens
gctggggctgccagcct

SEQ ID NO: 5915096 - DNA, 21 bp, Homo sapiens
gctggggctgccagcctgagc

SEQ ID NO: 5915097 - DNA, 14 bp, Homo sapiens
gctggggctgctcc

SEQ ID NO: 5915098 - DNA, 14 bp, Homo sapiens
gctggggctggcac

SEQ ID NO: 5915099 - DNA, 19 bp, Homo sapiens
gctggggcttatgggtggc

SEQ ID NO: 5915100 - DNA, 16 bp, Homo sapiens
gctgggggaaggcagg

SEQ ID NO: 5915101 - DNA, 15 bp, Homo sapiens
gctgggggactgctt

SEQ ID NO: 5915102 - DNA, 19 bp, Homo sapiens
gctgggggactggggggcc

SEQ ID NO: 5915103 - DNA, 15 bp, Homo sapiens
gctgggggagggact

SEQ ID NO: 5915104 - DNA, 16 bp, Homo sapiens
gctgggggagggactg

SEQ ID NO: 5915105 - DNA, 18 bp, Homo sapiens
gctgggggagggactgct

SEQ ID NO: 5915106 - DNA, 14 bp, Homo sapiens
gctgggggcacagc

SEQ ID NO: 5915107 - DNA, 16 bp, Homo sapiens
gctgggggcacagctg

SEQ ID NO: 5915108 - DNA, 21 bp, Homo sapiens
gctgggggcagcctgcgtggc

SEQ ID NO: 5915109 - DNA, 22 bp, Homo sapiens
gctgggggcagcctgcgtggct

SEQ ID NO: 5915110 - DNA, 23 bp, Homo sapiens
gctgggggcaggagggccctacc

SEQ ID NO: 5915111 - DNA, 20 bp, Homo sapiens
gctgggggcatgggggaggc

SEQ ID NO: 5915112 - DNA, 15 bp, Homo sapiens
gctgggggccagctc

SEQ ID NO: 5915113 - DNA, 19 bp, Homo sapiens
gctgggggccagggctgga

SEQ ID NO: 5915114 - DNA, 23 bp, Homo sapiens
gctgggggccatgagctccagac

SEQ ID NO: 5915115 - DNA, 14 bp, Homo sapiens
gctgggggcctcac

SEQ ID NO: 5915116 - DNA, 15 bp, Homo sapiens
gctgggggcctcagt

SEQ ID NO: 5915117 - DNA, 19 bp, Homo sapiens
gctgggggcctcagtgcca

SEQ ID NO: 5915118 - DNA, 16 bp, Homo sapiens
gctgggggctgcaggg

SEQ ID NO: 5915119 - DNA, 22 bp, Homo sapiens
gctgggggctgccgagccacca

SEQ ID NO: 5915120 - DNA, 12 bp, Homo sapiens
gctgggggctgg

SEQ ID NO: 5915121 - DNA, 13 bp, Homo sapiens
gctgggggctggc

SEQ ID NO: 5915122 - DNA, 17 bp, Homo sapiens
gctgggggctggcagag

SEQ ID NO: 5915123 - DNA, 18 bp, Homo sapiens
gctggggggatgacggcc

SEQ ID NO: 5915124 - DNA, 20 bp, Homo sapiens
gctggggggatgacggccag

SEQ ID NO: 5915125 - DNA, 21 bp, Homo sapiens
gctggggggatgacggccagg

SEQ ID NO: 5915126 - DNA, 22 bp, Homo sapiens
gctggggggcaggggggagagg

SEQ ID NO: 5915127 - DNA, 17 bp, Homo sapiens
gctggggggctgtcctg

SEQ ID NO: 5915128 - DNA, 13 bp, Homo sapiens
gctgggggtagcc

SEQ ID NO: 5915129 - DNA, 17 bp, Homo sapiens
gctgggggtagcctgga

SEQ ID NO: 5915130 - DNA, 16 bp, Homo sapiens
gctgggggtgctggat

SEQ ID NO: 5915131 - DNA, 15 bp, Homo sapiens
gctgggggtgggcca

SEQ ID NO: 5915132 - DNA, 23 bp, Homo sapiens
gctggggtaggctgtctgtgcca

SEQ ID NO: 5915133 - DNA, 16 bp, Homo sapiens
gctggggtcacagagg

SEQ ID NO: 5915134 - DNA, 14 bp, Homo sapiens
gctggggtcccagc

SEQ ID NO: 5915135 - DNA, 18 bp, Homo sapiens
gctggggtcctcctgtgc

SEQ ID NO: 5915136 - DNA, 22 bp, Homo sapiens
gctggggtctgggcagtgccac

SEQ ID NO: 5915137 - DNA, 20 bp, Homo sapiens
gctggggtcttgggttcctg

SEQ ID NO: 5915138 - DNA, 14 bp, Homo sapiens
gctggggtgcactg

SEQ ID NO: 5915139 - DNA, 12 bp, Homo sapiens
gctggggtgcag

SEQ ID NO: 5915140 - DNA, 13 bp, Homo sapiens
gctggggtgcagg

SEQ ID NO: 5915141 - DNA, 20 bp, Homo sapiens
gctggggtgcagggatgtgg

SEQ ID NO: 5915142 - DNA, 22 bp, Homo sapiens
gctggggtggggacctcaggcc

SEQ ID NO: 5915143 - DNA, 23 bp, Homo sapiens
gctggggttatctgaagtcagat

SEQ ID NO: 5915144 - DNA, 18 bp, Homo sapiens
gctgggtaagagcacagg

SEQ ID NO: 5915145 - DNA, 19 bp, Homo sapiens
gctgggtactgactgagat

SEQ ID NO: 5915146 - DNA, 20 bp, Homo sapiens
gctgggtataagcagagagg

SEQ ID NO: 5915147 - DNA, 15 bp, Homo sapiens
gctgggtattggaaa

SEQ ID NO: 5915148 - DNA, 21 bp, Homo sapiens
gctgggtcaaaagagccctgg

SEQ ID NO: 5915149 - DNA, 13 bp, Homo sapiens
gctgggtcacagg

SEQ ID NO: 5915150 - DNA, 16 bp, Homo sapiens
gctgggtcacaggaag

SEQ ID NO: 5915151 - DNA, 12 bp, Homo sapiens
gctgggtcacca

SEQ ID NO: 5915152 - DNA, 14 bp, Homo sapiens
gctgggtcaggggt

SEQ ID NO: 5915153 - DNA, 15 bp, Homo sapiens
gctgggtcaggggta

SEQ ID NO: 5915154 - DNA, 14 bp, Homo sapiens
gctgggtccaccct

SEQ ID NO: 5915155 - DNA, 19 bp, Homo sapiens
gctgggtccaccctgtcct

SEQ ID NO: 5915156 - DNA, 15 bp, Homo sapiens
gctgggtcctctgca

SEQ ID NO: 5915157 - DNA, 15 bp, Homo sapiens
gctgggtcctgccag

SEQ ID NO: 5915158 - DNA, 16 bp, Homo sapiens
gctgggtcctgccagc

SEQ ID NO: 5915159 - DNA, 18 bp, Homo sapiens
gctgggtcctgccagctg

SEQ ID NO: 5915160 - DNA, 15 bp, Homo sapiens
gctgggtccttgggc

SEQ ID NO: 5915161 - DNA, 15 bp, Homo sapiens
gctgggtcgcccctc

SEQ ID NO: 5915162 - DNA, 20 bp, Homo sapiens
gctgggtctaatccttctca

SEQ ID NO: 5915163 - DNA, 19 bp, Homo sapiens
gctgggtctgaggcccctg

SEQ ID NO: 5915164 - DNA, 20 bp, Homo sapiens
gctgggtctgaggcccctgc

SEQ ID NO: 5915165 - DNA, 21 bp, Homo sapiens
gctgggtctgaggcccctgcc

SEQ ID NO: 5915166 - DNA, 17 bp, Homo sapiens
gctgggtgccaggtgct

SEQ ID NO: 5915167 - DNA, 15 bp, Homo sapiens
gctgggtgcccacag

SEQ ID NO: 5915168 - DNA, 12 bp, Homo sapiens
gctgggtgcctg

SEQ ID NO: 5915169 - DNA, 16 bp, Homo sapiens
gctgggtgccttgcat

SEQ ID NO: 5915170 - DNA, 20 bp, Homo sapiens
gctgggtggcccatcccccc

SEQ ID NO: 5915171 - DNA, 21 bp, Homo sapiens
gctgggtggcccatcccccct

SEQ ID NO: 5915172 - DNA, 22 bp, Homo sapiens
gctgggtggcccatcccccctc

SEQ ID NO: 5915173 - DNA, 17 bp, Homo sapiens
gctgggtggccggccct

SEQ ID NO: 5915174 - DNA, 18 bp, Homo sapiens
gctgggtggccggccctg

SEQ ID NO: 5915175 - DNA, 22 bp, Homo sapiens
gctgggtggccggccctgcccc

SEQ ID NO: 5915176 - DNA, 15 bp, Homo sapiens
gctgggtggggacag

SEQ ID NO: 5915177 - DNA, 12 bp, Homo sapiens
gctgggtggggc

SEQ ID NO: 5915178 - DNA, 22 bp, Homo sapiens
gctgggtgtattaggactggct

SEQ ID NO: 5915179 - DNA, 22 bp, Homo sapiens
gctgggtgtgtttcaggacagc

SEQ ID NO: 5915180 - DNA, 17 bp, Homo sapiens
gctgggttcccactccc

SEQ ID NO: 5915181 - DNA, 17 bp, Homo sapiens
gctgggttccgggaggc

SEQ ID NO: 5915182 - DNA, 17 bp, Homo sapiens
gctgggttctacccagg

SEQ ID NO: 5915183 - DNA, 18 bp, Homo sapiens
gctgggttctacccaggt

SEQ ID NO: 5915184 - DNA, 20 bp, Homo sapiens
gctgggttctacccaggtgc

SEQ ID NO: 5915185 - DNA, 19 bp, Homo sapiens
gctgggttgtcactgagac

SEQ ID NO: 5915186 - DNA, 20 bp, Homo sapiens
gctgggtttccacacagcct

SEQ ID NO: 5915187 - DNA, 13 bp, Homo sapiens
gctgggtttgctg

SEQ ID NO: 5915188 - DNA, 17 bp, Homo sapiens
gctgggtttgctgtctt

SEQ ID NO: 5915189 - DNA, 18 bp, Homo sapiens
gctgggttttcaggggct

SEQ ID NO: 5915190 - DNA, 17 bp, Homo sapiens
gctggtaaaaatgacaa

SEQ ID NO: 5915191 - DNA, 16 bp, Homo sapiens
gctggtaaaatgaaga

SEQ ID NO: 5915192 - DNA, 23 bp, Homo sapiens
gctggtaaaatgaagaatttaaa

SEQ ID NO: 5915193 - DNA, 15 bp, Homo sapiens
gctggtaaactattt

SEQ ID NO: 5915194 - DNA, 15 bp, Homo sapiens
gctggtaaatgacat

SEQ ID NO: 5915195 - DNA, 16 bp, Homo sapiens
gctggtaaatgacatc

SEQ ID NO: 5915196 - DNA, 15 bp, Homo sapiens
gctggtaagggacct

SEQ ID NO: 5915197 - DNA, 19 bp, Homo sapiens
gctggtaagggaccttcag

SEQ ID NO: 5915198 - DNA, 23 bp, Homo sapiens
gctggtaagggaccttcagggag

SEQ ID NO: 5915199 - DNA, 23 bp, Homo sapiens
gctggtaagggccaagtcccacc

SEQ ID NO: 5915200 - DNA, 19 bp, Homo sapiens
gctggtagagacccccagg

SEQ ID NO: 5915201 - DNA, 14 bp, Homo sapiens
gctggtagagatgg

SEQ ID NO: 5915202 - DNA, 15 bp, Homo sapiens
gctggtagagatgga

SEQ ID NO: 5915203 - DNA, 21 bp, Homo sapiens
gctggtagagatggaggagga

SEQ ID NO: 5915204 - DNA, 23 bp, Homo sapiens
gctggtagagatggaggaggagg

SEQ ID NO: 5915205 - DNA, 14 bp, Homo sapiens
gctggtagagcagg

SEQ ID NO: 5915206 - DNA, 20 bp, Homo sapiens
gctggtagatgctgaggccc

SEQ ID NO: 5915207 - DNA, 16 bp, Homo sapiens
gctggtagctagtgat

SEQ ID NO: 5915208 - DNA, 16 bp, Homo sapiens
gctggtagctgagggg

SEQ ID NO: 5915209 - DNA, 18 bp, Homo sapiens
gctggtagctgaggggac

SEQ ID NO: 5915210 - DNA, 19 bp, Homo sapiens
gctggtagctgaggggacg

SEQ ID NO: 5915211 - DNA, 19 bp, Homo sapiens
gctggtaggcattccagct

SEQ ID NO: 5915212 - DNA, 15 bp, Homo sapiens
gctggtatctcagaa

SEQ ID NO: 5915213 - DNA, 17 bp, Homo sapiens
gctggtattctctctat

SEQ ID NO: 5915214 - DNA, 13 bp, Homo sapiens
gctggtatttcta

SEQ ID NO: 5915215 - DNA, 15 bp, Homo sapiens
gctggtatttctaat

SEQ ID NO: 5915216 - DNA, 18 bp, Homo sapiens
gctggtcacacaaggaac

SEQ ID NO: 5915217 - DNA, 15 bp, Homo sapiens
gctggtcacagcctc

SEQ ID NO: 5915218 - DNA, 20 bp, Homo sapiens
gctggtcacagcctcctctg

SEQ ID NO: 5915219 - DNA, 12 bp, Homo sapiens
gctggtcacccc

SEQ ID NO: 5915220 - DNA, 14 bp, Homo sapiens
gctggtcacctccc

SEQ ID NO: 5915221 - DNA, 13 bp, Homo sapiens
gctggtcactctg

SEQ ID NO: 5915222 - DNA, 17 bp, Homo sapiens
gctggtcactctgccct

SEQ ID NO: 5915223 - DNA, 18 bp, Homo sapiens
gctggtcactctgccctc

SEQ ID NO: 5915224 - DNA, 21 bp, Homo sapiens
gctggtcactctgccctctgc

SEQ ID NO: 5915225 - DNA, 23 bp, Homo sapiens
gctggtcactctgccctctgctg

SEQ ID NO: 5915226 - DNA, 14 bp, Homo sapiens
gctggtcagagacg

SEQ ID NO: 5915227 - DNA, 19 bp, Homo sapiens
gctggtcaggtccccatgg

SEQ ID NO: 5915228 - DNA, 17 bp, Homo sapiens
gctggtcagtctttgct

SEQ ID NO: 5915229 - DNA, 19 bp, Homo sapiens
gctgtagatggtgacctgg

SEQ ID NO: 5915230 - DNA, 17 bp, Homo sapiens
gctgtagccatggctca

SEQ ID NO: 5915231 - DNA, 13 bp, Homo sapiens
gctgtaggtgtgc

SEQ ID NO: 5915232 - DNA, 21 bp, Homo sapiens
gctgtagtagccctttctgtg

SEQ ID NO: 5915233 - DNA, 23 bp, Homo sapiens
gctgtagtaggcatttttaccat

SEQ ID NO: 5915234 - DNA, 21 bp, Homo sapiens
gctgtagtcctttctgccttg

SEQ ID NO: 5915235 - DNA, 20 bp, Homo sapiens
gctgtataaaatcagccaat

SEQ ID NO: 5915236 - DNA, 22 bp, Homo sapiens
gctgtataaggtaataaaactc

SEQ ID NO: 5915237 - DNA, 14 bp, Homo sapiens
gctgtatatatttt

SEQ ID NO: 5915238 - DNA, 17 bp, Homo sapiens
gctgtatatatttttct

SEQ ID NO: 5915239 - DNA, 17 bp, Homo sapiens
gctgtatcccatgagcc

SEQ ID NO: 5915240 - DNA, 23 bp, Homo sapiens
gctgtatcccatgagcctcagca

SEQ ID NO: 5915241 - DNA, 16 bp, Homo sapiens
gctgtatctatttttt

SEQ ID NO: 5915242 - DNA, 16 bp, Homo sapiens
gctgtatctgtaatta

SEQ ID NO: 5915243 - DNA, 14 bp, Homo sapiens
gctgtatcttgttt

SEQ ID NO: 5915244 - DNA, 18 bp, Homo sapiens
gctgtatcttgtttttcc

SEQ ID NO: 5915245 - DNA, 22 bp, Homo sapiens
gctgtatgaatattttatatta

SEQ ID NO: 5915246 - DNA, 19 bp, Homo sapiens
gctgtatgacccctggcca

SEQ ID NO: 5915247 - DNA, 14 bp, Homo sapiens
gctgtatgaggaga

SEQ ID NO: 5915248 - DNA, 16 bp, Homo sapiens
gctgtatgatttgttt

SEQ ID NO: 5915249 - DNA, 17 bp, Homo sapiens
gctgtatggcccaggca

SEQ ID NO: 5915250 - DNA, 21 bp, Homo sapiens
gctgtatggcccaggcagcct

SEQ ID NO: 5915251 - DNA, 16 bp, Homo sapiens
gctgtattaagtgact

SEQ ID NO: 5915252 - DNA, 22 bp, Homo sapiens
gctgtattatcttaaacccaca

SEQ ID NO: 5915253 - DNA, 23 bp, Homo sapiens
gctgtattcatatattgcatttc

SEQ ID NO: 5915254 - DNA, 13 bp, Homo sapiens
gctgtattcatga

SEQ ID NO: 5915255 - DNA, 13 bp, Homo sapiens
gctgtattcttct

SEQ ID NO: 5915256 - DNA, 17 bp, Homo sapiens
gctgtattgaatcatgt

SEQ ID NO: 5915257 - DNA, 15 bp, Homo sapiens
gctgtattgccccca

SEQ ID NO: 5915258 - DNA, 12 bp, Homo sapiens
gctgtattgtct

SEQ ID NO: 5915259 - DNA, 14 bp, Homo sapiens
gctgtattgtctga

SEQ ID NO: 5915260 - DNA, 15 bp, Homo sapiens
gctgtattgtctgaa

SEQ ID NO: 5915261 - DNA, 16 bp, Homo sapiens
gctgtatttacagaca

SEQ ID NO: 5915262 - DNA, 17 bp, Homo sapiens
gctgtatttgaggaaac

SEQ ID NO: 5915263 - DNA, 12 bp, Homo sapiens
gctgtattttaa

SEQ ID NO: 5915264 - DNA, 21 bp, Homo sapiens
gctgtattttaaaagaatgat

SEQ ID NO: 5915265 - DNA, 14 bp, Homo sapiens
gctgtattttaaag

SEQ ID NO: 5915266 - DNA, 18 bp, Homo sapiens
gctgtattttaacacttt

SEQ ID NO: 5915267 - DNA, 14 bp, Homo sapiens
gctgtattttgagt

SEQ ID NO: 5915268 - DNA, 23 bp, Homo sapiens
gctgtattttgagtttcagctgg

SEQ ID NO: 5915269 - DNA, 15 bp, Homo sapiens
gctgtattttgatat

SEQ ID NO: 5915270 - DNA, 14 bp, Homo sapiens
gctgtatttttatt

SEQ ID NO: 5915271 - DNA, 21 bp, Homo sapiens
gctgtcaaaactactgacagg

SEQ ID NO: 5915272 - DNA, 21 bp, Homo sapiens
gctgtcaaatccatgtgtccc

SEQ ID NO: 5915273 - DNA, 22 bp, Homo sapiens
gctgtcaaatccatgtgtcccc

SEQ ID NO: 5915274 - DNA, 20 bp, Homo sapiens
gctgtcaaggccgagggcca

SEQ ID NO: 5915275 - DNA, 21 bp, Homo sapiens
gctgtcaaggccgagggccag

SEQ ID NO: 5915276 - DNA, 23 bp, Homo sapiens
gctgtcaaggccgagggccaggc

SEQ ID NO: 5915277 - DNA, 22 bp, Homo sapiens
gctgtcaataaatgacacccag

SEQ ID NO: 5915278 - DNA, 20 bp, Homo sapiens
gctgtcaatgggacctgtgg

SEQ ID NO: 5915279 - DNA, 22 bp, Homo sapiens
gctgtcaatgggacctgtggct

SEQ ID NO: 5915280 - DNA, 19 bp, Homo sapiens
gctgtcacccagcaaggca

SEQ ID NO: 5915281 - DNA, 22 bp, Homo sapiens
gctgtcacccagcaaggcacag

SEQ ID NO: 5915282 - DNA, 21 bp, Homo sapiens
gctgtcacctctcagctgctg

SEQ ID NO: 5915283 - DNA, 22 bp, Homo sapiens
gctgtcacctctcagctgctgg

SEQ ID NO: 5915284 - DNA, 21 bp, Homo sapiens
gctgtcacctctcccacggga

SEQ ID NO: 5915285 - DNA, 22 bp, Homo sapiens
gctgtcacctctcccacgggac

SEQ ID NO: 5915286 - DNA, 20 bp, Homo sapiens
gctgtcactggcagagcaca

SEQ ID NO: 5915287 - DNA, 15 bp, Homo sapiens
gctgtcactggctgg

SEQ ID NO: 5915288 - DNA, 23 bp, Homo sapiens
gctgtcactggctggctcctagg

SEQ ID NO: 5915289 - DNA, 20 bp, Homo sapiens
gctgtcacttagggataaca

SEQ ID NO: 5915290 - DNA, 15 bp, Homo sapiens
gctgtcacttcttca

SEQ ID NO: 5915291 - DNA, 18 bp, Homo sapiens
gctgtcactttctctctt

SEQ ID NO: 5915292 - DNA, 14 bp, Homo sapiens
gctgtcagaagttt

SEQ ID NO: 5915293 - DNA, 22 bp, Homo sapiens
gctgtcagaccttcttccacag

SEQ ID NO: 5915294 - DNA, 16 bp, Homo sapiens
gctgtcagataccctg

SEQ ID NO: 5915295 - DNA, 12 bp, Homo sapiens
gctgtcagccaa

SEQ ID NO: 5915296 - DNA, 17 bp, Homo sapiens
gctgtcagccattcctg

SEQ ID NO: 5915297 - DNA, 18 bp, Homo sapiens
gctgtcagccctgctgtc

SEQ ID NO: 5915298 - DNA, 14 bp, Homo sapiens
gctgtcagcctggc

SEQ ID NO: 5915299 - DNA, 17 bp, Homo sapiens
gctgtcagcgcctcaag

SEQ ID NO: 5915300 - DNA, 18 bp, Homo sapiens
gctgtcaggattgcgaga

SEQ ID NO: 5915301 - DNA, 23 bp, Homo sapiens
gctgtcaggattgcgagagatgt

SEQ ID NO: 5915302 - DNA, 24 bp, Homo sapiens
gctgtcaggattgcgagagatgtg

SEQ ID NO: 5915303 - DNA, 15 bp, Homo sapiens
gctgtcagtgtttgg

SEQ ID NO: 5915304 - DNA, 20 bp, Homo sapiens
gctgtcataaaatgaaactt

SEQ ID NO: 5915305 - DNA, 14 bp, Homo sapiens
gctgtcatcaacat

SEQ ID NO: 5915306 - DNA, 23 bp, Homo sapiens
gctgtcatcaattgaatggtcag

SEQ ID NO: 5915307 - DNA, 14 bp, Homo sapiens
gctgtcatgcccag

SEQ ID NO: 5915308 - DNA, 16 bp, Homo sapiens
gctgtcatgcccagct

SEQ ID NO: 5915309 - DNA, 18 bp, Homo sapiens
gctgtcatgcccagcttg

SEQ ID NO: 5915310 - DNA, 18 bp, Homo sapiens
gctgtcatggaaaagccc

SEQ ID NO: 5915311 - DNA, 20 bp, Homo sapiens
gctgtcatggaaaagcccag

SEQ ID NO: 5915312 - DNA, 17 bp, Homo sapiens
gctgtcatgtggaaact

SEQ ID NO: 5915313 - DNA, 19 bp, Homo sapiens
gctgtcattcaggacccca

SEQ ID NO: 5915314 - DNA, 15 bp, Homo sapiens
gctgtcattgtccat

SEQ ID NO: 5915315 - DNA, 19 bp, Homo sapiens
gctgtcatttcattgcact

SEQ ID NO: 5915316 - DNA, 23 bp, Homo sapiens
gctgtccaatttctattaaaggt

SEQ ID NO: 5915317 - DNA, 18 bp, Homo sapiens
gctgtccagacagcctgt

SEQ ID NO: 5915318 - DNA, 22 bp, Homo sapiens
gctgtccagacagcctgtatct

SEQ ID NO: 5915319 - DNA, 13 bp, Homo sapiens
gctgtccaggcag

SEQ ID NO: 5915320 - DNA, 19 bp, Homo sapiens
gctgtccaggcagctccct

SEQ ID NO: 5915321 - DNA, 22 bp, Homo sapiens
gctgtccaggcagctccctcct

SEQ ID NO: 5915322 - DNA, 13 bp, Homo sapiens
gctgtccagtgcc

SEQ ID NO: 5915323 - DNA, 15 bp, Homo sapiens
gctgtccagtgccca

SEQ ID NO: 5915324 - DNA, 16 bp, Homo sapiens
gctgtccagtgcccat

SEQ ID NO: 5915325 - DNA, 17 bp, Homo sapiens
gctgtccagtgcctaca

SEQ ID NO: 5915326 - DNA, 16 bp, Homo sapiens
gctgtccatgcttctc

SEQ ID NO: 5915327 - DNA, 16 bp, Homo sapiens
gctgtcccagccccgg

SEQ ID NO: 5915328 - DNA, 23 bp, Homo sapiens
gctgtcccaggcatgcagctgcc

SEQ ID NO: 5915329 - DNA, 13 bp, Homo sapiens
gctgtcccagggg

SEQ ID NO: 5915330 - DNA, 22 bp, Homo sapiens
gctgtcccaggggtctccctga

SEQ ID NO: 5915331 - DNA, 20 bp, Homo sapiens
gctgtcccatagtccctgcc

SEQ ID NO: 5915332 - DNA, 21 bp, Homo sapiens
gctgtcccatagtccctgcca

SEQ ID NO: 5915333 - DNA, 22 bp, Homo sapiens
gctgtcccatctccactgttat

SEQ ID NO: 5915334 - DNA, 17 bp, Homo sapiens
gctgtcccctccatctg

SEQ ID NO: 5915335 - DNA, 20 bp, Homo sapiens
gctgtcccctccatctgggg

SEQ ID NO: 5915336 - DNA, 15 bp, Homo sapiens
gctgtcccctctgtc

SEQ ID NO: 5915337 - DNA, 16 bp, Homo sapiens
gctgtcccctcttgcc

SEQ ID NO: 5915338 - DNA, 14 bp, Homo sapiens
gctgtccccttcca

SEQ ID NO: 5915339 - DNA, 14 bp, Homo sapiens
gctgtcccggaggc

SEQ ID NO: 5915340 - DNA, 15 bp, Homo sapiens
gctgtccctcctgag

SEQ ID NO: 5915341 - DNA, 20 bp, Homo sapiens
gctgtccctcctgaggtctg

SEQ ID NO: 5915342 - DNA, 21 bp, Homo sapiens
gctgtccctcctgaggtctgg

SEQ ID NO: 5915343 - DNA, 15 bp, Homo sapiens
gctgtccctgcactg

SEQ ID NO: 5915344 - DNA, 19 bp, Homo sapiens
gctgtccctgcactgtgcc

SEQ ID NO: 5915345 - DNA, 21 bp, Homo sapiens
gctgtccctgcactgtgcccc

SEQ ID NO: 5915346 - DNA, 22 bp, Homo sapiens
gctgtccctgcactgtgccccg

SEQ ID NO: 5915347 - DNA, 13 bp, Homo sapiens
gctgtccctgtca

SEQ ID NO: 5915348 - DNA, 14 bp, Homo sapiens
gctgtccctgtcac

SEQ ID NO: 5915349 - DNA, 18 bp, Homo sapiens
gctgtccctgtcaccaag

SEQ ID NO: 5915350 - DNA, 23 bp, Homo sapiens
gctgtccctgtgggctcacaccg

SEQ ID NO: 5915351 - DNA, 20 bp, Homo sapiens
gctgtcccttggaactcttg

SEQ ID NO: 5915352 - DNA, 15 bp, Homo sapiens
gctgtccgtcctgct

SEQ ID NO: 5915353 - DNA, 16 bp, Homo sapiens
gctgtccgtcctgctc

SEQ ID NO: 5915354 - DNA, 14 bp, Homo sapiens
gctgtcctaggcca

SEQ ID NO: 5915355 - DNA, 16 bp, Homo sapiens
gctgtcctaggccaca

SEQ ID NO: 5915356 - DNA, 20 bp, Homo sapiens
gctgtcctccagggcgagca

SEQ ID NO: 5915357 - DNA, 14 bp, Homo sapiens
gctgtcctcctggc

SEQ ID NO: 5915358 - DNA, 18 bp, Homo sapiens
gctgtcctcctggcacct

SEQ ID NO: 5915359 - DNA, 12 bp, Homo sapiens
gctgtcctcctt

SEQ ID NO: 5915360 - DNA, 17 bp, Homo sapiens
gctgtcctccttcctgg

SEQ ID NO: 5915361 - DNA, 22 bp, Homo sapiens
gctgtcctctcagaactcctgt

SEQ ID NO: 5915362 - DNA, 23 bp, Homo sapiens
gctgtcctctcagaactcctgtg

SEQ ID NO: 5915363 - DNA, 13 bp, Homo sapiens
gctgtcctctccc

SEQ ID NO: 5915364 - DNA, 20 bp, Homo sapiens
gctgtcctctcgagcccaga

SEQ ID NO: 5915365 - DNA, 13 bp, Homo sapiens
gctgtcctgaacc

SEQ ID NO: 5915366 - DNA, 20 bp, Homo sapiens
gctgtcctgagccccctgca

SEQ ID NO: 5915367 - DNA, 21 bp, Homo sapiens
gctgtcctgagccccctgcac

SEQ ID NO: 5915368 - DNA, 22 bp, Homo sapiens
gctgtcctgcgttcagcccctg

SEQ ID NO: 5915369 - DNA, 12 bp, Homo sapiens
gctgtcctgctc

SEQ ID NO: 5915370 - DNA, 13 bp, Homo sapiens
gctgtcctgctgc

SEQ ID NO: 5915371 - DNA, 18 bp, Homo sapiens
gctgtcctgctgccctcc

SEQ ID NO: 5915372 - DNA, 14 bp, Homo sapiens
gctgtcctgctgtg

SEQ ID NO: 5915373 - DNA, 17 bp, Homo sapiens
gctgtcctgctgtgtga

SEQ ID NO: 5915374 - DNA, 14 bp, Homo sapiens
gctgtcctggtggc

SEQ ID NO: 5915375 - DNA, 22 bp, Homo sapiens
gctgtcctgtgatgtcagcggt

SEQ ID NO: 5915376 - DNA, 22 bp, Homo sapiens
gctgtccttaacccacctctcc

SEQ ID NO: 5915377 - DNA, 19 bp, Homo sapiens
gctgtccttagactccttc

SEQ ID NO: 5915378 - DNA, 21 bp, Homo sapiens
gctgtccttagactccttctc

SEQ ID NO: 5915379 - DNA, 17 bp, Homo sapiens
gctgtccttccccttcc

SEQ ID NO: 5915380 - DNA, 22 bp, Homo sapiens
gctgtccttccccttccccgtc

SEQ ID NO: 5915381 - DNA, 18 bp, Homo sapiens
gctgtcgccccaggccct

SEQ ID NO: 5915382 - DNA, 19 bp, Homo sapiens
gctgtcgccccaggccctc

SEQ ID NO: 5915383 - DNA, 20 bp, Homo sapiens
gctgtcgccccaggccctcc

SEQ ID NO: 5915384 - DNA, 21 bp, Homo sapiens
gctgtcgccccaggccctccc

SEQ ID NO: 5915385 - DNA, 23 bp, Homo sapiens
gctgtcgccccaggccctccctg

SEQ ID NO: 5915386 - DNA, 21 bp, Homo sapiens
gctgtcgctgcctccatggca

SEQ ID NO: 5915387 - DNA, 15 bp, Homo sapiens
gctgtcggcgctgcc

SEQ ID NO: 5915388 - DNA, 19 bp, Homo sapiens
gctgtcgggggccactgtg

SEQ ID NO: 5915389 - DNA, 20 bp, Homo sapiens
gctgtcgggggccactgtgt

SEQ ID NO: 5915390 - DNA, 18 bp, Homo sapiens
gctgtcggtgtgctgtca

SEQ ID NO: 5915391 - DNA, 22 bp, Homo sapiens
gctgtcgtctgactctgggttc

SEQ ID NO: 5915392 - DNA, 20 bp, Homo sapiens
gctgtctacactaagagaga

SEQ ID NO: 5915393 - DNA, 13 bp, Homo sapiens
gctgtctcaggag

SEQ ID NO: 5915394 - DNA, 19 bp, Homo sapiens
gctgtctcatcacataaaa

SEQ ID NO: 5915395 - DNA, 22 bp, Homo sapiens
gctgtctccagacccccacccc

SEQ ID NO: 5915396 - DNA, 12 bp, Homo sapiens
gctgtctctctg

SEQ ID NO: 5915397 - DNA, 14 bp, Homo sapiens
gctgtctctctggg

SEQ ID NO: 5915398 - DNA, 19 bp, Homo sapiens
gctgtctctctgggctgca

SEQ ID NO: 5915399 - DNA, 13 bp, Homo sapiens
gctgtctctgagg

SEQ ID NO: 5915400 - DNA, 12 bp, Homo sapiens
gctgtctctgct

SEQ ID NO: 5915401 - DNA, 14 bp, Homo sapiens
gctgtctctgctcg

SEQ ID NO: 5915402 - DNA, 16 bp, Homo sapiens
gctgtctctgtccctc

SEQ ID NO: 5915403 - DNA, 21 bp, Homo sapiens
gctgtctgaaaaagtgttttt

SEQ ID NO: 5915404 - DNA, 22 bp, Homo sapiens
gctgtttatggcctcagctgcc

SEQ ID NO: 5915405 - DNA, 17 bp, Homo sapiens
gctgtttatgtttttat

SEQ ID NO: 5915406 - DNA, 16 bp, Homo sapiens
gctgtttattaatctt

SEQ ID NO: 5915407 - DNA, 18 bp, Homo sapiens
gctgtttatttattcact

SEQ ID NO: 5915408 - DNA, 21 bp, Homo sapiens
gctgtttattttttttggcct

SEQ ID NO: 5915409 - DNA, 13 bp, Homo sapiens
gctgtttccatag

SEQ ID NO: 5915410 - DNA, 19 bp, Homo sapiens
gctgtttccttgcctgctt

SEQ ID NO: 5915411 - DNA, 21 bp, Homo sapiens
gctgtttcgcatccaccgcca

SEQ ID NO: 5915412 - DNA, 13 bp, Homo sapiens
gctgtttctcatg

SEQ ID NO: 5915413 - DNA, 16 bp, Homo sapiens
gctgtttctcatgaag

SEQ ID NO: 5915414 - DNA, 13 bp, Homo sapiens
gctgtttcttgat

SEQ ID NO: 5915415 - DNA, 12 bp, Homo sapiens
gctgtttcttgt

SEQ ID NO: 5915416 - DNA, 17 bp, Homo sapiens
gctgtttgccaagctga

SEQ ID NO: 5915417 - DNA, 22 bp, Homo sapiens
gctgtttgccaagctgaagcta

SEQ ID NO: 5915418 - DNA, 14 bp, Homo sapiens
gctgtttgcttcac

SEQ ID NO: 5915419 - DNA, 21 bp, Homo sapiens
gctgtttgggttgttggtctg

SEQ ID NO: 5915420 - DNA, 22 bp, Homo sapiens
gctgtttgggttgttggtctgt

SEQ ID NO: 5915421 - DNA, 20 bp, Homo sapiens
gctgtttgtttgacaaagaa

SEQ ID NO: 5915422 - DNA, 19 bp, Homo sapiens
gctgttttaacggcctgca

SEQ ID NO: 5915423 - DNA, 21 bp, Homo sapiens
gctgttttatgtcatactctg

SEQ ID NO: 5915424 - DNA, 19 bp, Homo sapiens
gctgttttattactgtttc

SEQ ID NO: 5915425 - DNA, 16 bp, Homo sapiens
gctgttttcaaagccc

SEQ ID NO: 5915426 - DNA, 13 bp, Homo sapiens
gctgttttccctc

SEQ ID NO: 5915427 - DNA, 21 bp, Homo sapiens
gctgttttccctctgctgctt

SEQ ID NO: 5915428 - DNA, 17 bp, Homo sapiens
gctgttttccctgacct

SEQ ID NO: 5915429 - DNA, 18 bp, Homo sapiens
gctgttttcctcccttct

SEQ ID NO: 5915430 - DNA, 12 bp, Homo sapiens
gctgttttctag

SEQ ID NO: 5915431 - DNA, 11 bp, Homo sapiens
gctgttttctt

SEQ ID NO: 5915432 - DNA, 19 bp, Homo sapiens
gctgttttgtggatttttg

SEQ ID NO: 5915433 - DNA, 21 bp, Homo sapiens
gctgtttttaggctgttcctt

SEQ ID NO: 5915434 - DNA, 15 bp, Homo sapiens
gctgtttttggctgt

SEQ ID NO: 5915435 - DNA, 17 bp, Homo sapiens
gcttaaaaaaaactctt

SEQ ID NO: 5915436 - DNA, 15 bp, Homo sapiens
gcttaaaaaaaggaa

SEQ ID NO: 5915437 - DNA, 13 bp, Homo sapiens
gcttaaaaaataa

SEQ ID NO: 5915438 - DNA, 16 bp, Homo sapiens
gcttaaaagagtagaa

SEQ ID NO: 5915439 - DNA, 17 bp, Homo sapiens
gcttaaaagagtagaat

SEQ ID NO: 5915440 - DNA, 19 bp, Homo sapiens
gcttaaaagcatttttatt

SEQ ID NO: 5915441 - DNA, 19 bp, Homo sapiens
gcttaaaataaacagttgt

SEQ ID NO: 5915442 - DNA, 21 bp, Homo sapiens
gcttaaaataagcaggtggat

SEQ ID NO: 5915443 - DNA, 12 bp, Homo sapiens
gcttaaaataca

SEQ ID NO: 5915444 - DNA, 18 bp, Homo sapiens
gcttaaaatacaagactg

SEQ ID NO: 5915445 - DNA, 11 bp, Homo sapiens
gcttaaaatat

SEQ ID NO: 5915446 - DNA, 23 bp, Homo sapiens
gcttaaaatatatagtgaaaaat

SEQ ID NO: 5915447 - DNA, 20 bp, Homo sapiens
gcttaaaatatgtatgtcta

SEQ ID NO: 5915448 - DNA, 23 bp, Homo sapiens
gcttaaaatatgtgaagttttcc

SEQ ID NO: 5915449 - DNA, 22 bp, Homo sapiens
gcttaaaatgtactctcctttt

SEQ ID NO: 5915450 - DNA, 12 bp, Homo sapiens
gcttaaacaaag

SEQ ID NO: 5915451 - DNA, 13 bp, Homo sapiens
gcttaaacaaagt

SEQ ID NO: 5915452 - DNA, 16 bp, Homo sapiens
gcttaaacaacacctc

SEQ ID NO: 5915453 - DNA, 22 bp, Homo sapiens
gcttaaacaacacctcctcctg

SEQ ID NO: 5915454 - DNA, 19 bp, Homo sapiens
gcttaaacacaagaaggaa

SEQ ID NO: 5915455 - DNA, 12 bp, Homo sapiens
gcttaaacattt

SEQ ID NO: 5915456 - DNA, 19 bp, Homo sapiens
gcttaaacatttccctgct

SEQ ID NO: 5915457 - DNA, 17 bp, Homo sapiens
gcttaaacccatacaat

SEQ ID NO: 5915458 - DNA, 18 bp, Homo sapiens
gcttaaacccatacaatg

SEQ ID NO: 5915459 - DNA, 17 bp, Homo sapiens
gcttaaactaaataatg

SEQ ID NO: 5915460 - DNA, 15 bp, Homo sapiens
gcttaaactggaaag

SEQ ID NO: 5915461 - DNA, 19 bp, Homo sapiens
gcttaaagcatcctcctcc

SEQ ID NO: 5915462 - DNA, 11 bp, Homo sapiens
gcttaaagctt

SEQ ID NO: 5915463 - DNA, 20 bp, Homo sapiens
gcttaaaggtgtcttcctcc

SEQ ID NO: 5915464 - DNA, 14 bp, Homo sapiens
gcttaaagtatcta

SEQ ID NO: 5915465 - DNA, 19 bp, Homo sapiens
gcttaaagtgaaggaaata

SEQ ID NO: 5915466 - DNA, 13 bp, Homo sapiens
gcttaaatgtgaa

SEQ ID NO: 5915467 - DNA, 22 bp, Homo sapiens
gcttaaattcttcaagaaagaa

SEQ ID NO: 5915468 - DNA, 15 bp, Homo sapiens
gcttaaatttcttat

SEQ ID NO: 5915469 - DNA, 21 bp, Homo sapiens
gcttaaatttcttatgtgaca

SEQ ID NO: 5915470 - DNA, 17 bp, Homo sapiens
gcttaacagttgctttg

SEQ ID NO: 5915471 - DNA, 20 bp, Homo sapiens
gcttaacattagatgtcatg

SEQ ID NO: 5915472 - DNA, 22 bp, Homo sapiens
gcttaacctttccgctgtcgcc

SEQ ID NO: 5915473 - DNA, 20 bp, Homo sapiens
gcttaactggactgaattca

SEQ ID NO: 5915474 - DNA, 21 bp, Homo sapiens
gcttaactggactgaattcaa

SEQ ID NO: 5915475 - DNA, 14 bp, Homo sapiens
gcttaacttcacat

SEQ ID NO: 5915476 - DNA, 17 bp, Homo sapiens
gcttaacttcacatatt

SEQ ID NO: 5915477 - DNA, 13 bp, Homo sapiens
gcttaagaaaaaa

SEQ ID NO: 5915478 - DNA, 13 bp, Homo sapiens
gcttaagaagtat

SEQ ID NO: 5915479 - DNA, 19 bp, Homo sapiens
gcttaagagagagagcctt

SEQ ID NO: 5915480 - DNA, 21 bp, Homo sapiens
gcttaagatgctaatagaaaa

SEQ ID NO: 5915481 - DNA, 21 bp, Homo sapiens
gcttaagatttgtttttctct

SEQ ID NO: 5915482 - DNA, 18 bp, Homo sapiens
gcttaaggaaaagagaaa

SEQ ID NO: 5915483 - DNA, 19 bp, Homo sapiens
gcttaaggaaaagagaaac

SEQ ID NO: 5915484 - DNA, 14 bp, Homo sapiens
gcttaaggagagga

SEQ ID NO: 5915485 - DNA, 21 bp, Homo sapiens
gcttaaggagaggagaaactg

SEQ ID NO: 5915486 - DNA, 15 bp, Homo sapiens
gcttaaggtttgttt

SEQ ID NO: 5915487 - DNA, 13 bp, Homo sapiens
gcttaagttccag

SEQ ID NO: 5915488 - DNA, 17 bp, Homo sapiens
gcttaataaaagaacat

SEQ ID NO: 5915489 - DNA, 16 bp, Homo sapiens
gcttaataaattccat

SEQ ID NO: 5915490 - DNA, 15 bp, Homo sapiens
gcttaatagccctcc

SEQ ID NO: 5915491 - DNA, 21 bp, Homo sapiens
gcttaatccaatattttgcct

SEQ ID NO: 5915492 - DNA, 14 bp, Homo sapiens
gcttaatctagagc

SEQ ID NO: 5915493 - DNA, 22 bp, Homo sapiens
gcttaatctagagctatgcaca

SEQ ID NO: 5915494 - DNA, 18 bp, Homo sapiens
gcttaatgacactagcta

SEQ ID NO: 5915495 - DNA, 16 bp, Homo sapiens
gcttaatgcttctttc

SEQ ID NO: 5915496 - DNA, 22 bp, Homo sapiens
gcttaattattgatgttttcat

SEQ ID NO: 5915497 - DNA, 14 bp, Homo sapiens
gcttaattcaaata

SEQ ID NO: 5915498 - DNA, 15 bp, Homo sapiens
gcttaattcaaataa

SEQ ID NO: 5915499 - DNA, 16 bp, Homo sapiens
gcttaattgactgaaa

SEQ ID NO: 5915500 - DNA, 18 bp, Homo sapiens
gcttaattgttctgcttt

SEQ ID NO: 5915501 - DNA, 18 bp, Homo sapiens
gcttaatttaaatagcat

SEQ ID NO: 5915502 - DNA, 21 bp, Homo sapiens
gcttaatttccttctgttaag

SEQ ID NO: 5915503 - DNA, 12 bp, Homo sapiens
gcttaatttcta

SEQ ID NO: 5915504 - DNA, 23 bp, Homo sapiens
gcttaattttctgtggatcattt

SEQ ID NO: 5915505 - DNA, 17 bp, Homo sapiens
gcttacaaagccttaca

SEQ ID NO: 5915506 - DNA, 16 bp, Homo sapiens
gcttacaactttctaa

SEQ ID NO: 5915507 - DNA, 19 bp, Homo sapiens
gcttacaagccagctggag

SEQ ID NO: 5915508 - DNA, 13 bp, Homo sapiens
gcttacactgagg

SEQ ID NO: 5915509 - DNA, 14 bp, Homo sapiens
gcttacactgagga

SEQ ID NO: 5915510 - DNA, 20 bp, Homo sapiens
gcttacactgaggactgtgg

SEQ ID NO: 5915511 - DNA, 23 bp, Homo sapiens
gcttacactgattggtgttttat

SEQ ID NO: 5915512 - DNA, 17 bp, Homo sapiens
gcttacagaaatgactg

SEQ ID NO: 5915513 - DNA, 18 bp, Homo sapiens
gcttacagtaaatgaact

SEQ ID NO: 5915514 - DNA, 14 bp, Homo sapiens
gcttacatctggaa

SEQ ID NO: 5915515 - DNA, 22 bp, Homo sapiens
gcttacatgcctaccaatattt

SEQ ID NO: 5915516 - DNA, 19 bp, Homo sapiens
gcttacatttgaataatgt

SEQ ID NO: 5915517 - DNA, 11 bp, Homo sapiens
gcttacatttt

SEQ ID NO: 5915518 - DNA, 14 bp, Homo sapiens
gcttacatttttac

SEQ ID NO: 5915519 - DNA, 19 bp, Homo sapiens
gcttacatttttacaataa

SEQ ID NO: 5915520 - DNA, 16 bp, Homo sapiens
gcttaccaaaagctca

SEQ ID NO: 5915521 - DNA, 20 bp, Homo sapiens
gcttaccacatcacaccact

SEQ ID NO: 5915522 - DNA, 22 bp, Homo sapiens
gcttacctaatttcattttagt

SEQ ID NO: 5915523 - DNA, 21 bp, Homo sapiens
gcttacctagtcttgtagcat

SEQ ID NO: 5915524 - DNA, 13 bp, Homo sapiens
gcttacctgacct

SEQ ID NO: 5915525 - DNA, 21 bp, Homo sapiens
gcttacctgacctcttgctgt

SEQ ID NO: 5915526 - DNA, 23 bp, Homo sapiens
gcttacctgacctcttgctgtct

SEQ ID NO: 5915527 - DNA, 12 bp, Homo sapiens
gcttacctgacg

SEQ ID NO: 5915528 - DNA, 12 bp, Homo sapiens
gcttacctgtga

SEQ ID NO: 5915529 - DNA, 20 bp, Homo sapiens
gcttacctgttctctagttt

SEQ ID NO: 5915530 - DNA, 18 bp, Homo sapiens
gcttacgctgctctcctg

SEQ ID NO: 5915531 - DNA, 15 bp, Homo sapiens
gcttacggccctggc

SEQ ID NO: 5915532 - DNA, 22 bp, Homo sapiens
gcttacgtagttctaccggctt

SEQ ID NO: 5915533 - DNA, 17 bp, Homo sapiens
gcttactaagctttgcc

SEQ ID NO: 5915534 - DNA, 23 bp, Homo sapiens
gcttactaagctttgccagctgc

SEQ ID NO: 5915535 - DNA, 21 bp, Homo sapiens
gcttactagccctgcggagcc

SEQ ID NO: 5915536 - DNA, 23 bp, Homo sapiens
gcttactcaagtgttaaattatt

SEQ ID NO: 5915537 - DNA, 22 bp, Homo sapiens
gcttactgaagaaatctttcca

SEQ ID NO: 5915538 - DNA, 20 bp, Homo sapiens
gcttactgtgttaaaatttt

SEQ ID NO: 5915539 - DNA, 11 bp, Homo sapiens
gcttacttttt

SEQ ID NO: 5915540 - DNA, 14 bp, Homo sapiens
gcttactttttaat

SEQ ID NO: 5915541 - DNA, 15 bp, Homo sapiens
gcttagaaacatgtt

SEQ ID NO: 5915542 - DNA, 18 bp, Homo sapiens
gcttagaaagttattgtg

SEQ ID NO: 5915543 - DNA, 18 bp, Homo sapiens
gcttagaacccttctgct

SEQ ID NO: 5915544 - DNA, 19 bp, Homo sapiens
gcttagacaccacctggag

SEQ ID NO: 5915545 - DNA, 15 bp, Homo sapiens
gcttagacataacaa

SEQ ID NO: 5915546 - DNA, 13 bp, Homo sapiens
gcttagacctcag

SEQ ID NO: 5915547 - DNA, 15 bp, Homo sapiens
gcttagacctcagcc

SEQ ID NO: 5915548 - DNA, 21 bp, Homo sapiens
gcttagacttcgactcaggat

SEQ ID NO: 5915549 - DNA, 14 bp, Homo sapiens
gcttagagaggaaa

SEQ ID NO: 5915550 - DNA, 12 bp, Homo sapiens
gcttagagcagt

SEQ ID NO: 5915551 - DNA, 18 bp, Homo sapiens
gcttagaggcatgggctt

SEQ ID NO: 5915552 - DNA, 14 bp, Homo sapiens
gcttagaggttctg

SEQ ID NO: 5915553 - DNA, 18 bp, Homo sapiens
gcttagaggttctgcctc

SEQ ID NO: 5915554 - DNA, 14 bp, Homo sapiens
gcttagagtgccca

SEQ ID NO: 5915555 - DNA, 16 bp, Homo sapiens
gcttagagtgcccagc

SEQ ID NO: 5915556 - DNA, 17 bp, Homo sapiens
gcttagagtgcccagca

SEQ ID NO: 5915557 - DNA, 17 bp, Homo sapiens
gcttagattttctgtaa

SEQ ID NO: 5915558 - DNA, 23 bp, Homo sapiens
gcttagcaggagaggagagccag

SEQ ID NO: 5915559 - DNA, 19 bp, Homo sapiens
gcttagcagtccccttccc

SEQ ID NO: 5915560 - DNA, 23 bp, Homo sapiens
gcttagccccgctgagcttggag

SEQ ID NO: 5915561 - DNA, 12 bp, Homo sapiens
gcttagcctgcc

SEQ ID NO: 5915562 - DNA, 17 bp, Homo sapiens
gcttagcctgcctcacc

SEQ ID NO: 5915563 - DNA, 20 bp, Homo sapiens
gcttagccttgtgccctgcc

SEQ ID NO: 5915564 - DNA, 20 bp, Homo sapiens
gcttagctcaattagtgtgg

SEQ ID NO: 5915565 - DNA, 17 bp, Homo sapiens
gcttagctgaaacctaa

SEQ ID NO: 5915566 - DNA, 21 bp, Homo sapiens
gcttagctgaaacctaaggca

SEQ ID NO: 5915567 - DNA, 13 bp, Homo sapiens
gcttagctgccat

SEQ ID NO: 5915568 - DNA, 17 bp, Homo sapiens
gcttagcttatctttct

SEQ ID NO: 5915569 - DNA, 22 bp, Homo sapiens
gcttagcttatctttctttcca

SEQ ID NO: 5915570 - DNA, 23 bp, Homo sapiens
gcttagcttatctttctttccat

SEQ ID NO: 5915571 - DNA, 15 bp, Homo sapiens
gcttagctttctgga

SEQ ID NO: 5915572 - DNA, 17 bp, Homo sapiens
gcttagctttgctctgc

SEQ ID NO: 5915573 - DNA, 23 bp, Homo sapiens
gcttaggagacagatcactcctg

SEQ ID NO: 5915574 - DNA, 13 bp, Homo sapiens
gcttaggcagggc

SEQ ID NO: 5915575 - DNA, 18 bp, Homo sapiens
gcttaggcagggctctct

SEQ ID NO: 5915576 - DNA, 14 bp, Homo sapiens
gcttaggcctctct

SEQ ID NO: 5915577 - DNA, 12 bp, Homo sapiens
gcttagggccct

SEQ ID NO: 5915578 - DNA, 17 bp, Homo sapiens
gcttagggccctggagg

SEQ ID NO: 5915579 - DNA, 23 bp, Homo sapiens
gcttaggtcctcacttctgtctc

SEQ ID NO: 5915580 - DNA, 14 bp, Homo sapiens
gcttagtatctcat

SEQ ID NO: 5915581 - DNA, 15 bp, Homo sapiens
gcttagtcactgaga

SEQ ID NO: 5915582 - DNA, 12 bp, Homo sapiens
gcttcatatcta

SEQ ID NO: 5915583 - DNA, 12 bp, Homo sapiens
gcttcatatctc

SEQ ID NO: 5915584 - DNA, 15 bp, Homo sapiens
gcttcatatctctcc

SEQ ID NO: 5915585 - DNA, 16 bp, Homo sapiens
gcttcatatctctccc

SEQ ID NO: 5915586 - DNA, 17 bp, Homo sapiens
gcttcatcaatttttat

SEQ ID NO: 5915587 - DNA, 19 bp, Homo sapiens
gcttcatcaatttttatac

SEQ ID NO: 5915588 - DNA, 21 bp, Homo sapiens
gcttcatcctcctcagatctt

SEQ ID NO: 5915589 - DNA, 19 bp, Homo sapiens
gcttcatctcatgaggatt

SEQ ID NO: 5915590 - DNA, 17 bp, Homo sapiens
gcttcatctctttagag

SEQ ID NO: 5915591 - DNA, 14 bp, Homo sapiens
gcttcatctggagt

SEQ ID NO: 5915592 - DNA, 13 bp, Homo sapiens
gcttcatctgtca

SEQ ID NO: 5915593 - DNA, 17 bp, Homo sapiens
gcttcatgcctcagttt

SEQ ID NO: 5915594 - DNA, 20 bp, Homo sapiens
gcttcatgcctcagtttccc

SEQ ID NO: 5915595 - DNA, 22 bp, Homo sapiens
gcttcatgcctcagtttcccca

SEQ ID NO: 5915596 - DNA, 13 bp, Homo sapiens
gcttcatgccttt

SEQ ID NO: 5915597 - DNA, 17 bp, Homo sapiens
gcttcatggcagaaggc

SEQ ID NO: 5915598 - DNA, 14 bp, Homo sapiens
gcttcatgtgtccc

SEQ ID NO: 5915599 - DNA, 18 bp, Homo sapiens
gcttcatgtgtcccagaa

SEQ ID NO: 5915600 - DNA, 21 bp, Homo sapiens
gcttcattatctgagttgcat

SEQ ID NO: 5915601 - DNA, 11 bp, Homo sapiens
gcttcattcaa

SEQ ID NO: 5915602 - DNA, 17 bp, Homo sapiens
gcttcattcaatattga

SEQ ID NO: 5915603 - DNA, 20 bp, Homo sapiens
gcttcattctcactctgctt

SEQ ID NO: 5915604 - DNA, 13 bp, Homo sapiens
gcttcattctgga

SEQ ID NO: 5915605 - DNA, 23 bp, Homo sapiens
gcttcattctggaaacttttgtt

SEQ ID NO: 5915606 - DNA, 17 bp, Homo sapiens
gcttcattctttgcagg

SEQ ID NO: 5915607 - DNA, 13 bp, Homo sapiens
gcttcatttcaat

SEQ ID NO: 5915608 - DNA, 15 bp, Homo sapiens
gcttcatttcaatca

SEQ ID NO: 5915609 - DNA, 22 bp, Homo sapiens
gcttcatttccttggggctgca

SEQ ID NO: 5915610 - DNA, 20 bp, Homo sapiens
gcttcatttttgtaataaca

SEQ ID NO: 5915611 - DNA, 23 bp, Homo sapiens
gcttcatttttgtaataacattt

SEQ ID NO: 5915612 - DNA, 12 bp, Homo sapiens
gcttccaaagcc

SEQ ID NO: 5915613 - DNA, 19 bp, Homo sapiens
gcttccaaagcctagacaa

SEQ ID NO: 5915614 - DNA, 21 bp, Homo sapiens
gcttccaaatgtgtcagaata

SEQ ID NO: 5915615 - DNA, 16 bp, Homo sapiens
gcttccaagcattact

SEQ ID NO: 5915616 - DNA, 18 bp, Homo sapiens
gcttccaaggtggtctgc

SEQ ID NO: 5915617 - DNA, 16 bp, Homo sapiens
gcttccacacttctgg

SEQ ID NO: 5915618 - DNA, 16 bp, Homo sapiens
gcttccacagtgtgaa

SEQ ID NO: 5915619 - DNA, 17 bp, Homo sapiens
gcttccacccctctcct

SEQ ID NO: 5915620 - DNA, 23 bp, Homo sapiens
gcttccacccgtctctctgccca

SEQ ID NO: 5915621 - DNA, 15 bp, Homo sapiens
gcttccacctcaccc

SEQ ID NO: 5915622 - DNA, 23 bp, Homo sapiens
gcttccactaccaaaagacatta

SEQ ID NO: 5915623 - DNA, 19 bp, Homo sapiens
gcttccagaaaaccccagc

SEQ ID NO: 5915624 - DNA, 20 bp, Homo sapiens
gcttccagaaatgccacact

SEQ ID NO: 5915625 - DNA, 16 bp, Homo sapiens
gcttccagaaggcagc

SEQ ID NO: 5915626 - DNA, 11 bp, Homo sapiens
gcttccagacc

SEQ ID NO: 5915627 - DNA, 12 bp, Homo sapiens
gcttccagacca

SEQ ID NO: 5915628 - DNA, 13 bp, Homo sapiens
gcttccagaccac

SEQ ID NO: 5915629 - DNA, 16 bp, Homo sapiens
gcttccagaccacctg

SEQ ID NO: 5915630 - DNA, 17 bp, Homo sapiens
gcttccagaccacctgc

SEQ ID NO: 5915631 - DNA, 20 bp, Homo sapiens
gcttccagaccacctgccag

SEQ ID NO: 5915632 - DNA, 21 bp, Homo sapiens
gcttccagaccacctgccagc

SEQ ID NO: 5915633 - DNA, 22 bp, Homo sapiens
gcttccagaccacctgccagcc

SEQ ID NO: 5915634 - DNA, 23 bp, Homo sapiens
gcttccagaccacctgccagcca

SEQ ID NO: 5915635 - DNA, 13 bp, Homo sapiens
gcttccagagagt

SEQ ID NO: 5915636 - DNA, 22 bp, Homo sapiens
gcttccagagagtcctctggat

SEQ ID NO: 5915637 - DNA, 18 bp, Homo sapiens
gcttccagagctctgacc

SEQ ID NO: 5915638 - DNA, 13 bp, Homo sapiens
gcttccagaggag

SEQ ID NO: 5915639 - DNA, 14 bp, Homo sapiens
gcttccagaggaga

SEQ ID NO: 5915640 - DNA, 13 bp, Homo sapiens
gcttccagcagga

SEQ ID NO: 5915641 - DNA, 17 bp, Homo sapiens
gcttccagcaggaggga

SEQ ID NO: 5915642 - DNA, 16 bp, Homo sapiens
gcttccagcgggccct

SEQ ID NO: 5915643 - DNA, 12 bp, Homo sapiens
gcttccagctca

SEQ ID NO: 5915644 - DNA, 13 bp, Homo sapiens
gcttccagctcag

SEQ ID NO: 5915645 - DNA, 18 bp, Homo sapiens
gcttccagcttcaggcac

SEQ ID NO: 5915646 - DNA, 20 bp, Homo sapiens
gcttccagcttcaggcacca

SEQ ID NO: 5915647 - DNA, 20 bp, Homo sapiens
gcttccagcttcctctgagc

SEQ ID NO: 5915648 - DNA, 19 bp, Homo sapiens
gcttccaggaaactccaca

SEQ ID NO: 5915649 - DNA, 11 bp, Homo sapiens
gcttccaggat

SEQ ID NO: 5915650 - DNA, 22 bp, Homo sapiens
gcttccaggataaggagactga

SEQ ID NO: 5915651 - DNA, 12 bp, Homo sapiens
gcttccaggctg

SEQ ID NO: 5915652 - DNA, 15 bp, Homo sapiens
gcttccaggctgggc

SEQ ID NO: 5915653 - DNA, 17 bp, Homo sapiens
gcttccagggacaagct

SEQ ID NO: 5915654 - DNA, 20 bp, Homo sapiens
gcttccaggtatctccagga

SEQ ID NO: 5915655 - DNA, 21 bp, Homo sapiens
gcttccaggtatctccaggat

SEQ ID NO: 5915656 - DNA, 14 bp, Homo sapiens
gcttccaggtggcc

SEQ ID NO: 5915657 - DNA, 15 bp, Homo sapiens
gcttccagtgaggct

SEQ ID NO: 5915658 - DNA, 16 bp, Homo sapiens
gcttccagtgaggctc

SEQ ID NO: 5915659 - DNA, 19 bp, Homo sapiens
gcttccagtgaggctctgc

SEQ ID NO: 5915660 - DNA, 23 bp, Homo sapiens
gcttccagtgaggctctgccctt

SEQ ID NO: 5915661 - DNA, 22 bp, Homo sapiens
gcttccatcccaaccagtgcca

SEQ ID NO: 5915662 - DNA, 15 bp, Homo sapiens
gcttccatgatgcac

SEQ ID NO: 5915663 - DNA, 15 bp, Homo sapiens
gcttccatgattcta

SEQ ID NO: 5915664 - DNA, 19 bp, Homo sapiens
gcttccatgattctattta

SEQ ID NO: 5915665 - DNA, 19 bp, Homo sapiens
gcttccatggcttcctgag

SEQ ID NO: 5915666 - DNA, 17 bp, Homo sapiens
gcttccattaacaaatg

SEQ ID NO: 5915667 - DNA, 12 bp, Homo sapiens
gcttccattcca

SEQ ID NO: 5915668 - DNA, 17 bp, Homo sapiens
gcttccatttgtgtgtg

SEQ ID NO: 5915669 - DNA, 20 bp, Homo sapiens
gcttcccaaactcccaggac

SEQ ID NO: 5915670 - DNA, 14 bp, Homo sapiens
gcttcccaaataca

SEQ ID NO: 5915671 - DNA, 16 bp, Homo sapiens
gcttcccaagtagctg

SEQ ID NO: 5915672 - DNA, 18 bp, Homo sapiens
gcttcccacacctgcctg

SEQ ID NO: 5915673 - DNA, 20 bp, Homo sapiens
gcttcccacacctgcctgcg

SEQ ID NO: 5915674 - DNA, 21 bp, Homo sapiens
gcttcccacagcctcttcctc

SEQ ID NO: 5915675 - DNA, 15 bp, Homo sapiens
gcttcccacctccct

SEQ ID NO: 5915676 - DNA, 14 bp, Homo sapiens
gcttcccactgggg

SEQ ID NO: 5915677 - DNA, 16 bp, Homo sapiens
gcttcccagaggagca

SEQ ID NO: 5915678 - DNA, 14 bp, Homo sapiens
gcttcccagaggga

SEQ ID NO: 5915679 - DNA, 17 bp, Homo sapiens
gcttcccagagggagca

SEQ ID NO: 5915680 - DNA, 14 bp, Homo sapiens
gcttcccagctctg

SEQ ID NO: 5915681 - DNA, 15 bp, Homo sapiens
gcttcccaggaccct

SEQ ID NO: 5915682 - DNA, 18 bp, Homo sapiens
gcttcccaggaccctggg

SEQ ID NO: 5915683 - DNA, 19 bp, Homo sapiens
gcttcccaggaccctgggt

SEQ ID NO: 5915684 - DNA, 12 bp, Homo sapiens
gcttcccaggat

SEQ ID NO: 5915685 - DNA, 20 bp, Homo sapiens
gcttcccaggatccctccca

SEQ ID NO: 5915686 - DNA, 18 bp, Homo sapiens
gcttcccagtggctgctg

SEQ ID NO: 5915687 - DNA, 19 bp, Homo sapiens
gcttcccagtggctgctgc

SEQ ID NO: 5915688 - DNA, 22 bp, Homo sapiens
gcttcccagtggctgctgccca

SEQ ID NO: 5915689 - DNA, 17 bp, Homo sapiens
gcttcccatccccagcg

SEQ ID NO: 5915690 - DNA, 18 bp, Homo sapiens
gcttcccatctgaagagt

SEQ ID NO: 5915691 - DNA, 19 bp, Homo sapiens
gcttcccattgtggctcct

SEQ ID NO: 5915692 - DNA, 13 bp, Homo sapiens
gcttccccacaga

SEQ ID NO: 5915693 - DNA, 14 bp, Homo sapiens
gcttccccactccc

SEQ ID NO: 5915694 - DNA, 12 bp, Homo sapiens
gcttccccagct

SEQ ID NO: 5915695 - DNA, 14 bp, Homo sapiens
gcttccccagctca

SEQ ID NO: 5915696 - DNA, 18 bp, Homo sapiens
gcttccccaggctgccca

SEQ ID NO: 5915697 - DNA, 19 bp, Homo sapiens
gcttccccatcagctccca

SEQ ID NO: 5915698 - DNA, 15 bp, Homo sapiens
gcttccccattgcct

SEQ ID NO: 5915699 - DNA, 20 bp, Homo sapiens
gcttccccattgccttctgg

SEQ ID NO: 5915700 - DNA, 19 bp, Homo sapiens
gcttcccccacttcacctt

SEQ ID NO: 5915701 - DNA, 20 bp, Homo sapiens
gcttccccctccccctcctg

SEQ ID NO: 5915702 - DNA, 22 bp, Homo sapiens
gcttccccctccccctcctgct

SEQ ID NO: 5915703 - DNA, 13 bp, Homo sapiens
gcttcccctcact

SEQ ID NO: 5915704 - DNA, 15 bp, Homo sapiens
gcttcccctccagga

SEQ ID NO: 5915705 - DNA, 19 bp, Homo sapiens
gcttcccctcgctgtcctg

SEQ ID NO: 5915706 - DNA, 14 bp, Homo sapiens
gcttcccctctctc

SEQ ID NO: 5915707 - DNA, 16 bp, Homo sapiens
gcttccccttcctaag

SEQ ID NO: 5915708 - DNA, 19 bp, Homo sapiens
gcttcccgggatgcgcctg

SEQ ID NO: 5915709 - DNA, 15 bp, Homo sapiens
gcttccctaaactgc

SEQ ID NO: 5915710 - DNA, 18 bp, Homo sapiens
gcttccctaaactgcagc

SEQ ID NO: 5915711 - DNA, 22 bp, Homo sapiens
gcttccctaaactgcagcctct

SEQ ID NO: 5915712 - DNA, 14 bp, Homo sapiens
gcttccctaatcta

SEQ ID NO: 5915713 - DNA, 16 bp, Homo sapiens
gcttccctacacaggg

SEQ ID NO: 5915714 - DNA, 21 bp, Homo sapiens
gcttccctacacagggcctgc

SEQ ID NO: 5915715 - DNA, 15 bp, Homo sapiens
gcttccctccatccc

SEQ ID NO: 5915716 - DNA, 13 bp, Homo sapiens
gcttccctcctgc

SEQ ID NO: 5915717 - DNA, 14 bp, Homo sapiens
gcttccctccttca

SEQ ID NO: 5915718 - DNA, 18 bp, Homo sapiens
gcttccctctcagctgct

SEQ ID NO: 5915719 - DNA, 17 bp, Homo sapiens
gcttccctctgcctgtc

SEQ ID NO: 5915720 - DNA, 18 bp, Homo sapiens
gcttccctctgctccaca

SEQ ID NO: 5915721 - DNA, 19 bp, Homo sapiens
gcttccctgacttgcttta

SEQ ID NO: 5915722 - DNA, 13 bp, Homo sapiens
gcttccctggaag

SEQ ID NO: 5915723 - DNA, 13 bp, Homo sapiens
gcttccctggggc

SEQ ID NO: 5915724 - DNA, 17 bp, Homo sapiens
gcttccctggggcccca

SEQ ID NO: 5915725 - DNA, 18 bp, Homo sapiens
gcttccctggggccccat

SEQ ID NO: 5915726 - DNA, 15 bp, Homo sapiens
gcttccctgttgaat

SEQ ID NO: 5915727 - DNA, 15 bp, Homo sapiens
gcttcccttactttg

SEQ ID NO: 5915728 - DNA, 21 bp, Homo sapiens
gcttcccttctccccagccag

SEQ ID NO: 5915729 - DNA, 16 bp, Homo sapiens
gcttccgagacaccac

SEQ ID NO: 5915730 - DNA, 16 bp, Homo sapiens
gcttccgcacatgccg

SEQ ID NO: 5915731 - DNA, 15 bp, Homo sapiens
gcttccgccactcag

SEQ ID NO: 5915732 - DNA, 17 bp, Homo sapiens
gcttccgccactcagcc

SEQ ID NO: 5915733 - DNA, 19 bp, Homo sapiens
gcttccgctgtcacccagc

SEQ ID NO: 5915734 - DNA, 18 bp, Homo sapiens
gcttccgctttgaaagaa

SEQ ID NO: 5915735 - DNA, 20 bp, Homo sapiens
gcttccggctgagctgtgcc

SEQ ID NO: 5915736 - DNA, 22 bp, Homo sapiens
gcttccgggaaaacagctatta

SEQ ID NO: 5915737 - DNA, 20 bp, Homo sapiens
gcttccggtagggaggcagc

SEQ ID NO: 5915738 - DNA, 17 bp, Homo sapiens
gcttccgtactatggct

SEQ ID NO: 5915739 - DNA, 14 bp, Homo sapiens
gcttccgtatttta

SEQ ID NO: 5915740 - DNA, 16 bp, Homo sapiens
gcttccgtattttaat

SEQ ID NO: 5915741 - DNA, 13 bp, Homo sapiens
gcttcctaactta

SEQ ID NO: 5915742 - DNA, 15 bp, Homo sapiens
gcttcctaacttatt

SEQ ID NO: 5915743 - DNA, 23 bp, Homo sapiens
gcttcctacccacacctctgcca

SEQ ID NO: 5915744 - DNA, 14 bp, Homo sapiens
gcttcctagtaagt

SEQ ID NO: 5915745 - DNA, 18 bp, Homo sapiens
gcttcctataacttcttc

SEQ ID NO: 5915746 - DNA, 16 bp, Homo sapiens
gcttcctcacacccct

SEQ ID NO: 5915747 - DNA, 17 bp, Homo sapiens
gcttcctcacacccctg

SEQ ID NO: 5915748 - DNA, 18 bp, Homo sapiens
gcttcctcacacccctgt

SEQ ID NO: 5915749 - DNA, 20 bp, Homo sapiens
gcttcctcacacccctgtcc

SEQ ID NO: 5915750 - DNA, 22 bp, Homo sapiens
gcttcctcacacccctgtccca

SEQ ID NO: 5915751 - DNA, 16 bp, Homo sapiens
gcttcctcagcctcca

SEQ ID NO: 5915752 - DNA, 14 bp, Homo sapiens
gcttcctcagggcc

SEQ ID NO: 5915753 - DNA, 22 bp, Homo sapiens
gcttcctcagtaacatttctgt

SEQ ID NO: 5915754 - DNA, 20 bp, Homo sapiens
gcttcctcccaacaagcagc

SEQ ID NO: 5915755 - DNA, 19 bp, Homo sapiens
gcttcctccggctggacct

SEQ ID NO: 5915756 - DNA, 19 bp, Homo sapiens
gcttcctccgtccacccag

SEQ ID NO: 5915757 - DNA, 22 bp, Homo sapiens
gcttcctccgtccacccaggct

SEQ ID NO: 5915758 - DNA, 23 bp, Homo sapiens
gcttcctccgtccacccaggctg

SEQ ID NO: 5915759 - DNA, 16 bp, Homo sapiens
gcttcctccgtctgca

SEQ ID NO: 5915760 - DNA, 18 bp, Homo sapiens
gcttcctccgtctgcaat

SEQ ID NO: 5915761 - DNA, 17 bp, Homo sapiens
gcttctcttttgaaagt

SEQ ID NO: 5915762 - DNA, 16 bp, Homo sapiens
gcttctgaactcaagc

SEQ ID NO: 5915763 - DNA, 18 bp, Homo sapiens
gcttctgaactcaagctg

SEQ ID NO: 5915764 - DNA, 23 bp, Homo sapiens
gcttctgaactcaagctgcgttt

SEQ ID NO: 5915765 - DNA, 21 bp, Homo sapiens
gcttctgaagagcctgaagct

SEQ ID NO: 5915766 - DNA, 21 bp, Homo sapiens
gcttctgaagctgctgcagct

SEQ ID NO: 5915767 - DNA, 13 bp, Homo sapiens
gcttctgaatcac

SEQ ID NO: 5915768 - DNA, 18 bp, Homo sapiens
gcttctgagcagcgagcc

SEQ ID NO: 5915769 - DNA, 21 bp, Homo sapiens
gcttctgagcagcgagcctgc

SEQ ID NO: 5915770 - DNA, 23 bp, Homo sapiens
gcttctgagcagcgagcctgcta

SEQ ID NO: 5915771 - DNA, 15 bp, Homo sapiens
gcttctgatgaatct

SEQ ID NO: 5915772 - DNA, 20 bp, Homo sapiens
gcttctgatgaatcttgcgt

SEQ ID NO: 5915773 - DNA, 21 bp, Homo sapiens
gcttctgcaccctccaccctg

SEQ ID NO: 5915774 - DNA, 14 bp, Homo sapiens
gcttctgcacctta

SEQ ID NO: 5915775 - DNA, 17 bp, Homo sapiens
gcttctgcagcaactcc

SEQ ID NO: 5915776 - DNA, 19 bp, Homo sapiens
gcttctgcagcaactccca

SEQ ID NO: 5915777 - DNA, 21 bp, Homo sapiens
gcttctgcagcaactcccacg

SEQ ID NO: 5915778 - DNA, 13 bp, Homo sapiens
gcttctgccactt

SEQ ID NO: 5915779 - DNA, 14 bp, Homo sapiens
gcttctgccacttc

SEQ ID NO: 5915780 - DNA, 18 bp, Homo sapiens
gcttctgcccaccccgcc

SEQ ID NO: 5915781 - DNA, 19 bp, Homo sapiens
gcttctgcccaccccgcct

SEQ ID NO: 5915782 - DNA, 16 bp, Homo sapiens
gcttctgccccctgca

SEQ ID NO: 5915783 - DNA, 15 bp, Homo sapiens
gcttctgcctcagct

SEQ ID NO: 5915784 - DNA, 12 bp, Homo sapiens
gcttctgcctgc

SEQ ID NO: 5915785 - DNA, 18 bp, Homo sapiens
gcttctgcggtgaggcag

SEQ ID NO: 5915786 - DNA, 21 bp, Homo sapiens
gcttctgcggtgaggcagggg

SEQ ID NO: 5915787 - DNA, 20 bp, Homo sapiens
gcttctgcgtccaccaggcc

SEQ ID NO: 5915788 - DNA, 22 bp, Homo sapiens
gcttctgctcacattccctctc

SEQ ID NO: 5915789 - DNA, 16 bp, Homo sapiens
gcttctgctccagccc

SEQ ID NO: 5915790 - DNA, 12 bp, Homo sapiens
gcttctgctgaa

SEQ ID NO: 5915791 - DNA, 13 bp, Homo sapiens
gcttctgctggag

SEQ ID NO: 5915792 - DNA, 15 bp, Homo sapiens
gcttctgctggagga

SEQ ID NO: 5915793 - DNA, 12 bp, Homo sapiens
gcttctgctggg

SEQ ID NO: 5915794 - DNA, 15 bp, Homo sapiens
gcttctgctgggctg

SEQ ID NO: 5915795 - DNA, 16 bp, Homo sapiens
gcttctgctggggcct

SEQ ID NO: 5915796 - DNA, 20 bp, Homo sapiens
gcttctgctggggcctggga

SEQ ID NO: 5915797 - DNA, 16 bp, Homo sapiens
gcttctgcttcaaacc

SEQ ID NO: 5915798 - DNA, 13 bp, Homo sapiens
gcttctgcttttc

SEQ ID NO: 5915799 - DNA, 14 bp, Homo sapiens
gcttctgcttttct

SEQ ID NO: 5915800 - DNA, 19 bp, Homo sapiens
gcttctgcttttctgccct

SEQ ID NO: 5915801 - DNA, 20 bp, Homo sapiens
gcttctgcttttctgccctg

SEQ ID NO: 5915802 - DNA, 23 bp, Homo sapiens
gcttctgcttttctgccctggct

SEQ ID NO: 5915803 - DNA, 20 bp, Homo sapiens
gcttctggaatttgttcaag

SEQ ID NO: 5915804 - DNA, 12 bp, Homo sapiens
gcttctggagcc

SEQ ID NO: 5915805 - DNA, 13 bp, Homo sapiens
gcttctggagccc

SEQ ID NO: 5915806 - DNA, 14 bp, Homo sapiens
gcttctggagccct

SEQ ID NO: 5915807 - DNA, 17 bp, Homo sapiens
gcttctggagcccttgg

SEQ ID NO: 5915808 - DNA, 12 bp, Homo sapiens
gcttctggcacc

SEQ ID NO: 5915809 - DNA, 14 bp, Homo sapiens
gcttctggccagga

SEQ ID NO: 5915810 - DNA, 15 bp, Homo sapiens
gcttctggccaggaa

SEQ ID NO: 5915811 - DNA, 23 bp, Homo sapiens
gcttctgggacaggcaccatgct

SEQ ID NO: 5915812 - DNA, 24 bp, Homo sapiens
gcttctgggacaggcaccatgctg

SEQ ID NO: 5915813 - DNA, 19 bp, Homo sapiens
gcttctgggcctgatggag

SEQ ID NO: 5915814 - DNA, 24 bp, Homo sapiens
gcttctgggcgccggttccacgtg

SEQ ID NO: 5915815 - DNA, 19 bp, Homo sapiens
gcttctggggtccccaggg

SEQ ID NO: 5915816 - DNA, 20 bp, Homo sapiens
gcttctggggtccccagggc

SEQ ID NO: 5915817 - DNA, 21 bp, Homo sapiens
gcttctggggtccccagggct

SEQ ID NO: 5915818 - DNA, 19 bp, Homo sapiens
gcttctggtgaccttccaa

SEQ ID NO: 5915819 - DNA, 17 bp, Homo sapiens
gcttctgtaccacacta

SEQ ID NO: 5915820 - DNA, 14 bp, Homo sapiens
gcttctgtagcttc

SEQ ID NO: 5915821 - DNA, 15 bp, Homo sapiens
gcttctgtagcttct

SEQ ID NO: 5915822 - DNA, 16 bp, Homo sapiens
gcttctgtatttcctt

SEQ ID NO: 5915823 - DNA, 14 bp, Homo sapiens
gcttctgtccagga

SEQ ID NO: 5915824 - DNA, 13 bp, Homo sapiens
gcttctgtcctgc

SEQ ID NO: 5915825 - DNA, 15 bp, Homo sapiens
gcttctgtctccagc

SEQ ID NO: 5915826 - DNA, 16 bp, Homo sapiens
gcttctgtgatgagct

SEQ ID NO: 5915827 - DNA, 17 bp, Homo sapiens
gcttctgtgatgagctg

SEQ ID NO: 5915828 - DNA, 18 bp, Homo sapiens
gcttctgtgcacctgggc

SEQ ID NO: 5915829 - DNA, 12 bp, Homo sapiens
gcttctgtgcct

SEQ ID NO: 5915830 - DNA, 15 bp, Homo sapiens
gcttctgtgtaccac

SEQ ID NO: 5915831 - DNA, 15 bp, Homo sapiens
gcttctgttctctgc

SEQ ID NO: 5915832 - DNA, 17 bp, Homo sapiens
gcttctgttgatctcag

SEQ ID NO: 5915833 - DNA, 16 bp, Homo sapiens
gcttctgttgctgcct

SEQ ID NO: 5915834 - DNA, 19 bp, Homo sapiens
gcttctgttgctgcctcat

SEQ ID NO: 5915835 - DNA, 17 bp, Homo sapiens
gcttctgttggcagagc

SEQ ID NO: 5915836 - DNA, 19 bp, Homo sapiens
gcttctgttgtaatagtcc

SEQ ID NO: 5915837 - DNA, 16 bp, Homo sapiens
gcttctgttgtcacct

SEQ ID NO: 5915838 - DNA, 21 bp, Homo sapiens
gcttcttacgaacgccacggc

SEQ ID NO: 5915839 - DNA, 22 bp, Homo sapiens
gcttcttagacggtcttcactg

SEQ ID NO: 5915840 - DNA, 21 bp, Homo sapiens
gcttcttcaagcacctgcaga

SEQ ID NO: 5915841 - DNA, 15 bp, Homo sapiens
gcttcttcagagact

SEQ ID NO: 5915842 - DNA, 21 bp, Homo sapiens
gcttcttcagagactcctgca

SEQ ID NO: 5915843 - DNA, 23 bp, Homo sapiens
gcttcttcagagactcctgcagg

SEQ ID NO: 5915844 - DNA, 18 bp, Homo sapiens
gcttcttcagagatcaag

SEQ ID NO: 5915845 - DNA, 16 bp, Homo sapiens
gcttcttcagatcagt

SEQ ID NO: 5915846 - DNA, 22 bp, Homo sapiens
gcttcttccgtttcttcccccc

SEQ ID NO: 5915847 - DNA, 21 bp, Homo sapiens
gcttcttcctaggtccaagcc

SEQ ID NO: 5915848 - DNA, 19 bp, Homo sapiens
gcttcttcctcacactgct

SEQ ID NO: 5915849 - DNA, 20 bp, Homo sapiens
gcttcttcctcacactgctg

SEQ ID NO: 5915850 - DNA, 17 bp, Homo sapiens
gcttcttcctcctccat

SEQ ID NO: 5915851 - DNA, 16 bp, Homo sapiens
gcttcttctgaggcct

SEQ ID NO: 5915852 - DNA, 17 bp, Homo sapiens
gcttcttctgaggcctg

SEQ ID NO: 5915853 - DNA, 13 bp, Homo sapiens
gcttcttgcccag

SEQ ID NO: 5915854 - DNA, 15 bp, Homo sapiens
gcttcttgcccagat

SEQ ID NO: 5915855 - DNA, 12 bp, Homo sapiens
gcttcttgcccc

SEQ ID NO: 5915856 - DNA, 14 bp, Homo sapiens
gcttcttgcccctt

SEQ ID NO: 5915857 - DNA, 15 bp, Homo sapiens
gcttcttgccccttg

SEQ ID NO: 5915858 - DNA, 19 bp, Homo sapiens
gcttcttgccccttgggcc

SEQ ID NO: 5915859 - DNA, 12 bp, Homo sapiens
gcttcttgcctc

SEQ ID NO: 5915860 - DNA, 19 bp, Homo sapiens
gcttcttgcctctgtgctg

SEQ ID NO: 5915861 - DNA, 22 bp, Homo sapiens
gcttcttgggctgagtgcagcc

SEQ ID NO: 5915862 - DNA, 17 bp, Homo sapiens
gcttcttgtgttttact

SEQ ID NO: 5915863 - DNA, 16 bp, Homo sapiens
gcttcttgtttccttg

SEQ ID NO: 5915864 - DNA, 21 bp, Homo sapiens
gcttctttcaagggctttcct

SEQ ID NO: 5915865 - DNA, 20 bp, Homo sapiens
gcttctttccagaaaccaaa

SEQ ID NO: 5915866 - DNA, 18 bp, Homo sapiens
gcttctttctgctggctg

SEQ ID NO: 5915867 - DNA, 15 bp, Homo sapiens
gcttcttttgaactg

SEQ ID NO: 5915868 - DNA, 17 bp, Homo sapiens
gcttcttttgaactgtt

SEQ ID NO: 5915869 - DNA, 19 bp, Homo sapiens
gcttgaaacccgtggcgct

SEQ ID NO: 5915870 - DNA, 13 bp, Homo sapiens
gcttgaaagaaaa

SEQ ID NO: 5915871 - DNA, 11 bp, Homo sapiens
gcttgaacaca

SEQ ID NO: 5915872 - DNA, 17 bp, Homo sapiens
gcttgaacacagtattt

SEQ ID NO: 5915873 - DNA, 13 bp, Homo sapiens
gcttgaacccagg

SEQ ID NO: 5915874 - DNA, 16 bp, Homo sapiens
gcttgaacccaggagg

SEQ ID NO: 5915875 - DNA, 23 bp, Homo sapiens
gcttgaacccaggtggcggaggt

SEQ ID NO: 5915876 - DNA, 19 bp, Homo sapiens
gcttgaacctgtgaggaag

SEQ ID NO: 5915877 - DNA, 12 bp, Homo sapiens
gcttgaaccttc

SEQ ID NO: 5915878 - DNA, 20 bp, Homo sapiens
gcttgaactaggctgagcaa

SEQ ID NO: 5915879 - DNA, 18 bp, Homo sapiens
gcttgaagattcaggctt

SEQ ID NO: 5915880 - DNA, 20 bp, Homo sapiens
gcttgaagattcaggcttgc

SEQ ID NO: 5915881 - DNA, 12 bp, Homo sapiens
gcttgaagccaa

SEQ ID NO: 5915882 - DNA, 16 bp, Homo sapiens
gcttgaagccaaagaa

SEQ ID NO: 5915883 - DNA, 13 bp, Homo sapiens
gcttgaaggccag

SEQ ID NO: 5915884 - DNA, 17 bp, Homo sapiens
gcttgaaggccagcagc

SEQ ID NO: 5915885 - DNA, 18 bp, Homo sapiens
gcttgaaggccctgctga

SEQ ID NO: 5915886 - DNA, 22 bp, Homo sapiens
gcttgaatgtccccattctata

SEQ ID NO: 5915887 - DNA, 13 bp, Homo sapiens
gcttgaatgtgag

SEQ ID NO: 5915888 - DNA, 13 bp, Homo sapiens
gcttgaattgaag

SEQ ID NO: 5915889 - DNA, 14 bp, Homo sapiens
gcttgaatttgcat

SEQ ID NO: 5915890 - DNA, 16 bp, Homo sapiens
gcttgacacagtcagc

SEQ ID NO: 5915891 - DNA, 13 bp, Homo sapiens
gcttgacacctgt

SEQ ID NO: 5915892 - DNA, 16 bp, Homo sapiens
gcttgacacctttgaa

SEQ ID NO: 5915893 - DNA, 16 bp, Homo sapiens
gcttgacaggacagca

SEQ ID NO: 5915894 - DNA, 13 bp, Homo sapiens
gcttgacatgtgc

SEQ ID NO: 5915895 - DNA, 14 bp, Homo sapiens
gcttgaccagacct

SEQ ID NO: 5915896 - DNA, 15 bp, Homo sapiens
gcttgaccagaccta

SEQ ID NO: 5915897 - DNA, 20 bp, Homo sapiens
gcttgaccatgttgcactgt

SEQ ID NO: 5915898 - DNA, 19 bp, Homo sapiens
gcttgaccgtactctcaca

SEQ ID NO: 5915899 - DNA, 23 bp, Homo sapiens
gcttgaccgtgaggccagagaca

SEQ ID NO: 5915900 - DNA, 14 bp, Homo sapiens
gcttgacctgaggc

SEQ ID NO: 5915901 - DNA, 23 bp, Homo sapiens
gcttgacgcgtggtcacaggacg

SEQ ID NO: 5915902 - DNA, 22 bp, Homo sapiens
gcttgactatcacatacaattt

SEQ ID NO: 5915903 - DNA, 16 bp, Homo sapiens
gcttgactcaggattt

SEQ ID NO: 5915904 - DNA, 23 bp, Homo sapiens
gcttgactcaggatttaaaaact

SEQ ID NO: 5915905 - DNA, 13 bp, Homo sapiens
gcttgactctcac

SEQ ID NO: 5915906 - DNA, 21 bp, Homo sapiens
gcttgactggatggaaggaga

SEQ ID NO: 5915907 - DNA, 18 bp, Homo sapiens
gcttgacttgtggggcag

SEQ ID NO: 5915908 - DNA, 14 bp, Homo sapiens
gcttgactttccag

SEQ ID NO: 5915909 - DNA, 15 bp, Homo sapiens
gcttgactttccaga

SEQ ID NO: 5915910 - DNA, 15 bp, Homo sapiens
gcttgactttggctg

SEQ ID NO: 5915911 - DNA, 22 bp, Homo sapiens
gcttgagaaggttactgagtga

SEQ ID NO: 5915912 - DNA, 23 bp, Homo sapiens
gcttgagacaaatcctttctgcc

SEQ ID NO: 5915913 - DNA, 12 bp, Homo sapiens
gcttgagcccag

SEQ ID NO: 5915914 - DNA, 15 bp, Homo sapiens
gcttgagcccaggag

SEQ ID NO: 5915915 - DNA, 12 bp, Homo sapiens
gcttgagccggg

SEQ ID NO: 5915916 - DNA, 13 bp, Homo sapiens
gcttgagcctccc

SEQ ID NO: 5915917 - DNA, 12 bp, Homo sapiens
gcttgagcctgt

SEQ ID NO: 5915918 - DNA, 13 bp, Homo sapiens
gcttgagcctgtc

SEQ ID NO: 5915919 - DNA, 18 bp, Homo sapiens
gcttgagctttctgtgca

SEQ ID NO: 5915920 - DNA, 20 bp, Homo sapiens
gcttgagctttctgtgcatg

SEQ ID NO: 5915921 - DNA, 22 bp, Homo sapiens
gcttgagctttctgtgcatgtg

SEQ ID NO: 5915922 - DNA, 21 bp, Homo sapiens
gcttgaggaggggcacctgcc

SEQ ID NO: 5915923 - DNA, 13 bp, Homo sapiens
gcttgagggaggg

SEQ ID NO: 5915924 - DNA, 22 bp, Homo sapiens
gcttgagggttgggctggtgtc

SEQ ID NO: 5915925 - DNA, 18 bp, Homo sapiens
gcttgaggtgaatttcat

SEQ ID NO: 5915926 - DNA, 22 bp, Homo sapiens
gcttgagtgagaagagcttgca

SEQ ID NO: 5915927 - DNA, 19 bp, Homo sapiens
gcttgagttaggaatgaga

SEQ ID NO: 5915928 - DNA, 19 bp, Homo sapiens
gcttgagtttggggaatgc

SEQ ID NO: 5915929 - DNA, 13 bp, Homo sapiens
gcttgagttttca

SEQ ID NO: 5915930 - DNA, 20 bp, Homo sapiens
gcttgagttttcatttcata

SEQ ID NO: 5915931 - DNA, 18 bp, Homo sapiens
gcttgataatatataaac

SEQ ID NO: 5915932 - DNA, 20 bp, Homo sapiens
gcttgataatatataaacaa

SEQ ID NO: 5915933 - DNA, 14 bp, Homo sapiens
gcttgatccagaag

SEQ ID NO: 5915934 - DNA, 21 bp, Homo sapiens
gcttgatccagaagagcccat

SEQ ID NO: 5915935 - DNA, 14 bp, Homo sapiens
gcttgatctgtgat

SEQ ID NO: 5915936 - DNA, 13 bp, Homo sapiens
gcttgatgaagca

SEQ ID NO: 5915937 - DNA, 19 bp, Homo sapiens
gcttgatgggattctggac

SEQ ID NO: 5915938 - DNA, 18 bp, Homo sapiens
gcttgatggtgacagctg

SEQ ID NO: 5915939 - DNA, 15 bp, Homo sapiens
gcttgatgttatatt

SEQ ID NO: 5915940 - DNA, 19 bp, Homo sapiens
gcttggtggggctcgtggc

SEQ ID NO: 5915941 - DNA, 21 bp, Homo sapiens
gcttggtggggctcgtggcct

SEQ ID NO: 5915942 - DNA, 20 bp, Homo sapiens
gcttggtggttatgtcccat

SEQ ID NO: 5915943 - DNA, 12 bp, Homo sapiens
gcttggtgtgac

SEQ ID NO: 5915944 - DNA, 14 bp, Homo sapiens
gcttggtgtgaccc

SEQ ID NO: 5915945 - DNA, 15 bp, Homo sapiens
gcttggttcctgccc

SEQ ID NO: 5915946 - DNA, 13 bp, Homo sapiens
gcttggttggctg

SEQ ID NO: 5915947 - DNA, 22 bp, Homo sapiens
gcttggtttagctgtgcagaag

SEQ ID NO: 5915948 - DNA, 17 bp, Homo sapiens
gcttgtaaatagctcag

SEQ ID NO: 5915949 - DNA, 18 bp, Homo sapiens
gcttgtaaatagctcagg

SEQ ID NO: 5915950 - DNA, 15 bp, Homo sapiens
gcttgtaacaagaaa

SEQ ID NO: 5915951 - DNA, 17 bp, Homo sapiens
gcttgtaacaagaaaac

SEQ ID NO: 5915952 - DNA, 15 bp, Homo sapiens
gcttgtaactccacc

SEQ ID NO: 5915953 - DNA, 16 bp, Homo sapiens
gcttgtaactccacca

SEQ ID NO: 5915954 - DNA, 14 bp, Homo sapiens
gcttgtacagttga

SEQ ID NO: 5915955 - DNA, 16 bp, Homo sapiens
gcttgtacataatgcg

SEQ ID NO: 5915956 - DNA, 19 bp, Homo sapiens
gcttgtacataatgcgtgc

SEQ ID NO: 5915957 - DNA, 21 bp, Homo sapiens
gcttgtacatttttaaattct

SEQ ID NO: 5915958 - DNA, 18 bp, Homo sapiens
gcttgtacctctggctga

SEQ ID NO: 5915959 - DNA, 15 bp, Homo sapiens
gcttgtactaagcca

SEQ ID NO: 5915960 - DNA, 18 bp, Homo sapiens
gcttgtactaagccagga

SEQ ID NO: 5915961 - DNA, 22 bp, Homo sapiens
gcttgtactaagccaggaggct

SEQ ID NO: 5915962 - DNA, 16 bp, Homo sapiens
gcttgtactgggacat

SEQ ID NO: 5915963 - DNA, 22 bp, Homo sapiens
gcttgtagaagtaggaggaaac

SEQ ID NO: 5915964 - DNA, 23 bp, Homo sapiens
gcttgtagaatttttaaaaaagt

SEQ ID NO: 5915965 - DNA, 19 bp, Homo sapiens
gcttgtagaccactgtcct

SEQ ID NO: 5915966 - DNA, 15 bp, Homo sapiens
gcttgtagccagccg

SEQ ID NO: 5915967 - DNA, 16 bp, Homo sapiens
gcttgtagccagccgg

SEQ ID NO: 5915968 - DNA, 14 bp, Homo sapiens
gcttgtagccctgg

SEQ ID NO: 5915969 - DNA, 21 bp, Homo sapiens
gcttgtagccctggatggcct

SEQ ID NO: 5915970 - DNA, 13 bp, Homo sapiens
gcttgtaggagct

SEQ ID NO: 5915971 - DNA, 14 bp, Homo sapiens
gcttgtagggtgag

SEQ ID NO: 5915972 - DNA, 15 bp, Homo sapiens
gcttgtagggtgagg

SEQ ID NO: 5915973 - DNA, 18 bp, Homo sapiens
gcttgtagggtgaggcgt

SEQ ID NO: 5915974 - DNA, 23 bp, Homo sapiens
gcttgtaggtatgtctgtgccat

SEQ ID NO: 5915975 - DNA, 14 bp, Homo sapiens
gcttgtatatacat

SEQ ID NO: 5915976 - DNA, 15 bp, Homo sapiens
gcttgtatatacata

SEQ ID NO: 5915977 - DNA, 22 bp, Homo sapiens
gcttgtatatacatattataaa

SEQ ID NO: 5915978 - DNA, 16 bp, Homo sapiens
gcttgtatctgatatc

SEQ ID NO: 5915979 - DNA, 17 bp, Homo sapiens
gcttgtatctgatatca

SEQ ID NO: 5915980 - DNA, 18 bp, Homo sapiens
gcttgtcactagcagctg

SEQ ID NO: 5915981 - DNA, 13 bp, Homo sapiens
gcttgtcagagct

SEQ ID NO: 5915982 - DNA, 17 bp, Homo sapiens
gcttgtcatagccagtg

SEQ ID NO: 5915983 - DNA, 11 bp, Homo sapiens
gcttgtcatcc

SEQ ID NO: 5915984 - DNA, 16 bp, Homo sapiens
gcttgtcatctgccac

SEQ ID NO: 5915985 - DNA, 18 bp, Homo sapiens
gcttgtcattgagcctgg

SEQ ID NO: 5915986 - DNA, 21 bp, Homo sapiens
gcttgtccaacccgaggcccg

SEQ ID NO: 5915987 - DNA, 15 bp, Homo sapiens
gcttgtccagcgcct

SEQ ID NO: 5915988 - DNA, 16 bp, Homo sapiens
gcttgtccctgcccag

SEQ ID NO: 5915989 - DNA, 14 bp, Homo sapiens
gcttgtcctgctca

SEQ ID NO: 5915990 - DNA, 23 bp, Homo sapiens
gcttgtcctgctcagatgctggt

SEQ ID NO: 5915991 - DNA, 15 bp, Homo sapiens
gcttgtcctgctctc

SEQ ID NO: 5915992 - DNA, 21 bp, Homo sapiens
gcttgtcctgctctcttcagg

SEQ ID NO: 5915993 - DNA, 17 bp, Homo sapiens
gcttgtccttgctcctg

SEQ ID NO: 5915994 - DNA, 18 bp, Homo sapiens
gcttgtctcttgcctgcc

SEQ ID NO: 5915995 - DNA, 19 bp, Homo sapiens
gcttgtctcttgcctgcca

SEQ ID NO: 5915996 - DNA, 22 bp, Homo sapiens
gcttgtcttcgtccatctgttg

SEQ ID NO: 5915997 - DNA, 19 bp, Homo sapiens
gcttgtctttaaagttact

SEQ ID NO: 5915998 - DNA, 23 bp, Homo sapiens
gcttgtcttttctgctgaggagg

SEQ ID NO: 5915999 - DNA, 20 bp, Homo sapiens
gcttgtgaaaaaataaagaa

SEQ ID NO: 5916000 - DNA, 12 bp, Homo sapiens
gcttgtgaacag

SEQ ID NO: 5916001 - DNA, 14 bp, Homo sapiens
gcttgtgagagctg

SEQ ID NO: 5916002 - DNA, 16 bp, Homo sapiens
gcttgtgagagctggt

SEQ ID NO: 5916003 - DNA, 18 bp, Homo sapiens
gcttgtgagagctggttg

SEQ ID NO: 5916004 - DNA, 17 bp, Homo sapiens
gcttgtgatctgggaac

SEQ ID NO: 5916005 - DNA, 20 bp, Homo sapiens
gcttgtgatttccatttctg

SEQ ID NO: 5916006 - DNA, 14 bp, Homo sapiens
gcttgtgcacaatt

SEQ ID NO: 5916007 - DNA, 21 bp, Homo sapiens
gcttgtgcagaaaacattgtt

SEQ ID NO: 5916008 - DNA, 18 bp, Homo sapiens
gcttgtgcctacctggcc

SEQ ID NO: 5916009 - DNA, 16 bp, Homo sapiens
gcttgtgctcatgtgt

SEQ ID NO: 5916010 - DNA, 14 bp, Homo sapiens
gcttgtgctcggga

SEQ ID NO: 5916011 - DNA, 15 bp, Homo sapiens
gcttgtgctgagcct

SEQ ID NO: 5916012 - DNA, 16 bp, Homo sapiens
gcttgtggaagacaag

SEQ ID NO: 5916013 - DNA, 17 bp, Homo sapiens
gcttgtggactctctgc

SEQ ID NO: 5916014 - DNA, 20 bp, Homo sapiens
gcttgtggactctctgcctg

SEQ ID NO: 5916015 - DNA, 22 bp, Homo sapiens
gcttgtggactctctgcctgct

SEQ ID NO: 5916016 - DNA, 14 bp, Homo sapiens
gcttgtggagcccc

SEQ ID NO: 5916017 - DNA, 20 bp, Homo sapiens
gcttgtggagccccacactg

SEQ ID NO: 5916018 - DNA, 21 bp, Homo sapiens
gcttgtggccccttttacttt

SEQ ID NO: 5916019 - DNA, 22 bp, Homo sapiens
gcttgtggctccacacacacaa

SEQ ID NO: 5916020 - DNA, 19 bp, Homo sapiens
gcttgtgggcactgtgcca

SEQ ID NO: 5916021 - DNA, 16 bp, Homo sapiens
gcttgtgggctggtgc

SEQ ID NO: 5916022 - DNA, 22 bp, Homo sapiens
gcttgtgggctggtgccccaca

SEQ ID NO: 5916023 - DNA, 17 bp, Homo sapiens
gcttgtggggcctggga

SEQ ID NO: 5916024 - DNA, 20 bp, Homo sapiens
gcttgtggtggggcaggaac

SEQ ID NO: 5916025 - DNA, 16 bp, Homo sapiens
gcttgtgtcctgtcct

SEQ ID NO: 5916026 - DNA, 12 bp, Homo sapiens
gcttgtgttaag

SEQ ID NO: 5916027 - DNA, 16 bp, Homo sapiens
gcttgtgttctgctcc

SEQ ID NO: 5916028 - DNA, 17 bp, Homo sapiens
gcttgttatcagctttc

SEQ ID NO: 5916029 - DNA, 15 bp, Homo sapiens
gcttgttatttataa

SEQ ID NO: 5916030 - DNA, 18 bp, Homo sapiens
gcttgttccctctccctg

SEQ ID NO: 5916031 - DNA, 14 bp, Homo sapiens
gcttgttctctgga

SEQ ID NO: 5916032 - DNA, 16 bp, Homo sapiens
gcttgttctctggaac

SEQ ID NO: 5916033 - DNA, 22 bp, Homo sapiens
gcttgttgaaaatatttctcta

SEQ ID NO: 5916034 - DNA, 13 bp, Homo sapiens
gcttgttgacaga

SEQ ID NO: 5916035 - DNA, 13 bp, Homo sapiens
gcttgttgacatc

SEQ ID NO: 5916036 - DNA, 24 bp, Homo sapiens
gcttgttgcatttccagctgtgca

SEQ ID NO: 5916037 - DNA, 14 bp, Homo sapiens
gcttgttgtaaagc

SEQ ID NO: 5916038 - DNA, 23 bp, Homo sapiens
gcttgtttaacggcagtgtcatt

SEQ ID NO: 5916039 - DNA, 13 bp, Homo sapiens
gcttgtttacagc

SEQ ID NO: 5916040 - DNA, 15 bp, Homo sapiens
gcttgtttacatgct

SEQ ID NO: 5916041 - DNA, 19 bp, Homo sapiens
gcttgtttacatgcttatt

SEQ ID NO: 5916042 - DNA, 15 bp, Homo sapiens
gcttgtttcctagca

SEQ ID NO: 5916043 - DNA, 18 bp, Homo sapiens
gcttgtttctatactgtt

SEQ ID NO: 5916044 - DNA, 17 bp, Homo sapiens
gcttgtttgatttcaac

SEQ ID NO: 5916045 - DNA, 15 bp, Homo sapiens
gcttgtttgcctgtc

SEQ ID NO: 5916046 - DNA, 19 bp, Homo sapiens
gcttgtttgctcacctggg

SEQ ID NO: 5916047 - DNA, 21 bp, Homo sapiens
gcttgtttgctcacctggggt

SEQ ID NO: 5916048 - DNA, 23 bp, Homo sapiens
gcttgttttataaaattttgctt

SEQ ID NO: 5916049 - DNA, 22 bp, Homo sapiens
gcttgttttccaaagaaaagta

SEQ ID NO: 5916050 - DNA, 18 bp, Homo sapiens
gcttgtttttcttcagca

SEQ ID NO: 5916051 - DNA, 18 bp, Homo sapiens
gctttaaaaaaataattg

SEQ ID NO: 5916052 - DNA, 16 bp, Homo sapiens
gctttaaaaaataaag

SEQ ID NO: 5916053 - DNA, 13 bp, Homo sapiens
gctttaaaaagaa

SEQ ID NO: 5916054 - DNA, 16 bp, Homo sapiens
gctttaaaaagaaaaa

SEQ ID NO: 5916055 - DNA, 21 bp, Homo sapiens
gctttaaaaagggaagaaact

SEQ ID NO: 5916056 - DNA, 13 bp, Homo sapiens
gctttaaaacaag

SEQ ID NO: 5916057 - DNA, 19 bp, Homo sapiens
gctttaaaacaagtgtgat

SEQ ID NO: 5916058 - DNA, 18 bp, Homo sapiens
gctttaaaagtatcttta

SEQ ID NO: 5916059 - DNA, 18 bp, Homo sapiens
gctttaaaagtcattatt

SEQ ID NO: 5916060 - DNA, 13 bp, Homo sapiens
gctttaaacaaat

SEQ ID NO: 5916061 - DNA, 16 bp, Homo sapiens
gctttaaacacccttc

SEQ ID NO: 5916062 - DNA, 20 bp, Homo sapiens
gctttaaacatgattatctt

SEQ ID NO: 5916063 - DNA, 20 bp, Homo sapiens
gctttaaactaccctccaga

SEQ ID NO: 5916064 - DNA, 16 bp, Homo sapiens
gctttaaactcaggga

SEQ ID NO: 5916065 - DNA, 18 bp, Homo sapiens
gctttaaactcagggaca

SEQ ID NO: 5916066 - DNA, 21 bp, Homo sapiens
gctttaaactcagggacagag

SEQ ID NO: 5916067 - DNA, 14 bp, Homo sapiens
gctttaaactgaca

SEQ ID NO: 5916068 - DNA, 19 bp, Homo sapiens
gctttaaatggcaattttt

SEQ ID NO: 5916069 - DNA, 13 bp, Homo sapiens
gctttaaattaaa

SEQ ID NO: 5916070 - DNA, 16 bp, Homo sapiens
gctttaaattaaaatt

SEQ ID NO: 5916071 - DNA, 19 bp, Homo sapiens
gctttaaccgtttttcaag

SEQ ID NO: 5916072 - DNA, 19 bp, Homo sapiens
gctttaacctgctgggaat

SEQ ID NO: 5916073 - DNA, 18 bp, Homo sapiens
gctttaacttaaatagta

SEQ ID NO: 5916074 - DNA, 15 bp, Homo sapiens
gctttaagaatgaac

SEQ ID NO: 5916075 - DNA, 14 bp, Homo sapiens
gctttaagccttca

SEQ ID NO: 5916076 - DNA, 16 bp, Homo sapiens
gctttaagctccagct

SEQ ID NO: 5916077 - DNA, 19 bp, Homo sapiens
gctttaagtgtgctgggca

SEQ ID NO: 5916078 - DNA, 13 bp, Homo sapiens
gctttaataatgt

SEQ ID NO: 5916079 - DNA, 12 bp, Homo sapiens
gctttaatataa

SEQ ID NO: 5916080 - DNA, 19 bp, Homo sapiens
gctttaatataaatgcaaa

SEQ ID NO: 5916081 - DNA, 21 bp, Homo sapiens
gctttaatataaatgcaaata

SEQ ID NO: 5916082 - DNA, 20 bp, Homo sapiens
gctttaatatgagcttcaat

SEQ ID NO: 5916083 - DNA, 19 bp, Homo sapiens
gctttaattaagctctcat

SEQ ID NO: 5916084 - DNA, 22 bp, Homo sapiens
gctttaattaattaagtatctg

SEQ ID NO: 5916085 - DNA, 18 bp, Homo sapiens
gctttaattacctggtga

SEQ ID NO: 5916086 - DNA, 20 bp, Homo sapiens
gctttaattacctggtgagt

SEQ ID NO: 5916087 - DNA, 19 bp, Homo sapiens
gctttaattccatgaatgt

SEQ ID NO: 5916088 - DNA, 12 bp, Homo sapiens
gctttaattgta

SEQ ID NO: 5916089 - DNA, 20 bp, Homo sapiens
gctttacaaaccaaccattt

SEQ ID NO: 5916090 - DNA, 22 bp, Homo sapiens
gctttacagtttttttctttgt

SEQ ID NO: 5916091 - DNA, 13 bp, Homo sapiens
gctttacatattc

SEQ ID NO: 5916092 - DNA, 12 bp, Homo sapiens
gctttacatgca

SEQ ID NO: 5916093 - DNA, 14 bp, Homo sapiens
gctttaccaaacag

SEQ ID NO: 5916094 - DNA, 17 bp, Homo sapiens
gctttaccaaacagcaa

SEQ ID NO: 5916095 - DNA, 14 bp, Homo sapiens
gctttacctttatt

SEQ ID NO: 5916096 - DNA, 19 bp, Homo sapiens
gctttacctttattaatga

SEQ ID NO: 5916097 - DNA, 13 bp, Homo sapiens
gctttaccttttt

SEQ ID NO: 5916098 - DNA, 15 bp, Homo sapiens
gctttacctttttgt

SEQ ID NO: 5916099 - DNA, 23 bp, Homo sapiens
gctttacctttttgtatgtgaac

SEQ ID NO: 5916100 - DNA, 19 bp, Homo sapiens
gctttactgtggctgtctg

SEQ ID NO: 5916101 - DNA, 16 bp, Homo sapiens
gctttactgtttgtta

SEQ ID NO: 5916102 - DNA, 18 bp, Homo sapiens
gctttactttagaattta

SEQ ID NO: 5916103 - DNA, 23 bp, Homo sapiens
gctttactttgtggatatattta

SEQ ID NO: 5916104 - DNA, 12 bp, Homo sapiens
gctttagaaaca

SEQ ID NO: 5916105 - DNA, 18 bp, Homo sapiens
gctttagaatgttttcct

SEQ ID NO: 5916106 - DNA, 20 bp, Homo sapiens
gctttagaatgttttccttc

SEQ ID NO: 5916107 - DNA, 21 bp, Homo sapiens
gctttagacactggctgccag

SEQ ID NO: 5916108 - DNA, 12 bp, Homo sapiens
gctttagacttg

SEQ ID NO: 5916109 - DNA, 18 bp, Homo sapiens
gctttagacttgaaaaga

SEQ ID NO: 5916110 - DNA, 18 bp, Homo sapiens
gctttagagacagggact

SEQ ID NO: 5916111 - DNA, 19 bp, Homo sapiens
gctttagagataattgctt

SEQ ID NO: 5916112 - DNA, 23 bp, Homo sapiens
gctttagattgaaatttatgact

SEQ ID NO: 5916113 - DNA, 18 bp, Homo sapiens
gctttagctggagggaga

SEQ ID NO: 5916114 - DNA, 12 bp, Homo sapiens
gctttagcttat

SEQ ID NO: 5916115 - DNA, 15 bp, Homo sapiens
gctttagtgaattaa

SEQ ID NO: 5916116 - DNA, 16 bp, Homo sapiens
gctttataataaactg

SEQ ID NO: 5916117 - DNA, 19 bp, Homo sapiens
gctttataatttctaccca

SEQ ID NO: 5916118 - DNA, 18 bp, Homo sapiens
gcttttatggggccctgt

SEQ ID NO: 5916119 - DNA, 15 bp, Homo sapiens
gcttttatgtgaaac

SEQ ID NO: 5916120 - DNA, 19 bp, Homo sapiens
gcttttatgtgaaacatgt

SEQ ID NO: 5916121 - DNA, 15 bp, Homo sapiens
gcttttattaaattt

SEQ ID NO: 5916122 - DNA, 18 bp, Homo sapiens
gcttttattaatgcactt

SEQ ID NO: 5916123 - DNA, 23 bp, Homo sapiens
gcttttattcgtcctttgacaaa

SEQ ID NO: 5916124 - DNA, 19 bp, Homo sapiens
gcttttattgagtaatatt

SEQ ID NO: 5916125 - DNA, 21 bp, Homo sapiens
gcttttattgagtaatattac

SEQ ID NO: 5916126 - DNA, 21 bp, Homo sapiens
gcttttattgcaccattttca

SEQ ID NO: 5916127 - DNA, 19 bp, Homo sapiens
gcttttatttggtgtgttc

SEQ ID NO: 5916128 - DNA, 21 bp, Homo sapiens
gcttttattttaatattgatg

SEQ ID NO: 5916129 - DNA, 16 bp, Homo sapiens
gcttttattttgaaaa

SEQ ID NO: 5916130 - DNA, 18 bp, Homo sapiens
gcttttattttttaagtt

SEQ ID NO: 5916131 - DNA, 14 bp, Homo sapiens
gcttttcaaacaaa

SEQ ID NO: 5916132 - DNA, 23 bp, Homo sapiens
gcttttcactgctggctgcctta

SEQ ID NO: 5916133 - DNA, 14 bp, Homo sapiens
gcttttcacttctt

SEQ ID NO: 5916134 - DNA, 15 bp, Homo sapiens
gcttttcactttctg

SEQ ID NO: 5916135 - DNA, 14 bp, Homo sapiens
gcttttcagccaat

SEQ ID NO: 5916136 - DNA, 22 bp, Homo sapiens
gcttttcagttcccgctctgca

SEQ ID NO: 5916137 - DNA, 14 bp, Homo sapiens
gcttttcatgtaga

SEQ ID NO: 5916138 - DNA, 22 bp, Homo sapiens
gcttttcatgtagaactcagca

SEQ ID NO: 5916139 - DNA, 16 bp, Homo sapiens
gcttttccaacccatg

SEQ ID NO: 5916140 - DNA, 23 bp, Homo sapiens
gcttttccaacccatgagtgcta

SEQ ID NO: 5916141 - DNA, 19 bp, Homo sapiens
gcttttccaggaagatcca

SEQ ID NO: 5916142 - DNA, 15 bp, Homo sapiens
gcttttccaggatcc

SEQ ID NO: 5916143 - DNA, 19 bp, Homo sapiens
gcttttccaggatcctgca

SEQ ID NO: 5916144 - DNA, 13 bp, Homo sapiens
gcttttccagtgt

SEQ ID NO: 5916145 - DNA, 14 bp, Homo sapiens
gcttttcccaaccc

SEQ ID NO: 5916146 - DNA, 20 bp, Homo sapiens
gcttttcccaccagctccca

SEQ ID NO: 5916147 - DNA, 22 bp, Homo sapiens
gcttttccccggtcccttgaga

SEQ ID NO: 5916148 - DNA, 15 bp, Homo sapiens
gcttttccctgtcct

SEQ ID NO: 5916149 - DNA, 20 bp, Homo sapiens
gcttttccctttttttaagt

SEQ ID NO: 5916150 - DNA, 22 bp, Homo sapiens
gcttttcctcaaagggagagag

SEQ ID NO: 5916151 - DNA, 20 bp, Homo sapiens
gcttttcctggacagctaga

SEQ ID NO: 5916152 - DNA, 15 bp, Homo sapiens
gcttttcctgggaca

SEQ ID NO: 5916153 - DNA, 21 bp, Homo sapiens
gcttttccttggcattccgca

SEQ ID NO: 5916154 - DNA, 14 bp, Homo sapiens
gcttttccttgggg

SEQ ID NO: 5916155 - DNA, 20 bp, Homo sapiens
gcttttccttggggcaggca

SEQ ID NO: 5916156 - DNA, 18 bp, Homo sapiens
gcttttcgaactgtgctc

SEQ ID NO: 5916157 - DNA, 23 bp, Homo sapiens
gcttttcgaactgtgctcccacg

SEQ ID NO: 5916158 - DNA, 13 bp, Homo sapiens
gcttttctaatta

SEQ ID NO: 5916159 - DNA, 13 bp, Homo sapiens
gcttttctcatgg

SEQ ID NO: 5916160 - DNA, 17 bp, Homo sapiens
gcttttctcccagaagg

SEQ ID NO: 5916161 - DNA, 15 bp, Homo sapiens
gcttttctcccagct

SEQ ID NO: 5916162 - DNA, 13 bp, Homo sapiens
gcttttctcctct

SEQ ID NO: 5916163 - DNA, 12 bp, Homo sapiens
gcttttctgatc

SEQ ID NO: 5916164 - DNA, 15 bp, Homo sapiens
gcttttctgatccag

SEQ ID NO: 5916165 - DNA, 14 bp, Homo sapiens
gcttttctgccctg

SEQ ID NO: 5916166 - DNA, 15 bp, Homo sapiens
gcttttctgccctgg

SEQ ID NO: 5916167 - DNA, 16 bp, Homo sapiens
gcttttctgccctggc

SEQ ID NO: 5916168 - DNA, 20 bp, Homo sapiens
gcttttctggggcccaggaa

SEQ ID NO: 5916169 - DNA, 22 bp, Homo sapiens
gcttttctggggcccaggaagc

SEQ ID NO: 5916170 - DNA, 23 bp, Homo sapiens
gcttttctgtagatgttgtcttg

SEQ ID NO: 5916171 - DNA, 18 bp, Homo sapiens
gcttttctgtattttatt

SEQ ID NO: 5916172 - DNA, 12 bp, Homo sapiens
gcttttcttgat

SEQ ID NO: 5916173 - DNA, 13 bp, Homo sapiens
gcttttcttgata

SEQ ID NO: 5916174 - DNA, 21 bp, Homo sapiens
gcttttcttggccaacagaac

SEQ ID NO: 5916175 - DNA, 13 bp, Homo sapiens
gcttttgaaaagt

SEQ ID NO: 5916176 - DNA, 16 bp, Homo sapiens
gcttttgaaaagttga

SEQ ID NO: 5916177 - DNA, 19 bp, Homo sapiens
gcttttgaggctatttcta

SEQ ID NO: 5916178 - DNA, 15 bp, Homo sapiens
gcttttgagtgggcc

SEQ ID NO: 5916179 - DNA, 16 bp, Homo sapiens
gcttttgagtgggccc

SEQ ID NO: 5916180 - DNA, 17 bp, Homo sapiens
gcttttgatggctatgt

SEQ ID NO: 5916181 - DNA, 13 bp, Homo sapiens
gcttttgatgtct

SEQ ID NO: 5916182 - DNA, 13 bp, Homo sapiens
gcttttgattagt

SEQ ID NO: 5916183 - DNA, 21 bp, Homo sapiens
gcttttgcccattttgaatca

SEQ ID NO: 5916184 - DNA, 22 bp, Homo sapiens
gcttttgccccagaaaggggaa

SEQ ID NO: 5916185 - DNA, 17 bp, Homo sapiens
gcttttgcctctgccca

SEQ ID NO: 5916186 - DNA, 23 bp, Homo sapiens
gcttttgcctgcctgtgctattt

SEQ ID NO: 5916187 - DNA, 13 bp, Homo sapiens
gcttttgctagat

SEQ ID NO: 5916188 - DNA, 23 bp, Homo sapiens
gcttttgctagatggaatggaaa

SEQ ID NO: 5916189 - DNA, 15 bp, Homo sapiens
gcttttgctggtcac

SEQ ID NO: 5916190 - DNA, 14 bp, Homo sapiens
gcttttgcttggca

SEQ ID NO: 5916191 - DNA, 15 bp, Homo sapiens
gcttttggggctctt

SEQ ID NO: 5916192 - DNA, 15 bp, Homo sapiens
gcttttgggggtcag

SEQ ID NO: 5916193 - DNA, 17 bp, Homo sapiens
gcttttggtgaatttgt

SEQ ID NO: 5916194 - DNA, 15 bp, Homo sapiens
gcttttggtgcctgg

SEQ ID NO: 5916195 - DNA, 16 bp, Homo sapiens
gcttttggtgcctggc

SEQ ID NO: 5916196 - DNA, 14 bp, Homo sapiens
gcttttggttaata

SEQ ID NO: 5916197 - DNA, 22 bp, Homo sapiens
gcttttggttttaaacctttaa

SEQ ID NO: 5916198 - DNA, 22 bp, Homo sapiens
gcttttgtacgttaattaaaca

SEQ ID NO: 5916199 - DNA, 16 bp, Homo sapiens
gcttttgtatagaaaa

SEQ ID NO: 5916200 - DNA, 20 bp, Homo sapiens
gcttttgtctacacaccctg

SEQ ID NO: 5916201 - DNA, 15 bp, Homo sapiens
gcttttgtctccctt

SEQ ID NO: 5916202 - DNA, 19 bp, Homo sapiens
gcttttgtgatggagtgct

SEQ ID NO: 5916203 - DNA, 21 bp, Homo sapiens
gcttttgtgggggactgtaag

SEQ ID NO: 5916204 - DNA, 14 bp, Homo sapiens
gcttttgtgtccca

SEQ ID NO: 5916205 - DNA, 14 bp, Homo sapiens
gcttttgttctaga

SEQ ID NO: 5916206 - DNA, 15 bp, Homo sapiens
gcttttgttgtgact

SEQ ID NO: 5916207 - DNA, 12 bp, Homo sapiens
gcttttgtttct

SEQ ID NO: 5916208 - DNA, 15 bp, Homo sapiens
gcttttgttttcata

SEQ ID NO: 5916209 - DNA, 19 bp, Homo sapiens
gcttttgttttcctgctgg

SEQ ID NO: 5916210 - DNA, 23 bp, Homo sapiens
gctttttaaaaaaatctccccag

SEQ ID NO: 5916211 - DNA, 20 bp, Homo sapiens
gctttttaaactgatgtata

SEQ ID NO: 5916212 - DNA, 17 bp, Homo sapiens
gctttttaatagcacta

SEQ ID NO: 5916213 - DNA, 11 bp, Homo sapiens
gctttttaatg

SEQ ID NO: 5916214 - DNA, 13 bp, Homo sapiens
gctttttaattgt

SEQ ID NO: 5916215 - DNA, 18 bp, Homo sapiens
gctttttaccgttcactt

SEQ ID NO: 5916216 - DNA, 21 bp, Homo sapiens
gctttttatttctgcatatgt

SEQ ID NO: 5916217 - DNA, 13 bp, Homo sapiens
gctttttcacagt

SEQ ID NO: 5916218 - DNA, 21 bp, Homo sapiens
gctttttcatccttctttcct

SEQ ID NO: 5916219 - DNA, 13 bp, Homo sapiens
gctttttcccagc

SEQ ID NO: 5916220 - DNA, 14 bp, Homo sapiens
gctttttcccagcc

SEQ ID NO: 5916221 - DNA, 23 bp, Homo sapiens
gctttttccccattggaactagt

SEQ ID NO: 5916222 - DNA, 16 bp, Homo sapiens
gctttttcctcctgga

SEQ ID NO: 5916223 - DNA, 16 bp, Homo sapiens
gctttttcctctgagc

SEQ ID NO: 5916224 - DNA, 12 bp, Homo sapiens
gctttttccttt

SEQ ID NO: 5916225 - DNA, 20 bp, Homo sapiens
gctttttctccccttcacgt

SEQ ID NO: 5916226 - DNA, 15 bp, Homo sapiens
gctttttctctcagg

SEQ ID NO: 5916227 - DNA, 14 bp, Homo sapiens
gctttttctgactc

SEQ ID NO: 5916228 - DNA, 15 bp, Homo sapiens
gctttttctgccact

SEQ ID NO: 5916229 - DNA, 15 bp, Homo sapiens
gctttttctgtggag

SEQ ID NO: 5916230 - DNA, 22 bp, Homo sapiens
gctttttctgtggaggacagac

SEQ ID NO: 5916231 - DNA, 14 bp, Homo sapiens
gctttttcttctct

SEQ ID NO: 5916232 - DNA, 20 bp, Homo sapiens
gctttttctttttttgcata

SEQ ID NO: 5916233 - DNA, 18 bp, Homo sapiens
gctttttgaaatgaaatt

SEQ ID NO: 5916234 - DNA, 20 bp, Homo sapiens
gctttttgaggtggcacttt

SEQ ID NO: 5916235 - DNA, 12 bp, Homo sapiens
gctttttggaat

SEQ ID NO: 5916236 - DNA, 14 bp, Homo sapiens
gctttttgtcatgt

SEQ ID NO: 5916237 - DNA, 22 bp, Homo sapiens
gcttttttaaccaaggaggggc

SEQ ID NO: 5916238 - DNA, 15 bp, Homo sapiens
gcttttttattttaa

SEQ ID NO: 5916239 - DNA, 17 bp, Homo sapiens
gcttttttccaaaacaa

SEQ ID NO: 5916240 - DNA, 20 bp, Homo sapiens
gcttttttccaaaacaaaaa

SEQ ID NO: 5916241 - DNA, 21 bp, Homo sapiens
gcttttttcctcctttctctg

SEQ ID NO: 5916242 - DNA, 22 bp, Homo sapiens
gcttttttcctcctttctctgt

SEQ ID NO: 5916243 - DNA, 22 bp, Homo sapiens
gcttttttctctgatacagaaa

SEQ ID NO: 5916244 - DNA, 15 bp, Homo sapiens
gctttttttcttaaa

SEQ ID NO: 5916245 - DNA, 16 bp, Homo sapiens
gctttttttcttgcta

SEQ ID NO: 5916246 - DNA, 22 bp, Homo sapiens
gctttttttgcctaccatttca

SEQ ID NO: 5916247 - DNA, 22 bp, Homo sapiens
gctttttttgtgtgtatttgct

SEQ ID NO: 5916248 - DNA, 15 bp, Homo sapiens
gcttttttttccttc

SEQ ID NO: 5916249 - DNA, 23 bp, Homo sapiens
gcttttttttttcttttgttttg

SEQ ID NO: 5916250 - DNA, 18 bp, Homo sapiens
gcttttttttttttgctt

SEQ ID NO: 5916251 - DNA, 21 bp, Homo sapiens
gcttttttttttttgctttgt

SEQ ID NO: 5916252 - DNA, 16 bp, Homo sapiens
ggaaaaaaaaaaagaa

SEQ ID NO: 5916253 - DNA, 17 bp, Homo sapiens
ggaaaaaaaaaaagaaa

SEQ ID NO: 5916254 - DNA, 18 bp, Homo sapiens
ggaaaaaaaaaaagaaaa

SEQ ID NO: 5916255 - DNA, 12 bp, Homo sapiens
ggaaaaaaaaga

SEQ ID NO: 5916256 - DNA, 13 bp, Homo sapiens
ggaaaaaaaagaa

SEQ ID NO: 5916257 - DNA, 17 bp, Homo sapiens
ggaaaaaaaagagactg

SEQ ID NO: 5916258 - DNA, 14 bp, Homo sapiens
ggaaaaaaaatata

SEQ ID NO: 5916259 - DNA, 15 bp, Homo sapiens
ggaaaaaaacaaaca

SEQ ID NO: 5916260 - DNA, 20 bp, Homo sapiens
ggaaaaaaacataaaaagca

SEQ ID NO: 5916261 - DNA, 15 bp, Homo sapiens
ggaaaaaaactggga

SEQ ID NO: 5916262 - DNA, 13 bp, Homo sapiens
ggaaaaaaacttt

SEQ ID NO: 5916263 - DNA, 14 bp, Homo sapiens
ggaaaaaaactttt

SEQ ID NO: 5916264 - DNA, 17 bp, Homo sapiens
ggaaaaaaagactcttt

SEQ ID NO: 5916265 - DNA, 11 bp, Homo sapiens
ggaaaaaaagc

SEQ ID NO: 5916266 - DNA, 19 bp, Homo sapiens
ggaaaaaaatcatctattt

SEQ ID NO: 5916267 - DNA, 14 bp, Homo sapiens
ggaaaaaaatgact

SEQ ID NO: 5916268 - DNA, 18 bp, Homo sapiens
ggaaaaaaattacaaaga

SEQ ID NO: 5916269 - DNA, 21 bp, Homo sapiens
ggaaaaaactttgctccaggc

SEQ ID NO: 5916270 - DNA, 12 bp, Homo sapiens
ggaaaaaagaaa

SEQ ID NO: 5916271 - DNA, 23 bp, Homo sapiens
ggaaaaaagaaaaaaaattttgt

SEQ ID NO: 5916272 - DNA, 13 bp, Homo sapiens
ggaaaaaagaaat

SEQ ID NO: 5916273 - DNA, 21 bp, Homo sapiens
ggaaaaaagatttttaaaatg

SEQ ID NO: 5916274 - DNA, 18 bp, Homo sapiens
ggaaaaaagcacatacat

SEQ ID NO: 5916275 - DNA, 15 bp, Homo sapiens
ggaaaaaaggaggat

SEQ ID NO: 5916276 - DNA, 22 bp, Homo sapiens
ggaaaaaaggaggatagaaaaa

SEQ ID NO: 5916277 - DNA, 15 bp, Homo sapiens
ggaaaaaagttttga

SEQ ID NO: 5916278 - DNA, 13 bp, Homo sapiens
ggaaaaaattaaa

SEQ ID NO: 5916279 - DNA, 13 bp, Homo sapiens
ggaaaaaattaac

SEQ ID NO: 5916280 - DNA, 23 bp, Homo sapiens
ggaaaaaattgcttttgagagaa

SEQ ID NO: 5916281 - DNA, 16 bp, Homo sapiens
ggaaaaacaacaaata

SEQ ID NO: 5916282 - DNA, 19 bp, Homo sapiens
ggaaaaacagaacatttct

SEQ ID NO: 5916283 - DNA, 22 bp, Homo sapiens
ggaaaaacagaggatgctgaag

SEQ ID NO: 5916284 - DNA, 17 bp, Homo sapiens
ggaaaaacaggaaagga

SEQ ID NO: 5916285 - DNA, 15 bp, Homo sapiens
ggaaaaacctgtggg

SEQ ID NO: 5916286 - DNA, 21 bp, Homo sapiens
ggaaaaactgagacaggcagt

SEQ ID NO: 5916287 - DNA, 19 bp, Homo sapiens
ggaaaaactttggaaccag

SEQ ID NO: 5916288 - DNA, 21 bp, Homo sapiens
ggaaaaagaaaaacatttcct

SEQ ID NO: 5916289 - DNA, 23 bp, Homo sapiens
ggaaaaagaaaaacatttcctct

SEQ ID NO: 5916290 - DNA, 13 bp, Homo sapiens
ggaaaaagaaaat

SEQ ID NO: 5916291 - DNA, 21 bp, Homo sapiens
ggaaaaagacctcgtggagaa

SEQ ID NO: 5916292 - DNA, 21 bp, Homo sapiens
ggaaaaagcaggactgtgcct

SEQ ID NO: 5916293 - DNA, 22 bp, Homo sapiens
ggaaaaagccatatcatgctaa

SEQ ID NO: 5916294 - DNA, 23 bp, Homo sapiens
ggaaaaagctccatgtgcctctt

SEQ ID NO: 5916295 - DNA, 12 bp, Homo sapiens
ggaaaaaggaca

SEQ ID NO: 5916296 - DNA, 23 bp, Homo sapiens
ggaaattgagattagagggaggt

SEQ ID NO: 5916297 - DNA, 15 bp, Homo sapiens
ggaaattgcaaagaa

SEQ ID NO: 5916298 - DNA, 14 bp, Homo sapiens
ggaaattggcagtt

SEQ ID NO: 5916299 - DNA, 21 bp, Homo sapiens
ggaaattgtaaatcctgtgtt

SEQ ID NO: 5916300 - DNA, 17 bp, Homo sapiens
ggaaatttagcattgta

SEQ ID NO: 5916301 - DNA, 18 bp, Homo sapiens
ggaaatttatacaaagaa

SEQ ID NO: 5916302 - DNA, 17 bp, Homo sapiens
ggaaatttccattaaag

SEQ ID NO: 5916303 - DNA, 12 bp, Homo sapiens
ggaaatttgtgt

SEQ ID NO: 5916304 - DNA, 22 bp, Homo sapiens
ggaaatttgtgtgcttcacaca

SEQ ID NO: 5916305 - DNA, 23 bp, Homo sapiens
ggaaattttacaagggcataaag

SEQ ID NO: 5916306 - DNA, 23 bp, Homo sapiens
ggaaattttatatgtaaatgtgt

SEQ ID NO: 5916307 - DNA, 14 bp, Homo sapiens
ggaaatttttaatg

SEQ ID NO: 5916308 - DNA, 18 bp, Homo sapiens
ggaaatttttgcatgttt

SEQ ID NO: 5916309 - DNA, 16 bp, Homo sapiens
ggaacaaaaaaaccac

SEQ ID NO: 5916310 - DNA, 19 bp, Homo sapiens
ggaacaaacagaaatgact

SEQ ID NO: 5916311 - DNA, 13 bp, Homo sapiens
ggaacaaagcatg

SEQ ID NO: 5916312 - DNA, 15 bp, Homo sapiens
ggaacaaatcttcct

SEQ ID NO: 5916313 - DNA, 21 bp, Homo sapiens
ggaacaaatgcttttccaacc

SEQ ID NO: 5916314 - DNA, 12 bp, Homo sapiens
ggaacaaggaag

SEQ ID NO: 5916315 - DNA, 18 bp, Homo sapiens
ggaacaaggagtcagaca

SEQ ID NO: 5916316 - DNA, 16 bp, Homo sapiens
ggaacaagtgtacaga

SEQ ID NO: 5916317 - DNA, 16 bp, Homo sapiens
ggaacaatcacaaaag

SEQ ID NO: 5916318 - DNA, 18 bp, Homo sapiens
ggaacaatcacaaaagct

SEQ ID NO: 5916319 - DNA, 18 bp, Homo sapiens
ggaacaatcacagggaat

SEQ ID NO: 5916320 - DNA, 19 bp, Homo sapiens
ggaacaatcacagggaatg

SEQ ID NO: 5916321 - DNA, 13 bp, Homo sapiens
ggaacaatctaaa

SEQ ID NO: 5916322 - DNA, 15 bp, Homo sapiens
ggaacaatgccgcct

SEQ ID NO: 5916323 - DNA, 21 bp, Homo sapiens
ggaacaattgaagtaaacttt

SEQ ID NO: 5916324 - DNA, 17 bp, Homo sapiens
ggaacacaataatgtgt

SEQ ID NO: 5916325 - DNA, 11 bp, Homo sapiens
ggaacacacac

SEQ ID NO: 5916326 - DNA, 14 bp, Homo sapiens
ggaacacacttgga

SEQ ID NO: 5916327 - DNA, 13 bp, Homo sapiens
ggaacacaggggc

SEQ ID NO: 5916328 - DNA, 14 bp, Homo sapiens
ggaacacatgcaca

SEQ ID NO: 5916329 - DNA, 19 bp, Homo sapiens
ggaacacatgcacacacac

SEQ ID NO: 5916330 - DNA, 16 bp, Homo sapiens
ggaacacccagcccca

SEQ ID NO: 5916331 - DNA, 13 bp, Homo sapiens
ggaacaccctgga

SEQ ID NO: 5916332 - DNA, 13 bp, Homo sapiens
ggaacacctcctc

SEQ ID NO: 5916333 - DNA, 22 bp, Homo sapiens
ggaacacctgatggtgaaacca

SEQ ID NO: 5916334 - DNA, 14 bp, Homo sapiens
ggaacacggccaca

SEQ ID NO: 5916335 - DNA, 21 bp, Homo sapiens
ggaacactagacaagccagaa

SEQ ID NO: 5916336 - DNA, 13 bp, Homo sapiens
ggaacactataga

SEQ ID NO: 5916337 - DNA, 17 bp, Homo sapiens
ggaacactcatgtctgg

SEQ ID NO: 5916338 - DNA, 15 bp, Homo sapiens
ggaacactccttcac

SEQ ID NO: 5916339 - DNA, 14 bp, Homo sapiens
ggaacactctgaga

SEQ ID NO: 5916340 - DNA, 16 bp, Homo sapiens
ggaacactctgagact

SEQ ID NO: 5916341 - DNA, 18 bp, Homo sapiens
ggaacactgagaaagagg

SEQ ID NO: 5916342 - DNA, 14 bp, Homo sapiens
ggaacactggcaga

SEQ ID NO: 5916343 - DNA, 22 bp, Homo sapiens
ggaacactggtgggcagctgag

SEQ ID NO: 5916344 - DNA, 15 bp, Homo sapiens
ggaacactgtcaatg

SEQ ID NO: 5916345 - DNA, 22 bp, Homo sapiens
ggaacagaacacttctaggact

SEQ ID NO: 5916346 - DNA, 12 bp, Homo sapiens
ggaacagaagtg

SEQ ID NO: 5916347 - DNA, 21 bp, Homo sapiens
ggaacagaagtgaggatgaga

SEQ ID NO: 5916348 - DNA, 16 bp, Homo sapiens
ggaacagaatgtttta

SEQ ID NO: 5916349 - DNA, 21 bp, Homo sapiens
ggaacagacaacagaagtcat

SEQ ID NO: 5916350 - DNA, 15 bp, Homo sapiens
ggaacagaccagtga

SEQ ID NO: 5916351 - DNA, 13 bp, Homo sapiens
ggaacagacctga

SEQ ID NO: 5916352 - DNA, 17 bp, Homo sapiens
ggaacagactggaagca

SEQ ID NO: 5916353 - DNA, 17 bp, Homo sapiens
ggaacagagcgggcctc

SEQ ID NO: 5916354 - DNA, 11 bp, Homo sapiens
ggaacagcaga

SEQ ID NO: 5916355 - DNA, 13 bp, Homo sapiens
ggaacagcagtgt

SEQ ID NO: 5916356 - DNA, 18 bp, Homo sapiens
ggaacagccaaagaaact

SEQ ID NO: 5916357 - DNA, 15 bp, Homo sapiens
ggaacagccacaaaa

SEQ ID NO: 5916358 - DNA, 12 bp, Homo sapiens
ggaacagcccag

SEQ ID NO: 5916359 - DNA, 13 bp, Homo sapiens
ggaacagcccagc

SEQ ID NO: 5916360 - DNA, 16 bp, Homo sapiens
ggaacagccccagggt

SEQ ID NO: 5916361 - DNA, 12 bp, Homo sapiens
ggaacagccctg

SEQ ID NO: 5916362 - DNA, 19 bp, Homo sapiens
ggaacagcgggagacctgt

SEQ ID NO: 5916363 - DNA, 21 bp, Homo sapiens
ggaacagctcttcactcagcc

SEQ ID NO: 5916364 - DNA, 22 bp, Homo sapiens
ggaacagctcttcactcagcca

SEQ ID NO: 5916365 - DNA, 13 bp, Homo sapiens
ggaacaggcccca

SEQ ID NO: 5916366 - DNA, 23 bp, Homo sapiens
ggaacaggctcagatctcatggg

SEQ ID NO: 5916367 - DNA, 15 bp, Homo sapiens
ggaacagggaccagc

SEQ ID NO: 5916368 - DNA, 14 bp, Homo sapiens
ggaacagggcccag

SEQ ID NO: 5916369 - DNA, 19 bp, Homo sapiens
ggaacagtattacagtgtc

SEQ ID NO: 5916370 - DNA, 17 bp, Homo sapiens
ggaacagtggccttgct

SEQ ID NO: 5916371 - DNA, 20 bp, Homo sapiens
ggaacagtgtaaatcccaga

SEQ ID NO: 5916372 - DNA, 18 bp, Homo sapiens
ggaacataaaaaggacat

SEQ ID NO: 5916373 - DNA, 17 bp, Homo sapiens
ggaacataaatcttaat

SEQ ID NO: 5916374 - DNA, 16 bp, Homo sapiens
ggaacatacagacaca

SEQ ID NO: 5916375 - DNA, 14 bp, Homo sapiens
ggaacatactgttc

SEQ ID NO: 5916376 - DNA, 15 bp, Homo sapiens
ggaacatcagtggat

SEQ ID NO: 5916377 - DNA, 15 bp, Homo sapiens
ggaacatcatcaagg

SEQ ID NO: 5916378 - DNA, 23 bp, Homo sapiens
ggaacatcatcaaggcactgcct

SEQ ID NO: 5916379 - DNA, 22 bp, Homo sapiens
ggaacatccggaacagccaaag

SEQ ID NO: 5916380 - DNA, 23 bp, Homo sapiens
ggaacatcctaagacagaggaac

SEQ ID NO: 5916381 - DNA, 14 bp, Homo sapiens
ggaacatgccccct

SEQ ID NO: 5916382 - DNA, 18 bp, Homo sapiens
ggaacatggagctgtcat

SEQ ID NO: 5916383 - DNA, 14 bp, Homo sapiens
ggaacatggggagg

SEQ ID NO: 5916384 - DNA, 19 bp, Homo sapiens
ggaacatgtgaatgaatac

SEQ ID NO: 5916385 - DNA, 15 bp, Homo sapiens
ggaacatgtgcttca

SEQ ID NO: 5916386 - DNA, 17 bp, Homo sapiens
ggaacattatttttaga

SEQ ID NO: 5916387 - DNA, 15 bp, Homo sapiens
ggaacattgggaagg

SEQ ID NO: 5916388 - DNA, 17 bp, Homo sapiens
ggaacatttattttatg

SEQ ID NO: 5916389 - DNA, 21 bp, Homo sapiens
ggaacatttctgtaaatacca

SEQ ID NO: 5916390 - DNA, 22 bp, Homo sapiens
ggaacatttctgtaaataccat

SEQ ID NO: 5916391 - DNA, 21 bp, Homo sapiens
ggaacatttgatatttttcca

SEQ ID NO: 5916392 - DNA, 13 bp, Homo sapiens
ggaaccacagggc

SEQ ID NO: 5916393 - DNA, 20 bp, Homo sapiens
ggaaccacagggccagaggg

SEQ ID NO: 5916394 - DNA, 13 bp, Homo sapiens
ggaaccaccagcg

SEQ ID NO: 5916395 - DNA, 22 bp, Homo sapiens
ggaaccactcccaccacaggca

SEQ ID NO: 5916396 - DNA, 12 bp, Homo sapiens
ggaaccagactc

SEQ ID NO: 5916397 - DNA, 23 bp, Homo sapiens
ggaaccagagcgatgtgttcttt

SEQ ID NO: 5916398 - DNA, 21 bp, Homo sapiens
ggaaccagcatctcagcgcca

SEQ ID NO: 5916399 - DNA, 14 bp, Homo sapiens
ggaaccaggcttgg

SEQ ID NO: 5916400 - DNA, 17 bp, Homo sapiens
ggaaccagggaggagag

SEQ ID NO: 5916401 - DNA, 12 bp, Homo sapiens
ggaaccagggcc

SEQ ID NO: 5916402 - DNA, 14 bp, Homo sapiens
ggaaccatgaagct

SEQ ID NO: 5916403 - DNA, 17 bp, Homo sapiens
ggaaccatgaagctgga

SEQ ID NO: 5916404 - DNA, 16 bp, Homo sapiens
ggaaccatggaggagg

SEQ ID NO: 5916405 - DNA, 18 bp, Homo sapiens
ggaaccattgttgtcttc

SEQ ID NO: 5916406 - DNA, 18 bp, Homo sapiens
ggaacccaccctctccac

SEQ ID NO: 5916407 - DNA, 14 bp, Homo sapiens
ggaacccagactca

SEQ ID NO: 5916408 - DNA, 13 bp, Homo sapiens
ggaacccagccag

SEQ ID NO: 5916409 - DNA, 16 bp, Homo sapiens
ggaacccatcactgtg

SEQ ID NO: 5916410 - DNA, 15 bp, Homo sapiens
ggaacccccctccca

SEQ ID NO: 5916411 - DNA, 22 bp, Homo sapiens
ggaacccccctcccacccaccg

SEQ ID NO: 5916412 - DNA, 18 bp, Homo sapiens
ggaaccccgagctggggg

SEQ ID NO: 5916413 - DNA, 16 bp, Homo sapiens
ggaacccctttcccac

SEQ ID NO: 5916414 - DNA, 19 bp, Homo sapiens
ggaacccctttcccacccc

SEQ ID NO: 5916415 - DNA, 18 bp, Homo sapiens
ggaacccggtcccaggcc

SEQ ID NO: 5916416 - DNA, 19 bp, Homo sapiens
ggaaccctctggggccctt

SEQ ID NO: 5916417 - DNA, 19 bp, Homo sapiens
ggaaccctggagacagaag

SEQ ID NO: 5916418 - DNA, 23 bp, Homo sapiens
ggaaccgaacatatcatttgtga

SEQ ID NO: 5916419 - DNA, 15 bp, Homo sapiens
ggaaccgaggactcc

SEQ ID NO: 5916420 - DNA, 20 bp, Homo sapiens
ggaaccgaggcagggaagga

SEQ ID NO: 5916421 - DNA, 23 bp, Homo sapiens
ggaaccgagggggctgctcccac

SEQ ID NO: 5916422 - DNA, 18 bp, Homo sapiens
ggaaccgcaggaagctgc

SEQ ID NO: 5916423 - DNA, 15 bp, Homo sapiens
ggaaccgccctcctg

SEQ ID NO: 5916424 - DNA, 18 bp, Homo sapiens
ggaaccgtgtccagcaca

SEQ ID NO: 5916425 - DNA, 14 bp, Homo sapiens
ggaacctcagcctg

SEQ ID NO: 5916426 - DNA, 15 bp, Homo sapiens
ggaacctcagcctgg

SEQ ID NO: 5916427 - DNA, 21 bp, Homo sapiens
ggaacctcagcctggccagac

SEQ ID NO: 5916428 - DNA, 23 bp, Homo sapiens
ggaacctcagcctggccagacac

SEQ ID NO: 5916429 - DNA, 20 bp, Homo sapiens
ggaacctcattgctaccaca

SEQ ID NO: 5916430 - DNA, 22 bp, Homo sapiens
ggaacctcccagaggtccagcc

SEQ ID NO: 5916431 - DNA, 14 bp, Homo sapiens
ggaacctccccagc

SEQ ID NO: 5916432 - DNA, 12 bp, Homo sapiens
ggaacctccctg

SEQ ID NO: 5916433 - DNA, 22 bp, Homo sapiens
ggaacctccctgggcctgtctc

SEQ ID NO: 5916434 - DNA, 14 bp, Homo sapiens
ggaacctctgtctc

SEQ ID NO: 5916435 - DNA, 23 bp, Homo sapiens
ggaacctctgtctcatcctcctg

SEQ ID NO: 5916436 - DNA, 13 bp, Homo sapiens
ggaacctgacccc

SEQ ID NO: 5916437 - DNA, 13 bp, Homo sapiens
ggaacctgacttt

SEQ ID NO: 5916438 - DNA, 11 bp, Homo sapiens
ggaacctgcca

SEQ ID NO: 5916439 - DNA, 12 bp, Homo sapiens
ggaacctggacc

SEQ ID NO: 5916440 - DNA, 18 bp, Homo sapiens
ggaacctggaccaaagct

SEQ ID NO: 5916441 - DNA, 15 bp, Homo sapiens
ggaacctggcaggcc

SEQ ID NO: 5916442 - DNA, 18 bp, Homo sapiens
ggaacctggcaggccctg

SEQ ID NO: 5916443 - DNA, 13 bp, Homo sapiens
ggaacctggctgc

SEQ ID NO: 5916444 - DNA, 22 bp, Homo sapiens
ggaacctgtcctaaggaacctt

SEQ ID NO: 5916445 - DNA, 16 bp, Homo sapiens
ggaaccttccctccaa

SEQ ID NO: 5916446 - DNA, 23 bp, Homo sapiens
ggaaccttctcccttcttgggtc

SEQ ID NO: 5916447 - DNA, 13 bp, Homo sapiens
ggaacctttccct

SEQ ID NO: 5916448 - DNA, 14 bp, Homo sapiens
ggaacgactggact

SEQ ID NO: 5916449 - DNA, 13 bp, Homo sapiens
ggaacgagcactg

SEQ ID NO: 5916450 - DNA, 13 bp, Homo sapiens
ggaacgcagatga

SEQ ID NO: 5916451 - DNA, 16 bp, Homo sapiens
ggaacgcagcctccag

SEQ ID NO: 5916452 - DNA, 14 bp, Homo sapiens
ggaacgcagttgat

SEQ ID NO: 5916453 - DNA, 13 bp, Homo sapiens
ggaacgcccactt

SEQ ID NO: 5916454 - DNA, 19 bp, Homo sapiens
ggaacgcccacttccctgg

SEQ ID NO: 5916455 - DNA, 21 bp, Homo sapiens
ggaacgcgttgaaattgtaat

SEQ ID NO: 5916456 - DNA, 18 bp, Homo sapiens
ggaacgctctaggcagaa

SEQ ID NO: 5916457 - DNA, 21 bp, Homo sapiens
ggaacgctctaggcagaagaa

SEQ ID NO: 5916458 - DNA, 17 bp, Homo sapiens
ggaacggatcagatgtc

SEQ ID NO: 5916459 - DNA, 13 bp, Homo sapiens
ggaacgggcagcc

SEQ ID NO: 5916460 - DNA, 14 bp, Homo sapiens
ggaacgggcagcca

SEQ ID NO: 5916461 - DNA, 20 bp, Homo sapiens
ggaacggtaaatttctgtgg

SEQ ID NO: 5916462 - DNA, 23 bp, Homo sapiens
ggaacgtagtcggcacagcctgg

SEQ ID NO: 5916463 - DNA, 16 bp, Homo sapiens
ggaacgtgactgcccc

SEQ ID NO: 5916464 - DNA, 21 bp, Homo sapiens
ggaacgtgtgtccaggctctg

SEQ ID NO: 5916465 - DNA, 22 bp, Homo sapiens
ggaactaaagggtgtgggtcag

SEQ ID NO: 5916466 - DNA, 20 bp, Homo sapiens
ggaactagactgcctgggtt

SEQ ID NO: 5916467 - DNA, 21 bp, Homo sapiens
ggaactatgaagacttaaaag

SEQ ID NO: 5916468 - DNA, 17 bp, Homo sapiens
ggaactatgaggagcct

SEQ ID NO: 5916469 - DNA, 14 bp, Homo sapiens
ggaactcaaggtgg

SEQ ID NO: 5916470 - DNA, 20 bp, Homo sapiens
ggaactcagatccagggaca

SEQ ID NO: 5916471 - DNA, 22 bp, Homo sapiens
ggaactcatcctgtgtggggag

SEQ ID NO: 5916472 - DNA, 23 bp, Homo sapiens
ggaactcatcctgtgtggggagg

SEQ ID NO: 5916473 - DNA, 13 bp, Homo sapiens
ggaactccactct

SEQ ID NO: 5916474 - DNA, 19 bp, Homo sapiens
ggaactccactctccttcg

SEQ ID NO: 5916475 - DNA, 21 bp, Homo sapiens
ggaagctttggtgagaacctg

SEQ ID NO: 5916476 - DNA, 19 bp, Homo sapiens
ggaagctttgtcccctgct

SEQ ID NO: 5916477 - DNA, 14 bp, Homo sapiens
ggaaggaaaaaata

SEQ ID NO: 5916478 - DNA, 20 bp, Homo sapiens
ggaaggaaacatagaaagac

SEQ ID NO: 5916479 - DNA, 21 bp, Homo sapiens
ggaaggaaacatagaaagaca

SEQ ID NO: 5916480 - DNA, 15 bp, Homo sapiens
ggaaggaaataacat

SEQ ID NO: 5916481 - DNA, 22 bp, Homo sapiens
ggaaggaacatggagctgtcat

SEQ ID NO: 5916482 - DNA, 18 bp, Homo sapiens
ggaaggaactctggcttc

SEQ ID NO: 5916483 - DNA, 15 bp, Homo sapiens
ggaaggaagaacagt

SEQ ID NO: 5916484 - DNA, 15 bp, Homo sapiens
ggaaggaaggctctc

SEQ ID NO: 5916485 - DNA, 19 bp, Homo sapiens
ggaaggacaatcccaggaa

SEQ ID NO: 5916486 - DNA, 16 bp, Homo sapiens
ggaaggacacagcagt

SEQ ID NO: 5916487 - DNA, 17 bp, Homo sapiens
ggaaggacacagcagta

SEQ ID NO: 5916488 - DNA, 16 bp, Homo sapiens
ggaaggacacattgtt

SEQ ID NO: 5916489 - DNA, 18 bp, Homo sapiens
ggaaggacacattgtttt

SEQ ID NO: 5916490 - DNA, 15 bp, Homo sapiens
ggaaggacagactgg

SEQ ID NO: 5916491 - DNA, 17 bp, Homo sapiens
ggaaggacagtccctgc

SEQ ID NO: 5916492 - DNA, 21 bp, Homo sapiens
ggaaggacagtccctgctggg

SEQ ID NO: 5916493 - DNA, 22 bp, Homo sapiens
ggaaggaccaacccatgccctg

SEQ ID NO: 5916494 - DNA, 23 bp, Homo sapiens
ggaaggaccaacccatgccctgc

SEQ ID NO: 5916495 - DNA, 12 bp, Homo sapiens
ggaaggacccct

SEQ ID NO: 5916496 - DNA, 15 bp, Homo sapiens
ggaaggaccctgtgc

SEQ ID NO: 5916497 - DNA, 17 bp, Homo sapiens
ggaaggacctatgtttg

SEQ ID NO: 5916498 - DNA, 16 bp, Homo sapiens
ggaaggagaagtaaga

SEQ ID NO: 5916499 - DNA, 17 bp, Homo sapiens
ggaaggagacacagatg

SEQ ID NO: 5916500 - DNA, 20 bp, Homo sapiens
ggaaggagacacagatgttc

SEQ ID NO: 5916501 - DNA, 18 bp, Homo sapiens
ggaaggagacaggatgag

SEQ ID NO: 5916502 - DNA, 14 bp, Homo sapiens
ggaaggagagcctg

SEQ ID NO: 5916503 - DNA, 17 bp, Homo sapiens
ggaaggagagcctgctg

SEQ ID NO: 5916504 - DNA, 19 bp, Homo sapiens
ggaaggagccagctcccag

SEQ ID NO: 5916505 - DNA, 21 bp, Homo sapiens
ggaaggagccagtttgccgga

SEQ ID NO: 5916506 - DNA, 17 bp, Homo sapiens
ggaaggagcccctgagt

SEQ ID NO: 5916507 - DNA, 13 bp, Homo sapiens
ggaaggagcctgc

SEQ ID NO: 5916508 - DNA, 21 bp, Homo sapiens
ggaaggagcctgcggctgctg

SEQ ID NO: 5916509 - DNA, 12 bp, Homo sapiens
ggaaggagcggc

SEQ ID NO: 5916510 - DNA, 15 bp, Homo sapiens
ggaaggagcggcgcc

SEQ ID NO: 5916511 - DNA, 21 bp, Homo sapiens
ggaaggagcggcgccctggac

SEQ ID NO: 5916512 - DNA, 14 bp, Homo sapiens
ggaaggagctgcct

SEQ ID NO: 5916513 - DNA, 13 bp, Homo sapiens
ggaaggaggagcc

SEQ ID NO: 5916514 - DNA, 16 bp, Homo sapiens
ggaaggaggagccgac

SEQ ID NO: 5916515 - DNA, 21 bp, Homo sapiens
ggaaggaggccaaccagcccg

SEQ ID NO: 5916516 - DNA, 16 bp, Homo sapiens
ggaaggagggagctgc

SEQ ID NO: 5916517 - DNA, 22 bp, Homo sapiens
ggaaggagggatgcgtgttcca

SEQ ID NO: 5916518 - DNA, 13 bp, Homo sapiens
ggaaggaggggag

SEQ ID NO: 5916519 - DNA, 20 bp, Homo sapiens
ggaaggagggtacagctggg

SEQ ID NO: 5916520 - DNA, 18 bp, Homo sapiens
ggaaggataaagccactt

SEQ ID NO: 5916521 - DNA, 13 bp, Homo sapiens
ggaaggatctgct

SEQ ID NO: 5916522 - DNA, 13 bp, Homo sapiens
ggaaggattgtaa

SEQ ID NO: 5916523 - DNA, 17 bp, Homo sapiens
ggaaggcaaaggcagag

SEQ ID NO: 5916524 - DNA, 19 bp, Homo sapiens
ggaaggcaaaggcagagga

SEQ ID NO: 5916525 - DNA, 18 bp, Homo sapiens
ggaaggcactacatgaaa

SEQ ID NO: 5916526 - DNA, 13 bp, Homo sapiens
ggaaggcagacag

SEQ ID NO: 5916527 - DNA, 12 bp, Homo sapiens
ggaaggcagagg

SEQ ID NO: 5916528 - DNA, 13 bp, Homo sapiens
ggaaggcagctgc

SEQ ID NO: 5916529 - DNA, 14 bp, Homo sapiens
ggaaggcagctgct

SEQ ID NO: 5916530 - DNA, 12 bp, Homo sapiens
ggaaggcaggca

SEQ ID NO: 5916531 - DNA, 19 bp, Homo sapiens
ggaaggcaggcagggctct

SEQ ID NO: 5916532 - DNA, 21 bp, Homo sapiens
ggaaggcaggcagggctctcc

SEQ ID NO: 5916533 - DNA, 18 bp, Homo sapiens
ggaaggcagggcagaggg

SEQ ID NO: 5916534 - DNA, 15 bp, Homo sapiens
ggaaggcagggcggt

SEQ ID NO: 5916535 - DNA, 19 bp, Homo sapiens
ggaaggcatgcctggacaa

SEQ ID NO: 5916536 - DNA, 21 bp, Homo sapiens
ggaaggccacctcccactcct

SEQ ID NO: 5916537 - DNA, 22 bp, Homo sapiens
ggaaggccatggggcagcctcc

SEQ ID NO: 5916538 - DNA, 14 bp, Homo sapiens
ggaaggcccagcac

SEQ ID NO: 5916539 - DNA, 15 bp, Homo sapiens
ggaaggcccagcacc

SEQ ID NO: 5916540 - DNA, 15 bp, Homo sapiens
ggaaggcccaggggt

SEQ ID NO: 5916541 - DNA, 16 bp, Homo sapiens
ggaaggccccttccct

SEQ ID NO: 5916542 - DNA, 14 bp, Homo sapiens
ggaaggccctgagg

SEQ ID NO: 5916543 - DNA, 22 bp, Homo sapiens
ggaaggcctcttggagacctta

SEQ ID NO: 5916544 - DNA, 12 bp, Homo sapiens
ggaaggcctggg

SEQ ID NO: 5916545 - DNA, 18 bp, Homo sapiens
ggaaggcctttcttctgt

SEQ ID NO: 5916546 - DNA, 19 bp, Homo sapiens
ggaaggcgagtctggggac

SEQ ID NO: 5916547 - DNA, 15 bp, Homo sapiens
ggaaggcggcaggca

SEQ ID NO: 5916548 - DNA, 21 bp, Homo sapiens
ggaaggcggcaggcagagaag

SEQ ID NO: 5916549 - DNA, 20 bp, Homo sapiens
ggaaggctacttcggggctg

SEQ ID NO: 5916550 - DNA, 23 bp, Homo sapiens
ggaaggctacttcggggctggga

SEQ ID NO: 5916551 - DNA, 22 bp, Homo sapiens
ggaaggctctctggtctacctg

SEQ ID NO: 5916552 - DNA, 14 bp, Homo sapiens
ggaaggctctgtca

SEQ ID NO: 5916553 - DNA, 20 bp, Homo sapiens
ggaaggctgaactcttcaga

SEQ ID NO: 5916554 - DNA, 15 bp, Homo sapiens
ggaaggctgccaggg

SEQ ID NO: 5916555 - DNA, 18 bp, Homo sapiens
ggaaggctgctgtgtagc

SEQ ID NO: 5916556 - DNA, 15 bp, Homo sapiens
ggaaggctggctgag

SEQ ID NO: 5916557 - DNA, 14 bp, Homo sapiens
ggaaggctgtgata

SEQ ID NO: 5916558 - DNA, 19 bp, Homo sapiens
ggaaggcttggtcccatcg

SEQ ID NO: 5916559 - DNA, 19 bp, Homo sapiens
ggaaggcttgttgtgcttt

SEQ ID NO: 5916560 - DNA, 15 bp, Homo sapiens
ggaagggaccaaggc

SEQ ID NO: 5916561 - DNA, 12 bp, Homo sapiens
ggaagggacccc

SEQ ID NO: 5916562 - DNA, 21 bp, Homo sapiens
ggaagggactctgggctgtgc

SEQ ID NO: 5916563 - DNA, 14 bp, Homo sapiens
ggaagggagggctt

SEQ ID NO: 5916564 - DNA, 15 bp, Homo sapiens
ggaagggataattta

SEQ ID NO: 5916565 - DNA, 17 bp, Homo sapiens
ggaagggcactatattt

SEQ ID NO: 5916566 - DNA, 13 bp, Homo sapiens
ggaagggcaggag

SEQ ID NO: 5916567 - DNA, 14 bp, Homo sapiens
ggaagggcaggagc

SEQ ID NO: 5916568 - DNA, 19 bp, Homo sapiens
ggaagggcaggagctcaca

SEQ ID NO: 5916569 - DNA, 13 bp, Homo sapiens
ggaagggcatgca

SEQ ID NO: 5916570 - DNA, 17 bp, Homo sapiens
ggaagggcatgcacggg

SEQ ID NO: 5916571 - DNA, 13 bp, Homo sapiens
ggaagggccaccc

SEQ ID NO: 5916572 - DNA, 20 bp, Homo sapiens
ggaagggccaccctgctgca

SEQ ID NO: 5916573 - DNA, 23 bp, Homo sapiens
ggaagggccaccctgctgcacta

SEQ ID NO: 5916574 - DNA, 11 bp, Homo sapiens
ggaagggccag

SEQ ID NO: 5916575 - DNA, 17 bp, Homo sapiens
ggaagggccagagcctg

SEQ ID NO: 5916576 - DNA, 20 bp, Homo sapiens
ggaagggccaggagagagat

SEQ ID NO: 5916577 - DNA, 17 bp, Homo sapiens
ggaagggcgggcaagga

SEQ ID NO: 5916578 - DNA, 14 bp, Homo sapiens
ggaagggctgggcc

SEQ ID NO: 5916579 - DNA, 22 bp, Homo sapiens
ggaagggctgggccaccaggga

SEQ ID NO: 5916580 - DNA, 13 bp, Homo sapiens
ggaagggctgggt

SEQ ID NO: 5916581 - DNA, 14 bp, Homo sapiens
ggaaggggacagga

SEQ ID NO: 5916582 - DNA, 14 bp, Homo sapiens
ggaaggggaccctc

SEQ ID NO: 5916583 - DNA, 14 bp, Homo sapiens
ggaaggggaggagg

SEQ ID NO: 5916584 - DNA, 15 bp, Homo sapiens
ggaaggggatggagg

SEQ ID NO: 5916585 - DNA, 16 bp, Homo sapiens
ggaaggggcagccctg

SEQ ID NO: 5916586 - DNA, 17 bp, Homo sapiens
ggaaggggcagccctga

SEQ ID NO: 5916587 - DNA, 15 bp, Homo sapiens
ggaaggggccagagg

SEQ ID NO: 5916588 - DNA, 22 bp, Homo sapiens
ggaaggggccccatggcagctc

SEQ ID NO: 5916589 - DNA, 21 bp, Homo sapiens
ggaaggggcccgtgggagtca

SEQ ID NO: 5916590 - DNA, 14 bp, Homo sapiens
ggaaggggccttgc

SEQ ID NO: 5916591 - DNA, 16 bp, Homo sapiens
ggaaggggccttgctg

SEQ ID NO: 5916592 - DNA, 18 bp, Homo sapiens
ggaaggggccttgctgag

SEQ ID NO: 5916593 - DNA, 21 bp, Homo sapiens
ggaaggggctatcctgggacc

SEQ ID NO: 5916594 - DNA, 16 bp, Homo sapiens
ggaaggggcttctgga

SEQ ID NO: 5916595 - DNA, 21 bp, Homo sapiens
ggaagggggggctacattata

SEQ ID NO: 5916596 - DNA, 16 bp, Homo sapiens
ggaagggggtccaccc

SEQ ID NO: 5916597 - DNA, 19 bp, Homo sapiens
ggaaggggttcctcaaatt

SEQ ID NO: 5916598 - DNA, 21 bp, Homo sapiens
ggaaggggttcctcaaatttt

SEQ ID NO: 5916599 - DNA, 14 bp, Homo sapiens
ggaagggtaaacaa

SEQ ID NO: 5916600 - DNA, 19 bp, Homo sapiens
ggaagggtgcctggctggg

SEQ ID NO: 5916601 - DNA, 15 bp, Homo sapiens
ggaagggtgggaagg

SEQ ID NO: 5916602 - DNA, 20 bp, Homo sapiens
ggaaggtaaaaacccagcgg

SEQ ID NO: 5916603 - DNA, 17 bp, Homo sapiens
ggaaggtagcccagcac

SEQ ID NO: 5916604 - DNA, 20 bp, Homo sapiens
ggaaggtagttcaagaaatg

SEQ ID NO: 5916605 - DNA, 21 bp, Homo sapiens
ggaaggtagttcaagaaatga

SEQ ID NO: 5916606 - DNA, 21 bp, Homo sapiens
ggaaggtcagttgccatggtt

SEQ ID NO: 5916607 - DNA, 19 bp, Homo sapiens
ggaaggtcccttgtttcca

SEQ ID NO: 5916608 - DNA, 23 bp, Homo sapiens
ggaaggtgaagatgaagaagcct

SEQ ID NO: 5916609 - DNA, 13 bp, Homo sapiens
ggaaggtgccaga

SEQ ID NO: 5916610 - DNA, 15 bp, Homo sapiens
ggaaggtgcctggcc

SEQ ID NO: 5916611 - DNA, 15 bp, Homo sapiens
ggaaggtgctgagct

SEQ ID NO: 5916612 - DNA, 21 bp, Homo sapiens
ggaaggtgggtgaggctgggc

SEQ ID NO: 5916613 - DNA, 17 bp, Homo sapiens
ggaaggtgtttaaagag

SEQ ID NO: 5916614 - DNA, 15 bp, Homo sapiens
ggaaggttgtatgtg

SEQ ID NO: 5916615 - DNA, 22 bp, Homo sapiens
ggaaggtttgcggatgagggca

SEQ ID NO: 5916616 - DNA, 24 bp, Homo sapiens
ggaaggtttgcggatgagggcatg

SEQ ID NO: 5916617 - DNA, 18 bp, Homo sapiens
ggaaggtttgtatattgt

SEQ ID NO: 5916618 - DNA, 19 bp, Homo sapiens
ggaaggttttaacattgaa

SEQ ID NO: 5916619 - DNA, 15 bp, Homo sapiens
ggaagtaaaacagtc

SEQ ID NO: 5916620 - DNA, 19 bp, Homo sapiens
ggaagtaaacctgaacaaa

SEQ ID NO: 5916621 - DNA, 23 bp, Homo sapiens
ggaagtaaacctgaacaaaccct

SEQ ID NO: 5916622 - DNA, 19 bp, Homo sapiens
ggaagtaaaggcattccac

SEQ ID NO: 5916623 - DNA, 17 bp, Homo sapiens
ggaagtaaagtgaagaa

SEQ ID NO: 5916624 - DNA, 15 bp, Homo sapiens
ggaagtaattttctt

SEQ ID NO: 5916625 - DNA, 18 bp, Homo sapiens
ggaagtacatgaatacaa

SEQ ID NO: 5916626 - DNA, 16 bp, Homo sapiens
ggaagtacgtcccagc

SEQ ID NO: 5916627 - DNA, 18 bp, Homo sapiens
ggaagtactggagaaaat

SEQ ID NO: 5916628 - DNA, 24 bp, Homo sapiens
ggaagtacttggcccccttcagga

SEQ ID NO: 5916629 - DNA, 17 bp, Homo sapiens
ggaagtagcacaggctg

SEQ ID NO: 5916630 - DNA, 21 bp, Homo sapiens
ggaagtataggccaggcacag

SEQ ID NO: 5916631 - DNA, 16 bp, Homo sapiens
ggaagtatgagtgctg

SEQ ID NO: 5916632 - DNA, 19 bp, Homo sapiens
ggaagtcacctttctgggc

SEQ ID NO: 5916633 - DNA, 20 bp, Homo sapiens
ggaagtcagaatttttaact

SEQ ID NO: 5916634 - DNA, 13 bp, Homo sapiens
ggaagtcaggagc

SEQ ID NO: 5916635 - DNA, 16 bp, Homo sapiens
ggaagtcaggagccag

SEQ ID NO: 5916636 - DNA, 18 bp, Homo sapiens
ggaagtcaggagccagca

SEQ ID NO: 5916637 - DNA, 14 bp, Homo sapiens
ggaagtcaggggag

SEQ ID NO: 5916638 - DNA, 15 bp, Homo sapiens
ggaagtcaggggaga

SEQ ID NO: 5916639 - DNA, 23 bp, Homo sapiens
ggaagtcaggggagaagctgaag

SEQ ID NO: 5916640 - DNA, 12 bp, Homo sapiens
ggaagtcatggg

SEQ ID NO: 5916641 - DNA, 18 bp, Homo sapiens
ggaagtccccaggcccca

SEQ ID NO: 5916642 - DNA, 18 bp, Homo sapiens
ggaagtccctgagaagcc

SEQ ID NO: 5916643 - DNA, 21 bp, Homo sapiens
ggaagtcctaagaagtggggc

SEQ ID NO: 5916644 - DNA, 13 bp, Homo sapiens
ggaagtcctctgg

SEQ ID NO: 5916645 - DNA, 19 bp, Homo sapiens
ggaagtccttatctagctg

SEQ ID NO: 5916646 - DNA, 18 bp, Homo sapiens
ggaagtcgtttcaggaca

SEQ ID NO: 5916647 - DNA, 15 bp, Homo sapiens
ggaagtctacctgct

SEQ ID NO: 5916648 - DNA, 19 bp, Homo sapiens
ggaagtctacctgctggac

SEQ ID NO: 5916649 - DNA, 22 bp, Homo sapiens
ggaagtctacctgctggacagc

SEQ ID NO: 5916650 - DNA, 14 bp, Homo sapiens
ggaagtctccatga

SEQ ID NO: 5916651 - DNA, 23 bp, Homo sapiens
ggaagtgaagagggagaagggat

SEQ ID NO: 5916652 - DNA, 18 bp, Homo sapiens
ggaagtgacattgtgtca

SEQ ID NO: 5916653 - DNA, 20 bp, Homo sapiens
ggaagtgacggtttaatggg

SEQ ID NO: 5916654 - DNA, 23 bp, Homo sapiens
ggaagtgacttgaatgtacaaag

SEQ ID NO: 5916655 - DNA, 14 bp, Homo sapiens
ggaagtgagaaggg

SEQ ID NO: 5916656 - DNA, 17 bp, Homo sapiens
ggaagtgagaagggctc

SEQ ID NO: 5916657 - DNA, 22 bp, Homo sapiens
ggaagtgagaagggctcagaga

SEQ ID NO: 5916658 - DNA, 15 bp, Homo sapiens
ggaagtgaggcccaa

SEQ ID NO: 5916659 - DNA, 13 bp, Homo sapiens
ggaagtgaggtag

SEQ ID NO: 5916660 - DNA, 15 bp, Homo sapiens
ggaagtgcagcgggc

SEQ ID NO: 5916661 - DNA, 22 bp, Homo sapiens
ggaagtgcagcgggccaggcag

SEQ ID NO: 5916662 - DNA, 23 bp, Homo sapiens
ggaagtgcagcgggccaggcagg

SEQ ID NO: 5916663 - DNA, 12 bp, Homo sapiens
ggaagtgcccag

SEQ ID NO: 5916664 - DNA, 14 bp, Homo sapiens
ggaagtgctcccca

SEQ ID NO: 5916665 - DNA, 19 bp, Homo sapiens
ggaagtgctccccacacgt

SEQ ID NO: 5916666 - DNA, 17 bp, Homo sapiens
ggaagtggcctgagaag

SEQ ID NO: 5916667 - DNA, 14 bp, Homo sapiens
ggaagtggctcaga

SEQ ID NO: 5916668 - DNA, 14 bp, Homo sapiens
ggaagtgggccagt

SEQ ID NO: 5916669 - DNA, 16 bp, Homo sapiens
ggaagtgggccagtcc

SEQ ID NO: 5916670 - DNA, 19 bp, Homo sapiens
ggaagtgggccagtcctgg

SEQ ID NO: 5916671 - DNA, 20 bp, Homo sapiens
ggaagtgggccagtcctggt

SEQ ID NO: 5916672 - DNA, 23 bp, Homo sapiens
ggaagtggggctaggtcttgcca

SEQ ID NO: 5916673 - DNA, 13 bp, Homo sapiens
ggaagtgggggcc

SEQ ID NO: 5916674 - DNA, 18 bp, Homo sapiens
ggaagtgggggccgctgg

SEQ ID NO: 5916675 - DNA, 22 bp, Homo sapiens
ggaagtgggggccgctggccca

SEQ ID NO: 5916676 - DNA, 18 bp, Homo sapiens
ggaagtggggtgttcttc

SEQ ID NO: 5916677 - DNA, 20 bp, Homo sapiens
ggaagtggtggctgtggaag

SEQ ID NO: 5916678 - DNA, 16 bp, Homo sapiens
ggaagtggtggggact

SEQ ID NO: 5916679 - DNA, 19 bp, Homo sapiens
ggaagtgtaacagctgagg

SEQ ID NO: 5916680 - DNA, 21 bp, Homo sapiens
ggaagtgtaacagctgaggtc

SEQ ID NO: 5916681 - DNA, 15 bp, Homo sapiens
ggaagtgtgacttct

SEQ ID NO: 5916682 - DNA, 19 bp, Homo sapiens
ggaagtgtgtgccaagagc

SEQ ID NO: 5916683 - DNA, 19 bp, Homo sapiens
ggaagtgtgtgtggcagca

SEQ ID NO: 5916684 - DNA, 15 bp, Homo sapiens
ggaagtgtgtttgcc

SEQ ID NO: 5916685 - DNA, 18 bp, Homo sapiens
ggaagtgttccctgagaa

SEQ ID NO: 5916686 - DNA, 16 bp, Homo sapiens
ggaagttaaaagcaca

SEQ ID NO: 5916687 - DNA, 14 bp, Homo sapiens
ggaagttcaagtga

SEQ ID NO: 5916688 - DNA, 14 bp, Homo sapiens
ggaagttcactgga

SEQ ID NO: 5916689 - DNA, 16 bp, Homo sapiens
ggaagttcagaaggtg

SEQ ID NO: 5916690 - DNA, 19 bp, Homo sapiens
ggaagttcagaaggtgtgt

SEQ ID NO: 5916691 - DNA, 14 bp, Homo sapiens
ggaagttgctgtgc

SEQ ID NO: 5916692 - DNA, 17 bp, Homo sapiens
ggaagttgctgtgcccc

SEQ ID NO: 5916693 - DNA, 17 bp, Homo sapiens
ggaagttggggcactgg

SEQ ID NO: 5916694 - DNA, 13 bp, Homo sapiens
ggaagttgtggat

SEQ ID NO: 5916695 - DNA, 23 bp, Homo sapiens
ggaagttgtggatatcagggtat

SEQ ID NO: 5916696 - DNA, 15 bp, Homo sapiens
ggaagtttagctctg

SEQ ID NO: 5916697 - DNA, 16 bp, Homo sapiens
ggaagtttagctctga

SEQ ID NO: 5916698 - DNA, 14 bp, Homo sapiens
ggaagtttatttcc

SEQ ID NO: 5916699 - DNA, 15 bp, Homo sapiens
ggaagtttatttgag

SEQ ID NO: 5916700 - DNA, 21 bp, Homo sapiens
ggaagtttatttgagaaaata

SEQ ID NO: 5916701 - DNA, 14 bp, Homo sapiens
ggaagtttgctgtg

SEQ ID NO: 5916702 - DNA, 16 bp, Homo sapiens
ggaagtttgctgtgct

SEQ ID NO: 5916703 - DNA, 17 bp, Homo sapiens
ggaagtttgctgtgctt

SEQ ID NO: 5916704 - DNA, 19 bp, Homo sapiens
ggaagtttggtcagagtga

SEQ ID NO: 5916705 - DNA, 23 bp, Homo sapiens
ggaagttttaactttaatacagc

SEQ ID NO: 5916706 - DNA, 11 bp, Homo sapiens
ggaagttttat

SEQ ID NO: 5916707 - DNA, 11 bp, Homo sapiens
ggaagttttca

SEQ ID NO: 5916708 - DNA, 14 bp, Homo sapiens
ggaagttttcaatg

SEQ ID NO: 5916709 - DNA, 21 bp, Homo sapiens
ggaagttttgtggaggagctc

SEQ ID NO: 5916710 - DNA, 15 bp, Homo sapiens
ggaataaaaggcttg

SEQ ID NO: 5916711 - DNA, 18 bp, Homo sapiens
ggaataaaaggcttgaag

SEQ ID NO: 5916712 - DNA, 14 bp, Homo sapiens
ggaataaaatacta

SEQ ID NO: 5916713 - DNA, 20 bp, Homo sapiens
ggaataaacagtgagcatat

SEQ ID NO: 5916714 - DNA, 18 bp, Homo sapiens
ggaataaacatctgtgtc

SEQ ID NO: 5916715 - DNA, 13 bp, Homo sapiens
ggaataaacatta

SEQ ID NO: 5916716 - DNA, 13 bp, Homo sapiens
ggaataaagactt

SEQ ID NO: 5916717 - DNA, 23 bp, Homo sapiens
ggaataaagcttctctctgagct

SEQ ID NO: 5916718 - DNA, 15 bp, Homo sapiens
ggaataaagttgcag

SEQ ID NO: 5916719 - DNA, 18 bp, Homo sapiens
ggaataaagttgcagatg

SEQ ID NO: 5916720 - DNA, 21 bp, Homo sapiens
ggaataaagttgcagatgatt

SEQ ID NO: 5916721 - DNA, 19 bp, Homo sapiens
ggaataaatgcctttatat

SEQ ID NO: 5916722 - DNA, 18 bp, Homo sapiens
ggaataacatgtaattaa

SEQ ID NO: 5916723 - DNA, 21 bp, Homo sapiens
ggaataactatctcacttcca

SEQ ID NO: 5916724 - DNA, 13 bp, Homo sapiens
ggaataagacaga

SEQ ID NO: 5916725 - DNA, 13 bp, Homo sapiens
ggaataagccatg

SEQ ID NO: 5916726 - DNA, 20 bp, Homo sapiens
ggaataaggccttaatatgt

SEQ ID NO: 5916727 - DNA, 14 bp, Homo sapiens
ggaataattgcttt

SEQ ID NO: 5916728 - DNA, 21 bp, Homo sapiens
ggaataatttccttcaggcag

SEQ ID NO: 5916729 - DNA, 15 bp, Homo sapiens
ggaataatttgtaaa

SEQ ID NO: 5916730 - DNA, 16 bp, Homo sapiens
ggaatacctgtccccc

SEQ ID NO: 5916731 - DNA, 19 bp, Homo sapiens
ggaatacctgtccccctga

SEQ ID NO: 5916732 - DNA, 18 bp, Homo sapiens
ggaatacgatcctgcagg

SEQ ID NO: 5916733 - DNA, 18 bp, Homo sapiens
ggaatactatacagccat

SEQ ID NO: 5916734 - DNA, 17 bp, Homo sapiens
ggaatactttttgttat

SEQ ID NO: 5916735 - DNA, 14 bp, Homo sapiens
ggaatagaggaaga

SEQ ID NO: 5916736 - DNA, 17 bp, Homo sapiens
ggaatagagttttcctc

SEQ ID NO: 5916737 - DNA, 16 bp, Homo sapiens
ggaatagccagagagg

SEQ ID NO: 5916738 - DNA, 21 bp, Homo sapiens
ggaatagcccgaggaccgggc

SEQ ID NO: 5916739 - DNA, 19 bp, Homo sapiens
ggaatagggacagctggtc

SEQ ID NO: 5916740 - DNA, 14 bp, Homo sapiens
ggaatagggagaca

SEQ ID NO: 5916741 - DNA, 15 bp, Homo sapiens
ggaatagggagacag

SEQ ID NO: 5916742 - DNA, 20 bp, Homo sapiens
ggaatagggagacagggtag

SEQ ID NO: 5916743 - DNA, 23 bp, Homo sapiens
ggaataggttactttggactgag

SEQ ID NO: 5916744 - DNA, 16 bp, Homo sapiens
ggaataggtttcaaca

SEQ ID NO: 5916745 - DNA, 19 bp, Homo sapiens
ggaatagtgcttgctggcc

SEQ ID NO: 5916746 - DNA, 15 bp, Homo sapiens
ggaatataaaacagt

SEQ ID NO: 5916747 - DNA, 14 bp, Homo sapiens
ggaatataagaaaa

SEQ ID NO: 5916748 - DNA, 22 bp, Homo sapiens
ggaatataagaaaagtaatgaa

SEQ ID NO: 5916749 - DNA, 23 bp, Homo sapiens
ggaatatacatgtaaaaatgttt

SEQ ID NO: 5916750 - DNA, 21 bp, Homo sapiens
ggaatatatatggaataagtg

SEQ ID NO: 5916751 - DNA, 17 bp, Homo sapiens
ggaatatcgtaaccagt

SEQ ID NO: 5916752 - DNA, 13 bp, Homo sapiens
ggaatatgactca

SEQ ID NO: 5916753 - DNA, 16 bp, Homo sapiens
ggaatatgactgtttt

SEQ ID NO: 5916754 - DNA, 23 bp, Homo sapiens
ggaatatgttcaatgcaaagtaa

SEQ ID NO: 5916755 - DNA, 15 bp, Homo sapiens
ggaatattaaaaaac

SEQ ID NO: 5916756 - DNA, 19 bp, Homo sapiens
ggaatattatatttggatg

SEQ ID NO: 5916757 - DNA, 14 bp, Homo sapiens
ggaatattgtgatt

SEQ ID NO: 5916758 - DNA, 14 bp, Homo sapiens
ggaatatttgaata

SEQ ID NO: 5916759 - DNA, 17 bp, Homo sapiens
ggaatcaagagctgccc

SEQ ID NO: 5916760 - DNA, 23 bp, Homo sapiens
ggaatcaagagctgccctccttg

SEQ ID NO: 5916761 - DNA, 17 bp, Homo sapiens
ggaatcaattatttatg

SEQ ID NO: 5916762 - DNA, 18 bp, Homo sapiens
ggaatcaatttcccagaa

SEQ ID NO: 5916763 - DNA, 19 bp, Homo sapiens
ggaatcaatttcccagaag

SEQ ID NO: 5916764 - DNA, 14 bp, Homo sapiens
ggaatcacctggag

SEQ ID NO: 5916765 - DNA, 20 bp, Homo sapiens
ggaatcactcttgtggatgt

SEQ ID NO: 5916766 - DNA, 21 bp, Homo sapiens
ggaatcagacttcacactgca

SEQ ID NO: 5916767 - DNA, 23 bp, Homo sapiens
ggaatcagacttcacactgcaag

SEQ ID NO: 5916768 - DNA, 17 bp, Homo sapiens
ggaatcagcttttaata

SEQ ID NO: 5916769 - DNA, 16 bp, Homo sapiens
ggaatcagggaccagc

SEQ ID NO: 5916770 - DNA, 19 bp, Homo sapiens
ggaatcagggaccagcttt

SEQ ID NO: 5916771 - DNA, 15 bp, Homo sapiens
ggaatcagggagcac

SEQ ID NO: 5916772 - DNA, 21 bp, Homo sapiens
ggaatcatactgcctactgtt

SEQ ID NO: 5916773 - DNA, 21 bp, Homo sapiens
ggaatcatctcctttgcagaa

SEQ ID NO: 5916774 - DNA, 15 bp, Homo sapiens
ggaatcatggcctct

SEQ ID NO: 5916775 - DNA, 20 bp, Homo sapiens
ggaatcatggcctcttgaag

SEQ ID NO: 5916776 - DNA, 15 bp, Homo sapiens
ggaatcatgtcaggc

SEQ ID NO: 5916777 - DNA, 23 bp, Homo sapiens
ggaatcatgtccatcccttttcc

SEQ ID NO: 5916778 - DNA, 22 bp, Homo sapiens
ggaatcattaatttcaaaattt

SEQ ID NO: 5916779 - DNA, 17 bp, Homo sapiens
ggaatcattccagtgct

SEQ ID NO: 5916780 - DNA, 22 bp, Homo sapiens
ggaatcattccagtgctagaaa

SEQ ID NO: 5916781 - DNA, 20 bp, Homo sapiens
ggaatcattgtccagagctg

SEQ ID NO: 5916782 - DNA, 20 bp, Homo sapiens
ggaatccactcccaggcagc

SEQ ID NO: 5916783 - DNA, 17 bp, Homo sapiens
ggaatccagaaggaagc

SEQ ID NO: 5916784 - DNA, 23 bp, Homo sapiens
ggaatccagctccctagactgca

SEQ ID NO: 5916785 - DNA, 19 bp, Homo sapiens
ggaatccagtgcttccaca

SEQ ID NO: 5916786 - DNA, 24 bp, Homo sapiens
ggaatccagtgtggctcccacagg

SEQ ID NO: 5916787 - DNA, 20 bp, Homo sapiens
ggaatcccactaatgcaaac

SEQ ID NO: 5916788 - DNA, 20 bp, Homo sapiens
ggaatccgcctgcagaggac

SEQ ID NO: 5916789 - DNA, 19 bp, Homo sapiens
ggaatccgggacacctggg

SEQ ID NO: 5916790 - DNA, 21 bp, Homo sapiens
ggaatcctacgctatgtagaa

SEQ ID NO: 5916791 - DNA, 14 bp, Homo sapiens
ggaatcctgctgcc

SEQ ID NO: 5916792 - DNA, 13 bp, Homo sapiens
ggaatcctggacc

SEQ ID NO: 5916793 - DNA, 19 bp, Homo sapiens
ggaatcgtttttgctgcag

SEQ ID NO: 5916794 - DNA, 14 bp, Homo sapiens
ggaatctaagtggg

SEQ ID NO: 5916795 - DNA, 18 bp, Homo sapiens
ggaatctaagtgggagac

SEQ ID NO: 5916796 - DNA, 17 bp, Homo sapiens
ggaatctagaagaaatg

SEQ ID NO: 5916797 - DNA, 18 bp, Homo sapiens
ggaatctagaagaaatga

SEQ ID NO: 5916798 - DNA, 18 bp, Homo sapiens
ggaatctagcccaaccta

SEQ ID NO: 5916799 - DNA, 22 bp, Homo sapiens
ggaatctcccagacttgtttcc

SEQ ID NO: 5916800 - DNA, 20 bp, Homo sapiens
ggaatctgaaagtatatttt

SEQ ID NO: 5916801 - DNA, 22 bp, Homo sapiens
ggaatctgaggcatcctctgac

SEQ ID NO: 5916802 - DNA, 22 bp, Homo sapiens
ggaatctgatcccataaagaaa

SEQ ID NO: 5916803 - DNA, 23 bp, Homo sapiens
ggaatctggcattctacacctgg

SEQ ID NO: 5916804 - DNA, 17 bp, Homo sapiens
ggaatctgtttctctgc

SEQ ID NO: 5916805 - DNA, 15 bp, Homo sapiens
ggaatcttcacctca

SEQ ID NO: 5916806 - DNA, 16 bp, Homo sapiens
ggaatcttcacctcag

SEQ ID NO: 5916807 - DNA, 23 bp, Homo sapiens
ggaatcttctcatcttttatcta

SEQ ID NO: 5916808 - DNA, 14 bp, Homo sapiens
ggaatcttgctgca

SEQ ID NO: 5916809 - DNA, 21 bp, Homo sapiens
ggaatctttgtaccaaaattt

SEQ ID NO: 5916810 - DNA, 11 bp, Homo sapiens
ggaatctttta

SEQ ID NO: 5916811 - DNA, 23 bp, Homo sapiens
ggaatgaaagagagctctaacca

SEQ ID NO: 5916812 - DNA, 20 bp, Homo sapiens
ggaatgaaattaacacaaag

SEQ ID NO: 5916813 - DNA, 19 bp, Homo sapiens
ggaatgaaccatggcacct

SEQ ID NO: 5916814 - DNA, 12 bp, Homo sapiens
ggaatgaagaac

SEQ ID NO: 5916815 - DNA, 18 bp, Homo sapiens
ggaatgaagataccatca

SEQ ID NO: 5916816 - DNA, 19 bp, Homo sapiens
ggaatgaagatactgaaat

SEQ ID NO: 5916817 - DNA, 13 bp, Homo sapiens
ggaatgaagcatg

SEQ ID NO: 5916818 - DNA, 14 bp, Homo sapiens
ggaatgaagcatgt

SEQ ID NO: 5916819 - DNA, 15 bp, Homo sapiens
ggaatgaagcatgta

SEQ ID NO: 5916820 - DNA, 19 bp, Homo sapiens
ggaatgaatgtcagtgtga

SEQ ID NO: 5916821 - DNA, 13 bp, Homo sapiens
ggaatgaccttgg

SEQ ID NO: 5916822 - DNA, 22 bp, Homo sapiens
ggaatgactcatgcctctgagc

SEQ ID NO: 5916823 - DNA, 20 bp, Homo sapiens
ggaatgagaagtagccacag

SEQ ID NO: 5916824 - DNA, 23 bp, Homo sapiens
ggaatgagccgcggggaagctgg

SEQ ID NO: 5916825 - DNA, 17 bp, Homo sapiens
ggaatgaggaaaattct

SEQ ID NO: 5916826 - DNA, 21 bp, Homo sapiens
ggaatgaggcttgctgagagg

SEQ ID NO: 5916827 - DNA, 20 bp, Homo sapiens
ggaatgagtcaatcagcctt

SEQ ID NO: 5916828 - DNA, 15 bp, Homo sapiens
ggaatgagtgtgcat

SEQ ID NO: 5916829 - DNA, 12 bp, Homo sapiens
ggacagcccggg

SEQ ID NO: 5916830 - DNA, 15 bp, Homo sapiens
ggacagcccgggagc

SEQ ID NO: 5916831 - DNA, 16 bp, Homo sapiens
ggacagccggagcagt

SEQ ID NO: 5916832 - DNA, 17 bp, Homo sapiens
ggacagcctcttcagcc

SEQ ID NO: 5916833 - DNA, 20 bp, Homo sapiens
ggacagcctcttctgtccca

SEQ ID NO: 5916834 - DNA, 23 bp, Homo sapiens
ggacagcctcttctgtcccaagt

SEQ ID NO: 5916835 - DNA, 14 bp, Homo sapiens
ggacagcctgcctc

SEQ ID NO: 5916836 - DNA, 15 bp, Homo sapiens
ggacagcctgcctct

SEQ ID NO: 5916837 - DNA, 11 bp, Homo sapiens
ggacagccttc

SEQ ID NO: 5916838 - DNA, 15 bp, Homo sapiens
ggacagccttcagca

SEQ ID NO: 5916839 - DNA, 21 bp, Homo sapiens
ggacagcggcagtgggcctgc

SEQ ID NO: 5916840 - DNA, 20 bp, Homo sapiens
ggacagcggccccgcggagc

SEQ ID NO: 5916841 - DNA, 21 bp, Homo sapiens
ggacagcggccccgcggagcc

SEQ ID NO: 5916842 - DNA, 23 bp, Homo sapiens
ggacagcggccccgcggagcccc

SEQ ID NO: 5916843 - DNA, 15 bp, Homo sapiens
ggacagcggcccggc

SEQ ID NO: 5916844 - DNA, 17 bp, Homo sapiens
ggacagcggcccggccc

SEQ ID NO: 5916845 - DNA, 15 bp, Homo sapiens
ggacagcgggaaaaa

SEQ ID NO: 5916846 - DNA, 11 bp, Homo sapiens
ggacagctcct

SEQ ID NO: 5916847 - DNA, 17 bp, Homo sapiens
ggacagctgataaattt

SEQ ID NO: 5916848 - DNA, 17 bp, Homo sapiens
ggacagctgcaggtgcc

SEQ ID NO: 5916849 - DNA, 19 bp, Homo sapiens
ggacagctgcccagacaca

SEQ ID NO: 5916850 - DNA, 22 bp, Homo sapiens
ggacagctgcccagacacatgg

SEQ ID NO: 5916851 - DNA, 12 bp, Homo sapiens
ggacagctgctt

SEQ ID NO: 5916852 - DNA, 13 bp, Homo sapiens
ggacagctgcttg

SEQ ID NO: 5916853 - DNA, 14 bp, Homo sapiens
ggacagctggctgc

SEQ ID NO: 5916854 - DNA, 22 bp, Homo sapiens
ggacagctggctgctgacagga

SEQ ID NO: 5916855 - DNA, 18 bp, Homo sapiens
ggacagctggctgggcct

SEQ ID NO: 5916856 - DNA, 13 bp, Homo sapiens
ggacagctgtcct

SEQ ID NO: 5916857 - DNA, 11 bp, Homo sapiens
ggacagctgtg

SEQ ID NO: 5916858 - DNA, 17 bp, Homo sapiens
ggacagctgtgccggga

SEQ ID NO: 5916859 - DNA, 23 bp, Homo sapiens
ggacagctgtgccgggaggcagc

SEQ ID NO: 5916860 - DNA, 14 bp, Homo sapiens
ggacagctgtgcct

SEQ ID NO: 5916861 - DNA, 15 bp, Homo sapiens
ggacagctgtgcctc

SEQ ID NO: 5916862 - DNA, 15 bp, Homo sapiens
ggacagcttcctcac

SEQ ID NO: 5916863 - DNA, 15 bp, Homo sapiens
ggacagcttgtatgt

SEQ ID NO: 5916864 - DNA, 20 bp, Homo sapiens
ggacaggaacacccagcccc

SEQ ID NO: 5916865 - DNA, 19 bp, Homo sapiens
ggacaggaagcacagcagg

SEQ ID NO: 5916866 - DNA, 14 bp, Homo sapiens
ggacaggaagctgg

SEQ ID NO: 5916867 - DNA, 14 bp, Homo sapiens
ggacaggaccccag

SEQ ID NO: 5916868 - DNA, 16 bp, Homo sapiens
ggacaggaccctcagg

SEQ ID NO: 5916869 - DNA, 19 bp, Homo sapiens
ggacaggaggcggcccggc

SEQ ID NO: 5916870 - DNA, 15 bp, Homo sapiens
ggacaggatccaggc

SEQ ID NO: 5916871 - DNA, 13 bp, Homo sapiens
ggacaggatctat

SEQ ID NO: 5916872 - DNA, 16 bp, Homo sapiens
ggacaggatgaggaca

SEQ ID NO: 5916873 - DNA, 18 bp, Homo sapiens
ggacaggattgtctgctg

SEQ ID NO: 5916874 - DNA, 19 bp, Homo sapiens
ggacaggattgtctgctgc

SEQ ID NO: 5916875 - DNA, 24 bp, Homo sapiens
ggacaggattgtctgctgcctcca

SEQ ID NO: 5916876 - DNA, 14 bp, Homo sapiens
ggacaggcaggcca

SEQ ID NO: 5916877 - DNA, 23 bp, Homo sapiens
ggacaggcatgttctctgaggac

SEQ ID NO: 5916878 - DNA, 17 bp, Homo sapiens
ggacaggccagtagggg

SEQ ID NO: 5916879 - DNA, 12 bp, Homo sapiens
ggacaggcccag

SEQ ID NO: 5916880 - DNA, 21 bp, Homo sapiens
ggacaggcccagcgcggccag

SEQ ID NO: 5916881 - DNA, 22 bp, Homo sapiens
ggacaggcccagcgcggccagc

SEQ ID NO: 5916882 - DNA, 23 bp, Homo sapiens
ggacaggcccagcgcggccagcg

SEQ ID NO: 5916883 - DNA, 12 bp, Homo sapiens
ggacaggcgggc

SEQ ID NO: 5916884 - DNA, 17 bp, Homo sapiens
ggacaggcgggctcgga

SEQ ID NO: 5916885 - DNA, 18 bp, Homo sapiens
ggacaggctctagagaga

SEQ ID NO: 5916886 - DNA, 20 bp, Homo sapiens
ggacaggctctagagagagg

SEQ ID NO: 5916887 - DNA, 13 bp, Homo sapiens
ggacaggctctgc

SEQ ID NO: 5916888 - DNA, 20 bp, Homo sapiens
ggacaggctcttctttccca

SEQ ID NO: 5916889 - DNA, 15 bp, Homo sapiens
ggacaggctgaagag

SEQ ID NO: 5916890 - DNA, 21 bp, Homo sapiens
ggacaggctgcggcccctccc

SEQ ID NO: 5916891 - DNA, 13 bp, Homo sapiens
ggacaggctggaa

SEQ ID NO: 5916892 - DNA, 21 bp, Homo sapiens
ggacaggctggaatgagggag

SEQ ID NO: 5916893 - DNA, 19 bp, Homo sapiens
ggacagggacttcgcagag

SEQ ID NO: 5916894 - DNA, 20 bp, Homo sapiens
ggacagggacttcgcagagg

SEQ ID NO: 5916895 - DNA, 16 bp, Homo sapiens
ggacagggaggccaca

SEQ ID NO: 5916896 - DNA, 15 bp, Homo sapiens
ggacagggagggccg

SEQ ID NO: 5916897 - DNA, 16 bp, Homo sapiens
ggacagggagggccgg

SEQ ID NO: 5916898 - DNA, 22 bp, Homo sapiens
ggacagggatgagcatggagct

SEQ ID NO: 5916899 - DNA, 13 bp, Homo sapiens
ggacagggcaggc

SEQ ID NO: 5916900 - DNA, 16 bp, Homo sapiens
ggacagggccagggtt

SEQ ID NO: 5916901 - DNA, 11 bp, Homo sapiens
ggacagggccc

SEQ ID NO: 5916902 - DNA, 18 bp, Homo sapiens
ggacagggccctggagct

SEQ ID NO: 5916903 - DNA, 15 bp, Homo sapiens
ggacagggctggccc

SEQ ID NO: 5916904 - DNA, 12 bp, Homo sapiens
ggacagggcttc

SEQ ID NO: 5916905 - DNA, 15 bp, Homo sapiens
ggacagggcttgggg

SEQ ID NO: 5916906 - DNA, 15 bp, Homo sapiens
ggacaggggttcctt

SEQ ID NO: 5916907 - DNA, 20 bp, Homo sapiens
ggacaggtcctcagtgtcct

SEQ ID NO: 5916908 - DNA, 19 bp, Homo sapiens
ggacaggtctctgagacag

SEQ ID NO: 5916909 - DNA, 21 bp, Homo sapiens
ggacaggtggaggcgagccag

SEQ ID NO: 5916910 - DNA, 16 bp, Homo sapiens
ggacaggtgggcctgg

SEQ ID NO: 5916911 - DNA, 18 bp, Homo sapiens
ggacaggtgggcctggcg

SEQ ID NO: 5916912 - DNA, 13 bp, Homo sapiens
ggacaggtggggc

SEQ ID NO: 5916913 - DNA, 19 bp, Homo sapiens
ggacaggtggggcctcagc

SEQ ID NO: 5916914 - DNA, 19 bp, Homo sapiens
ggacagtatttgtggggag

SEQ ID NO: 5916915 - DNA, 17 bp, Homo sapiens
ggacagtccctgctggg

SEQ ID NO: 5916916 - DNA, 16 bp, Homo sapiens
ggacagtcctgggaga

SEQ ID NO: 5916917 - DNA, 19 bp, Homo sapiens
ggacagtcctgggagaacc

SEQ ID NO: 5916918 - DNA, 14 bp, Homo sapiens
ggacagtctccctg

SEQ ID NO: 5916919 - DNA, 14 bp, Homo sapiens
ggacagtgctgcag

SEQ ID NO: 5916920 - DNA, 18 bp, Homo sapiens
ggacagtgcttcagcctg

SEQ ID NO: 5916921 - DNA, 21 bp, Homo sapiens
ggacagtgcttcagcctgagg

SEQ ID NO: 5916922 - DNA, 23 bp, Homo sapiens
ggacagtgcttgatacaggaaca

SEQ ID NO: 5916923 - DNA, 16 bp, Homo sapiens
ggacagtggcaggaca

SEQ ID NO: 5916924 - DNA, 16 bp, Homo sapiens
ggacagtgggctatgc

SEQ ID NO: 5916925 - DNA, 17 bp, Homo sapiens
ggacagttacaaaccag

SEQ ID NO: 5916926 - DNA, 22 bp, Homo sapiens
ggacagttacaaaccaggtcac

SEQ ID NO: 5916927 - DNA, 21 bp, Homo sapiens
ggacagttagacccctgggtg

SEQ ID NO: 5916928 - DNA, 16 bp, Homo sapiens
ggacagttcacaccct

SEQ ID NO: 5916929 - DNA, 20 bp, Homo sapiens
ggacagttcacaccctgcaa

SEQ ID NO: 5916930 - DNA, 22 bp, Homo sapiens
ggacagttccagaagtgtgact

SEQ ID NO: 5916931 - DNA, 17 bp, Homo sapiens
ggacagttgatggagcc

SEQ ID NO: 5916932 - DNA, 18 bp, Homo sapiens
ggacagttgatggagccc

SEQ ID NO: 5916933 - DNA, 12 bp, Homo sapiens
ggacagttgctg

SEQ ID NO: 5916934 - DNA, 22 bp, Homo sapiens
ggacagttgcttttcagcatgg

SEQ ID NO: 5916935 - DNA, 15 bp, Homo sapiens
ggacagttggcagag

SEQ ID NO: 5916936 - DNA, 20 bp, Homo sapiens
ggacagtttaccagttgcct

SEQ ID NO: 5916937 - DNA, 21 bp, Homo sapiens
ggacagtttatcatgaagcct

SEQ ID NO: 5916938 - DNA, 13 bp, Homo sapiens
ggacagtttgtaa

SEQ ID NO: 5916939 - DNA, 16 bp, Homo sapiens
ggacagtttgtttcct

SEQ ID NO: 5916940 - DNA, 19 bp, Homo sapiens
ggacagttttgatacaaac

SEQ ID NO: 5916941 - DNA, 12 bp, Homo sapiens
ggacataaaatt

SEQ ID NO: 5916942 - DNA, 21 bp, Homo sapiens
ggacataaagcctctgactca

SEQ ID NO: 5916943 - DNA, 23 bp, Homo sapiens
ggacataaatcacagaaaattta

SEQ ID NO: 5916944 - DNA, 14 bp, Homo sapiens
ggacataatttcag

SEQ ID NO: 5916945 - DNA, 22 bp, Homo sapiens
ggacataatttcagtgggaaat

SEQ ID NO: 5916946 - DNA, 19 bp, Homo sapiens
ggacatactctctgcctgg

SEQ ID NO: 5916947 - DNA, 15 bp, Homo sapiens
ggacatactgctgga

SEQ ID NO: 5916948 - DNA, 17 bp, Homo sapiens
ggacatagaatctgtga

SEQ ID NO: 5916949 - DNA, 19 bp, Homo sapiens
ggacatatattttttaaaa

SEQ ID NO: 5916950 - DNA, 17 bp, Homo sapiens
ggacatcacagcagaat

SEQ ID NO: 5916951 - DNA, 12 bp, Homo sapiens
ggacatcagcaa

SEQ ID NO: 5916952 - DNA, 15 bp, Homo sapiens
ggacatcagcaaaca

SEQ ID NO: 5916953 - DNA, 22 bp, Homo sapiens
ggacatcagtgtttgttggatc

SEQ ID NO: 5916954 - DNA, 14 bp, Homo sapiens
ggacatcctcttct

SEQ ID NO: 5916955 - DNA, 23 bp, Homo sapiens
ggacatcgtaggcagccacggcc

SEQ ID NO: 5916956 - DNA, 16 bp, Homo sapiens
ggacatctcctggcta

SEQ ID NO: 5916957 - DNA, 15 bp, Homo sapiens
ggacatctctctggc

SEQ ID NO: 5916958 - DNA, 15 bp, Homo sapiens
ggacatctctttgaa

SEQ ID NO: 5916959 - DNA, 15 bp, Homo sapiens
ggacatctgacccca

SEQ ID NO: 5916960 - DNA, 13 bp, Homo sapiens
ggacatgaaggaa

SEQ ID NO: 5916961 - DNA, 14 bp, Homo sapiens
ggacatgaaggaaa

SEQ ID NO: 5916962 - DNA, 19 bp, Homo sapiens
ggacatgagactaagagaa

SEQ ID NO: 5916963 - DNA, 20 bp, Homo sapiens
ggacatgagactaagagaaa

SEQ ID NO: 5916964 - DNA, 19 bp, Homo sapiens
ggacatgagatcagggcct

SEQ ID NO: 5916965 - DNA, 22 bp, Homo sapiens
ggacatgatggggaaggagtac

SEQ ID NO: 5916966 - DNA, 21 bp, Homo sapiens
ggacatgatttagggaagcag

SEQ ID NO: 5916967 - DNA, 22 bp, Homo sapiens
ggacatgcaataaaatttaaaa

SEQ ID NO: 5916968 - DNA, 11 bp, Homo sapiens
ggacatgcacc

SEQ ID NO: 5916969 - DNA, 15 bp, Homo sapiens
ggacatgcacccgca

SEQ ID NO: 5916970 - DNA, 16 bp, Homo sapiens
ggacatgcagctctga

SEQ ID NO: 5916971 - DNA, 15 bp, Homo sapiens
ggacatgccctgtgt

SEQ ID NO: 5916972 - DNA, 18 bp, Homo sapiens
ggacatgcctgtcctgaa

SEQ ID NO: 5916973 - DNA, 21 bp, Homo sapiens
ggacatgcctgtcctgaaagc

SEQ ID NO: 5916974 - DNA, 21 bp, Homo sapiens
ggacatgcggtagccagcaca

SEQ ID NO: 5916975 - DNA, 18 bp, Homo sapiens
ggacatgcgtgtgtcagg

SEQ ID NO: 5916976 - DNA, 23 bp, Homo sapiens
ggacatgcgtgtgtcagggatga

SEQ ID NO: 5916977 - DNA, 16 bp, Homo sapiens
ggacatgctcacctct

SEQ ID NO: 5916978 - DNA, 17 bp, Homo sapiens
ggacatgctcacctcta

SEQ ID NO: 5916979 - DNA, 19 bp, Homo sapiens
ggacatgctgaagccaaag

SEQ ID NO: 5916980 - DNA, 20 bp, Homo sapiens
ggacatgcttttctgccact

SEQ ID NO: 5916981 - DNA, 14 bp, Homo sapiens
ggacatgggcagca

SEQ ID NO: 5916982 - DNA, 16 bp, Homo sapiens
ggacatggggcaagcc

SEQ ID NO: 5916983 - DNA, 16 bp, Homo sapiens
ggacatggggcataga

SEQ ID NO: 5916984 - DNA, 17 bp, Homo sapiens
ggacatggtcacagtcc

SEQ ID NO: 5916985 - DNA, 16 bp, Homo sapiens
ggacatggtctgtcct

SEQ ID NO: 5916986 - DNA, 23 bp, Homo sapiens
ggacatggtgagtctatttttaa

SEQ ID NO: 5916987 - DNA, 22 bp, Homo sapiens
ggacatgtgctattgaactgag

SEQ ID NO: 5916988 - DNA, 13 bp, Homo sapiens
ggacatgtgggtg

SEQ ID NO: 5916989 - DNA, 17 bp, Homo sapiens
ggacatgttttgataaa

SEQ ID NO: 5916990 - DNA, 21 bp, Homo sapiens
ggacatgtttttgttttcttt

SEQ ID NO: 5916991 - DNA, 20 bp, Homo sapiens
ggacattccaatttgcactt

SEQ ID NO: 5916992 - DNA, 17 bp, Homo sapiens
ggacattctaatgcata

SEQ ID NO: 5916993 - DNA, 12 bp, Homo sapiens
ggacattctctt

SEQ ID NO: 5916994 - DNA, 16 bp, Homo sapiens
ggacattctctttgat

SEQ ID NO: 5916995 - DNA, 24 bp, Homo sapiens
ggacattgcagagtggcctagagc

SEQ ID NO: 5916996 - DNA, 17 bp, Homo sapiens
ggacattgctctctggg

SEQ ID NO: 5916997 - DNA, 18 bp, Homo sapiens
ggacattgctctctgggc

SEQ ID NO: 5916998 - DNA, 20 bp, Homo sapiens
ggacatttaacttttctacc

SEQ ID NO: 5916999 - DNA, 16 bp, Homo sapiens
ggacatttatgtacaa

SEQ ID NO: 5917000 - DNA, 16 bp, Homo sapiens
ggacatttccctcctg

SEQ ID NO: 5917001 - DNA, 17 bp, Homo sapiens
ggacatttgctcatgga

SEQ ID NO: 5917002 - DNA, 19 bp, Homo sapiens
ggacatttgggactgtctt

SEQ ID NO: 5917003 - DNA, 17 bp, Homo sapiens
ggacatttgtggcagtg

SEQ ID NO: 5917004 - DNA, 18 bp, Homo sapiens
ggacatttgtggcagtgc

SEQ ID NO: 5917005 - DNA, 15 bp, Homo sapiens
ggacattttatgtct

SEQ ID NO: 5917006 - DNA, 19 bp, Homo sapiens
ggacattttctctttaaaa

SEQ ID NO: 5917007 - DNA, 19 bp, Homo sapiens
ggacgcaggccctgtccag

SEQ ID NO: 5917008 - DNA, 21 bp, Homo sapiens
ggacgcaggccctgtccagcc

SEQ ID NO: 5917009 - DNA, 13 bp, Homo sapiens
ggacgcagggaga

SEQ ID NO: 5917010 - DNA, 16 bp, Homo sapiens
ggacgcaggtgctgcg

SEQ ID NO: 5917011 - DNA, 18 bp, Homo sapiens
ggacgcatgcagggcccc

SEQ ID NO: 5917012 - DNA, 18 bp, Homo sapiens
ggacgccaacttctccca

SEQ ID NO: 5917013 - DNA, 13 bp, Homo sapiens
ggacgcccagccc

SEQ ID NO: 5917014 - DNA, 15 bp, Homo sapiens
ggacgcccagccccc

SEQ ID NO: 5917015 - DNA, 19 bp, Homo sapiens
ggacgcccagcccccaccc

SEQ ID NO: 5917016 - DNA, 12 bp, Homo sapiens
ggacgccgcgat

SEQ ID NO: 5917017 - DNA, 13 bp, Homo sapiens
ggacgcctgcagg

SEQ ID NO: 5917018 - DNA, 18 bp, Homo sapiens
ggacgcctggctccaggc

SEQ ID NO: 5917019 - DNA, 19 bp, Homo sapiens
ggacgcctgggggtgccag

SEQ ID NO: 5917020 - DNA, 13 bp, Homo sapiens
ggacgcggaggag

SEQ ID NO: 5917021 - DNA, 18 bp, Homo sapiens
ggacgcggaggaggaaga

SEQ ID NO: 5917022 - DNA, 17 bp, Homo sapiens
ggacgctacccgggaag

SEQ ID NO: 5917023 - DNA, 19 bp, Homo sapiens
ggacgctacccgggaaggg

SEQ ID NO: 5917024 - DNA, 20 bp, Homo sapiens
ggacgctacccgggaagggg

SEQ ID NO: 5917025 - DNA, 19 bp, Homo sapiens
ggacgctctctggccttcg

SEQ ID NO: 5917026 - DNA, 17 bp, Homo sapiens
ggacgctgaccgtggag

SEQ ID NO: 5917027 - DNA, 15 bp, Homo sapiens
ggacgctgaggaagt

SEQ ID NO: 5917028 - DNA, 16 bp, Homo sapiens
ggacgctgcagacccc

SEQ ID NO: 5917029 - DNA, 19 bp, Homo sapiens
ggacgctggagaccctgcg

SEQ ID NO: 5917030 - DNA, 13 bp, Homo sapiens
ggacgctggctcc

SEQ ID NO: 5917031 - DNA, 15 bp, Homo sapiens
ggacgcttttgagtg

SEQ ID NO: 5917032 - DNA, 19 bp, Homo sapiens
ggacggaaggtcagttgcc

SEQ ID NO: 5917033 - DNA, 15 bp, Homo sapiens
ggacggaccagcatc

SEQ ID NO: 5917034 - DNA, 14 bp, Homo sapiens
ggacggaggtcccc

SEQ ID NO: 5917035 - DNA, 15 bp, Homo sapiens
ggacggatgggccct

SEQ ID NO: 5917036 - DNA, 12 bp, Homo sapiens
ggacggcgctgc

SEQ ID NO: 5917037 - DNA, 14 bp, Homo sapiens
ggacggcggcagta

SEQ ID NO: 5917038 - DNA, 13 bp, Homo sapiens
ggacggctgagca

SEQ ID NO: 5917039 - DNA, 13 bp, Homo sapiens
ggacgggccacac

SEQ ID NO: 5917040 - DNA, 13 bp, Homo sapiens
ggacggggaggct

SEQ ID NO: 5917041 - DNA, 19 bp, Homo sapiens
ggacggggcccgccccagg

SEQ ID NO: 5917042 - DNA, 13 bp, Homo sapiens
ggacggggcgggc

SEQ ID NO: 5917043 - DNA, 21 bp, Homo sapiens
ggacggggcgggccctgcctg

SEQ ID NO: 5917044 - DNA, 13 bp, Homo sapiens
ggacggggctccc

SEQ ID NO: 5917045 - DNA, 17 bp, Homo sapiens
ggacgggggctgcttct

SEQ ID NO: 5917046 - DNA, 15 bp, Homo sapiens
ggacggtctgtgccc

SEQ ID NO: 5917047 - DNA, 21 bp, Homo sapiens
ggacggtgcccaagccagagg

SEQ ID NO: 5917048 - DNA, 17 bp, Homo sapiens
ggacggtgctccaggca

SEQ ID NO: 5917049 - DNA, 15 bp, Homo sapiens
ggacggttgtaagca

SEQ ID NO: 5917050 - DNA, 23 bp, Homo sapiens
ggacgtccttccatatccctgcc

SEQ ID NO: 5917051 - DNA, 16 bp, Homo sapiens
ggacgtcgcggtgtgt

SEQ ID NO: 5917052 - DNA, 17 bp, Homo sapiens
ggacgtgcactgacagc

SEQ ID NO: 5917053 - DNA, 18 bp, Homo sapiens
ggacgtgcactgacagcc

SEQ ID NO: 5917054 - DNA, 19 bp, Homo sapiens
ggacgtggctcagccagca

SEQ ID NO: 5917055 - DNA, 15 bp, Homo sapiens
ggacgtgggccctgc

SEQ ID NO: 5917056 - DNA, 21 bp, Homo sapiens
ggacgtgggccctgcaggctg

SEQ ID NO: 5917057 - DNA, 13 bp, Homo sapiens
ggacgtgggctgg

SEQ ID NO: 5917058 - DNA, 18 bp, Homo sapiens
ggacgtggtcagggcagg

SEQ ID NO: 5917059 - DNA, 16 bp, Homo sapiens
ggacgtgtacagcaca

SEQ ID NO: 5917060 - DNA, 20 bp, Homo sapiens
ggacgtgtacagcacagaat

SEQ ID NO: 5917061 - DNA, 16 bp, Homo sapiens
ggacgtgtcaggtggt

SEQ ID NO: 5917062 - DNA, 18 bp, Homo sapiens
ggacgtgtgtaaatatgt

SEQ ID NO: 5917063 - DNA, 20 bp, Homo sapiens
ggacgtgttatgactccaga

SEQ ID NO: 5917064 - DNA, 15 bp, Homo sapiens
ggacgttaggccagg

SEQ ID NO: 5917065 - DNA, 19 bp, Homo sapiens
ggacgttaggccaggcctt

SEQ ID NO: 5917066 - DNA, 21 bp, Homo sapiens
ggacgttaggcccgggcccct

SEQ ID NO: 5917067 - DNA, 21 bp, Homo sapiens
ggacgttccagccggcatggc

SEQ ID NO: 5917068 - DNA, 17 bp, Homo sapiens
ggacgttgcctggccct

SEQ ID NO: 5917069 - DNA, 15 bp, Homo sapiens
ggacgttgctgagcc

SEQ ID NO: 5917070 - DNA, 21 bp, Homo sapiens
ggacgttgctgagccagctgc

SEQ ID NO: 5917071 - DNA, 12 bp, Homo sapiens
ggacgttggcct

SEQ ID NO: 5917072 - DNA, 14 bp, Homo sapiens
ggacgttgttttgg

SEQ ID NO: 5917073 - DNA, 12 bp, Homo sapiens
ggacgtttctca

SEQ ID NO: 5917074 - DNA, 14 bp, Homo sapiens
ggacgtttctggaa

SEQ ID NO: 5917075 - DNA, 19 bp, Homo sapiens
ggactaaactatctgtatt

SEQ ID NO: 5917076 - DNA, 22 bp, Homo sapiens
ggactaacactcagaagcctgg

SEQ ID NO: 5917077 - DNA, 18 bp, Homo sapiens
ggactaacataaaatctg

SEQ ID NO: 5917078 - DNA, 24 bp, Homo sapiens
ggactaacttgtctttggaccctg

SEQ ID NO: 5917079 - DNA, 13 bp, Homo sapiens
ggactacagaagt

SEQ ID NO: 5917080 - DNA, 17 bp, Homo sapiens
ggactacaggacaaggg

SEQ ID NO: 5917081 - DNA, 14 bp, Homo sapiens
ggactacaggtgtg

SEQ ID NO: 5917082 - DNA, 17 bp, Homo sapiens
ggactacattttgctct

SEQ ID NO: 5917083 - DNA, 16 bp, Homo sapiens
ggactaccgcaggccc

SEQ ID NO: 5917084 - DNA, 13 bp, Homo sapiens
ggactactgaagc

SEQ ID NO: 5917085 - DNA, 21 bp, Homo sapiens
ggactagaacctatctttaaa

SEQ ID NO: 5917086 - DNA, 14 bp, Homo sapiens
ggactagaacctgg

SEQ ID NO: 5917087 - DNA, 21 bp, Homo sapiens
ggactagatactactttctct

SEQ ID NO: 5917088 - DNA, 14 bp, Homo sapiens
ggactagcccctgt

SEQ ID NO: 5917089 - DNA, 21 bp, Homo sapiens
ggactaggcatgtcagaggac

SEQ ID NO: 5917090 - DNA, 14 bp, Homo sapiens
ggactagtgtccta

SEQ ID NO: 5917091 - DNA, 21 bp, Homo sapiens
ggactatgatgagaggccagc

SEQ ID NO: 5917092 - DNA, 16 bp, Homo sapiens
ggactattatgtggaa

SEQ ID NO: 5917093 - DNA, 18 bp, Homo sapiens
ggactcaagccccggact

SEQ ID NO: 5917094 - DNA, 15 bp, Homo sapiens
ggactcaatgcactg

SEQ ID NO: 5917095 - DNA, 22 bp, Homo sapiens
ggactcaatgcactgacattgt

SEQ ID NO: 5917096 - DNA, 13 bp, Homo sapiens
ggactcaccctca

SEQ ID NO: 5917097 - DNA, 15 bp, Homo sapiens
ggactcactggcagc

SEQ ID NO: 5917098 - DNA, 19 bp, Homo sapiens
ggactcactggcagcccca

SEQ ID NO: 5917099 - DNA, 22 bp, Homo sapiens
ggactcacttgatgtttcctgg

SEQ ID NO: 5917100 - DNA, 18 bp, Homo sapiens
ggactcagaagcctctgg

SEQ ID NO: 5917101 - DNA, 20 bp, Homo sapiens
ggactcagactcctggcttc

SEQ ID NO: 5917102 - DNA, 21 bp, Homo sapiens
ggactcagactcctggcttca

SEQ ID NO: 5917103 - DNA, 11 bp, Homo sapiens
ggactcagccc

SEQ ID NO: 5917104 - DNA, 13 bp, Homo sapiens
ggactcagcccac

SEQ ID NO: 5917105 - DNA, 17 bp, Homo sapiens
ggactcagcccacctgc

SEQ ID NO: 5917106 - DNA, 18 bp, Homo sapiens
ggactcagcccacctgca

SEQ ID NO: 5917107 - DNA, 19 bp, Homo sapiens
ggactcagcccacctgcac

SEQ ID NO: 5917108 - DNA, 15 bp, Homo sapiens
ggactcagccctgag

SEQ ID NO: 5917109 - DNA, 17 bp, Homo sapiens
ggactcagccctgaggt

SEQ ID NO: 5917110 - DNA, 17 bp, Homo sapiens
ggactcagccttcagac

SEQ ID NO: 5917111 - DNA, 14 bp, Homo sapiens
ggactcaggaactt

SEQ ID NO: 5917112 - DNA, 17 bp, Homo sapiens
ggactcaggcctgccaa

SEQ ID NO: 5917113 - DNA, 16 bp, Homo sapiens
ggactcaggcgggaca

SEQ ID NO: 5917114 - DNA, 11 bp, Homo sapiens
ggactcaggga

SEQ ID NO: 5917115 - DNA, 20 bp, Homo sapiens
ggactcagggccatgcctgc

SEQ ID NO: 5917116 - DNA, 23 bp, Homo sapiens
ggactcaggtctgtaactgccca

SEQ ID NO: 5917117 - DNA, 19 bp, Homo sapiens
ggactcagtgggttaacat

SEQ ID NO: 5917118 - DNA, 20 bp, Homo sapiens
ggactcagttcttggcctgc

SEQ ID NO: 5917119 - DNA, 21 bp, Homo sapiens
ggactcagttcttggcctgct

SEQ ID NO: 5917120 - DNA, 14 bp, Homo sapiens
ggactcatgaggag

SEQ ID NO: 5917121 - DNA, 14 bp, Homo sapiens
ggactcatggctta

SEQ ID NO: 5917122 - DNA, 17 bp, Homo sapiens
ggactccaagccctggg

SEQ ID NO: 5917123 - DNA, 19 bp, Homo sapiens
ggactccacgatgcctttg

SEQ ID NO: 5917124 - DNA, 17 bp, Homo sapiens
ggactccactggacaga

SEQ ID NO: 5917125 - DNA, 16 bp, Homo sapiens
ggactccagaagcagc

SEQ ID NO: 5917126 - DNA, 18 bp, Homo sapiens
ggactccagaatctaaag

SEQ ID NO: 5917127 - DNA, 19 bp, Homo sapiens
ggactccaggatcctcctg

SEQ ID NO: 5917128 - DNA, 20 bp, Homo sapiens
ggactccaggatcctcctgg

SEQ ID NO: 5917129 - DNA, 21 bp, Homo sapiens
ggactccaggcagcagacaca

SEQ ID NO: 5917130 - DNA, 15 bp, Homo sapiens
ggactccaggcccaa

SEQ ID NO: 5917131 - DNA, 22 bp, Homo sapiens
ggactccaggcccaaggctccc

SEQ ID NO: 5917132 - DNA, 18 bp, Homo sapiens
ggactccaggcctgacca

SEQ ID NO: 5917133 - DNA, 13 bp, Homo sapiens
ggactccaggtct

SEQ ID NO: 5917134 - DNA, 11 bp, Homo sapiens
ggactccatct

SEQ ID NO: 5917135 - DNA, 17 bp, Homo sapiens
ggactccccaggccagg

SEQ ID NO: 5917136 - DNA, 19 bp, Homo sapiens
ggactccccaggccaggcc

SEQ ID NO: 5917137 - DNA, 15 bp, Homo sapiens
ggactcccgggccac

SEQ ID NO: 5917138 - DNA, 18 bp, Homo sapiens
ggactcccgggccacgcc

SEQ ID NO: 5917139 - DNA, 19 bp, Homo sapiens
ggactcccgggccacgccc

SEQ ID NO: 5917140 - DNA, 15 bp, Homo sapiens
ggactccctccccac

SEQ ID NO: 5917141 - DNA, 20 bp, Homo sapiens
ggactccctcctcacctctg

SEQ ID NO: 5917142 - DNA, 20 bp, Homo sapiens
ggactccggaggactgagcc

SEQ ID NO: 5917143 - DNA, 22 bp, Homo sapiens
ggactcctccccaccctcctgg

SEQ ID NO: 5917144 - DNA, 15 bp, Homo sapiens
ggactcctcctttct

SEQ ID NO: 5917145 - DNA, 12 bp, Homo sapiens
ggactcctctgt

SEQ ID NO: 5917146 - DNA, 15 bp, Homo sapiens
ggactcctctgtcca

SEQ ID NO: 5917147 - DNA, 11 bp, Homo sapiens
ggactcctgaa

SEQ ID NO: 5917148 - DNA, 14 bp, Homo sapiens
ggactcctggtgcc

SEQ ID NO: 5917149 - DNA, 18 bp, Homo sapiens
ggactcctggtgcccctc

SEQ ID NO: 5917150 - DNA, 14 bp, Homo sapiens
ggactcgcttgtaa

SEQ ID NO: 5917151 - DNA, 13 bp, Homo sapiens
ggactcggccact

SEQ ID NO: 5917152 - DNA, 13 bp, Homo sapiens
ggactctcaggga

SEQ ID NO: 5917153 - DNA, 13 bp, Homo sapiens
ggactctccaggc

SEQ ID NO: 5917154 - DNA, 14 bp, Homo sapiens
ggactctcctcctc

SEQ ID NO: 5917155 - DNA, 16 bp, Homo sapiens
ggactctcctcctccc

SEQ ID NO: 5917156 - DNA, 18 bp, Homo sapiens
ggactctcctcctcccct

SEQ ID NO: 5917157 - DNA, 23 bp, Homo sapiens
ggactctcctcctcccctcctct

SEQ ID NO: 5917158 - DNA, 17 bp, Homo sapiens
ggactctctccaggagg

SEQ ID NO: 5917159 - DNA, 12 bp, Homo sapiens
ggactctctgac

SEQ ID NO: 5917160 - DNA, 15 bp, Homo sapiens
ggactctctgcctgc

SEQ ID NO: 5917161 - DNA, 16 bp, Homo sapiens
ggactctctgcctgct

SEQ ID NO: 5917162 - DNA, 13 bp, Homo sapiens
ggactctctttct

SEQ ID NO: 5917163 - DNA, 20 bp, Homo sapiens
ggactctgaaatatcccggg

SEQ ID NO: 5917164 - DNA, 17 bp, Homo sapiens
ggactctgaagcctctg

SEQ ID NO: 5917165 - DNA, 19 bp, Homo sapiens
ggactctgaagcctctggg

SEQ ID NO: 5917166 - DNA, 14 bp, Homo sapiens
ggactctgatctct

SEQ ID NO: 5917167 - DNA, 23 bp, Homo sapiens
ggactctgcaagtgtctggagcg

SEQ ID NO: 5917168 - DNA, 21 bp, Homo sapiens
ggactctgcacatgtcttgta

SEQ ID NO: 5917169 - DNA, 22 bp, Homo sapiens
ggactctgcagatagtgcctct

SEQ ID NO: 5917170 - DNA, 17 bp, Homo sapiens
ggactctgcagcctcag

SEQ ID NO: 5917171 - DNA, 13 bp, Homo sapiens
ggactctgcccca

SEQ ID NO: 5917172 - DNA, 14 bp, Homo sapiens
ggactctgccccaa

SEQ ID NO: 5917173 - DNA, 23 bp, Homo sapiens
ggactctgccccttctgtttcca

SEQ ID NO: 5917174 - DNA, 11 bp, Homo sapiens
ggactctgcct

SEQ ID NO: 5917175 - DNA, 16 bp, Homo sapiens
ggactctgccttccag

SEQ ID NO: 5917176 - DNA, 17 bp, Homo sapiens
ggactctgccttccagg

SEQ ID NO: 5917177 - DNA, 21 bp, Homo sapiens
ggactctgcgggaggctgggg

SEQ ID NO: 5917178 - DNA, 21 bp, Homo sapiens
ggactctgcttggctgtcccc

SEQ ID NO: 5917179 - DNA, 23 bp, Homo sapiens
ggactctggaagattttcattga

SEQ ID NO: 5917180 - DNA, 13 bp, Homo sapiens
ggactctggcaca

SEQ ID NO: 5917181 - DNA, 20 bp, Homo sapiens
ggactctgggctatggacac

SEQ ID NO: 5917182 - DNA, 18 bp, Homo sapiens
ggactctgggctgtgcct

SEQ ID NO: 5917183 - DNA, 17 bp, Homo sapiens
ggactctggtgcctcca

SEQ ID NO: 5917184 - DNA, 18 bp, Homo sapiens
ggactctggtgcctccag

SEQ ID NO: 5917185 - DNA, 18 bp, Homo sapiens
ggactctgtctggccagg

SEQ ID NO: 5917186 - DNA, 14 bp, Homo sapiens
ggactctgtgctca

SEQ ID NO: 5917187 - DNA, 23 bp, Homo sapiens
ggagaattccagttgtatttgaa

SEQ ID NO: 5917188 - DNA, 14 bp, Homo sapiens
ggagaattgcctct

SEQ ID NO: 5917189 - DNA, 22 bp, Homo sapiens
ggagaattgctggaacccagga

SEQ ID NO: 5917190 - DNA, 22 bp, Homo sapiens
ggagaatttaggtttttattag

SEQ ID NO: 5917191 - DNA, 19 bp, Homo sapiens
ggagaatttttactgggga

SEQ ID NO: 5917192 - DNA, 15 bp, Homo sapiens
ggagacaaaagagca

SEQ ID NO: 5917193 - DNA, 20 bp, Homo sapiens
ggagacaaacagcccttcct

SEQ ID NO: 5917194 - DNA, 16 bp, Homo sapiens
ggagacaaggtgctaa

SEQ ID NO: 5917195 - DNA, 12 bp, Homo sapiens
ggagacaatcta

SEQ ID NO: 5917196 - DNA, 17 bp, Homo sapiens
ggagacaatctaaaaaa

SEQ ID NO: 5917197 - DNA, 21 bp, Homo sapiens
ggagacaattagcagaatgga

SEQ ID NO: 5917198 - DNA, 23 bp, Homo sapiens
ggagacacagatggcacctgtgg

SEQ ID NO: 5917199 - DNA, 17 bp, Homo sapiens
ggagacacgacagcaca

SEQ ID NO: 5917200 - DNA, 20 bp, Homo sapiens
ggagacactggcccctcaaa

SEQ ID NO: 5917201 - DNA, 14 bp, Homo sapiens
ggagacagaaagcc

SEQ ID NO: 5917202 - DNA, 13 bp, Homo sapiens
ggagacagaccac

SEQ ID NO: 5917203 - DNA, 14 bp, Homo sapiens
ggagacagaccact

SEQ ID NO: 5917204 - DNA, 14 bp, Homo sapiens
ggagacagagacag

SEQ ID NO: 5917205 - DNA, 22 bp, Homo sapiens
ggagacagagagctcctccctg

SEQ ID NO: 5917206 - DNA, 14 bp, Homo sapiens
ggagacagagatgt

SEQ ID NO: 5917207 - DNA, 19 bp, Homo sapiens
ggagacagagatgtgcaga

SEQ ID NO: 5917208 - DNA, 22 bp, Homo sapiens
ggagacagagcaacccctggac

SEQ ID NO: 5917209 - DNA, 23 bp, Homo sapiens
ggagacagagccaagcactgctc

SEQ ID NO: 5917210 - DNA, 11 bp, Homo sapiens
ggagacagagg

SEQ ID NO: 5917211 - DNA, 16 bp, Homo sapiens
ggagacagaggaaagg

SEQ ID NO: 5917212 - DNA, 20 bp, Homo sapiens
ggagacagaggaaagggctg

SEQ ID NO: 5917213 - DNA, 11 bp, Homo sapiens
ggagacagcag

SEQ ID NO: 5917214 - DNA, 12 bp, Homo sapiens
ggagacagcagc

SEQ ID NO: 5917215 - DNA, 18 bp, Homo sapiens
ggagacagcatcagggtt

SEQ ID NO: 5917216 - DNA, 15 bp, Homo sapiens
ggagacagccaggtg

SEQ ID NO: 5917217 - DNA, 15 bp, Homo sapiens
ggagacagccccaga

SEQ ID NO: 5917218 - DNA, 22 bp, Homo sapiens
ggagacagccccagagcagggt

SEQ ID NO: 5917219 - DNA, 16 bp, Homo sapiens
ggagacagccctgcct

SEQ ID NO: 5917220 - DNA, 17 bp, Homo sapiens
ggagacaggagcctagc

SEQ ID NO: 5917221 - DNA, 13 bp, Homo sapiens
ggagacagggcaa

SEQ ID NO: 5917222 - DNA, 19 bp, Homo sapiens
ggagacaggttagctgctc

SEQ ID NO: 5917223 - DNA, 22 bp, Homo sapiens
ggagacataaccactgcttcca

SEQ ID NO: 5917224 - DNA, 14 bp, Homo sapiens
ggagacatgtgaca

SEQ ID NO: 5917225 - DNA, 15 bp, Homo sapiens
ggagacatgtgacat

SEQ ID NO: 5917226 - DNA, 13 bp, Homo sapiens
ggagaccaccccc

SEQ ID NO: 5917227 - DNA, 14 bp, Homo sapiens
ggagaccacccccg

SEQ ID NO: 5917228 - DNA, 17 bp, Homo sapiens
ggagaccacccccgagc

SEQ ID NO: 5917229 - DNA, 20 bp, Homo sapiens
ggagaccagaacagcatggc

SEQ ID NO: 5917230 - DNA, 18 bp, Homo sapiens
ggagaccagaagtgaatg

SEQ ID NO: 5917231 - DNA, 13 bp, Homo sapiens
ggagaccagctca

SEQ ID NO: 5917232 - DNA, 14 bp, Homo sapiens
ggagaccagctcag

SEQ ID NO: 5917233 - DNA, 13 bp, Homo sapiens
ggagaccaggact

SEQ ID NO: 5917234 - DNA, 13 bp, Homo sapiens
ggagaccaggctc

SEQ ID NO: 5917235 - DNA, 19 bp, Homo sapiens
ggagacccaccccacctgc

SEQ ID NO: 5917236 - DNA, 17 bp, Homo sapiens
ggagaccccaccagcct

SEQ ID NO: 5917237 - DNA, 20 bp, Homo sapiens
ggagaccccggtggcagtgg

SEQ ID NO: 5917238 - DNA, 21 bp, Homo sapiens
ggagaccccttggggagcagg

SEQ ID NO: 5917239 - DNA, 15 bp, Homo sapiens
ggagaccctccccac

SEQ ID NO: 5917240 - DNA, 17 bp, Homo sapiens
ggagaccctcccctgcc

SEQ ID NO: 5917241 - DNA, 17 bp, Homo sapiens
ggagaccctgaactcag

SEQ ID NO: 5917242 - DNA, 22 bp, Homo sapiens
ggagaccctgaactcagaaggc

SEQ ID NO: 5917243 - DNA, 13 bp, Homo sapiens
ggagaccctgcaa

SEQ ID NO: 5917244 - DNA, 22 bp, Homo sapiens
ggagaccctgcaaacagaacag

SEQ ID NO: 5917245 - DNA, 23 bp, Homo sapiens
ggagaccctgcaaacagaacagg

SEQ ID NO: 5917246 - DNA, 12 bp, Homo sapiens
ggagaccctgcc

SEQ ID NO: 5917247 - DNA, 23 bp, Homo sapiens
ggagaccctgccacagccagagg

SEQ ID NO: 5917248 - DNA, 13 bp, Homo sapiens
ggagaccctgcgc

SEQ ID NO: 5917249 - DNA, 18 bp, Homo sapiens
ggagaccctgcgcccctg

SEQ ID NO: 5917250 - DNA, 14 bp, Homo sapiens
ggagaccctgtctt

SEQ ID NO: 5917251 - DNA, 22 bp, Homo sapiens
ggagaccgagtgtggagctgct

SEQ ID NO: 5917252 - DNA, 23 bp, Homo sapiens
ggagaccgcttcacccctgcact

SEQ ID NO: 5917253 - DNA, 17 bp, Homo sapiens
ggagaccggcctgccag

SEQ ID NO: 5917254 - DNA, 21 bp, Homo sapiens
ggagacctgttggcctgtggg

SEQ ID NO: 5917255 - DNA, 15 bp, Homo sapiens
ggagacgcctctccc

SEQ ID NO: 5917256 - DNA, 18 bp, Homo sapiens
ggagacggccctgctggg

SEQ ID NO: 5917257 - DNA, 16 bp, Homo sapiens
ggagacgggaccctgc

SEQ ID NO: 5917258 - DNA, 19 bp, Homo sapiens
ggagacggtttccagggag

SEQ ID NO: 5917259 - DNA, 22 bp, Homo sapiens
ggagacgtacgtatcagcggcc

SEQ ID NO: 5917260 - DNA, 19 bp, Homo sapiens
ggagacgtggaacctctgt

SEQ ID NO: 5917261 - DNA, 23 bp, Homo sapiens
ggagacgtggaacctctgtctca

SEQ ID NO: 5917262 - DNA, 16 bp, Homo sapiens
ggagactaagccctgt

SEQ ID NO: 5917263 - DNA, 15 bp, Homo sapiens
ggagactatgtgtca

SEQ ID NO: 5917264 - DNA, 13 bp, Homo sapiens
ggagactcacctc

SEQ ID NO: 5917265 - DNA, 19 bp, Homo sapiens
ggagactcacctctgcctc

SEQ ID NO: 5917266 - DNA, 21 bp, Homo sapiens
ggagactcacctctgcctcaa

SEQ ID NO: 5917267 - DNA, 16 bp, Homo sapiens
ggagactcctaggcag

SEQ ID NO: 5917268 - DNA, 18 bp, Homo sapiens
ggagactcctaggcagga

SEQ ID NO: 5917269 - DNA, 16 bp, Homo sapiens
ggagactcctggtctg

SEQ ID NO: 5917270 - DNA, 16 bp, Homo sapiens
ggagactctgtggggc

SEQ ID NO: 5917271 - DNA, 13 bp, Homo sapiens
ggagactgaccca

SEQ ID NO: 5917272 - DNA, 17 bp, Homo sapiens
ggagactgacccattca

SEQ ID NO: 5917273 - DNA, 12 bp, Homo sapiens
ggagactgagat

SEQ ID NO: 5917274 - DNA, 15 bp, Homo sapiens
ggagactgagcttga

SEQ ID NO: 5917275 - DNA, 23 bp, Homo sapiens
ggagactgcttcccatcctaccc

SEQ ID NO: 5917276 - DNA, 14 bp, Homo sapiens
ggagactggcaggc

SEQ ID NO: 5917277 - DNA, 15 bp, Homo sapiens
ggagactggcaggcg

SEQ ID NO: 5917278 - DNA, 13 bp, Homo sapiens
ggagactgggctg

SEQ ID NO: 5917279 - DNA, 18 bp, Homo sapiens
ggagactggggggcttga

SEQ ID NO: 5917280 - DNA, 12 bp, Homo sapiens
ggagactgtccc

SEQ ID NO: 5917281 - DNA, 16 bp, Homo sapiens
ggagactgtctcaaga

SEQ ID NO: 5917282 - DNA, 23 bp, Homo sapiens
ggagactgtggtaggggcaggga

SEQ ID NO: 5917283 - DNA, 20 bp, Homo sapiens
ggagactgtgtgtgccctct

SEQ ID NO: 5917284 - DNA, 22 bp, Homo sapiens
ggagacttagggcaccaggggt

SEQ ID NO: 5917285 - DNA, 10 bp, Homo sapiens
ggagagaaaa

SEQ ID NO: 5917286 - DNA, 15 bp, Homo sapiens
ggagagaaaaaagaa

SEQ ID NO: 5917287 - DNA, 12 bp, Homo sapiens
ggagagaaaaca

SEQ ID NO: 5917288 - DNA, 16 bp, Homo sapiens
ggagagaaaatatatg

SEQ ID NO: 5917289 - DNA, 15 bp, Homo sapiens
ggagagaaatatttt

SEQ ID NO: 5917290 - DNA, 18 bp, Homo sapiens
ggagagaaatattttaat

SEQ ID NO: 5917291 - DNA, 18 bp, Homo sapiens
ggagagaatgagagagtg

SEQ ID NO: 5917292 - DNA, 19 bp, Homo sapiens
ggagagaatgagagagtgt

SEQ ID NO: 5917293 - DNA, 17 bp, Homo sapiens
ggagagacactggtggg

SEQ ID NO: 5917294 - DNA, 16 bp, Homo sapiens
ggagagacaggcagcc

SEQ ID NO: 5917295 - DNA, 18 bp, Homo sapiens
ggagagaccagcctttct

SEQ ID NO: 5917296 - DNA, 18 bp, Homo sapiens
ggagagaccgagtgaacc

SEQ ID NO: 5917297 - DNA, 17 bp, Homo sapiens
ggagagaccttctctta

SEQ ID NO: 5917298 - DNA, 17 bp, Homo sapiens
ggagagactcccatgaa

SEQ ID NO: 5917299 - DNA, 20 bp, Homo sapiens
ggagagactcccatgaagcc

SEQ ID NO: 5917300 - DNA, 22 bp, Homo sapiens
ggagagactgaaagcagcagct

SEQ ID NO: 5917301 - DNA, 14 bp, Homo sapiens
ggagagactggcca

SEQ ID NO: 5917302 - DNA, 14 bp, Homo sapiens
ggagagactgtgag

SEQ ID NO: 5917303 - DNA, 10 bp, Homo sapiens
ggagagagaa

SEQ ID NO: 5917304 - DNA, 11 bp, Homo sapiens
ggagagagaaa

SEQ ID NO: 5917305 - DNA, 12 bp, Homo sapiens
ggagagagaaag

SEQ ID NO: 5917306 - DNA, 18 bp, Homo sapiens
ggagagagaaagccaggc

SEQ ID NO: 5917307 - DNA, 16 bp, Homo sapiens
ggagagagaagcaggc

SEQ ID NO: 5917308 - DNA, 16 bp, Homo sapiens
ggagagagacagagag

SEQ ID NO: 5917309 - DNA, 19 bp, Homo sapiens
ggagagagacgtgtacata

SEQ ID NO: 5917310 - DNA, 18 bp, Homo sapiens
ggagagagagagagaaag

SEQ ID NO: 5917311 - DNA, 19 bp, Homo sapiens
ggagagagagagagagagg

SEQ ID NO: 5917312 - DNA, 13 bp, Homo sapiens
ggagagagaggct

SEQ ID NO: 5917313 - DNA, 14 bp, Homo sapiens
ggagagagaggctg

SEQ ID NO: 5917314 - DNA, 20 bp, Homo sapiens
ggagagagaggctgcctcag

SEQ ID NO: 5917315 - DNA, 16 bp, Homo sapiens
ggagagagagttctca

SEQ ID NO: 5917316 - DNA, 12 bp, Homo sapiens
ggagagagcagg

SEQ ID NO: 5917317 - DNA, 13 bp, Homo sapiens
ggagagagccaag

SEQ ID NO: 5917318 - DNA, 15 bp, Homo sapiens
ggagagagccaggat

SEQ ID NO: 5917319 - DNA, 17 bp, Homo sapiens
ggagagagcccttccca

SEQ ID NO: 5917320 - DNA, 20 bp, Homo sapiens
ggagagagcccttcccaggg

SEQ ID NO: 5917321 - DNA, 21 bp, Homo sapiens
ggagagagcccttcccagggc

SEQ ID NO: 5917322 - DNA, 13 bp, Homo sapiens
ggagagaggcaga

SEQ ID NO: 5917323 - DNA, 12 bp, Homo sapiens
ggagagagggga

SEQ ID NO: 5917324 - DNA, 14 bp, Homo sapiens
ggagagaggttgag

SEQ ID NO: 5917325 - DNA, 19 bp, Homo sapiens
ggagagagtagctgcagcc

SEQ ID NO: 5917326 - DNA, 15 bp, Homo sapiens
ggagagagtcccaga

SEQ ID NO: 5917327 - DNA, 20 bp, Homo sapiens
ggagagagtcttttaacttt

SEQ ID NO: 5917328 - DNA, 13 bp, Homo sapiens
ggagagagtgaga

SEQ ID NO: 5917329 - DNA, 17 bp, Homo sapiens
ggagagagtgagagaga

SEQ ID NO: 5917330 - DNA, 18 bp, Homo sapiens
ggagagagtgagagagag

SEQ ID NO: 5917331 - DNA, 19 bp, Homo sapiens
ggagagagtgagagagagt

SEQ ID NO: 5917332 - DNA, 21 bp, Homo sapiens
ggagagattattaaatcgttt

SEQ ID NO: 5917333 - DNA, 14 bp, Homo sapiens
ggagagcaaaggcc

SEQ ID NO: 5917334 - DNA, 18 bp, Homo sapiens
ggagagcaaaggcccatg

SEQ ID NO: 5917335 - DNA, 13 bp, Homo sapiens
ggagagcactgcc

SEQ ID NO: 5917336 - DNA, 14 bp, Homo sapiens
ggagagcactgcct

SEQ ID NO: 5917337 - DNA, 15 bp, Homo sapiens
ggagagcactgcctc

SEQ ID NO: 5917338 - DNA, 17 bp, Homo sapiens
ggagagcactgcctcta

SEQ ID NO: 5917339 - DNA, 16 bp, Homo sapiens
ggagagcagcaggtgc

SEQ ID NO: 5917340 - DNA, 12 bp, Homo sapiens
ggagagcagctg

SEQ ID NO: 5917341 - DNA, 13 bp, Homo sapiens
ggagagcagctgg

SEQ ID NO: 5917342 - DNA, 16 bp, Homo sapiens
ggagagcaggctggca

SEQ ID NO: 5917343 - DNA, 19 bp, Homo sapiens
ggagagcatcaccaccaca

SEQ ID NO: 5917344 - DNA, 20 bp, Homo sapiens
ggagagcatcggcctagggc

SEQ ID NO: 5917345 - DNA, 19 bp, Homo sapiens
ggagagcatctgctctgag

SEQ ID NO: 5917346 - DNA, 16 bp, Homo sapiens
ggagagccactgggcc

SEQ ID NO: 5917347 - DNA, 17 bp, Homo sapiens
ggagagccactgggccc

SEQ ID NO: 5917348 - DNA, 16 bp, Homo sapiens
ggagagccagaacctg

SEQ ID NO: 5917349 - DNA, 20 bp, Homo sapiens
ggagagccagaacctggagg

SEQ ID NO: 5917350 - DNA, 21 bp, Homo sapiens
ggagagccagaacctggaggg

SEQ ID NO: 5917351 - DNA, 14 bp, Homo sapiens
ggagagccagagaa

SEQ ID NO: 5917352 - DNA, 15 bp, Homo sapiens
ggagagccagccctc

SEQ ID NO: 5917353 - DNA, 21 bp, Homo sapiens
ggagagccagccctccctgtc

SEQ ID NO: 5917354 - DNA, 21 bp, Homo sapiens
ggagagccatacataaaagaa

SEQ ID NO: 5917355 - DNA, 16 bp, Homo sapiens
ggagagcccaggcctg

SEQ ID NO: 5917356 - DNA, 11 bp, Homo sapiens
ggagagccctg

SEQ ID NO: 5917357 - DNA, 12 bp, Homo sapiens
ggagagccctgg

SEQ ID NO: 5917358 - DNA, 23 bp, Homo sapiens
ggagagccctggattaggagggt

SEQ ID NO: 5917359 - DNA, 12 bp, Homo sapiens
ggagagccctgt

SEQ ID NO: 5917360 - DNA, 11 bp, Homo sapiens
ggagagcctgc

SEQ ID NO: 5917361 - DNA, 13 bp, Homo sapiens
ggagagcctggca

SEQ ID NO: 5917362 - DNA, 12 bp, Homo sapiens
ggagagcctggt

SEQ ID NO: 5917363 - DNA, 18 bp, Homo sapiens
ggagagccttccaggggt

SEQ ID NO: 5917364 - DNA, 22 bp, Homo sapiens
ggagagccttccaggggtggga

SEQ ID NO: 5917365 - DNA, 23 bp, Homo sapiens
ggagagccttggcgagggcagca

SEQ ID NO: 5917366 - DNA, 15 bp, Homo sapiens
ggagagcgaggaggc

SEQ ID NO: 5917367 - DNA, 17 bp, Homo sapiens
ggagagcgccacccgcc

SEQ ID NO: 5917368 - DNA, 22 bp, Homo sapiens
ggagagcgcctgcccctcccag

SEQ ID NO: 5917369 - DNA, 14 bp, Homo sapiens
ggagagcggaggag

SEQ ID NO: 5917370 - DNA, 17 bp, Homo sapiens
ggagagcggaggaggaa

SEQ ID NO: 5917371 - DNA, 14 bp, Homo sapiens
ggagagcggctgga

SEQ ID NO: 5917372 - DNA, 18 bp, Homo sapiens
ggagagctagaacctgga

SEQ ID NO: 5917373 - DNA, 20 bp, Homo sapiens
ggagagctagaacctggaga

SEQ ID NO: 5917374 - DNA, 17 bp, Homo sapiens
ggagagctagcagcagg

SEQ ID NO: 5917375 - DNA, 21 bp, Homo sapiens
ggagagctagcagcagggagg

SEQ ID NO: 5917376 - DNA, 12 bp, Homo sapiens
ggagagctagga

SEQ ID NO: 5917377 - DNA, 15 bp, Homo sapiens
ggagagctaggagca

SEQ ID NO: 5917378 - DNA, 20 bp, Homo sapiens
ggagagctcagtacagggca

SEQ ID NO: 5917379 - DNA, 21 bp, Homo sapiens
ggagagctcagtacagggcag

SEQ ID NO: 5917380 - DNA, 21 bp, Homo sapiens
ggagagctgattgcagaaagg

SEQ ID NO: 5917381 - DNA, 22 bp, Homo sapiens
ggagagctggagcctggtgccc

SEQ ID NO: 5917382 - DNA, 13 bp, Homo sapiens
ggagagctggcag

SEQ ID NO: 5917383 - DNA, 18 bp, Homo sapiens
ggagagctggcagtgtgc

SEQ ID NO: 5917384 - DNA, 19 bp, Homo sapiens
ggagagctgggcagacagg

SEQ ID NO: 5917385 - DNA, 14 bp, Homo sapiens
ggagagctggtgac

SEQ ID NO: 5917386 - DNA, 15 bp, Homo sapiens
ggagagctggtgact

SEQ ID NO: 5917387 - DNA, 20 bp, Homo sapiens
ggagagctggtgactttggg

SEQ ID NO: 5917388 - DNA, 17 bp, Homo sapiens
ggagagctggtgcccgg

SEQ ID NO: 5917389 - DNA, 19 bp, Homo sapiens
ggagagcttcaggccccag

SEQ ID NO: 5917390 - DNA, 21 bp, Homo sapiens
ggagagcttcaggccccagga

SEQ ID NO: 5917391 - DNA, 16 bp, Homo sapiens
ggagagctttgtgctt

SEQ ID NO: 5917392 - DNA, 17 bp, Homo sapiens
ggagaggaaaatgtttc

SEQ ID NO: 5917393 - DNA, 17 bp, Homo sapiens
ggagaggaactccttgg

SEQ ID NO: 5917394 - DNA, 11 bp, Homo sapiens
ggagaggaaga

SEQ ID NO: 5917395 - DNA, 15 bp, Homo sapiens
ggagaggaagaaacg

SEQ ID NO: 5917396 - DNA, 12 bp, Homo sapiens
ggagaggaagca

SEQ ID NO: 5917397 - DNA, 14 bp, Homo sapiens
ggagaggaagcaca

SEQ ID NO: 5917398 - DNA, 22 bp, Homo sapiens
ggagaggaagcacactgcaggg

SEQ ID NO: 5917399 - DNA, 21 bp, Homo sapiens
ggagaggaccccattctggga

SEQ ID NO: 5917400 - DNA, 13 bp, Homo sapiens
ggagaggactctg

SEQ ID NO: 5917401 - DNA, 14 bp, Homo sapiens
ggagaggactctgc

SEQ ID NO: 5917402 - DNA, 14 bp, Homo sapiens
ggagaggagaaaaa

SEQ ID NO: 5917403 - DNA, 12 bp, Homo sapiens
ggagaggagaac

SEQ ID NO: 5917404 - DNA, 17 bp, Homo sapiens
ggagaggagagaatgag

SEQ ID NO: 5917405 - DNA, 14 bp, Homo sapiens
ggagaggagagcca

SEQ ID NO: 5917406 - DNA, 20 bp, Homo sapiens
ggagaggagagccagagaag

SEQ ID NO: 5917407 - DNA, 16 bp, Homo sapiens
ggagaggagccctgcc

SEQ ID NO: 5917408 - DNA, 20 bp, Homo sapiens
ggagaggagtgactgagctt

SEQ ID NO: 5917409 - DNA, 22 bp, Homo sapiens
ggagaggatgagagcccagagg

SEQ ID NO: 5917410 - DNA, 12 bp, Homo sapiens
ggagaggcagaa

SEQ ID NO: 5917411 - DNA, 14 bp, Homo sapiens
ggagaggcagcatg

SEQ ID NO: 5917412 - DNA, 22 bp, Homo sapiens
ggagaggcagcatgcttgggct

SEQ ID NO: 5917413 - DNA, 23 bp, Homo sapiens
ggagaggcattgccttctctgcc

SEQ ID NO: 5917414 - DNA, 13 bp, Homo sapiens
ggagaggccatga

SEQ ID NO: 5917415 - DNA, 22 bp, Homo sapiens
ggagaggcctggggtgggacag

SEQ ID NO: 5917416 - DNA, 14 bp, Homo sapiens
ggagaggcggcctc

SEQ ID NO: 5917417 - DNA, 16 bp, Homo sapiens
ggagaggcggcctcgt

SEQ ID NO: 5917418 - DNA, 21 bp, Homo sapiens
ggagaggcggcctcgtgccat

SEQ ID NO: 5917419 - DNA, 15 bp, Homo sapiens
ggagaggctaacctc

SEQ ID NO: 5917420 - DNA, 16 bp, Homo sapiens
ggagaggctgggaggt

SEQ ID NO: 5917421 - DNA, 13 bp, Homo sapiens
ggagaggctgggc

SEQ ID NO: 5917422 - DNA, 13 bp, Homo sapiens
ggagaggctgtct

SEQ ID NO: 5917423 - DNA, 14 bp, Homo sapiens
ggagaggcttccct

SEQ ID NO: 5917424 - DNA, 16 bp, Homo sapiens
ggagaggcttccctac

SEQ ID NO: 5917425 - DNA, 21 bp, Homo sapiens
ggagaggcttccctacacagg

SEQ ID NO: 5917426 - DNA, 22 bp, Homo sapiens
ggagagggacagcccactgaga

SEQ ID NO: 5917427 - DNA, 19 bp, Homo sapiens
ggagagggacgcacagcac

SEQ ID NO: 5917428 - DNA, 17 bp, Homo sapiens
ggagagggagcaagcct

SEQ ID NO: 5917429 - DNA, 13 bp, Homo sapiens
ggagagggaggtc

SEQ ID NO: 5917430 - DNA, 14 bp, Homo sapiens
ggagagggatgagg

SEQ ID NO: 5917431 - DNA, 21 bp, Homo sapiens
ggagagggatgaggtgctggg

SEQ ID NO: 5917432 - DNA, 18 bp, Homo sapiens
ggagagggcccaggtccc

SEQ ID NO: 5917433 - DNA, 21 bp, Homo sapiens
ggagagggctacaaaggagga

SEQ ID NO: 5917434 - DNA, 20 bp, Homo sapiens
ggagagggctagccctgagc

SEQ ID NO: 5917435 - DNA, 22 bp, Homo sapiens
ggagaggggaagggccagtctg

SEQ ID NO: 5917436 - DNA, 14 bp, Homo sapiens
ggagaggggcagaa

SEQ ID NO: 5917437 - DNA, 19 bp, Homo sapiens
ggagaggggcctgggaaag

SEQ ID NO: 5917438 - DNA, 18 bp, Homo sapiens
ggagagggggctggtggg

SEQ ID NO: 5917439 - DNA, 21 bp, Homo sapiens
ggagaggggtcacacccaccc

SEQ ID NO: 5917440 - DNA, 17 bp, Homo sapiens
ggagaggggtggaggct

SEQ ID NO: 5917441 - DNA, 17 bp, Homo sapiens
ggagaggtcagccttga

SEQ ID NO: 5917442 - DNA, 18 bp, Homo sapiens
ggagaggtcttttttaaa

SEQ ID NO: 5917443 - DNA, 13 bp, Homo sapiens
ggagaggtggagc

SEQ ID NO: 5917444 - DNA, 13 bp, Homo sapiens
ggagaggtggccg

SEQ ID NO: 5917445 - DNA, 16 bp, Homo sapiens
ggagaggtggccgcca

SEQ ID NO: 5917446 - DNA, 18 bp, Homo sapiens
ggagaggtggctgcgccc

SEQ ID NO: 5917447 - DNA, 15 bp, Homo sapiens
ggagaggttaaagca

SEQ ID NO: 5917448 - DNA, 21 bp, Homo sapiens
ggagaggttaaagcaaaccag

SEQ ID NO: 5917449 - DNA, 21 bp, Homo sapiens
ggagaggttacccgagaagca

SEQ ID NO: 5917450 - DNA, 20 bp, Homo sapiens
ggagagtacccccctgagag

SEQ ID NO: 5917451 - DNA, 18 bp, Homo sapiens
ggagagtccttagcctgg

SEQ ID NO: 5917452 - DNA, 19 bp, Homo sapiens
ggagagtccttagcctggg

SEQ ID NO: 5917453 - DNA, 22 bp, Homo sapiens
ggagagtccttagcctgggcct

SEQ ID NO: 5917454 - DNA, 19 bp, Homo sapiens
ggagagtcggtctgctttg

SEQ ID NO: 5917455 - DNA, 17 bp, Homo sapiens
ggagagtcttgcagtga

SEQ ID NO: 5917456 - DNA, 18 bp, Homo sapiens
ggagagtcttgggcctgg

SEQ ID NO: 5917457 - DNA, 21 bp, Homo sapiens
ggagagtgaggtcatcccggg

SEQ ID NO: 5917458 - DNA, 21 bp, Homo sapiens
ggagagtgcggcgtgggggca

SEQ ID NO: 5917459 - DNA, 16 bp, Homo sapiens
ggagagtgctcaacct

SEQ ID NO: 5917460 - DNA, 20 bp, Homo sapiens
ggagagtggaaggactgtgg

SEQ ID NO: 5917461 - DNA, 13 bp, Homo sapiens
ggagagtgggggt

SEQ ID NO: 5917462 - DNA, 18 bp, Homo sapiens
ggagagtggttgttgcca

SEQ ID NO: 5917463 - DNA, 22 bp, Homo sapiens
ggagagtgtcaaccagacagag

SEQ ID NO: 5917464 - DNA, 19 bp, Homo sapiens
ggagagttctttgctgccc

SEQ ID NO: 5917465 - DNA, 21 bp, Homo sapiens
ggagagttctttgctgcccct

SEQ ID NO: 5917466 - DNA, 18 bp, Homo sapiens
ggagagtttcctgaaaca

SEQ ID NO: 5917467 - DNA, 16 bp, Homo sapiens
ggagataaggtggctt

SEQ ID NO: 5917468 - DNA, 19 bp, Homo sapiens
ggagataaggtggcttctc

SEQ ID NO: 5917469 - DNA, 22 bp, Homo sapiens
ggagatacttggtcacagccag

SEQ ID NO: 5917470 - DNA, 23 bp, Homo sapiens
ggagatacttggtcacagccagg

SEQ ID NO: 5917471 - DNA, 23 bp, Homo sapiens
ggagatagacgggttgaaagaca

SEQ ID NO: 5917472 - DNA, 19 bp, Homo sapiens
ggagatagatgactttgca

SEQ ID NO: 5917473 - DNA, 22 bp, Homo sapiens
ggagatatctgagggaggaggc

SEQ ID NO: 5917474 - DNA, 21 bp, Homo sapiens
ggagatattataagggagagc

SEQ ID NO: 5917475 - DNA, 22 bp, Homo sapiens
ggagatatttatggggggagaa

SEQ ID NO: 5917476 - DNA, 20 bp, Homo sapiens
ggagatcaaggagaggaggc

SEQ ID NO: 5917477 - DNA, 21 bp, Homo sapiens
ggagatcagaaaaatggagca

SEQ ID NO: 5917478 - DNA, 14 bp, Homo sapiens
ggagatcagcagcg

SEQ ID NO: 5917479 - DNA, 18 bp, Homo sapiens
ggagatcagcatgcctgt

SEQ ID NO: 5917480 - DNA, 15 bp, Homo sapiens
ggagatcccacatat

SEQ ID NO: 5917481 - DNA, 16 bp, Homo sapiens
ggagatccgccctggg

SEQ ID NO: 5917482 - DNA, 15 bp, Homo sapiens
ggagatcctcctgca

SEQ ID NO: 5917483 - DNA, 18 bp, Homo sapiens
ggagatcgcttttctcag

SEQ ID NO: 5917484 - DNA, 19 bp, Homo sapiens
ggagatcgcttttctcaga

SEQ ID NO: 5917485 - DNA, 22 bp, Homo sapiens
ggagatcgcttttctcagactc

SEQ ID NO: 5917486 - DNA, 18 bp, Homo sapiens
ggagatcggggccagagg

SEQ ID NO: 5917487 - DNA, 19 bp, Homo sapiens
ggagatctgaacccagctg

SEQ ID NO: 5917488 - DNA, 23 bp, Homo sapiens
ggagatgaaatcttacagctggg

SEQ ID NO: 5917489 - DNA, 14 bp, Homo sapiens
ggagatgaatagaa

SEQ ID NO: 5917490 - DNA, 19 bp, Homo sapiens
ggagatgacatttgctttg

SEQ ID NO: 5917491 - DNA, 14 bp, Homo sapiens
ggagatgaccaggg

SEQ ID NO: 5917492 - DNA, 18 bp, Homo sapiens
ggagatgaccagggatgc

SEQ ID NO: 5917493 - DNA, 16 bp, Homo sapiens
ggagatgaggccagac

SEQ ID NO: 5917494 - DNA, 18 bp, Homo sapiens
ggagatgaggccagacca

SEQ ID NO: 5917495 - DNA, 17 bp, Homo sapiens
ggagatgagttgcagtt

SEQ ID NO: 5917496 - DNA, 14 bp, Homo sapiens
ggagatgatgatga

SEQ ID NO: 5917497 - DNA, 15 bp, Homo sapiens
ggagatgatgatgat

SEQ ID NO: 5917498 - DNA, 19 bp, Homo sapiens
ggagatgctctctgaggca

SEQ ID NO: 5917499 - DNA, 22 bp, Homo sapiens
ggagatgcttctaaggcatggt

SEQ ID NO: 5917500 - DNA, 19 bp, Homo sapiens
ggagatggacccctccctt

SEQ ID NO: 5917501 - DNA, 15 bp, Homo sapiens
ggagatggactcagg

SEQ ID NO: 5917502 - DNA, 12 bp, Homo sapiens
ggagatggaggg

SEQ ID NO: 5917503 - DNA, 16 bp, Homo sapiens
ggagatggagggcttg

SEQ ID NO: 5917504 - DNA, 18 bp, Homo sapiens
ggagatggcaggagagct

SEQ ID NO: 5917505 - DNA, 13 bp, Homo sapiens
ggagatggcccca

SEQ ID NO: 5917506 - DNA, 13 bp, Homo sapiens
ggagatggctgct

SEQ ID NO: 5917507 - DNA, 16 bp, Homo sapiens
ggagatggctgctgct

SEQ ID NO: 5917508 - DNA, 18 bp, Homo sapiens
ggagatgggccttttgga

SEQ ID NO: 5917509 - DNA, 17 bp, Homo sapiens
ggagatggggagaaacc

SEQ ID NO: 5917510 - DNA, 20 bp, Homo sapiens
ggagatggggagggcgcttt

SEQ ID NO: 5917511 - DNA, 12 bp, Homo sapiens
ggagatgggggc

SEQ ID NO: 5917512 - DNA, 13 bp, Homo sapiens
ggagatgggggct

SEQ ID NO: 5917513 - DNA, 14 bp, Homo sapiens
ggagatgggtggga

SEQ ID NO: 5917514 - DNA, 14 bp, Homo sapiens
ggagatgtaagagc

SEQ ID NO: 5917515 - DNA, 19 bp, Homo sapiens
ggagatgtaatgacagaga

SEQ ID NO: 5917516 - DNA, 16 bp, Homo sapiens
ggagatgtagcaaaac

SEQ ID NO: 5917517 - DNA, 21 bp, Homo sapiens
ggagatgtatttctaaatgtt

SEQ ID NO: 5917518 - DNA, 13 bp, Homo sapiens
ggagatgtctctg

SEQ ID NO: 5917519 - DNA, 13 bp, Homo sapiens
ggagatgtcttcg

SEQ ID NO: 5917520 - DNA, 14 bp, Homo sapiens
ggagatgtcttcgt

SEQ ID NO: 5917521 - DNA, 19 bp, Homo sapiens
ggagatgtgatcaggcccc

SEQ ID NO: 5917522 - DNA, 20 bp, Homo sapiens
ggagatgtgatcaggcccca

SEQ ID NO: 5917523 - DNA, 15 bp, Homo sapiens
ggagattaaaaccag

SEQ ID NO: 5917524 - DNA, 22 bp, Homo sapiens
ggagattatcagtagaaagagt

SEQ ID NO: 5917525 - DNA, 16 bp, Homo sapiens
ggagattcaggcagac

SEQ ID NO: 5917526 - DNA, 16 bp, Homo sapiens
ggagattccacacagg

SEQ ID NO: 5917527 - DNA, 22 bp, Homo sapiens
ggagattctcataacttgagac

SEQ ID NO: 5917528 - DNA, 13 bp, Homo sapiens
ggagattctgcct

SEQ ID NO: 5917529 - DNA, 12 bp, Homo sapiens
ggagattctggg

SEQ ID NO: 5917530 - DNA, 20 bp, Homo sapiens
ggagattctgggtttgccca

SEQ ID NO: 5917531 - DNA, 21 bp, Homo sapiens
ggagattctgtgtattaacat

SEQ ID NO: 5917532 - DNA, 13 bp, Homo sapiens
ggagattgaactt

SEQ ID NO: 5917533 - DNA, 17 bp, Homo sapiens
ggagattgaactttccc

SEQ ID NO: 5917534 - DNA, 17 bp, Homo sapiens
ggagattgagaaggaga

SEQ ID NO: 5917535 - DNA, 14 bp, Homo sapiens
ggagattgctctgg

SEQ ID NO: 5917536 - DNA, 15 bp, Homo sapiens
ggagattgctctggg

SEQ ID NO: 5917537 - DNA, 17 bp, Homo sapiens
ggagattggacggcctg

SEQ ID NO: 5917538 - DNA, 22 bp, Homo sapiens
ggagattgggagacaattagca

SEQ ID NO: 5917539 - DNA, 20 bp, Homo sapiens
ggagatttacaactggggga

SEQ ID NO: 5917540 - DNA, 17 bp, Homo sapiens
ggagattttccttccta

SEQ ID NO: 5917541 - DNA, 10 bp, Homo sapiens
ggagattttt

SEQ ID NO: 5917542 - DNA, 16 bp, Homo sapiens
ggagcaaaaggcagct

SEQ ID NO: 5917543 - DNA, 19 bp, Homo sapiens
ggagcaaactgcatgccca

SEQ ID NO: 5917544 - DNA, 21 bp, Homo sapiens
ggagcaaactgcatgcccaga

SEQ ID NO: 5917545 - DNA, 22 bp, Homo sapiens
ggagcggtggccctgtccctcc

SEQ ID NO: 5917546 - DNA, 16 bp, Homo sapiens
ggagcgtcagggttgg

SEQ ID NO: 5917547 - DNA, 19 bp, Homo sapiens
ggagcgtggactggttggt

SEQ ID NO: 5917548 - DNA, 23 bp, Homo sapiens
ggagctaaattgaatacacaaat

SEQ ID NO: 5917549 - DNA, 17 bp, Homo sapiens
ggagctaacactggccc

SEQ ID NO: 5917550 - DNA, 18 bp, Homo sapiens
ggagctaacactggcccc

SEQ ID NO: 5917551 - DNA, 19 bp, Homo sapiens
ggagctaacactggcccct

SEQ ID NO: 5917552 - DNA, 16 bp, Homo sapiens
ggagctaaggccagct

SEQ ID NO: 5917553 - DNA, 20 bp, Homo sapiens
ggagctaaggctctatgagt

SEQ ID NO: 5917554 - DNA, 15 bp, Homo sapiens
ggagctacagccagc

SEQ ID NO: 5917555 - DNA, 19 bp, Homo sapiens
ggagctacctgtgtggaca

SEQ ID NO: 5917556 - DNA, 18 bp, Homo sapiens
ggagctactgacattcct

SEQ ID NO: 5917557 - DNA, 14 bp, Homo sapiens
ggagctactgatga

SEQ ID NO: 5917558 - DNA, 22 bp, Homo sapiens
ggagctagaaaatgaactgtat

SEQ ID NO: 5917559 - DNA, 23 bp, Homo sapiens
ggagctagagaggggcctctggc

SEQ ID NO: 5917560 - DNA, 13 bp, Homo sapiens
ggagctagaggcc

SEQ ID NO: 5917561 - DNA, 15 bp, Homo sapiens
ggagctagccagagg

SEQ ID NO: 5917562 - DNA, 17 bp, Homo sapiens
ggagctagcccagtccc

SEQ ID NO: 5917563 - DNA, 18 bp, Homo sapiens
ggagctagcctgaaggat

SEQ ID NO: 5917564 - DNA, 20 bp, Homo sapiens
ggagctagcctgaaggattc

SEQ ID NO: 5917565 - DNA, 21 bp, Homo sapiens
ggagctcaacggtctggcagg

SEQ ID NO: 5917566 - DNA, 16 bp, Homo sapiens
ggagctcacaccgcac

SEQ ID NO: 5917567 - DNA, 20 bp, Homo sapiens
ggagctcactgtggtgtctg

SEQ ID NO: 5917568 - DNA, 21 bp, Homo sapiens
ggagctcaggaaccgaggcag

SEQ ID NO: 5917569 - DNA, 22 bp, Homo sapiens
ggagctcaggaagaagagatgc

SEQ ID NO: 5917570 - DNA, 14 bp, Homo sapiens
ggagctcagggctg

SEQ ID NO: 5917571 - DNA, 19 bp, Homo sapiens
ggagctcaggtggggagtc

SEQ ID NO: 5917572 - DNA, 13 bp, Homo sapiens
ggagctcaggttt

SEQ ID NO: 5917573 - DNA, 13 bp, Homo sapiens
ggagctcagttga

SEQ ID NO: 5917574 - DNA, 17 bp, Homo sapiens
ggagctcatgtgtccct

SEQ ID NO: 5917575 - DNA, 19 bp, Homo sapiens
ggagctcattttccacatg

SEQ ID NO: 5917576 - DNA, 18 bp, Homo sapiens
ggagctccagcctgacat

SEQ ID NO: 5917577 - DNA, 15 bp, Homo sapiens
ggagctccaggatgg

SEQ ID NO: 5917578 - DNA, 11 bp, Homo sapiens
ggagctccagt

SEQ ID NO: 5917579 - DNA, 16 bp, Homo sapiens
ggagctcccctgtttg

SEQ ID NO: 5917580 - DNA, 23 bp, Homo sapiens
ggagctccgatttaactgggaac

SEQ ID NO: 5917581 - DNA, 14 bp, Homo sapiens
ggagctcctccctc

SEQ ID NO: 5917582 - DNA, 21 bp, Homo sapiens
ggagctcctccctccagctgc

SEQ ID NO: 5917583 - DNA, 17 bp, Homo sapiens
ggagctcctctcctgga

SEQ ID NO: 5917584 - DNA, 21 bp, Homo sapiens
ggagctcctctcctggaggat

SEQ ID NO: 5917585 - DNA, 15 bp, Homo sapiens
ggagctcgcccctcc

SEQ ID NO: 5917586 - DNA, 18 bp, Homo sapiens
ggagctcgcccctcccct

SEQ ID NO: 5917587 - DNA, 17 bp, Homo sapiens
ggagctctaccctgctc

SEQ ID NO: 5917588 - DNA, 18 bp, Homo sapiens
ggagctctcaattttatg

SEQ ID NO: 5917589 - DNA, 15 bp, Homo sapiens
ggagctctctgctga

SEQ ID NO: 5917590 - DNA, 16 bp, Homo sapiens
ggagctctctgctgag

SEQ ID NO: 5917591 - DNA, 14 bp, Homo sapiens
ggagctctgcgcca

SEQ ID NO: 5917592 - DNA, 15 bp, Homo sapiens
ggagctctgcgccag

SEQ ID NO: 5917593 - DNA, 11 bp, Homo sapiens
ggagctctgct

SEQ ID NO: 5917594 - DNA, 23 bp, Homo sapiens
ggagctctgggaatttggagtga

SEQ ID NO: 5917595 - DNA, 12 bp, Homo sapiens
ggagctcttgga

SEQ ID NO: 5917596 - DNA, 15 bp, Homo sapiens
ggagctcttggaaga

SEQ ID NO: 5917597 - DNA, 15 bp, Homo sapiens
ggagctgaaaaatca

SEQ ID NO: 5917598 - DNA, 17 bp, Homo sapiens
ggagctgacagagccag

SEQ ID NO: 5917599 - DNA, 19 bp, Homo sapiens
ggagctgagaagaggagga

SEQ ID NO: 5917600 - DNA, 11 bp, Homo sapiens
ggagctgagat

SEQ ID NO: 5917601 - DNA, 15 bp, Homo sapiens
ggagctgaggcctcc

SEQ ID NO: 5917602 - DNA, 14 bp, Homo sapiens
ggagctgagggagg

SEQ ID NO: 5917603 - DNA, 21 bp, Homo sapiens
ggagctgagggagggagccat

SEQ ID NO: 5917604 - DNA, 15 bp, Homo sapiens
ggagctgaggggcag

SEQ ID NO: 5917605 - DNA, 18 bp, Homo sapiens
ggagctgaggtttagatg

SEQ ID NO: 5917606 - DNA, 18 bp, Homo sapiens
ggagctgatttccaggcc

SEQ ID NO: 5917607 - DNA, 21 bp, Homo sapiens
ggagctgcacaaagtcagcag

SEQ ID NO: 5917608 - DNA, 22 bp, Homo sapiens
ggagctgcacaaagtcagcagg

SEQ ID NO: 5917609 - DNA, 13 bp, Homo sapiens
ggagctgcacaca

SEQ ID NO: 5917610 - DNA, 21 bp, Homo sapiens
ggagctgcagcgcctcctgga

SEQ ID NO: 5917611 - DNA, 14 bp, Homo sapiens
ggagctgcaggggc

SEQ ID NO: 5917612 - DNA, 23 bp, Homo sapiens
ggagctgcagttcttgtggaaga

SEQ ID NO: 5917613 - DNA, 22 bp, Homo sapiens
ggagctgcatggacgcctggct

SEQ ID NO: 5917614 - DNA, 23 bp, Homo sapiens
ggagctgcatggacgcctggctc

SEQ ID NO: 5917615 - DNA, 15 bp, Homo sapiens
ggagctgcccctctc

SEQ ID NO: 5917616 - DNA, 16 bp, Homo sapiens
ggagctgccgcaaggc

SEQ ID NO: 5917617 - DNA, 19 bp, Homo sapiens
ggagctgccgcaaggccct

SEQ ID NO: 5917618 - DNA, 13 bp, Homo sapiens
ggagctgcctgca

SEQ ID NO: 5917619 - DNA, 14 bp, Homo sapiens
ggagctgcctgcag

SEQ ID NO: 5917620 - DNA, 17 bp, Homo sapiens
ggagctgcctgcagcac

SEQ ID NO: 5917621 - DNA, 21 bp, Homo sapiens
ggagctgcctgcttggcccgg

SEQ ID NO: 5917622 - DNA, 13 bp, Homo sapiens
ggagctgcctgga

SEQ ID NO: 5917623 - DNA, 17 bp, Homo sapiens
ggagctgctggccatgg

SEQ ID NO: 5917624 - DNA, 22 bp, Homo sapiens
ggagctgctggccatggctgct

SEQ ID NO: 5917625 - DNA, 13 bp, Homo sapiens
ggagctgctggct

SEQ ID NO: 5917626 - DNA, 15 bp, Homo sapiens
ggagctgctgggcta

SEQ ID NO: 5917627 - DNA, 14 bp, Homo sapiens
ggagctggaaataa

SEQ ID NO: 5917628 - DNA, 21 bp, Homo sapiens
ggagctggaaataaacctgga

SEQ ID NO: 5917629 - DNA, 22 bp, Homo sapiens
ggagctggaggagcaggcagtg

SEQ ID NO: 5917630 - DNA, 16 bp, Homo sapiens
ggagctggaggggtgg

SEQ ID NO: 5917631 - DNA, 20 bp, Homo sapiens
ggagctggaggggtggggag

SEQ ID NO: 5917632 - DNA, 17 bp, Homo sapiens
ggagctggcaccattca

SEQ ID NO: 5917633 - DNA, 12 bp, Homo sapiens
ggagctggccca

SEQ ID NO: 5917634 - DNA, 20 bp, Homo sapiens
ggagctggccccgccgcctg

SEQ ID NO: 5917635 - DNA, 15 bp, Homo sapiens
ggagctggccccgct

SEQ ID NO: 5917636 - DNA, 18 bp, Homo sapiens
ggagctggctccagcctg

SEQ ID NO: 5917637 - DNA, 13 bp, Homo sapiens
ggagctggctggc

SEQ ID NO: 5917638 - DNA, 15 bp, Homo sapiens
ggagctggctggcag

SEQ ID NO: 5917639 - DNA, 18 bp, Homo sapiens
ggagctggctggcaggtg

SEQ ID NO: 5917640 - DNA, 14 bp, Homo sapiens
ggagctggctgtgc

SEQ ID NO: 5917641 - DNA, 21 bp, Homo sapiens
ggagctggctgtgcctgcttc

SEQ ID NO: 5917642 - DNA, 22 bp, Homo sapiens
ggagctggctgtgcctgcttct

SEQ ID NO: 5917643 - DNA, 18 bp, Homo sapiens
ggagctgggaaggtcccg

SEQ ID NO: 5917644 - DNA, 21 bp, Homo sapiens
ggagctgggacacttaacaga

SEQ ID NO: 5917645 - DNA, 12 bp, Homo sapiens
ggagctgggaga

SEQ ID NO: 5917646 - DNA, 21 bp, Homo sapiens
ggagctgggagaccctcccca

SEQ ID NO: 5917647 - DNA, 17 bp, Homo sapiens
ggagctgggagccaggc

SEQ ID NO: 5917648 - DNA, 16 bp, Homo sapiens
ggagctgggaggtctc

SEQ ID NO: 5917649 - DNA, 18 bp, Homo sapiens
ggagctgggcagaaggcc

SEQ ID NO: 5917650 - DNA, 19 bp, Homo sapiens
ggagctgggcagaaggcca

SEQ ID NO: 5917651 - DNA, 11 bp, Homo sapiens
ggagctgggcc

SEQ ID NO: 5917652 - DNA, 14 bp, Homo sapiens
ggagctgggccctg

SEQ ID NO: 5917653 - DNA, 15 bp, Homo sapiens
ggagctgggccctgc

SEQ ID NO: 5917654 - DNA, 17 bp, Homo sapiens
ggagctgggccctgcct

SEQ ID NO: 5917655 - DNA, 19 bp, Homo sapiens
ggagctgggccctgcctgc

SEQ ID NO: 5917656 - DNA, 14 bp, Homo sapiens
ggagctgggcctgg

SEQ ID NO: 5917657 - DNA, 17 bp, Homo sapiens
ggagctggggatccctc

SEQ ID NO: 5917658 - DNA, 23 bp, Homo sapiens
ggagctgggggaaggcaggagcc

SEQ ID NO: 5917659 - DNA, 18 bp, Homo sapiens
ggagctggtgacagcctt

SEQ ID NO: 5917660 - DNA, 18 bp, Homo sapiens
ggagctgtaaaccagaga

SEQ ID NO: 5917661 - DNA, 22 bp, Homo sapiens
ggagctgtcacctctcagctgc

SEQ ID NO: 5917662 - DNA, 14 bp, Homo sapiens
ggagctgtcaggca

SEQ ID NO: 5917663 - DNA, 22 bp, Homo sapiens
ggagctgttactgaatattaaa

SEQ ID NO: 5917664 - DNA, 16 bp, Homo sapiens
ggagcttaagaaagaa

SEQ ID NO: 5917665 - DNA, 17 bp, Homo sapiens
ggagcttaagccactgc

SEQ ID NO: 5917666 - DNA, 14 bp, Homo sapiens
ggagcttacccaag

SEQ ID NO: 5917667 - DNA, 13 bp, Homo sapiens
ggagcttccagtg

SEQ ID NO: 5917668 - DNA, 18 bp, Homo sapiens
ggagcttccagtgcatgt

SEQ ID NO: 5917669 - DNA, 18 bp, Homo sapiens
ggagcttcccacacctgc

SEQ ID NO: 5917670 - DNA, 21 bp, Homo sapiens
ggagcttcccacacctgcctg

SEQ ID NO: 5917671 - DNA, 16 bp, Homo sapiens
ggagcttcctggctct

SEQ ID NO: 5917672 - DNA, 19 bp, Homo sapiens
ggagcttcctggctctggg

SEQ ID NO: 5917673 - DNA, 19 bp, Homo sapiens
ggagcttcctgtcctccca

SEQ ID NO: 5917674 - DNA, 17 bp, Homo sapiens
ggagcttcggggcctcc

SEQ ID NO: 5917675 - DNA, 16 bp, Homo sapiens
ggagcttgagggacaa

SEQ ID NO: 5917676 - DNA, 16 bp, Homo sapiens
ggagcttgcctgcctg

SEQ ID NO: 5917677 - DNA, 15 bp, Homo sapiens
ggagcttggccctgc

SEQ ID NO: 5917678 - DNA, 17 bp, Homo sapiens
ggagcttgggactcagg

SEQ ID NO: 5917679 - DNA, 17 bp, Homo sapiens
ggagcttgggcagtgcc

SEQ ID NO: 5917680 - DNA, 21 bp, Homo sapiens
ggagcttgggcagtgccccag

SEQ ID NO: 5917681 - DNA, 22 bp, Homo sapiens
ggagcttgggcagtgccccagg

SEQ ID NO: 5917682 - DNA, 24 bp, Homo sapiens
ggagcttgggtctctctcggcccc

SEQ ID NO: 5917683 - DNA, 17 bp, Homo sapiens
ggagctttaaagagcag

SEQ ID NO: 5917684 - DNA, 20 bp, Homo sapiens
ggagctttcaaagaaggaat

SEQ ID NO: 5917685 - DNA, 14 bp, Homo sapiens
ggagctttcccaga

SEQ ID NO: 5917686 - DNA, 14 bp, Homo sapiens
ggagctttctgtat

SEQ ID NO: 5917687 - DNA, 17 bp, Homo sapiens
ggagctttcttgtttct

SEQ ID NO: 5917688 - DNA, 18 bp, Homo sapiens
ggagctttcttgtttctt

SEQ ID NO: 5917689 - DNA, 19 bp, Homo sapiens
ggagctttgactcaggagc

SEQ ID NO: 5917690 - DNA, 14 bp, Homo sapiens
ggagctttgtaatg

SEQ ID NO: 5917691 - DNA, 18 bp, Homo sapiens
ggaggaaaaaggctggtg

SEQ ID NO: 5917692 - DNA, 21 bp, Homo sapiens
ggaggaaaacacagcctccct

SEQ ID NO: 5917693 - DNA, 22 bp, Homo sapiens
ggaggaaacctgagatctgtgt

SEQ ID NO: 5917694 - DNA, 12 bp, Homo sapiens
ggaggaaagcaa

SEQ ID NO: 5917695 - DNA, 23 bp, Homo sapiens
ggaggaaatttgaatgggtccat

SEQ ID NO: 5917696 - DNA, 13 bp, Homo sapiens
ggaggaacacctg

SEQ ID NO: 5917697 - DNA, 21 bp, Homo sapiens
ggaggaaccacaatgtttctt

SEQ ID NO: 5917698 - DNA, 20 bp, Homo sapiens
ggaggaaccgagggggctgc

SEQ ID NO: 5917699 - DNA, 16 bp, Homo sapiens
ggaggaacgggcagcc

SEQ ID NO: 5917700 - DNA, 17 bp, Homo sapiens
ggaggaacgggcagcca

SEQ ID NO: 5917701 - DNA, 20 bp, Homo sapiens
ggaggaacgggcagccacag

SEQ ID NO: 5917702 - DNA, 18 bp, Homo sapiens
ggaggaacgtggttcaga

SEQ ID NO: 5917703 - DNA, 21 bp, Homo sapiens
ggaggaactggtccaggccag

SEQ ID NO: 5917704 - DNA, 23 bp, Homo sapiens
ggaggaactggtccaggccaggc

SEQ ID NO: 5917705 - DNA, 21 bp, Homo sapiens
ggaggaagaactgaaaggctt

SEQ ID NO: 5917706 - DNA, 19 bp, Homo sapiens
ggaggaagactctggagcc

SEQ ID NO: 5917707 - DNA, 18 bp, Homo sapiens
ggaggaagagagagactg

SEQ ID NO: 5917708 - DNA, 14 bp, Homo sapiens
ggaggaagagccac

SEQ ID NO: 5917709 - DNA, 15 bp, Homo sapiens
ggaggaagagccacc

SEQ ID NO: 5917710 - DNA, 16 bp, Homo sapiens
ggaggaagagccacct

SEQ ID NO: 5917711 - DNA, 18 bp, Homo sapiens
ggaggaagagccacctgc

SEQ ID NO: 5917712 - DNA, 19 bp, Homo sapiens
ggaggaagaggctgcactg

SEQ ID NO: 5917713 - DNA, 17 bp, Homo sapiens
ggaggaagatggctccc

SEQ ID NO: 5917714 - DNA, 11 bp, Homo sapiens
ggaggaagcag

SEQ ID NO: 5917715 - DNA, 14 bp, Homo sapiens
ggaggaagcagaat

SEQ ID NO: 5917716 - DNA, 20 bp, Homo sapiens
ggaggaagcagaataaagca

SEQ ID NO: 5917717 - DNA, 22 bp, Homo sapiens
ggaggaagcagaataaagcaat

SEQ ID NO: 5917718 - DNA, 23 bp, Homo sapiens
ggaggaaggaaacccagctctgg

SEQ ID NO: 5917719 - DNA, 13 bp, Homo sapiens
ggaggaaggattg

SEQ ID NO: 5917720 - DNA, 14 bp, Homo sapiens
ggaggaaggcaaag

SEQ ID NO: 5917721 - DNA, 21 bp, Homo sapiens
ggaggaaggcaaagcccctgg

SEQ ID NO: 5917722 - DNA, 17 bp, Homo sapiens
ggaggccagtgggcggg

SEQ ID NO: 5917723 - DNA, 13 bp, Homo sapiens
ggaggccatctgg

SEQ ID NO: 5917724 - DNA, 12 bp, Homo sapiens
ggaggccatgcc

SEQ ID NO: 5917725 - DNA, 17 bp, Homo sapiens
ggaggccatttgctgcc

SEQ ID NO: 5917726 - DNA, 19 bp, Homo sapiens
ggaggccatttgctgccct

SEQ ID NO: 5917727 - DNA, 20 bp, Homo sapiens
ggaggccatttgctgccctg

SEQ ID NO: 5917728 - DNA, 23 bp, Homo sapiens
ggaggccatttgctgccctgggg

SEQ ID NO: 5917729 - DNA, 14 bp, Homo sapiens
ggaggcccaaatga

SEQ ID NO: 5917730 - DNA, 14 bp, Homo sapiens
ggaggcccaacctc

SEQ ID NO: 5917731 - DNA, 21 bp, Homo sapiens
ggaggcccagcgcggacatcc

SEQ ID NO: 5917732 - DNA, 16 bp, Homo sapiens
ggaggcccaggctggg

SEQ ID NO: 5917733 - DNA, 17 bp, Homo sapiens
ggaggcccatgccctcc

SEQ ID NO: 5917734 - DNA, 14 bp, Homo sapiens
ggaggccccactga

SEQ ID NO: 5917735 - DNA, 17 bp, Homo sapiens
ggaggccccactgggga

SEQ ID NO: 5917736 - DNA, 22 bp, Homo sapiens
ggaggccccagctctgagggga

SEQ ID NO: 5917737 - DNA, 19 bp, Homo sapiens
ggaggccccggcgcccgca

SEQ ID NO: 5917738 - DNA, 15 bp, Homo sapiens
ggaggcccctggagc

SEQ ID NO: 5917739 - DNA, 18 bp, Homo sapiens
ggaggcccctggcccagc

SEQ ID NO: 5917740 - DNA, 19 bp, Homo sapiens
ggaggcccctggcccagcg

SEQ ID NO: 5917741 - DNA, 22 bp, Homo sapiens
ggaggcccctggcccagcggcc

SEQ ID NO: 5917742 - DNA, 23 bp, Homo sapiens
ggaggcccctggcccagcggccc

SEQ ID NO: 5917743 - DNA, 14 bp, Homo sapiens
ggaggcccctgggc

SEQ ID NO: 5917744 - DNA, 17 bp, Homo sapiens
ggaggcccctgggctct

SEQ ID NO: 5917745 - DNA, 13 bp, Homo sapiens
ggaggcccctggt

SEQ ID NO: 5917746 - DNA, 14 bp, Homo sapiens
ggaggccctgcctg

SEQ ID NO: 5917747 - DNA, 16 bp, Homo sapiens
ggaggccctggccctt

SEQ ID NO: 5917748 - DNA, 17 bp, Homo sapiens
ggaggccctggcccttt

SEQ ID NO: 5917749 - DNA, 16 bp, Homo sapiens
ggaggcccttgtcgtg

SEQ ID NO: 5917750 - DNA, 12 bp, Homo sapiens
ggaggccgaagc

SEQ ID NO: 5917751 - DNA, 21 bp, Homo sapiens
ggaggccgactgggctgctgg

SEQ ID NO: 5917752 - DNA, 17 bp, Homo sapiens
ggaggccgaggcacgag

SEQ ID NO: 5917753 - DNA, 15 bp, Homo sapiens
ggaggccgaggcagg

SEQ ID NO: 5917754 - DNA, 23 bp, Homo sapiens
ggaggccgaggcaggggctgggc

SEQ ID NO: 5917755 - DNA, 16 bp, Homo sapiens
ggaggccgaggcaggt

SEQ ID NO: 5917756 - DNA, 22 bp, Homo sapiens
ggaggccgcttagtgctgcttt

SEQ ID NO: 5917757 - DNA, 22 bp, Homo sapiens
ggaggcctcaaagcaacccgct

SEQ ID NO: 5917758 - DNA, 16 bp, Homo sapiens
ggaggcctcaggtgct

SEQ ID NO: 5917759 - DNA, 17 bp, Homo sapiens
ggaggcctcaggtgctg

SEQ ID NO: 5917760 - DNA, 18 bp, Homo sapiens
ggaggcctccactccttc

SEQ ID NO: 5917761 - DNA, 20 bp, Homo sapiens
ggaggcctcgtaccagccag

SEQ ID NO: 5917762 - DNA, 22 bp, Homo sapiens
ggaggcctcgtaccagccagga

SEQ ID NO: 5917763 - DNA, 14 bp, Homo sapiens
ggaggcctctggcc

SEQ ID NO: 5917764 - DNA, 16 bp, Homo sapiens
ggaggcctctggccct

SEQ ID NO: 5917765 - DNA, 13 bp, Homo sapiens
ggaggcctctggg

SEQ ID NO: 5917766 - DNA, 19 bp, Homo sapiens
ggaggcctgatgctgcccc

SEQ ID NO: 5917767 - DNA, 21 bp, Homo sapiens
ggaggcctgcgaccctggggg

SEQ ID NO: 5917768 - DNA, 11 bp, Homo sapiens
ggaggcctgga

SEQ ID NO: 5917769 - DNA, 13 bp, Homo sapiens
ggaggcctgggag

SEQ ID NO: 5917770 - DNA, 15 bp, Homo sapiens
ggaggcctgggaggg

SEQ ID NO: 5917771 - DNA, 14 bp, Homo sapiens
ggaggcctgggggc

SEQ ID NO: 5917772 - DNA, 18 bp, Homo sapiens
ggaggcctgggggcaggg

SEQ ID NO: 5917773 - DNA, 14 bp, Homo sapiens
ggaggcctggtctg

SEQ ID NO: 5917774 - DNA, 15 bp, Homo sapiens
ggaggcctggtctgg

SEQ ID NO: 5917775 - DNA, 20 bp, Homo sapiens
ggaggcctggtctggagccc

SEQ ID NO: 5917776 - DNA, 18 bp, Homo sapiens
ggaggccttccagctgct

SEQ ID NO: 5917777 - DNA, 18 bp, Homo sapiens
ggaggccttggggtgggg

SEQ ID NO: 5917778 - DNA, 20 bp, Homo sapiens
ggaggccttggggtgggggc

SEQ ID NO: 5917779 - DNA, 21 bp, Homo sapiens
ggaggccttggggtgggggcc

SEQ ID NO: 5917780 - DNA, 23 bp, Homo sapiens
ggaggcctttccctaagccagct

SEQ ID NO: 5917781 - DNA, 18 bp, Homo sapiens
ggaggcgatgccagcctt

SEQ ID NO: 5917782 - DNA, 13 bp, Homo sapiens
ggaggcgcagccc

SEQ ID NO: 5917783 - DNA, 20 bp, Homo sapiens
ggaggcgcagcccgaagccc

SEQ ID NO: 5917784 - DNA, 19 bp, Homo sapiens
ggaggcgcccacctgccca

SEQ ID NO: 5917785 - DNA, 23 bp, Homo sapiens
ggaggcgcccacctgcccagtta

SEQ ID NO: 5917786 - DNA, 17 bp, Homo sapiens
ggaggcgccttcctggg

SEQ ID NO: 5917787 - DNA, 19 bp, Homo sapiens
ggaggcgccttcctgggtt

SEQ ID NO: 5917788 - DNA, 12 bp, Homo sapiens
ggaggcggagag

SEQ ID NO: 5917789 - DNA, 20 bp, Homo sapiens
ggaggcggagagtacagtga

SEQ ID NO: 5917790 - DNA, 20 bp, Homo sapiens
ggaggcggatgttgaagtga

SEQ ID NO: 5917791 - DNA, 21 bp, Homo sapiens
ggaggcggcacattggcagtg

SEQ ID NO: 5917792 - DNA, 20 bp, Homo sapiens
ggaggcggcactccaaccta

SEQ ID NO: 5917793 - DNA, 23 bp, Homo sapiens
ggaggcggcagctcttctgggca

SEQ ID NO: 5917794 - DNA, 17 bp, Homo sapiens
ggaggcggcccggccag

SEQ ID NO: 5917795 - DNA, 14 bp, Homo sapiens
ggaggcggcctcca

SEQ ID NO: 5917796 - DNA, 15 bp, Homo sapiens
ggaggcggctccagg

SEQ ID NO: 5917797 - DNA, 16 bp, Homo sapiens
ggaggcggctccaggt

SEQ ID NO: 5917798 - DNA, 17 bp, Homo sapiens
ggaggcggctccaggtc

SEQ ID NO: 5917799 - DNA, 22 bp, Homo sapiens
ggaggcggctccaggtccggag

SEQ ID NO: 5917800 - DNA, 13 bp, Homo sapiens
ggaggcggggagg

SEQ ID NO: 5917801 - DNA, 16 bp, Homo sapiens
ggaggcggggaggagg

SEQ ID NO: 5917802 - DNA, 15 bp, Homo sapiens
ggaggcggggctcta

SEQ ID NO: 5917803 - DNA, 18 bp, Homo sapiens
ggaggcgtgcccccctcc

SEQ ID NO: 5917804 - DNA, 15 bp, Homo sapiens
ggaggctaagcctgg

SEQ ID NO: 5917805 - DNA, 20 bp, Homo sapiens
ggaggctaagcctggacaca

SEQ ID NO: 5917806 - DNA, 18 bp, Homo sapiens
ggaggctacccgctgtgg

SEQ ID NO: 5917807 - DNA, 20 bp, Homo sapiens
ggaggctacccgctgtggcc

SEQ ID NO: 5917808 - DNA, 19 bp, Homo sapiens
ggaggctacctcacctggg

SEQ ID NO: 5917809 - DNA, 20 bp, Homo sapiens
ggaggctacctcacctgggc

SEQ ID NO: 5917810 - DNA, 21 bp, Homo sapiens
ggaggctcacccccttctcca

SEQ ID NO: 5917811 - DNA, 15 bp, Homo sapiens
ggaggctccagaggg

SEQ ID NO: 5917812 - DNA, 16 bp, Homo sapiens
ggaggctccagagggc

SEQ ID NO: 5917813 - DNA, 18 bp, Homo sapiens
ggaggctccagagggcac

SEQ ID NO: 5917814 - DNA, 15 bp, Homo sapiens
ggaggctccaggcag

SEQ ID NO: 5917815 - DNA, 16 bp, Homo sapiens
ggaggctcccagaccc

SEQ ID NO: 5917816 - DNA, 19 bp, Homo sapiens
ggaggctcccatgggctag

SEQ ID NO: 5917817 - DNA, 19 bp, Homo sapiens
ggaggctcccggggcctgg

SEQ ID NO: 5917818 - DNA, 15 bp, Homo sapiens
ggaggctccgtgagc

SEQ ID NO: 5917819 - DNA, 22 bp, Homo sapiens
ggaggctcctccctctgcctca

SEQ ID NO: 5917820 - DNA, 22 bp, Homo sapiens
ggaggctcctgcctgagcttcc

SEQ ID NO: 5917821 - DNA, 15 bp, Homo sapiens
ggaggctcggggctc

SEQ ID NO: 5917822 - DNA, 17 bp, Homo sapiens
ggaggctcggggctccc

SEQ ID NO: 5917823 - DNA, 11 bp, Homo sapiens
ggaggctctct

SEQ ID NO: 5917824 - DNA, 14 bp, Homo sapiens
ggaggctctctgta

SEQ ID NO: 5917825 - DNA, 20 bp, Homo sapiens
ggaggctctggagcccactg

SEQ ID NO: 5917826 - DNA, 21 bp, Homo sapiens
ggaggctgagacgcaaggatc

SEQ ID NO: 5917827 - DNA, 20 bp, Homo sapiens
ggaggctgagactgcagagg

SEQ ID NO: 5917828 - DNA, 19 bp, Homo sapiens
ggaggctgagatgggagaa

SEQ ID NO: 5917829 - DNA, 13 bp, Homo sapiens
ggaggctgaggca

SEQ ID NO: 5917830 - DNA, 14 bp, Homo sapiens
ggaggctgaggcag

SEQ ID NO: 5917831 - DNA, 15 bp, Homo sapiens
ggaggctgaggcaga

SEQ ID NO: 5917832 - DNA, 16 bp, Homo sapiens
ggaggctgaggcagga

SEQ ID NO: 5917833 - DNA, 19 bp, Homo sapiens
ggaggctgaggcaggagga

SEQ ID NO: 5917834 - DNA, 19 bp, Homo sapiens
ggaggctgaggtgggcaga

SEQ ID NO: 5917835 - DNA, 14 bp, Homo sapiens
ggaggctgcagcca

SEQ ID NO: 5917836 - DNA, 16 bp, Homo sapiens
ggaggctgcagccagg

SEQ ID NO: 5917837 - DNA, 20 bp, Homo sapiens
ggaggctgcagccaggcctc

SEQ ID NO: 5917838 - DNA, 22 bp, Homo sapiens
ggaggctgcatgctctggaagc

SEQ ID NO: 5917839 - DNA, 10 bp, Homo sapiens
ggaggctgcc

SEQ ID NO: 5917840 - DNA, 12 bp, Homo sapiens
ggaggctgcccc

SEQ ID NO: 5917841 - DNA, 22 bp, Homo sapiens
ggaggctgcccccggccccctg

SEQ ID NO: 5917842 - DNA, 22 bp, Homo sapiens
ggaggctgcctatgttgggggg

SEQ ID NO: 5917843 - DNA, 16 bp, Homo sapiens
ggaggctgcctcccaa

SEQ ID NO: 5917844 - DNA, 15 bp, Homo sapiens
ggaggctgctgcccc

SEQ ID NO: 5917845 - DNA, 21 bp, Homo sapiens
ggaggctgctgccccctggct

SEQ ID NO: 5917846 - DNA, 18 bp, Homo sapiens
ggaggctgctgctgctct

SEQ ID NO: 5917847 - DNA, 13 bp, Homo sapiens
ggaggctgctgtg

SEQ ID NO: 5917848 - DNA, 14 bp, Homo sapiens
ggaggctgctgtga

SEQ ID NO: 5917849 - DNA, 23 bp, Homo sapiens
ggaggctgctgtgaaaactctgg

SEQ ID NO: 5917850 - DNA, 18 bp, Homo sapiens
ggaggctggcagggtccc

SEQ ID NO: 5917851 - DNA, 12 bp, Homo sapiens
ggaggctggcca

SEQ ID NO: 5917852 - DNA, 13 bp, Homo sapiens
ggaggctgggcac

SEQ ID NO: 5917853 - DNA, 15 bp, Homo sapiens
ggaggctgggcacag

SEQ ID NO: 5917854 - DNA, 13 bp, Homo sapiens
ggaggctgggccc

SEQ ID NO: 5917855 - DNA, 19 bp, Homo sapiens
ggaggctgggcccctggga

SEQ ID NO: 5917856 - DNA, 14 bp, Homo sapiens
ggaggctggggccc

SEQ ID NO: 5917857 - DNA, 13 bp, Homo sapiens
ggaggcttccagc

SEQ ID NO: 5917858 - DNA, 17 bp, Homo sapiens
ggaggcttccagctcag

SEQ ID NO: 5917859 - DNA, 21 bp, Homo sapiens
ggaggcttcctgactgacaca

SEQ ID NO: 5917860 - DNA, 18 bp, Homo sapiens
ggaggcttgtcagagctg

SEQ ID NO: 5917861 - DNA, 19 bp, Homo sapiens
ggaggcttgtcagagctgg

SEQ ID NO: 5917862 - DNA, 17 bp, Homo sapiens
ggaggctttctgggctc

SEQ ID NO: 5917863 - DNA, 19 bp, Homo sapiens
ggaggctttctgggctctg

SEQ ID NO: 5917864 - DNA, 19 bp, Homo sapiens
ggagggaagagtggaggtg

SEQ ID NO: 5917865 - DNA, 16 bp, Homo sapiens
ggagggaagctcttgg

SEQ ID NO: 5917866 - DNA, 14 bp, Homo sapiens
ggagggaaggacag

SEQ ID NO: 5917867 - DNA, 16 bp, Homo sapiens
ggagggaaggacagac

SEQ ID NO: 5917868 - DNA, 15 bp, Homo sapiens
ggagggaagggagcc

SEQ ID NO: 5917869 - DNA, 16 bp, Homo sapiens
ggagggaagggagcca

SEQ ID NO: 5917870 - DNA, 21 bp, Homo sapiens
ggagggaagggagccaaggga

SEQ ID NO: 5917871 - DNA, 22 bp, Homo sapiens
ggagggaaggggatggaggcca

SEQ ID NO: 5917872 - DNA, 21 bp, Homo sapiens
ggagggaatgaacctggaggg

SEQ ID NO: 5917873 - DNA, 15 bp, Homo sapiens
ggagggaattgaggt

SEQ ID NO: 5917874 - DNA, 15 bp, Homo sapiens
ggagggacagggcag

SEQ ID NO: 5917875 - DNA, 14 bp, Homo sapiens
ggagggacagggct

SEQ ID NO: 5917876 - DNA, 19 bp, Homo sapiens
ggagggacagtctggaggt

SEQ ID NO: 5917877 - DNA, 12 bp, Homo sapiens
ggagggaccagg

SEQ ID NO: 5917878 - DNA, 17 bp, Homo sapiens
ggagggaccgcgcaggc

SEQ ID NO: 5917879 - DNA, 16 bp, Homo sapiens
ggagggactctgtctg

SEQ ID NO: 5917880 - DNA, 22 bp, Homo sapiens
ggagggactctgtctggccagg

SEQ ID NO: 5917881 - DNA, 17 bp, Homo sapiens
ggagggactgctgaccc

SEQ ID NO: 5917882 - DNA, 20 bp, Homo sapiens
ggagggactgctgacccacc

SEQ ID NO: 5917883 - DNA, 12 bp, Homo sapiens
ggagggacttgg

SEQ ID NO: 5917884 - DNA, 14 bp, Homo sapiens
ggagggagaaagga

SEQ ID NO: 5917885 - DNA, 12 bp, Homo sapiens
ggagggagaaga

SEQ ID NO: 5917886 - DNA, 13 bp, Homo sapiens
ggagggagaagag

SEQ ID NO: 5917887 - DNA, 15 bp, Homo sapiens
ggagggagagccctg

SEQ ID NO: 5917888 - DNA, 12 bp, Homo sapiens
ggagggagctga

SEQ ID NO: 5917889 - DNA, 21 bp, Homo sapiens
ggagggagctgaggagccctt

SEQ ID NO: 5917890 - DNA, 14 bp, Homo sapiens
ggagggaggagggc

SEQ ID NO: 5917891 - DNA, 13 bp, Homo sapiens
ggagggaggcacc

SEQ ID NO: 5917892 - DNA, 11 bp, Homo sapiens
ggagggaggcc

SEQ ID NO: 5917893 - DNA, 21 bp, Homo sapiens
ggagggaggcggggaggagga

SEQ ID NO: 5917894 - DNA, 13 bp, Homo sapiens
ggagggagggctc

SEQ ID NO: 5917895 - DNA, 16 bp, Homo sapiens
ggagggagggctccag

SEQ ID NO: 5917896 - DNA, 20 bp, Homo sapiens
ggagggagtcccagagccct

SEQ ID NO: 5917897 - DNA, 21 bp, Homo sapiens
ggagggagttttgtctgtctc

SEQ ID NO: 5917898 - DNA, 18 bp, Homo sapiens
ggagggatagagacgcag

SEQ ID NO: 5917899 - DNA, 22 bp, Homo sapiens
ggagggatcagccccgcctgtc

SEQ ID NO: 5917900 - DNA, 18 bp, Homo sapiens
ggagggatgaccttccca

SEQ ID NO: 5917901 - DNA, 14 bp, Homo sapiens
ggagtgagaggccc

SEQ ID NO: 5917902 - DNA, 15 bp, Homo sapiens
ggagtgagaggcccc

SEQ ID NO: 5917903 - DNA, 18 bp, Homo sapiens
ggagtgagcagctactgt

SEQ ID NO: 5917904 - DNA, 12 bp, Homo sapiens
ggagtgagctgg

SEQ ID NO: 5917905 - DNA, 18 bp, Homo sapiens
ggagtgagctggggagct

SEQ ID NO: 5917906 - DNA, 14 bp, Homo sapiens
ggagtgagcttggt

SEQ ID NO: 5917907 - DNA, 18 bp, Homo sapiens
ggagtgaggcttccaggc

SEQ ID NO: 5917908 - DNA, 20 bp, Homo sapiens
ggagtgaggcttccaggctc

SEQ ID NO: 5917909 - DNA, 22 bp, Homo sapiens
ggagtgaggcttccaggctctt

SEQ ID NO: 5917910 - DNA, 22 bp, Homo sapiens
ggagtgagggcctcagagcctg

SEQ ID NO: 5917911 - DNA, 23 bp, Homo sapiens
ggagtgagttgatagcacagacc

SEQ ID NO: 5917912 - DNA, 21 bp, Homo sapiens
ggagtgataatattgtttccc

SEQ ID NO: 5917913 - DNA, 17 bp, Homo sapiens
ggagtgatgggcaaggg

SEQ ID NO: 5917914 - DNA, 16 bp, Homo sapiens
ggagtgatggtgtcct

SEQ ID NO: 5917915 - DNA, 21 bp, Homo sapiens
ggagtgatggtgtccttccct

SEQ ID NO: 5917916 - DNA, 19 bp, Homo sapiens
ggagtgcagaacacctggc

SEQ ID NO: 5917917 - DNA, 18 bp, Homo sapiens
ggagtgcagccttctcca

SEQ ID NO: 5917918 - DNA, 15 bp, Homo sapiens
ggagtgcagtgagcc

SEQ ID NO: 5917919 - DNA, 21 bp, Homo sapiens
ggagtgcagtgatgcaatctt

SEQ ID NO: 5917920 - DNA, 12 bp, Homo sapiens
ggagtgcagtgg

SEQ ID NO: 5917921 - DNA, 17 bp, Homo sapiens
ggagtgcagtggcatga

SEQ ID NO: 5917922 - DNA, 22 bp, Homo sapiens
ggagtgcatggccacagccacc

SEQ ID NO: 5917923 - DNA, 20 bp, Homo sapiens
ggagtgccacgtggccgctg

SEQ ID NO: 5917924 - DNA, 13 bp, Homo sapiens
ggagtgccaggac

SEQ ID NO: 5917925 - DNA, 17 bp, Homo sapiens
ggagtgccaggaccagc

SEQ ID NO: 5917926 - DNA, 19 bp, Homo sapiens
ggagtgcccaccctgggag

SEQ ID NO: 5917927 - DNA, 13 bp, Homo sapiens
ggagtgccccaag

SEQ ID NO: 5917928 - DNA, 16 bp, Homo sapiens
ggagtgccctgcaggc

SEQ ID NO: 5917929 - DNA, 14 bp, Homo sapiens
ggagtgctcttccc

SEQ ID NO: 5917930 - DNA, 15 bp, Homo sapiens
ggagtgctggcatta

SEQ ID NO: 5917931 - DNA, 23 bp, Homo sapiens
ggagtgctggctccacgccctgg

SEQ ID NO: 5917932 - DNA, 21 bp, Homo sapiens
ggagtgctgttttgttatata

SEQ ID NO: 5917933 - DNA, 22 bp, Homo sapiens
ggagtggacaccgctcagtatt

SEQ ID NO: 5917934 - DNA, 17 bp, Homo sapiens
ggagtggaggggtcagc

SEQ ID NO: 5917935 - DNA, 18 bp, Homo sapiens
ggagtggattcctcccca

SEQ ID NO: 5917936 - DNA, 16 bp, Homo sapiens
ggagtggcagcccagc

SEQ ID NO: 5917937 - DNA, 19 bp, Homo sapiens
ggagtggcagcccagccag

SEQ ID NO: 5917938 - DNA, 18 bp, Homo sapiens
ggagtggcaggaaagagg

SEQ ID NO: 5917939 - DNA, 17 bp, Homo sapiens
ggagtggcatggtcctg

SEQ ID NO: 5917940 - DNA, 11 bp, Homo sapiens
ggagtggccaa

SEQ ID NO: 5917941 - DNA, 18 bp, Homo sapiens
ggagtggctcgccaggcc

SEQ ID NO: 5917942 - DNA, 22 bp, Homo sapiens
ggagtgggacagacagcagctg

SEQ ID NO: 5917943 - DNA, 17 bp, Homo sapiens
ggagtgggacagagtct

SEQ ID NO: 5917944 - DNA, 24 bp, Homo sapiens
ggagtgggagaggaagccacgtgc

SEQ ID NO: 5917945 - DNA, 14 bp, Homo sapiens
ggagtgggatagga

SEQ ID NO: 5917946 - DNA, 23 bp, Homo sapiens
ggagtgggctctctggacctgac

SEQ ID NO: 5917947 - DNA, 22 bp, Homo sapiens
ggagtggggaagtgatcttttg

SEQ ID NO: 5917948 - DNA, 12 bp, Homo sapiens
ggagtggggagc

SEQ ID NO: 5917949 - DNA, 18 bp, Homo sapiens
ggagtggggaggagagag

SEQ ID NO: 5917950 - DNA, 15 bp, Homo sapiens
ggagtggggcagtag

SEQ ID NO: 5917951 - DNA, 13 bp, Homo sapiens
ggagtgggggctg

SEQ ID NO: 5917952 - DNA, 16 bp, Homo sapiens
ggagtggggtagagga

SEQ ID NO: 5917953 - DNA, 23 bp, Homo sapiens
ggagtgggtagatttcagggaga

SEQ ID NO: 5917954 - DNA, 23 bp, Homo sapiens
ggagtgggtcgcccacgggtgtg

SEQ ID NO: 5917955 - DNA, 18 bp, Homo sapiens
ggagtgggtttccctgcg

SEQ ID NO: 5917956 - DNA, 20 bp, Homo sapiens
ggagtggttaggcagcaagc

SEQ ID NO: 5917957 - DNA, 20 bp, Homo sapiens
ggagtggtttaggctatttg

SEQ ID NO: 5917958 - DNA, 15 bp, Homo sapiens
ggagtgtactcccag

SEQ ID NO: 5917959 - DNA, 19 bp, Homo sapiens
ggagtgtactcccagggct

SEQ ID NO: 5917960 - DNA, 13 bp, Homo sapiens
ggagtgtcctctt

SEQ ID NO: 5917961 - DNA, 15 bp, Homo sapiens
ggagtgtcctgccca

SEQ ID NO: 5917962 - DNA, 19 bp, Homo sapiens
ggagtgtcctgtctgctgg

SEQ ID NO: 5917963 - DNA, 17 bp, Homo sapiens
ggagtgtctgcagtcct

SEQ ID NO: 5917964 - DNA, 20 bp, Homo sapiens
ggagtgtgagggtcctgcag

SEQ ID NO: 5917965 - DNA, 12 bp, Homo sapiens
ggagtgtgcaga

SEQ ID NO: 5917966 - DNA, 13 bp, Homo sapiens
ggagtgtgcagac

SEQ ID NO: 5917967 - DNA, 12 bp, Homo sapiens
ggagtgtggcct

SEQ ID NO: 5917968 - DNA, 22 bp, Homo sapiens
ggagtgtggctgaggaggcctc

SEQ ID NO: 5917969 - DNA, 14 bp, Homo sapiens
ggagtgtgggctgc

SEQ ID NO: 5917970 - DNA, 15 bp, Homo sapiens
ggagtgtgggctgcc

SEQ ID NO: 5917971 - DNA, 18 bp, Homo sapiens
ggagtgtgggctgccctt

SEQ ID NO: 5917972 - DNA, 17 bp, Homo sapiens
ggagtgtgggtgatcag

SEQ ID NO: 5917973 - DNA, 18 bp, Homo sapiens
ggagtgtgggtgatcaga

SEQ ID NO: 5917974 - DNA, 21 bp, Homo sapiens
ggagtgtgggtgatcagaagg

SEQ ID NO: 5917975 - DNA, 22 bp, Homo sapiens
ggagtgtgtaatttaaaattgt

SEQ ID NO: 5917976 - DNA, 16 bp, Homo sapiens
ggagtgtgtattgttc

SEQ ID NO: 5917977 - DNA, 18 bp, Homo sapiens
ggagtgtgtattgttccc

SEQ ID NO: 5917978 - DNA, 21 bp, Homo sapiens
ggagtgtgtcagagcccaggg

SEQ ID NO: 5917979 - DNA, 22 bp, Homo sapiens
ggagtgtgtcagagcccagggg

SEQ ID NO: 5917980 - DNA, 21 bp, Homo sapiens
ggagtgtgtgggggtctggga

SEQ ID NO: 5917981 - DNA, 16 bp, Homo sapiens
ggagtgttatgtattt

SEQ ID NO: 5917982 - DNA, 12 bp, Homo sapiens
ggagtgttcccc

SEQ ID NO: 5917983 - DNA, 20 bp, Homo sapiens
ggagtgttccccttccactg

SEQ ID NO: 5917984 - DNA, 19 bp, Homo sapiens
ggagtgttctgtgggcttg

SEQ ID NO: 5917985 - DNA, 14 bp, Homo sapiens
ggagtgttggggct

SEQ ID NO: 5917986 - DNA, 16 bp, Homo sapiens
ggagtgttggggctgg

SEQ ID NO: 5917987 - DNA, 15 bp, Homo sapiens
ggagttaagacctgg

SEQ ID NO: 5917988 - DNA, 16 bp, Homo sapiens
ggagttaagacctggc

SEQ ID NO: 5917989 - DNA, 22 bp, Homo sapiens
ggagttacattaatgttaattc

SEQ ID NO: 5917990 - DNA, 15 bp, Homo sapiens
ggagttagaggccag

SEQ ID NO: 5917991 - DNA, 18 bp, Homo sapiens
ggagttagaggccagcct

SEQ ID NO: 5917992 - DNA, 12 bp, Homo sapiens
ggagttagccaa

SEQ ID NO: 5917993 - DNA, 16 bp, Homo sapiens
ggagttagccaaacaa

SEQ ID NO: 5917994 - DNA, 22 bp, Homo sapiens
ggagttataggattttcacaca

SEQ ID NO: 5917995 - DNA, 12 bp, Homo sapiens
ggagttatctaa

SEQ ID NO: 5917996 - DNA, 19 bp, Homo sapiens
ggagttattgaagcagagt

SEQ ID NO: 5917997 - DNA, 20 bp, Homo sapiens
ggagttcaagaccagcctgg

SEQ ID NO: 5917998 - DNA, 21 bp, Homo sapiens
ggagttcaagaccagcctggg

SEQ ID NO: 5917999 - DNA, 12 bp, Homo sapiens
ggagttcaatga

SEQ ID NO: 5918000 - DNA, 17 bp, Homo sapiens
ggagttcaatgatctag

SEQ ID NO: 5918001 - DNA, 13 bp, Homo sapiens
ggagttcagaggg

SEQ ID NO: 5918002 - DNA, 14 bp, Homo sapiens
ggagttcagagggt

SEQ ID NO: 5918003 - DNA, 20 bp, Homo sapiens
ggagttcaggaacccttctc

SEQ ID NO: 5918004 - DNA, 15 bp, Homo sapiens
ggagttccatgaaga

SEQ ID NO: 5918005 - DNA, 14 bp, Homo sapiens
ggagttccggcctg

SEQ ID NO: 5918006 - DNA, 19 bp, Homo sapiens
ggagttccggcctgggcac

SEQ ID NO: 5918007 - DNA, 13 bp, Homo sapiens
ggagttcctgctc

SEQ ID NO: 5918008 - DNA, 20 bp, Homo sapiens
ggagttcgagaccagcctgg

SEQ ID NO: 5918009 - DNA, 20 bp, Homo sapiens
ggagttcgaggctgcagtca

SEQ ID NO: 5918010 - DNA, 22 bp, Homo sapiens
ggagttctaacaaaacaagttg

SEQ ID NO: 5918011 - DNA, 18 bp, Homo sapiens
ggagttctagaaccactt

SEQ ID NO: 5918012 - DNA, 12 bp, Homo sapiens
ggagttcttctt

SEQ ID NO: 5918013 - DNA, 16 bp, Homo sapiens
ggagttgacagtgaaa

SEQ ID NO: 5918014 - DNA, 19 bp, Homo sapiens
ggagttgactgactgagca

SEQ ID NO: 5918015 - DNA, 23 bp, Homo sapiens
ggagttgaggtgtcagagaaaat

SEQ ID NO: 5918016 - DNA, 19 bp, Homo sapiens
ggagttgagtcacaagagg

SEQ ID NO: 5918017 - DNA, 23 bp, Homo sapiens
ggagttgatcgcctttcccaggt

SEQ ID NO: 5918018 - DNA, 17 bp, Homo sapiens
ggagttgatctggaacc

SEQ ID NO: 5918019 - DNA, 22 bp, Homo sapiens
ggagttgccaactattctcagg

SEQ ID NO: 5918020 - DNA, 13 bp, Homo sapiens
ggagttgcctgac

SEQ ID NO: 5918021 - DNA, 18 bp, Homo sapiens
ggagttggagtagaatgt

SEQ ID NO: 5918022 - DNA, 12 bp, Homo sapiens
ggagttggggct

SEQ ID NO: 5918023 - DNA, 20 bp, Homo sapiens
ggagttgggggcaggtcagg

SEQ ID NO: 5918024 - DNA, 15 bp, Homo sapiens
ggagttgtattttga

SEQ ID NO: 5918025 - DNA, 16 bp, Homo sapiens
ggagttgtctgtcctg

SEQ ID NO: 5918026 - DNA, 20 bp, Homo sapiens
ggagttgtctgtcctggtca

SEQ ID NO: 5918027 - DNA, 14 bp, Homo sapiens
ggagtttaaaaaca

SEQ ID NO: 5918028 - DNA, 21 bp, Homo sapiens
ggagtttaaaaacatttttta

SEQ ID NO: 5918029 - DNA, 20 bp, Homo sapiens
ggagtttaagaccagcctgg

SEQ ID NO: 5918030 - DNA, 17 bp, Homo sapiens
ggagtttccatttggat

SEQ ID NO: 5918031 - DNA, 12 bp, Homo sapiens
ggagtttctctg

SEQ ID NO: 5918032 - DNA, 14 bp, Homo sapiens
ggagtttctgacga

SEQ ID NO: 5918033 - DNA, 17 bp, Homo sapiens
ggagtttgagacaagcc

SEQ ID NO: 5918034 - DNA, 20 bp, Homo sapiens
ggagtttgagacaagccctg

SEQ ID NO: 5918035 - DNA, 15 bp, Homo sapiens
ggagtttgagaccag

SEQ ID NO: 5918036 - DNA, 19 bp, Homo sapiens
ggagtttgagaccaggctg

SEQ ID NO: 5918037 - DNA, 21 bp, Homo sapiens
ggagtttgtggtaacttgaga

SEQ ID NO: 5918038 - DNA, 11 bp, Homo sapiens
ggagtttgtgt

SEQ ID NO: 5918039 - DNA, 12 bp, Homo sapiens
ggagttttactc

SEQ ID NO: 5918040 - DNA, 16 bp, Homo sapiens
ggagttttactgcctg

SEQ ID NO: 5918041 - DNA, 19 bp, Homo sapiens
ggagttttatttttaagaa

SEQ ID NO: 5918042 - DNA, 20 bp, Homo sapiens
ggagttttctgtgtggtctc

SEQ ID NO: 5918043 - DNA, 15 bp, Homo sapiens
ggagttttgcaaagt

SEQ ID NO: 5918044 - DNA, 18 bp, Homo sapiens
ggagtttttatgagaaac

SEQ ID NO: 5918045 - DNA, 17 bp, Homo sapiens
ggagtttttcttacata

SEQ ID NO: 5918046 - DNA, 18 bp, Homo sapiens
ggataaaaagccagggct

SEQ ID NO: 5918047 - DNA, 19 bp, Homo sapiens
ggataaaaagccagggctg

SEQ ID NO: 5918048 - DNA, 21 bp, Homo sapiens
ggataaaaaggaaggagagat

SEQ ID NO: 5918049 - DNA, 16 bp, Homo sapiens
ggataaaacagcatta

SEQ ID NO: 5918050 - DNA, 11 bp, Homo sapiens
ggataaaataa

SEQ ID NO: 5918051 - DNA, 14 bp, Homo sapiens
ggataaaatgaggt

SEQ ID NO: 5918052 - DNA, 18 bp, Homo sapiens
ggataaacattccagaga

SEQ ID NO: 5918053 - DNA, 20 bp, Homo sapiens
ggataaaccaccctctgggg

SEQ ID NO: 5918054 - DNA, 23 bp, Homo sapiens
ggataaaccaccctctggggaca

SEQ ID NO: 5918055 - DNA, 23 bp, Homo sapiens
ggataaataataaaggttctatg

SEQ ID NO: 5918056 - DNA, 12 bp, Homo sapiens
ggataaatgcca

SEQ ID NO: 5918057 - DNA, 17 bp, Homo sapiens
ggataaattgccataat

SEQ ID NO: 5918058 - DNA, 18 bp, Homo sapiens
ggataaattgccataata

SEQ ID NO: 5918059 - DNA, 14 bp, Homo sapiens
ggataactaaaatt

SEQ ID NO: 5918060 - DNA, 15 bp, Homo sapiens
ggataactaaaattc

SEQ ID NO: 5918061 - DNA, 18 bp, Homo sapiens
ggataactgatggcaata

SEQ ID NO: 5918062 - DNA, 20 bp, Homo sapiens
ggataacttccttgcccctg

SEQ ID NO: 5918063 - DNA, 21 bp, Homo sapiens
ggataagaaagcctaaaattg

SEQ ID NO: 5918064 - DNA, 20 bp, Homo sapiens
ggataaggagactgaggctt

SEQ ID NO: 5918065 - DNA, 21 bp, Homo sapiens
ggataaggtacctttcacata

SEQ ID NO: 5918066 - DNA, 16 bp, Homo sapiens
ggataataaaaattgt

SEQ ID NO: 5918067 - DNA, 14 bp, Homo sapiens
ggataatagagtag

SEQ ID NO: 5918068 - DNA, 17 bp, Homo sapiens
ggataatataaaaagca

SEQ ID NO: 5918069 - DNA, 16 bp, Homo sapiens
ggataatgaaataatc

SEQ ID NO: 5918070 - DNA, 21 bp, Homo sapiens
ggataatgaaataatcagtga

SEQ ID NO: 5918071 - DNA, 20 bp, Homo sapiens
ggataatgctgttgcctcat

SEQ ID NO: 5918072 - DNA, 15 bp, Homo sapiens
ggataattaaatata

SEQ ID NO: 5918073 - DNA, 19 bp, Homo sapiens
ggataattagcatctcagg

SEQ ID NO: 5918074 - DNA, 15 bp, Homo sapiens
ggatacagctgcttt

SEQ ID NO: 5918075 - DNA, 22 bp, Homo sapiens
ggatacaggagagaagctggtc

SEQ ID NO: 5918076 - DNA, 23 bp, Homo sapiens
ggatacaggttactaccctcacc

SEQ ID NO: 5918077 - DNA, 13 bp, Homo sapiens
ggatacagtgccc

SEQ ID NO: 5918078 - DNA, 15 bp, Homo sapiens
ggatcgaggcatggg

SEQ ID NO: 5918079 - DNA, 18 bp, Homo sapiens
ggatcgagtgtagctgtg

SEQ ID NO: 5918080 - DNA, 14 bp, Homo sapiens
ggatcgatgtgctc

SEQ ID NO: 5918081 - DNA, 17 bp, Homo sapiens
ggatcgctaagctggct

SEQ ID NO: 5918082 - DNA, 15 bp, Homo sapiens
ggatcggcctcctct

SEQ ID NO: 5918083 - DNA, 14 bp, Homo sapiens
ggatcggcttcctc

SEQ ID NO: 5918084 - DNA, 21 bp, Homo sapiens
ggatcgtgcatttgaggggcc

SEQ ID NO: 5918085 - DNA, 21 bp, Homo sapiens
ggatcgtggaagaagggccac

SEQ ID NO: 5918086 - DNA, 13 bp, Homo sapiens
ggatcgtggccaa

SEQ ID NO: 5918087 - DNA, 18 bp, Homo sapiens
ggatctacagaacaaccc

SEQ ID NO: 5918088 - DNA, 12 bp, Homo sapiens
ggatctaccagc

SEQ ID NO: 5918089 - DNA, 18 bp, Homo sapiens
ggatctaccagcataaat

SEQ ID NO: 5918090 - DNA, 17 bp, Homo sapiens
ggatctacctggaggga

SEQ ID NO: 5918091 - DNA, 13 bp, Homo sapiens
ggatctagaaggg

SEQ ID NO: 5918092 - DNA, 16 bp, Homo sapiens
ggatctagccatggct

SEQ ID NO: 5918093 - DNA, 23 bp, Homo sapiens
ggatctagccatggctggcagag

SEQ ID NO: 5918094 - DNA, 21 bp, Homo sapiens
ggatctagcttcatgcctcag

SEQ ID NO: 5918095 - DNA, 21 bp, Homo sapiens
ggatctatttcatgtttttga

SEQ ID NO: 5918096 - DNA, 17 bp, Homo sapiens
ggatctcacaggctgag

SEQ ID NO: 5918097 - DNA, 16 bp, Homo sapiens
ggatctcagctttgag

SEQ ID NO: 5918098 - DNA, 22 bp, Homo sapiens
ggatctcagctttgagaagcct

SEQ ID NO: 5918099 - DNA, 10 bp, Homo sapiens
ggatctcagg

SEQ ID NO: 5918100 - DNA, 15 bp, Homo sapiens
ggatctcagttttta

SEQ ID NO: 5918101 - DNA, 21 bp, Homo sapiens
ggatctccactgataagactg

SEQ ID NO: 5918102 - DNA, 13 bp, Homo sapiens
ggatctccaggcc

SEQ ID NO: 5918103 - DNA, 14 bp, Homo sapiens
ggatctccaggccc

SEQ ID NO: 5918104 - DNA, 22 bp, Homo sapiens
ggatctccaggcccagcctggc

SEQ ID NO: 5918105 - DNA, 17 bp, Homo sapiens
ggatctcccagggctac

SEQ ID NO: 5918106 - DNA, 14 bp, Homo sapiens
ggatctccccactc

SEQ ID NO: 5918107 - DNA, 21 bp, Homo sapiens
ggatctccctgagatgggctt

SEQ ID NO: 5918108 - DNA, 20 bp, Homo sapiens
ggatctcctgccagcccagc

SEQ ID NO: 5918109 - DNA, 22 bp, Homo sapiens
ggatctcctgccagcccagctg

SEQ ID NO: 5918110 - DNA, 21 bp, Homo sapiens
ggatctccttgagatcctgat

SEQ ID NO: 5918111 - DNA, 16 bp, Homo sapiens
ggatctcgcctggaaa

SEQ ID NO: 5918112 - DNA, 18 bp, Homo sapiens
ggatctcgcctggaaaca

SEQ ID NO: 5918113 - DNA, 22 bp, Homo sapiens
ggatctcgcctggaaacagagg

SEQ ID NO: 5918114 - DNA, 21 bp, Homo sapiens
ggatctctcaggagcacaggc

SEQ ID NO: 5918115 - DNA, 19 bp, Homo sapiens
ggatctgaaaacttggctg

SEQ ID NO: 5918116 - DNA, 17 bp, Homo sapiens
ggatctgagtaggtctg

SEQ ID NO: 5918117 - DNA, 22 bp, Homo sapiens
ggatctgcattccccgctgccc

SEQ ID NO: 5918118 - DNA, 20 bp, Homo sapiens
ggatctgcccctccctgctt

SEQ ID NO: 5918119 - DNA, 13 bp, Homo sapiens
ggatctgctccaa

SEQ ID NO: 5918120 - DNA, 16 bp, Homo sapiens
ggatctgctccatgca

SEQ ID NO: 5918121 - DNA, 21 bp, Homo sapiens
ggatctgctgaggcccagtgc

SEQ ID NO: 5918122 - DNA, 17 bp, Homo sapiens
ggatctgctgggctctg

SEQ ID NO: 5918123 - DNA, 16 bp, Homo sapiens
ggatctggatctgtta

SEQ ID NO: 5918124 - DNA, 23 bp, Homo sapiens
ggatctgggaccctttccttcct

SEQ ID NO: 5918125 - DNA, 16 bp, Homo sapiens
ggatctggggaaggac

SEQ ID NO: 5918126 - DNA, 20 bp, Homo sapiens
ggatctggggagagcggctg

SEQ ID NO: 5918127 - DNA, 19 bp, Homo sapiens
ggatctggggggtggggag

SEQ ID NO: 5918128 - DNA, 21 bp, Homo sapiens
ggatctggtagggggaaaatg

SEQ ID NO: 5918129 - DNA, 15 bp, Homo sapiens
ggatctgtccaagga

SEQ ID NO: 5918130 - DNA, 15 bp, Homo sapiens
ggatctgtctgtgca

SEQ ID NO: 5918131 - DNA, 17 bp, Homo sapiens
ggatctgtcttggcatt

SEQ ID NO: 5918132 - DNA, 17 bp, Homo sapiens
ggatctgtgattggctg

SEQ ID NO: 5918133 - DNA, 19 bp, Homo sapiens
ggatctgtgattggctggt

SEQ ID NO: 5918134 - DNA, 20 bp, Homo sapiens
ggatctgttgggaaccagag

SEQ ID NO: 5918135 - DNA, 17 bp, Homo sapiens
ggatctgttttctggaa

SEQ ID NO: 5918136 - DNA, 13 bp, Homo sapiens
ggatcttatttgg

SEQ ID NO: 5918137 - DNA, 15 bp, Homo sapiens
ggatcttcaatggct

SEQ ID NO: 5918138 - DNA, 20 bp, Homo sapiens
ggatcttcagaactgccctt

SEQ ID NO: 5918139 - DNA, 15 bp, Homo sapiens
ggatcttcccacagg

SEQ ID NO: 5918140 - DNA, 16 bp, Homo sapiens
ggatcttcccacagga

SEQ ID NO: 5918141 - DNA, 20 bp, Homo sapiens
ggatcttctatcattccaat

SEQ ID NO: 5918142 - DNA, 23 bp, Homo sapiens
ggatcttgaagaagctcttttgg

SEQ ID NO: 5918143 - DNA, 15 bp, Homo sapiens
ggatcttgaatgtgg

SEQ ID NO: 5918144 - DNA, 20 bp, Homo sapiens
ggatcttgaatgtggtctca

SEQ ID NO: 5918145 - DNA, 17 bp, Homo sapiens
ggatcttgcattcccag

SEQ ID NO: 5918146 - DNA, 18 bp, Homo sapiens
ggatcttgccacatttct

SEQ ID NO: 5918147 - DNA, 22 bp, Homo sapiens
ggatctttggacagaagcagct

SEQ ID NO: 5918148 - DNA, 13 bp, Homo sapiens
ggatcttttctaa

SEQ ID NO: 5918149 - DNA, 19 bp, Homo sapiens
ggatcttttggacctggct

SEQ ID NO: 5918150 - DNA, 22 bp, Homo sapiens
ggatgaaaagagaggtttctgg

SEQ ID NO: 5918151 - DNA, 11 bp, Homo sapiens
ggatgaacaat

SEQ ID NO: 5918152 - DNA, 14 bp, Homo sapiens
ggatgaactagcca

SEQ ID NO: 5918153 - DNA, 15 bp, Homo sapiens
ggatgaagaccctat

SEQ ID NO: 5918154 - DNA, 14 bp, Homo sapiens
ggatgaatgaggtc

SEQ ID NO: 5918155 - DNA, 16 bp, Homo sapiens
ggatgaatgggaaagt

SEQ ID NO: 5918156 - DNA, 23 bp, Homo sapiens
ggatgaatgtatgtgcactgtca

SEQ ID NO: 5918157 - DNA, 21 bp, Homo sapiens
ggatgaattccaaattctgct

SEQ ID NO: 5918158 - DNA, 19 bp, Homo sapiens
ggatgaattttctgcagct

SEQ ID NO: 5918159 - DNA, 18 bp, Homo sapiens
ggatgacaccctggcctg

SEQ ID NO: 5918160 - DNA, 23 bp, Homo sapiens
ggatgacagccaccctcaccgcg

SEQ ID NO: 5918161 - DNA, 20 bp, Homo sapiens
ggatgacaggtgtgagccac

SEQ ID NO: 5918162 - DNA, 14 bp, Homo sapiens
ggatgaccagaaca

SEQ ID NO: 5918163 - DNA, 14 bp, Homo sapiens
ggatgacctccaga

SEQ ID NO: 5918164 - DNA, 14 bp, Homo sapiens
ggatgacggccagg

SEQ ID NO: 5918165 - DNA, 23 bp, Homo sapiens
ggatgacggtattatgcttcttg

SEQ ID NO: 5918166 - DNA, 16 bp, Homo sapiens
ggatgactaacaagat

SEQ ID NO: 5918167 - DNA, 19 bp, Homo sapiens
ggatgactaacaagatttg

SEQ ID NO: 5918168 - DNA, 19 bp, Homo sapiens
ggatgactagaggcaggga

SEQ ID NO: 5918169 - DNA, 18 bp, Homo sapiens
ggatgagaaacagctcag

SEQ ID NO: 5918170 - DNA, 19 bp, Homo sapiens
ggatgagaaacagctcagc

SEQ ID NO: 5918171 - DNA, 21 bp, Homo sapiens
ggatgagaatttgagtgctct

SEQ ID NO: 5918172 - DNA, 18 bp, Homo sapiens
ggatgagagcccagaggt

SEQ ID NO: 5918173 - DNA, 22 bp, Homo sapiens
ggatgagatacttatgcaagat

SEQ ID NO: 5918174 - DNA, 13 bp, Homo sapiens
ggatgagcagagg

SEQ ID NO: 5918175 - DNA, 18 bp, Homo sapiens
ggatgagcagagggagga

SEQ ID NO: 5918176 - DNA, 17 bp, Homo sapiens
ggatgagcatggagctg

SEQ ID NO: 5918177 - DNA, 20 bp, Homo sapiens
ggatgagcatggagctggcc

SEQ ID NO: 5918178 - DNA, 23 bp, Homo sapiens
ggatgagcatggagctgtcacct

SEQ ID NO: 5918179 - DNA, 13 bp, Homo sapiens
ggatgagcattta

SEQ ID NO: 5918180 - DNA, 19 bp, Homo sapiens
ggatgagccaaaccagcag

SEQ ID NO: 5918181 - DNA, 20 bp, Homo sapiens
ggatgagccaaaccagcagg

SEQ ID NO: 5918182 - DNA, 23 bp, Homo sapiens
ggatgagcctctccttgccccag

SEQ ID NO: 5918183 - DNA, 14 bp, Homo sapiens
ggatgaggacagag

SEQ ID NO: 5918184 - DNA, 13 bp, Homo sapiens
ggatgaggccccg

SEQ ID NO: 5918185 - DNA, 20 bp, Homo sapiens
ggatgaggccgctagaggcc

SEQ ID NO: 5918186 - DNA, 18 bp, Homo sapiens
ggatgaggggtgctgggt

SEQ ID NO: 5918187 - DNA, 16 bp, Homo sapiens
ggatgaggtgctggga

SEQ ID NO: 5918188 - DNA, 18 bp, Homo sapiens
ggatgaggtgctgggagg

SEQ ID NO: 5918189 - DNA, 20 bp, Homo sapiens
ggatgaggtggtggagtgga

SEQ ID NO: 5918190 - DNA, 20 bp, Homo sapiens
ggatgagtaaactgtttctc

SEQ ID NO: 5918191 - DNA, 23 bp, Homo sapiens
ggatgagtacccaaaagctcagc

SEQ ID NO: 5918192 - DNA, 15 bp, Homo sapiens
ggatgataaaggaaa

SEQ ID NO: 5918193 - DNA, 15 bp, Homo sapiens
ggatgatatggaggt

SEQ ID NO: 5918194 - DNA, 22 bp, Homo sapiens
ggatgatccccacgccacagcc

SEQ ID NO: 5918195 - DNA, 18 bp, Homo sapiens
ggatgatctaggaagact

SEQ ID NO: 5918196 - DNA, 19 bp, Homo sapiens
ggatgatgagggaagcaat

SEQ ID NO: 5918197 - DNA, 14 bp, Homo sapiens
ggatgatgccacac

SEQ ID NO: 5918198 - DNA, 15 bp, Homo sapiens
ggatgatgcctcatg

SEQ ID NO: 5918199 - DNA, 13 bp, Homo sapiens
ggatgatggaaaa

SEQ ID NO: 5918200 - DNA, 22 bp, Homo sapiens
ggatgatgtgtgaaacctgaca

SEQ ID NO: 5918201 - DNA, 14 bp, Homo sapiens
ggatgattaaattt

SEQ ID NO: 5918202 - DNA, 16 bp, Homo sapiens
ggatgattcagaaatt

SEQ ID NO: 5918203 - DNA, 20 bp, Homo sapiens
ggatgattcagaaattggaa

SEQ ID NO: 5918204 - DNA, 21 bp, Homo sapiens
ggatgattcagaaattggaac

SEQ ID NO: 5918205 - DNA, 15 bp, Homo sapiens
ggatgattgtacaga

SEQ ID NO: 5918206 - DNA, 21 bp, Homo sapiens
ggatgcaaatagattcagaga

SEQ ID NO: 5918207 - DNA, 18 bp, Homo sapiens
ggatgcaacaaatgtggc

SEQ ID NO: 5918208 - DNA, 18 bp, Homo sapiens
ggatgcaaggtagcatgg

SEQ ID NO: 5918209 - DNA, 15 bp, Homo sapiens
ggatgcacagtgcct

SEQ ID NO: 5918210 - DNA, 11 bp, Homo sapiens
ggatgcacatt

SEQ ID NO: 5918211 - DNA, 13 bp, Homo sapiens
ggatgcacatttc

SEQ ID NO: 5918212 - DNA, 18 bp, Homo sapiens
ggatgcagaggcctgcag

SEQ ID NO: 5918213 - DNA, 16 bp, Homo sapiens
ggatgcagcctcacag

SEQ ID NO: 5918214 - DNA, 17 bp, Homo sapiens
ggatgcagcctcacagt

SEQ ID NO: 5918215 - DNA, 18 bp, Homo sapiens
ggatgcaggctcccctga

SEQ ID NO: 5918216 - DNA, 19 bp, Homo sapiens
ggatgcagtgcctttcccc

SEQ ID NO: 5918217 - DNA, 14 bp, Homo sapiens
ggatgcagtgctcg

SEQ ID NO: 5918218 - DNA, 22 bp, Homo sapiens
ggatgcagtgctcgctgttgct

SEQ ID NO: 5918219 - DNA, 22 bp, Homo sapiens
ggatgcagtggctcatgcctgt

SEQ ID NO: 5918220 - DNA, 14 bp, Homo sapiens
ggatgcatgcaggg

SEQ ID NO: 5918221 - DNA, 16 bp, Homo sapiens
ggatgcatggagatag

SEQ ID NO: 5918222 - DNA, 17 bp, Homo sapiens
ggatgcattcgagatgg

SEQ ID NO: 5918223 - DNA, 21 bp, Homo sapiens
ggatgcattctgataggaggg

SEQ ID NO: 5918224 - DNA, 12 bp, Homo sapiens
ggatgcatttca

SEQ ID NO: 5918225 - DNA, 15 bp, Homo sapiens
ggatgcatttcaaat

SEQ ID NO: 5918226 - DNA, 15 bp, Homo sapiens
ggatgcatttctctg

SEQ ID NO: 5918227 - DNA, 23 bp, Homo sapiens
ggatgccaacaccttcttggctt

SEQ ID NO: 5918228 - DNA, 19 bp, Homo sapiens
ggatgccaagaagtttaag

SEQ ID NO: 5918229 - DNA, 20 bp, Homo sapiens
ggatgccaagtggccctcag

SEQ ID NO: 5918230 - DNA, 22 bp, Homo sapiens
ggatgccaatattaaatctgct

SEQ ID NO: 5918231 - DNA, 13 bp, Homo sapiens
ggatgccacagcc

SEQ ID NO: 5918232 - DNA, 15 bp, Homo sapiens
ggatgccacagcccc

SEQ ID NO: 5918233 - DNA, 19 bp, Homo sapiens
ggatgccacagccccacag

SEQ ID NO: 5918234 - DNA, 18 bp, Homo sapiens
ggatgccactcctccctc

SEQ ID NO: 5918235 - DNA, 22 bp, Homo sapiens
ggatgccagccccgtgccagga

SEQ ID NO: 5918236 - DNA, 18 bp, Homo sapiens
ggatgccagcccctgcct

SEQ ID NO: 5918237 - DNA, 22 bp, Homo sapiens
ggatgccataaaagccgcccag

SEQ ID NO: 5918238 - DNA, 19 bp, Homo sapiens
ggatgccatctgtgggcac

SEQ ID NO: 5918239 - DNA, 19 bp, Homo sapiens
ggatgcccaaagatgcagc

SEQ ID NO: 5918240 - DNA, 19 bp, Homo sapiens
ggatgcccagatgaactga

SEQ ID NO: 5918241 - DNA, 22 bp, Homo sapiens
ggatgcccagggccactctgcc

SEQ ID NO: 5918242 - DNA, 14 bp, Homo sapiens
ggatgcccagtggt

SEQ ID NO: 5918243 - DNA, 21 bp, Homo sapiens
ggatgcccattcctgcctggt

SEQ ID NO: 5918244 - DNA, 12 bp, Homo sapiens
ggatgcccccag

SEQ ID NO: 5918245 - DNA, 16 bp, Homo sapiens
ggatgcccccaggcag

SEQ ID NO: 5918246 - DNA, 21 bp, Homo sapiens
ggatgcccccaggcagccacc

SEQ ID NO: 5918247 - DNA, 19 bp, Homo sapiens
ggatgcccctggccctgcc

SEQ ID NO: 5918248 - DNA, 21 bp, Homo sapiens
ggatgcccctggccctgcctc

SEQ ID NO: 5918249 - DNA, 15 bp, Homo sapiens
ggatgccctggaggt

SEQ ID NO: 5918250 - DNA, 21 bp, Homo sapiens
ggatgccctggaggtggctga

SEQ ID NO: 5918251 - DNA, 16 bp, Homo sapiens
ggatgcccttccccct

SEQ ID NO: 5918252 - DNA, 14 bp, Homo sapiens
ggatgcctgagccc

SEQ ID NO: 5918253 - DNA, 17 bp, Homo sapiens
ggatgcctgagccccct

SEQ ID NO: 5918254 - DNA, 16 bp, Homo sapiens
ggatgtggtggcagtg

SEQ ID NO: 5918255 - DNA, 17 bp, Homo sapiens
ggatgtggttttcttaa

SEQ ID NO: 5918256 - DNA, 15 bp, Homo sapiens
ggatgtgtaaatgga

SEQ ID NO: 5918257 - DNA, 14 bp, Homo sapiens
ggatgtgtcctgac

SEQ ID NO: 5918258 - DNA, 15 bp, Homo sapiens
ggatgtgtcctgaca

SEQ ID NO: 5918259 - DNA, 13 bp, Homo sapiens
ggatgtgtgcatg

SEQ ID NO: 5918260 - DNA, 18 bp, Homo sapiens
ggatgtgtgtctcacccc

SEQ ID NO: 5918261 - DNA, 18 bp, Homo sapiens
ggatgttactctcttgca

SEQ ID NO: 5918262 - DNA, 15 bp, Homo sapiens
ggatgttatgaacag

SEQ ID NO: 5918263 - DNA, 20 bp, Homo sapiens
ggatgttgctatagtgacat

SEQ ID NO: 5918264 - DNA, 14 bp, Homo sapiens
ggatgttgctcaga

SEQ ID NO: 5918265 - DNA, 16 bp, Homo sapiens
ggatgttgctccatcc

SEQ ID NO: 5918266 - DNA, 22 bp, Homo sapiens
ggatgttgcttctgaatcactg

SEQ ID NO: 5918267 - DNA, 19 bp, Homo sapiens
ggatgttgtcaggaatcat

SEQ ID NO: 5918268 - DNA, 13 bp, Homo sapiens
ggatgttgttatg

SEQ ID NO: 5918269 - DNA, 20 bp, Homo sapiens
ggatgtttagcagtggctgg

SEQ ID NO: 5918270 - DNA, 23 bp, Homo sapiens
ggatgtttctgtcacatcagctc

SEQ ID NO: 5918271 - DNA, 13 bp, Homo sapiens
ggatgtttcttct

SEQ ID NO: 5918272 - DNA, 15 bp, Homo sapiens
ggatgtttggaaaaa

SEQ ID NO: 5918273 - DNA, 21 bp, Homo sapiens
ggatgtttttagttctgactt

SEQ ID NO: 5918274 - DNA, 18 bp, Homo sapiens
ggatgtttttcatgaaaa

SEQ ID NO: 5918275 - DNA, 18 bp, Homo sapiens
ggattaaaacaatttttt

SEQ ID NO: 5918276 - DNA, 19 bp, Homo sapiens
ggattaaaaccttaagagt

SEQ ID NO: 5918277 - DNA, 16 bp, Homo sapiens
ggattaaacttatgaa

SEQ ID NO: 5918278 - DNA, 19 bp, Homo sapiens
ggattaaacttatgaatgt

SEQ ID NO: 5918279 - DNA, 21 bp, Homo sapiens
ggattaaacttatgaatgttt

SEQ ID NO: 5918280 - DNA, 20 bp, Homo sapiens
ggattaacccactagctctt

SEQ ID NO: 5918281 - DNA, 16 bp, Homo sapiens
ggattaacctctgcac

SEQ ID NO: 5918282 - DNA, 20 bp, Homo sapiens
ggattaagaaaccttgctct

SEQ ID NO: 5918283 - DNA, 14 bp, Homo sapiens
ggattaagggacgg

SEQ ID NO: 5918284 - DNA, 13 bp, Homo sapiens
ggattaagggcaa

SEQ ID NO: 5918285 - DNA, 14 bp, Homo sapiens
ggattaatatgaaa

SEQ ID NO: 5918286 - DNA, 16 bp, Homo sapiens
ggattaatatgaaaac

SEQ ID NO: 5918287 - DNA, 15 bp, Homo sapiens
ggattaatttattta

SEQ ID NO: 5918288 - DNA, 20 bp, Homo sapiens
ggattaatttgtgaaaatgt

SEQ ID NO: 5918289 - DNA, 16 bp, Homo sapiens
ggattacagaaactga

SEQ ID NO: 5918290 - DNA, 17 bp, Homo sapiens
ggattacagaaactgat

SEQ ID NO: 5918291 - DNA, 19 bp, Homo sapiens
ggattacagaaactgatgc

SEQ ID NO: 5918292 - DNA, 20 bp, Homo sapiens
ggattacagaaactgatgcc

SEQ ID NO: 5918293 - DNA, 14 bp, Homo sapiens
ggattacaggcctt

SEQ ID NO: 5918294 - DNA, 19 bp, Homo sapiens
ggattactgacttttcttt

SEQ ID NO: 5918295 - DNA, 18 bp, Homo sapiens
ggattagctagactagga

SEQ ID NO: 5918296 - DNA, 21 bp, Homo sapiens
ggattaggtttcagcagagct

SEQ ID NO: 5918297 - DNA, 19 bp, Homo sapiens
ggattatgggtcacaggaa

SEQ ID NO: 5918298 - DNA, 11 bp, Homo sapiens
ggattatgtca

SEQ ID NO: 5918299 - DNA, 21 bp, Homo sapiens
ggattattattagtgttttat

SEQ ID NO: 5918300 - DNA, 19 bp, Homo sapiens
ggattattctttgaaaaca

SEQ ID NO: 5918301 - DNA, 19 bp, Homo sapiens
ggattatttaataacatta

SEQ ID NO: 5918302 - DNA, 22 bp, Homo sapiens
ggattatttaataacattacct

SEQ ID NO: 5918303 - DNA, 12 bp, Homo sapiens
ggattattttct

SEQ ID NO: 5918304 - DNA, 14 bp, Homo sapiens
ggattattttttca

SEQ ID NO: 5918305 - DNA, 16 bp, Homo sapiens
ggattattttttcaga

SEQ ID NO: 5918306 - DNA, 17 bp, Homo sapiens
ggattattttttcagac

SEQ ID NO: 5918307 - DNA, 18 bp, Homo sapiens
ggattattttttcagacc

SEQ ID NO: 5918308 - DNA, 19 bp, Homo sapiens
ggattattttttcagaccg

SEQ ID NO: 5918309 - DNA, 20 bp, Homo sapiens
ggattattttttcagaccga

SEQ ID NO: 5918310 - DNA, 11 bp, Homo sapiens
ggattcaaatg

SEQ ID NO: 5918311 - DNA, 13 bp, Homo sapiens
ggattcaagtgat

SEQ ID NO: 5918312 - DNA, 17 bp, Homo sapiens
ggattcacaccccacct

SEQ ID NO: 5918313 - DNA, 19 bp, Homo sapiens
ggattcacaccccacctgc

SEQ ID NO: 5918314 - DNA, 20 bp, Homo sapiens
ggattcacaccccacctgcg

SEQ ID NO: 5918315 - DNA, 22 bp, Homo sapiens
ggattcacccccctctgctgcc

SEQ ID NO: 5918316 - DNA, 23 bp, Homo sapiens
ggattcacccccctctgctgccg

SEQ ID NO: 5918317 - DNA, 12 bp, Homo sapiens
ggattcacttct

SEQ ID NO: 5918318 - DNA, 12 bp, Homo sapiens
ggattcagcctt

SEQ ID NO: 5918319 - DNA, 16 bp, Homo sapiens
ggattcagccttcttt

SEQ ID NO: 5918320 - DNA, 23 bp, Homo sapiens
ggattcagccttctttttctgga

SEQ ID NO: 5918321 - DNA, 13 bp, Homo sapiens
ggattcaggcagc

SEQ ID NO: 5918322 - DNA, 13 bp, Homo sapiens
ggattcaggctgc

SEQ ID NO: 5918323 - DNA, 16 bp, Homo sapiens
ggattcaggggctttg

SEQ ID NO: 5918324 - DNA, 20 bp, Homo sapiens
ggattcagtggaggctggca

SEQ ID NO: 5918325 - DNA, 15 bp, Homo sapiens
ggattcagttcattc

SEQ ID NO: 5918326 - DNA, 15 bp, Homo sapiens
ggattcatgtccaga

SEQ ID NO: 5918327 - DNA, 13 bp, Homo sapiens
ggattcatttcct

SEQ ID NO: 5918328 - DNA, 17 bp, Homo sapiens
ggattcatttcctgccc

SEQ ID NO: 5918329 - DNA, 18 bp, Homo sapiens
ggattccagcatttgcca

SEQ ID NO: 5918330 - DNA, 18 bp, Homo sapiens
ggattccccatctcaggc

SEQ ID NO: 5918331 - DNA, 15 bp, Homo sapiens
ggattcccccagcca

SEQ ID NO: 5918332 - DNA, 15 bp, Homo sapiens
ggattccccctgccc

SEQ ID NO: 5918333 - DNA, 11 bp, Homo sapiens
ggattcccttt

SEQ ID NO: 5918334 - DNA, 17 bp, Homo sapiens
ggattccggccctggct

SEQ ID NO: 5918335 - DNA, 22 bp, Homo sapiens
ggattccggccctggctgggga

SEQ ID NO: 5918336 - DNA, 11 bp, Homo sapiens
ggattcctcac

SEQ ID NO: 5918337 - DNA, 13 bp, Homo sapiens
ggattcctcccca

SEQ ID NO: 5918338 - DNA, 17 bp, Homo sapiens
ggattcctcccctggaa

SEQ ID NO: 5918339 - DNA, 15 bp, Homo sapiens
ggattcctcttttct

SEQ ID NO: 5918340 - DNA, 16 bp, Homo sapiens
ggattcctgacccagg

SEQ ID NO: 5918341 - DNA, 22 bp, Homo sapiens
ggattcctgagctggcctgtct

SEQ ID NO: 5918342 - DNA, 23 bp, Homo sapiens
ggattctaaacagatgtccctga

SEQ ID NO: 5918343 - DNA, 14 bp, Homo sapiens
ggattctaaataca

SEQ ID NO: 5918344 - DNA, 20 bp, Homo sapiens
ggattctactttaagcacta

SEQ ID NO: 5918345 - DNA, 23 bp, Homo sapiens
ggattctactttaagcactacat

SEQ ID NO: 5918346 - DNA, 21 bp, Homo sapiens
ggattctcatgggaaggggag

SEQ ID NO: 5918347 - DNA, 19 bp, Homo sapiens
ggattctctaattagaaat

SEQ ID NO: 5918348 - DNA, 15 bp, Homo sapiens
ggattctctgcagcc

SEQ ID NO: 5918349 - DNA, 21 bp, Homo sapiens
ggattctgaggccctgcccaa

SEQ ID NO: 5918350 - DNA, 15 bp, Homo sapiens
ggattctggatggcc

SEQ ID NO: 5918351 - DNA, 14 bp, Homo sapiens
ggattctggttcca

SEQ ID NO: 5918352 - DNA, 16 bp, Homo sapiens
ggattcttaaagttga

SEQ ID NO: 5918353 - DNA, 16 bp, Homo sapiens
ggattcttatggacaa

SEQ ID NO: 5918354 - DNA, 20 bp, Homo sapiens
ggattcttcccgctccccac

SEQ ID NO: 5918355 - DNA, 11 bp, Homo sapiens
ggattcttctt

SEQ ID NO: 5918356 - DNA, 19 bp, Homo sapiens
ggattcttgttttgcttcc

SEQ ID NO: 5918357 - DNA, 16 bp, Homo sapiens
ggattctttccccaga

SEQ ID NO: 5918358 - DNA, 19 bp, Homo sapiens
ggattgaaaatgtccagga

SEQ ID NO: 5918359 - DNA, 16 bp, Homo sapiens
ggattgaagccctcca

SEQ ID NO: 5918360 - DNA, 21 bp, Homo sapiens
ggattgaagtggctggaaaga

SEQ ID NO: 5918361 - DNA, 17 bp, Homo sapiens
ggattgagataatctaa

SEQ ID NO: 5918362 - DNA, 13 bp, Homo sapiens
ggattgagtctgt

SEQ ID NO: 5918363 - DNA, 18 bp, Homo sapiens
ggattgagttgtaaagaa

SEQ ID NO: 5918364 - DNA, 14 bp, Homo sapiens
ggattgatcattct

SEQ ID NO: 5918365 - DNA, 18 bp, Homo sapiens
ggattgattatgcagaat

SEQ ID NO: 5918366 - DNA, 15 bp, Homo sapiens
ggattgcacgtggcc

SEQ ID NO: 5918367 - DNA, 18 bp, Homo sapiens
ggattgcaggtgcctggc

SEQ ID NO: 5918368 - DNA, 17 bp, Homo sapiens
ggattgcatcctgctgg

SEQ ID NO: 5918369 - DNA, 17 bp, Homo sapiens
ggattgcccctggcttt

SEQ ID NO: 5918370 - DNA, 19 bp, Homo sapiens
ggattgcctttaatatttt

SEQ ID NO: 5918371 - DNA, 16 bp, Homo sapiens
ggattgcgagagatgt

SEQ ID NO: 5918372 - DNA, 19 bp, Homo sapiens
ggattgcgagagatgtgtg

SEQ ID NO: 5918373 - DNA, 16 bp, Homo sapiens
ggattgctaaaacagc

SEQ ID NO: 5918374 - DNA, 16 bp, Homo sapiens
ggattgctatgaatga

SEQ ID NO: 5918375 - DNA, 14 bp, Homo sapiens
ggattgctgccact

SEQ ID NO: 5918376 - DNA, 15 bp, Homo sapiens
ggattgctgccactt

SEQ ID NO: 5918377 - DNA, 20 bp, Homo sapiens
ggattgcttcaattaaaatt

SEQ ID NO: 5918378 - DNA, 23 bp, Homo sapiens
ggattgctttgcattactgtccc

SEQ ID NO: 5918379 - DNA, 22 bp, Homo sapiens
ggattggattatttaataacat

SEQ ID NO: 5918380 - DNA, 23 bp, Homo sapiens
ggattggcaactcttcagacgga

SEQ ID NO: 5918381 - DNA, 23 bp, Homo sapiens
ggattggcacaagctccctggtg

SEQ ID NO: 5918382 - DNA, 15 bp, Homo sapiens
ggattggccctgccc

SEQ ID NO: 5918383 - DNA, 17 bp, Homo sapiens
ggattggccctgcccct

SEQ ID NO: 5918384 - DNA, 16 bp, Homo sapiens
ggattggcctgtgtct

SEQ ID NO: 5918385 - DNA, 19 bp, Homo sapiens
ggattggcctgtgtctggc

SEQ ID NO: 5918386 - DNA, 20 bp, Homo sapiens
ggattgggagggacagggct

SEQ ID NO: 5918387 - DNA, 17 bp, Homo sapiens
ggattggggtccctcta

SEQ ID NO: 5918388 - DNA, 22 bp, Homo sapiens
ggattggggtgataaggggcct

SEQ ID NO: 5918389 - DNA, 20 bp, Homo sapiens
ggattgtacgtgggagaggc

SEQ ID NO: 5918390 - DNA, 19 bp, Homo sapiens
ggattgtatttaagacata

SEQ ID NO: 5918391 - DNA, 23 bp, Homo sapiens
ggattgtccaccttctgccaagg

SEQ ID NO: 5918392 - DNA, 13 bp, Homo sapiens
ggattgtccccga

SEQ ID NO: 5918393 - DNA, 16 bp, Homo sapiens
ggattgtccccgaccc

SEQ ID NO: 5918394 - DNA, 22 bp, Homo sapiens
ggattgtgcaatagtcagagtg

SEQ ID NO: 5918395 - DNA, 23 bp, Homo sapiens
ggattgtggttccatgcagcctt

SEQ ID NO: 5918396 - DNA, 15 bp, Homo sapiens
ggattgtgtatctgt

SEQ ID NO: 5918397 - DNA, 23 bp, Homo sapiens
ggattgtgtatctgtgcttctaa

SEQ ID NO: 5918398 - DNA, 10 bp, Homo sapiens
ggattgtttt

SEQ ID NO: 5918399 - DNA, 17 bp, Homo sapiens
ggattgttttttcttta

SEQ ID NO: 5918400 - DNA, 16 bp, Homo sapiens
ggatttaacagaaatg

SEQ ID NO: 5918401 - DNA, 21 bp, Homo sapiens
ggatttaacagtcatttaaaa

SEQ ID NO: 5918402 - DNA, 14 bp, Homo sapiens
ggatttaatttcca

SEQ ID NO: 5918403 - DNA, 19 bp, Homo sapiens
ggatttactgagagaaggt

SEQ ID NO: 5918404 - DNA, 16 bp, Homo sapiens
ggatttataaatgcta

SEQ ID NO: 5918405 - DNA, 20 bp, Homo sapiens
ggatttatctttaggccagg

SEQ ID NO: 5918406 - DNA, 17 bp, Homo sapiens
ggatttatgtattttga

SEQ ID NO: 5918407 - DNA, 17 bp, Homo sapiens
ggatttattatataaat

SEQ ID NO: 5918408 - DNA, 15 bp, Homo sapiens
ggatttattcccttt

SEQ ID NO: 5918409 - DNA, 14 bp, Homo sapiens
ggatttatttttcc

SEQ ID NO: 5918410 - DNA, 23 bp, Homo sapiens
ggatttcaaacttaaacaaaaaa

SEQ ID NO: 5918411 - DNA, 20 bp, Homo sapiens
ggatttcactgtgttagcca

SEQ ID NO: 5918412 - DNA, 13 bp, Homo sapiens
ggatttccctgca

SEQ ID NO: 5918413 - DNA, 18 bp, Homo sapiens
ggatttcctagtggagtt

SEQ ID NO: 5918414 - DNA, 16 bp, Homo sapiens
ggatttcctattttaa

SEQ ID NO: 5918415 - DNA, 19 bp, Homo sapiens
ggatttcctattttaaaac

SEQ ID NO: 5918416 - DNA, 18 bp, Homo sapiens
ggatttctctttctctct

SEQ ID NO: 5918417 - DNA, 12 bp, Homo sapiens
ggatttcttgta

SEQ ID NO: 5918418 - DNA, 14 bp, Homo sapiens
ggatttgaaaacac

SEQ ID NO: 5918419 - DNA, 21 bp, Homo sapiens
ggatttgaaccaggccttctg

SEQ ID NO: 5918420 - DNA, 17 bp, Homo sapiens
ggatttgaactgagccg

SEQ ID NO: 5918421 - DNA, 16 bp, Homo sapiens
ggatttgacacactca

SEQ ID NO: 5918422 - DNA, 19 bp, Homo sapiens
ggatttgatgcttttctct

SEQ ID NO: 5918423 - DNA, 17 bp, Homo sapiens
ggatttgcactgcttta

SEQ ID NO: 5918424 - DNA, 16 bp, Homo sapiens
ggatttgcatatttat

SEQ ID NO: 5918425 - DNA, 14 bp, Homo sapiens
ggatttgctcctgg

SEQ ID NO: 5918426 - DNA, 17 bp, Homo sapiens
ggatttggagagaaata

SEQ ID NO: 5918427 - DNA, 22 bp, Homo sapiens
ggatttggccacactggggctg

SEQ ID NO: 5918428 - DNA, 16 bp, Homo sapiens
ggatttggctcgctgt

SEQ ID NO: 5918429 - DNA, 19 bp, Homo sapiens
ggatttgggttggaagtga

SEQ ID NO: 5918430 - DNA, 13 bp, Homo sapiens
ggatttggttgtt

SEQ ID NO: 5918431 - DNA, 17 bp, Homo sapiens
ggatttgtccaaacagg

SEQ ID NO: 5918432 - DNA, 12 bp, Homo sapiens
ggcacatttttt

SEQ ID NO: 5918433 - DNA, 22 bp, Homo sapiens
ggcaccaaaccctgtcctccca

SEQ ID NO: 5918434 - DNA, 10 bp, Homo sapiens
ggcaccaaag

SEQ ID NO: 5918435 - DNA, 19 bp, Homo sapiens
ggcaccaccaggagcagca

SEQ ID NO: 5918436 - DNA, 22 bp, Homo sapiens
ggcaccaccaggagcagcagcc

SEQ ID NO: 5918437 - DNA, 24 bp, Homo sapiens
ggcaccaccaggagcagcagccag

SEQ ID NO: 5918438 - DNA, 13 bp, Homo sapiens
ggcaccaccaggg

SEQ ID NO: 5918439 - DNA, 15 bp, Homo sapiens
ggcaccaccagggtg

SEQ ID NO: 5918440 - DNA, 23 bp, Homo sapiens
ggcaccactagggtcctggccct

SEQ ID NO: 5918441 - DNA, 13 bp, Homo sapiens
ggcaccagacacc

SEQ ID NO: 5918442 - DNA, 16 bp, Homo sapiens
ggcaccagacacccag

SEQ ID NO: 5918443 - DNA, 18 bp, Homo sapiens
ggcaccagacacccagga

SEQ ID NO: 5918444 - DNA, 13 bp, Homo sapiens
ggcaccagcagca

SEQ ID NO: 5918445 - DNA, 17 bp, Homo sapiens
ggcaccagcagcctgga

SEQ ID NO: 5918446 - DNA, 15 bp, Homo sapiens
ggcaccagcaggcac

SEQ ID NO: 5918447 - DNA, 18 bp, Homo sapiens
ggcaccagccccctggat

SEQ ID NO: 5918448 - DNA, 21 bp, Homo sapiens
ggcaccagggcattcgggcca

SEQ ID NO: 5918449 - DNA, 16 bp, Homo sapiens
ggcaccagtccagcaa

SEQ ID NO: 5918450 - DNA, 15 bp, Homo sapiens
ggcaccagtccctgt

SEQ ID NO: 5918451 - DNA, 15 bp, Homo sapiens
ggcaccatccagctc

SEQ ID NO: 5918452 - DNA, 14 bp, Homo sapiens
ggcaccatctgcca

SEQ ID NO: 5918453 - DNA, 16 bp, Homo sapiens
ggcacccacaaataaa

SEQ ID NO: 5918454 - DNA, 21 bp, Homo sapiens
ggcacccacacagaggacctc

SEQ ID NO: 5918455 - DNA, 15 bp, Homo sapiens
ggcacccacatcccc

SEQ ID NO: 5918456 - DNA, 16 bp, Homo sapiens
ggcacccaccactctc

SEQ ID NO: 5918457 - DNA, 23 bp, Homo sapiens
ggcacccaccatcatgtctggct

SEQ ID NO: 5918458 - DNA, 13 bp, Homo sapiens
ggcacccaccctg

SEQ ID NO: 5918459 - DNA, 14 bp, Homo sapiens
ggcacccaccctgg

SEQ ID NO: 5918460 - DNA, 11 bp, Homo sapiens
ggcacccaccg

SEQ ID NO: 5918461 - DNA, 20 bp, Homo sapiens
ggcacccaccgtctcggccc

SEQ ID NO: 5918462 - DNA, 19 bp, Homo sapiens
ggcacccatgtgggcgccc

SEQ ID NO: 5918463 - DNA, 17 bp, Homo sapiens
ggcaccccaggcagctc

SEQ ID NO: 5918464 - DNA, 16 bp, Homo sapiens
ggcacccccaaattca

SEQ ID NO: 5918465 - DNA, 22 bp, Homo sapiens
ggcacccccaaattcaaagaaa

SEQ ID NO: 5918466 - DNA, 20 bp, Homo sapiens
ggcacccccacaagctgtcc

SEQ ID NO: 5918467 - DNA, 13 bp, Homo sapiens
ggcacccccagcc

SEQ ID NO: 5918468 - DNA, 16 bp, Homo sapiens
ggcacccccagcctgg

SEQ ID NO: 5918469 - DNA, 18 bp, Homo sapiens
ggcacccccagcctgggc

SEQ ID NO: 5918470 - DNA, 20 bp, Homo sapiens
ggcacccccagcctgggcct

SEQ ID NO: 5918471 - DNA, 17 bp, Homo sapiens
ggcacccccatgctgcc

SEQ ID NO: 5918472 - DNA, 18 bp, Homo sapiens
ggcaccccctgcagcttg

SEQ ID NO: 5918473 - DNA, 14 bp, Homo sapiens
ggcaccccctggag

SEQ ID NO: 5918474 - DNA, 12 bp, Homo sapiens
ggcacccctgcc

SEQ ID NO: 5918475 - DNA, 18 bp, Homo sapiens
ggcaccccttgtttctgt

SEQ ID NO: 5918476 - DNA, 20 bp, Homo sapiens
ggcaccccttgtttctgttg

SEQ ID NO: 5918477 - DNA, 21 bp, Homo sapiens
ggcaccccttgtttctgttgt

SEQ ID NO: 5918478 - DNA, 15 bp, Homo sapiens
ggcacccggcccctg

SEQ ID NO: 5918479 - DNA, 13 bp, Homo sapiens
ggcaccctcaggg

SEQ ID NO: 5918480 - DNA, 16 bp, Homo sapiens
ggcaccctcagggagc

SEQ ID NO: 5918481 - DNA, 15 bp, Homo sapiens
ggcaccctgcaggca

SEQ ID NO: 5918482 - DNA, 19 bp, Homo sapiens
ggcaccctgtggccctggc

SEQ ID NO: 5918483 - DNA, 15 bp, Homo sapiens
ggcaccgaagcccag

SEQ ID NO: 5918484 - DNA, 16 bp, Homo sapiens
ggcaccgaagcccaga

SEQ ID NO: 5918485 - DNA, 22 bp, Homo sapiens
ggcaccgaagcccagagggtct

SEQ ID NO: 5918486 - DNA, 14 bp, Homo sapiens
ggcaccgcagcctg

SEQ ID NO: 5918487 - DNA, 19 bp, Homo sapiens
ggcaccgccacgtcccagc

SEQ ID NO: 5918488 - DNA, 21 bp, Homo sapiens
ggcaccgccagagtgtcctgc

SEQ ID NO: 5918489 - DNA, 14 bp, Homo sapiens
ggcaccgcccaccc

SEQ ID NO: 5918490 - DNA, 15 bp, Homo sapiens
ggcaccgcccaccca

SEQ ID NO: 5918491 - DNA, 21 bp, Homo sapiens
ggcaccgcccacccacacccc

SEQ ID NO: 5918492 - DNA, 22 bp, Homo sapiens
ggcaccgcccacccacaccccg

SEQ ID NO: 5918493 - DNA, 18 bp, Homo sapiens
ggcaccgcctgcccccag

SEQ ID NO: 5918494 - DNA, 23 bp, Homo sapiens
ggcaccggacgctggagaccctg

SEQ ID NO: 5918495 - DNA, 17 bp, Homo sapiens
ggcaccgggaccccctc

SEQ ID NO: 5918496 - DNA, 14 bp, Homo sapiens
ggcaccgggctcca

SEQ ID NO: 5918497 - DNA, 23 bp, Homo sapiens
ggcaccgggctccatgcctctgg

SEQ ID NO: 5918498 - DNA, 17 bp, Homo sapiens
ggcaccgtccaggcccc

SEQ ID NO: 5918499 - DNA, 15 bp, Homo sapiens
ggcaccgttatccct

SEQ ID NO: 5918500 - DNA, 20 bp, Homo sapiens
ggcaccgttatccctgcaca

SEQ ID NO: 5918501 - DNA, 12 bp, Homo sapiens
ggcacctaaact

SEQ ID NO: 5918502 - DNA, 18 bp, Homo sapiens
ggcacctaatccaggcag

SEQ ID NO: 5918503 - DNA, 21 bp, Homo sapiens
ggcacctacatccccaggtct

SEQ ID NO: 5918504 - DNA, 22 bp, Homo sapiens
ggcacctatagtcccagctact

SEQ ID NO: 5918505 - DNA, 18 bp, Homo sapiens
ggcacctatgtggcatgt

SEQ ID NO: 5918506 - DNA, 23 bp, Homo sapiens
ggcacctcaacatttcagtgttt

SEQ ID NO: 5918507 - DNA, 17 bp, Homo sapiens
ggcacctcagacaatcc

SEQ ID NO: 5918508 - DNA, 23 bp, Homo sapiens
ggcacctcagacaatccactctc

SEQ ID NO: 5918509 - DNA, 14 bp, Homo sapiens
ggcacctccaggca

SEQ ID NO: 5918510 - DNA, 22 bp, Homo sapiens
ggcacctccccgctctccctgt

SEQ ID NO: 5918511 - DNA, 14 bp, Homo sapiens
ggcacctcctgaga

SEQ ID NO: 5918512 - DNA, 18 bp, Homo sapiens
ggcacctcggggacacca

SEQ ID NO: 5918513 - DNA, 20 bp, Homo sapiens
ggcacctcggggacaccaga

SEQ ID NO: 5918514 - DNA, 17 bp, Homo sapiens
ggcacctctcttgaacc

SEQ ID NO: 5918515 - DNA, 20 bp, Homo sapiens
ggcacctgcacactccatct

SEQ ID NO: 5918516 - DNA, 11 bp, Homo sapiens
ggcacctgcca

SEQ ID NO: 5918517 - DNA, 14 bp, Homo sapiens
ggcacctgccaccg

SEQ ID NO: 5918518 - DNA, 16 bp, Homo sapiens
ggcacctgccaccgcc

SEQ ID NO: 5918519 - DNA, 17 bp, Homo sapiens
ggcacctgccaccgcca

SEQ ID NO: 5918520 - DNA, 19 bp, Homo sapiens
ggcacctgccaccgccaga

SEQ ID NO: 5918521 - DNA, 16 bp, Homo sapiens
ggcacctgcccccaca

SEQ ID NO: 5918522 - DNA, 20 bp, Homo sapiens
ggcacctgcccccacagctc

SEQ ID NO: 5918523 - DNA, 12 bp, Homo sapiens
ggcacctgctgg

SEQ ID NO: 5918524 - DNA, 13 bp, Homo sapiens
ggcacctggcctg

SEQ ID NO: 5918525 - DNA, 16 bp, Homo sapiens
ggcacctggcctgctg

SEQ ID NO: 5918526 - DNA, 12 bp, Homo sapiens
ggcacctgggaa

SEQ ID NO: 5918527 - DNA, 19 bp, Homo sapiens
ggcacctgggaaaacagag

SEQ ID NO: 5918528 - DNA, 20 bp, Homo sapiens
ggcacctgggaaaacagagg

SEQ ID NO: 5918529 - DNA, 22 bp, Homo sapiens
ggcacctgggaaaacagaggaa

SEQ ID NO: 5918530 - DNA, 13 bp, Homo sapiens
ggcacctgggccc

SEQ ID NO: 5918531 - DNA, 23 bp, Homo sapiens
ggcacctgggccctggggcctgt

SEQ ID NO: 5918532 - DNA, 17 bp, Homo sapiens
ggcacctggggagtggg

SEQ ID NO: 5918533 - DNA, 20 bp, Homo sapiens
ggcacctgtagtcccagcta

SEQ ID NO: 5918534 - DNA, 13 bp, Homo sapiens
ggcacctgtctgc

SEQ ID NO: 5918535 - DNA, 13 bp, Homo sapiens
ggcacctgtttcc

SEQ ID NO: 5918536 - DNA, 22 bp, Homo sapiens
ggcaccttaactggagaccaga

SEQ ID NO: 5918537 - DNA, 16 bp, Homo sapiens
ggcaccttttactgtg

SEQ ID NO: 5918538 - DNA, 18 bp, Homo sapiens
ggcacgaaatggctgaag

SEQ ID NO: 5918539 - DNA, 18 bp, Homo sapiens
ggcacgaacccacctgct

SEQ ID NO: 5918540 - DNA, 19 bp, Homo sapiens
ggcacgaacccacctgctg

SEQ ID NO: 5918541 - DNA, 17 bp, Homo sapiens
ggcacgaggctctagaa

SEQ ID NO: 5918542 - DNA, 13 bp, Homo sapiens
ggcacgcacttgc

SEQ ID NO: 5918543 - DNA, 15 bp, Homo sapiens
ggcacgcacttgcct

SEQ ID NO: 5918544 - DNA, 21 bp, Homo sapiens
ggcacgccctactccactgcc

SEQ ID NO: 5918545 - DNA, 16 bp, Homo sapiens
ggcacgccctcctcag

SEQ ID NO: 5918546 - DNA, 14 bp, Homo sapiens
ggcacgcctgctgg

SEQ ID NO: 5918547 - DNA, 15 bp, Homo sapiens
ggcacgctcctgcct

SEQ ID NO: 5918548 - DNA, 13 bp, Homo sapiens
ggcacgctgtggg

SEQ ID NO: 5918549 - DNA, 13 bp, Homo sapiens
ggcacggcaggcg

SEQ ID NO: 5918550 - DNA, 14 bp, Homo sapiens
ggcacggctctggg

SEQ ID NO: 5918551 - DNA, 12 bp, Homo sapiens
ggcacgggcctg

SEQ ID NO: 5918552 - DNA, 16 bp, Homo sapiens
ggcacggggacctgga

SEQ ID NO: 5918553 - DNA, 14 bp, Homo sapiens
ggcacgggtggtcc

SEQ ID NO: 5918554 - DNA, 17 bp, Homo sapiens
ggcacgggtggtccccg

SEQ ID NO: 5918555 - DNA, 20 bp, Homo sapiens
ggcacggtggctcacacctg

SEQ ID NO: 5918556 - DNA, 15 bp, Homo sapiens
ggcacgtaatttttt

SEQ ID NO: 5918557 - DNA, 15 bp, Homo sapiens
ggcacgtcccatgtg

SEQ ID NO: 5918558 - DNA, 16 bp, Homo sapiens
ggcacgtcctccaccg

SEQ ID NO: 5918559 - DNA, 21 bp, Homo sapiens
ggcacgtcgcccgctgagctg

SEQ ID NO: 5918560 - DNA, 15 bp, Homo sapiens
ggcacgtctcctgct

SEQ ID NO: 5918561 - DNA, 14 bp, Homo sapiens
ggcacgtggccagg

SEQ ID NO: 5918562 - DNA, 13 bp, Homo sapiens
ggcacgtgtgggc

SEQ ID NO: 5918563 - DNA, 18 bp, Homo sapiens
ggcactaaaatgtttaat

SEQ ID NO: 5918564 - DNA, 20 bp, Homo sapiens
ggcactaaaatgtttaattc

SEQ ID NO: 5918565 - DNA, 19 bp, Homo sapiens
ggcactaaaccacttctct

SEQ ID NO: 5918566 - DNA, 15 bp, Homo sapiens
ggcactagcctttgg

SEQ ID NO: 5918567 - DNA, 21 bp, Homo sapiens
ggcactagcctttggctctgg

SEQ ID NO: 5918568 - DNA, 17 bp, Homo sapiens
ggcactagctagatgct

SEQ ID NO: 5918569 - DNA, 23 bp, Homo sapiens
ggcactaggtaggcttctacctg

SEQ ID NO: 5918570 - DNA, 15 bp, Homo sapiens
ggcactatttattta

SEQ ID NO: 5918571 - DNA, 14 bp, Homo sapiens
ggcactatttttat

SEQ ID NO: 5918572 - DNA, 18 bp, Homo sapiens
ggcactcaatgcagccag

SEQ ID NO: 5918573 - DNA, 22 bp, Homo sapiens
ggcactcacagacctggagccc

SEQ ID NO: 5918574 - DNA, 18 bp, Homo sapiens
ggcactcagaagacactg

SEQ ID NO: 5918575 - DNA, 14 bp, Homo sapiens
ggcactcagccacg

SEQ ID NO: 5918576 - DNA, 18 bp, Homo sapiens
ggcactcagccacgacca

SEQ ID NO: 5918577 - DNA, 20 bp, Homo sapiens
ggcactcagccacgaccagc

SEQ ID NO: 5918578 - DNA, 22 bp, Homo sapiens
ggcactcccaggcccctgcccc

SEQ ID NO: 5918579 - DNA, 23 bp, Homo sapiens
ggcactccgcgccgatgccaccg

SEQ ID NO: 5918580 - DNA, 21 bp, Homo sapiens
ggcactctcatcaccccagag

SEQ ID NO: 5918581 - DNA, 17 bp, Homo sapiens
ggcactctctgccagct

SEQ ID NO: 5918582 - DNA, 23 bp, Homo sapiens
ggcactctctgccattctgtgca

SEQ ID NO: 5918583 - DNA, 19 bp, Homo sapiens
ggcactctgttcccctccc

SEQ ID NO: 5918584 - DNA, 22 bp, Homo sapiens
ggcactctgttcccctccccct

SEQ ID NO: 5918585 - DNA, 15 bp, Homo sapiens
ggcactgacagcctg

SEQ ID NO: 5918586 - DNA, 16 bp, Homo sapiens
ggcactgacagcctgg

SEQ ID NO: 5918587 - DNA, 18 bp, Homo sapiens
ggcactgacagcctgggg

SEQ ID NO: 5918588 - DNA, 19 bp, Homo sapiens
ggcactgacagcctggggg

SEQ ID NO: 5918589 - DNA, 17 bp, Homo sapiens
ggcactgaccaggccca

SEQ ID NO: 5918590 - DNA, 15 bp, Homo sapiens
ggcactgactgatag

SEQ ID NO: 5918591 - DNA, 17 bp, Homo sapiens
ggcactgagatatttat

SEQ ID NO: 5918592 - DNA, 21 bp, Homo sapiens
ggcactgagatttaaatgcaa

SEQ ID NO: 5918593 - DNA, 13 bp, Homo sapiens
ggcactgagcagg

SEQ ID NO: 5918594 - DNA, 15 bp, Homo sapiens
ggcactgagcaggga

SEQ ID NO: 5918595 - DNA, 12 bp, Homo sapiens
ggcactgagccc

SEQ ID NO: 5918596 - DNA, 13 bp, Homo sapiens
ggcactgagcccc

SEQ ID NO: 5918597 - DNA, 22 bp, Homo sapiens
ggcactgatgggcactggaaaa

SEQ ID NO: 5918598 - DNA, 17 bp, Homo sapiens
ggcactgcagtctgcag

SEQ ID NO: 5918599 - DNA, 12 bp, Homo sapiens
ggcactgccagc

SEQ ID NO: 5918600 - DNA, 13 bp, Homo sapiens
ggcactgccagcc

SEQ ID NO: 5918601 - DNA, 15 bp, Homo sapiens
ggcactgccagccca

SEQ ID NO: 5918602 - DNA, 14 bp, Homo sapiens
ggcactgccctggt

SEQ ID NO: 5918603 - DNA, 21 bp, Homo sapiens
ggcactgccttctcctctctg

SEQ ID NO: 5918604 - DNA, 17 bp, Homo sapiens
ggcactgcgccacctgc

SEQ ID NO: 5918605 - DNA, 16 bp, Homo sapiens
ggcactgctgggtggc

SEQ ID NO: 5918606 - DNA, 22 bp, Homo sapiens
ggcactgctgggtggcccatcc

SEQ ID NO: 5918607 - DNA, 16 bp, Homo sapiens
ggcactgctgtgctgt

SEQ ID NO: 5918608 - DNA, 24 bp, Homo sapiens
ggcactgcttccagtgaggctctg

SEQ ID NO: 5918609 - DNA, 20 bp, Homo sapiens
ggcactgcttgaggaggggc

SEQ ID NO: 5918610 - DNA, 21 bp, Homo sapiens
ggcactgcttgaggaggggca

SEQ ID NO: 5918611 - DNA, 13 bp, Homo sapiens
ggcagagggctgg

SEQ ID NO: 5918612 - DNA, 20 bp, Homo sapiens
ggcagagggctggaggccca

SEQ ID NO: 5918613 - DNA, 13 bp, Homo sapiens
ggcagaggggaga

SEQ ID NO: 5918614 - DNA, 20 bp, Homo sapiens
ggcagaggggagaggaagca

SEQ ID NO: 5918615 - DNA, 16 bp, Homo sapiens
ggcagaggtggtctgg

SEQ ID NO: 5918616 - DNA, 14 bp, Homo sapiens
ggcagaggttgcag

SEQ ID NO: 5918617 - DNA, 21 bp, Homo sapiens
ggcagaggttgtggtgagccg

SEQ ID NO: 5918618 - DNA, 14 bp, Homo sapiens
ggcagagtcctgcc

SEQ ID NO: 5918619 - DNA, 18 bp, Homo sapiens
ggcagagtcgttggagac

SEQ ID NO: 5918620 - DNA, 23 bp, Homo sapiens
ggcagagtgagactcgtctcaaa

SEQ ID NO: 5918621 - DNA, 18 bp, Homo sapiens
ggcagagtggagcccagg

SEQ ID NO: 5918622 - DNA, 21 bp, Homo sapiens
ggcagagtggagcccagggtg

SEQ ID NO: 5918623 - DNA, 19 bp, Homo sapiens
ggcagagtggcctgtgagc

SEQ ID NO: 5918624 - DNA, 21 bp, Homo sapiens
ggcagagtggcctgtgagcaa

SEQ ID NO: 5918625 - DNA, 14 bp, Homo sapiens
ggcagagtgggctg

SEQ ID NO: 5918626 - DNA, 19 bp, Homo sapiens
ggcagagttacagttctgt

SEQ ID NO: 5918627 - DNA, 14 bp, Homo sapiens
ggcagagttacttg

SEQ ID NO: 5918628 - DNA, 21 bp, Homo sapiens
ggcagagttgaagacagagct

SEQ ID NO: 5918629 - DNA, 14 bp, Homo sapiens
ggcagagttgtaaa

SEQ ID NO: 5918630 - DNA, 16 bp, Homo sapiens
ggcagagttgtaaata

SEQ ID NO: 5918631 - DNA, 17 bp, Homo sapiens
ggcagataactgctgta

SEQ ID NO: 5918632 - DNA, 18 bp, Homo sapiens
ggcagataatcagcctct

SEQ ID NO: 5918633 - DNA, 21 bp, Homo sapiens
ggcagatatagcattaataaa

SEQ ID NO: 5918634 - DNA, 22 bp, Homo sapiens
ggcagatatagcattaataaaa

SEQ ID NO: 5918635 - DNA, 18 bp, Homo sapiens
ggcagatcaccagaggtc

SEQ ID NO: 5918636 - DNA, 18 bp, Homo sapiens
ggcagatcacctgaggtc

SEQ ID NO: 5918637 - DNA, 20 bp, Homo sapiens
ggcagatcatttgaggccag

SEQ ID NO: 5918638 - DNA, 14 bp, Homo sapiens
ggcagatccaggac

SEQ ID NO: 5918639 - DNA, 15 bp, Homo sapiens
ggcagatctgtgccc

SEQ ID NO: 5918640 - DNA, 22 bp, Homo sapiens
ggcagatgatttgggcagagcg

SEQ ID NO: 5918641 - DNA, 21 bp, Homo sapiens
ggcagatgcagctcttcctgg

SEQ ID NO: 5918642 - DNA, 14 bp, Homo sapiens
ggcagatgcccttg

SEQ ID NO: 5918643 - DNA, 19 bp, Homo sapiens
ggcagatgcccttgctggg

SEQ ID NO: 5918644 - DNA, 21 bp, Homo sapiens
ggcagatgcccttgctgggcc

SEQ ID NO: 5918645 - DNA, 23 bp, Homo sapiens
ggcagatgcccttgctgggcctg

SEQ ID NO: 5918646 - DNA, 14 bp, Homo sapiens
ggcagatgggcctg

SEQ ID NO: 5918647 - DNA, 20 bp, Homo sapiens
ggcagatgtaggagggactg

SEQ ID NO: 5918648 - DNA, 15 bp, Homo sapiens
ggcagatgtccccca

SEQ ID NO: 5918649 - DNA, 20 bp, Homo sapiens
ggcagatgtcccccactgct

SEQ ID NO: 5918650 - DNA, 21 bp, Homo sapiens
ggcagatgtcttccctgggct

SEQ ID NO: 5918651 - DNA, 22 bp, Homo sapiens
ggcagatgtggggctgagctgg

SEQ ID NO: 5918652 - DNA, 17 bp, Homo sapiens
ggcagattgttttttcc

SEQ ID NO: 5918653 - DNA, 19 bp, Homo sapiens
ggcagatttactgtcccag

SEQ ID NO: 5918654 - DNA, 23 bp, Homo sapiens
ggcagatttccattttttgtatt

SEQ ID NO: 5918655 - DNA, 19 bp, Homo sapiens
ggcagatttgtggggacct

SEQ ID NO: 5918656 - DNA, 16 bp, Homo sapiens
ggcagattttacaaaa

SEQ ID NO: 5918657 - DNA, 21 bp, Homo sapiens
ggcagattttacagagcgcac

SEQ ID NO: 5918658 - DNA, 16 bp, Homo sapiens
ggcagcaacaggacca

SEQ ID NO: 5918659 - DNA, 17 bp, Homo sapiens
ggcagcaacaggaccag

SEQ ID NO: 5918660 - DNA, 19 bp, Homo sapiens
ggcagcaacaggaccagga

SEQ ID NO: 5918661 - DNA, 20 bp, Homo sapiens
ggcagcaacaggaccaggag

SEQ ID NO: 5918662 - DNA, 18 bp, Homo sapiens
ggcagcaaggcagtgagc

SEQ ID NO: 5918663 - DNA, 16 bp, Homo sapiens
ggcagcaaggcccgag

SEQ ID NO: 5918664 - DNA, 18 bp, Homo sapiens
ggcagcaaggcccgagca

SEQ ID NO: 5918665 - DNA, 19 bp, Homo sapiens
ggcagcaaggcccgagcag

SEQ ID NO: 5918666 - DNA, 23 bp, Homo sapiens
ggcagcaaggcccgagcagctga

SEQ ID NO: 5918667 - DNA, 13 bp, Homo sapiens
ggcagcaaggcct

SEQ ID NO: 5918668 - DNA, 16 bp, Homo sapiens
ggcagcaaggctgctg

SEQ ID NO: 5918669 - DNA, 18 bp, Homo sapiens
ggcagcaaggctgctgcc

SEQ ID NO: 5918670 - DNA, 22 bp, Homo sapiens
ggcagcaaggctgctgccggaa

SEQ ID NO: 5918671 - DNA, 16 bp, Homo sapiens
ggcagcaagggacctg

SEQ ID NO: 5918672 - DNA, 20 bp, Homo sapiens
ggcagcaagggacctgctca

SEQ ID NO: 5918673 - DNA, 17 bp, Homo sapiens
ggcagcaattcacgctg

SEQ ID NO: 5918674 - DNA, 14 bp, Homo sapiens
ggcagcacagagac

SEQ ID NO: 5918675 - DNA, 21 bp, Homo sapiens
ggcagcacagagacccccgga

SEQ ID NO: 5918676 - DNA, 16 bp, Homo sapiens
ggcagcacccactcag

SEQ ID NO: 5918677 - DNA, 14 bp, Homo sapiens
ggcagcaccctccc

SEQ ID NO: 5918678 - DNA, 15 bp, Homo sapiens
ggcagcaccctcccc

SEQ ID NO: 5918679 - DNA, 16 bp, Homo sapiens
ggcagcaccctccccc

SEQ ID NO: 5918680 - DNA, 19 bp, Homo sapiens
ggcagcaccctcccccgca

SEQ ID NO: 5918681 - DNA, 21 bp, Homo sapiens
ggcagcaccgcagcctctgcc

SEQ ID NO: 5918682 - DNA, 16 bp, Homo sapiens
ggcagcacctccggga

SEQ ID NO: 5918683 - DNA, 13 bp, Homo sapiens
ggcagcacctctg

SEQ ID NO: 5918684 - DNA, 22 bp, Homo sapiens
ggcagcacctctggtcaggagg

SEQ ID NO: 5918685 - DNA, 15 bp, Homo sapiens
ggcagcacctggagc

SEQ ID NO: 5918686 - DNA, 21 bp, Homo sapiens
ggcagcacctgtctcctttca

SEQ ID NO: 5918687 - DNA, 13 bp, Homo sapiens
ggcagcactggga

SEQ ID NO: 5918688 - DNA, 16 bp, Homo sapiens
ggcagcagacacatgc

SEQ ID NO: 5918689 - DNA, 14 bp, Homo sapiens
ggcagcagactgtg

SEQ ID NO: 5918690 - DNA, 14 bp, Homo sapiens
ggcagcagcagccc

SEQ ID NO: 5918691 - DNA, 15 bp, Homo sapiens
ggcagcagcatccca

SEQ ID NO: 5918692 - DNA, 13 bp, Homo sapiens
ggcagcagccagc

SEQ ID NO: 5918693 - DNA, 16 bp, Homo sapiens
ggcagcagccagccct

SEQ ID NO: 5918694 - DNA, 20 bp, Homo sapiens
ggcagcagccagccctgcct

SEQ ID NO: 5918695 - DNA, 14 bp, Homo sapiens
ggcagcagccccca

SEQ ID NO: 5918696 - DNA, 16 bp, Homo sapiens
ggcagcagctcagcct

SEQ ID NO: 5918697 - DNA, 13 bp, Homo sapiens
ggcagcaggagcc

SEQ ID NO: 5918698 - DNA, 19 bp, Homo sapiens
ggcagcaggcatggcttcc

SEQ ID NO: 5918699 - DNA, 12 bp, Homo sapiens
ggcagcaggcca

SEQ ID NO: 5918700 - DNA, 14 bp, Homo sapiens
ggcagcaggccaga

SEQ ID NO: 5918701 - DNA, 20 bp, Homo sapiens
ggcagcaggccagagaaagc

SEQ ID NO: 5918702 - DNA, 15 bp, Homo sapiens
ggcagcaggggctgc

SEQ ID NO: 5918703 - DNA, 15 bp, Homo sapiens
ggcagcaggggttgg

SEQ ID NO: 5918704 - DNA, 12 bp, Homo sapiens
ggcagcagtgaa

SEQ ID NO: 5918705 - DNA, 13 bp, Homo sapiens
ggcagcagtgggg

SEQ ID NO: 5918706 - DNA, 19 bp, Homo sapiens
ggcagcagtgtgaggccag

SEQ ID NO: 5918707 - DNA, 20 bp, Homo sapiens
ggcagcagtgtgaggccagg

SEQ ID NO: 5918708 - DNA, 15 bp, Homo sapiens
ggcagcagttgaggt

SEQ ID NO: 5918709 - DNA, 17 bp, Homo sapiens
ggcagcatccccttgaa

SEQ ID NO: 5918710 - DNA, 17 bp, Homo sapiens
ggcagcatcctccaaaa

SEQ ID NO: 5918711 - DNA, 23 bp, Homo sapiens
ggcagcatcggggtggcccactg

SEQ ID NO: 5918712 - DNA, 23 bp, Homo sapiens
ggcagcatgcaaacttggatcag

SEQ ID NO: 5918713 - DNA, 20 bp, Homo sapiens
ggcagcatgcacggaggcgg

SEQ ID NO: 5918714 - DNA, 20 bp, Homo sapiens
ggcagcatgcgatgtcatat

SEQ ID NO: 5918715 - DNA, 14 bp, Homo sapiens
ggcagcatggagac

SEQ ID NO: 5918716 - DNA, 17 bp, Homo sapiens
ggcagcatggagagagg

SEQ ID NO: 5918717 - DNA, 20 bp, Homo sapiens
ggcagccaaacccatgaggc

SEQ ID NO: 5918718 - DNA, 12 bp, Homo sapiens
ggcagccaagga

SEQ ID NO: 5918719 - DNA, 22 bp, Homo sapiens
ggcagccacacgcaggcggcca

SEQ ID NO: 5918720 - DNA, 12 bp, Homo sapiens
ggcagccacagg

SEQ ID NO: 5918721 - DNA, 19 bp, Homo sapiens
ggcagccacaggactgagc

SEQ ID NO: 5918722 - DNA, 23 bp, Homo sapiens
ggcagccacaggactgagccctc

SEQ ID NO: 5918723 - DNA, 14 bp, Homo sapiens
ggcagccacaggga

SEQ ID NO: 5918724 - DNA, 16 bp, Homo sapiens
ggcagccacccaagcc

SEQ ID NO: 5918725 - DNA, 22 bp, Homo sapiens
ggcagccacccaagcctgctgg

SEQ ID NO: 5918726 - DNA, 14 bp, Homo sapiens
ggcagccaccctgc

SEQ ID NO: 5918727 - DNA, 19 bp, Homo sapiens
ggcagccacggccccgggt

SEQ ID NO: 5918728 - DNA, 21 bp, Homo sapiens
ggcagccagatccccagggca

SEQ ID NO: 5918729 - DNA, 19 bp, Homo sapiens
ggcagccagcatctgggcc

SEQ ID NO: 5918730 - DNA, 17 bp, Homo sapiens
ggcagccaggccacaag

SEQ ID NO: 5918731 - DNA, 13 bp, Homo sapiens
ggcagccaggctg

SEQ ID NO: 5918732 - DNA, 15 bp, Homo sapiens
ggcagccaggctgcc

SEQ ID NO: 5918733 - DNA, 19 bp, Homo sapiens
ggcagccaggctgccaagg

SEQ ID NO: 5918734 - DNA, 19 bp, Homo sapiens
ggcagccagtgccctgagc

SEQ ID NO: 5918735 - DNA, 23 bp, Homo sapiens
ggcagccagtgccctgagccagg

SEQ ID NO: 5918736 - DNA, 14 bp, Homo sapiens
ggcagccatgagaa

SEQ ID NO: 5918737 - DNA, 12 bp, Homo sapiens
ggcagccatgcc

SEQ ID NO: 5918738 - DNA, 21 bp, Homo sapiens
ggcagccattggcctctgtct

SEQ ID NO: 5918739 - DNA, 15 bp, Homo sapiens
ggcagcccactgcac

SEQ ID NO: 5918740 - DNA, 22 bp, Homo sapiens
ggcagcccactgcaccgcctca

SEQ ID NO: 5918741 - DNA, 21 bp, Homo sapiens
ggcagcccagagactttgtag

SEQ ID NO: 5918742 - DNA, 14 bp, Homo sapiens
ggcagcccagccag

SEQ ID NO: 5918743 - DNA, 15 bp, Homo sapiens
ggcagcccagccagc

SEQ ID NO: 5918744 - DNA, 16 bp, Homo sapiens
ggcagccccacagtcc

SEQ ID NO: 5918745 - DNA, 22 bp, Homo sapiens
ggcagccccacagtcccattcc

SEQ ID NO: 5918746 - DNA, 21 bp, Homo sapiens
ggcagccccacttcaccccca

SEQ ID NO: 5918747 - DNA, 16 bp, Homo sapiens
ggcagccccagagaga

SEQ ID NO: 5918748 - DNA, 19 bp, Homo sapiens
ggcagccccagagagagga

SEQ ID NO: 5918749 - DNA, 14 bp, Homo sapiens
ggcagccccagcac

SEQ ID NO: 5918750 - DNA, 15 bp, Homo sapiens
ggcagccccagcctg

SEQ ID NO: 5918751 - DNA, 19 bp, Homo sapiens
ggcagccccagcctgctag

SEQ ID NO: 5918752 - DNA, 15 bp, Homo sapiens
ggcagccccatcctt

SEQ ID NO: 5918753 - DNA, 21 bp, Homo sapiens
ggcagccccatccttcccgca

SEQ ID NO: 5918754 - DNA, 22 bp, Homo sapiens
ggcagccccatccttcccgcag

SEQ ID NO: 5918755 - DNA, 16 bp, Homo sapiens
ggcagccccattctgc

SEQ ID NO: 5918756 - DNA, 22 bp, Homo sapiens
ggcagccccattctgcctgccc

SEQ ID NO: 5918757 - DNA, 18 bp, Homo sapiens
ggcagccccccagtgtcc

SEQ ID NO: 5918758 - DNA, 23 bp, Homo sapiens
ggcagccccccagtgtccccagg

SEQ ID NO: 5918759 - DNA, 16 bp, Homo sapiens
ggcagcccccccctca

SEQ ID NO: 5918760 - DNA, 19 bp, Homo sapiens
ggcagcccccccctcaagg

SEQ ID NO: 5918761 - DNA, 20 bp, Homo sapiens
ggcagcccccccctcaaggg

SEQ ID NO: 5918762 - DNA, 20 bp, Homo sapiens
ggcagccccgcgaccacccc

SEQ ID NO: 5918763 - DNA, 11 bp, Homo sapiens
ggcagcccctc

SEQ ID NO: 5918764 - DNA, 15 bp, Homo sapiens
ggcagcccctcccca

SEQ ID NO: 5918765 - DNA, 13 bp, Homo sapiens
ggcagcccctgca

SEQ ID NO: 5918766 - DNA, 14 bp, Homo sapiens
ggcagcccctgctg

SEQ ID NO: 5918767 - DNA, 15 bp, Homo sapiens
ggcagcccctgctgg

SEQ ID NO: 5918768 - DNA, 16 bp, Homo sapiens
ggcagcccctgttttc

SEQ ID NO: 5918769 - DNA, 21 bp, Homo sapiens
ggcagcccctgttttctgctg

SEQ ID NO: 5918770 - DNA, 22 bp, Homo sapiens
ggcagcccctgttttctgctgt

SEQ ID NO: 5918771 - DNA, 14 bp, Homo sapiens
ggcagccccttctg

SEQ ID NO: 5918772 - DNA, 17 bp, Homo sapiens
ggcagccccttctggcc

SEQ ID NO: 5918773 - DNA, 18 bp, Homo sapiens
ggcagcccggctgctgct

SEQ ID NO: 5918774 - DNA, 21 bp, Homo sapiens
ggcagcccggctgctgcttgg

SEQ ID NO: 5918775 - DNA, 22 bp, Homo sapiens
ggcagcccggctgctgcttgga

SEQ ID NO: 5918776 - DNA, 14 bp, Homo sapiens
ggcagccctcacct

SEQ ID NO: 5918777 - DNA, 16 bp, Homo sapiens
ggcagccctccttacc

SEQ ID NO: 5918778 - DNA, 13 bp, Homo sapiens
ggcagccgagctc

SEQ ID NO: 5918779 - DNA, 15 bp, Homo sapiens
ggcagccgaggcctg

SEQ ID NO: 5918780 - DNA, 19 bp, Homo sapiens
ggcagccgcggtgcccaac

SEQ ID NO: 5918781 - DNA, 15 bp, Homo sapiens
ggcagccgtcccagg

SEQ ID NO: 5918782 - DNA, 18 bp, Homo sapiens
ggcagccgtgccttcagc

SEQ ID NO: 5918783 - DNA, 21 bp, Homo sapiens
ggcagccgtgccttcagctct

SEQ ID NO: 5918784 - DNA, 22 bp, Homo sapiens
ggcagccgtgccttcagctcta

SEQ ID NO: 5918785 - DNA, 22 bp, Homo sapiens
ggcagcctactagggacctggg

SEQ ID NO: 5918786 - DNA, 16 bp, Homo sapiens
ggcagcctagcctatg

SEQ ID NO: 5918787 - DNA, 15 bp, Homo sapiens
ggcagcctcaacctc

SEQ ID NO: 5918788 - DNA, 20 bp, Homo sapiens
ggcaggtagatcgcttgagc

SEQ ID NO: 5918789 - DNA, 21 bp, Homo sapiens
ggcaggtagatcgcttgagcc

SEQ ID NO: 5918790 - DNA, 24 bp, Homo sapiens
ggcaggtagatcgcttgagcccag

SEQ ID NO: 5918791 - DNA, 14 bp, Homo sapiens
ggcaggtagccagg

SEQ ID NO: 5918792 - DNA, 16 bp, Homo sapiens
ggcaggtccagctctg

SEQ ID NO: 5918793 - DNA, 13 bp, Homo sapiens
ggcaggtccaggg

SEQ ID NO: 5918794 - DNA, 19 bp, Homo sapiens
ggcaggtccccagactcca

SEQ ID NO: 5918795 - DNA, 18 bp, Homo sapiens
ggcaggtcccgagccccc

SEQ ID NO: 5918796 - DNA, 19 bp, Homo sapiens
ggcaggtcccgagccccct

SEQ ID NO: 5918797 - DNA, 18 bp, Homo sapiens
ggcaggtcctggggaggc

SEQ ID NO: 5918798 - DNA, 20 bp, Homo sapiens
ggcaggtcctggggaggctg

SEQ ID NO: 5918799 - DNA, 20 bp, Homo sapiens
ggcaggtcgggctgccagcc

SEQ ID NO: 5918800 - DNA, 19 bp, Homo sapiens
ggcaggtgacagtgaggtc

SEQ ID NO: 5918801 - DNA, 12 bp, Homo sapiens
ggcaggtgcaga

SEQ ID NO: 5918802 - DNA, 19 bp, Homo sapiens
ggcaggtgcagatgggctg

SEQ ID NO: 5918803 - DNA, 22 bp, Homo sapiens
ggcaggtgccatgtctgggaac

SEQ ID NO: 5918804 - DNA, 15 bp, Homo sapiens
ggcaggtgcctccag

SEQ ID NO: 5918805 - DNA, 16 bp, Homo sapiens
ggcaggtgcctccagg

SEQ ID NO: 5918806 - DNA, 21 bp, Homo sapiens
ggcaggtgcctccaggtgtgc

SEQ ID NO: 5918807 - DNA, 19 bp, Homo sapiens
ggcaggtgctggagcactg

SEQ ID NO: 5918808 - DNA, 21 bp, Homo sapiens
ggcaggtggacgctgcagacc

SEQ ID NO: 5918809 - DNA, 16 bp, Homo sapiens
ggcaggtggccacagc

SEQ ID NO: 5918810 - DNA, 13 bp, Homo sapiens
ggcaggtggccag

SEQ ID NO: 5918811 - DNA, 14 bp, Homo sapiens
ggcaggtggccagg

SEQ ID NO: 5918812 - DNA, 20 bp, Homo sapiens
ggcaggtggccgcccctgag

SEQ ID NO: 5918813 - DNA, 17 bp, Homo sapiens
ggcaggtggcctctgct

SEQ ID NO: 5918814 - DNA, 19 bp, Homo sapiens
ggcaggtggcctctgctgg

SEQ ID NO: 5918815 - DNA, 12 bp, Homo sapiens
ggcaggtgggag

SEQ ID NO: 5918816 - DNA, 15 bp, Homo sapiens
ggcaggtgggagctg

SEQ ID NO: 5918817 - DNA, 14 bp, Homo sapiens
ggcaggtgggcaga

SEQ ID NO: 5918818 - DNA, 15 bp, Homo sapiens
ggcaggtgggcagac

SEQ ID NO: 5918819 - DNA, 23 bp, Homo sapiens
ggcaggtgggctgcctgctgtgt

SEQ ID NO: 5918820 - DNA, 17 bp, Homo sapiens
ggcaggtggtggcactg

SEQ ID NO: 5918821 - DNA, 21 bp, Homo sapiens
ggcaggtggtggcactgagcc

SEQ ID NO: 5918822 - DNA, 17 bp, Homo sapiens
ggcaggtgtgggctccc

SEQ ID NO: 5918823 - DNA, 23 bp, Homo sapiens
ggcaggtgtgggctcccacgccc

SEQ ID NO: 5918824 - DNA, 16 bp, Homo sapiens
ggcaggttagaaccta

SEQ ID NO: 5918825 - DNA, 21 bp, Homo sapiens
ggcaggttcctggggccgcct

SEQ ID NO: 5918826 - DNA, 14 bp, Homo sapiens
ggcaggttgatcag

SEQ ID NO: 5918827 - DNA, 20 bp, Homo sapiens
ggcagtaacatgcaacaaaa

SEQ ID NO: 5918828 - DNA, 14 bp, Homo sapiens
ggcagtaataaaaa

SEQ ID NO: 5918829 - DNA, 15 bp, Homo sapiens
ggcagtactcctccc

SEQ ID NO: 5918830 - DNA, 19 bp, Homo sapiens
ggcagtactcctccctggg

SEQ ID NO: 5918831 - DNA, 20 bp, Homo sapiens
ggcagtactcctccctgggg

SEQ ID NO: 5918832 - DNA, 21 bp, Homo sapiens
ggcagtactcctccctggggg

SEQ ID NO: 5918833 - DNA, 22 bp, Homo sapiens
ggcagtaggaacccagctctca

SEQ ID NO: 5918834 - DNA, 18 bp, Homo sapiens
ggcagtatggcggaggcc

SEQ ID NO: 5918835 - DNA, 21 bp, Homo sapiens
ggcagtatggcggaggccatg

SEQ ID NO: 5918836 - DNA, 19 bp, Homo sapiens
ggcagtatgtgatggactg

SEQ ID NO: 5918837 - DNA, 16 bp, Homo sapiens
ggcagtcacactgctg

SEQ ID NO: 5918838 - DNA, 18 bp, Homo sapiens
ggcagtcacactgctggg

SEQ ID NO: 5918839 - DNA, 15 bp, Homo sapiens
ggcagtcaccaccca

SEQ ID NO: 5918840 - DNA, 18 bp, Homo sapiens
ggcagtcaccacccagcc

SEQ ID NO: 5918841 - DNA, 21 bp, Homo sapiens
ggcagtcaccacccagccctt

SEQ ID NO: 5918842 - DNA, 22 bp, Homo sapiens
ggcagtcaccacccagcccttc

SEQ ID NO: 5918843 - DNA, 17 bp, Homo sapiens
ggcagtcatactggggt

SEQ ID NO: 5918844 - DNA, 22 bp, Homo sapiens
ggcagtcattcagcaccagagc

SEQ ID NO: 5918845 - DNA, 23 bp, Homo sapiens
ggcagtcattcagcaccagagca

SEQ ID NO: 5918846 - DNA, 14 bp, Homo sapiens
ggcagtccagagct

SEQ ID NO: 5918847 - DNA, 17 bp, Homo sapiens
ggcagtccagccagctc

SEQ ID NO: 5918848 - DNA, 18 bp, Homo sapiens
ggcagtccagccagctcc

SEQ ID NO: 5918849 - DNA, 13 bp, Homo sapiens
ggcagtcccggga

SEQ ID NO: 5918850 - DNA, 16 bp, Homo sapiens
ggcagtccgtgggacg

SEQ ID NO: 5918851 - DNA, 14 bp, Homo sapiens
ggcagtcctggagg

SEQ ID NO: 5918852 - DNA, 16 bp, Homo sapiens
ggcagtcctggaggca

SEQ ID NO: 5918853 - DNA, 19 bp, Homo sapiens
ggcagtcgatagagctgta

SEQ ID NO: 5918854 - DNA, 15 bp, Homo sapiens
ggcagtcgggggctg

SEQ ID NO: 5918855 - DNA, 16 bp, Homo sapiens
ggcagtctagtcctgg

SEQ ID NO: 5918856 - DNA, 17 bp, Homo sapiens
ggcagtctccccttcct

SEQ ID NO: 5918857 - DNA, 18 bp, Homo sapiens
ggcagtctccccttcctg

SEQ ID NO: 5918858 - DNA, 21 bp, Homo sapiens
ggcagtctccccttcctggca

SEQ ID NO: 5918859 - DNA, 22 bp, Homo sapiens
ggcagtctctatattatgtctt

SEQ ID NO: 5918860 - DNA, 20 bp, Homo sapiens
ggcagtctgagagaggccat

SEQ ID NO: 5918861 - DNA, 14 bp, Homo sapiens
ggcagtctgctctg

SEQ ID NO: 5918862 - DNA, 13 bp, Homo sapiens
ggcagtctggagg

SEQ ID NO: 5918863 - DNA, 14 bp, Homo sapiens
ggcagtctggaggg

SEQ ID NO: 5918864 - DNA, 21 bp, Homo sapiens
ggcagtctggaggggcatggc

SEQ ID NO: 5918865 - DNA, 13 bp, Homo sapiens
ggcagtcttgcaa

SEQ ID NO: 5918866 - DNA, 13 bp, Homo sapiens
ggcagtgacaagt

SEQ ID NO: 5918867 - DNA, 18 bp, Homo sapiens
ggcagtgacgtgagtggg

SEQ ID NO: 5918868 - DNA, 19 bp, Homo sapiens
ggcagtgacgtgagtgggg

SEQ ID NO: 5918869 - DNA, 15 bp, Homo sapiens
ggcagtgactggcag

SEQ ID NO: 5918870 - DNA, 18 bp, Homo sapiens
ggcagtgactggcaggtg

SEQ ID NO: 5918871 - DNA, 20 bp, Homo sapiens
ggcagtgatgacttgctgtc

SEQ ID NO: 5918872 - DNA, 16 bp, Homo sapiens
ggcagtgcagcaacca

SEQ ID NO: 5918873 - DNA, 21 bp, Homo sapiens
ggcagtgcagcaaccagagca

SEQ ID NO: 5918874 - DNA, 14 bp, Homo sapiens
ggcagtgcatgcat

SEQ ID NO: 5918875 - DNA, 17 bp, Homo sapiens
ggcagtgccacagcctg

SEQ ID NO: 5918876 - DNA, 19 bp, Homo sapiens
ggcagtgccacagcctgct

SEQ ID NO: 5918877 - DNA, 12 bp, Homo sapiens
ggcagtgccagc

SEQ ID NO: 5918878 - DNA, 16 bp, Homo sapiens
ggcagtgccagggcag

SEQ ID NO: 5918879 - DNA, 14 bp, Homo sapiens
ggcagtgcccacca

SEQ ID NO: 5918880 - DNA, 16 bp, Homo sapiens
ggcagtgcccaccatg

SEQ ID NO: 5918881 - DNA, 14 bp, Homo sapiens
ggcagtgcccatgt

SEQ ID NO: 5918882 - DNA, 15 bp, Homo sapiens
ggcagtgccccaggg

SEQ ID NO: 5918883 - DNA, 13 bp, Homo sapiens
ggcagtgcctcct

SEQ ID NO: 5918884 - DNA, 16 bp, Homo sapiens
ggcagtgcctcctggg

SEQ ID NO: 5918885 - DNA, 17 bp, Homo sapiens
ggcagtgcgggaggaat

SEQ ID NO: 5918886 - DNA, 19 bp, Homo sapiens
ggcagtgctcacccacacc

SEQ ID NO: 5918887 - DNA, 14 bp, Homo sapiens
ggcagtgctggttc

SEQ ID NO: 5918888 - DNA, 21 bp, Homo sapiens
ggcagtgctggttctccaaca

SEQ ID NO: 5918889 - DNA, 19 bp, Homo sapiens
ggcagtgcttggcccagga

SEQ ID NO: 5918890 - DNA, 20 bp, Homo sapiens
ggcagtgcttggcccaggag

SEQ ID NO: 5918891 - DNA, 21 bp, Homo sapiens
ggcagtgcttggcccaggagt

SEQ ID NO: 5918892 - DNA, 23 bp, Homo sapiens
ggcagtgcttggcccaggagttt

SEQ ID NO: 5918893 - DNA, 19 bp, Homo sapiens
ggcagtggaaaaatcagaa

SEQ ID NO: 5918894 - DNA, 20 bp, Homo sapiens
ggcagtggaaaaatcagaag

SEQ ID NO: 5918895 - DNA, 14 bp, Homo sapiens
ggcagtggagaggg

SEQ ID NO: 5918896 - DNA, 16 bp, Homo sapiens
ggcagtggaggctgct

SEQ ID NO: 5918897 - DNA, 14 bp, Homo sapiens
ggcagtggcagaga

SEQ ID NO: 5918898 - DNA, 13 bp, Homo sapiens
ggcagtggcagca

SEQ ID NO: 5918899 - DNA, 15 bp, Homo sapiens
ggcagtggccaagcc

SEQ ID NO: 5918900 - DNA, 22 bp, Homo sapiens
ggcagtggccaagcctgctgtg

SEQ ID NO: 5918901 - DNA, 16 bp, Homo sapiens
ggcagtggccaggcag

SEQ ID NO: 5918902 - DNA, 19 bp, Homo sapiens
ggcagtggccaggcaggga

SEQ ID NO: 5918903 - DNA, 12 bp, Homo sapiens
ggcagtggccca

SEQ ID NO: 5918904 - DNA, 15 bp, Homo sapiens
ggcagtggcccaggg

SEQ ID NO: 5918905 - DNA, 12 bp, Homo sapiens
ggcagtggctgg

SEQ ID NO: 5918906 - DNA, 13 bp, Homo sapiens
ggcagtggctggg

SEQ ID NO: 5918907 - DNA, 14 bp, Homo sapiens
ggcagtggctgggg

SEQ ID NO: 5918908 - DNA, 15 bp, Homo sapiens
ggcagtggctggggg

SEQ ID NO: 5918909 - DNA, 13 bp, Homo sapiens
ggcagtgggaaaa

SEQ ID NO: 5918910 - DNA, 13 bp, Homo sapiens
ggcagtgggagct

SEQ ID NO: 5918911 - DNA, 14 bp, Homo sapiens
ggcagtgggagctg

SEQ ID NO: 5918912 - DNA, 16 bp, Homo sapiens
ggcagtgggagctgcc

SEQ ID NO: 5918913 - DNA, 17 bp, Homo sapiens
ggcagtgggagctgcct

SEQ ID NO: 5918914 - DNA, 19 bp, Homo sapiens
ggcagtgggagctgcctgt

SEQ ID NO: 5918915 - DNA, 15 bp, Homo sapiens
ggcagtggggctgga

SEQ ID NO: 5918916 - DNA, 20 bp, Homo sapiens
ggcagtgggtggaggaccgg

SEQ ID NO: 5918917 - DNA, 20 bp, Homo sapiens
ggcagtggtaagctctggct

SEQ ID NO: 5918918 - DNA, 21 bp, Homo sapiens
ggcagtggtggttttctgttc

SEQ ID NO: 5918919 - DNA, 17 bp, Homo sapiens
ggcagtgtccctccctg

SEQ ID NO: 5918920 - DNA, 22 bp, Homo sapiens
ggcagtgtcttaaggagactgg

SEQ ID NO: 5918921 - DNA, 15 bp, Homo sapiens
ggcagtgtggcctct

SEQ ID NO: 5918922 - DNA, 22 bp, Homo sapiens
ggcagtgtgtcacactgagctg

SEQ ID NO: 5918923 - DNA, 22 bp, Homo sapiens
ggcagttaccattaaaccatct

SEQ ID NO: 5918924 - DNA, 23 bp, Homo sapiens
ggcagttaccattaaaccatctc

SEQ ID NO: 5918925 - DNA, 15 bp, Homo sapiens
ggcagttactatttt

SEQ ID NO: 5918926 - DNA, 18 bp, Homo sapiens
ggcagttagagcagcctc

SEQ ID NO: 5918927 - DNA, 21 bp, Homo sapiens
ggcagttagagcagcctcgtg

SEQ ID NO: 5918928 - DNA, 14 bp, Homo sapiens
ggcagttatatttt

SEQ ID NO: 5918929 - DNA, 18 bp, Homo sapiens
ggcagttcgcagccaccc

SEQ ID NO: 5918930 - DNA, 19 bp, Homo sapiens
ggcagttctcactcctagg

SEQ ID NO: 5918931 - DNA, 21 bp, Homo sapiens
ggcagttctcactcctaggag

SEQ ID NO: 5918932 - DNA, 13 bp, Homo sapiens
ggcagttctccca

SEQ ID NO: 5918933 - DNA, 17 bp, Homo sapiens
ggcagttctcccaggga

SEQ ID NO: 5918934 - DNA, 21 bp, Homo sapiens
ggcagttctcccagggagtga

SEQ ID NO: 5918935 - DNA, 15 bp, Homo sapiens
ggcagttctctcgaa

SEQ ID NO: 5918936 - DNA, 15 bp, Homo sapiens
ggcagttctgggtgc

SEQ ID NO: 5918937 - DNA, 21 bp, Homo sapiens
ggcagttctgggtgctcccta

SEQ ID NO: 5918938 - DNA, 16 bp, Homo sapiens
ggcagttctgtgtcct

SEQ ID NO: 5918939 - DNA, 15 bp, Homo sapiens
ggcagttgcttgtgt

SEQ ID NO: 5918940 - DNA, 13 bp, Homo sapiens
ggcagttggccag

SEQ ID NO: 5918941 - DNA, 18 bp, Homo sapiens
ggcagttggggcggccca

SEQ ID NO: 5918942 - DNA, 14 bp, Homo sapiens
ggcagttgggtaga

SEQ ID NO: 5918943 - DNA, 20 bp, Homo sapiens
ggcagttgggtagatgggtg

SEQ ID NO: 5918944 - DNA, 18 bp, Homo sapiens
ggcagtttaaagcacaat

SEQ ID NO: 5918945 - DNA, 19 bp, Homo sapiens
ggcagttttagcagcactt

SEQ ID NO: 5918946 - DNA, 20 bp, Homo sapiens
ggcagttttgacatcagcca

SEQ ID NO: 5918947 - DNA, 12 bp, Homo sapiens
ggcataaagtaa

SEQ ID NO: 5918948 - DNA, 19 bp, Homo sapiens
ggcatacaacctgagcctt

SEQ ID NO: 5918949 - DNA, 17 bp, Homo sapiens
ggcatacaatgaaaagt

SEQ ID NO: 5918950 - DNA, 22 bp, Homo sapiens
ggcatacgagagcagaggtctc

SEQ ID NO: 5918951 - DNA, 14 bp, Homo sapiens
ggcatactttctct

SEQ ID NO: 5918952 - DNA, 19 bp, Homo sapiens
ggcatactttttaaaaaac

SEQ ID NO: 5918953 - DNA, 22 bp, Homo sapiens
ggcatagaggcttctccgccag

SEQ ID NO: 5918954 - DNA, 13 bp, Homo sapiens
ggcatagagggag

SEQ ID NO: 5918955 - DNA, 19 bp, Homo sapiens
ggcatagatgcaggtgagc

SEQ ID NO: 5918956 - DNA, 15 bp, Homo sapiens
ggcatagccctcctg

SEQ ID NO: 5918957 - DNA, 13 bp, Homo sapiens
ggcatagctacgt

SEQ ID NO: 5918958 - DNA, 15 bp, Homo sapiens
ggcatagctctgggg

SEQ ID NO: 5918959 - DNA, 16 bp, Homo sapiens
ggcataggcctgggtg

SEQ ID NO: 5918960 - DNA, 17 bp, Homo sapiens
ggcataggcctgggtgc

SEQ ID NO: 5918961 - DNA, 18 bp, Homo sapiens
ggcataggtaagctgtgc

SEQ ID NO: 5918962 - DNA, 22 bp, Homo sapiens
ggcatagtccccagagctcccc

SEQ ID NO: 5918963 - DNA, 14 bp, Homo sapiens
ggcatagtggcact

SEQ ID NO: 5918964 - DNA, 14 bp, Homo sapiens
ggcatatacagtga

SEQ ID NO: 5918965 - DNA, 22 bp, Homo sapiens
ggcatatccaccacctccctca

SEQ ID NO: 5918966 - DNA, 22 bp, Homo sapiens
ggcatggtgttctcctgctgct

SEQ ID NO: 5918967 - DNA, 21 bp, Homo sapiens
ggcatggttccttccctggga

SEQ ID NO: 5918968 - DNA, 18 bp, Homo sapiens
ggcatggttttgtgccat

SEQ ID NO: 5918969 - DNA, 22 bp, Homo sapiens
ggcatggttttgtgccatctgt

SEQ ID NO: 5918970 - DNA, 11 bp, Homo sapiens
ggcatgtaaat

SEQ ID NO: 5918971 - DNA, 20 bp, Homo sapiens
ggcatgtattggcctggagg

SEQ ID NO: 5918972 - DNA, 21 bp, Homo sapiens
ggcatgtattggcctggaggt

SEQ ID NO: 5918973 - DNA, 19 bp, Homo sapiens
ggcatgtcagagccaggct

SEQ ID NO: 5918974 - DNA, 16 bp, Homo sapiens
ggcatgtcagaggacc

SEQ ID NO: 5918975 - DNA, 23 bp, Homo sapiens
ggcatgtcagaggaccccagggt

SEQ ID NO: 5918976 - DNA, 19 bp, Homo sapiens
ggcatgtcatttgcacaca

SEQ ID NO: 5918977 - DNA, 14 bp, Homo sapiens
ggcatgtccccagt

SEQ ID NO: 5918978 - DNA, 20 bp, Homo sapiens
ggcatgtcctttccatctgt

SEQ ID NO: 5918979 - DNA, 23 bp, Homo sapiens
ggcatgtcctttccatctgtcca

SEQ ID NO: 5918980 - DNA, 13 bp, Homo sapiens
ggcatgtctgcct

SEQ ID NO: 5918981 - DNA, 16 bp, Homo sapiens
ggcatgtctgcctgga

SEQ ID NO: 5918982 - DNA, 16 bp, Homo sapiens
ggcatgtgaaaagtaa

SEQ ID NO: 5918983 - DNA, 22 bp, Homo sapiens
ggcatgtgcagacactcaagag

SEQ ID NO: 5918984 - DNA, 19 bp, Homo sapiens
ggcatgtgcggctgaactg

SEQ ID NO: 5918985 - DNA, 17 bp, Homo sapiens
ggcatgtggcctgtggc

SEQ ID NO: 5918986 - DNA, 15 bp, Homo sapiens
ggcatgtgtgcctgt

SEQ ID NO: 5918987 - DNA, 19 bp, Homo sapiens
ggcatgtgtgcctgtggca

SEQ ID NO: 5918988 - DNA, 16 bp, Homo sapiens
ggcatgttcctgcccc

SEQ ID NO: 5918989 - DNA, 23 bp, Homo sapiens
ggcatgttctctgaggacactaa

SEQ ID NO: 5918990 - DNA, 18 bp, Homo sapiens
ggcatgttgggataaata

SEQ ID NO: 5918991 - DNA, 19 bp, Homo sapiens
ggcatgttgtaacatttca

SEQ ID NO: 5918992 - DNA, 18 bp, Homo sapiens
ggcatgtttcactcctgc

SEQ ID NO: 5918993 - DNA, 16 bp, Homo sapiens
ggcatgtttccagcag

SEQ ID NO: 5918994 - DNA, 20 bp, Homo sapiens
ggcatgttttctttgtttcc

SEQ ID NO: 5918995 - DNA, 12 bp, Homo sapiens
ggcatgttttgt

SEQ ID NO: 5918996 - DNA, 17 bp, Homo sapiens
ggcattaccctctgcag

SEQ ID NO: 5918997 - DNA, 19 bp, Homo sapiens
ggcattagaattatttaaa

SEQ ID NO: 5918998 - DNA, 17 bp, Homo sapiens
ggcattagtgtcccccc

SEQ ID NO: 5918999 - DNA, 19 bp, Homo sapiens
ggcattagtgtcccccctt

SEQ ID NO: 5919000 - DNA, 20 bp, Homo sapiens
ggcattagtgtccccccttg

SEQ ID NO: 5919001 - DNA, 22 bp, Homo sapiens
ggcattagtttcaggcaaggca

SEQ ID NO: 5919002 - DNA, 22 bp, Homo sapiens
ggcattatgatcccttccccct

SEQ ID NO: 5919003 - DNA, 20 bp, Homo sapiens
ggcattcacacacagcctgg

SEQ ID NO: 5919004 - DNA, 21 bp, Homo sapiens
ggcattcacacacagcctggc

SEQ ID NO: 5919005 - DNA, 22 bp, Homo sapiens
ggcattcacacacagcctggcc

SEQ ID NO: 5919006 - DNA, 12 bp, Homo sapiens
ggcattccacag

SEQ ID NO: 5919007 - DNA, 16 bp, Homo sapiens
ggcattccccaggagg

SEQ ID NO: 5919008 - DNA, 17 bp, Homo sapiens
ggcattccccaggaggc

SEQ ID NO: 5919009 - DNA, 14 bp, Homo sapiens
ggcattcctctaat

SEQ ID NO: 5919010 - DNA, 16 bp, Homo sapiens
ggcattcctgaaggga

SEQ ID NO: 5919011 - DNA, 15 bp, Homo sapiens
ggcattcctgcttat

SEQ ID NO: 5919012 - DNA, 15 bp, Homo sapiens
ggcattcggggaagc

SEQ ID NO: 5919013 - DNA, 16 bp, Homo sapiens
ggcattcggggaagct

SEQ ID NO: 5919014 - DNA, 23 bp, Homo sapiens
ggcattcggggaagctgcacatg

SEQ ID NO: 5919015 - DNA, 16 bp, Homo sapiens
ggcattctacacctgg

SEQ ID NO: 5919016 - DNA, 17 bp, Homo sapiens
ggcattctacacctgga

SEQ ID NO: 5919017 - DNA, 13 bp, Homo sapiens
ggcattctcccag

SEQ ID NO: 5919018 - DNA, 14 bp, Homo sapiens
ggcattctcccagc

SEQ ID NO: 5919019 - DNA, 19 bp, Homo sapiens
ggcattctcggtacttctg

SEQ ID NO: 5919020 - DNA, 12 bp, Homo sapiens
ggcattctctga

SEQ ID NO: 5919021 - DNA, 14 bp, Homo sapiens
ggcattcttgtaca

SEQ ID NO: 5919022 - DNA, 16 bp, Homo sapiens
ggcattcttgtacagt

SEQ ID NO: 5919023 - DNA, 15 bp, Homo sapiens
ggcattgacataggt

SEQ ID NO: 5919024 - DNA, 11 bp, Homo sapiens
ggcattgagta

SEQ ID NO: 5919025 - DNA, 17 bp, Homo sapiens
ggcattgcactgcttat

SEQ ID NO: 5919026 - DNA, 22 bp, Homo sapiens
ggcattgcaggaccttgggcac

SEQ ID NO: 5919027 - DNA, 13 bp, Homo sapiens
ggcattgctcagc

SEQ ID NO: 5919028 - DNA, 18 bp, Homo sapiens
ggcattgctcagcccgct

SEQ ID NO: 5919029 - DNA, 18 bp, Homo sapiens
ggcattggcagcaggtgc

SEQ ID NO: 5919030 - DNA, 13 bp, Homo sapiens
ggcattgggttct

SEQ ID NO: 5919031 - DNA, 16 bp, Homo sapiens
ggcattggtctgctga

SEQ ID NO: 5919032 - DNA, 17 bp, Homo sapiens
ggcattgtccaaagttt

SEQ ID NO: 5919033 - DNA, 15 bp, Homo sapiens
ggcattgtcctgtga

SEQ ID NO: 5919034 - DNA, 14 bp, Homo sapiens
ggcatttattttat

SEQ ID NO: 5919035 - DNA, 12 bp, Homo sapiens
ggcatttcaatc

SEQ ID NO: 5919036 - DNA, 13 bp, Homo sapiens
ggcatttcacaaa

SEQ ID NO: 5919037 - DNA, 19 bp, Homo sapiens
ggcatttcacgaactgttc

SEQ ID NO: 5919038 - DNA, 13 bp, Homo sapiens
ggcatttccaaac

SEQ ID NO: 5919039 - DNA, 16 bp, Homo sapiens
ggcatttcccaccctg

SEQ ID NO: 5919040 - DNA, 11 bp, Homo sapiens
ggcatttccta

SEQ ID NO: 5919041 - DNA, 15 bp, Homo sapiens
ggcatttcctgggtg

SEQ ID NO: 5919042 - DNA, 16 bp, Homo sapiens
ggcatttcctgggtgg

SEQ ID NO: 5919043 - DNA, 15 bp, Homo sapiens
ggcatttgctgattt

SEQ ID NO: 5919044 - DNA, 19 bp, Homo sapiens
ggcatttgctgatttctag

SEQ ID NO: 5919045 - DNA, 21 bp, Homo sapiens
ggcatttgctgatttctagtg

SEQ ID NO: 5919046 - DNA, 22 bp, Homo sapiens
ggcatttgctgccccagctact

SEQ ID NO: 5919047 - DNA, 16 bp, Homo sapiens
ggcatttgctggcctg

SEQ ID NO: 5919048 - DNA, 23 bp, Homo sapiens
ggcatttgctggcctggcagggg

SEQ ID NO: 5919049 - DNA, 16 bp, Homo sapiens
ggcatttgctggttat

SEQ ID NO: 5919050 - DNA, 14 bp, Homo sapiens
ggcatttggcctct

SEQ ID NO: 5919051 - DNA, 14 bp, Homo sapiens
ggcatttggtgaga

SEQ ID NO: 5919052 - DNA, 21 bp, Homo sapiens
ggcatttggtgagagtcaaag

SEQ ID NO: 5919053 - DNA, 12 bp, Homo sapiens
ggcatttgtaaa

SEQ ID NO: 5919054 - DNA, 22 bp, Homo sapiens
ggcatttgtaaatattaaacca

SEQ ID NO: 5919055 - DNA, 20 bp, Homo sapiens
ggcatttgtcttagagagag

SEQ ID NO: 5919056 - DNA, 21 bp, Homo sapiens
ggcatttgtcttagagagaga

SEQ ID NO: 5919057 - DNA, 12 bp, Homo sapiens
ggcatttgttca

SEQ ID NO: 5919058 - DNA, 18 bp, Homo sapiens
ggcattttcctcctctgc

SEQ ID NO: 5919059 - DNA, 19 bp, Homo sapiens
ggcattttcctcctctgcc

SEQ ID NO: 5919060 - DNA, 18 bp, Homo sapiens
ggcattttggctcagagt

SEQ ID NO: 5919061 - DNA, 22 bp, Homo sapiens
ggcatttttactactattctgt

SEQ ID NO: 5919062 - DNA, 14 bp, Homo sapiens
ggcatttttccaaa

SEQ ID NO: 5919063 - DNA, 13 bp, Homo sapiens
ggcatttttcttg

SEQ ID NO: 5919064 - DNA, 14 bp, Homo sapiens
ggccaaaaggaaaa

SEQ ID NO: 5919065 - DNA, 15 bp, Homo sapiens
ggccaaaaggaaaaa

SEQ ID NO: 5919066 - DNA, 18 bp, Homo sapiens
ggccaaaagggcagccag

SEQ ID NO: 5919067 - DNA, 17 bp, Homo sapiens
ggccaaacccagacaac

SEQ ID NO: 5919068 - DNA, 12 bp, Homo sapiens
ggccaaacctct

SEQ ID NO: 5919069 - DNA, 16 bp, Homo sapiens
ggccaaacctctgttc

SEQ ID NO: 5919070 - DNA, 17 bp, Homo sapiens
ggccaaactcacctgcc

SEQ ID NO: 5919071 - DNA, 11 bp, Homo sapiens
ggccaaactgc

SEQ ID NO: 5919072 - DNA, 17 bp, Homo sapiens
ggccaaagaaggcaggg

SEQ ID NO: 5919073 - DNA, 13 bp, Homo sapiens
ggccaaagacaaa

SEQ ID NO: 5919074 - DNA, 15 bp, Homo sapiens
ggccaaagacaaata

SEQ ID NO: 5919075 - DNA, 16 bp, Homo sapiens
ggccaaagacaaatag

SEQ ID NO: 5919076 - DNA, 17 bp, Homo sapiens
ggccaaagcacagctgg

SEQ ID NO: 5919077 - DNA, 14 bp, Homo sapiens
ggccaaagccccat

SEQ ID NO: 5919078 - DNA, 15 bp, Homo sapiens
ggccaaagccccatg

SEQ ID NO: 5919079 - DNA, 16 bp, Homo sapiens
ggccaaaggaagcaca

SEQ ID NO: 5919080 - DNA, 19 bp, Homo sapiens
ggccaaaggaagcacatgc

SEQ ID NO: 5919081 - DNA, 20 bp, Homo sapiens
ggccaaagtcagtaggagag

SEQ ID NO: 5919082 - DNA, 23 bp, Homo sapiens
ggccaaagtgccggtgagaccca

SEQ ID NO: 5919083 - DNA, 22 bp, Homo sapiens
ggccaaatccgctctcttcctg

SEQ ID NO: 5919084 - DNA, 19 bp, Homo sapiens
ggccaaatgcacaagctca

SEQ ID NO: 5919085 - DNA, 15 bp, Homo sapiens
ggccaacaaagctgt

SEQ ID NO: 5919086 - DNA, 18 bp, Homo sapiens
ggccaacaccagggatgg

SEQ ID NO: 5919087 - DNA, 19 bp, Homo sapiens
ggccaacatcgtgaaaccc

SEQ ID NO: 5919088 - DNA, 13 bp, Homo sapiens
ggccaaccaggac

SEQ ID NO: 5919089 - DNA, 16 bp, Homo sapiens
ggccaaccaggaccca

SEQ ID NO: 5919090 - DNA, 17 bp, Homo sapiens
ggccaaccaggacccag

SEQ ID NO: 5919091 - DNA, 19 bp, Homo sapiens
ggccaaccaggacccaggg

SEQ ID NO: 5919092 - DNA, 20 bp, Homo sapiens
ggccaaccaggacccagggt

SEQ ID NO: 5919093 - DNA, 21 bp, Homo sapiens
ggccaaccaggacccagggtc

SEQ ID NO: 5919094 - DNA, 16 bp, Homo sapiens
ggccaacgtggacctg

SEQ ID NO: 5919095 - DNA, 22 bp, Homo sapiens
ggccaactgcaaaaaaagcctc

SEQ ID NO: 5919096 - DNA, 23 bp, Homo sapiens
ggccaacttgagggcccagagca

SEQ ID NO: 5919097 - DNA, 18 bp, Homo sapiens
ggccaagaatacttgaag

SEQ ID NO: 5919098 - DNA, 17 bp, Homo sapiens
ggccaagaatattgcaa

SEQ ID NO: 5919099 - DNA, 16 bp, Homo sapiens
ggccaagacagatgga

SEQ ID NO: 5919100 - DNA, 12 bp, Homo sapiens
ggccaagagaag

SEQ ID NO: 5919101 - DNA, 15 bp, Homo sapiens
ggccaagagagacat

SEQ ID NO: 5919102 - DNA, 15 bp, Homo sapiens
ggccaagagatctgt

SEQ ID NO: 5919103 - DNA, 22 bp, Homo sapiens
ggccaagagatgcagtgccagg

SEQ ID NO: 5919104 - DNA, 13 bp, Homo sapiens
ggccaagatgctt

SEQ ID NO: 5919105 - DNA, 20 bp, Homo sapiens
ggccaagatggctgctgcct

SEQ ID NO: 5919106 - DNA, 15 bp, Homo sapiens
ggccaagcaagaggt

SEQ ID NO: 5919107 - DNA, 13 bp, Homo sapiens
ggccaagcaggct

SEQ ID NO: 5919108 - DNA, 15 bp, Homo sapiens
ggccaagcaggctgg

SEQ ID NO: 5919109 - DNA, 11 bp, Homo sapiens
ggccaagccag

SEQ ID NO: 5919110 - DNA, 12 bp, Homo sapiens
ggccaagccagc

SEQ ID NO: 5919111 - DNA, 16 bp, Homo sapiens
ggccaagccagctgcc

SEQ ID NO: 5919112 - DNA, 15 bp, Homo sapiens
ggccaagccggccca

SEQ ID NO: 5919113 - DNA, 17 bp, Homo sapiens
ggccaagcctgccccgg

SEQ ID NO: 5919114 - DNA, 14 bp, Homo sapiens
ggccaagcctggcc

SEQ ID NO: 5919115 - DNA, 16 bp, Homo sapiens
ggccaagcctggccct

SEQ ID NO: 5919116 - DNA, 19 bp, Homo sapiens
ggccaagctgaggaggtgc

SEQ ID NO: 5919117 - DNA, 22 bp, Homo sapiens
ggccaagctgaggaggtgctgc

SEQ ID NO: 5919118 - DNA, 10 bp, Homo sapiens
ggccaaggac

SEQ ID NO: 5919119 - DNA, 20 bp, Homo sapiens
ggccaaggacactgatgggt

SEQ ID NO: 5919120 - DNA, 23 bp, Homo sapiens
ggccaaggacccaggcgctgcat

SEQ ID NO: 5919121 - DNA, 16 bp, Homo sapiens
ggccaaggacctgaga

SEQ ID NO: 5919122 - DNA, 16 bp, Homo sapiens
ggccaaggagggtgag

SEQ ID NO: 5919123 - DNA, 21 bp, Homo sapiens
ggccaaggatgccccgtcccc

SEQ ID NO: 5919124 - DNA, 15 bp, Homo sapiens
ggccaaggcctcagg

SEQ ID NO: 5919125 - DNA, 16 bp, Homo sapiens
ggccaaggctgagagc

SEQ ID NO: 5919126 - DNA, 14 bp, Homo sapiens
ggccaagggccaga

SEQ ID NO: 5919127 - DNA, 21 bp, Homo sapiens
ggccaaggggagtcaccttcc

SEQ ID NO: 5919128 - DNA, 21 bp, Homo sapiens
ggccaaggggccagctgcccc

SEQ ID NO: 5919129 - DNA, 15 bp, Homo sapiens
ggccaagtccactgt

SEQ ID NO: 5919130 - DNA, 14 bp, Homo sapiens
ggccaagtcccacc

SEQ ID NO: 5919131 - DNA, 16 bp, Homo sapiens
ggccaagtcccaccgg

SEQ ID NO: 5919132 - DNA, 16 bp, Homo sapiens
ggccaagtccgcagaa

SEQ ID NO: 5919133 - DNA, 18 bp, Homo sapiens
ggccaagtctaatgaaga

SEQ ID NO: 5919134 - DNA, 13 bp, Homo sapiens
ggccaagttcctc

SEQ ID NO: 5919135 - DNA, 17 bp, Homo sapiens
ggccaataaaaagttca

SEQ ID NO: 5919136 - DNA, 21 bp, Homo sapiens
ggccaataccctactgtgggg

SEQ ID NO: 5919137 - DNA, 17 bp, Homo sapiens
ggccaatgggctagagg

SEQ ID NO: 5919138 - DNA, 23 bp, Homo sapiens
ggccaatgtgactaccgtgccag

SEQ ID NO: 5919139 - DNA, 17 bp, Homo sapiens
ggccaatttactggcca

SEQ ID NO: 5919140 - DNA, 15 bp, Homo sapiens
ggccaatttcacccc

SEQ ID NO: 5919141 - DNA, 17 bp, Homo sapiens
ggccaattttggatgag

SEQ ID NO: 5919142 - DNA, 14 bp, Homo sapiens
ggccacaaaaacaa

SEQ ID NO: 5919143 - DNA, 22 bp, Homo sapiens
ggccacaaatcaaagcaagggc

SEQ ID NO: 5919144 - DNA, 21 bp, Homo sapiens
ggccacaaggaaaaggaggag

SEQ ID NO: 5919145 - DNA, 20 bp, Homo sapiens
ggccatgctttccttttctt

SEQ ID NO: 5919146 - DNA, 20 bp, Homo sapiens
ggccatggaagctggcagga

SEQ ID NO: 5919147 - DNA, 22 bp, Homo sapiens
ggccatggaagctggcaggaga

SEQ ID NO: 5919148 - DNA, 24 bp, Homo sapiens
ggccatggacgaatatgaatgtca

SEQ ID NO: 5919149 - DNA, 16 bp, Homo sapiens
ggccatggagaaagct

SEQ ID NO: 5919150 - DNA, 22 bp, Homo sapiens
ggccatggagagctggagcctg

SEQ ID NO: 5919151 - DNA, 12 bp, Homo sapiens
ggccatggccaa

SEQ ID NO: 5919152 - DNA, 14 bp, Homo sapiens
ggccatggctcagg

SEQ ID NO: 5919153 - DNA, 16 bp, Homo sapiens
ggccatggctttcatc

SEQ ID NO: 5919154 - DNA, 15 bp, Homo sapiens
ggccatgggaggcct

SEQ ID NO: 5919155 - DNA, 13 bp, Homo sapiens
ggccatggggcag

SEQ ID NO: 5919156 - DNA, 16 bp, Homo sapiens
ggccatggggcagcct

SEQ ID NO: 5919157 - DNA, 17 bp, Homo sapiens
ggccatggggcagcctc

SEQ ID NO: 5919158 - DNA, 14 bp, Homo sapiens
ggccatgggtcctc

SEQ ID NO: 5919159 - DNA, 22 bp, Homo sapiens
ggccatgggtcctcggcccatc

SEQ ID NO: 5919160 - DNA, 14 bp, Homo sapiens
ggccatggtggagg

SEQ ID NO: 5919161 - DNA, 16 bp, Homo sapiens
ggccatggtggagggc

SEQ ID NO: 5919162 - DNA, 24 bp, Homo sapiens
ggccatggtggagggcacttcagg

SEQ ID NO: 5919163 - DNA, 17 bp, Homo sapiens
ggccatgtcagacacag

SEQ ID NO: 5919164 - DNA, 16 bp, Homo sapiens
ggccatgtcctctctt

SEQ ID NO: 5919165 - DNA, 16 bp, Homo sapiens
ggccatgtctcctgca

SEQ ID NO: 5919166 - DNA, 15 bp, Homo sapiens
ggccatgtgctgccc

SEQ ID NO: 5919167 - DNA, 16 bp, Homo sapiens
ggccatgtggcctgcc

SEQ ID NO: 5919168 - DNA, 20 bp, Homo sapiens
ggccatgtggcctgcccagc

SEQ ID NO: 5919169 - DNA, 16 bp, Homo sapiens
ggccatgttgtgcctc

SEQ ID NO: 5919170 - DNA, 14 bp, Homo sapiens
ggccattaggaaac

SEQ ID NO: 5919171 - DNA, 17 bp, Homo sapiens
ggccattatgcctggct

SEQ ID NO: 5919172 - DNA, 23 bp, Homo sapiens
ggccattccccaacggggtgggg

SEQ ID NO: 5919173 - DNA, 23 bp, Homo sapiens
ggccattcttatgttccagatgg

SEQ ID NO: 5919174 - DNA, 20 bp, Homo sapiens
ggccattctttcccaacacc

SEQ ID NO: 5919175 - DNA, 13 bp, Homo sapiens
ggccatttcacat

SEQ ID NO: 5919176 - DNA, 18 bp, Homo sapiens
ggccatttcacattcctg

SEQ ID NO: 5919177 - DNA, 23 bp, Homo sapiens
ggccatttccttttctctgccct

SEQ ID NO: 5919178 - DNA, 18 bp, Homo sapiens
ggccatttgcaataacag

SEQ ID NO: 5919179 - DNA, 20 bp, Homo sapiens
ggccatttgcaataacagct

SEQ ID NO: 5919180 - DNA, 23 bp, Homo sapiens
ggccatttgcaataacagctgca

SEQ ID NO: 5919181 - DNA, 23 bp, Homo sapiens
ggccatttgctagttctgctgcc

SEQ ID NO: 5919182 - DNA, 15 bp, Homo sapiens
ggccatttggccggc

SEQ ID NO: 5919183 - DNA, 19 bp, Homo sapiens
ggccatttggccggctctg

SEQ ID NO: 5919184 - DNA, 16 bp, Homo sapiens
ggccatttgttacagt

SEQ ID NO: 5919185 - DNA, 23 bp, Homo sapiens
ggccattttcttgcctgaggctc

SEQ ID NO: 5919186 - DNA, 16 bp, Homo sapiens
ggccatttttctgggg

SEQ ID NO: 5919187 - DNA, 13 bp, Homo sapiens
ggcccaaaacata

SEQ ID NO: 5919188 - DNA, 17 bp, Homo sapiens
ggcccaaaccaggggga

SEQ ID NO: 5919189 - DNA, 12 bp, Homo sapiens
ggcccaaagcag

SEQ ID NO: 5919190 - DNA, 24 bp, Homo sapiens
ggcccaaaggaagtagcaggccca

SEQ ID NO: 5919191 - DNA, 17 bp, Homo sapiens
ggcccaaaggcccaggg

SEQ ID NO: 5919192 - DNA, 21 bp, Homo sapiens
ggcccaaaggccttggacaac

SEQ ID NO: 5919193 - DNA, 21 bp, Homo sapiens
ggcccaaataacagtggcaag

SEQ ID NO: 5919194 - DNA, 15 bp, Homo sapiens
ggcccaaatgatgga

SEQ ID NO: 5919195 - DNA, 16 bp, Homo sapiens
ggcccaaccctgtctg

SEQ ID NO: 5919196 - DNA, 17 bp, Homo sapiens
ggcccaactggttcagg

SEQ ID NO: 5919197 - DNA, 17 bp, Homo sapiens
ggcccaagactgggctg

SEQ ID NO: 5919198 - DNA, 16 bp, Homo sapiens
ggcccaagagagacag

SEQ ID NO: 5919199 - DNA, 21 bp, Homo sapiens
ggcccaagagagacagcacag

SEQ ID NO: 5919200 - DNA, 22 bp, Homo sapiens
ggcccaagagagacagcacagg

SEQ ID NO: 5919201 - DNA, 14 bp, Homo sapiens
ggcccaagagcccg

SEQ ID NO: 5919202 - DNA, 22 bp, Homo sapiens
ggcccaagcatgccccacccac

SEQ ID NO: 5919203 - DNA, 16 bp, Homo sapiens
ggcccaagccccatct

SEQ ID NO: 5919204 - DNA, 18 bp, Homo sapiens
ggcccaaggagcttaccc

SEQ ID NO: 5919205 - DNA, 21 bp, Homo sapiens
ggcccaaggcggcccctcccg

SEQ ID NO: 5919206 - DNA, 14 bp, Homo sapiens
ggcccaagggatgg

SEQ ID NO: 5919207 - DNA, 20 bp, Homo sapiens
ggcccaaggtcccctccaca

SEQ ID NO: 5919208 - DNA, 21 bp, Homo sapiens
ggcccaaggtcccctccacat

SEQ ID NO: 5919209 - DNA, 14 bp, Homo sapiens
ggcccaagttgcag

SEQ ID NO: 5919210 - DNA, 15 bp, Homo sapiens
ggcccaagttgcagt

SEQ ID NO: 5919211 - DNA, 17 bp, Homo sapiens
ggcccaagtttctaagg

SEQ ID NO: 5919212 - DNA, 23 bp, Homo sapiens
ggcccaatctcgtcaggctgcca

SEQ ID NO: 5919213 - DNA, 20 bp, Homo sapiens
ggcccaatgaggtggctcat

SEQ ID NO: 5919214 - DNA, 16 bp, Homo sapiens
ggcccaatgcctataa

SEQ ID NO: 5919215 - DNA, 20 bp, Homo sapiens
ggcccacacccgacaccagc

SEQ ID NO: 5919216 - DNA, 14 bp, Homo sapiens
ggcccacacgtgca

SEQ ID NO: 5919217 - DNA, 15 bp, Homo sapiens
ggcccacactgaggc

SEQ ID NO: 5919218 - DNA, 19 bp, Homo sapiens
ggcccacagcaggtgctga

SEQ ID NO: 5919219 - DNA, 15 bp, Homo sapiens
ggcccacagctccca

SEQ ID NO: 5919220 - DNA, 19 bp, Homo sapiens
ggcccacagctcccacccc

SEQ ID NO: 5919221 - DNA, 18 bp, Homo sapiens
ggcccacagctctgctgg

SEQ ID NO: 5919222 - DNA, 14 bp, Homo sapiens
ggcccacaggttta

SEQ ID NO: 5919223 - DNA, 18 bp, Homo sapiens
ggcccacattggaagagc

SEQ ID NO: 5919224 - DNA, 20 bp, Homo sapiens
ggcccaccagagcctccctc

SEQ ID NO: 5919225 - DNA, 21 bp, Homo sapiens
ggcccaccagagcctccctca

SEQ ID NO: 5919226 - DNA, 22 bp, Homo sapiens
ggcccaccagggactgcagctg

SEQ ID NO: 5919227 - DNA, 22 bp, Homo sapiens
ggcccaccatcaccaccgcctc

SEQ ID NO: 5919228 - DNA, 14 bp, Homo sapiens
ggcccacccacatg

SEQ ID NO: 5919229 - DNA, 19 bp, Homo sapiens
ggcccaccccacccacttc

SEQ ID NO: 5919230 - DNA, 18 bp, Homo sapiens
ggcccacccggtgggacc

SEQ ID NO: 5919231 - DNA, 19 bp, Homo sapiens
ggcccaccctctgcccagg

SEQ ID NO: 5919232 - DNA, 20 bp, Homo sapiens
ggcccaccctgcctgcacct

SEQ ID NO: 5919233 - DNA, 22 bp, Homo sapiens
ggcccaccctgcttggcccagg

SEQ ID NO: 5919234 - DNA, 23 bp, Homo sapiens
ggcccaccctgcttggcccaggg

SEQ ID NO: 5919235 - DNA, 21 bp, Homo sapiens
ggcccacctaccttcaaagct

SEQ ID NO: 5919236 - DNA, 18 bp, Homo sapiens
ggcccacctggccacctg

SEQ ID NO: 5919237 - DNA, 22 bp, Homo sapiens
ggcccacctggccacctgaggt

SEQ ID NO: 5919238 - DNA, 22 bp, Homo sapiens
ggcccaccttggaccctggtga

SEQ ID NO: 5919239 - DNA, 13 bp, Homo sapiens
ggcccacgaggag

SEQ ID NO: 5919240 - DNA, 23 bp, Homo sapiens
ggcccacgcacgacgtcagcctc

SEQ ID NO: 5919241 - DNA, 14 bp, Homo sapiens
ggcccacgcagagc

SEQ ID NO: 5919242 - DNA, 18 bp, Homo sapiens
ggcccacgcagagccccg

SEQ ID NO: 5919243 - DNA, 14 bp, Homo sapiens
ggcccacgccagct

SEQ ID NO: 5919244 - DNA, 21 bp, Homo sapiens
ggcccacgccagctggcccag

SEQ ID NO: 5919245 - DNA, 22 bp, Homo sapiens
ggcccacgccctccctctccca

SEQ ID NO: 5919246 - DNA, 20 bp, Homo sapiens
ggcccacgcgcttccctggg

SEQ ID NO: 5919247 - DNA, 19 bp, Homo sapiens
ggcccacgggccggccagc

SEQ ID NO: 5919248 - DNA, 16 bp, Homo sapiens
ggcccacgtcctgggt

SEQ ID NO: 5919249 - DNA, 17 bp, Homo sapiens
ggcccacgtggttgggg

SEQ ID NO: 5919250 - DNA, 22 bp, Homo sapiens
ggcccacgtgtatagtatctgt

SEQ ID NO: 5919251 - DNA, 13 bp, Homo sapiens
ggcccactagagg

SEQ ID NO: 5919252 - DNA, 15 bp, Homo sapiens
ggcccactagagggc

SEQ ID NO: 5919253 - DNA, 17 bp, Homo sapiens
ggcccactagagggccc

SEQ ID NO: 5919254 - DNA, 20 bp, Homo sapiens
ggcccactagagggcccatc

SEQ ID NO: 5919255 - DNA, 14 bp, Homo sapiens
ggcccactccccag

SEQ ID NO: 5919256 - DNA, 17 bp, Homo sapiens
ggcccactgagtctcgg

SEQ ID NO: 5919257 - DNA, 17 bp, Homo sapiens
ggcccactgctggctgc

SEQ ID NO: 5919258 - DNA, 22 bp, Homo sapiens
ggcccactgtgcagtggagcag

SEQ ID NO: 5919259 - DNA, 17 bp, Homo sapiens
ggcccactgtgcctcag

SEQ ID NO: 5919260 - DNA, 21 bp, Homo sapiens
ggcccactgtgcctcagagac

SEQ ID NO: 5919261 - DNA, 16 bp, Homo sapiens
ggcccacttggggcct

SEQ ID NO: 5919262 - DNA, 16 bp, Homo sapiens
ggcccactttcctgag

SEQ ID NO: 5919263 - DNA, 18 bp, Homo sapiens
ggcccactttcctgagct

SEQ ID NO: 5919264 - DNA, 21 bp, Homo sapiens
ggcccagaaagcctctctctc

SEQ ID NO: 5919265 - DNA, 12 bp, Homo sapiens
ggcccagaccct

SEQ ID NO: 5919266 - DNA, 16 bp, Homo sapiens
ggcccagaccctgggc

SEQ ID NO: 5919267 - DNA, 17 bp, Homo sapiens
ggcccagaccctgggca

SEQ ID NO: 5919268 - DNA, 18 bp, Homo sapiens
ggcccagaccggcttctc

SEQ ID NO: 5919269 - DNA, 21 bp, Homo sapiens
ggcccagacctggcctctgcc

SEQ ID NO: 5919270 - DNA, 15 bp, Homo sapiens
ggcccagagaagcca

SEQ ID NO: 5919271 - DNA, 11 bp, Homo sapiens
ggcccagagag

SEQ ID NO: 5919272 - DNA, 20 bp, Homo sapiens
ggcccagagagaagagcccc

SEQ ID NO: 5919273 - DNA, 23 bp, Homo sapiens
ggcccagagagaagagccccact

SEQ ID NO: 5919274 - DNA, 12 bp, Homo sapiens
ggcccagagcca

SEQ ID NO: 5919275 - DNA, 17 bp, Homo sapiens
ggcccagagccatactg

SEQ ID NO: 5919276 - DNA, 14 bp, Homo sapiens
ggcccagagcccag

SEQ ID NO: 5919277 - DNA, 17 bp, Homo sapiens
ggcccagagcccagctc

SEQ ID NO: 5919278 - DNA, 18 bp, Homo sapiens
ggcccagagcccagctcc

SEQ ID NO: 5919279 - DNA, 19 bp, Homo sapiens
ggcccagagcccagctcca

SEQ ID NO: 5919280 - DNA, 17 bp, Homo sapiens
ggcccagagcccttgac

SEQ ID NO: 5919281 - DNA, 20 bp, Homo sapiens
ggcccagagtttacattcta

SEQ ID NO: 5919282 - DNA, 22 bp, Homo sapiens
ggcccagatctggtcccttgca

SEQ ID NO: 5919283 - DNA, 23 bp, Homo sapiens
ggcccagcaccccctctcctgga

SEQ ID NO: 5919284 - DNA, 20 bp, Homo sapiens
ggcccagcacgagcctgggc

SEQ ID NO: 5919285 - DNA, 15 bp, Homo sapiens
ggcccagcagcttgg

SEQ ID NO: 5919286 - DNA, 17 bp, Homo sapiens
ggcccagcagcttggct

SEQ ID NO: 5919287 - DNA, 22 bp, Homo sapiens
ggcccagcagcttggctgagcc

SEQ ID NO: 5919288 - DNA, 23 bp, Homo sapiens
ggcccagcagcttggctgagccc

SEQ ID NO: 5919289 - DNA, 14 bp, Homo sapiens
ggcccagcatgcag

SEQ ID NO: 5919290 - DNA, 17 bp, Homo sapiens
ggcccagcattgctggt

SEQ ID NO: 5919291 - DNA, 14 bp, Homo sapiens
ggcccagccagcag

SEQ ID NO: 5919292 - DNA, 13 bp, Homo sapiens
ggcccagccagga

SEQ ID NO: 5919293 - DNA, 14 bp, Homo sapiens
ggcccagccatggc

SEQ ID NO: 5919294 - DNA, 17 bp, Homo sapiens
ggcccagccatgggccc

SEQ ID NO: 5919295 - DNA, 18 bp, Homo sapiens
ggcccagccatgggccct

SEQ ID NO: 5919296 - DNA, 22 bp, Homo sapiens
ggcccagcccaagtgaggcagc

SEQ ID NO: 5919297 - DNA, 14 bp, Homo sapiens
ggcccagcccagag

SEQ ID NO: 5919298 - DNA, 13 bp, Homo sapiens
ggcccagccccca

SEQ ID NO: 5919299 - DNA, 16 bp, Homo sapiens
ggcccagcccccacag

SEQ ID NO: 5919300 - DNA, 13 bp, Homo sapiens
ggcccagccccta

SEQ ID NO: 5919301 - DNA, 13 bp, Homo sapiens
ggcccagcccctc

SEQ ID NO: 5919302 - DNA, 17 bp, Homo sapiens
ggcccagcccctccacg

SEQ ID NO: 5919303 - DNA, 15 bp, Homo sapiens
ggcccagccctcaga

SEQ ID NO: 5919304 - DNA, 12 bp, Homo sapiens
ggcccagccggc

SEQ ID NO: 5919305 - DNA, 21 bp, Homo sapiens
ggcccagccggcctctctggc

SEQ ID NO: 5919306 - DNA, 18 bp, Homo sapiens
ggcccagcctctctggct

SEQ ID NO: 5919307 - DNA, 21 bp, Homo sapiens
ggcccagcctctctggctcag

SEQ ID NO: 5919308 - DNA, 23 bp, Homo sapiens
ggcccagcctctgagtcccgtgg

SEQ ID NO: 5919309 - DNA, 14 bp, Homo sapiens
ggcccagcctctgc

SEQ ID NO: 5919310 - DNA, 16 bp, Homo sapiens
ggcccagcctctgccc

SEQ ID NO: 5919311 - DNA, 18 bp, Homo sapiens
ggcccagcctctgcccca

SEQ ID NO: 5919312 - DNA, 13 bp, Homo sapiens
ggcccagcctctt

SEQ ID NO: 5919313 - DNA, 12 bp, Homo sapiens
ggcccagcctgg

SEQ ID NO: 5919314 - DNA, 16 bp, Homo sapiens
ggcccagcctggcccc

SEQ ID NO: 5919315 - DNA, 12 bp, Homo sapiens
ggcccagcctgt

SEQ ID NO: 5919316 - DNA, 16 bp, Homo sapiens
ggcccagcctgtcctg

SEQ ID NO: 5919317 - DNA, 14 bp, Homo sapiens
ggcccagcctgtgg

SEQ ID NO: 5919318 - DNA, 20 bp, Homo sapiens
ggcccagcctgtggcctcag

SEQ ID NO: 5919319 - DNA, 23 bp, Homo sapiens
ggcccagcctgtggcctcagcat

SEQ ID NO: 5919320 - DNA, 13 bp, Homo sapiens
ggcccagccttgt

SEQ ID NO: 5919321 - DNA, 16 bp, Homo sapiens
ggcccagcgacctcgg

SEQ ID NO: 5919322 - DNA, 21 bp, Homo sapiens
ggcccccaacctcagggctcc

SEQ ID NO: 5919323 - DNA, 13 bp, Homo sapiens
ggcccccaataaa

SEQ ID NO: 5919324 - DNA, 18 bp, Homo sapiens
ggcccccaataaaccagt

SEQ ID NO: 5919325 - DNA, 19 bp, Homo sapiens
ggcccccaataaaccagtg

SEQ ID NO: 5919326 - DNA, 19 bp, Homo sapiens
ggcccccaataaaggcagc

SEQ ID NO: 5919327 - DNA, 21 bp, Homo sapiens
ggcccccaataaaggcagctg

SEQ ID NO: 5919328 - DNA, 16 bp, Homo sapiens
ggcccccacagcgctc

SEQ ID NO: 5919329 - DNA, 23 bp, Homo sapiens
ggcccccacaggagcatgtccta

SEQ ID NO: 5919330 - DNA, 13 bp, Homo sapiens
ggcccccacatgg

SEQ ID NO: 5919331 - DNA, 20 bp, Homo sapiens
ggcccccaccacacatccca

SEQ ID NO: 5919332 - DNA, 21 bp, Homo sapiens
ggcccccaccacacatcccag

SEQ ID NO: 5919333 - DNA, 22 bp, Homo sapiens
ggcccccaccacacatcccagc

SEQ ID NO: 5919334 - DNA, 17 bp, Homo sapiens
ggcccccacccaccttc

SEQ ID NO: 5919335 - DNA, 19 bp, Homo sapiens
ggcccccaccgccggggtc

SEQ ID NO: 5919336 - DNA, 17 bp, Homo sapiens
ggcccccacctggctca

SEQ ID NO: 5919337 - DNA, 12 bp, Homo sapiens
ggcccccactgg

SEQ ID NO: 5919338 - DNA, 19 bp, Homo sapiens
ggcccccagagacctttgc

SEQ ID NO: 5919339 - DNA, 12 bp, Homo sapiens
ggcccccagagc

SEQ ID NO: 5919340 - DNA, 16 bp, Homo sapiens
ggcccccagagcgccc

SEQ ID NO: 5919341 - DNA, 13 bp, Homo sapiens
ggcccccagcacc

SEQ ID NO: 5919342 - DNA, 14 bp, Homo sapiens
ggcccccagcaccc

SEQ ID NO: 5919343 - DNA, 17 bp, Homo sapiens
ggcccccagcccagggc

SEQ ID NO: 5919344 - DNA, 18 bp, Homo sapiens
ggcccccagcccagggct

SEQ ID NO: 5919345 - DNA, 16 bp, Homo sapiens
ggcccccagcccctcc

SEQ ID NO: 5919346 - DNA, 15 bp, Homo sapiens
ggcccccagcctggc

SEQ ID NO: 5919347 - DNA, 23 bp, Homo sapiens
ggcccccagcctggccagacaag

SEQ ID NO: 5919348 - DNA, 19 bp, Homo sapiens
ggcccccagctggtgtcct

SEQ ID NO: 5919349 - DNA, 14 bp, Homo sapiens
ggcccccagcttca

SEQ ID NO: 5919350 - DNA, 12 bp, Homo sapiens
ggcccccagggg

SEQ ID NO: 5919351 - DNA, 13 bp, Homo sapiens
ggcccccaggggc

SEQ ID NO: 5919352 - DNA, 17 bp, Homo sapiens
ggcccccaggggcagga

SEQ ID NO: 5919353 - DNA, 18 bp, Homo sapiens
ggcccccaggggcaggac

SEQ ID NO: 5919354 - DNA, 23 bp, Homo sapiens
ggcccccaggtctgatctgggtt

SEQ ID NO: 5919355 - DNA, 23 bp, Homo sapiens
ggcccccagtgggaccacatgcc

SEQ ID NO: 5919356 - DNA, 24 bp, Homo sapiens
ggcccccagtgggaccacatgcca

SEQ ID NO: 5919357 - DNA, 14 bp, Homo sapiens
ggcccccagtgggg

SEQ ID NO: 5919358 - DNA, 20 bp, Homo sapiens
ggcccccagtggggacaggg

SEQ ID NO: 5919359 - DNA, 17 bp, Homo sapiens
ggcccccatcagccctg

SEQ ID NO: 5919360 - DNA, 18 bp, Homo sapiens
ggcccccatcagccctgc

SEQ ID NO: 5919361 - DNA, 19 bp, Homo sapiens
ggcccccatcagccctgct

SEQ ID NO: 5919362 - DNA, 19 bp, Homo sapiens
ggcccccatcatcctctgg

SEQ ID NO: 5919363 - DNA, 16 bp, Homo sapiens
ggccccccaaatccca

SEQ ID NO: 5919364 - DNA, 20 bp, Homo sapiens
ggccccccacacgcgtgtgt

SEQ ID NO: 5919365 - DNA, 23 bp, Homo sapiens
ggccccccacacgcgtgtgtaca

SEQ ID NO: 5919366 - DNA, 23 bp, Homo sapiens
ggccccccagctcaggggcagct

SEQ ID NO: 5919367 - DNA, 15 bp, Homo sapiens
ggcccccccagcccc

SEQ ID NO: 5919368 - DNA, 21 bp, Homo sapiens
ggccccccgcacagccacccg

SEQ ID NO: 5919369 - DNA, 16 bp, Homo sapiens
ggccccccgcagcacc

SEQ ID NO: 5919370 - DNA, 23 bp, Homo sapiens
ggccccccgcgctcgcccagcag

SEQ ID NO: 5919371 - DNA, 16 bp, Homo sapiens
ggcccccctccaggca

SEQ ID NO: 5919372 - DNA, 23 bp, Homo sapiens
ggcccccctccaggcatgctggc

SEQ ID NO: 5919373 - DNA, 15 bp, Homo sapiens
ggcccccctcccccc

SEQ ID NO: 5919374 - DNA, 14 bp, Homo sapiens
ggcccccctctcgg

SEQ ID NO: 5919375 - DNA, 15 bp, Homo sapiens
ggcccccctggtccc

SEQ ID NO: 5919376 - DNA, 20 bp, Homo sapiens
ggcccccgaactgtgccttc

SEQ ID NO: 5919377 - DNA, 13 bp, Homo sapiens
ggcccccgagctg

SEQ ID NO: 5919378 - DNA, 15 bp, Homo sapiens
ggcccccgagctggg

SEQ ID NO: 5919379 - DNA, 20 bp, Homo sapiens
ggcccccgcacgcaagcctc

SEQ ID NO: 5919380 - DNA, 23 bp, Homo sapiens
ggcccccgcacgcaagcctcagc

SEQ ID NO: 5919381 - DNA, 13 bp, Homo sapiens
ggcccccgccccg

SEQ ID NO: 5919382 - DNA, 18 bp, Homo sapiens
ggcccccgccctctgccc

SEQ ID NO: 5919383 - DNA, 21 bp, Homo sapiens
ggcccccggaggcgcccacct

SEQ ID NO: 5919384 - DNA, 19 bp, Homo sapiens
ggcccccggctttcctccg

SEQ ID NO: 5919385 - DNA, 14 bp, Homo sapiens
ggcccccgggcctg

SEQ ID NO: 5919386 - DNA, 15 bp, Homo sapiens
ggcccccgggcctgc

SEQ ID NO: 5919387 - DNA, 16 bp, Homo sapiens
ggcccccgtgttcagg

SEQ ID NO: 5919388 - DNA, 19 bp, Homo sapiens
ggcccccgttgggacccac

SEQ ID NO: 5919389 - DNA, 13 bp, Homo sapiens
ggccccctaggat

SEQ ID NO: 5919390 - DNA, 21 bp, Homo sapiens
ggccccctccccccagactct

SEQ ID NO: 5919391 - DNA, 16 bp, Homo sapiens
ggccccctccctggat

SEQ ID NO: 5919392 - DNA, 18 bp, Homo sapiens
ggccccctcgcgcccctg

SEQ ID NO: 5919393 - DNA, 20 bp, Homo sapiens
ggccccctctcaggagccat

SEQ ID NO: 5919394 - DNA, 18 bp, Homo sapiens
ggccccctggtctctggt

SEQ ID NO: 5919395 - DNA, 12 bp, Homo sapiens
ggccccctgtcc

SEQ ID NO: 5919396 - DNA, 14 bp, Homo sapiens
ggccccctgtcccc

SEQ ID NO: 5919397 - DNA, 14 bp, Homo sapiens
ggccccctgtcctc

SEQ ID NO: 5919398 - DNA, 15 bp, Homo sapiens
ggccccctgtgccag

SEQ ID NO: 5919399 - DNA, 17 bp, Homo sapiens
ggccccctgtgccagct

SEQ ID NO: 5919400 - DNA, 16 bp, Homo sapiens
ggcccccttcaggagc

SEQ ID NO: 5919401 - DNA, 23 bp, Homo sapiens
ggcccccttcaggagcctggcca

SEQ ID NO: 5919402 - DNA, 11 bp, Homo sapiens
ggcccccttcc

SEQ ID NO: 5919403 - DNA, 15 bp, Homo sapiens
ggcccccttcctggc

SEQ ID NO: 5919404 - DNA, 18 bp, Homo sapiens
ggccccctttcccgggct

SEQ ID NO: 5919405 - DNA, 19 bp, Homo sapiens
ggccccctttctatgttca

SEQ ID NO: 5919406 - DNA, 18 bp, Homo sapiens
ggccccgaatgtcactgg

SEQ ID NO: 5919407 - DNA, 14 bp, Homo sapiens
ggccccgagctcag

SEQ ID NO: 5919408 - DNA, 16 bp, Homo sapiens
ggccccgatggactcc

SEQ ID NO: 5919409 - DNA, 15 bp, Homo sapiens
ggccccgcacccctc

SEQ ID NO: 5919410 - DNA, 15 bp, Homo sapiens
ggccccgccagggct

SEQ ID NO: 5919411 - DNA, 16 bp, Homo sapiens
ggccccgcccgagccc

SEQ ID NO: 5919412 - DNA, 20 bp, Homo sapiens
ggccccgcccgagcccctgc

SEQ ID NO: 5919413 - DNA, 15 bp, Homo sapiens
ggccccgccgcctgg

SEQ ID NO: 5919414 - DNA, 18 bp, Homo sapiens
ggccccgccgcctggtac

SEQ ID NO: 5919415 - DNA, 14 bp, Homo sapiens
ggccccgcgcgtgc

SEQ ID NO: 5919416 - DNA, 18 bp, Homo sapiens
ggccccgcgcgtgccccc

SEQ ID NO: 5919417 - DNA, 19 bp, Homo sapiens
ggccccgcgcgtgccccca

SEQ ID NO: 5919418 - DNA, 20 bp, Homo sapiens
ggccccgcgcgtgcccccag

SEQ ID NO: 5919419 - DNA, 21 bp, Homo sapiens
ggccccgcgcgtgcccccagc

SEQ ID NO: 5919420 - DNA, 16 bp, Homo sapiens
ggccccgcggagcccc

SEQ ID NO: 5919421 - DNA, 23 bp, Homo sapiens
ggccccggatcagagcaggacct

SEQ ID NO: 5919422 - DNA, 14 bp, Homo sapiens
ggccccggccccag

SEQ ID NO: 5919423 - DNA, 16 bp, Homo sapiens
ggccccggctcccacc

SEQ ID NO: 5919424 - DNA, 20 bp, Homo sapiens
ggccccgggacccacggagc

SEQ ID NO: 5919425 - DNA, 17 bp, Homo sapiens
ggccccgggctggagaa

SEQ ID NO: 5919426 - DNA, 18 bp, Homo sapiens
ggccccgggctggagaaa

SEQ ID NO: 5919427 - DNA, 15 bp, Homo sapiens
ggccccgtctcaggt

SEQ ID NO: 5919428 - DNA, 20 bp, Homo sapiens
ggcccctagaaaccacctgg

SEQ ID NO: 5919429 - DNA, 13 bp, Homo sapiens
ggcccctcaacag

SEQ ID NO: 5919430 - DNA, 17 bp, Homo sapiens
ggcccctcacatcctct

SEQ ID NO: 5919431 - DNA, 11 bp, Homo sapiens
ggcccctcacc

SEQ ID NO: 5919432 - DNA, 17 bp, Homo sapiens
ggcccctcaccctctgt

SEQ ID NO: 5919433 - DNA, 19 bp, Homo sapiens
ggcccctcaccctgcctta

SEQ ID NO: 5919434 - DNA, 15 bp, Homo sapiens
ggcccctcacctggt

SEQ ID NO: 5919435 - DNA, 21 bp, Homo sapiens
ggcccctcacctggtacctgg

SEQ ID NO: 5919436 - DNA, 14 bp, Homo sapiens
ggcccctcagagcc

SEQ ID NO: 5919437 - DNA, 12 bp, Homo sapiens
ggcccctcagcc

SEQ ID NO: 5919438 - DNA, 15 bp, Homo sapiens
ggcccctcagccacc

SEQ ID NO: 5919439 - DNA, 15 bp, Homo sapiens
ggcccctcagcctgc

SEQ ID NO: 5919440 - DNA, 12 bp, Homo sapiens
ggcccctcaggg

SEQ ID NO: 5919441 - DNA, 17 bp, Homo sapiens
ggcccctcaggggaagc

SEQ ID NO: 5919442 - DNA, 19 bp, Homo sapiens
ggcccctcagggtccctgg

SEQ ID NO: 5919443 - DNA, 21 bp, Homo sapiens
ggcccctcagggtccctggtg

SEQ ID NO: 5919444 - DNA, 18 bp, Homo sapiens
ggcccctccacgcctcct

SEQ ID NO: 5919445 - DNA, 20 bp, Homo sapiens
ggcccctccagaccctgcct

SEQ ID NO: 5919446 - DNA, 14 bp, Homo sapiens
ggcccctccagcac

SEQ ID NO: 5919447 - DNA, 17 bp, Homo sapiens
ggcccctccagcttgtg

SEQ ID NO: 5919448 - DNA, 15 bp, Homo sapiens
ggcccctccaggaac

SEQ ID NO: 5919449 - DNA, 17 bp, Homo sapiens
ggcccctccatccaccc

SEQ ID NO: 5919450 - DNA, 22 bp, Homo sapiens
ggcccctcccacacacacccac

SEQ ID NO: 5919451 - DNA, 23 bp, Homo sapiens
ggcccctcccacacccaaagctg

SEQ ID NO: 5919452 - DNA, 22 bp, Homo sapiens
ggcccctccccaactccttcct

SEQ ID NO: 5919453 - DNA, 13 bp, Homo sapiens
ggcccctcccccg

SEQ ID NO: 5919454 - DNA, 17 bp, Homo sapiens
ggcccctcccccgtcct

SEQ ID NO: 5919455 - DNA, 14 bp, Homo sapiens
ggcccctcccctcc

SEQ ID NO: 5919456 - DNA, 15 bp, Homo sapiens
ggcccctcccctgca

SEQ ID NO: 5919457 - DNA, 14 bp, Homo sapiens
ggcccctccctacc

SEQ ID NO: 5919458 - DNA, 16 bp, Homo sapiens
ggcccctccctacctc

SEQ ID NO: 5919459 - DNA, 20 bp, Homo sapiens
ggcccctccctacctcaacc

SEQ ID NO: 5919460 - DNA, 15 bp, Homo sapiens
ggcccctccctctcc

SEQ ID NO: 5919461 - DNA, 19 bp, Homo sapiens
ggcccctccctctgcccca

SEQ ID NO: 5919462 - DNA, 14 bp, Homo sapiens
ggcccctcctagac

SEQ ID NO: 5919463 - DNA, 21 bp, Homo sapiens
ggcccctcctagacccaggtg

SEQ ID NO: 5919464 - DNA, 23 bp, Homo sapiens
ggcccctcctagacccaggtgga

SEQ ID NO: 5919465 - DNA, 20 bp, Homo sapiens
ggcccctcctccagagcctg

SEQ ID NO: 5919466 - DNA, 13 bp, Homo sapiens
ggcccctcctctg

SEQ ID NO: 5919467 - DNA, 14 bp, Homo sapiens
ggcccctcctctgt

SEQ ID NO: 5919468 - DNA, 23 bp, Homo sapiens
ggcccctccttgcaaccaggcag

SEQ ID NO: 5919469 - DNA, 23 bp, Homo sapiens
ggcccctcggcattcacacacag

SEQ ID NO: 5919470 - DNA, 15 bp, Homo sapiens
ggcccctctcagccc

SEQ ID NO: 5919471 - DNA, 20 bp, Homo sapiens
ggcccctctcagccctcaca

SEQ ID NO: 5919472 - DNA, 12 bp, Homo sapiens
ggcccctctcct

SEQ ID NO: 5919473 - DNA, 14 bp, Homo sapiens
ggcccctctcctcc

SEQ ID NO: 5919474 - DNA, 21 bp, Homo sapiens
ggcccctctctagggacccct

SEQ ID NO: 5919475 - DNA, 14 bp, Homo sapiens
ggcccctctgacct

SEQ ID NO: 5919476 - DNA, 24 bp, Homo sapiens
ggcccctctgactcccaaagagct

SEQ ID NO: 5919477 - DNA, 16 bp, Homo sapiens
ggcccctctgcccagc

SEQ ID NO: 5919478 - DNA, 15 bp, Homo sapiens
ggcccctctgctgtc

SEQ ID NO: 5919479 - DNA, 22 bp, Homo sapiens
ggcccctctgctgtcctgcagt

SEQ ID NO: 5919480 - DNA, 16 bp, Homo sapiens
ggcccctctgtggagc

SEQ ID NO: 5919481 - DNA, 21 bp, Homo sapiens
ggcccctcttattcctctagg

SEQ ID NO: 5919482 - DNA, 23 bp, Homo sapiens
ggcccctgaagtgaccccagctc

SEQ ID NO: 5919483 - DNA, 17 bp, Homo sapiens
ggcccctgagcccagag

SEQ ID NO: 5919484 - DNA, 18 bp, Homo sapiens
ggcccctgagcccagaga

SEQ ID NO: 5919485 - DNA, 15 bp, Homo sapiens
ggcccctgaggactg

SEQ ID NO: 5919486 - DNA, 16 bp, Homo sapiens
ggcccctgccaccctg

SEQ ID NO: 5919487 - DNA, 17 bp, Homo sapiens
ggcccctgccagacccc

SEQ ID NO: 5919488 - DNA, 12 bp, Homo sapiens
ggcccctgcccc

SEQ ID NO: 5919489 - DNA, 20 bp, Homo sapiens
ggcccctgcccggctgcgga

SEQ ID NO: 5919490 - DNA, 17 bp, Homo sapiens
ggcccctgcctctctgc

SEQ ID NO: 5919491 - DNA, 19 bp, Homo sapiens
ggcccctgcctgccttctc

SEQ ID NO: 5919492 - DNA, 22 bp, Homo sapiens
ggcccctgctccgaggggctca

SEQ ID NO: 5919493 - DNA, 13 bp, Homo sapiens
ggcccctgctggt

SEQ ID NO: 5919494 - DNA, 21 bp, Homo sapiens
ggcccctgctgtctctctggg

SEQ ID NO: 5919495 - DNA, 10 bp, Homo sapiens
ggcccctgga

SEQ ID NO: 5919496 - DNA, 13 bp, Homo sapiens
ggcccctggagcc

SEQ ID NO: 5919497 - DNA, 22 bp, Homo sapiens
ggcccctggaggctgcctccca

SEQ ID NO: 5919498 - DNA, 21 bp, Homo sapiens
ggcccctggcacgtcctccac

SEQ ID NO: 5919499 - DNA, 22 bp, Homo sapiens
ggcccctggcagcacagcccag

SEQ ID NO: 5919500 - DNA, 16 bp, Homo sapiens
ggccctctgcctgcac

SEQ ID NO: 5919501 - DNA, 19 bp, Homo sapiens
ggccctctgcctgcactcc

SEQ ID NO: 5919502 - DNA, 20 bp, Homo sapiens
ggccctctgcctgcactccc

SEQ ID NO: 5919503 - DNA, 14 bp, Homo sapiens
ggccctctggagtg

SEQ ID NO: 5919504 - DNA, 18 bp, Homo sapiens
ggccctctggagtggcca

SEQ ID NO: 5919505 - DNA, 14 bp, Homo sapiens
ggccctctgtggcc

SEQ ID NO: 5919506 - DNA, 16 bp, Homo sapiens
ggccctctgtggcctg

SEQ ID NO: 5919507 - DNA, 15 bp, Homo sapiens
ggccctcttgccagc

SEQ ID NO: 5919508 - DNA, 22 bp, Homo sapiens
ggccctcttgccagcctccttg

SEQ ID NO: 5919509 - DNA, 18 bp, Homo sapiens
ggccctcttgcgggcctg

SEQ ID NO: 5919510 - DNA, 19 bp, Homo sapiens
ggccctcttgcgggcctgg

SEQ ID NO: 5919511 - DNA, 13 bp, Homo sapiens
ggccctgaaccac

SEQ ID NO: 5919512 - DNA, 14 bp, Homo sapiens
ggccctgacttctg

SEQ ID NO: 5919513 - DNA, 12 bp, Homo sapiens
ggccctgagcca

SEQ ID NO: 5919514 - DNA, 23 bp, Homo sapiens
ggccctgagccagagacaaggtc

SEQ ID NO: 5919515 - DNA, 15 bp, Homo sapiens
ggccctgaggaataa

SEQ ID NO: 5919516 - DNA, 17 bp, Homo sapiens
ggccctgaggaataaag

SEQ ID NO: 5919517 - DNA, 18 bp, Homo sapiens
ggccctgaggtgtggggg

SEQ ID NO: 5919518 - DNA, 19 bp, Homo sapiens
ggccctgaggtgtgggggc

SEQ ID NO: 5919519 - DNA, 13 bp, Homo sapiens
ggccctgagtcct

SEQ ID NO: 5919520 - DNA, 13 bp, Homo sapiens
ggccctgatccag

SEQ ID NO: 5919521 - DNA, 14 bp, Homo sapiens
ggccctgatccagg

SEQ ID NO: 5919522 - DNA, 22 bp, Homo sapiens
ggccctgcaaaaggactctcag

SEQ ID NO: 5919523 - DNA, 22 bp, Homo sapiens
ggccctgcaagacacaggctca

SEQ ID NO: 5919524 - DNA, 15 bp, Homo sapiens
ggccctgcaagggcg

SEQ ID NO: 5919525 - DNA, 18 bp, Homo sapiens
ggccctgcacctgtgcag

SEQ ID NO: 5919526 - DNA, 15 bp, Homo sapiens
ggccctgcactgtcc

SEQ ID NO: 5919527 - DNA, 18 bp, Homo sapiens
ggccctgcactgtcctgc

SEQ ID NO: 5919528 - DNA, 20 bp, Homo sapiens
ggccctgcactgtcctgctc

SEQ ID NO: 5919529 - DNA, 23 bp, Homo sapiens
ggccctgcactgtcctgctccac

SEQ ID NO: 5919530 - DNA, 17 bp, Homo sapiens
ggccctgcaggagcagg

SEQ ID NO: 5919531 - DNA, 16 bp, Homo sapiens
ggccctgcaggaggcc

SEQ ID NO: 5919532 - DNA, 17 bp, Homo sapiens
ggccctgcaggaggcct

SEQ ID NO: 5919533 - DNA, 22 bp, Homo sapiens
ggccctgcaggaggcctgggag

SEQ ID NO: 5919534 - DNA, 24 bp, Homo sapiens
ggccctgcaggctgcaggagggca

SEQ ID NO: 5919535 - DNA, 17 bp, Homo sapiens
ggccctgcattggcctg

SEQ ID NO: 5919536 - DNA, 23 bp, Homo sapiens
ggccctgcattggcctggcctcc

SEQ ID NO: 5919537 - DNA, 14 bp, Homo sapiens
ggccctgccacgtc

SEQ ID NO: 5919538 - DNA, 19 bp, Homo sapiens
ggccctgccacgtcccgct

SEQ ID NO: 5919539 - DNA, 21 bp, Homo sapiens
ggccctgccacgtcccgctgc

SEQ ID NO: 5919540 - DNA, 21 bp, Homo sapiens
ggccctgccagtggggaagga

SEQ ID NO: 5919541 - DNA, 20 bp, Homo sapiens
ggccctgccatcttcccagc

SEQ ID NO: 5919542 - DNA, 19 bp, Homo sapiens
ggccctgccattggcctct

SEQ ID NO: 5919543 - DNA, 10 bp, Homo sapiens
ggccctgccc

SEQ ID NO: 5919544 - DNA, 12 bp, Homo sapiens
ggccctgcccac

SEQ ID NO: 5919545 - DNA, 14 bp, Homo sapiens
ggccctgcccagcc

SEQ ID NO: 5919546 - DNA, 19 bp, Homo sapiens
ggccctgcccagccagcca

SEQ ID NO: 5919547 - DNA, 12 bp, Homo sapiens
ggccctgcccca

SEQ ID NO: 5919548 - DNA, 20 bp, Homo sapiens
ggccctgccccacacaggcc

SEQ ID NO: 5919549 - DNA, 21 bp, Homo sapiens
ggccctgccccacacaggcct

SEQ ID NO: 5919550 - DNA, 22 bp, Homo sapiens
ggccctgccccacacaggcctg

SEQ ID NO: 5919551 - DNA, 20 bp, Homo sapiens
ggccctgccccaccccatcc

SEQ ID NO: 5919552 - DNA, 13 bp, Homo sapiens
ggccctgccccag

SEQ ID NO: 5919553 - DNA, 16 bp, Homo sapiens
ggccctgccccagccc

SEQ ID NO: 5919554 - DNA, 19 bp, Homo sapiens
ggccctgccccaggcctgg

SEQ ID NO: 5919555 - DNA, 22 bp, Homo sapiens
ggccctgccccatcctgggcct

SEQ ID NO: 5919556 - DNA, 14 bp, Homo sapiens
ggccctgcccccac

SEQ ID NO: 5919557 - DNA, 17 bp, Homo sapiens
ggccctgcccccacccc

SEQ ID NO: 5919558 - DNA, 22 bp, Homo sapiens
ggccctgcccccaccccttcct

SEQ ID NO: 5919559 - DNA, 14 bp, Homo sapiens
ggccctgcccccca

SEQ ID NO: 5919560 - DNA, 13 bp, Homo sapiens
ggccctgcccctc

SEQ ID NO: 5919561 - DNA, 17 bp, Homo sapiens
ggccctgcccctccccc

SEQ ID NO: 5919562 - DNA, 11 bp, Homo sapiens
ggccctgcccg

SEQ ID NO: 5919563 - DNA, 23 bp, Homo sapiens
ggccctgcccggggagctgcaga

SEQ ID NO: 5919564 - DNA, 17 bp, Homo sapiens
ggccctgccctccccca

SEQ ID NO: 5919565 - DNA, 15 bp, Homo sapiens
ggccctgccctctcc

SEQ ID NO: 5919566 - DNA, 18 bp, Homo sapiens
ggccctgccctgaggaag

SEQ ID NO: 5919567 - DNA, 13 bp, Homo sapiens
ggccctgccctgt

SEQ ID NO: 5919568 - DNA, 20 bp, Homo sapiens
ggccctgcccttggcaccac

SEQ ID NO: 5919569 - DNA, 13 bp, Homo sapiens
ggccctgcctcac

SEQ ID NO: 5919570 - DNA, 15 bp, Homo sapiens
ggccctgcctcctgg

SEQ ID NO: 5919571 - DNA, 11 bp, Homo sapiens
ggccctgcctg

SEQ ID NO: 5919572 - DNA, 15 bp, Homo sapiens
ggccctgcctgcagc

SEQ ID NO: 5919573 - DNA, 18 bp, Homo sapiens
ggccctgcctgcagccag

SEQ ID NO: 5919574 - DNA, 21 bp, Homo sapiens
ggccctgcctgcagccagggc

SEQ ID NO: 5919575 - DNA, 23 bp, Homo sapiens
ggccctgcctgcagccagggctg

SEQ ID NO: 5919576 - DNA, 13 bp, Homo sapiens
ggccctgcctgct

SEQ ID NO: 5919577 - DNA, 14 bp, Homo sapiens
ggccctgccttctt

SEQ ID NO: 5919578 - DNA, 12 bp, Homo sapiens
ggccctgcgccc

SEQ ID NO: 5919579 - DNA, 13 bp, Homo sapiens
ggccctgcgccct

SEQ ID NO: 5919580 - DNA, 9 bp, Homo sapiens
ggccctgct

SEQ ID NO: 5919581 - DNA, 22 bp, Homo sapiens
ggccctgctcaggcctcacctg

SEQ ID NO: 5919582 - DNA, 15 bp, Homo sapiens
ggccctgctcctgca

SEQ ID NO: 5919583 - DNA, 21 bp, Homo sapiens
ggccctgctcctgcagcatgg

SEQ ID NO: 5919584 - DNA, 20 bp, Homo sapiens
ggccctgctgagtcatctgt

SEQ ID NO: 5919585 - DNA, 14 bp, Homo sapiens
ggccctgcttcctg

SEQ ID NO: 5919586 - DNA, 20 bp, Homo sapiens
ggccctgctttctacgccaa

SEQ ID NO: 5919587 - DNA, 15 bp, Homo sapiens
ggccctggaactcta

SEQ ID NO: 5919588 - DNA, 23 bp, Homo sapiens
ggccctggacacagcccaccctc

SEQ ID NO: 5919589 - DNA, 16 bp, Homo sapiens
ggccctggagccaggg

SEQ ID NO: 5919590 - DNA, 19 bp, Homo sapiens
ggccctggagccagggcag

SEQ ID NO: 5919591 - DNA, 23 bp, Homo sapiens
ggccctggagccagggcagagga

SEQ ID NO: 5919592 - DNA, 16 bp, Homo sapiens
ggccctggagctcaag

SEQ ID NO: 5919593 - DNA, 12 bp, Homo sapiens
ggccctggagga

SEQ ID NO: 5919594 - DNA, 20 bp, Homo sapiens
ggccctggagggaaggacag

SEQ ID NO: 5919595 - DNA, 19 bp, Homo sapiens
ggccctggaggtctccagg

SEQ ID NO: 5919596 - DNA, 17 bp, Homo sapiens
ggccctggatcagcgtg

SEQ ID NO: 5919597 - DNA, 20 bp, Homo sapiens
ggccctggatcagcgtggcc

SEQ ID NO: 5919598 - DNA, 19 bp, Homo sapiens
ggccctggatgtgcccaca

SEQ ID NO: 5919599 - DNA, 20 bp, Homo sapiens
ggccctggatgtgcccacag

SEQ ID NO: 5919600 - DNA, 21 bp, Homo sapiens
ggccctggatgtgcccacagg

SEQ ID NO: 5919601 - DNA, 23 bp, Homo sapiens
ggccctggatgtgcccacaggga

SEQ ID NO: 5919602 - DNA, 22 bp, Homo sapiens
ggccctggcacccccacaagct

SEQ ID NO: 5919603 - DNA, 13 bp, Homo sapiens
ggccctggcagcc

SEQ ID NO: 5919604 - DNA, 11 bp, Homo sapiens
ggccctggcca

SEQ ID NO: 5919605 - DNA, 13 bp, Homo sapiens
ggccctggccagc

SEQ ID NO: 5919606 - DNA, 14 bp, Homo sapiens
ggccctggccagga

SEQ ID NO: 5919607 - DNA, 12 bp, Homo sapiens
ggccctggccct

SEQ ID NO: 5919608 - DNA, 12 bp, Homo sapiens
ggccctggcctg

SEQ ID NO: 5919609 - DNA, 17 bp, Homo sapiens
ggccctggcgggtggct

SEQ ID NO: 5919610 - DNA, 19 bp, Homo sapiens
ggccctggcgggtggctgc

SEQ ID NO: 5919611 - DNA, 13 bp, Homo sapiens
ggccctggctccc

SEQ ID NO: 5919612 - DNA, 22 bp, Homo sapiens
ggccctggctcccacaggccct

SEQ ID NO: 5919613 - DNA, 13 bp, Homo sapiens
ggccctggctctg

SEQ ID NO: 5919614 - DNA, 16 bp, Homo sapiens
ggccctggctctgtca

SEQ ID NO: 5919615 - DNA, 12 bp, Homo sapiens
ggccctggcttg

SEQ ID NO: 5919616 - DNA, 13 bp, Homo sapiens
ggccctgggcctc

SEQ ID NO: 5919617 - DNA, 16 bp, Homo sapiens
ggccctgggcctcagt

SEQ ID NO: 5919618 - DNA, 15 bp, Homo sapiens
ggccctgggcctcca

SEQ ID NO: 5919619 - DNA, 22 bp, Homo sapiens
ggccctgggcctccacctctgt

SEQ ID NO: 5919620 - DNA, 16 bp, Homo sapiens
ggccctgggctcggag

SEQ ID NO: 5919621 - DNA, 14 bp, Homo sapiens
ggccctgggctgga

SEQ ID NO: 5919622 - DNA, 15 bp, Homo sapiens
ggccctgggctgggt

SEQ ID NO: 5919623 - DNA, 11 bp, Homo sapiens
ggccctgggga

SEQ ID NO: 5919624 - DNA, 18 bp, Homo sapiens
ggccctggggaggggtgg

SEQ ID NO: 5919625 - DNA, 11 bp, Homo sapiens
ggccctggggc

SEQ ID NO: 5919626 - DNA, 21 bp, Homo sapiens
ggccctggggcccctcccctc

SEQ ID NO: 5919627 - DNA, 15 bp, Homo sapiens
ggccctggggcctgt

SEQ ID NO: 5919628 - DNA, 16 bp, Homo sapiens
ggccctggggcctgta

SEQ ID NO: 5919629 - DNA, 13 bp, Homo sapiens
ggccctggggctg

SEQ ID NO: 5919630 - DNA, 18 bp, Homo sapiens
ggccctggggctgccctc

SEQ ID NO: 5919631 - DNA, 20 bp, Homo sapiens
ggccctggggctgccctcgg

SEQ ID NO: 5919632 - DNA, 22 bp, Homo sapiens
ggccctggggtaccatgtggcc

SEQ ID NO: 5919633 - DNA, 12 bp, Homo sapiens
ggccctggggtc

SEQ ID NO: 5919634 - DNA, 15 bp, Homo sapiens
ggccctggggtccca

SEQ ID NO: 5919635 - DNA, 18 bp, Homo sapiens
ggccctggggtccccact

SEQ ID NO: 5919636 - DNA, 20 bp, Homo sapiens
ggccctggggtccccactcc

SEQ ID NO: 5919637 - DNA, 22 bp, Homo sapiens
ggccctggggtccccactccct

SEQ ID NO: 5919638 - DNA, 18 bp, Homo sapiens
ggccctggggtgtgtctc

SEQ ID NO: 5919639 - DNA, 12 bp, Homo sapiens
ggccctgggtaa

SEQ ID NO: 5919640 - DNA, 20 bp, Homo sapiens
ggccctgggtaagaagggtg

SEQ ID NO: 5919641 - DNA, 15 bp, Homo sapiens
ggccctgggttcctc

SEQ ID NO: 5919642 - DNA, 15 bp, Homo sapiens
ggccctggtaaaata

SEQ ID NO: 5919643 - DNA, 15 bp, Homo sapiens
ggccctggtctggct

SEQ ID NO: 5919644 - DNA, 15 bp, Homo sapiens
ggccctggtggagag

SEQ ID NO: 5919645 - DNA, 22 bp, Homo sapiens
ggccctggttcccccaggaccc

SEQ ID NO: 5919646 - DNA, 12 bp, Homo sapiens
ggccctgtacag

SEQ ID NO: 5919647 - DNA, 14 bp, Homo sapiens
ggccctgtagccct

SEQ ID NO: 5919648 - DNA, 15 bp, Homo sapiens
ggccctgtagccctg

SEQ ID NO: 5919649 - DNA, 18 bp, Homo sapiens
ggccctgtagttaggcct

SEQ ID NO: 5919650 - DNA, 22 bp, Homo sapiens
ggccctgtagttaggcctggct

SEQ ID NO: 5919651 - DNA, 14 bp, Homo sapiens
ggccctgtcccagg

SEQ ID NO: 5919652 - DNA, 17 bp, Homo sapiens
ggccctgtcccaggccg

SEQ ID NO: 5919653 - DNA, 18 bp, Homo sapiens
ggccctgtcccctggagt

SEQ ID NO: 5919654 - DNA, 15 bp, Homo sapiens
ggccctgtccctccc

SEQ ID NO: 5919655 - DNA, 18 bp, Homo sapiens
ggccctgtccctcccacc

SEQ ID NO: 5919656 - DNA, 20 bp, Homo sapiens
ggccctgtccctcccacctc

SEQ ID NO: 5919657 - DNA, 22 bp, Homo sapiens
ggccctgtccctcccacctctg

SEQ ID NO: 5919658 - DNA, 23 bp, Homo sapiens
ggccctgtccctcccacctctgt

SEQ ID NO: 5919659 - DNA, 19 bp, Homo sapiens
ggccctgtcgcccctcctt

SEQ ID NO: 5919660 - DNA, 22 bp, Homo sapiens
ggccctgtgagcacaaagaaga

SEQ ID NO: 5919661 - DNA, 16 bp, Homo sapiens
ggccctgtgcagacct

SEQ ID NO: 5919662 - DNA, 16 bp, Homo sapiens
ggccctgtgcctgggc

SEQ ID NO: 5919663 - DNA, 17 bp, Homo sapiens
ggccctgtgggagtcca

SEQ ID NO: 5919664 - DNA, 15 bp, Homo sapiens
ggccctgtggtgctg

SEQ ID NO: 5919665 - DNA, 14 bp, Homo sapiens
ggccctgtgtgcag

SEQ ID NO: 5919666 - DNA, 15 bp, Homo sapiens
ggccctgtgtgcagg

SEQ ID NO: 5919667 - DNA, 16 bp, Homo sapiens
ggccctgttccctgga

SEQ ID NO: 5919668 - DNA, 15 bp, Homo sapiens
ggcccttacacactc

SEQ ID NO: 5919669 - DNA, 21 bp, Homo sapiens
ggcccttacacactcaggcct

SEQ ID NO: 5919670 - DNA, 16 bp, Homo sapiens
ggcccttagagacccc

SEQ ID NO: 5919671 - DNA, 20 bp, Homo sapiens
ggcccttatgactgccaaga

SEQ ID NO: 5919672 - DNA, 20 bp, Homo sapiens
ggcccttcactgcctttgct

SEQ ID NO: 5919673 - DNA, 22 bp, Homo sapiens
ggcccttcagtctgctccacca

SEQ ID NO: 5919674 - DNA, 19 bp, Homo sapiens
ggcccttcctcctccacca

SEQ ID NO: 5919675 - DNA, 23 bp, Homo sapiens
ggcccttcctcgcacagggcatg

SEQ ID NO: 5919676 - DNA, 18 bp, Homo sapiens
ggcccttcctctccactg

SEQ ID NO: 5919677 - DNA, 12 bp, Homo sapiens
ggcccttcctgg

SEQ ID NO: 5919678 - DNA, 13 bp, Homo sapiens
ggcccttcctgga

SEQ ID NO: 5919679 - DNA, 23 bp, Homo sapiens
ggccgggaccccgagcctggctc

SEQ ID NO: 5919680 - DNA, 12 bp, Homo sapiens
ggccgggactgg

SEQ ID NO: 5919681 - DNA, 12 bp, Homo sapiens
ggccgggcacag

SEQ ID NO: 5919682 - DNA, 18 bp, Homo sapiens
ggccgggcaccaccccca

SEQ ID NO: 5919683 - DNA, 21 bp, Homo sapiens
ggccgggcacggtcacacggc

SEQ ID NO: 5919684 - DNA, 13 bp, Homo sapiens
ggccgggcaggcg

SEQ ID NO: 5919685 - DNA, 16 bp, Homo sapiens
ggccgggcagggggac

SEQ ID NO: 5919686 - DNA, 13 bp, Homo sapiens
ggccgggcccagg

SEQ ID NO: 5919687 - DNA, 22 bp, Homo sapiens
ggccgggcctgtacagtctgtc

SEQ ID NO: 5919688 - DNA, 15 bp, Homo sapiens
ggccgggctgctgct

SEQ ID NO: 5919689 - DNA, 16 bp, Homo sapiens
ggccgggctgctgctg

SEQ ID NO: 5919690 - DNA, 14 bp, Homo sapiens
ggccgggctggctt

SEQ ID NO: 5919691 - DNA, 15 bp, Homo sapiens
ggccgggctggcttc

SEQ ID NO: 5919692 - DNA, 18 bp, Homo sapiens
ggccgggctgtagatcag

SEQ ID NO: 5919693 - DNA, 21 bp, Homo sapiens
ggccgggctttccagaaggcc

SEQ ID NO: 5919694 - DNA, 21 bp, Homo sapiens
ggccggggaactggccaagct

SEQ ID NO: 5919695 - DNA, 18 bp, Homo sapiens
ggccggggaagctgccag

SEQ ID NO: 5919696 - DNA, 22 bp, Homo sapiens
ggccggggctctgggtgctgcc

SEQ ID NO: 5919697 - DNA, 21 bp, Homo sapiens
ggccggggctgaagccacaca

SEQ ID NO: 5919698 - DNA, 14 bp, Homo sapiens
ggccggggctgccg

SEQ ID NO: 5919699 - DNA, 18 bp, Homo sapiens
ggccgggggaggtgggtg

SEQ ID NO: 5919700 - DNA, 19 bp, Homo sapiens
ggccgggggcggggccggg

SEQ ID NO: 5919701 - DNA, 19 bp, Homo sapiens
ggccggggggaggggacag

SEQ ID NO: 5919702 - DNA, 15 bp, Homo sapiens
ggccgggggtggggg

SEQ ID NO: 5919703 - DNA, 19 bp, Homo sapiens
ggccgggggtgggggcctg

SEQ ID NO: 5919704 - DNA, 15 bp, Homo sapiens
ggccggtaggctgct

SEQ ID NO: 5919705 - DNA, 16 bp, Homo sapiens
ggccggtaggctgctg

SEQ ID NO: 5919706 - DNA, 18 bp, Homo sapiens
ggccggtaggctgctggc

SEQ ID NO: 5919707 - DNA, 23 bp, Homo sapiens
ggccggtccaccccgtcccggcc

SEQ ID NO: 5919708 - DNA, 13 bp, Homo sapiens
ggccggtgccagc

SEQ ID NO: 5919709 - DNA, 15 bp, Homo sapiens
ggccggtgccagctg

SEQ ID NO: 5919710 - DNA, 12 bp, Homo sapiens
ggccggtgctgg

SEQ ID NO: 5919711 - DNA, 14 bp, Homo sapiens
ggccggtgctgggg

SEQ ID NO: 5919712 - DNA, 15 bp, Homo sapiens
ggccggtgctgggtt

SEQ ID NO: 5919713 - DNA, 15 bp, Homo sapiens
ggccggtgtgggctg

SEQ ID NO: 5919714 - DNA, 19 bp, Homo sapiens
ggccggttaacatctttta

SEQ ID NO: 5919715 - DNA, 22 bp, Homo sapiens
ggccgtaccccaccctcagcac

SEQ ID NO: 5919716 - DNA, 19 bp, Homo sapiens
ggccgtaggggctcctgag

SEQ ID NO: 5919717 - DNA, 21 bp, Homo sapiens
ggccgtaggggctcctgagtg

SEQ ID NO: 5919718 - DNA, 19 bp, Homo sapiens
ggccgtatctccggctccc

SEQ ID NO: 5919719 - DNA, 20 bp, Homo sapiens
ggccgtatctccggctccca

SEQ ID NO: 5919720 - DNA, 23 bp, Homo sapiens
ggccgtcacgctttcatgaccac

SEQ ID NO: 5919721 - DNA, 14 bp, Homo sapiens
ggccgtcccctctc

SEQ ID NO: 5919722 - DNA, 17 bp, Homo sapiens
ggccgtcccctctcccc

SEQ ID NO: 5919723 - DNA, 12 bp, Homo sapiens
ggccgtccctga

SEQ ID NO: 5919724 - DNA, 18 bp, Homo sapiens
ggccgtcctcccgggccc

SEQ ID NO: 5919725 - DNA, 23 bp, Homo sapiens
ggccgtctcccttggcccagaga

SEQ ID NO: 5919726 - DNA, 15 bp, Homo sapiens
ggccgtctcctccct

SEQ ID NO: 5919727 - DNA, 17 bp, Homo sapiens
ggccgtctcctccctca

SEQ ID NO: 5919728 - DNA, 20 bp, Homo sapiens
ggccgtcttcactcgccccc

SEQ ID NO: 5919729 - DNA, 21 bp, Homo sapiens
ggccgtgaatgggtgcccaca

SEQ ID NO: 5919730 - DNA, 15 bp, Homo sapiens
ggccgtgcagggcca

SEQ ID NO: 5919731 - DNA, 22 bp, Homo sapiens
ggccgtgcccgcccacctctgc

SEQ ID NO: 5919732 - DNA, 16 bp, Homo sapiens
ggccgtgcctggtggg

SEQ ID NO: 5919733 - DNA, 13 bp, Homo sapiens
ggccgtggctgct

SEQ ID NO: 5919734 - DNA, 17 bp, Homo sapiens
ggccgtggcttgggctg

SEQ ID NO: 5919735 - DNA, 17 bp, Homo sapiens
ggccgtgggacccaggc

SEQ ID NO: 5919736 - DNA, 19 bp, Homo sapiens
ggccgtgggccgggaggca

SEQ ID NO: 5919737 - DNA, 14 bp, Homo sapiens
ggccgtgtgtttag

SEQ ID NO: 5919738 - DNA, 21 bp, Homo sapiens
ggccgttgatgttggctggga

SEQ ID NO: 5919739 - DNA, 13 bp, Homo sapiens
ggccgttggccac

SEQ ID NO: 5919740 - DNA, 20 bp, Homo sapiens
ggcctaaaactggcctgact

SEQ ID NO: 5919741 - DNA, 14 bp, Homo sapiens
ggcctaaacttcag

SEQ ID NO: 5919742 - DNA, 18 bp, Homo sapiens
ggcctaaagaatcccacc

SEQ ID NO: 5919743 - DNA, 19 bp, Homo sapiens
ggcctaaatttattaaata

SEQ ID NO: 5919744 - DNA, 20 bp, Homo sapiens
ggcctaagaggctgccctcc

SEQ ID NO: 5919745 - DNA, 14 bp, Homo sapiens
ggcctaaggctgct

SEQ ID NO: 5919746 - DNA, 14 bp, Homo sapiens
ggcctaagtgcctc

SEQ ID NO: 5919747 - DNA, 22 bp, Homo sapiens
ggcctaataaaactgatgtgaa

SEQ ID NO: 5919748 - DNA, 15 bp, Homo sapiens
ggcctaatccacctg

SEQ ID NO: 5919749 - DNA, 17 bp, Homo sapiens
ggcctacagccacatcc

SEQ ID NO: 5919750 - DNA, 23 bp, Homo sapiens
ggcctacagctttgatccctgac

SEQ ID NO: 5919751 - DNA, 15 bp, Homo sapiens
ggcctacattcttta

SEQ ID NO: 5919752 - DNA, 16 bp, Homo sapiens
ggcctaccacagctgc

SEQ ID NO: 5919753 - DNA, 18 bp, Homo sapiens
ggcctaccacagctgcct

SEQ ID NO: 5919754 - DNA, 21 bp, Homo sapiens
ggcctaccccagttcctagca

SEQ ID NO: 5919755 - DNA, 23 bp, Homo sapiens
ggcctaccccgcagacaccttgg

SEQ ID NO: 5919756 - DNA, 21 bp, Homo sapiens
ggcctacccctttctccagcc

SEQ ID NO: 5919757 - DNA, 13 bp, Homo sapiens
ggcctacctcaag

SEQ ID NO: 5919758 - DNA, 15 bp, Homo sapiens
ggcctacctgctccc

SEQ ID NO: 5919759 - DNA, 15 bp, Homo sapiens
ggcctaccttgtgag

SEQ ID NO: 5919760 - DNA, 22 bp, Homo sapiens
ggcctaccttgtgagggagaga

SEQ ID NO: 5919761 - DNA, 24 bp, Homo sapiens
ggcctactagagtctgaacagctg

SEQ ID NO: 5919762 - DNA, 15 bp, Homo sapiens
ggcctactcctgtct

SEQ ID NO: 5919763 - DNA, 13 bp, Homo sapiens
ggcctagaaaggg

SEQ ID NO: 5919764 - DNA, 18 bp, Homo sapiens
ggcctagaaagggcaagg

SEQ ID NO: 5919765 - DNA, 14 bp, Homo sapiens
ggcctagaccagca

SEQ ID NO: 5919766 - DNA, 13 bp, Homo sapiens
ggcctagaggcct

SEQ ID NO: 5919767 - DNA, 15 bp, Homo sapiens
ggcctagagtggcag

SEQ ID NO: 5919768 - DNA, 16 bp, Homo sapiens
ggcctagcaggcacag

SEQ ID NO: 5919769 - DNA, 19 bp, Homo sapiens
ggcctagcaggcacaggac

SEQ ID NO: 5919770 - DNA, 22 bp, Homo sapiens
ggcctagcatacgtacacattt

SEQ ID NO: 5919771 - DNA, 22 bp, Homo sapiens
ggcctagcccaccctgctgcct

SEQ ID NO: 5919772 - DNA, 17 bp, Homo sapiens
ggcctaggagggtcctc

SEQ ID NO: 5919773 - DNA, 23 bp, Homo sapiens
ggcctaggagggtcctctgagac

SEQ ID NO: 5919774 - DNA, 15 bp, Homo sapiens
ggcctaggattctaa

SEQ ID NO: 5919775 - DNA, 14 bp, Homo sapiens
ggcctaggcctcag

SEQ ID NO: 5919776 - DNA, 16 bp, Homo sapiens
ggcctaggctaggacg

SEQ ID NO: 5919777 - DNA, 13 bp, Homo sapiens
ggcctaggggtgg

SEQ ID NO: 5919778 - DNA, 19 bp, Homo sapiens
ggcctaggtgggagccacc

SEQ ID NO: 5919779 - DNA, 17 bp, Homo sapiens
ggcctagtaaccaaggc

SEQ ID NO: 5919780 - DNA, 18 bp, Homo sapiens
ggcctagtaaccaaggcc

SEQ ID NO: 5919781 - DNA, 21 bp, Homo sapiens
ggcctagtaaccaaggccctg

SEQ ID NO: 5919782 - DNA, 16 bp, Homo sapiens
ggcctagtcagatgga

SEQ ID NO: 5919783 - DNA, 15 bp, Homo sapiens
ggcctagtcagccac

SEQ ID NO: 5919784 - DNA, 22 bp, Homo sapiens
ggcctagtggcttcagcccctg

SEQ ID NO: 5919785 - DNA, 18 bp, Homo sapiens
ggcctatatgccagcgcc

SEQ ID NO: 5919786 - DNA, 18 bp, Homo sapiens
ggcctatctggaagccac

SEQ ID NO: 5919787 - DNA, 17 bp, Homo sapiens
ggcctatgaccctgtgc

SEQ ID NO: 5919788 - DNA, 18 bp, Homo sapiens
ggcctatgaccctgtgcc

SEQ ID NO: 5919789 - DNA, 17 bp, Homo sapiens
ggcctatggagagccct

SEQ ID NO: 5919790 - DNA, 23 bp, Homo sapiens
ggcctatgtgcgaagcaagaaga

SEQ ID NO: 5919791 - DNA, 22 bp, Homo sapiens
ggcctattgcttgggtctctct

SEQ ID NO: 5919792 - DNA, 20 bp, Homo sapiens
ggcctattgttgaataaatg

SEQ ID NO: 5919793 - DNA, 15 bp, Homo sapiens
ggcctatttcagctg

SEQ ID NO: 5919794 - DNA, 20 bp, Homo sapiens
ggcctcaaagcaacccgctg

SEQ ID NO: 5919795 - DNA, 23 bp, Homo sapiens
ggcctcaaagcaacccgctggag

SEQ ID NO: 5919796 - DNA, 20 bp, Homo sapiens
ggcctcaaaggcccgctcta

SEQ ID NO: 5919797 - DNA, 17 bp, Homo sapiens
ggcctcaaccctccctc

SEQ ID NO: 5919798 - DNA, 18 bp, Homo sapiens
ggcctcaaccctccctca

SEQ ID NO: 5919799 - DNA, 21 bp, Homo sapiens
ggcctcaaccctccctcagcc

SEQ ID NO: 5919800 - DNA, 17 bp, Homo sapiens
ggcctcaactcctccca

SEQ ID NO: 5919801 - DNA, 18 bp, Homo sapiens
ggcctcaactcctcccat

SEQ ID NO: 5919802 - DNA, 22 bp, Homo sapiens
ggcctcaactgagaagccaagc

SEQ ID NO: 5919803 - DNA, 23 bp, Homo sapiens
ggcctcaagaaaggcccggaagc

SEQ ID NO: 5919804 - DNA, 20 bp, Homo sapiens
ggcctcaagaacaaacactg

SEQ ID NO: 5919805 - DNA, 17 bp, Homo sapiens
ggcctcaagagcacaca

SEQ ID NO: 5919806 - DNA, 12 bp, Homo sapiens
ggcctcaagatc

SEQ ID NO: 5919807 - DNA, 20 bp, Homo sapiens
ggcctcaagcaatccacctg

SEQ ID NO: 5919808 - DNA, 18 bp, Homo sapiens
ggcctcaagccatcttcc

SEQ ID NO: 5919809 - DNA, 15 bp, Homo sapiens
ggcctcaaggacttg

SEQ ID NO: 5919810 - DNA, 17 bp, Homo sapiens
ggcctcaatctaaggcc

SEQ ID NO: 5919811 - DNA, 14 bp, Homo sapiens
ggcctcacacccag

SEQ ID NO: 5919812 - DNA, 13 bp, Homo sapiens
ggcctcaccaggc

SEQ ID NO: 5919813 - DNA, 19 bp, Homo sapiens
ggcctcaccaggcccacga

SEQ ID NO: 5919814 - DNA, 12 bp, Homo sapiens
ggcctcacccac

SEQ ID NO: 5919815 - DNA, 18 bp, Homo sapiens
ggcctcacccacccctgc

SEQ ID NO: 5919816 - DNA, 19 bp, Homo sapiens
ggcctcacccctcccctgg

SEQ ID NO: 5919817 - DNA, 20 bp, Homo sapiens
ggcctcacccctcccctggg

SEQ ID NO: 5919818 - DNA, 23 bp, Homo sapiens
ggcctcaccctgcttggggcctg

SEQ ID NO: 5919819 - DNA, 18 bp, Homo sapiens
ggcctcaccgagtggggg

SEQ ID NO: 5919820 - DNA, 19 bp, Homo sapiens
ggcctcacctcccagggct

SEQ ID NO: 5919821 - DNA, 21 bp, Homo sapiens
ggcctcacctcccagggctac

SEQ ID NO: 5919822 - DNA, 12 bp, Homo sapiens
ggcctcacctgg

SEQ ID NO: 5919823 - DNA, 19 bp, Homo sapiens
ggcctcacctggcttccca

SEQ ID NO: 5919824 - DNA, 21 bp, Homo sapiens
ggcctcacctggcttcccagg

SEQ ID NO: 5919825 - DNA, 20 bp, Homo sapiens
ggcctcactactcgagccca

SEQ ID NO: 5919826 - DNA, 19 bp, Homo sapiens
ggcctcactaggcttctgg

SEQ ID NO: 5919827 - DNA, 17 bp, Homo sapiens
ggcctcactcaagcctg

SEQ ID NO: 5919828 - DNA, 19 bp, Homo sapiens
ggcctcactggctcatgcc

SEQ ID NO: 5919829 - DNA, 19 bp, Homo sapiens
ggcctcactggctggggca

SEQ ID NO: 5919830 - DNA, 23 bp, Homo sapiens
ggcctcactggctggggcagagg

SEQ ID NO: 5919831 - DNA, 12 bp, Homo sapiens
ggcctcacttcc

SEQ ID NO: 5919832 - DNA, 20 bp, Homo sapiens
ggcctcacttccctgggaac

SEQ ID NO: 5919833 - DNA, 19 bp, Homo sapiens
ggcctcagaccccctcagc

SEQ ID NO: 5919834 - DNA, 18 bp, Homo sapiens
ggcctcagactgcaccca

SEQ ID NO: 5919835 - DNA, 19 bp, Homo sapiens
ggcctcagactgcacccag

SEQ ID NO: 5919836 - DNA, 19 bp, Homo sapiens
ggcctcagagcctgacctg

SEQ ID NO: 5919837 - DNA, 17 bp, Homo sapiens
ggcctcagagcttcctg

SEQ ID NO: 5919838 - DNA, 19 bp, Homo sapiens
ggcctcagagcttcctggg

SEQ ID NO: 5919839 - DNA, 17 bp, Homo sapiens
ggcctcagcacccctgt

SEQ ID NO: 5919840 - DNA, 21 bp, Homo sapiens
ggcctcagcacccctgtctct

SEQ ID NO: 5919841 - DNA, 18 bp, Homo sapiens
ggcctcagcaggaacctg

SEQ ID NO: 5919842 - DNA, 15 bp, Homo sapiens
ggcctcagccagaga

SEQ ID NO: 5919843 - DNA, 13 bp, Homo sapiens
ggcctcagccctg

SEQ ID NO: 5919844 - DNA, 18 bp, Homo sapiens
ggcctcagccctgctccc

SEQ ID NO: 5919845 - DNA, 17 bp, Homo sapiens
ggcctcagcctccaggc

SEQ ID NO: 5919846 - DNA, 18 bp, Homo sapiens
ggcctcagcctccaggca

SEQ ID NO: 5919847 - DNA, 12 bp, Homo sapiens
ggcctcagcctg

SEQ ID NO: 5919848 - DNA, 13 bp, Homo sapiens
ggcctcagcctgc

SEQ ID NO: 5919849 - DNA, 17 bp, Homo sapiens
ggcctcagcctggggct

SEQ ID NO: 5919850 - DNA, 19 bp, Homo sapiens
ggcctcagctcaatgcagt

SEQ ID NO: 5919851 - DNA, 22 bp, Homo sapiens
ggcctcagctgcctcacttcct

SEQ ID NO: 5919852 - DNA, 12 bp, Homo sapiens
ggcctcaggaga

SEQ ID NO: 5919853 - DNA, 13 bp, Homo sapiens
ggcctcaggaggc

SEQ ID NO: 5919854 - DNA, 13 bp, Homo sapiens
ggcctcagggaga

SEQ ID NO: 5919855 - DNA, 11 bp, Homo sapiens
ggcctcagggc

SEQ ID NO: 5919856 - DNA, 11 bp, Homo sapiens
ggcctctgcct

SEQ ID NO: 5919857 - DNA, 16 bp, Homo sapiens
ggcctctgcctccagg

SEQ ID NO: 5919858 - DNA, 20 bp, Homo sapiens
ggcctctgcctccaggaggg

SEQ ID NO: 5919859 - DNA, 13 bp, Homo sapiens
ggcctctgcctgc

SEQ ID NO: 5919860 - DNA, 18 bp, Homo sapiens
ggcctctgcctgctgggg

SEQ ID NO: 5919861 - DNA, 20 bp, Homo sapiens
ggcctctgcgagtggtttct

SEQ ID NO: 5919862 - DNA, 19 bp, Homo sapiens
ggcctctgcggagcacact

SEQ ID NO: 5919863 - DNA, 12 bp, Homo sapiens
ggcctctgctgc

SEQ ID NO: 5919864 - DNA, 13 bp, Homo sapiens
ggcctctgctgcc

SEQ ID NO: 5919865 - DNA, 18 bp, Homo sapiens
ggcctctgctgccccctt

SEQ ID NO: 5919866 - DNA, 13 bp, Homo sapiens
ggcctctgctggc

SEQ ID NO: 5919867 - DNA, 16 bp, Homo sapiens
ggcctctgctggctca

SEQ ID NO: 5919868 - DNA, 17 bp, Homo sapiens
ggcctctgctggctcag

SEQ ID NO: 5919869 - DNA, 18 bp, Homo sapiens
ggcctctgcttgccagcc

SEQ ID NO: 5919870 - DNA, 12 bp, Homo sapiens
ggcctctggaca

SEQ ID NO: 5919871 - DNA, 19 bp, Homo sapiens
ggcctctggactggcctgt

SEQ ID NO: 5919872 - DNA, 14 bp, Homo sapiens
ggcctctggccctc

SEQ ID NO: 5919873 - DNA, 14 bp, Homo sapiens
ggcctctggcctgg

SEQ ID NO: 5919874 - DNA, 15 bp, Homo sapiens
ggcctctggctgcct

SEQ ID NO: 5919875 - DNA, 14 bp, Homo sapiens
ggcctctggcttcc

SEQ ID NO: 5919876 - DNA, 18 bp, Homo sapiens
ggcctctggggcaggacc

SEQ ID NO: 5919877 - DNA, 10 bp, Homo sapiens
ggcctctggt

SEQ ID NO: 5919878 - DNA, 21 bp, Homo sapiens
ggcctctgtaccgcccggcag

SEQ ID NO: 5919879 - DNA, 14 bp, Homo sapiens
ggcctctgtgtaca

SEQ ID NO: 5919880 - DNA, 20 bp, Homo sapiens
ggcctctgtgtccttccctg

SEQ ID NO: 5919881 - DNA, 18 bp, Homo sapiens
ggcctcttcaaattagaa

SEQ ID NO: 5919882 - DNA, 13 bp, Homo sapiens
ggcctcttccctc

SEQ ID NO: 5919883 - DNA, 15 bp, Homo sapiens
ggcctcttccctcag

SEQ ID NO: 5919884 - DNA, 23 bp, Homo sapiens
ggcctcttcgcctttcccaccct

SEQ ID NO: 5919885 - DNA, 16 bp, Homo sapiens
ggcctcttctctcaga

SEQ ID NO: 5919886 - DNA, 18 bp, Homo sapiens
ggcctcttctctcagacc

SEQ ID NO: 5919887 - DNA, 18 bp, Homo sapiens
ggcctcttgagcagtggc

SEQ ID NO: 5919888 - DNA, 17 bp, Homo sapiens
ggcctcttgctggtgca

SEQ ID NO: 5919889 - DNA, 18 bp, Homo sapiens
ggcctcttgctggtgcac

SEQ ID NO: 5919890 - DNA, 17 bp, Homo sapiens
ggcctcttggacctctg

SEQ ID NO: 5919891 - DNA, 20 bp, Homo sapiens
ggcctcttggataccagctc

SEQ ID NO: 5919892 - DNA, 13 bp, Homo sapiens
ggcctcttggcac

SEQ ID NO: 5919893 - DNA, 18 bp, Homo sapiens
ggcctcttggcacctgcc

SEQ ID NO: 5919894 - DNA, 22 bp, Homo sapiens
ggcctcttggctatttctgtgt

SEQ ID NO: 5919895 - DNA, 23 bp, Homo sapiens
ggcctcttggctatttctgtgtc

SEQ ID NO: 5919896 - DNA, 17 bp, Homo sapiens
ggcctcttgtcccttgg

SEQ ID NO: 5919897 - DNA, 15 bp, Homo sapiens
ggcctctttttgccc

SEQ ID NO: 5919898 - DNA, 17 bp, Homo sapiens
ggcctctttttgccctt

SEQ ID NO: 5919899 - DNA, 15 bp, Homo sapiens
ggcctgaaacccgcc

SEQ ID NO: 5919900 - DNA, 20 bp, Homo sapiens
ggcctgaaagcaacagctgg

SEQ ID NO: 5919901 - DNA, 19 bp, Homo sapiens
ggcctgaactaggtgctgg

SEQ ID NO: 5919902 - DNA, 21 bp, Homo sapiens
ggcctgaactcggacaagtga

SEQ ID NO: 5919903 - DNA, 17 bp, Homo sapiens
ggcctgaactgaggaga

SEQ ID NO: 5919904 - DNA, 23 bp, Homo sapiens
ggcctgaagaagcacttctgctg

SEQ ID NO: 5919905 - DNA, 16 bp, Homo sapiens
ggcctgaagccagctg

SEQ ID NO: 5919906 - DNA, 18 bp, Homo sapiens
ggcctgaagccagctgcc

SEQ ID NO: 5919907 - DNA, 22 bp, Homo sapiens
ggcctgaatcatgagcctgctg

SEQ ID NO: 5919908 - DNA, 18 bp, Homo sapiens
ggcctgacacaggccagc

SEQ ID NO: 5919909 - DNA, 20 bp, Homo sapiens
ggcctgacacaggccagcct

SEQ ID NO: 5919910 - DNA, 17 bp, Homo sapiens
ggcctgacaccccctcc

SEQ ID NO: 5919911 - DNA, 21 bp, Homo sapiens
ggcctgacaccccctccccgc

SEQ ID NO: 5919912 - DNA, 16 bp, Homo sapiens
ggcctgaccagggggc

SEQ ID NO: 5919913 - DNA, 20 bp, Homo sapiens
ggcctgacccacggggcagt

SEQ ID NO: 5919914 - DNA, 19 bp, Homo sapiens
ggcctgacctccagtcctg

SEQ ID NO: 5919915 - DNA, 16 bp, Homo sapiens
ggcctgactcccatgc

SEQ ID NO: 5919916 - DNA, 19 bp, Homo sapiens
ggcctgactcccatgcaag

SEQ ID NO: 5919917 - DNA, 17 bp, Homo sapiens
ggcctgactccttctgc

SEQ ID NO: 5919918 - DNA, 16 bp, Homo sapiens
ggcctgactgccaagc

SEQ ID NO: 5919919 - DNA, 19 bp, Homo sapiens
ggcctgactgccaagccat

SEQ ID NO: 5919920 - DNA, 19 bp, Homo sapiens
ggcctgactgttgcccccc

SEQ ID NO: 5919921 - DNA, 16 bp, Homo sapiens
ggcctgacttgagcca

SEQ ID NO: 5919922 - DNA, 17 bp, Homo sapiens
ggcctgacttgagccac

SEQ ID NO: 5919923 - DNA, 19 bp, Homo sapiens
ggcctgacttgagccactc

SEQ ID NO: 5919924 - DNA, 21 bp, Homo sapiens
ggcctgagaattgaggggagg

SEQ ID NO: 5919925 - DNA, 18 bp, Homo sapiens
ggcctgagacccaggact

SEQ ID NO: 5919926 - DNA, 13 bp, Homo sapiens
ggcctgagagaat

SEQ ID NO: 5919927 - DNA, 15 bp, Homo sapiens
ggcctgagagtcagc

SEQ ID NO: 5919928 - DNA, 21 bp, Homo sapiens
ggcctgagagtcagctctctg

SEQ ID NO: 5919929 - DNA, 19 bp, Homo sapiens
ggcctgagcagtccttggc

SEQ ID NO: 5919930 - DNA, 20 bp, Homo sapiens
ggcctgagcatccagacctg

SEQ ID NO: 5919931 - DNA, 12 bp, Homo sapiens
ggcctgagcccc

SEQ ID NO: 5919932 - DNA, 15 bp, Homo sapiens
ggcctgagcctggcc

SEQ ID NO: 5919933 - DNA, 13 bp, Homo sapiens
ggcctgagctgct

SEQ ID NO: 5919934 - DNA, 15 bp, Homo sapiens
ggcctgagctggggc

SEQ ID NO: 5919935 - DNA, 16 bp, Homo sapiens
ggcctgagctggggcc

SEQ ID NO: 5919936 - DNA, 19 bp, Homo sapiens
ggcctgagctggggccaca

SEQ ID NO: 5919937 - DNA, 17 bp, Homo sapiens
ggcctgaggagcagcag

SEQ ID NO: 5919938 - DNA, 19 bp, Homo sapiens
ggcctgaggcctgtgcctg

SEQ ID NO: 5919939 - DNA, 16 bp, Homo sapiens
ggcctgaggctgctga

SEQ ID NO: 5919940 - DNA, 15 bp, Homo sapiens
ggcctgagggaagcc

SEQ ID NO: 5919941 - DNA, 21 bp, Homo sapiens
ggcctgagggaagcccacccg

SEQ ID NO: 5919942 - DNA, 20 bp, Homo sapiens
ggcctgagggtccacctgga

SEQ ID NO: 5919943 - DNA, 22 bp, Homo sapiens
ggcctgagggtccacctggaga

SEQ ID NO: 5919944 - DNA, 21 bp, Homo sapiens
ggcctgaggtctcgctgatgc

SEQ ID NO: 5919945 - DNA, 22 bp, Homo sapiens
ggcctgaggtctcgctgatgct

SEQ ID NO: 5919946 - DNA, 13 bp, Homo sapiens
ggcctgagtcctg

SEQ ID NO: 5919947 - DNA, 19 bp, Homo sapiens
ggcctgagtcctggtccct

SEQ ID NO: 5919948 - DNA, 22 bp, Homo sapiens
ggcctgagtcctggtccctctg

SEQ ID NO: 5919949 - DNA, 21 bp, Homo sapiens
ggcctgagtgacctccttctg

SEQ ID NO: 5919950 - DNA, 22 bp, Homo sapiens
ggcctgagtgagaggggaggcc

SEQ ID NO: 5919951 - DNA, 15 bp, Homo sapiens
ggcctgatcagacca

SEQ ID NO: 5919952 - DNA, 23 bp, Homo sapiens
ggcctgatctctgctccctgcaa

SEQ ID NO: 5919953 - DNA, 14 bp, Homo sapiens
ggcctgatgacaga

SEQ ID NO: 5919954 - DNA, 17 bp, Homo sapiens
ggcctgatgctccctcc

SEQ ID NO: 5919955 - DNA, 16 bp, Homo sapiens
ggcctgatgctgcccc

SEQ ID NO: 5919956 - DNA, 15 bp, Homo sapiens
ggcctgatggagagg

SEQ ID NO: 5919957 - DNA, 19 bp, Homo sapiens
ggcctgatggagaggagaa

SEQ ID NO: 5919958 - DNA, 17 bp, Homo sapiens
ggcctgatggccaggcc

SEQ ID NO: 5919959 - DNA, 18 bp, Homo sapiens
ggcctgatggccaggcct

SEQ ID NO: 5919960 - DNA, 19 bp, Homo sapiens
ggcctgatggggtggaagg

SEQ ID NO: 5919961 - DNA, 16 bp, Homo sapiens
ggcctgatggtggggc

SEQ ID NO: 5919962 - DNA, 23 bp, Homo sapiens
ggcctgcaaaccttcctgggagg

SEQ ID NO: 5919963 - DNA, 12 bp, Homo sapiens
ggcctgcacaca

SEQ ID NO: 5919964 - DNA, 13 bp, Homo sapiens
ggcctgcacacaa

SEQ ID NO: 5919965 - DNA, 14 bp, Homo sapiens
ggcctgcacagata

SEQ ID NO: 5919966 - DNA, 21 bp, Homo sapiens
ggcctgcaccgacccgaggcc

SEQ ID NO: 5919967 - DNA, 23 bp, Homo sapiens
ggcctgcaccgacccgaggccca

SEQ ID NO: 5919968 - DNA, 16 bp, Homo sapiens
ggcctgcacctctcca

SEQ ID NO: 5919969 - DNA, 20 bp, Homo sapiens
ggcctgcagaaggaaagaag

SEQ ID NO: 5919970 - DNA, 17 bp, Homo sapiens
ggcctgcagacagacct

SEQ ID NO: 5919971 - DNA, 18 bp, Homo sapiens
ggcctgcagaccctgcca

SEQ ID NO: 5919972 - DNA, 18 bp, Homo sapiens
ggcctgcagccacatggg

SEQ ID NO: 5919973 - DNA, 12 bp, Homo sapiens
ggcctgcagccc

SEQ ID NO: 5919974 - DNA, 14 bp, Homo sapiens
ggcctgcagcccct

SEQ ID NO: 5919975 - DNA, 14 bp, Homo sapiens
ggcctgcaggccag

SEQ ID NO: 5919976 - DNA, 21 bp, Homo sapiens
ggcctgcaggccccagccaag

SEQ ID NO: 5919977 - DNA, 22 bp, Homo sapiens
ggcctgcaggccccagccaagt

SEQ ID NO: 5919978 - DNA, 14 bp, Homo sapiens
ggcctgcagggcct

SEQ ID NO: 5919979 - DNA, 16 bp, Homo sapiens
ggcctgcaggggcaag

SEQ ID NO: 5919980 - DNA, 14 bp, Homo sapiens
ggcctgcagtggtg

SEQ ID NO: 5919981 - DNA, 20 bp, Homo sapiens
ggcctgccaatgccacagcc

SEQ ID NO: 5919982 - DNA, 21 bp, Homo sapiens
ggcctgccaatgccacagcca

SEQ ID NO: 5919983 - DNA, 18 bp, Homo sapiens
ggcctgccaccctcctgc

SEQ ID NO: 5919984 - DNA, 23 bp, Homo sapiens
ggcctgccacctggacccctgca

SEQ ID NO: 5919985 - DNA, 22 bp, Homo sapiens
ggcctgccactctcctgaggag

SEQ ID NO: 5919986 - DNA, 15 bp, Homo sapiens
ggcctgccagcccct

SEQ ID NO: 5919987 - DNA, 14 bp, Homo sapiens
ggcctgccaggctc

SEQ ID NO: 5919988 - DNA, 14 bp, Homo sapiens
ggcctgccatgcca

SEQ ID NO: 5919989 - DNA, 12 bp, Homo sapiens
ggcctgcccagc

SEQ ID NO: 5919990 - DNA, 14 bp, Homo sapiens
ggcctgcccagcct

SEQ ID NO: 5919991 - DNA, 15 bp, Homo sapiens
ggcctgcccagttgc

SEQ ID NO: 5919992 - DNA, 13 bp, Homo sapiens
ggcctgccccagc

SEQ ID NO: 5919993 - DNA, 17 bp, Homo sapiens
ggcctgccccccttccc

SEQ ID NO: 5919994 - DNA, 22 bp, Homo sapiens
ggcctgccccccttcccacccc

SEQ ID NO: 5919995 - DNA, 23 bp, Homo sapiens
ggcctgccccccttcccacccct

SEQ ID NO: 5919996 - DNA, 13 bp, Homo sapiens
ggcctgccccctg

SEQ ID NO: 5919997 - DNA, 17 bp, Homo sapiens
ggcctgccccctgggga

SEQ ID NO: 5919998 - DNA, 19 bp, Homo sapiens
ggcctgcccgtgccctggt

SEQ ID NO: 5919999 - DNA, 22 bp, Homo sapiens
ggcctgcccgttgccgggcctg

SEQ ID NO: 5920000 - DNA, 11 bp, Homo sapiens
ggcctgccctc

SEQ ID NO: 5920001 - DNA, 13 bp, Homo sapiens
ggcctgccctccc

SEQ ID NO: 5920002 - DNA, 15 bp, Homo sapiens
ggcctgccctctgcc

SEQ ID NO: 5920003 - DNA, 18 bp, Homo sapiens
ggcctgccctctgcccca

SEQ ID NO: 5920004 - DNA, 14 bp, Homo sapiens
ggcctgccgggctg

SEQ ID NO: 5920005 - DNA, 19 bp, Homo sapiens
ggcctgcctccagggctgg

SEQ ID NO: 5920006 - DNA, 15 bp, Homo sapiens
ggcctgcctcccact

SEQ ID NO: 5920007 - DNA, 17 bp, Homo sapiens
ggcctgcctcccagccc

SEQ ID NO: 5920008 - DNA, 11 bp, Homo sapiens
ggcctgcctgc

SEQ ID NO: 5920009 - DNA, 12 bp, Homo sapiens
ggcctgcctgcc

SEQ ID NO: 5920010 - DNA, 19 bp, Homo sapiens
ggcctgcctgcctccaccc

SEQ ID NO: 5920011 - DNA, 12 bp, Homo sapiens
ggcctgcctggc

SEQ ID NO: 5920012 - DNA, 23 bp, Homo sapiens
ggcctgcctggcccctcgcctgt

SEQ ID NO: 5920013 - DNA, 16 bp, Homo sapiens
ggcctgcgaccctggg

SEQ ID NO: 5920014 - DNA, 18 bp, Homo sapiens
ggcctgcgaccctggggg

SEQ ID NO: 5920015 - DNA, 23 bp, Homo sapiens
ggcctgcgaccctgggggcacag

SEQ ID NO: 5920016 - DNA, 15 bp, Homo sapiens
ggcctgcgcccagag

SEQ ID NO: 5920017 - DNA, 18 bp, Homo sapiens
ggcctgcggccgggctgc

SEQ ID NO: 5920018 - DNA, 23 bp, Homo sapiens
ggcctgcggccgggctgcccttc

SEQ ID NO: 5920019 - DNA, 17 bp, Homo sapiens
ggcctgcgggcccctgg

SEQ ID NO: 5920020 - DNA, 18 bp, Homo sapiens
ggcctgcgggcccctggt

SEQ ID NO: 5920021 - DNA, 20 bp, Homo sapiens
ggcctgcggggttccctgcg

SEQ ID NO: 5920022 - DNA, 22 bp, Homo sapiens
ggcctgcgtctccatatgtgta

SEQ ID NO: 5920023 - DNA, 23 bp, Homo sapiens
ggcctgcgtcttttttctcttcc

SEQ ID NO: 5920024 - DNA, 17 bp, Homo sapiens
ggcctgcgtgccgggag

SEQ ID NO: 5920025 - DNA, 14 bp, Homo sapiens
ggcctgctccagac

SEQ ID NO: 5920026 - DNA, 16 bp, Homo sapiens
ggcctgctccagacct

SEQ ID NO: 5920027 - DNA, 17 bp, Homo sapiens
ggcctgctcccagcagc

SEQ ID NO: 5920028 - DNA, 21 bp, Homo sapiens
ggcctgctcttacttccccca

SEQ ID NO: 5920029 - DNA, 17 bp, Homo sapiens
ggcctgctgaggccttc

SEQ ID NO: 5920030 - DNA, 18 bp, Homo sapiens
ggcctgctgccagtgcag

SEQ ID NO: 5920031 - DNA, 19 bp, Homo sapiens
ggcctgctgccagtgcagc

SEQ ID NO: 5920032 - DNA, 21 bp, Homo sapiens
ggcctgctgccagtgcagcca

SEQ ID NO: 5920033 - DNA, 19 bp, Homo sapiens
ggcctgctgcgccccaggc

SEQ ID NO: 5920034 - DNA, 13 bp, Homo sapiens
ggcgcagagggaa

SEQ ID NO: 5920035 - DNA, 23 bp, Homo sapiens
ggcgcagcatattcaggaagctc

SEQ ID NO: 5920036 - DNA, 15 bp, Homo sapiens
ggcgcagccaaggcc

SEQ ID NO: 5920037 - DNA, 12 bp, Homo sapiens
ggcgcagcccct

SEQ ID NO: 5920038 - DNA, 16 bp, Homo sapiens
ggcgcagcccgaagcc

SEQ ID NO: 5920039 - DNA, 18 bp, Homo sapiens
ggcgcagcccgaagccca

SEQ ID NO: 5920040 - DNA, 12 bp, Homo sapiens
ggcgcagcccta

SEQ ID NO: 5920041 - DNA, 16 bp, Homo sapiens
ggcgcagccctagtgg

SEQ ID NO: 5920042 - DNA, 18 bp, Homo sapiens
ggcgcagctgaagcctgg

SEQ ID NO: 5920043 - DNA, 19 bp, Homo sapiens
ggcgcagctgaagcctgga

SEQ ID NO: 5920044 - DNA, 24 bp, Homo sapiens
ggcgcagctgaagcctggacgcag

SEQ ID NO: 5920045 - DNA, 18 bp, Homo sapiens
ggcgcaggaaccgaggac

SEQ ID NO: 5920046 - DNA, 22 bp, Homo sapiens
ggcgcaggaaccgaggactcca

SEQ ID NO: 5920047 - DNA, 11 bp, Homo sapiens
ggcgcaggagg

SEQ ID NO: 5920048 - DNA, 13 bp, Homo sapiens
ggcgcaggcccag

SEQ ID NO: 5920049 - DNA, 15 bp, Homo sapiens
ggcgcaggcccagtg

SEQ ID NO: 5920050 - DNA, 14 bp, Homo sapiens
ggcgcaggccgtga

SEQ ID NO: 5920051 - DNA, 22 bp, Homo sapiens
ggcgcaggcgaccgggcctccc

SEQ ID NO: 5920052 - DNA, 14 bp, Homo sapiens
ggcgcaggggaggg

SEQ ID NO: 5920053 - DNA, 16 bp, Homo sapiens
ggcgcaggtgccatgc

SEQ ID NO: 5920054 - DNA, 19 bp, Homo sapiens
ggcgcaggtgccatgcctg

SEQ ID NO: 5920055 - DNA, 20 bp, Homo sapiens
ggcgcaggtgccatgcctgc

SEQ ID NO: 5920056 - DNA, 22 bp, Homo sapiens
ggcgcaggtgccatgcctgctc

SEQ ID NO: 5920057 - DNA, 15 bp, Homo sapiens
ggcgcaggtgggctg

SEQ ID NO: 5920058 - DNA, 20 bp, Homo sapiens
ggcgcaggtgggctggactt

SEQ ID NO: 5920059 - DNA, 17 bp, Homo sapiens
ggcgcagtgcctctggt

SEQ ID NO: 5920060 - DNA, 21 bp, Homo sapiens
ggcgcagtggctcacgcctgt

SEQ ID NO: 5920061 - DNA, 17 bp, Homo sapiens
ggcgcatgagtatctgt

SEQ ID NO: 5920062 - DNA, 23 bp, Homo sapiens
ggcgcatgcatgggaggaattca

SEQ ID NO: 5920063 - DNA, 19 bp, Homo sapiens
ggcgcatgcctcccaggcc

SEQ ID NO: 5920064 - DNA, 15 bp, Homo sapiens
ggcgccaactgctga

SEQ ID NO: 5920065 - DNA, 16 bp, Homo sapiens
ggcgccaagtctggca

SEQ ID NO: 5920066 - DNA, 17 bp, Homo sapiens
ggcgccaccaccacctg

SEQ ID NO: 5920067 - DNA, 16 bp, Homo sapiens
ggcgccaccagctctg

SEQ ID NO: 5920068 - DNA, 17 bp, Homo sapiens
ggcgccaccagctctgc

SEQ ID NO: 5920069 - DNA, 18 bp, Homo sapiens
ggcgccaccagctctgcc

SEQ ID NO: 5920070 - DNA, 14 bp, Homo sapiens
ggcgccagcctcac

SEQ ID NO: 5920071 - DNA, 21 bp, Homo sapiens
ggcgccaggacagcagcactc

SEQ ID NO: 5920072 - DNA, 19 bp, Homo sapiens
ggcgccaggggcaggcagc

SEQ ID NO: 5920073 - DNA, 22 bp, Homo sapiens
ggcgcccacccggcccggctga

SEQ ID NO: 5920074 - DNA, 14 bp, Homo sapiens
ggcgcccaccctgg

SEQ ID NO: 5920075 - DNA, 22 bp, Homo sapiens
ggcgcccaccctgggctccaca

SEQ ID NO: 5920076 - DNA, 15 bp, Homo sapiens
ggcgcccacctcccc

SEQ ID NO: 5920077 - DNA, 24 bp, Homo sapiens
ggcgcccacctccccacgccctcc

SEQ ID NO: 5920078 - DNA, 14 bp, Homo sapiens
ggcgcccagcagcc

SEQ ID NO: 5920079 - DNA, 18 bp, Homo sapiens
ggcgcccagcagcctgcc

SEQ ID NO: 5920080 - DNA, 21 bp, Homo sapiens
ggcgcccagcagcctgccagc

SEQ ID NO: 5920081 - DNA, 13 bp, Homo sapiens
ggcgcccagccca

SEQ ID NO: 5920082 - DNA, 21 bp, Homo sapiens
ggcgcccagcccaggcctggt

SEQ ID NO: 5920083 - DNA, 13 bp, Homo sapiens
ggcgcccagggtc

SEQ ID NO: 5920084 - DNA, 21 bp, Homo sapiens
ggcgcccatcctagtgggcac

SEQ ID NO: 5920085 - DNA, 18 bp, Homo sapiens
ggcgccccaacccgtgga

SEQ ID NO: 5920086 - DNA, 19 bp, Homo sapiens
ggcgccccaacccgtggag

SEQ ID NO: 5920087 - DNA, 23 bp, Homo sapiens
ggcgccccaacccgtggaggctg

SEQ ID NO: 5920088 - DNA, 15 bp, Homo sapiens
ggcgccccaagagcc

SEQ ID NO: 5920089 - DNA, 21 bp, Homo sapiens
ggcgccccatgggccctcagc

SEQ ID NO: 5920090 - DNA, 16 bp, Homo sapiens
ggcgcccccacccctg

SEQ ID NO: 5920091 - DNA, 15 bp, Homo sapiens
ggcgcccccagtgtg

SEQ ID NO: 5920092 - DNA, 16 bp, Homo sapiens
ggcgcccccgccccag

SEQ ID NO: 5920093 - DNA, 18 bp, Homo sapiens
ggcgcccccgccccaggc

SEQ ID NO: 5920094 - DNA, 20 bp, Homo sapiens
ggcgccccgcacccccgcca

SEQ ID NO: 5920095 - DNA, 20 bp, Homo sapiens
ggcgccccgcacctgtacag

SEQ ID NO: 5920096 - DNA, 21 bp, Homo sapiens
ggcgccccgcacctgtacagt

SEQ ID NO: 5920097 - DNA, 13 bp, Homo sapiens
ggcgccccggacg

SEQ ID NO: 5920098 - DNA, 17 bp, Homo sapiens
ggcgccccggacgccgc

SEQ ID NO: 5920099 - DNA, 22 bp, Homo sapiens
ggcgcccctgccacctccctga

SEQ ID NO: 5920100 - DNA, 15 bp, Homo sapiens
ggcgccctctctgct

SEQ ID NO: 5920101 - DNA, 11 bp, Homo sapiens
ggcgccctctg

SEQ ID NO: 5920102 - DNA, 16 bp, Homo sapiens
ggcgccctctgtcctg

SEQ ID NO: 5920103 - DNA, 12 bp, Homo sapiens
ggcgccctgcct

SEQ ID NO: 5920104 - DNA, 14 bp, Homo sapiens
ggcgccctgcctcc

SEQ ID NO: 5920105 - DNA, 20 bp, Homo sapiens
ggcgccctgcctcctggagg

SEQ ID NO: 5920106 - DNA, 12 bp, Homo sapiens
ggcgccctggac

SEQ ID NO: 5920107 - DNA, 19 bp, Homo sapiens
ggcgccgcaaaccacactg

SEQ ID NO: 5920108 - DNA, 18 bp, Homo sapiens
ggcgccggttccacgtgg

SEQ ID NO: 5920109 - DNA, 17 bp, Homo sapiens
ggcgccgtgctgggcag

SEQ ID NO: 5920110 - DNA, 18 bp, Homo sapiens
ggcgccgtgctgggcagc

SEQ ID NO: 5920111 - DNA, 19 bp, Homo sapiens
ggcgccgtgctgggcagcc

SEQ ID NO: 5920112 - DNA, 16 bp, Homo sapiens
ggcgcctagagcgcgg

SEQ ID NO: 5920113 - DNA, 22 bp, Homo sapiens
ggcgcctagagcgcggctggct

SEQ ID NO: 5920114 - DNA, 22 bp, Homo sapiens
ggcgcctcaactctgctgaggg

SEQ ID NO: 5920115 - DNA, 20 bp, Homo sapiens
ggcgcctgccctgcccaagt

SEQ ID NO: 5920116 - DNA, 23 bp, Homo sapiens
ggcgcctgccctgcccaagtgac

SEQ ID NO: 5920117 - DNA, 14 bp, Homo sapiens
ggcgcctgcgctcc

SEQ ID NO: 5920118 - DNA, 12 bp, Homo sapiens
ggcgcctggaga

SEQ ID NO: 5920119 - DNA, 13 bp, Homo sapiens
ggcgcctggagag

SEQ ID NO: 5920120 - DNA, 14 bp, Homo sapiens
ggcgcctggagagc

SEQ ID NO: 5920121 - DNA, 17 bp, Homo sapiens
ggcgcctggagagcgag

SEQ ID NO: 5920122 - DNA, 20 bp, Homo sapiens
ggcgcctggagagcgaggag

SEQ ID NO: 5920123 - DNA, 12 bp, Homo sapiens
ggcgcctggcct

SEQ ID NO: 5920124 - DNA, 16 bp, Homo sapiens
ggcgcctggcctccag

SEQ ID NO: 5920125 - DNA, 15 bp, Homo sapiens
ggcgcctgtggttct

SEQ ID NO: 5920126 - DNA, 19 bp, Homo sapiens
ggcgccttctacctgcagg

SEQ ID NO: 5920127 - DNA, 20 bp, Homo sapiens
ggcgccttctacctgcagga

SEQ ID NO: 5920128 - DNA, 18 bp, Homo sapiens
ggcgccttctcggagctg

SEQ ID NO: 5920129 - DNA, 15 bp, Homo sapiens
ggcgccttttcagcc

SEQ ID NO: 5920130 - DNA, 17 bp, Homo sapiens
ggcgccttttcagccct

SEQ ID NO: 5920131 - DNA, 23 bp, Homo sapiens
ggcgcgatctcggctcagcctcc

SEQ ID NO: 5920132 - DNA, 13 bp, Homo sapiens
ggcgcgcctgcct

SEQ ID NO: 5920133 - DNA, 14 bp, Homo sapiens
ggcgcgcctgcctt

SEQ ID NO: 5920134 - DNA, 17 bp, Homo sapiens
ggcgcgcgcccccagga

SEQ ID NO: 5920135 - DNA, 19 bp, Homo sapiens
ggcgcgcgcccccaggacc

SEQ ID NO: 5920136 - DNA, 15 bp, Homo sapiens
ggcgcggagtgaacc

SEQ ID NO: 5920137 - DNA, 15 bp, Homo sapiens
ggcgcgggaggcacc

SEQ ID NO: 5920138 - DNA, 22 bp, Homo sapiens
ggcgcggttcaggtcagggcta

SEQ ID NO: 5920139 - DNA, 18 bp, Homo sapiens
ggcgcgtgaggcccgtgg

SEQ ID NO: 5920140 - DNA, 21 bp, Homo sapiens
ggcgctagaggccatggaggc

SEQ ID NO: 5920141 - DNA, 22 bp, Homo sapiens
ggcgctagcacagctcccttct

SEQ ID NO: 5920142 - DNA, 17 bp, Homo sapiens
ggcgctattgcactcca

SEQ ID NO: 5920143 - DNA, 18 bp, Homo sapiens
ggcgctattgcactccag

SEQ ID NO: 5920144 - DNA, 20 bp, Homo sapiens
ggcgctattgcttcagctgc

SEQ ID NO: 5920145 - DNA, 15 bp, Homo sapiens
ggcgctcagacccca

SEQ ID NO: 5920146 - DNA, 14 bp, Homo sapiens
ggcgctcagacggc

SEQ ID NO: 5920147 - DNA, 19 bp, Homo sapiens
ggcgctcagacggcggcca

SEQ ID NO: 5920148 - DNA, 22 bp, Homo sapiens
ggcgctcagacggcggccaggc

SEQ ID NO: 5920149 - DNA, 17 bp, Homo sapiens
ggcgctcagcagcccta

SEQ ID NO: 5920150 - DNA, 11 bp, Homo sapiens
ggcgctcagga

SEQ ID NO: 5920151 - DNA, 19 bp, Homo sapiens
ggcgctcaggacccaggcc

SEQ ID NO: 5920152 - DNA, 19 bp, Homo sapiens
ggcgctccggcagaggcag

SEQ ID NO: 5920153 - DNA, 15 bp, Homo sapiens
ggcgctcgctcaggt

SEQ ID NO: 5920154 - DNA, 13 bp, Homo sapiens
ggcgctctgccct

SEQ ID NO: 5920155 - DNA, 22 bp, Homo sapiens
ggcgctctgccctccctggcct

SEQ ID NO: 5920156 - DNA, 14 bp, Homo sapiens
ggcgctgacactgg

SEQ ID NO: 5920157 - DNA, 15 bp, Homo sapiens
ggcgctgagggcagg

SEQ ID NO: 5920158 - DNA, 20 bp, Homo sapiens
ggcgctgagtggcggggccc

SEQ ID NO: 5920159 - DNA, 14 bp, Homo sapiens
ggcgctgcagcctc

SEQ ID NO: 5920160 - DNA, 16 bp, Homo sapiens
ggcgctgcagcctccc

SEQ ID NO: 5920161 - DNA, 21 bp, Homo sapiens
ggcgctgcagcctcccttcca

SEQ ID NO: 5920162 - DNA, 18 bp, Homo sapiens
ggcgctgcatacagggga

SEQ ID NO: 5920163 - DNA, 21 bp, Homo sapiens
ggcgctgcatacaggggaggg

SEQ ID NO: 5920164 - DNA, 18 bp, Homo sapiens
ggcgctgccacctgcccc

SEQ ID NO: 5920165 - DNA, 11 bp, Homo sapiens
ggcgctgcccc

SEQ ID NO: 5920166 - DNA, 21 bp, Homo sapiens
ggcgctgcccccacagatcca

SEQ ID NO: 5920167 - DNA, 21 bp, Homo sapiens
ggcgctgcccctggcagcccc

SEQ ID NO: 5920168 - DNA, 21 bp, Homo sapiens
ggcgctgcgcggactcgcccc

SEQ ID NO: 5920169 - DNA, 15 bp, Homo sapiens
ggcgctgctgggagc

SEQ ID NO: 5920170 - DNA, 20 bp, Homo sapiens
ggcgctggaagaacccttct

SEQ ID NO: 5920171 - DNA, 15 bp, Homo sapiens
ggcgctggcccagcc

SEQ ID NO: 5920172 - DNA, 20 bp, Homo sapiens
ggcgctggcccagccggcct

SEQ ID NO: 5920173 - DNA, 20 bp, Homo sapiens
ggcgctgggggctggacctg

SEQ ID NO: 5920174 - DNA, 15 bp, Homo sapiens
ggcgctgggtgcctg

SEQ ID NO: 5920175 - DNA, 23 bp, Homo sapiens
ggcgctgggtgcctgcagcgcct

SEQ ID NO: 5920176 - DNA, 18 bp, Homo sapiens
ggcgctgtgcggcctcac

SEQ ID NO: 5920177 - DNA, 23 bp, Homo sapiens
ggcgctgtgcggcctcaccaggc

SEQ ID NO: 5920178 - DNA, 14 bp, Homo sapiens
ggcgctgtggctcc

SEQ ID NO: 5920179 - DNA, 15 bp, Homo sapiens
ggcgctgtggctcct

SEQ ID NO: 5920180 - DNA, 18 bp, Homo sapiens
ggcgcttggatctggggt

SEQ ID NO: 5920181 - DNA, 17 bp, Homo sapiens
ggcgctttctcctgtgc

SEQ ID NO: 5920182 - DNA, 14 bp, Homo sapiens
ggcggaacctggct

SEQ ID NO: 5920183 - DNA, 22 bp, Homo sapiens
ggcggacaaaagggccaggtgc

SEQ ID NO: 5920184 - DNA, 20 bp, Homo sapiens
ggcggacacctggcccccga

SEQ ID NO: 5920185 - DNA, 20 bp, Homo sapiens
ggcggaccttgtagtgagcc

SEQ ID NO: 5920186 - DNA, 15 bp, Homo sapiens
ggcggacgttccagc

SEQ ID NO: 5920187 - DNA, 20 bp, Homo sapiens
ggcggagagtacagtgagcc

SEQ ID NO: 5920188 - DNA, 17 bp, Homo sapiens
ggcggagatgggtcctg

SEQ ID NO: 5920189 - DNA, 13 bp, Homo sapiens
ggcggagctggcc

SEQ ID NO: 5920190 - DNA, 12 bp, Homo sapiens
ggcggaggctgt

SEQ ID NO: 5920191 - DNA, 17 bp, Homo sapiens
ggcggagggagcggcat

SEQ ID NO: 5920192 - DNA, 15 bp, Homo sapiens
ggcggaggggcttgg

SEQ ID NO: 5920193 - DNA, 23 bp, Homo sapiens
ggcggaggtctctgggagcccag

SEQ ID NO: 5920194 - DNA, 19 bp, Homo sapiens
ggcggaggttgcagtgagc

SEQ ID NO: 5920195 - DNA, 21 bp, Homo sapiens
ggcggagtccccggggttccc

SEQ ID NO: 5920196 - DNA, 22 bp, Homo sapiens
ggcggatcacaaggtcaggagt

SEQ ID NO: 5920197 - DNA, 20 bp, Homo sapiens
ggcggatcatctaattctct

SEQ ID NO: 5920198 - DNA, 20 bp, Homo sapiens
ggcggatgttgaagtgagct

SEQ ID NO: 5920199 - DNA, 20 bp, Homo sapiens
ggcggcacaggtcgggcgca

SEQ ID NO: 5920200 - DNA, 18 bp, Homo sapiens
ggcggcacattggcagtg

SEQ ID NO: 5920201 - DNA, 22 bp, Homo sapiens
ggcggcacattggcagtgtgtc

SEQ ID NO: 5920202 - DNA, 21 bp, Homo sapiens
ggcggcacgccaacagccccc

SEQ ID NO: 5920203 - DNA, 20 bp, Homo sapiens
ggcggcagctcttctgggca

SEQ ID NO: 5920204 - DNA, 13 bp, Homo sapiens
ggcggcaggcaga

SEQ ID NO: 5920205 - DNA, 14 bp, Homo sapiens
ggcggcaggcagag

SEQ ID NO: 5920206 - DNA, 11 bp, Homo sapiens
ggcggcagggg

SEQ ID NO: 5920207 - DNA, 18 bp, Homo sapiens
ggcggcaggggcctggag

SEQ ID NO: 5920208 - DNA, 12 bp, Homo sapiens
ggcggcaggggt

SEQ ID NO: 5920209 - DNA, 18 bp, Homo sapiens
ggcggcagggtgggggag

SEQ ID NO: 5920210 - DNA, 20 bp, Homo sapiens
ggcggccagccctcccagca

SEQ ID NO: 5920211 - DNA, 14 bp, Homo sapiens
ggcggccaggcaca

SEQ ID NO: 5920212 - DNA, 17 bp, Homo sapiens
ggcggccaggcacaggg

SEQ ID NO: 5920213 - DNA, 18 bp, Homo sapiens
ggcggccaggcacagggc

SEQ ID NO: 5920214 - DNA, 18 bp, Homo sapiens
ggcggccagggacccccg

SEQ ID NO: 5920215 - DNA, 12 bp, Homo sapiens
ggcggccagggc

SEQ ID NO: 5920216 - DNA, 13 bp, Homo sapiens
ggcggccagggcg

SEQ ID NO: 5920217 - DNA, 16 bp, Homo sapiens
ggcggcccacgccagc

SEQ ID NO: 5920218 - DNA, 16 bp, Homo sapiens
ggcggccccgccgcag

SEQ ID NO: 5920219 - DNA, 21 bp, Homo sapiens
ggcggcccctcagcctgcctg

SEQ ID NO: 5920220 - DNA, 22 bp, Homo sapiens
ggcggcccctcagcctgcctga

SEQ ID NO: 5920221 - DNA, 14 bp, Homo sapiens
ggcggcccggccag

SEQ ID NO: 5920222 - DNA, 17 bp, Homo sapiens
ggcggcccggccagcgg

SEQ ID NO: 5920223 - DNA, 22 bp, Homo sapiens
ggcggcccggccagcgggcaca

SEQ ID NO: 5920224 - DNA, 20 bp, Homo sapiens
ggcggcccttctgactgttt

SEQ ID NO: 5920225 - DNA, 15 bp, Homo sapiens
ggcggcctcccaggt

SEQ ID NO: 5920226 - DNA, 11 bp, Homo sapiens
ggcggcctctc

SEQ ID NO: 5920227 - DNA, 14 bp, Homo sapiens
ggcggcggccacgc

SEQ ID NO: 5920228 - DNA, 13 bp, Homo sapiens
ggcggcggccctc

SEQ ID NO: 5920229 - DNA, 16 bp, Homo sapiens
ggcggcgggcggctgg

SEQ ID NO: 5920230 - DNA, 22 bp, Homo sapiens
ggcggcggggcctgggtccccc

SEQ ID NO: 5920231 - DNA, 23 bp, Homo sapiens
ggcggctactcagcagccctcct

SEQ ID NO: 5920232 - DNA, 16 bp, Homo sapiens
ggcggctactctggaa

SEQ ID NO: 5920233 - DNA, 18 bp, Homo sapiens
ggcggctaggccggccag

SEQ ID NO: 5920234 - DNA, 19 bp, Homo sapiens
ggcggctcacaagtgaaaa

SEQ ID NO: 5920235 - DNA, 14 bp, Homo sapiens
ggcggctccaggtc

SEQ ID NO: 5920236 - DNA, 15 bp, Homo sapiens
ggcggctccaggtcc

SEQ ID NO: 5920237 - DNA, 18 bp, Homo sapiens
ggcggctcggaggaagcc

SEQ ID NO: 5920238 - DNA, 13 bp, Homo sapiens
ggcggctctgagc

SEQ ID NO: 5920239 - DNA, 14 bp, Homo sapiens
ggcggctctgagca

SEQ ID NO: 5920240 - DNA, 17 bp, Homo sapiens
ggcggctctgagcaggg

SEQ ID NO: 5920241 - DNA, 13 bp, Homo sapiens
ggcggctctggga

SEQ ID NO: 5920242 - DNA, 23 bp, Homo sapiens
ggcggctctggttcctccagcca

SEQ ID NO: 5920243 - DNA, 19 bp, Homo sapiens
ggcggctggggtcccagca

SEQ ID NO: 5920244 - DNA, 24 bp, Homo sapiens
ggcggctggggtcccagcagctgc

SEQ ID NO: 5920245 - DNA, 14 bp, Homo sapiens
ggcggcttccctgc

SEQ ID NO: 5920246 - DNA, 21 bp, Homo sapiens
ggcggcttcctgtccactctc

SEQ ID NO: 5920247 - DNA, 15 bp, Homo sapiens
ggcgggaaccctctg

SEQ ID NO: 5920248 - DNA, 16 bp, Homo sapiens
ggcgggaagggtgggc

SEQ ID NO: 5920249 - DNA, 22 bp, Homo sapiens
ggcgggaagggtgggccctgga

SEQ ID NO: 5920250 - DNA, 22 bp, Homo sapiens
ggcgggaggccacgggggaggc

SEQ ID NO: 5920251 - DNA, 22 bp, Homo sapiens
ggcgggatcctccacagagagg

SEQ ID NO: 5920252 - DNA, 13 bp, Homo sapiens
ggcgggatgggct

SEQ ID NO: 5920253 - DNA, 18 bp, Homo sapiens
ggcgggcagagggctgga

SEQ ID NO: 5920254 - DNA, 17 bp, Homo sapiens
ggcgggcagccaggctg

SEQ ID NO: 5920255 - DNA, 16 bp, Homo sapiens
ggcgggcagcccctgc

SEQ ID NO: 5920256 - DNA, 17 bp, Homo sapiens
ggcgggccaaggactgc

SEQ ID NO: 5920257 - DNA, 13 bp, Homo sapiens
ggcgggccagcca

SEQ ID NO: 5920258 - DNA, 15 bp, Homo sapiens
ggcgggccagccagg

SEQ ID NO: 5920259 - DNA, 12 bp, Homo sapiens
ggcgggccaggg

SEQ ID NO: 5920260 - DNA, 23 bp, Homo sapiens
ggcgggccagggtgggaagagaa

SEQ ID NO: 5920261 - DNA, 12 bp, Homo sapiens
ggcgggccctgg

SEQ ID NO: 5920262 - DNA, 15 bp, Homo sapiens
ggcgggccctggagc

SEQ ID NO: 5920263 - DNA, 12 bp, Homo sapiens
ggcgggcctgtt

SEQ ID NO: 5920264 - DNA, 20 bp, Homo sapiens
ggcgggcggatcacgaggtc

SEQ ID NO: 5920265 - DNA, 14 bp, Homo sapiens
ggcgggctcagagc

SEQ ID NO: 5920266 - DNA, 16 bp, Homo sapiens
ggcgggctcagagctt

SEQ ID NO: 5920267 - DNA, 20 bp, Homo sapiens
ggcgggctcagagctttgtc

SEQ ID NO: 5920268 - DNA, 13 bp, Homo sapiens
ggcgggctgagga

SEQ ID NO: 5920269 - DNA, 20 bp, Homo sapiens
ggcggggaggaggagctgcc

SEQ ID NO: 5920270 - DNA, 14 bp, Homo sapiens
ggcggggcaggagg

SEQ ID NO: 5920271 - DNA, 22 bp, Homo sapiens
ggcggggcaggaggcctggcct

SEQ ID NO: 5920272 - DNA, 16 bp, Homo sapiens
ggcggggccaggatgg

SEQ ID NO: 5920273 - DNA, 12 bp, Homo sapiens
ggcggggcccag

SEQ ID NO: 5920274 - DNA, 13 bp, Homo sapiens
ggcggggccggga

SEQ ID NO: 5920275 - DNA, 13 bp, Homo sapiens
ggcggggcctggg

SEQ ID NO: 5920276 - DNA, 20 bp, Homo sapiens
ggcggggcgccccaagagcc

SEQ ID NO: 5920277 - DNA, 12 bp, Homo sapiens
ggcggggctcct

SEQ ID NO: 5920278 - DNA, 15 bp, Homo sapiens
ggcggggctcctcct

SEQ ID NO: 5920279 - DNA, 18 bp, Homo sapiens
ggcggggctcgaggctgg

SEQ ID NO: 5920280 - DNA, 18 bp, Homo sapiens
ggcggggctggaggtggc

SEQ ID NO: 5920281 - DNA, 22 bp, Homo sapiens
ggcggggctgtgcgggcgcccg

SEQ ID NO: 5920282 - DNA, 18 bp, Homo sapiens
ggcgggggagccaacagc

SEQ ID NO: 5920283 - DNA, 11 bp, Homo sapiens
ggcgggggcac

SEQ ID NO: 5920284 - DNA, 18 bp, Homo sapiens
ggcgggggcggaggagga

SEQ ID NO: 5920285 - DNA, 16 bp, Homo sapiens
ggcggggtggcggtgg

SEQ ID NO: 5920286 - DNA, 12 bp, Homo sapiens
ggcggggtgggg

SEQ ID NO: 5920287 - DNA, 13 bp, Homo sapiens
ggcggggtggggt

SEQ ID NO: 5920288 - DNA, 19 bp, Homo sapiens
ggcggggttagagccaagc

SEQ ID NO: 5920289 - DNA, 15 bp, Homo sapiens
ggcgggtcctagctg

SEQ ID NO: 5920290 - DNA, 22 bp, Homo sapiens
ggcgggtgcctgtaatcccagc

SEQ ID NO: 5920291 - DNA, 20 bp, Homo sapiens
ggcgggtggatcacaaggtc

SEQ ID NO: 5920292 - DNA, 16 bp, Homo sapiens
ggcgggtgggggtgga

SEQ ID NO: 5920293 - DNA, 23 bp, Homo sapiens
ggcggtcaataattgtggagagg

SEQ ID NO: 5920294 - DNA, 18 bp, Homo sapiens
ggcggtcatgtgtgcatg

SEQ ID NO: 5920295 - DNA, 14 bp, Homo sapiens
ggcggtcccagctc

SEQ ID NO: 5920296 - DNA, 19 bp, Homo sapiens
ggcggtcctactgctgtga

SEQ ID NO: 5920297 - DNA, 15 bp, Homo sapiens
ggcggtcctgcacag

SEQ ID NO: 5920298 - DNA, 19 bp, Homo sapiens
ggcggtgaccgctgcagga

SEQ ID NO: 5920299 - DNA, 14 bp, Homo sapiens
ggcggtgaggtggg

SEQ ID NO: 5920300 - DNA, 18 bp, Homo sapiens
ggcggtgatcagcagaga

SEQ ID NO: 5920301 - DNA, 20 bp, Homo sapiens
ggcggtgcagtggcaaagga

SEQ ID NO: 5920302 - DNA, 15 bp, Homo sapiens
ggcgtaagtacagag

SEQ ID NO: 5920303 - DNA, 18 bp, Homo sapiens
ggcgtaagtacagagaag

SEQ ID NO: 5920304 - DNA, 21 bp, Homo sapiens
ggcgtaagtacagagaagcca

SEQ ID NO: 5920305 - DNA, 17 bp, Homo sapiens
ggcgtacgctggtgctg

SEQ ID NO: 5920306 - DNA, 15 bp, Homo sapiens
ggcgtactacccagc

SEQ ID NO: 5920307 - DNA, 17 bp, Homo sapiens
ggcgtactacccagctc

SEQ ID NO: 5920308 - DNA, 21 bp, Homo sapiens
ggcgtaggctacagagaagcc

SEQ ID NO: 5920309 - DNA, 13 bp, Homo sapiens
ggcgtagggccag

SEQ ID NO: 5920310 - DNA, 14 bp, Homo sapiens
ggcgtagggccagg

SEQ ID NO: 5920311 - DNA, 20 bp, Homo sapiens
ggcgtagggccagggctctg

SEQ ID NO: 5920312 - DNA, 13 bp, Homo sapiens
ggcgtcagcctcc

SEQ ID NO: 5920313 - DNA, 14 bp, Homo sapiens
ggcgtcagcctcca

SEQ ID NO: 5920314 - DNA, 16 bp, Homo sapiens
ggcgtcagcctccagc

SEQ ID NO: 5920315 - DNA, 22 bp, Homo sapiens
ggcgtcagcctccagcctctgt

SEQ ID NO: 5920316 - DNA, 21 bp, Homo sapiens
ggcgtcaggggtgcacagtcc

SEQ ID NO: 5920317 - DNA, 21 bp, Homo sapiens
ggcgtccctgagggcccttcc

SEQ ID NO: 5920318 - DNA, 21 bp, Homo sapiens
ggcgtccgcgcgccagcacag

SEQ ID NO: 5920319 - DNA, 16 bp, Homo sapiens
ggcgtcctctccctcc

SEQ ID NO: 5920320 - DNA, 17 bp, Homo sapiens
ggcgtcctctccctcct

SEQ ID NO: 5920321 - DNA, 16 bp, Homo sapiens
ggcgtcctggtgagga

SEQ ID NO: 5920322 - DNA, 23 bp, Homo sapiens
ggcgtcctggtgaggacaaggta

SEQ ID NO: 5920323 - DNA, 19 bp, Homo sapiens
ggcgtcctttgggtgactc

SEQ ID NO: 5920324 - DNA, 20 bp, Homo sapiens
ggcgtcgctggacaacccag

SEQ ID NO: 5920325 - DNA, 19 bp, Homo sapiens
ggcgtctcccccagagtgc

SEQ ID NO: 5920326 - DNA, 16 bp, Homo sapiens
ggcgtctgagctgggg

SEQ ID NO: 5920327 - DNA, 17 bp, Homo sapiens
ggcgtctgagctggggt

SEQ ID NO: 5920328 - DNA, 18 bp, Homo sapiens
ggcgtctgagctggggtg

SEQ ID NO: 5920329 - DNA, 12 bp, Homo sapiens
ggcgtctgctct

SEQ ID NO: 5920330 - DNA, 20 bp, Homo sapiens
ggcgtctggactgttctgta

SEQ ID NO: 5920331 - DNA, 16 bp, Homo sapiens
ggcgtctgtatatttt

SEQ ID NO: 5920332 - DNA, 12 bp, Homo sapiens
ggcgtctgttct

SEQ ID NO: 5920333 - DNA, 18 bp, Homo sapiens
ggcgtcttcatctccctg

SEQ ID NO: 5920334 - DNA, 20 bp, Homo sapiens
ggcgtcttcatctccctgcc

SEQ ID NO: 5920335 - DNA, 15 bp, Homo sapiens
ggcgtcttgcccagc

SEQ ID NO: 5920336 - DNA, 15 bp, Homo sapiens
ggcgtgaaacacaat

SEQ ID NO: 5920337 - DNA, 17 bp, Homo sapiens
ggcgtgactcacccaag

SEQ ID NO: 5920338 - DNA, 14 bp, Homo sapiens
ggcgtgagacctgc

SEQ ID NO: 5920339 - DNA, 18 bp, Homo sapiens
ggcgtgagacctgcccct

SEQ ID NO: 5920340 - DNA, 12 bp, Homo sapiens
ggcgtgagccac

SEQ ID NO: 5920341 - DNA, 17 bp, Homo sapiens
ggcgtgagccacctcgc

SEQ ID NO: 5920342 - DNA, 13 bp, Homo sapiens
ggcgtgagccact

SEQ ID NO: 5920343 - DNA, 19 bp, Homo sapiens
ggcgtgagccactgttccc

SEQ ID NO: 5920344 - DNA, 12 bp, Homo sapiens
ggcgtgatctcg

SEQ ID NO: 5920345 - DNA, 15 bp, Homo sapiens
ggcgtgccctggagg

SEQ ID NO: 5920346 - DNA, 15 bp, Homo sapiens
ggcgtgcctgccaag

SEQ ID NO: 5920347 - DNA, 14 bp, Homo sapiens
ggcgtggagactgg

SEQ ID NO: 5920348 - DNA, 20 bp, Homo sapiens
ggcgtggagagcccggcgcc

SEQ ID NO: 5920349 - DNA, 18 bp, Homo sapiens
ggcgtggagggaggcccc

SEQ ID NO: 5920350 - DNA, 17 bp, Homo sapiens
ggcgtggcccgtggcct

SEQ ID NO: 5920351 - DNA, 13 bp, Homo sapiens
ggcgtggcctccc

SEQ ID NO: 5920352 - DNA, 14 bp, Homo sapiens
ggcgtggctctggg

SEQ ID NO: 5920353 - DNA, 17 bp, Homo sapiens
ggcgtggctggcctttc

SEQ ID NO: 5920354 - DNA, 16 bp, Homo sapiens
ggcgtgggatccagag

SEQ ID NO: 5920355 - DNA, 17 bp, Homo sapiens
ggcgtgggtctctgggg

SEQ ID NO: 5920356 - DNA, 16 bp, Homo sapiens
ggcgtggtggcgggca

SEQ ID NO: 5920357 - DNA, 21 bp, Homo sapiens
ggcgtggtggctcatgcctgt

SEQ ID NO: 5920358 - DNA, 21 bp, Homo sapiens
ggcgtggtgtgtccctggaca

SEQ ID NO: 5920359 - DNA, 22 bp, Homo sapiens
ggcgtgtgcatagcgtcctgcc

SEQ ID NO: 5920360 - DNA, 20 bp, Homo sapiens
ggcgtgtggtttccctgccc

SEQ ID NO: 5920361 - DNA, 23 bp, Homo sapiens
ggcgtgtggtttccctgcccctg

SEQ ID NO: 5920362 - DNA, 18 bp, Homo sapiens
ggcgtgtgtccctgtggt

SEQ ID NO: 5920363 - DNA, 18 bp, Homo sapiens
ggcgttatttatggacca

SEQ ID NO: 5920364 - DNA, 20 bp, Homo sapiens
ggcgttatttatggaccact

SEQ ID NO: 5920365 - DNA, 21 bp, Homo sapiens
ggcgttatttatggaccactt

SEQ ID NO: 5920366 - DNA, 22 bp, Homo sapiens
ggcgttcctgccaggctctccc

SEQ ID NO: 5920367 - DNA, 23 bp, Homo sapiens
ggcgttcctgccaggctctccct

SEQ ID NO: 5920368 - DNA, 14 bp, Homo sapiens
ggcgttctcctgct

SEQ ID NO: 5920369 - DNA, 23 bp, Homo sapiens
ggcgttcttaggctgctgggatg

SEQ ID NO: 5920370 - DNA, 17 bp, Homo sapiens
ggcgttggtgccacttc

SEQ ID NO: 5920371 - DNA, 13 bp, Homo sapiens
ggcgttgtgggga

SEQ ID NO: 5920372 - DNA, 14 bp, Homo sapiens
ggcgtttcctactg

SEQ ID NO: 5920373 - DNA, 17 bp, Homo sapiens
ggctaaaaagaatgcag

SEQ ID NO: 5920374 - DNA, 18 bp, Homo sapiens
ggctaaaaagaatgcaga

SEQ ID NO: 5920375 - DNA, 19 bp, Homo sapiens
ggctaaaaggcttccaggc

SEQ ID NO: 5920376 - DNA, 20 bp, Homo sapiens
ggctaaaaggcttccaggct

SEQ ID NO: 5920377 - DNA, 21 bp, Homo sapiens
ggctaaacatccaatattttc

SEQ ID NO: 5920378 - DNA, 18 bp, Homo sapiens
ggctaaaggggagaaact

SEQ ID NO: 5920379 - DNA, 11 bp, Homo sapiens
ggctaaatgaa

SEQ ID NO: 5920380 - DNA, 21 bp, Homo sapiens
ggctaacctggacctggaact

SEQ ID NO: 5920381 - DNA, 22 bp, Homo sapiens
ggctaacctgttacactgggct

SEQ ID NO: 5920382 - DNA, 16 bp, Homo sapiens
ggctaacgggaggctg

SEQ ID NO: 5920383 - DNA, 20 bp, Homo sapiens
ggctaacgggaggctgggca

SEQ ID NO: 5920384 - DNA, 14 bp, Homo sapiens
ggctaactctggca

SEQ ID NO: 5920385 - DNA, 16 bp, Homo sapiens
ggctaactgatgaatt

SEQ ID NO: 5920386 - DNA, 14 bp, Homo sapiens
ggctaactggaagc

SEQ ID NO: 5920387 - DNA, 16 bp, Homo sapiens
ggctaactggccccag

SEQ ID NO: 5920388 - DNA, 18 bp, Homo sapiens
ggctaactggccccaggc

SEQ ID NO: 5920389 - DNA, 21 bp, Homo sapiens
ggctaagaagttcaccagccc

SEQ ID NO: 5920390 - DNA, 16 bp, Homo sapiens
ggctccctcttctttc

SEQ ID NO: 5920391 - DNA, 18 bp, Homo sapiens
ggctccctgaccaccctg

SEQ ID NO: 5920392 - DNA, 19 bp, Homo sapiens
ggctccctgaccaccctgc

SEQ ID NO: 5920393 - DNA, 22 bp, Homo sapiens
ggctccctgaccaccctgcctg

SEQ ID NO: 5920394 - DNA, 17 bp, Homo sapiens
ggctccctgaggtacct

SEQ ID NO: 5920395 - DNA, 20 bp, Homo sapiens
ggctccctgatgggggacag

SEQ ID NO: 5920396 - DNA, 13 bp, Homo sapiens
ggctccctgcccc

SEQ ID NO: 5920397 - DNA, 15 bp, Homo sapiens
ggctccctgcctgga

SEQ ID NO: 5920398 - DNA, 22 bp, Homo sapiens
ggctccctgctccctccctcca

SEQ ID NO: 5920399 - DNA, 13 bp, Homo sapiens
ggctccctggagg

SEQ ID NO: 5920400 - DNA, 14 bp, Homo sapiens
ggctccctggccca

SEQ ID NO: 5920401 - DNA, 15 bp, Homo sapiens
ggctccctggcccag

SEQ ID NO: 5920402 - DNA, 16 bp, Homo sapiens
ggctccctggcccagc

SEQ ID NO: 5920403 - DNA, 17 bp, Homo sapiens
ggctccctggcccagcc

SEQ ID NO: 5920404 - DNA, 19 bp, Homo sapiens
ggctccctggcccagccag

SEQ ID NO: 5920405 - DNA, 14 bp, Homo sapiens
ggctccctgggcag

SEQ ID NO: 5920406 - DNA, 14 bp, Homo sapiens
ggctccctgggctg

SEQ ID NO: 5920407 - DNA, 15 bp, Homo sapiens
ggctccctgggctgg

SEQ ID NO: 5920408 - DNA, 20 bp, Homo sapiens
ggctccctgggggcggccag

SEQ ID NO: 5920409 - DNA, 13 bp, Homo sapiens
ggctcccttccca

SEQ ID NO: 5920410 - DNA, 16 bp, Homo sapiens
ggctcccttcccacct

SEQ ID NO: 5920411 - DNA, 18 bp, Homo sapiens
ggctcccttcccacctct

SEQ ID NO: 5920412 - DNA, 22 bp, Homo sapiens
ggctcccttcccacctctctca

SEQ ID NO: 5920413 - DNA, 19 bp, Homo sapiens
ggctccgaggagctggggc

SEQ ID NO: 5920414 - DNA, 20 bp, Homo sapiens
ggctccgagggcggccaggg

SEQ ID NO: 5920415 - DNA, 21 bp, Homo sapiens
ggctccgagggcggccaggga

SEQ ID NO: 5920416 - DNA, 21 bp, Homo sapiens
ggctccgcccttagtccccca

SEQ ID NO: 5920417 - DNA, 17 bp, Homo sapiens
ggctccggcctctgcct

SEQ ID NO: 5920418 - DNA, 18 bp, Homo sapiens
ggctccgggctgtgtcct

SEQ ID NO: 5920419 - DNA, 17 bp, Homo sapiens
ggctccgggtcactgct

SEQ ID NO: 5920420 - DNA, 20 bp, Homo sapiens
ggctccgggtcactgctgta

SEQ ID NO: 5920421 - DNA, 18 bp, Homo sapiens
ggctccgtcagtatcagg

SEQ ID NO: 5920422 - DNA, 22 bp, Homo sapiens
ggctccgtcagtatcaggcctg

SEQ ID NO: 5920423 - DNA, 24 bp, Homo sapiens
ggctccgtcagtatcaggcctgcc

SEQ ID NO: 5920424 - DNA, 15 bp, Homo sapiens
ggctccgtgagccct

SEQ ID NO: 5920425 - DNA, 14 bp, Homo sapiens
ggctccgtgtggga

SEQ ID NO: 5920426 - DNA, 18 bp, Homo sapiens
ggctccgtgtgggagacc

SEQ ID NO: 5920427 - DNA, 22 bp, Homo sapiens
ggctcctacaggcgctccaggc

SEQ ID NO: 5920428 - DNA, 13 bp, Homo sapiens
ggctcctaccagc

SEQ ID NO: 5920429 - DNA, 13 bp, Homo sapiens
ggctcctacctgg

SEQ ID NO: 5920430 - DNA, 14 bp, Homo sapiens
ggctcctaggctca

SEQ ID NO: 5920431 - DNA, 22 bp, Homo sapiens
ggctcctaggggaacagaccag

SEQ ID NO: 5920432 - DNA, 15 bp, Homo sapiens
ggctcctaggggaag

SEQ ID NO: 5920433 - DNA, 13 bp, Homo sapiens
ggctcctcaccac

SEQ ID NO: 5920434 - DNA, 14 bp, Homo sapiens
ggctcctcagccct

SEQ ID NO: 5920435 - DNA, 16 bp, Homo sapiens
ggctcctcagccctct

SEQ ID NO: 5920436 - DNA, 20 bp, Homo sapiens
ggctcctccagcaagacctc

SEQ ID NO: 5920437 - DNA, 20 bp, Homo sapiens
ggctcctcccagcacaggca

SEQ ID NO: 5920438 - DNA, 14 bp, Homo sapiens
ggctcctccccgat

SEQ ID NO: 5920439 - DNA, 14 bp, Homo sapiens
ggctcctccctccc

SEQ ID NO: 5920440 - DNA, 15 bp, Homo sapiens
ggctcctccctctgc

SEQ ID NO: 5920441 - DNA, 16 bp, Homo sapiens
ggctcctccctctgcc

SEQ ID NO: 5920442 - DNA, 22 bp, Homo sapiens
ggctcctccctctgcctcatcc

SEQ ID NO: 5920443 - DNA, 18 bp, Homo sapiens
ggctcctcctcacccacc

SEQ ID NO: 5920444 - DNA, 13 bp, Homo sapiens
ggctcctcctgaa

SEQ ID NO: 5920445 - DNA, 14 bp, Homo sapiens
ggctcctcctgaag

SEQ ID NO: 5920446 - DNA, 13 bp, Homo sapiens
ggctcctcgcccc

SEQ ID NO: 5920447 - DNA, 12 bp, Homo sapiens
ggctcctctcag

SEQ ID NO: 5920448 - DNA, 20 bp, Homo sapiens
ggctcctctcctaacatata

SEQ ID NO: 5920449 - DNA, 20 bp, Homo sapiens
ggctcctctgcatcttgctc

SEQ ID NO: 5920450 - DNA, 10 bp, Homo sapiens
ggctcctgac

SEQ ID NO: 5920451 - DNA, 12 bp, Homo sapiens
ggctcctgaggg

SEQ ID NO: 5920452 - DNA, 12 bp, Homo sapiens
ggctcctgccac

SEQ ID NO: 5920453 - DNA, 14 bp, Homo sapiens
ggctcctgccactg

SEQ ID NO: 5920454 - DNA, 15 bp, Homo sapiens
ggctcctgccactga

SEQ ID NO: 5920455 - DNA, 17 bp, Homo sapiens
ggctcctgccactgacc

SEQ ID NO: 5920456 - DNA, 20 bp, Homo sapiens
ggctcctgccactgacctca

SEQ ID NO: 5920457 - DNA, 11 bp, Homo sapiens
ggctcctgccc

SEQ ID NO: 5920458 - DNA, 12 bp, Homo sapiens
ggctcctgccca

SEQ ID NO: 5920459 - DNA, 19 bp, Homo sapiens
ggctcctgcccaggccaca

SEQ ID NO: 5920460 - DNA, 14 bp, Homo sapiens
ggctcctgcccctt

SEQ ID NO: 5920461 - DNA, 18 bp, Homo sapiens
ggctcctgccttctgtcc

SEQ ID NO: 5920462 - DNA, 23 bp, Homo sapiens
ggctcctgctgcaccaacccagc

SEQ ID NO: 5920463 - DNA, 13 bp, Homo sapiens
ggctcctggaaag

SEQ ID NO: 5920464 - DNA, 14 bp, Homo sapiens
ggctcctggacccc

SEQ ID NO: 5920465 - DNA, 12 bp, Homo sapiens
ggctcctggcag

SEQ ID NO: 5920466 - DNA, 12 bp, Homo sapiens
ggctcctggctg

SEQ ID NO: 5920467 - DNA, 14 bp, Homo sapiens
ggctcctggctgcc

SEQ ID NO: 5920468 - DNA, 15 bp, Homo sapiens
ggctcctggctgcca

SEQ ID NO: 5920469 - DNA, 17 bp, Homo sapiens
ggctcctggctgccagg

SEQ ID NO: 5920470 - DNA, 19 bp, Homo sapiens
ggctcctggctgccaggcg

SEQ ID NO: 5920471 - DNA, 20 bp, Homo sapiens
ggctcctggctgccaggcgt

SEQ ID NO: 5920472 - DNA, 16 bp, Homo sapiens
ggctcctgggaggccc

SEQ ID NO: 5920473 - DNA, 22 bp, Homo sapiens
ggctcctgggaggccctggcag

SEQ ID NO: 5920474 - DNA, 24 bp, Homo sapiens
ggctcctgggaggccctggcagaa

SEQ ID NO: 5920475 - DNA, 13 bp, Homo sapiens
ggctcctggtggc

SEQ ID NO: 5920476 - DNA, 13 bp, Homo sapiens
ggctcctgtctgg

SEQ ID NO: 5920477 - DNA, 17 bp, Homo sapiens
ggctcctgtgcccttat

SEQ ID NO: 5920478 - DNA, 20 bp, Homo sapiens
ggctcctgtgctactttgcc

SEQ ID NO: 5920479 - DNA, 20 bp, Homo sapiens
ggctcctgtggtagtcctcc

SEQ ID NO: 5920480 - DNA, 23 bp, Homo sapiens
ggctcctgtgtctggtccacaca

SEQ ID NO: 5920481 - DNA, 22 bp, Homo sapiens
ggctccttagggttttctctct

SEQ ID NO: 5920482 - DNA, 21 bp, Homo sapiens
ggctccttcactgaacatgcc

SEQ ID NO: 5920483 - DNA, 13 bp, Homo sapiens
ggctccttcccct

SEQ ID NO: 5920484 - DNA, 15 bp, Homo sapiens
ggctccttcctgtgg

SEQ ID NO: 5920485 - DNA, 17 bp, Homo sapiens
ggctccttgcagcaggg

SEQ ID NO: 5920486 - DNA, 19 bp, Homo sapiens
ggctccttgcagcagggct

SEQ ID NO: 5920487 - DNA, 23 bp, Homo sapiens
ggctccttgggatgaagagggta

SEQ ID NO: 5920488 - DNA, 16 bp, Homo sapiens
ggctccttgtgccaga

SEQ ID NO: 5920489 - DNA, 19 bp, Homo sapiens
ggctccttgtgggcctggg

SEQ ID NO: 5920490 - DNA, 12 bp, Homo sapiens
ggctcctttccc

SEQ ID NO: 5920491 - DNA, 13 bp, Homo sapiens
ggctcctttccca

SEQ ID NO: 5920492 - DNA, 18 bp, Homo sapiens
ggctcctttcccacagtc

SEQ ID NO: 5920493 - DNA, 12 bp, Homo sapiens
ggctcctttctc

SEQ ID NO: 5920494 - DNA, 13 bp, Homo sapiens
ggctcctttctcc

SEQ ID NO: 5920495 - DNA, 19 bp, Homo sapiens
ggctcctttctccagccag

SEQ ID NO: 5920496 - DNA, 21 bp, Homo sapiens
ggctcctttctccagccagca

SEQ ID NO: 5920497 - DNA, 17 bp, Homo sapiens
ggctcctttgcctctgc

SEQ ID NO: 5920498 - DNA, 23 bp, Homo sapiens
ggctcctttgcctctgctactga

SEQ ID NO: 5920499 - DNA, 18 bp, Homo sapiens
ggctcgaatctctgtgcc

SEQ ID NO: 5920500 - DNA, 19 bp, Homo sapiens
ggctcgagctcggggctgg

SEQ ID NO: 5920501 - DNA, 17 bp, Homo sapiens
ggctcgaggctggtgcc

SEQ ID NO: 5920502 - DNA, 21 bp, Homo sapiens
ggctcgaggggctcagggcct

SEQ ID NO: 5920503 - DNA, 16 bp, Homo sapiens
ggctcgagtgcccctg

SEQ ID NO: 5920504 - DNA, 22 bp, Homo sapiens
ggctcgattttgtatctgcagg

SEQ ID NO: 5920505 - DNA, 13 bp, Homo sapiens
ggctcgcaccccc

SEQ ID NO: 5920506 - DNA, 14 bp, Homo sapiens
ggctcgcactgccc

SEQ ID NO: 5920507 - DNA, 17 bp, Homo sapiens
ggctcgccaaggcctag

SEQ ID NO: 5920508 - DNA, 22 bp, Homo sapiens
ggctcgccaaggcctaggacct

SEQ ID NO: 5920509 - DNA, 16 bp, Homo sapiens
ggctcgccatgccggg

SEQ ID NO: 5920510 - DNA, 18 bp, Homo sapiens
ggctcgcccatacccgtg

SEQ ID NO: 5920511 - DNA, 15 bp, Homo sapiens
ggctcgccccaccca

SEQ ID NO: 5920512 - DNA, 20 bp, Homo sapiens
ggctcgccccacccagggct

SEQ ID NO: 5920513 - DNA, 17 bp, Homo sapiens
ggctcgccgtgtctcag

SEQ ID NO: 5920514 - DNA, 20 bp, Homo sapiens
ggctcgccgtgtctcagcct

SEQ ID NO: 5920515 - DNA, 22 bp, Homo sapiens
ggctcgccttccctcctgcttt

SEQ ID NO: 5920516 - DNA, 13 bp, Homo sapiens
ggctcgctgtggt

SEQ ID NO: 5920517 - DNA, 15 bp, Homo sapiens
ggctcggacccaccc

SEQ ID NO: 5920518 - DNA, 19 bp, Homo sapiens
ggctcggacccaccccaac

SEQ ID NO: 5920519 - DNA, 15 bp, Homo sapiens
ggctcggcccagcac

SEQ ID NO: 5920520 - DNA, 16 bp, Homo sapiens
ggctcggcccagcacc

SEQ ID NO: 5920521 - DNA, 15 bp, Homo sapiens
ggctcggcctgcccc

SEQ ID NO: 5920522 - DNA, 13 bp, Homo sapiens
ggctcgggcgctg

SEQ ID NO: 5920523 - DNA, 21 bp, Homo sapiens
ggctcggggctccccacgccc

SEQ ID NO: 5920524 - DNA, 19 bp, Homo sapiens
ggctcggggtaaaaagtgg

SEQ ID NO: 5920525 - DNA, 16 bp, Homo sapiens
ggctcgggtgcccagg

SEQ ID NO: 5920526 - DNA, 15 bp, Homo sapiens
ggctcgtaggcctgc

SEQ ID NO: 5920527 - DNA, 13 bp, Homo sapiens
ggctcgtggactg

SEQ ID NO: 5920528 - DNA, 15 bp, Homo sapiens
ggctcgtgggctctg

SEQ ID NO: 5920529 - DNA, 17 bp, Homo sapiens
ggctcgtgtttcacagt

SEQ ID NO: 5920530 - DNA, 18 bp, Homo sapiens
ggctcgtgtttcacagtg

SEQ ID NO: 5920531 - DNA, 14 bp, Homo sapiens
ggctcgttccccca

SEQ ID NO: 5920532 - DNA, 15 bp, Homo sapiens
ggctcgttctcttct

SEQ ID NO: 5920533 - DNA, 14 bp, Homo sapiens
ggctctaacgcctg

SEQ ID NO: 5920534 - DNA, 15 bp, Homo sapiens
ggctctaacgcctga

SEQ ID NO: 5920535 - DNA, 16 bp, Homo sapiens
ggctctaacgcctgag

SEQ ID NO: 5920536 - DNA, 18 bp, Homo sapiens
ggctctaacgcctgagcc

SEQ ID NO: 5920537 - DNA, 19 bp, Homo sapiens
ggctctaattcacagtgct

SEQ ID NO: 5920538 - DNA, 14 bp, Homo sapiens
ggctctacacatat

SEQ ID NO: 5920539 - DNA, 16 bp, Homo sapiens
ggctctaccttcctgt

SEQ ID NO: 5920540 - DNA, 21 bp, Homo sapiens
ggctctaccttcctgtccctg

SEQ ID NO: 5920541 - DNA, 16 bp, Homo sapiens
ggctctagaattccag

SEQ ID NO: 5920542 - DNA, 16 bp, Homo sapiens
ggctctagccccagcg

SEQ ID NO: 5920543 - DNA, 19 bp, Homo sapiens
ggctctagggttgctggag

SEQ ID NO: 5920544 - DNA, 16 bp, Homo sapiens
ggctctatctgctggg

SEQ ID NO: 5920545 - DNA, 19 bp, Homo sapiens
ggctctatctgctgggctg

SEQ ID NO: 5920546 - DNA, 18 bp, Homo sapiens
ggctctatgagtctagat

SEQ ID NO: 5920547 - DNA, 16 bp, Homo sapiens
ggctctatgcctgcac

SEQ ID NO: 5920548 - DNA, 15 bp, Homo sapiens
ggctctatttcttct

SEQ ID NO: 5920549 - DNA, 13 bp, Homo sapiens
ggctctcaagtga

SEQ ID NO: 5920550 - DNA, 15 bp, Homo sapiens
ggctctcacccagtc

SEQ ID NO: 5920551 - DNA, 15 bp, Homo sapiens
ggctctcagaggaaa

SEQ ID NO: 5920552 - DNA, 12 bp, Homo sapiens
ggctctcagctc

SEQ ID NO: 5920553 - DNA, 14 bp, Homo sapiens
ggctctcagctcag

SEQ ID NO: 5920554 - DNA, 15 bp, Homo sapiens
ggctctcaggccagc

SEQ ID NO: 5920555 - DNA, 18 bp, Homo sapiens
ggctctcaggccagctgc

SEQ ID NO: 5920556 - DNA, 19 bp, Homo sapiens
ggctctcaggccagctgct

SEQ ID NO: 5920557 - DNA, 18 bp, Homo sapiens
ggctctccaagtgccaga

SEQ ID NO: 5920558 - DNA, 14 bp, Homo sapiens
ggctctccacctca

SEQ ID NO: 5920559 - DNA, 15 bp, Homo sapiens
ggctctccacctcag

SEQ ID NO: 5920560 - DNA, 18 bp, Homo sapiens
ggctctccacctcagcct

SEQ ID NO: 5920561 - DNA, 16 bp, Homo sapiens
ggctctccagacctga

SEQ ID NO: 5920562 - DNA, 11 bp, Homo sapiens
ggctctcccac

SEQ ID NO: 5920563 - DNA, 12 bp, Homo sapiens
ggctctcccacc

SEQ ID NO: 5920564 - DNA, 14 bp, Homo sapiens
ggctctcccacccc

SEQ ID NO: 5920565 - DNA, 23 bp, Homo sapiens
ggctctcccctctcgccccatcc

SEQ ID NO: 5920566 - DNA, 14 bp, Homo sapiens
ggctctccctgcac

SEQ ID NO: 5920567 - DNA, 15 bp, Homo sapiens
ggctctcctctggct

SEQ ID NO: 5920568 - DNA, 12 bp, Homo sapiens
ggctctcctgag

SEQ ID NO: 5920569 - DNA, 23 bp, Homo sapiens
ggctctcctgagaggtgctgcag

SEQ ID NO: 5920570 - DNA, 13 bp, Homo sapiens
ggctctcctggct

SEQ ID NO: 5920571 - DNA, 23 bp, Homo sapiens
ggctgcccctgtaaggtttcaat

SEQ ID NO: 5920572 - DNA, 22 bp, Homo sapiens
ggctgcccgctcccagtgtctt

SEQ ID NO: 5920573 - DNA, 13 bp, Homo sapiens
ggctgccctcctg

SEQ ID NO: 5920574 - DNA, 14 bp, Homo sapiens
ggctgccctcctgt

SEQ ID NO: 5920575 - DNA, 18 bp, Homo sapiens
ggctgccctcctgtgctc

SEQ ID NO: 5920576 - DNA, 20 bp, Homo sapiens
ggctgccctcctgtgctcag

SEQ ID NO: 5920577 - DNA, 23 bp, Homo sapiens
ggctgccctcctgtgctcagccc

SEQ ID NO: 5920578 - DNA, 18 bp, Homo sapiens
ggctgccctctggggcca

SEQ ID NO: 5920579 - DNA, 17 bp, Homo sapiens
ggctgccctgacccttc

SEQ ID NO: 5920580 - DNA, 21 bp, Homo sapiens
ggctgccctgagaagctgctc

SEQ ID NO: 5920581 - DNA, 15 bp, Homo sapiens
ggctgccctgagggg

SEQ ID NO: 5920582 - DNA, 20 bp, Homo sapiens
ggctgccctgaggggctggg

SEQ ID NO: 5920583 - DNA, 11 bp, Homo sapiens
ggctgccctgg

SEQ ID NO: 5920584 - DNA, 14 bp, Homo sapiens
ggctgccctggccc

SEQ ID NO: 5920585 - DNA, 16 bp, Homo sapiens
ggctgccctggccctg

SEQ ID NO: 5920586 - DNA, 13 bp, Homo sapiens
ggctgccctgggc

SEQ ID NO: 5920587 - DNA, 13 bp, Homo sapiens
ggctgccctggtg

SEQ ID NO: 5920588 - DNA, 22 bp, Homo sapiens
ggctgcccttcgctgccaggac

SEQ ID NO: 5920589 - DNA, 18 bp, Homo sapiens
ggctgcccttgggccacc

SEQ ID NO: 5920590 - DNA, 19 bp, Homo sapiens
ggctgcccttgttgcctgc

SEQ ID NO: 5920591 - DNA, 17 bp, Homo sapiens
ggctgccgactccccca

SEQ ID NO: 5920592 - DNA, 18 bp, Homo sapiens
ggctgccgcatctgcctg

SEQ ID NO: 5920593 - DNA, 20 bp, Homo sapiens
ggctgccgctgctctcccag

SEQ ID NO: 5920594 - DNA, 22 bp, Homo sapiens
ggctgccggagggagccctgag

SEQ ID NO: 5920595 - DNA, 18 bp, Homo sapiens
ggctgccggatctgggct

SEQ ID NO: 5920596 - DNA, 22 bp, Homo sapiens
ggctgccgggtggggggagggc

SEQ ID NO: 5920597 - DNA, 16 bp, Homo sapiens
ggctgccgtggggccg

SEQ ID NO: 5920598 - DNA, 23 bp, Homo sapiens
ggctgccgtggggccgccgcctc

SEQ ID NO: 5920599 - DNA, 13 bp, Homo sapiens
ggctgcctcagcc

SEQ ID NO: 5920600 - DNA, 18 bp, Homo sapiens
ggctgcctcagccagtgg

SEQ ID NO: 5920601 - DNA, 12 bp, Homo sapiens
ggctgcctccac

SEQ ID NO: 5920602 - DNA, 12 bp, Homo sapiens
ggctgcctccgc

SEQ ID NO: 5920603 - DNA, 22 bp, Homo sapiens
ggctgcctcctcctgagagctg

SEQ ID NO: 5920604 - DNA, 14 bp, Homo sapiens
ggctgcctcctttg

SEQ ID NO: 5920605 - DNA, 14 bp, Homo sapiens
ggctgcctctgggt

SEQ ID NO: 5920606 - DNA, 23 bp, Homo sapiens
ggctgcctgagtcgtgacctgct

SEQ ID NO: 5920607 - DNA, 12 bp, Homo sapiens
ggctgcctgccc

SEQ ID NO: 5920608 - DNA, 14 bp, Homo sapiens
ggctgcctgcccct

SEQ ID NO: 5920609 - DNA, 15 bp, Homo sapiens
ggctgcctgcccctg

SEQ ID NO: 5920610 - DNA, 12 bp, Homo sapiens
ggctgcctgccg

SEQ ID NO: 5920611 - DNA, 13 bp, Homo sapiens
ggctgcctgccgc

SEQ ID NO: 5920612 - DNA, 11 bp, Homo sapiens
ggctgcctgga

SEQ ID NO: 5920613 - DNA, 16 bp, Homo sapiens
ggctgcctggagaaag

SEQ ID NO: 5920614 - DNA, 18 bp, Homo sapiens
ggctgcctggagaaagga

SEQ ID NO: 5920615 - DNA, 13 bp, Homo sapiens
ggctgcctggccc

SEQ ID NO: 5920616 - DNA, 14 bp, Homo sapiens
ggctgcctggccca

SEQ ID NO: 5920617 - DNA, 23 bp, Homo sapiens
ggctgcctggcccagggaggaat

SEQ ID NO: 5920618 - DNA, 14 bp, Homo sapiens
ggctgcctgggctg

SEQ ID NO: 5920619 - DNA, 17 bp, Homo sapiens
ggctgcctggggattgg

SEQ ID NO: 5920620 - DNA, 22 bp, Homo sapiens
ggctgcctggggattgggaggg

SEQ ID NO: 5920621 - DNA, 12 bp, Homo sapiens
ggctgccttctg

SEQ ID NO: 5920622 - DNA, 14 bp, Homo sapiens
ggctgccttgctgt

SEQ ID NO: 5920623 - DNA, 21 bp, Homo sapiens
ggctgcgaaaacgttgacccc

SEQ ID NO: 5920624 - DNA, 18 bp, Homo sapiens
ggctgcgaactgtgcagt

SEQ ID NO: 5920625 - DNA, 19 bp, Homo sapiens
ggctgcgaactgtgcagtt

SEQ ID NO: 5920626 - DNA, 19 bp, Homo sapiens
ggctgcgacgcttgctctg

SEQ ID NO: 5920627 - DNA, 18 bp, Homo sapiens
ggctgcgctagcagccct

SEQ ID NO: 5920628 - DNA, 20 bp, Homo sapiens
ggctgcgctagcagcccttg

SEQ ID NO: 5920629 - DNA, 15 bp, Homo sapiens
ggctgcgcttcctat

SEQ ID NO: 5920630 - DNA, 17 bp, Homo sapiens
ggctgcggcgtctgtct

SEQ ID NO: 5920631 - DNA, 20 bp, Homo sapiens
ggctgcgggacagaggacca

SEQ ID NO: 5920632 - DNA, 16 bp, Homo sapiens
ggctgcgggaggccct

SEQ ID NO: 5920633 - DNA, 22 bp, Homo sapiens
ggctgcgggaggccctggccct

SEQ ID NO: 5920634 - DNA, 16 bp, Homo sapiens
ggctgcggtgggcagc

SEQ ID NO: 5920635 - DNA, 18 bp, Homo sapiens
ggctgcgtccctccgagc

SEQ ID NO: 5920636 - DNA, 16 bp, Homo sapiens
ggctgctaagtggaag

SEQ ID NO: 5920637 - DNA, 17 bp, Homo sapiens
ggctgctaagtggaaga

SEQ ID NO: 5920638 - DNA, 22 bp, Homo sapiens
ggctgctaagtggaagacagag

SEQ ID NO: 5920639 - DNA, 15 bp, Homo sapiens
ggctgctacccagaa

SEQ ID NO: 5920640 - DNA, 16 bp, Homo sapiens
ggctgctacccagaaa

SEQ ID NO: 5920641 - DNA, 21 bp, Homo sapiens
ggctgctcagcctcatcctga

SEQ ID NO: 5920642 - DNA, 12 bp, Homo sapiens
ggctgctcatca

SEQ ID NO: 5920643 - DNA, 17 bp, Homo sapiens
ggctgctcatcacccag

SEQ ID NO: 5920644 - DNA, 18 bp, Homo sapiens
ggctgctcatcacccagt

SEQ ID NO: 5920645 - DNA, 21 bp, Homo sapiens
ggctgctcattccttctggag

SEQ ID NO: 5920646 - DNA, 13 bp, Homo sapiens
ggctgctcccacc

SEQ ID NO: 5920647 - DNA, 18 bp, Homo sapiens
ggctgctcccacctggct

SEQ ID NO: 5920648 - DNA, 22 bp, Homo sapiens
ggctgctcccacctggctctgt

SEQ ID NO: 5920649 - DNA, 13 bp, Homo sapiens
ggctgctccccac

SEQ ID NO: 5920650 - DNA, 12 bp, Homo sapiens
ggctgctccctg

SEQ ID NO: 5920651 - DNA, 13 bp, Homo sapiens
ggctgctccctga

SEQ ID NO: 5920652 - DNA, 16 bp, Homo sapiens
ggctgctccctgctcc

SEQ ID NO: 5920653 - DNA, 19 bp, Homo sapiens
ggctgctccctgctcccag

SEQ ID NO: 5920654 - DNA, 20 bp, Homo sapiens
ggctgctccctgctcccagg

SEQ ID NO: 5920655 - DNA, 16 bp, Homo sapiens
ggctgctcctccagcc

SEQ ID NO: 5920656 - DNA, 15 bp, Homo sapiens
ggctgctcctccagg

SEQ ID NO: 5920657 - DNA, 23 bp, Homo sapiens
ggctgctcggcttgatcacagct

SEQ ID NO: 5920658 - DNA, 22 bp, Homo sapiens
ggctgctcggggtgcacaggag

SEQ ID NO: 5920659 - DNA, 15 bp, Homo sapiens
ggctgctctgcctgt

SEQ ID NO: 5920660 - DNA, 17 bp, Homo sapiens
ggctgctctgggaaggg

SEQ ID NO: 5920661 - DNA, 20 bp, Homo sapiens
ggctgctctgtcttggtcct

SEQ ID NO: 5920662 - DNA, 19 bp, Homo sapiens
ggctgctctttccacttgc

SEQ ID NO: 5920663 - DNA, 23 bp, Homo sapiens
ggctgctgaaaaccatctggcct

SEQ ID NO: 5920664 - DNA, 19 bp, Homo sapiens
ggctgctgacaggatgtgg

SEQ ID NO: 5920665 - DNA, 19 bp, Homo sapiens
ggctgctgatcgccttccc

SEQ ID NO: 5920666 - DNA, 22 bp, Homo sapiens
ggctgctgcagtcagcacagag

SEQ ID NO: 5920667 - DNA, 14 bp, Homo sapiens
ggctgctgcagtga

SEQ ID NO: 5920668 - DNA, 17 bp, Homo sapiens
ggctgctgccaggcccg

SEQ ID NO: 5920669 - DNA, 14 bp, Homo sapiens
ggctgctgccatcc

SEQ ID NO: 5920670 - DNA, 18 bp, Homo sapiens
ggctgctgccctgctgtg

SEQ ID NO: 5920671 - DNA, 23 bp, Homo sapiens
ggctgctgccctgctgtggaaga

SEQ ID NO: 5920672 - DNA, 21 bp, Homo sapiens
ggctgctgccggaatcacttc

SEQ ID NO: 5920673 - DNA, 16 bp, Homo sapiens
ggctgctgcggctgtg

SEQ ID NO: 5920674 - DNA, 19 bp, Homo sapiens
ggctgctgcggctgtgggc

SEQ ID NO: 5920675 - DNA, 11 bp, Homo sapiens
ggctgctgctc

SEQ ID NO: 5920676 - DNA, 12 bp, Homo sapiens
ggctgctgctcc

SEQ ID NO: 5920677 - DNA, 19 bp, Homo sapiens
ggctgctgctgatgtagga

SEQ ID NO: 5920678 - DNA, 22 bp, Homo sapiens
ggctgctgctgctcttggctgg

SEQ ID NO: 5920679 - DNA, 12 bp, Homo sapiens
ggctgctggagg

SEQ ID NO: 5920680 - DNA, 16 bp, Homo sapiens
ggctgctggcacagac

SEQ ID NO: 5920681 - DNA, 12 bp, Homo sapiens
ggctgctggcca

SEQ ID NO: 5920682 - DNA, 12 bp, Homo sapiens
ggctgctggccc

SEQ ID NO: 5920683 - DNA, 21 bp, Homo sapiens
ggctgctggcccacagctctg

SEQ ID NO: 5920684 - DNA, 19 bp, Homo sapiens
ggctgctggcctggccctt

SEQ ID NO: 5920685 - DNA, 13 bp, Homo sapiens
ggctgctggcgcc

SEQ ID NO: 5920686 - DNA, 19 bp, Homo sapiens
ggctgctggcgcctctgca

SEQ ID NO: 5920687 - DNA, 19 bp, Homo sapiens
ggctgctggcttcagggag

SEQ ID NO: 5920688 - DNA, 12 bp, Homo sapiens
ggctgctgggcg

SEQ ID NO: 5920689 - DNA, 17 bp, Homo sapiens
ggctgctggggcagggc

SEQ ID NO: 5920690 - DNA, 22 bp, Homo sapiens
ggctgctggggcatgtgtgcct

SEQ ID NO: 5920691 - DNA, 22 bp, Homo sapiens
ggctgctgggggcaactggcca

SEQ ID NO: 5920692 - DNA, 22 bp, Homo sapiens
ggctgctgggggctccccttgc

SEQ ID NO: 5920693 - DNA, 22 bp, Homo sapiens
ggctgctgtaaagttgagggga

SEQ ID NO: 5920694 - DNA, 20 bp, Homo sapiens
ggctgctgtgatgccgtcct

SEQ ID NO: 5920695 - DNA, 17 bp, Homo sapiens
ggctgctgtgggaaatg

SEQ ID NO: 5920696 - DNA, 22 bp, Homo sapiens
ggctgctgtgtggacggcgctg

SEQ ID NO: 5920697 - DNA, 15 bp, Homo sapiens
ggctgcttcaaggat

SEQ ID NO: 5920698 - DNA, 19 bp, Homo sapiens
ggctgcttccctgaagctc

SEQ ID NO: 5920699 - DNA, 16 bp, Homo sapiens
ggctgcttcctcctgg

SEQ ID NO: 5920700 - DNA, 13 bp, Homo sapiens
ggctgcttcctgt

SEQ ID NO: 5920701 - DNA, 23 bp, Homo sapiens
ggctgcttctccacctcccccaa

SEQ ID NO: 5920702 - DNA, 15 bp, Homo sapiens
ggctgcttctggggc

SEQ ID NO: 5920703 - DNA, 16 bp, Homo sapiens
ggctgcttgcagccag

SEQ ID NO: 5920704 - DNA, 18 bp, Homo sapiens
ggctgcttgcagccagga

SEQ ID NO: 5920705 - DNA, 15 bp, Homo sapiens
ggctgcttgcttttg

SEQ ID NO: 5920706 - DNA, 22 bp, Homo sapiens
ggctgctttgtagtttgcccag

SEQ ID NO: 5920707 - DNA, 16 bp, Homo sapiens
ggctggaaagcagagc

SEQ ID NO: 5920708 - DNA, 23 bp, Homo sapiens
ggctggaaagcagagcctcctgg

SEQ ID NO: 5920709 - DNA, 22 bp, Homo sapiens
ggctggaagatcctgcgggtgg

SEQ ID NO: 5920710 - DNA, 20 bp, Homo sapiens
ggctggaaggacctgctccc

SEQ ID NO: 5920711 - DNA, 17 bp, Homo sapiens
ggctggaaggaggaaga

SEQ ID NO: 5920712 - DNA, 15 bp, Homo sapiens
ggctggaaggcagca

SEQ ID NO: 5920713 - DNA, 16 bp, Homo sapiens
ggctggaaggggtcca

SEQ ID NO: 5920714 - DNA, 15 bp, Homo sapiens
ggctggaataagagg

SEQ ID NO: 5920715 - DNA, 20 bp, Homo sapiens
ggctggaatgcagtggtgtg

SEQ ID NO: 5920716 - DNA, 21 bp, Homo sapiens
ggctggaatgggagacctgtt

SEQ ID NO: 5920717 - DNA, 16 bp, Homo sapiens
ggctggaatttctgct

SEQ ID NO: 5920718 - DNA, 17 bp, Homo sapiens
ggctggacaccctctgc

SEQ ID NO: 5920719 - DNA, 21 bp, Homo sapiens
ggctggacatttgtggcagtg

SEQ ID NO: 5920720 - DNA, 15 bp, Homo sapiens
ggctggaccaactgc

SEQ ID NO: 5920721 - DNA, 16 bp, Homo sapiens
ggctggaccaactgct

SEQ ID NO: 5920722 - DNA, 19 bp, Homo sapiens
ggctggacccagccaggcc

SEQ ID NO: 5920723 - DNA, 20 bp, Homo sapiens
ggctggacccagccaggccc

SEQ ID NO: 5920724 - DNA, 16 bp, Homo sapiens
ggctggacctatgtcc

SEQ ID NO: 5920725 - DNA, 13 bp, Homo sapiens
ggctggacctgca

SEQ ID NO: 5920726 - DNA, 13 bp, Homo sapiens
ggctggacctgct

SEQ ID NO: 5920727 - DNA, 12 bp, Homo sapiens
ggctggacctgg

SEQ ID NO: 5920728 - DNA, 22 bp, Homo sapiens
ggctggacctggggtcccccct

SEQ ID NO: 5920729 - DNA, 23 bp, Homo sapiens
ggctggacctggggtcccccctc

SEQ ID NO: 5920730 - DNA, 23 bp, Homo sapiens
ggctggactccagatctgcaccg

SEQ ID NO: 5920731 - DNA, 19 bp, Homo sapiens
ggctggactgcagtggcct

SEQ ID NO: 5920732 - DNA, 12 bp, Homo sapiens
ggctggactgga

SEQ ID NO: 5920733 - DNA, 18 bp, Homo sapiens
ggctggactggaggtggg

SEQ ID NO: 5920734 - DNA, 12 bp, Homo sapiens
ggctggactggc

SEQ ID NO: 5920735 - DNA, 14 bp, Homo sapiens
ggctggactggctg

SEQ ID NO: 5920736 - DNA, 20 bp, Homo sapiens
ggctggacttctacctgccc

SEQ ID NO: 5920737 - DNA, 13 bp, Homo sapiens
ggctggacttgga

SEQ ID NO: 5920738 - DNA, 19 bp, Homo sapiens
ggctggagaaagagctgcc

SEQ ID NO: 5920739 - DNA, 21 bp, Homo sapiens
ggctggagaaagagctgcctg

SEQ ID NO: 5920740 - DNA, 23 bp, Homo sapiens
ggctggagaaagagctgcctgga

SEQ ID NO: 5920741 - DNA, 23 bp, Homo sapiens
ggctggagaatttagaatcagaa

SEQ ID NO: 5920742 - DNA, 13 bp, Homo sapiens
ggctggagacagg

SEQ ID NO: 5920743 - DNA, 19 bp, Homo sapiens
ggctggagaccagaacagc

SEQ ID NO: 5920744 - DNA, 21 bp, Homo sapiens
ggctggagataacagcctctt

SEQ ID NO: 5920745 - DNA, 15 bp, Homo sapiens
ggctggagctcctcc

SEQ ID NO: 5920746 - DNA, 17 bp, Homo sapiens
ggctggagctcctccct

SEQ ID NO: 5920747 - DNA, 13 bp, Homo sapiens
ggctggagctggc

SEQ ID NO: 5920748 - DNA, 16 bp, Homo sapiens
ggctggaggaaggaaa

SEQ ID NO: 5920749 - DNA, 17 bp, Homo sapiens
ggctggaggagcccagg

SEQ ID NO: 5920750 - DNA, 17 bp, Homo sapiens
ggctggaggagctggcc

SEQ ID NO: 5920751 - DNA, 20 bp, Homo sapiens
ggctggaggagctggcctgt

SEQ ID NO: 5920752 - DNA, 22 bp, Homo sapiens
ggctggaggagctggcctgtgg

SEQ ID NO: 5920753 - DNA, 13 bp, Homo sapiens
ggctggaggcagg

SEQ ID NO: 5920754 - DNA, 19 bp, Homo sapiens
ggctggaggcagggccttg

SEQ ID NO: 5920755 - DNA, 17 bp, Homo sapiens
ggctggaggcattccca

SEQ ID NO: 5920756 - DNA, 14 bp, Homo sapiens
ggctggaggcccag

SEQ ID NO: 5920757 - DNA, 15 bp, Homo sapiens
ggctggaggcccagg

SEQ ID NO: 5920758 - DNA, 13 bp, Homo sapiens
ggctggaggtgct

SEQ ID NO: 5920759 - DNA, 20 bp, Homo sapiens
ggctggagtacagtggtgcc

SEQ ID NO: 5920760 - DNA, 20 bp, Homo sapiens
ggctggagtacagtggtgtg

SEQ ID NO: 5920761 - DNA, 14 bp, Homo sapiens
ggctggagtgagga

SEQ ID NO: 5920762 - DNA, 20 bp, Homo sapiens
ggctggagtgcagtggcgcg

SEQ ID NO: 5920763 - DNA, 20 bp, Homo sapiens
ggctggagtgcagtggtgcc

SEQ ID NO: 5920764 - DNA, 20 bp, Homo sapiens
ggctggagtgcggtggcgca

SEQ ID NO: 5920765 - DNA, 20 bp, Homo sapiens
ggctggagtggagtggcacg

SEQ ID NO: 5920766 - DNA, 14 bp, Homo sapiens
ggctggagtgggct

SEQ ID NO: 5920767 - DNA, 17 bp, Homo sapiens
ggctggatctgtgaggg

SEQ ID NO: 5920768 - DNA, 15 bp, Homo sapiens
ggctggatgaaattt

SEQ ID NO: 5920769 - DNA, 16 bp, Homo sapiens
ggctggatgagctccc

SEQ ID NO: 5920770 - DNA, 15 bp, Homo sapiens
ggctggatggacaga

SEQ ID NO: 5920771 - DNA, 15 bp, Homo sapiens
ggctggcaagcaggg

SEQ ID NO: 5920772 - DNA, 18 bp, Homo sapiens
ggctggcacagcccctgg

SEQ ID NO: 5920773 - DNA, 19 bp, Homo sapiens
ggctggcaccgccttctct

SEQ ID NO: 5920774 - DNA, 18 bp, Homo sapiens
ggctggcacgtgacaggc

SEQ ID NO: 5920775 - DNA, 16 bp, Homo sapiens
ggctggcactgctggg

SEQ ID NO: 5920776 - DNA, 13 bp, Homo sapiens
ggctggcagggct

SEQ ID NO: 5920777 - DNA, 14 bp, Homo sapiens
ggctggcaggtatg

SEQ ID NO: 5920778 - DNA, 16 bp, Homo sapiens
ggctggcatctccccc

SEQ ID NO: 5920779 - DNA, 12 bp, Homo sapiens
ggctggcatgat

SEQ ID NO: 5920780 - DNA, 15 bp, Homo sapiens
ggctggcatggggag

SEQ ID NO: 5920781 - DNA, 21 bp, Homo sapiens
ggctggcatggggaggggaga

SEQ ID NO: 5920782 - DNA, 17 bp, Homo sapiens
ggctggccactgcacag

SEQ ID NO: 5920783 - DNA, 22 bp, Homo sapiens
ggctggccagcaaggcaggttg

SEQ ID NO: 5920784 - DNA, 14 bp, Homo sapiens
ggctggccagcccc

SEQ ID NO: 5920785 - DNA, 20 bp, Homo sapiens
ggctggccagccccacagcc

SEQ ID NO: 5920786 - DNA, 16 bp, Homo sapiens
ggctggccagccgctc

SEQ ID NO: 5920787 - DNA, 13 bp, Homo sapiens
ggctggccaggac

SEQ ID NO: 5920788 - DNA, 15 bp, Homo sapiens
ggctggccaggacac

SEQ ID NO: 5920789 - DNA, 16 bp, Homo sapiens
ggctggccaggacaca

SEQ ID NO: 5920790 - DNA, 19 bp, Homo sapiens
ggctggccaggacacactg

SEQ ID NO: 5920791 - DNA, 20 bp, Homo sapiens
ggctggccagtccaggctgc

SEQ ID NO: 5920792 - DNA, 19 bp, Homo sapiens
ggctggccatggagaaagc

SEQ ID NO: 5920793 - DNA, 20 bp, Homo sapiens
ggctggcccagccctgctgg

SEQ ID NO: 5920794 - DNA, 21 bp, Homo sapiens
ggctggcccagccctgctggc

SEQ ID NO: 5920795 - DNA, 22 bp, Homo sapiens
ggctggcccagccctgctggcc

SEQ ID NO: 5920796 - DNA, 20 bp, Homo sapiens
ggctggccccagggcaccct

SEQ ID NO: 5920797 - DNA, 20 bp, Homo sapiens
ggctggccccatcctggccc

SEQ ID NO: 5920798 - DNA, 21 bp, Homo sapiens
ggctggccccatcctggccca

SEQ ID NO: 5920799 - DNA, 18 bp, Homo sapiens
ggctggccctaggcactg

SEQ ID NO: 5920800 - DNA, 13 bp, Homo sapiens
ggctggccctgcc

SEQ ID NO: 5920801 - DNA, 12 bp, Homo sapiens
ggctggccctgt

SEQ ID NO: 5920802 - DNA, 14 bp, Homo sapiens
ggctggccctgtgc

SEQ ID NO: 5920803 - DNA, 18 bp, Homo sapiens
ggctggccggtccacccc

SEQ ID NO: 5920804 - DNA, 15 bp, Homo sapiens
ggctggcctccgcct

SEQ ID NO: 5920805 - DNA, 12 bp, Homo sapiens
ggctggcctgag

SEQ ID NO: 5920806 - DNA, 13 bp, Homo sapiens
ggctggcctggag

SEQ ID NO: 5920807 - DNA, 15 bp, Homo sapiens
ggctggcctggaggc

SEQ ID NO: 5920808 - DNA, 14 bp, Homo sapiens
ggctggccttcctg

SEQ ID NO: 5920809 - DNA, 13 bp, Homo sapiens
ggctggcctttca

SEQ ID NO: 5920810 - DNA, 22 bp, Homo sapiens
ggctggcctttcaggtccaggc

SEQ ID NO: 5920811 - DNA, 16 bp, Homo sapiens
ggctggcgcagccaag

SEQ ID NO: 5920812 - DNA, 17 bp, Homo sapiens
ggctggcgcagccaagg

SEQ ID NO: 5920813 - DNA, 21 bp, Homo sapiens
ggctggcgcagccaaggccga

SEQ ID NO: 5920814 - DNA, 18 bp, Homo sapiens
ggctggcgcttggatctg

SEQ ID NO: 5920815 - DNA, 15 bp, Homo sapiens
ggctggcgggccctg

SEQ ID NO: 5920816 - DNA, 18 bp, Homo sapiens
ggctggcggggtctgctc

SEQ ID NO: 5920817 - DNA, 20 bp, Homo sapiens
ggctggcggggtctgctcct

SEQ ID NO: 5920818 - DNA, 14 bp, Homo sapiens
ggctggcgtgcagt

SEQ ID NO: 5920819 - DNA, 21 bp, Homo sapiens
ggctggctccccctccccagg

SEQ ID NO: 5920820 - DNA, 18 bp, Homo sapiens
ggctggctcccctgcagc

SEQ ID NO: 5920821 - DNA, 16 bp, Homo sapiens
ggctggctccctcttg

SEQ ID NO: 5920822 - DNA, 16 bp, Homo sapiens
ggctggctctgaagcc

SEQ ID NO: 5920823 - DNA, 13 bp, Homo sapiens
ggctggctctgca

SEQ ID NO: 5920824 - DNA, 14 bp, Homo sapiens
ggctggctgagggc

SEQ ID NO: 5920825 - DNA, 15 bp, Homo sapiens
ggctggctgagggca

SEQ ID NO: 5920826 - DNA, 10 bp, Homo sapiens
ggctggctgc

SEQ ID NO: 5920827 - DNA, 16 bp, Homo sapiens
ggctggctgccttctg

SEQ ID NO: 5920828 - DNA, 20 bp, Homo sapiens
ggctggctgctcctaaccta

SEQ ID NO: 5920829 - DNA, 12 bp, Homo sapiens
ggctggctggag

SEQ ID NO: 5920830 - DNA, 15 bp, Homo sapiens
ggctggctggcctca

SEQ ID NO: 5920831 - DNA, 13 bp, Homo sapiens
ggctggctggggg

SEQ ID NO: 5920832 - DNA, 14 bp, Homo sapiens
ggctggctgggggc

SEQ ID NO: 5920833 - DNA, 16 bp, Homo sapiens
ggctggcttcaggagg

SEQ ID NO: 5920834 - DNA, 16 bp, Homo sapiens
ggctggcttctccctg

SEQ ID NO: 5920835 - DNA, 17 bp, Homo sapiens
ggctgggaacagtgtgc

SEQ ID NO: 5920836 - DNA, 22 bp, Homo sapiens
ggctgggaacatgacccagcct

SEQ ID NO: 5920837 - DNA, 19 bp, Homo sapiens
ggctgggaactcacctggg

SEQ ID NO: 5920838 - DNA, 22 bp, Homo sapiens
ggctgggaactgggccagcaga

SEQ ID NO: 5920839 - DNA, 19 bp, Homo sapiens
ggctgggacgtggctcagc

SEQ ID NO: 5920840 - DNA, 18 bp, Homo sapiens
ggctgggagaaggtgctt

SEQ ID NO: 5920841 - DNA, 13 bp, Homo sapiens
ggctgggagagcc

SEQ ID NO: 5920842 - DNA, 18 bp, Homo sapiens
ggctgggagagccttcca

SEQ ID NO: 5920843 - DNA, 23 bp, Homo sapiens
ggctgggagagccttccaggggt

SEQ ID NO: 5920844 - DNA, 22 bp, Homo sapiens
ggctgggagcctcgcccctcca

SEQ ID NO: 5920845 - DNA, 15 bp, Homo sapiens
ggctgggaggaaggg

SEQ ID NO: 5920846 - DNA, 15 bp, Homo sapiens
ggctgggaggagccc

SEQ ID NO: 5920847 - DNA, 15 bp, Homo sapiens
ggctgggaggaggaa

SEQ ID NO: 5920848 - DNA, 21 bp, Homo sapiens
ggctgggaggagggcaggcat

SEQ ID NO: 5920849 - DNA, 14 bp, Homo sapiens
ggctgggaggctcg

SEQ ID NO: 5920850 - DNA, 22 bp, Homo sapiens
ggctgggagttttgattgcata

SEQ ID NO: 5920851 - DNA, 19 bp, Homo sapiens
ggctgggatggtgactcct

SEQ ID NO: 5920852 - DNA, 20 bp, Homo sapiens
ggctgggatggtgactcctg

SEQ ID NO: 5920853 - DNA, 23 bp, Homo sapiens
ggctgggcaaggaaaaagaaaat

SEQ ID NO: 5920854 - DNA, 19 bp, Homo sapiens
ggctgggcaaggcgctcag

SEQ ID NO: 5920855 - DNA, 16 bp, Homo sapiens
ggctgggcaccgtgtc

SEQ ID NO: 5920856 - DNA, 13 bp, Homo sapiens
ggctgggcacctg

SEQ ID NO: 5920857 - DNA, 14 bp, Homo sapiens
ggctgggcagagct

SEQ ID NO: 5920858 - DNA, 21 bp, Homo sapiens
ggctgggcagcacaaggcctt

SEQ ID NO: 5920859 - DNA, 19 bp, Homo sapiens
ggctgggcagccccagaga

SEQ ID NO: 5920860 - DNA, 14 bp, Homo sapiens
ggctgggcagctgt

SEQ ID NO: 5920861 - DNA, 13 bp, Homo sapiens
ggctgggcagggc

SEQ ID NO: 5920862 - DNA, 17 bp, Homo sapiens
ggctgggcagggccgca

SEQ ID NO: 5920863 - DNA, 18 bp, Homo sapiens
ggctgggcagggccgcag

SEQ ID NO: 5920864 - DNA, 15 bp, Homo sapiens
ggctgggcatcccag

SEQ ID NO: 5920865 - DNA, 16 bp, Homo sapiens
ggctgggcatcccagc

SEQ ID NO: 5920866 - DNA, 19 bp, Homo sapiens
ggctgggcatcccagcttg

SEQ ID NO: 5920867 - DNA, 18 bp, Homo sapiens
ggctgggccagcctcagc

SEQ ID NO: 5920868 - DNA, 22 bp, Homo sapiens
ggctgggcccacagagatgcat

SEQ ID NO: 5920869 - DNA, 15 bp, Homo sapiens
ggctgggcccaccca

SEQ ID NO: 5920870 - DNA, 16 bp, Homo sapiens
ggctgggcccacccag

SEQ ID NO: 5920871 - DNA, 17 bp, Homo sapiens
ggctgggcccagaggca

SEQ ID NO: 5920872 - DNA, 14 bp, Homo sapiens
ggctgggcccctgg

SEQ ID NO: 5920873 - DNA, 21 bp, Homo sapiens
ggctgggcccctgggatggga

SEQ ID NO: 5920874 - DNA, 16 bp, Homo sapiens
ggctgggcccctgggg

SEQ ID NO: 5920875 - DNA, 20 bp, Homo sapiens
ggctgggcccctggggacag

SEQ ID NO: 5920876 - DNA, 21 bp, Homo sapiens
ggctgggccctctttccctgc

SEQ ID NO: 5920877 - DNA, 22 bp, Homo sapiens
ggctgggccctctttccctgcg

SEQ ID NO: 5920878 - DNA, 19 bp, Homo sapiens
ggctgggcccttcctggct

SEQ ID NO: 5920879 - DNA, 14 bp, Homo sapiens
ggctgggcctcctt

SEQ ID NO: 5920880 - DNA, 19 bp, Homo sapiens
ggctgggcctcgtgcgccc

SEQ ID NO: 5920881 - DNA, 15 bp, Homo sapiens
ggctgggcctgagcc

SEQ ID NO: 5920882 - DNA, 13 bp, Homo sapiens
ggctgggcctgcg

SEQ ID NO: 5920883 - DNA, 22 bp, Homo sapiens
ggctgggcgcctctgtcctggc

SEQ ID NO: 5920884 - DNA, 14 bp, Homo sapiens
ggctgggctcacag

SEQ ID NO: 5920885 - DNA, 20 bp, Homo sapiens
ggctgggctcacaggcctct

SEQ ID NO: 5920886 - DNA, 21 bp, Homo sapiens
ggctgggctcccttcccacct

SEQ ID NO: 5920887 - DNA, 19 bp, Homo sapiens
ggctgggctgagcccctgg

SEQ ID NO: 5920888 - DNA, 23 bp, Homo sapiens
ggctgggctgagcccctggtctt

SEQ ID NO: 5920889 - DNA, 14 bp, Homo sapiens
ggctgggctgggca

SEQ ID NO: 5920890 - DNA, 17 bp, Homo sapiens
ggctgggctgggctgag

SEQ ID NO: 5920891 - DNA, 11 bp, Homo sapiens
ggctgggcttc

SEQ ID NO: 5920892 - DNA, 12 bp, Homo sapiens
ggctgggcttca

SEQ ID NO: 5920893 - DNA, 17 bp, Homo sapiens
ggctgggctttggggct

SEQ ID NO: 5920894 - DNA, 19 bp, Homo sapiens
ggctggggacccacccagc

SEQ ID NO: 5920895 - DNA, 14 bp, Homo sapiens
ggctggggacccag

SEQ ID NO: 5920896 - DNA, 15 bp, Homo sapiens
ggctggggacccaga

SEQ ID NO: 5920897 - DNA, 14 bp, Homo sapiens
ggctggggactctg

SEQ ID NO: 5920898 - DNA, 15 bp, Homo sapiens
ggctggggactctgg

SEQ ID NO: 5920899 - DNA, 15 bp, Homo sapiens
ggctggggacttggc

SEQ ID NO: 5920900 - DNA, 11 bp, Homo sapiens
ggctggggagg

SEQ ID NO: 5920901 - DNA, 16 bp, Homo sapiens
ggctggggaggacctg

SEQ ID NO: 5920902 - DNA, 20 bp, Homo sapiens
ggctggggaggcctgcctgg

SEQ ID NO: 5920903 - DNA, 15 bp, Homo sapiens
ggctggggagggggt

SEQ ID NO: 5920904 - DNA, 16 bp, Homo sapiens
ggctggggcagagggg

SEQ ID NO: 5920905 - DNA, 20 bp, Homo sapiens
ggctggggcagcctctgggc

SEQ ID NO: 5920906 - DNA, 15 bp, Homo sapiens
ggctggggcaggctc

SEQ ID NO: 5920907 - DNA, 16 bp, Homo sapiens
ggctggggcaggctct

SEQ ID NO: 5920908 - DNA, 13 bp, Homo sapiens
ggctggggcaggg

SEQ ID NO: 5920909 - DNA, 15 bp, Homo sapiens
ggctggggcaggggc

SEQ ID NO: 5920910 - DNA, 17 bp, Homo sapiens
ggctggggcaggggcct

SEQ ID NO: 5920911 - DNA, 21 bp, Homo sapiens
ggctggggcaggggcctgggc

SEQ ID NO: 5920912 - DNA, 16 bp, Homo sapiens
ggctggggcatggcaa

SEQ ID NO: 5920913 - DNA, 14 bp, Homo sapiens
ggctggggccgctg

SEQ ID NO: 5920914 - DNA, 17 bp, Homo sapiens
ggctggggccggggctg

SEQ ID NO: 5920915 - DNA, 20 bp, Homo sapiens
ggctggggcctatcagtgtg

SEQ ID NO: 5920916 - DNA, 22 bp, Homo sapiens
ggctggggcctatcagtgtgcc

SEQ ID NO: 5920917 - DNA, 15 bp, Homo sapiens
ggctggggcctggcc

SEQ ID NO: 5920918 - DNA, 17 bp, Homo sapiens
ggctggggcctggccta

SEQ ID NO: 5920919 - DNA, 19 bp, Homo sapiens
ggctggggcctggcctatt

SEQ ID NO: 5920920 - DNA, 14 bp, Homo sapiens
ggctggggcggagc

SEQ ID NO: 5920921 - DNA, 15 bp, Homo sapiens
ggctggggcggggcc

SEQ ID NO: 5920922 - DNA, 17 bp, Homo sapiens
ggctggggcggggccca

SEQ ID NO: 5920923 - DNA, 19 bp, Homo sapiens
ggctggggcggggctggag

SEQ ID NO: 5920924 - DNA, 15 bp, Homo sapiens
ggctggggctgctcc

SEQ ID NO: 5920925 - DNA, 16 bp, Homo sapiens
ggctggggctgctccc

SEQ ID NO: 5920926 - DNA, 16 bp, Homo sapiens
ggctgggggactgctt

SEQ ID NO: 5920927 - DNA, 14 bp, Homo sapiens
ggctgggggactgg

SEQ ID NO: 5920928 - DNA, 15 bp, Homo sapiens
ggctgggggagagcc

SEQ ID NO: 5920929 - DNA, 23 bp, Homo sapiens
ggcttctcgctgcgcagcctcca

SEQ ID NO: 5920930 - DNA, 13 bp, Homo sapiens
ggcttctctccac

SEQ ID NO: 5920931 - DNA, 18 bp, Homo sapiens
ggcttctctccacagtgt

SEQ ID NO: 5920932 - DNA, 13 bp, Homo sapiens
ggcttctctcttt

SEQ ID NO: 5920933 - DNA, 15 bp, Homo sapiens
ggcttctctgaggaa

SEQ ID NO: 5920934 - DNA, 13 bp, Homo sapiens
ggcttctctgtct

SEQ ID NO: 5920935 - DNA, 17 bp, Homo sapiens
ggcttctcttgggtggg

SEQ ID NO: 5920936 - DNA, 18 bp, Homo sapiens
ggcttctcttgggtggga

SEQ ID NO: 5920937 - DNA, 14 bp, Homo sapiens
ggcttctgagcagc

SEQ ID NO: 5920938 - DNA, 22 bp, Homo sapiens
ggcttctgagcagcgagcctgc

SEQ ID NO: 5920939 - DNA, 11 bp, Homo sapiens
ggcttctgatg

SEQ ID NO: 5920940 - DNA, 19 bp, Homo sapiens
ggcttctgatgaatcttgc

SEQ ID NO: 5920941 - DNA, 23 bp, Homo sapiens
ggcttctgattatttgcagctgc

SEQ ID NO: 5920942 - DNA, 19 bp, Homo sapiens
ggcttctgcagctttggct

SEQ ID NO: 5920943 - DNA, 15 bp, Homo sapiens
ggcttctgcgccgcc

SEQ ID NO: 5920944 - DNA, 21 bp, Homo sapiens
ggcttctgcggtgaggcaggg

SEQ ID NO: 5920945 - DNA, 19 bp, Homo sapiens
ggcttctgcgtccaccagg

SEQ ID NO: 5920946 - DNA, 12 bp, Homo sapiens
ggcttctgcttc

SEQ ID NO: 5920947 - DNA, 18 bp, Homo sapiens
ggcttctggagcccttgg

SEQ ID NO: 5920948 - DNA, 17 bp, Homo sapiens
ggcttctggctcctcgg

SEQ ID NO: 5920949 - DNA, 17 bp, Homo sapiens
ggcttctgggacctgtg

SEQ ID NO: 5920950 - DNA, 19 bp, Homo sapiens
ggcttctgggcagactctg

SEQ ID NO: 5920951 - DNA, 21 bp, Homo sapiens
ggcttctgggtggctcctgcc

SEQ ID NO: 5920952 - DNA, 12 bp, Homo sapiens
ggcttctgtggg

SEQ ID NO: 5920953 - DNA, 19 bp, Homo sapiens
ggcttctgtggggcccctc

SEQ ID NO: 5920954 - DNA, 15 bp, Homo sapiens
ggcttctgtttctag

SEQ ID NO: 5920955 - DNA, 14 bp, Homo sapiens
ggcttcttaaaaac

SEQ ID NO: 5920956 - DNA, 18 bp, Homo sapiens
ggcttcttaaaaactgtg

SEQ ID NO: 5920957 - DNA, 21 bp, Homo sapiens
ggcttcttaaaaactgtgtat

SEQ ID NO: 5920958 - DNA, 16 bp, Homo sapiens
ggcttcttcctcctcc

SEQ ID NO: 5920959 - DNA, 15 bp, Homo sapiens
ggcttcttcctggat

SEQ ID NO: 5920960 - DNA, 14 bp, Homo sapiens
ggcttcttcttata

SEQ ID NO: 5920961 - DNA, 18 bp, Homo sapiens
ggcttcttggaccttggc

SEQ ID NO: 5920962 - DNA, 16 bp, Homo sapiens
ggcttctttctgctgg

SEQ ID NO: 5920963 - DNA, 13 bp, Homo sapiens
ggcttctttgctt

SEQ ID NO: 5920964 - DNA, 15 bp, Homo sapiens
ggcttgaagccaaag

SEQ ID NO: 5920965 - DNA, 20 bp, Homo sapiens
ggcttgaagccaaagaaaaa

SEQ ID NO: 5920966 - DNA, 15 bp, Homo sapiens
ggcttgaaggccagc

SEQ ID NO: 5920967 - DNA, 21 bp, Homo sapiens
ggcttgacacctgtcttgaat

SEQ ID NO: 5920968 - DNA, 14 bp, Homo sapiens
ggcttgacagcatg

SEQ ID NO: 5920969 - DNA, 17 bp, Homo sapiens
ggcttgactcaggattt

SEQ ID NO: 5920970 - DNA, 21 bp, Homo sapiens
ggcttgagggaatcatgggca

SEQ ID NO: 5920971 - DNA, 15 bp, Homo sapiens
ggcttgagtctggat

SEQ ID NO: 5920972 - DNA, 15 bp, Homo sapiens
ggcttgcactctctt

SEQ ID NO: 5920973 - DNA, 17 bp, Homo sapiens
ggcttgccccactctgc

SEQ ID NO: 5920974 - DNA, 23 bp, Homo sapiens
ggcttgccccactctgcctgcct

SEQ ID NO: 5920975 - DNA, 13 bp, Homo sapiens
ggcttgccccagg

SEQ ID NO: 5920976 - DNA, 19 bp, Homo sapiens
ggcttgcccctgtggccct

SEQ ID NO: 5920977 - DNA, 14 bp, Homo sapiens
ggcttgcctgcagg

SEQ ID NO: 5920978 - DNA, 22 bp, Homo sapiens
ggcttgcctggtgggggaaggg

SEQ ID NO: 5920979 - DNA, 14 bp, Homo sapiens
ggcttgctccaggg

SEQ ID NO: 5920980 - DNA, 16 bp, Homo sapiens
ggcttgctccagggtc

SEQ ID NO: 5920981 - DNA, 22 bp, Homo sapiens
ggcttgctcccgccccagggtc

SEQ ID NO: 5920982 - DNA, 20 bp, Homo sapiens
ggcttgctgatggctgctgg

SEQ ID NO: 5920983 - DNA, 20 bp, Homo sapiens
ggcttgctttcttctcctgt

SEQ ID NO: 5920984 - DNA, 17 bp, Homo sapiens
ggcttggacttcctggg

SEQ ID NO: 5920985 - DNA, 12 bp, Homo sapiens
ggcttggagagg

SEQ ID NO: 5920986 - DNA, 14 bp, Homo sapiens
ggcttggagaggta

SEQ ID NO: 5920987 - DNA, 13 bp, Homo sapiens
ggcttggagcaga

SEQ ID NO: 5920988 - DNA, 21 bp, Homo sapiens
ggcttggcattgaccttcatg

SEQ ID NO: 5920989 - DNA, 17 bp, Homo sapiens
ggcttggccaaaacagg

SEQ ID NO: 5920990 - DNA, 22 bp, Homo sapiens
ggcttggccaaaacaggctcag

SEQ ID NO: 5920991 - DNA, 18 bp, Homo sapiens
ggcttggccacagccagg

SEQ ID NO: 5920992 - DNA, 13 bp, Homo sapiens
ggcttggcccagc

SEQ ID NO: 5920993 - DNA, 15 bp, Homo sapiens
ggcttggccctggca

SEQ ID NO: 5920994 - DNA, 16 bp, Homo sapiens
ggcttggccctggcag

SEQ ID NO: 5920995 - DNA, 16 bp, Homo sapiens
ggcttggcctatctcc

SEQ ID NO: 5920996 - DNA, 13 bp, Homo sapiens
ggcttggcctgct

SEQ ID NO: 5920997 - DNA, 14 bp, Homo sapiens
ggcttggcctggag

SEQ ID NO: 5920998 - DNA, 15 bp, Homo sapiens
ggcttggcctggaga

SEQ ID NO: 5920999 - DNA, 23 bp, Homo sapiens
ggcttggctcggcgcccccaccc

SEQ ID NO: 5921000 - DNA, 20 bp, Homo sapiens
ggcttggctcttggcttcca

SEQ ID NO: 5921001 - DNA, 21 bp, Homo sapiens
ggcttggctcttggcttccag

SEQ ID NO: 5921002 - DNA, 22 bp, Homo sapiens
ggcttggctcttggcttccaga

SEQ ID NO: 5921003 - DNA, 17 bp, Homo sapiens
ggcttgggatttgctgt

SEQ ID NO: 5921004 - DNA, 16 bp, Homo sapiens
ggcttgggcccagtag

SEQ ID NO: 5921005 - DNA, 18 bp, Homo sapiens
ggcttgggcctaggctgc

SEQ ID NO: 5921006 - DNA, 12 bp, Homo sapiens
ggcttgggcctg

SEQ ID NO: 5921007 - DNA, 23 bp, Homo sapiens
ggcttgggcttccatttgtgtgt

SEQ ID NO: 5921008 - DNA, 17 bp, Homo sapiens
ggcttggggaccagagc

SEQ ID NO: 5921009 - DNA, 14 bp, Homo sapiens
ggcttggggagcag

SEQ ID NO: 5921010 - DNA, 21 bp, Homo sapiens
ggcttggggattgtacacggg

SEQ ID NO: 5921011 - DNA, 15 bp, Homo sapiens
ggcttggggcttcct

SEQ ID NO: 5921012 - DNA, 15 bp, Homo sapiens
ggcttggggtagaga

SEQ ID NO: 5921013 - DNA, 17 bp, Homo sapiens
ggcttggggtagagagg

SEQ ID NO: 5921014 - DNA, 18 bp, Homo sapiens
ggcttggggtagagagga

SEQ ID NO: 5921015 - DNA, 19 bp, Homo sapiens
ggcttggtggccaagcctg

SEQ ID NO: 5921016 - DNA, 21 bp, Homo sapiens
ggcttggtggctcacgcctgt

SEQ ID NO: 5921017 - DNA, 15 bp, Homo sapiens
ggcttgtaactccac

SEQ ID NO: 5921018 - DNA, 15 bp, Homo sapiens
ggcttgtacattttt

SEQ ID NO: 5921019 - DNA, 16 bp, Homo sapiens
ggcttgtagttcttta

SEQ ID NO: 5921020 - DNA, 16 bp, Homo sapiens
ggcttgtcactagcag

SEQ ID NO: 5921021 - DNA, 21 bp, Homo sapiens
ggcttgtcactagcagctgca

SEQ ID NO: 5921022 - DNA, 15 bp, Homo sapiens
ggcttgtcagagctg

SEQ ID NO: 5921023 - DNA, 16 bp, Homo sapiens
ggcttgtcatagccag

SEQ ID NO: 5921024 - DNA, 22 bp, Homo sapiens
ggcttgtcttcgctggctccta

SEQ ID NO: 5921025 - DNA, 15 bp, Homo sapiens
ggcttgtgctcggga

SEQ ID NO: 5921026 - DNA, 18 bp, Homo sapiens
ggcttgtggactctctgc

SEQ ID NO: 5921027 - DNA, 20 bp, Homo sapiens
ggcttgtgggcactgtgcca

SEQ ID NO: 5921028 - DNA, 13 bp, Homo sapiens
ggcttgtgggctg

SEQ ID NO: 5921029 - DNA, 16 bp, Homo sapiens
ggcttgtggggcctgg

SEQ ID NO: 5921030 - DNA, 19 bp, Homo sapiens
ggcttgttcatcatccaga

SEQ ID NO: 5921031 - DNA, 23 bp, Homo sapiens
ggcttgttgacttcgcagccccg

SEQ ID NO: 5921032 - DNA, 12 bp, Homo sapiens
ggcttgtttatt

SEQ ID NO: 5921033 - DNA, 15 bp, Homo sapiens
ggcttgtttattttg

SEQ ID NO: 5921034 - DNA, 14 bp, Homo sapiens
ggctttaacaaaac

SEQ ID NO: 5921035 - DNA, 17 bp, Homo sapiens
ggctttaagctccagct

SEQ ID NO: 5921036 - DNA, 13 bp, Homo sapiens
ggctttaattgta

SEQ ID NO: 5921037 - DNA, 16 bp, Homo sapiens
ggctttaattgtataa

SEQ ID NO: 5921038 - DNA, 14 bp, Homo sapiens
ggctttatcctctt

SEQ ID NO: 5921039 - DNA, 15 bp, Homo sapiens
ggctttatcctcttt

SEQ ID NO: 5921040 - DNA, 22 bp, Homo sapiens
ggctttatgataatagattctc

SEQ ID NO: 5921041 - DNA, 17 bp, Homo sapiens
ggctttatgcaaataca

SEQ ID NO: 5921042 - DNA, 18 bp, Homo sapiens
ggctttatgcaaatacaa

SEQ ID NO: 5921043 - DNA, 23 bp, Homo sapiens
ggctttcaaagctaaaatatata

SEQ ID NO: 5921044 - DNA, 22 bp, Homo sapiens
ggctttcaaggctggggcatgg

SEQ ID NO: 5921045 - DNA, 18 bp, Homo sapiens
ggctttcacatttaaatg

SEQ ID NO: 5921046 - DNA, 15 bp, Homo sapiens
ggctttcagcgcccc

SEQ ID NO: 5921047 - DNA, 18 bp, Homo sapiens
ggctttcagcgcccccag

SEQ ID NO: 5921048 - DNA, 16 bp, Homo sapiens
ggctttcatgaggagg

SEQ ID NO: 5921049 - DNA, 18 bp, Homo sapiens
ggctttcatgtaattatc

SEQ ID NO: 5921050 - DNA, 20 bp, Homo sapiens
ggctttcatgtaattatcta

SEQ ID NO: 5921051 - DNA, 22 bp, Homo sapiens
ggctttcattattagtactgct

SEQ ID NO: 5921052 - DNA, 22 bp, Homo sapiens
ggctttcatttcttattaacca

SEQ ID NO: 5921053 - DNA, 21 bp, Homo sapiens
ggctttccagaaggccacagg

SEQ ID NO: 5921054 - DNA, 17 bp, Homo sapiens
ggctttcccaacagctc

SEQ ID NO: 5921055 - DNA, 23 bp, Homo sapiens
ggctttcccacttcccaccctgc

SEQ ID NO: 5921056 - DNA, 13 bp, Homo sapiens
ggctttcccagga

SEQ ID NO: 5921057 - DNA, 17 bp, Homo sapiens
ggctttcccaggagaaa

SEQ ID NO: 5921058 - DNA, 12 bp, Homo sapiens
ggctttcctccg

SEQ ID NO: 5921059 - DNA, 17 bp, Homo sapiens
ggctttccttgttttga

SEQ ID NO: 5921060 - DNA, 16 bp, Homo sapiens
ggctttcggggagggc

SEQ ID NO: 5921061 - DNA, 20 bp, Homo sapiens
ggctttcgtccacagcttcc

SEQ ID NO: 5921062 - DNA, 12 bp, Homo sapiens
ggctttctattg

SEQ ID NO: 5921063 - DNA, 14 bp, Homo sapiens
ggctttctccctca

SEQ ID NO: 5921064 - DNA, 22 bp, Homo sapiens
ggctttctccggggtctgtgct

SEQ ID NO: 5921065 - DNA, 24 bp, Homo sapiens
ggctttctccggggtctgtgctgt

SEQ ID NO: 5921066 - DNA, 14 bp, Homo sapiens
ggctttctcctgga

SEQ ID NO: 5921067 - DNA, 15 bp, Homo sapiens
ggctttctcctggag

SEQ ID NO: 5921068 - DNA, 20 bp, Homo sapiens
ggctttctctctggcttctc

SEQ ID NO: 5921069 - DNA, 22 bp, Homo sapiens
ggctttctctctggcttctctc

SEQ ID NO: 5921070 - DNA, 12 bp, Homo sapiens
ggctttctcttc

SEQ ID NO: 5921071 - DNA, 14 bp, Homo sapiens
ggctttctgggctc

SEQ ID NO: 5921072 - DNA, 20 bp, Homo sapiens
ggctttctgggctctggact

SEQ ID NO: 5921073 - DNA, 21 bp, Homo sapiens
ggctttctgggctctggactc

SEQ ID NO: 5921074 - DNA, 19 bp, Homo sapiens
ggctttctgggtgtgactg

SEQ ID NO: 5921075 - DNA, 15 bp, Homo sapiens
ggctttctgttgcca

SEQ ID NO: 5921076 - DNA, 16 bp, Homo sapiens
ggctttcttttctcta

SEQ ID NO: 5921077 - DNA, 22 bp, Homo sapiens
ggctttgaaacctcagggctgt

SEQ ID NO: 5921078 - DNA, 18 bp, Homo sapiens
ggctttgattccatctcc

SEQ ID NO: 5921079 - DNA, 21 bp, Homo sapiens
ggctttgcaaccattttcatt

SEQ ID NO: 5921080 - DNA, 19 bp, Homo sapiens
ggctttgcacttgacctca

SEQ ID NO: 5921081 - DNA, 15 bp, Homo sapiens
ggctttgcagctgct

SEQ ID NO: 5921082 - DNA, 19 bp, Homo sapiens
ggctttgcaggctctgggc

SEQ ID NO: 5921083 - DNA, 20 bp, Homo sapiens
ggctttgcaggctctgggct

SEQ ID NO: 5921084 - DNA, 13 bp, Homo sapiens
ggctttgcatttc

SEQ ID NO: 5921085 - DNA, 18 bp, Homo sapiens
ggctttgccattaaaatg

SEQ ID NO: 5921086 - DNA, 20 bp, Homo sapiens
ggctttgcccaacctcagca

SEQ ID NO: 5921087 - DNA, 21 bp, Homo sapiens
ggctttgcccacccctcactc

SEQ ID NO: 5921088 - DNA, 15 bp, Homo sapiens
ggctttgccttgcag

SEQ ID NO: 5921089 - DNA, 21 bp, Homo sapiens
ggctttggaaagacctgtgag

SEQ ID NO: 5921090 - DNA, 19 bp, Homo sapiens
ggctttggaatgctccagg

SEQ ID NO: 5921091 - DNA, 17 bp, Homo sapiens
ggctttggcaacagaaa

SEQ ID NO: 5921092 - DNA, 13 bp, Homo sapiens
ggctttggcactc

SEQ ID NO: 5921093 - DNA, 18 bp, Homo sapiens
ggctttggcactctctgc

SEQ ID NO: 5921094 - DNA, 20 bp, Homo sapiens
ggctttggcagaccatctcc

SEQ ID NO: 5921095 - DNA, 18 bp, Homo sapiens
ggctttggctcgggactt

SEQ ID NO: 5921096 - DNA, 18 bp, Homo sapiens
ggctttgggaaagcccag

SEQ ID NO: 5921097 - DNA, 16 bp, Homo sapiens
ggctttgggagtaaga

SEQ ID NO: 5921098 - DNA, 19 bp, Homo sapiens
ggctttgggatgggaggcc

SEQ ID NO: 5921099 - DNA, 21 bp, Homo sapiens
ggctttgggcccaagaactgc

SEQ ID NO: 5921100 - DNA, 22 bp, Homo sapiens
ggctttgggcccaagaactgca

SEQ ID NO: 5921101 - DNA, 15 bp, Homo sapiens
ggctttggggtccta

SEQ ID NO: 5921102 - DNA, 16 bp, Homo sapiens
ggctttgtcccacagc

SEQ ID NO: 5921103 - DNA, 13 bp, Homo sapiens
ggctttgtcctgg

SEQ ID NO: 5921104 - DNA, 15 bp, Homo sapiens
ggctttgtgcttggg

SEQ ID NO: 5921105 - DNA, 19 bp, Homo sapiens
ggctttgtggaaacagctg

SEQ ID NO: 5921106 - DNA, 11 bp, Homo sapiens
ggctttgtgtt

SEQ ID NO: 5921107 - DNA, 17 bp, Homo sapiens
gggacacatgcccctcc

SEQ ID NO: 5921108 - DNA, 14 bp, Homo sapiens
gggacaccagagct

SEQ ID NO: 5921109 - DNA, 20 bp, Homo sapiens
gggacaccagccaggctctg

SEQ ID NO: 5921110 - DNA, 22 bp, Homo sapiens
gggacaccagccaggctctgtg

SEQ ID NO: 5921111 - DNA, 23 bp, Homo sapiens
gggacaccccagaatcccctggg

SEQ ID NO: 5921112 - DNA, 19 bp, Homo sapiens
gggacacccctacacacac

SEQ ID NO: 5921113 - DNA, 14 bp, Homo sapiens
gggacacctgccca

SEQ ID NO: 5921114 - DNA, 16 bp, Homo sapiens
gggacacctgccctgc

SEQ ID NO: 5921115 - DNA, 16 bp, Homo sapiens
gggacacggcctctgg

SEQ ID NO: 5921116 - DNA, 16 bp, Homo sapiens
gggacactgggcagca

SEQ ID NO: 5921117 - DNA, 20 bp, Homo sapiens
gggacactgggcagcaaggc

SEQ ID NO: 5921118 - DNA, 18 bp, Homo sapiens
gggacactgtggcagcag

SEQ ID NO: 5921119 - DNA, 20 bp, Homo sapiens
gggacagaaaagaaagctgc

SEQ ID NO: 5921120 - DNA, 21 bp, Homo sapiens
gggacagacaaggtgcctgtt

SEQ ID NO: 5921121 - DNA, 18 bp, Homo sapiens
gggacagaccagcccttc

SEQ ID NO: 5921122 - DNA, 21 bp, Homo sapiens
gggacagacgcttgcgccgag

SEQ ID NO: 5921123 - DNA, 14 bp, Homo sapiens
gggacagagccacc

SEQ ID NO: 5921124 - DNA, 18 bp, Homo sapiens
gggacagagccaccccat

SEQ ID NO: 5921125 - DNA, 12 bp, Homo sapiens
gggacagagccc

SEQ ID NO: 5921126 - DNA, 14 bp, Homo sapiens
gggacagagcccgg

SEQ ID NO: 5921127 - DNA, 18 bp, Homo sapiens
gggacagagcccgggaga

SEQ ID NO: 5921128 - DNA, 17 bp, Homo sapiens
gggacagaggccccagc

SEQ ID NO: 5921129 - DNA, 18 bp, Homo sapiens
gggacagaggccccagcc

SEQ ID NO: 5921130 - DNA, 17 bp, Homo sapiens
gggacagaggcctgccc

SEQ ID NO: 5921131 - DNA, 23 bp, Homo sapiens
gggacagagttcagggaggggct

SEQ ID NO: 5921132 - DNA, 17 bp, Homo sapiens
gggacagatcatagatt

SEQ ID NO: 5921133 - DNA, 14 bp, Homo sapiens
gggacagattcagt

SEQ ID NO: 5921134 - DNA, 17 bp, Homo sapiens
gggacagattcgcagca

SEQ ID NO: 5921135 - DNA, 20 bp, Homo sapiens
gggacagcaagtgagcagag

SEQ ID NO: 5921136 - DNA, 14 bp, Homo sapiens
gggacagcagcctc

SEQ ID NO: 5921137 - DNA, 15 bp, Homo sapiens
gggacagcagcctcc

SEQ ID NO: 5921138 - DNA, 16 bp, Homo sapiens
gggacagcagcctccc

SEQ ID NO: 5921139 - DNA, 17 bp, Homo sapiens
gggacagccagagctgg

SEQ ID NO: 5921140 - DNA, 12 bp, Homo sapiens
gggacagcccac

SEQ ID NO: 5921141 - DNA, 21 bp, Homo sapiens
gggacagcccagagcctggct

SEQ ID NO: 5921142 - DNA, 16 bp, Homo sapiens
gggacagccccagggc

SEQ ID NO: 5921143 - DNA, 12 bp, Homo sapiens
gggacagcctct

SEQ ID NO: 5921144 - DNA, 13 bp, Homo sapiens
gggacagccttca

SEQ ID NO: 5921145 - DNA, 16 bp, Homo sapiens
gggacagcggccccgc

SEQ ID NO: 5921146 - DNA, 21 bp, Homo sapiens
gggacagcggccccgcggagc

SEQ ID NO: 5921147 - DNA, 18 bp, Homo sapiens
gggacagcggcccggccc

SEQ ID NO: 5921148 - DNA, 22 bp, Homo sapiens
gggacagcggcccggcccacgc

SEQ ID NO: 5921149 - DNA, 22 bp, Homo sapiens
gggacagctaggctgagatgca

SEQ ID NO: 5921150 - DNA, 13 bp, Homo sapiens
gggacagctcctt

SEQ ID NO: 5921151 - DNA, 15 bp, Homo sapiens
gggacagctgctggg

SEQ ID NO: 5921152 - DNA, 20 bp, Homo sapiens
gggacagctgctgggaccca

SEQ ID NO: 5921153 - DNA, 13 bp, Homo sapiens
gggacagctggct

SEQ ID NO: 5921154 - DNA, 14 bp, Homo sapiens
gggacagctgtgcc

SEQ ID NO: 5921155 - DNA, 13 bp, Homo sapiens
gggacagcttcct

SEQ ID NO: 5921156 - DNA, 14 bp, Homo sapiens
gggacagcttcctc

SEQ ID NO: 5921157 - DNA, 15 bp, Homo sapiens
gggacaggaccccag

SEQ ID NO: 5921158 - DNA, 19 bp, Homo sapiens
gggacaggaccccagctct

SEQ ID NO: 5921159 - DNA, 17 bp, Homo sapiens
gggacaggattgtctgc

SEQ ID NO: 5921160 - DNA, 21 bp, Homo sapiens
gggacaggatttggccacact

SEQ ID NO: 5921161 - DNA, 18 bp, Homo sapiens
gggacaggctgaagagag

SEQ ID NO: 5921162 - DNA, 23 bp, Homo sapiens
gggacaggctggaatgagggagg

SEQ ID NO: 5921163 - DNA, 15 bp, Homo sapiens
gggacagggaggcca

SEQ ID NO: 5921164 - DNA, 14 bp, Homo sapiens
gggacagggctcgc

SEQ ID NO: 5921165 - DNA, 12 bp, Homo sapiens
gggacagggctg

SEQ ID NO: 5921166 - DNA, 13 bp, Homo sapiens
gggacagggcttc

SEQ ID NO: 5921167 - DNA, 18 bp, Homo sapiens
gggacagggcttggggag

SEQ ID NO: 5921168 - DNA, 22 bp, Homo sapiens
gggacagggcttggggagcagg

SEQ ID NO: 5921169 - DNA, 17 bp, Homo sapiens
gggacaggtgacagtgg

SEQ ID NO: 5921170 - DNA, 23 bp, Homo sapiens
gggacaggtgacagtggctgctc

SEQ ID NO: 5921171 - DNA, 16 bp, Homo sapiens
gggacaggtgggcctg

SEQ ID NO: 5921172 - DNA, 15 bp, Homo sapiens
gggacagtattctca

SEQ ID NO: 5921173 - DNA, 20 bp, Homo sapiens
gggacagtcacctcatggaa

SEQ ID NO: 5921174 - DNA, 22 bp, Homo sapiens
gggacagtcacctcatggaatt

SEQ ID NO: 5921175 - DNA, 19 bp, Homo sapiens
gggacagtgataggcccaa

SEQ ID NO: 5921176 - DNA, 16 bp, Homo sapiens
gggacagttggcagag

SEQ ID NO: 5921177 - DNA, 11 bp, Homo sapiens
gggacagtttg

SEQ ID NO: 5921178 - DNA, 14 bp, Homo sapiens
gggacatatcagtg

SEQ ID NO: 5921179 - DNA, 22 bp, Homo sapiens
gggacatcctgtcatctgagaa

SEQ ID NO: 5921180 - DNA, 15 bp, Homo sapiens
gggacatctctttga

SEQ ID NO: 5921181 - DNA, 14 bp, Homo sapiens
gggacatgctaaat

SEQ ID NO: 5921182 - DNA, 17 bp, Homo sapiens
gggacatgctcacctct

SEQ ID NO: 5921183 - DNA, 18 bp, Homo sapiens
gggacatgctcacctcta

SEQ ID NO: 5921184 - DNA, 14 bp, Homo sapiens
gggacatggcacag

SEQ ID NO: 5921185 - DNA, 18 bp, Homo sapiens
gggacatggggcaagcca

SEQ ID NO: 5921186 - DNA, 19 bp, Homo sapiens
gggacatggggcaagccag

SEQ ID NO: 5921187 - DNA, 21 bp, Homo sapiens
gggacatggtgtgccacaggc

SEQ ID NO: 5921188 - DNA, 17 bp, Homo sapiens
gggacattgctctctgg

SEQ ID NO: 5921189 - DNA, 15 bp, Homo sapiens
gggacattgggaagg

SEQ ID NO: 5921190 - DNA, 14 bp, Homo sapiens
gggacatttccaag

SEQ ID NO: 5921191 - DNA, 17 bp, Homo sapiens
gggacatttccaagctg

SEQ ID NO: 5921192 - DNA, 17 bp, Homo sapiens
gggacatttcttcccca

SEQ ID NO: 5921193 - DNA, 20 bp, Homo sapiens
gggacatttgctcatggaat

SEQ ID NO: 5921194 - DNA, 16 bp, Homo sapiens
gggaccaaagggggag

SEQ ID NO: 5921195 - DNA, 16 bp, Homo sapiens
gggaccaaaggtcagg

SEQ ID NO: 5921196 - DNA, 17 bp, Homo sapiens
gggaccaaaggtcaggg

SEQ ID NO: 5921197 - DNA, 21 bp, Homo sapiens
gggaccaagatgtcaagctgg

SEQ ID NO: 5921198 - DNA, 20 bp, Homo sapiens
gggaccaagcgaccaaggat

SEQ ID NO: 5921199 - DNA, 12 bp, Homo sapiens
gggaccaaggca

SEQ ID NO: 5921200 - DNA, 18 bp, Homo sapiens
gggaccaattctggacag

SEQ ID NO: 5921201 - DNA, 17 bp, Homo sapiens
gggaccacagaggctgt

SEQ ID NO: 5921202 - DNA, 22 bp, Homo sapiens
gggaccacagcaaggcacctgc

SEQ ID NO: 5921203 - DNA, 16 bp, Homo sapiens
gggaccacagctgctg

SEQ ID NO: 5921204 - DNA, 21 bp, Homo sapiens
gggaccacaggtgcccgccac

SEQ ID NO: 5921205 - DNA, 18 bp, Homo sapiens
gggaccacatctgtcctc

SEQ ID NO: 5921206 - DNA, 19 bp, Homo sapiens
gggaccacatctgtcctca

SEQ ID NO: 5921207 - DNA, 19 bp, Homo sapiens
gggaccaccctgagccggc

SEQ ID NO: 5921208 - DNA, 23 bp, Homo sapiens
gggaccactaaatctccaagacc

SEQ ID NO: 5921209 - DNA, 14 bp, Homo sapiens
gggaccactccagg

SEQ ID NO: 5921210 - DNA, 18 bp, Homo sapiens
gggaccactgggcccctc

SEQ ID NO: 5921211 - DNA, 21 bp, Homo sapiens
gggaccactgggtacaagaga

SEQ ID NO: 5921212 - DNA, 22 bp, Homo sapiens
gggaccagaaacctgggagaga

SEQ ID NO: 5921213 - DNA, 23 bp, Homo sapiens
gggaccagaaacctgggagagac

SEQ ID NO: 5921214 - DNA, 15 bp, Homo sapiens
gggaccagagccaga

SEQ ID NO: 5921215 - DNA, 17 bp, Homo sapiens
gggaccagagccagatg

SEQ ID NO: 5921216 - DNA, 22 bp, Homo sapiens
gggaccagagccagatgcagga

SEQ ID NO: 5921217 - DNA, 13 bp, Homo sapiens
gggaccaggagct

SEQ ID NO: 5921218 - DNA, 12 bp, Homo sapiens
gggaccaggagt

SEQ ID NO: 5921219 - DNA, 18 bp, Homo sapiens
gggaccaggagtgggtgg

SEQ ID NO: 5921220 - DNA, 21 bp, Homo sapiens
gggaccaggatactggacgct

SEQ ID NO: 5921221 - DNA, 13 bp, Homo sapiens
gggaccagggcat

SEQ ID NO: 5921222 - DNA, 20 bp, Homo sapiens
gggaccagggccaccgcagg

SEQ ID NO: 5921223 - DNA, 18 bp, Homo sapiens
gggaccatctgctgcagt

SEQ ID NO: 5921224 - DNA, 17 bp, Homo sapiens
gggaccatgtgtcactt

SEQ ID NO: 5921225 - DNA, 16 bp, Homo sapiens
gggaccattgacctca

SEQ ID NO: 5921226 - DNA, 20 bp, Homo sapiens
gggaccattgacctcagctg

SEQ ID NO: 5921227 - DNA, 17 bp, Homo sapiens
gggacccacctccccct

SEQ ID NO: 5921228 - DNA, 13 bp, Homo sapiens
gggacccacctgc

SEQ ID NO: 5921229 - DNA, 14 bp, Homo sapiens
gggacccacctgct

SEQ ID NO: 5921230 - DNA, 18 bp, Homo sapiens
gggacccactccgactcc

SEQ ID NO: 5921231 - DNA, 20 bp, Homo sapiens
gggacccagagtcccaggcc

SEQ ID NO: 5921232 - DNA, 22 bp, Homo sapiens
gggacccagagtcccaggcccc

SEQ ID NO: 5921233 - DNA, 21 bp, Homo sapiens
gggacccagctactctgtcca

SEQ ID NO: 5921234 - DNA, 17 bp, Homo sapiens
gggacccagctcctctg

SEQ ID NO: 5921235 - DNA, 16 bp, Homo sapiens
gggacccaggctccca

SEQ ID NO: 5921236 - DNA, 18 bp, Homo sapiens
gggacccaggctcccagc

SEQ ID NO: 5921237 - DNA, 18 bp, Homo sapiens
gggacccaggtgtgcctg

SEQ ID NO: 5921238 - DNA, 17 bp, Homo sapiens
gggacccagtggcaggg

SEQ ID NO: 5921239 - DNA, 20 bp, Homo sapiens
gggacccagtggcagggcac

SEQ ID NO: 5921240 - DNA, 20 bp, Homo sapiens
gggacccatagatcttctga

SEQ ID NO: 5921241 - DNA, 23 bp, Homo sapiens
gggaccccacccctcatcaggag

SEQ ID NO: 5921242 - DNA, 21 bp, Homo sapiens
gggaccccactccctgctcta

SEQ ID NO: 5921243 - DNA, 12 bp, Homo sapiens
gggaccccagat

SEQ ID NO: 5921244 - DNA, 12 bp, Homo sapiens
gggaccccagct

SEQ ID NO: 5921245 - DNA, 11 bp, Homo sapiens
gggacccccag

SEQ ID NO: 5921246 - DNA, 14 bp, Homo sapiens
gggacccccgcccc

SEQ ID NO: 5921247 - DNA, 18 bp, Homo sapiens
gggacccccgccccctgc

SEQ ID NO: 5921248 - DNA, 24 bp, Homo sapiens
gggacccccgccccctgccctccc

SEQ ID NO: 5921249 - DNA, 16 bp, Homo sapiens
gggaccccctcgccag

SEQ ID NO: 5921250 - DNA, 22 bp, Homo sapiens
gggaccccctcgccagcttggc

SEQ ID NO: 5921251 - DNA, 22 bp, Homo sapiens
gggaccccgagaaccctgagca

SEQ ID NO: 5921252 - DNA, 14 bp, Homo sapiens
gggacccctgagct

SEQ ID NO: 5921253 - DNA, 20 bp, Homo sapiens
gggacccctgctcccagcct

SEQ ID NO: 5921254 - DNA, 20 bp, Homo sapiens
gggacccctggtggttcact

SEQ ID NO: 5921255 - DNA, 14 bp, Homo sapiens
gggaccccttccca

SEQ ID NO: 5921256 - DNA, 16 bp, Homo sapiens
gggacccgaagcccag

SEQ ID NO: 5921257 - DNA, 15 bp, Homo sapiens
gggacccgctggggg

SEQ ID NO: 5921258 - DNA, 19 bp, Homo sapiens
gggacccgctgggggctgg

SEQ ID NO: 5921259 - DNA, 19 bp, Homo sapiens
gggacccggggtctcctgg

SEQ ID NO: 5921260 - DNA, 17 bp, Homo sapiens
gggaccctcagcagctc

SEQ ID NO: 5921261 - DNA, 21 bp, Homo sapiens
gggaccctcggggcaggaagt

SEQ ID NO: 5921262 - DNA, 18 bp, Homo sapiens
gggaccctgcccagagct

SEQ ID NO: 5921263 - DNA, 21 bp, Homo sapiens
gggaccctgcccagagctgag

SEQ ID NO: 5921264 - DNA, 23 bp, Homo sapiens
gggaccctgtgacatggtgcctg

SEQ ID NO: 5921265 - DNA, 22 bp, Homo sapiens
gggacccttgttggggagtggg

SEQ ID NO: 5921266 - DNA, 17 bp, Homo sapiens
gggaccgagcccagcag

SEQ ID NO: 5921267 - DNA, 14 bp, Homo sapiens
gggaccgcctggcc

SEQ ID NO: 5921268 - DNA, 17 bp, Homo sapiens
gggaccgcctggccctc

SEQ ID NO: 5921269 - DNA, 22 bp, Homo sapiens
gggaccgctacaccactctggc

SEQ ID NO: 5921270 - DNA, 13 bp, Homo sapiens
gggaccggcagag

SEQ ID NO: 5921271 - DNA, 19 bp, Homo sapiens
gggaccgggcgcagccctc

SEQ ID NO: 5921272 - DNA, 13 bp, Homo sapiens
gggaccggtgctg

SEQ ID NO: 5921273 - DNA, 18 bp, Homo sapiens
gggaccggtgctgcagga

SEQ ID NO: 5921274 - DNA, 19 bp, Homo sapiens
gggaccggtgctgcaggag

SEQ ID NO: 5921275 - DNA, 18 bp, Homo sapiens
gggaccgtgccccacctc

SEQ ID NO: 5921276 - DNA, 23 bp, Homo sapiens
gggaccgtgccccacctccccac

SEQ ID NO: 5921277 - DNA, 17 bp, Homo sapiens
gggacctactgaaccca

SEQ ID NO: 5921278 - DNA, 19 bp, Homo sapiens
gggacctagggaggcatgg

SEQ ID NO: 5921279 - DNA, 19 bp, Homo sapiens
gggacctataactgcccag

SEQ ID NO: 5921280 - DNA, 17 bp, Homo sapiens
gggacctcagcctgcac

SEQ ID NO: 5921281 - DNA, 13 bp, Homo sapiens
gggacctcagggg

SEQ ID NO: 5921282 - DNA, 15 bp, Homo sapiens
gggacctcaggggca

SEQ ID NO: 5921283 - DNA, 18 bp, Homo sapiens
gggacctcaggggcacct

SEQ ID NO: 5921284 - DNA, 14 bp, Homo sapiens
gggaggcaccagct

SEQ ID NO: 5921285 - DNA, 15 bp, Homo sapiens
gggaggcaccagctc

SEQ ID NO: 5921286 - DNA, 16 bp, Homo sapiens
gggaggcaccagctct

SEQ ID NO: 5921287 - DNA, 19 bp, Homo sapiens
gggaggcacttcctcccct

SEQ ID NO: 5921288 - DNA, 14 bp, Homo sapiens
gggaggcagagagg

SEQ ID NO: 5921289 - DNA, 14 bp, Homo sapiens
gggaggcagcagag

SEQ ID NO: 5921290 - DNA, 12 bp, Homo sapiens
gggaggcagccg

SEQ ID NO: 5921291 - DNA, 14 bp, Homo sapiens
gggaggcagctcca

SEQ ID NO: 5921292 - DNA, 14 bp, Homo sapiens
gggaggcagggctg

SEQ ID NO: 5921293 - DNA, 21 bp, Homo sapiens
gggaggcaggggtcctgcagg

SEQ ID NO: 5921294 - DNA, 22 bp, Homo sapiens
gggaggcaggtcgggctgccag

SEQ ID NO: 5921295 - DNA, 18 bp, Homo sapiens
gggaggcatctgcatggg

SEQ ID NO: 5921296 - DNA, 19 bp, Homo sapiens
gggaggcatctgcatgggt

SEQ ID NO: 5921297 - DNA, 19 bp, Homo sapiens
gggaggccaagagtggccc

SEQ ID NO: 5921298 - DNA, 23 bp, Homo sapiens
gggaggccaagagtggccccacc

SEQ ID NO: 5921299 - DNA, 14 bp, Homo sapiens
gggaggccaaggca

SEQ ID NO: 5921300 - DNA, 19 bp, Homo sapiens
gggaggccaaggcaggtag

SEQ ID NO: 5921301 - DNA, 16 bp, Homo sapiens
gggaggccaaggcggg

SEQ ID NO: 5921302 - DNA, 19 bp, Homo sapiens
gggaggccaaggtgggagg

SEQ ID NO: 5921303 - DNA, 13 bp, Homo sapiens
gggaggccacgtc

SEQ ID NO: 5921304 - DNA, 12 bp, Homo sapiens
gggaggccaggc

SEQ ID NO: 5921305 - DNA, 19 bp, Homo sapiens
gggaggccaggcgagcctg

SEQ ID NO: 5921306 - DNA, 22 bp, Homo sapiens
gggaggccatttgctgccctgg

SEQ ID NO: 5921307 - DNA, 18 bp, Homo sapiens
gggaggccccactgggga

SEQ ID NO: 5921308 - DNA, 12 bp, Homo sapiens
gggaggccctgc

SEQ ID NO: 5921309 - DNA, 20 bp, Homo sapiens
gggaggccgaggcaggggct

SEQ ID NO: 5921310 - DNA, 15 bp, Homo sapiens
gggaggccgaggcgg

SEQ ID NO: 5921311 - DNA, 18 bp, Homo sapiens
gggaggccgaggtgggca

SEQ ID NO: 5921312 - DNA, 21 bp, Homo sapiens
gggaggccggcgcagcgcaga

SEQ ID NO: 5921313 - DNA, 13 bp, Homo sapiens
gggaggcctcagt

SEQ ID NO: 5921314 - DNA, 11 bp, Homo sapiens
gggaggcctga

SEQ ID NO: 5921315 - DNA, 12 bp, Homo sapiens
gggaggcctgag

SEQ ID NO: 5921316 - DNA, 13 bp, Homo sapiens
gggaggcctgagg

SEQ ID NO: 5921317 - DNA, 14 bp, Homo sapiens
gggaggcgcgagcc

SEQ ID NO: 5921318 - DNA, 21 bp, Homo sapiens
gggaggcggacgttccagccg

SEQ ID NO: 5921319 - DNA, 18 bp, Homo sapiens
gggaggcggagagtacag

SEQ ID NO: 5921320 - DNA, 13 bp, Homo sapiens
gggaggcggcctc

SEQ ID NO: 5921321 - DNA, 13 bp, Homo sapiens
gggaggcggggag

SEQ ID NO: 5921322 - DNA, 22 bp, Homo sapiens
gggaggcggggaggaggaacgg

SEQ ID NO: 5921323 - DNA, 13 bp, Homo sapiens
gggaggctcccag

SEQ ID NO: 5921324 - DNA, 20 bp, Homo sapiens
gggaggctcccggggcctgg

SEQ ID NO: 5921325 - DNA, 18 bp, Homo sapiens
gggaggctcggggctccc

SEQ ID NO: 5921326 - DNA, 11 bp, Homo sapiens
gggaggctgag

SEQ ID NO: 5921327 - DNA, 15 bp, Homo sapiens
gggaggctgagacag

SEQ ID NO: 5921328 - DNA, 14 bp, Homo sapiens
gggaggctgagact

SEQ ID NO: 5921329 - DNA, 16 bp, Homo sapiens
gggaggctgaggcaca

SEQ ID NO: 5921330 - DNA, 18 bp, Homo sapiens
gggaggctgaggcagaag

SEQ ID NO: 5921331 - DNA, 17 bp, Homo sapiens
gggaggctgaggcagga

SEQ ID NO: 5921332 - DNA, 18 bp, Homo sapiens
gggaggctgaggcaggag

SEQ ID NO: 5921333 - DNA, 18 bp, Homo sapiens
gggaggctgaggcggaag

SEQ ID NO: 5921334 - DNA, 17 bp, Homo sapiens
gggaggctgcagccagg

SEQ ID NO: 5921335 - DNA, 19 bp, Homo sapiens
gggaggctgcagccaggcc

SEQ ID NO: 5921336 - DNA, 16 bp, Homo sapiens
gggaggctgggcacag

SEQ ID NO: 5921337 - DNA, 13 bp, Homo sapiens
gggaggctggggc

SEQ ID NO: 5921338 - DNA, 14 bp, Homo sapiens
gggaggctggggcc

SEQ ID NO: 5921339 - DNA, 15 bp, Homo sapiens
gggaggctggggccc

SEQ ID NO: 5921340 - DNA, 19 bp, Homo sapiens
gggaggcttccagctcagt

SEQ ID NO: 5921341 - DNA, 14 bp, Homo sapiens
gggaggcttcctga

SEQ ID NO: 5921342 - DNA, 20 bp, Homo sapiens
gggaggcttttggtggtccc

SEQ ID NO: 5921343 - DNA, 13 bp, Homo sapiens
gggagggaacatc

SEQ ID NO: 5921344 - DNA, 18 bp, Homo sapiens
gggagggaagggagccaa

SEQ ID NO: 5921345 - DNA, 22 bp, Homo sapiens
gggagggaagtgtgagcgcctt

SEQ ID NO: 5921346 - DNA, 16 bp, Homo sapiens
gggagggacagggcag

SEQ ID NO: 5921347 - DNA, 21 bp, Homo sapiens
gggagggagcaagccctactc

SEQ ID NO: 5921348 - DNA, 15 bp, Homo sapiens
gggagggagccatgg

SEQ ID NO: 5921349 - DNA, 18 bp, Homo sapiens
gggagggagctgagaaga

SEQ ID NO: 5921350 - DNA, 11 bp, Homo sapiens
gggagggaggg

SEQ ID NO: 5921351 - DNA, 16 bp, Homo sapiens
gggagggagggctcca

SEQ ID NO: 5921352 - DNA, 14 bp, Homo sapiens
gggagggaggggga

SEQ ID NO: 5921353 - DNA, 16 bp, Homo sapiens
gggagggatcagcccc

SEQ ID NO: 5921354 - DNA, 13 bp, Homo sapiens
gggagggatggcc

SEQ ID NO: 5921355 - DNA, 11 bp, Homo sapiens
gggagggcaga

SEQ ID NO: 5921356 - DNA, 20 bp, Homo sapiens
gggagggcagagctggtgcg

SEQ ID NO: 5921357 - DNA, 13 bp, Homo sapiens
gggagggcagcag

SEQ ID NO: 5921358 - DNA, 15 bp, Homo sapiens
gggagggcagctggc

SEQ ID NO: 5921359 - DNA, 19 bp, Homo sapiens
gggagggcaggatggcctt

SEQ ID NO: 5921360 - DNA, 18 bp, Homo sapiens
gggagggccagggaggca

SEQ ID NO: 5921361 - DNA, 14 bp, Homo sapiens
gggagggcctctgg

SEQ ID NO: 5921362 - DNA, 21 bp, Homo sapiens
gggagggcggcaggggcctgg

SEQ ID NO: 5921363 - DNA, 22 bp, Homo sapiens
gggagggcggcaggggcctgga

SEQ ID NO: 5921364 - DNA, 11 bp, Homo sapiens
gggagggctcc

SEQ ID NO: 5921365 - DNA, 16 bp, Homo sapiens
gggagggctcctgggg

SEQ ID NO: 5921366 - DNA, 15 bp, Homo sapiens
gggagggctctgagg

SEQ ID NO: 5921367 - DNA, 18 bp, Homo sapiens
gggagggctctgaggcgc

SEQ ID NO: 5921368 - DNA, 20 bp, Homo sapiens
gggagggctctgaggcgccc

SEQ ID NO: 5921369 - DNA, 17 bp, Homo sapiens
gggaggggaaaggctgc

SEQ ID NO: 5921370 - DNA, 18 bp, Homo sapiens
gggaggggaaggggccgg

SEQ ID NO: 5921371 - DNA, 16 bp, Homo sapiens
gggaggggagactttg

SEQ ID NO: 5921372 - DNA, 13 bp, Homo sapiens
gggaggggagaga

SEQ ID NO: 5921373 - DNA, 16 bp, Homo sapiens
gggaggggcaggctga

SEQ ID NO: 5921374 - DNA, 16 bp, Homo sapiens
gggaggggccctcagg

SEQ ID NO: 5921375 - DNA, 17 bp, Homo sapiens
gggaggggccggccctg

SEQ ID NO: 5921376 - DNA, 16 bp, Homo sapiens
gggaggggcctaggga

SEQ ID NO: 5921377 - DNA, 19 bp, Homo sapiens
gggaggggcctagggagcc

SEQ ID NO: 5921378 - DNA, 19 bp, Homo sapiens
gggaggggcctggcctggg

SEQ ID NO: 5921379 - DNA, 21 bp, Homo sapiens
gggaggggcgctggcccagcc

SEQ ID NO: 5921380 - DNA, 14 bp, Homo sapiens
gggaggggctcctt

SEQ ID NO: 5921381 - DNA, 19 bp, Homo sapiens
gggaggggctggggcaggc

SEQ ID NO: 5921382 - DNA, 13 bp, Homo sapiens
gggagggggaagc

SEQ ID NO: 5921383 - DNA, 17 bp, Homo sapiens
gggagggggaagcaaag

SEQ ID NO: 5921384 - DNA, 13 bp, Homo sapiens
gggagggggacgc

SEQ ID NO: 5921385 - DNA, 14 bp, Homo sapiens
gggagggggagagg

SEQ ID NO: 5921386 - DNA, 14 bp, Homo sapiens
gggagggggctcca

SEQ ID NO: 5921387 - DNA, 21 bp, Homo sapiens
gggagggggctggctctgaga

SEQ ID NO: 5921388 - DNA, 19 bp, Homo sapiens
gggaggggggagccagagg

SEQ ID NO: 5921389 - DNA, 20 bp, Homo sapiens
gggagggggtgagaggcagg

SEQ ID NO: 5921390 - DNA, 21 bp, Homo sapiens
gggagggggtgagaggcagga

SEQ ID NO: 5921391 - DNA, 21 bp, Homo sapiens
gggagggggttacaaactgca

SEQ ID NO: 5921392 - DNA, 22 bp, Homo sapiens
gggaggggtaaaattccttagc

SEQ ID NO: 5921393 - DNA, 15 bp, Homo sapiens
gggaggggtggtact

SEQ ID NO: 5921394 - DNA, 19 bp, Homo sapiens
gggaggggttgccacaggc

SEQ ID NO: 5921395 - DNA, 23 bp, Homo sapiens
gggaggggttgccacaggcctcc

SEQ ID NO: 5921396 - DNA, 13 bp, Homo sapiens
gggagggtcagtg

SEQ ID NO: 5921397 - DNA, 16 bp, Homo sapiens
gggagggtctgcaggg

SEQ ID NO: 5921398 - DNA, 11 bp, Homo sapiens
gggagggtggc

SEQ ID NO: 5921399 - DNA, 18 bp, Homo sapiens
gggagggtggcagagaca

SEQ ID NO: 5921400 - DNA, 15 bp, Homo sapiens
gggagggtgggcgtg

SEQ ID NO: 5921401 - DNA, 17 bp, Homo sapiens
gggagggttagcctgca

SEQ ID NO: 5921402 - DNA, 16 bp, Homo sapiens
gggagggttcccctgg

SEQ ID NO: 5921403 - DNA, 19 bp, Homo sapiens
gggagggttggcacctgca

SEQ ID NO: 5921404 - DNA, 23 bp, Homo sapiens
gggaggtagaaggggaggacact

SEQ ID NO: 5921405 - DNA, 18 bp, Homo sapiens
gggaggtcaaggctgcag

SEQ ID NO: 5921406 - DNA, 15 bp, Homo sapiens
gggaggtcactggaa

SEQ ID NO: 5921407 - DNA, 15 bp, Homo sapiens
gggaggtcaggccct

SEQ ID NO: 5921408 - DNA, 17 bp, Homo sapiens
gggaggtcaggccctgg

SEQ ID NO: 5921409 - DNA, 16 bp, Homo sapiens
gggaggtccaagcaga

SEQ ID NO: 5921410 - DNA, 16 bp, Homo sapiens
gggaggtccaaggtca

SEQ ID NO: 5921411 - DNA, 17 bp, Homo sapiens
gggaggtccaggcagga

SEQ ID NO: 5921412 - DNA, 14 bp, Homo sapiens
gggaggtcccaggg

SEQ ID NO: 5921413 - DNA, 18 bp, Homo sapiens
gggaggtcccagggccct

SEQ ID NO: 5921414 - DNA, 15 bp, Homo sapiens
gggaggtcgaggtag

SEQ ID NO: 5921415 - DNA, 16 bp, Homo sapiens
gggaggtcgaggtagg

SEQ ID NO: 5921416 - DNA, 19 bp, Homo sapiens
gggaggtctcgtcccagcc

SEQ ID NO: 5921417 - DNA, 18 bp, Homo sapiens
gggaggtgaaaagggcag

SEQ ID NO: 5921418 - DNA, 20 bp, Homo sapiens
gggaggtgaaaagggcagag

SEQ ID NO: 5921419 - DNA, 22 bp, Homo sapiens
gggaggtgaaaagggcagaggc

SEQ ID NO: 5921420 - DNA, 20 bp, Homo sapiens
gggaggtgctgggggagccc

SEQ ID NO: 5921421 - DNA, 23 bp, Homo sapiens
gggaggtggaagcagaggccctg

SEQ ID NO: 5921422 - DNA, 13 bp, Homo sapiens
gggaggtggaagg

SEQ ID NO: 5921423 - DNA, 20 bp, Homo sapiens
gggaggtggaggttgcattg

SEQ ID NO: 5921424 - DNA, 19 bp, Homo sapiens
gggaggtggccagcccgca

SEQ ID NO: 5921425 - DNA, 18 bp, Homo sapiens
gggaggtgggaggccagg

SEQ ID NO: 5921426 - DNA, 17 bp, Homo sapiens
gggaggtgggatcctcc

SEQ ID NO: 5921427 - DNA, 20 bp, Homo sapiens
gggaggtgtttaaagagagg

SEQ ID NO: 5921428 - DNA, 14 bp, Homo sapiens
gggaggttgggagg

SEQ ID NO: 5921429 - DNA, 19 bp, Homo sapiens
gggaggttggttccttggg

SEQ ID NO: 5921430 - DNA, 17 bp, Homo sapiens
gggaggtttggggggca

SEQ ID NO: 5921431 - DNA, 23 bp, Homo sapiens
gggagtaagaaatgggcctcagc

SEQ ID NO: 5921432 - DNA, 24 bp, Homo sapiens
gggagtaagaaatgggcctcagcc

SEQ ID NO: 5921433 - DNA, 18 bp, Homo sapiens
gggagtaataggaccaga

SEQ ID NO: 5921434 - DNA, 13 bp, Homo sapiens
gggagtacctgct

SEQ ID NO: 5921435 - DNA, 17 bp, Homo sapiens
gggagtagacttgcttt

SEQ ID NO: 5921436 - DNA, 23 bp, Homo sapiens
gggagtagcatggactctgggtt

SEQ ID NO: 5921437 - DNA, 10 bp, Homo sapiens
gggagtagga

SEQ ID NO: 5921438 - DNA, 20 bp, Homo sapiens
gggagtaggctccagacagg

SEQ ID NO: 5921439 - DNA, 21 bp, Homo sapiens
gggagtcaggcctgggcagga

SEQ ID NO: 5921440 - DNA, 17 bp, Homo sapiens
gggagtcagggacctgc

SEQ ID NO: 5921441 - DNA, 19 bp, Homo sapiens
gggagtcagggacctgctg

SEQ ID NO: 5921442 - DNA, 23 bp, Homo sapiens
gggagtcagggacctgctgctca

SEQ ID NO: 5921443 - DNA, 17 bp, Homo sapiens
gggagtcatggtcaggg

SEQ ID NO: 5921444 - DNA, 21 bp, Homo sapiens
gggagtccactttcctctctc

SEQ ID NO: 5921445 - DNA, 17 bp, Homo sapiens
gggagtccaggcacagg

SEQ ID NO: 5921446 - DNA, 14 bp, Homo sapiens
gggagtccagggtt

SEQ ID NO: 5921447 - DNA, 17 bp, Homo sapiens
gggagtccccttttctt

SEQ ID NO: 5921448 - DNA, 14 bp, Homo sapiens
gggagtccttacct

SEQ ID NO: 5921449 - DNA, 17 bp, Homo sapiens
gggagtccttacctcgg

SEQ ID NO: 5921450 - DNA, 18 bp, Homo sapiens
gggagtccttacctcggg

SEQ ID NO: 5921451 - DNA, 15 bp, Homo sapiens
gggagtctcaggagg

SEQ ID NO: 5921452 - DNA, 23 bp, Homo sapiens
gggagtctgaagcagatgcaaag

SEQ ID NO: 5921453 - DNA, 14 bp, Homo sapiens
gggagtctgccagg

SEQ ID NO: 5921454 - DNA, 11 bp, Homo sapiens
gggagtgagca

SEQ ID NO: 5921455 - DNA, 14 bp, Homo sapiens
gggagtgagcagct

SEQ ID NO: 5921456 - DNA, 11 bp, Homo sapiens
gggagtgagct

SEQ ID NO: 5921457 - DNA, 16 bp, Homo sapiens
gggagtgaggggctgt

SEQ ID NO: 5921458 - DNA, 19 bp, Homo sapiens
gggagtgaggggctgtgac

SEQ ID NO: 5921459 - DNA, 15 bp, Homo sapiens
gggagtggagtggaa

SEQ ID NO: 5921460 - DNA, 13 bp, Homo sapiens
gggagtggccaca

SEQ ID NO: 5921461 - DNA, 13 bp, Homo sapiens
gggagtggccatc

SEQ ID NO: 5921462 - DNA, 20 bp, Homo sapiens
gggagtgggacagagtctgg

SEQ ID NO: 5921463 - DNA, 21 bp, Homo sapiens
gggagtgggacagagtctggg

SEQ ID NO: 5921464 - DNA, 23 bp, Homo sapiens
gggcaaaacccaggacatctcct

SEQ ID NO: 5921465 - DNA, 18 bp, Homo sapiens
gggcaaaattcccaggga

SEQ ID NO: 5921466 - DNA, 20 bp, Homo sapiens
gggcaaacagagctactgag

SEQ ID NO: 5921467 - DNA, 17 bp, Homo sapiens
gggcaaaccctggtgct

SEQ ID NO: 5921468 - DNA, 17 bp, Homo sapiens
gggcaaacctagccgga

SEQ ID NO: 5921469 - DNA, 18 bp, Homo sapiens
gggcaaagccacaaggct

SEQ ID NO: 5921470 - DNA, 13 bp, Homo sapiens
gggcaaagccagg

SEQ ID NO: 5921471 - DNA, 16 bp, Homo sapiens
gggcaaagcccctcac

SEQ ID NO: 5921472 - DNA, 14 bp, Homo sapiens
gggcaaagcctagt

SEQ ID NO: 5921473 - DNA, 12 bp, Homo sapiens
gggcaaagctga

SEQ ID NO: 5921474 - DNA, 19 bp, Homo sapiens
gggcaaagctgctgggcca

SEQ ID NO: 5921475 - DNA, 21 bp, Homo sapiens
gggcaaagctgctgggccagt

SEQ ID NO: 5921476 - DNA, 14 bp, Homo sapiens
gggcaaagctgtgt

SEQ ID NO: 5921477 - DNA, 17 bp, Homo sapiens
gggcaaaggcagggcca

SEQ ID NO: 5921478 - DNA, 14 bp, Homo sapiens
gggcaaaggccccc

SEQ ID NO: 5921479 - DNA, 17 bp, Homo sapiens
gggcaaatgccagggcc

SEQ ID NO: 5921480 - DNA, 15 bp, Homo sapiens
gggcaaatggctgag

SEQ ID NO: 5921481 - DNA, 22 bp, Homo sapiens
gggcaacagagcaagaccctgt

SEQ ID NO: 5921482 - DNA, 22 bp, Homo sapiens
gggcaacatagtgagattctgt

SEQ ID NO: 5921483 - DNA, 21 bp, Homo sapiens
gggcaacattgttcacctttg

SEQ ID NO: 5921484 - DNA, 21 bp, Homo sapiens
gggcaaccaactgccccaggg

SEQ ID NO: 5921485 - DNA, 16 bp, Homo sapiens
gggcaacccccagcct

SEQ ID NO: 5921486 - DNA, 20 bp, Homo sapiens
gggcaacccccagcctgcta

SEQ ID NO: 5921487 - DNA, 18 bp, Homo sapiens
gggcaaccctggtgacca

SEQ ID NO: 5921488 - DNA, 14 bp, Homo sapiens
gggcaacgaagaaa

SEQ ID NO: 5921489 - DNA, 23 bp, Homo sapiens
gggcaacgaagaaaaaaaataac

SEQ ID NO: 5921490 - DNA, 16 bp, Homo sapiens
gggcaacgattcacag

SEQ ID NO: 5921491 - DNA, 21 bp, Homo sapiens
gggcaacgattcacagcctcc

SEQ ID NO: 5921492 - DNA, 19 bp, Homo sapiens
gggcaactcgtgacagcct

SEQ ID NO: 5921493 - DNA, 22 bp, Homo sapiens
gggcaactcgtgacagcctctg

SEQ ID NO: 5921494 - DNA, 23 bp, Homo sapiens
gggcaactgcagtgaccaggggc

SEQ ID NO: 5921495 - DNA, 23 bp, Homo sapiens
gggcaagaaattcattaaagaaa

SEQ ID NO: 5921496 - DNA, 20 bp, Homo sapiens
gggcaagaagatcacgctcc

SEQ ID NO: 5921497 - DNA, 14 bp, Homo sapiens
gggcaagaagctgc

SEQ ID NO: 5921498 - DNA, 16 bp, Homo sapiens
gggcaagaagctgctt

SEQ ID NO: 5921499 - DNA, 21 bp, Homo sapiens
gggcaagacagaaaagtgcct

SEQ ID NO: 5921500 - DNA, 21 bp, Homo sapiens
gggcaagacctcttccctctg

SEQ ID NO: 5921501 - DNA, 22 bp, Homo sapiens
gggcaagagatgggacaagcag

SEQ ID NO: 5921502 - DNA, 13 bp, Homo sapiens
gggcaagaggaaa

SEQ ID NO: 5921503 - DNA, 14 bp, Homo sapiens
gggcaagaggatga

SEQ ID NO: 5921504 - DNA, 17 bp, Homo sapiens
gggcaagagggggacct

SEQ ID NO: 5921505 - DNA, 18 bp, Homo sapiens
gggcaagagggggacctg

SEQ ID NO: 5921506 - DNA, 21 bp, Homo sapiens
gggcaagaggtgcctgggagg

SEQ ID NO: 5921507 - DNA, 17 bp, Homo sapiens
gggcaagatccaggtgg

SEQ ID NO: 5921508 - DNA, 15 bp, Homo sapiens
gggcaagccagggcc

SEQ ID NO: 5921509 - DNA, 19 bp, Homo sapiens
gggcaagccagggcccaga

SEQ ID NO: 5921510 - DNA, 16 bp, Homo sapiens
gggcaagcctgagtgg

SEQ ID NO: 5921511 - DNA, 22 bp, Homo sapiens
gggcaagctttgctccttcagt

SEQ ID NO: 5921512 - DNA, 14 bp, Homo sapiens
gggcaaggaaaaag

SEQ ID NO: 5921513 - DNA, 20 bp, Homo sapiens
gggcaaggaaaaagaaaata

SEQ ID NO: 5921514 - DNA, 21 bp, Homo sapiens
gggcaaggaatcctctgggag

SEQ ID NO: 5921515 - DNA, 13 bp, Homo sapiens
gggcaaggagacc

SEQ ID NO: 5921516 - DNA, 20 bp, Homo sapiens
gggcaaggatacccggtggc

SEQ ID NO: 5921517 - DNA, 16 bp, Homo sapiens
gggcaaggccccttcc

SEQ ID NO: 5921518 - DNA, 18 bp, Homo sapiens
gggcaaggccccttccac

SEQ ID NO: 5921519 - DNA, 14 bp, Homo sapiens
gggcaaggggccag

SEQ ID NO: 5921520 - DNA, 17 bp, Homo sapiens
gggcaaggggccaggaa

SEQ ID NO: 5921521 - DNA, 20 bp, Homo sapiens
gggcaagggttaaggcctga

SEQ ID NO: 5921522 - DNA, 22 bp, Homo sapiens
gggcaagtcccttgacctttcc

SEQ ID NO: 5921523 - DNA, 16 bp, Homo sapiens
gggcaagtgagagggg

SEQ ID NO: 5921524 - DNA, 18 bp, Homo sapiens
gggcaagtgagaggggag

SEQ ID NO: 5921525 - DNA, 19 bp, Homo sapiens
gggcaagtggatggcccag

SEQ ID NO: 5921526 - DNA, 22 bp, Homo sapiens
gggcaagtggatggcccagcag

SEQ ID NO: 5921527 - DNA, 16 bp, Homo sapiens
gggcaatattctctgt

SEQ ID NO: 5921528 - DNA, 16 bp, Homo sapiens
gggcaatgcagtgcag

SEQ ID NO: 5921529 - DNA, 17 bp, Homo sapiens
gggcaatgccatcagcc

SEQ ID NO: 5921530 - DNA, 23 bp, Homo sapiens
gggcaatgccatcagcccctggg

SEQ ID NO: 5921531 - DNA, 18 bp, Homo sapiens
gggcaatggccaggggcc

SEQ ID NO: 5921532 - DNA, 14 bp, Homo sapiens
gggcaatggggaga

SEQ ID NO: 5921533 - DNA, 15 bp, Homo sapiens
gggcaatggggagag

SEQ ID NO: 5921534 - DNA, 18 bp, Homo sapiens
gggcaatggggagaggca

SEQ ID NO: 5921535 - DNA, 18 bp, Homo sapiens
gggcaattgacttcctcc

SEQ ID NO: 5921536 - DNA, 21 bp, Homo sapiens
gggcacaaaattctagaagca

SEQ ID NO: 5921537 - DNA, 13 bp, Homo sapiens
gggcacaaacaga

SEQ ID NO: 5921538 - DNA, 18 bp, Homo sapiens
gggcacaaactgcagctg

SEQ ID NO: 5921539 - DNA, 23 bp, Homo sapiens
gggcacaaactgcagctgtgagt

SEQ ID NO: 5921540 - DNA, 17 bp, Homo sapiens
gggcacaagacccctgc

SEQ ID NO: 5921541 - DNA, 20 bp, Homo sapiens
gggcacaagacccctgctcc

SEQ ID NO: 5921542 - DNA, 14 bp, Homo sapiens
gggcacaagttttt

SEQ ID NO: 5921543 - DNA, 22 bp, Homo sapiens
gggcacaagtttttttgttcat

SEQ ID NO: 5921544 - DNA, 18 bp, Homo sapiens
gggcacacacacccgccc

SEQ ID NO: 5921545 - DNA, 15 bp, Homo sapiens
gggcacaccactgcc

SEQ ID NO: 5921546 - DNA, 22 bp, Homo sapiens
gggcacacgcacaaacacacac

SEQ ID NO: 5921547 - DNA, 23 bp, Homo sapiens
gggcacacgcacaaacacacaca

SEQ ID NO: 5921548 - DNA, 15 bp, Homo sapiens
gggcacacgcctccc

SEQ ID NO: 5921549 - DNA, 19 bp, Homo sapiens
gggcacactacagagcagc

SEQ ID NO: 5921550 - DNA, 13 bp, Homo sapiens
gggcacactctgc

SEQ ID NO: 5921551 - DNA, 15 bp, Homo sapiens
gggcacactctgcca

SEQ ID NO: 5921552 - DNA, 20 bp, Homo sapiens
gggcacagaaaatggaagac

SEQ ID NO: 5921553 - DNA, 13 bp, Homo sapiens
gggcacagattga

SEQ ID NO: 5921554 - DNA, 12 bp, Homo sapiens
gggcacagccag

SEQ ID NO: 5921555 - DNA, 14 bp, Homo sapiens
gggcacagccagaa

SEQ ID NO: 5921556 - DNA, 23 bp, Homo sapiens
gggcacagctgtctgccaggcac

SEQ ID NO: 5921557 - DNA, 13 bp, Homo sapiens
gggcacaggagct

SEQ ID NO: 5921558 - DNA, 14 bp, Homo sapiens
gggcacaggccatg

SEQ ID NO: 5921559 - DNA, 16 bp, Homo sapiens
gggcacaggccatgga

SEQ ID NO: 5921560 - DNA, 12 bp, Homo sapiens
gggcacagggca

SEQ ID NO: 5921561 - DNA, 16 bp, Homo sapiens
gggcacagggcaccag

SEQ ID NO: 5921562 - DNA, 17 bp, Homo sapiens
gggcacagggcaccaga

SEQ ID NO: 5921563 - DNA, 13 bp, Homo sapiens
gggcacagggcct

SEQ ID NO: 5921564 - DNA, 18 bp, Homo sapiens
gggcacagtccagaccca

SEQ ID NO: 5921565 - DNA, 17 bp, Homo sapiens
gggcacagtgctgcccc

SEQ ID NO: 5921566 - DNA, 21 bp, Homo sapiens
gggcacagtgctgccccttgc

SEQ ID NO: 5921567 - DNA, 20 bp, Homo sapiens
gggcacatagcataggctgg

SEQ ID NO: 5921568 - DNA, 15 bp, Homo sapiens
gggcacatgaggagg

SEQ ID NO: 5921569 - DNA, 20 bp, Homo sapiens
gggcacatgctgagtctccc

SEQ ID NO: 5921570 - DNA, 19 bp, Homo sapiens
gggcacatgtatgtccatt

SEQ ID NO: 5921571 - DNA, 13 bp, Homo sapiens
gggcaccagaggc

SEQ ID NO: 5921572 - DNA, 14 bp, Homo sapiens
gggcaccagaggcc

SEQ ID NO: 5921573 - DNA, 21 bp, Homo sapiens
gggcaccagcttctttctcgg

SEQ ID NO: 5921574 - DNA, 14 bp, Homo sapiens
gggcaccaggggcc

SEQ ID NO: 5921575 - DNA, 15 bp, Homo sapiens
gggcaccatctggac

SEQ ID NO: 5921576 - DNA, 16 bp, Homo sapiens
gggcacccacctccac

SEQ ID NO: 5921577 - DNA, 18 bp, Homo sapiens
gggcaccccagcctgaag

SEQ ID NO: 5921578 - DNA, 22 bp, Homo sapiens
gggcaccccaggcagctcctgt

SEQ ID NO: 5921579 - DNA, 14 bp, Homo sapiens
gggcacccccagcc

SEQ ID NO: 5921580 - DNA, 15 bp, Homo sapiens
gggcacccccggccc

SEQ ID NO: 5921581 - DNA, 23 bp, Homo sapiens
gggcacccccggcccagtgcccc

SEQ ID NO: 5921582 - DNA, 14 bp, Homo sapiens
gggcaccctcccac

SEQ ID NO: 5921583 - DNA, 17 bp, Homo sapiens
gggcaccctgcaggcag

SEQ ID NO: 5921584 - DNA, 14 bp, Homo sapiens
gggcaccggggcct

SEQ ID NO: 5921585 - DNA, 21 bp, Homo sapiens
gggcaccgtattcctctccca

SEQ ID NO: 5921586 - DNA, 22 bp, Homo sapiens
gggcacctccggctgcctagcc

SEQ ID NO: 5921587 - DNA, 23 bp, Homo sapiens
gggcacctccggctgcctagccc

SEQ ID NO: 5921588 - DNA, 13 bp, Homo sapiens
gggcacctctgct

SEQ ID NO: 5921589 - DNA, 22 bp, Homo sapiens
gggcacctgacttggctgggga

SEQ ID NO: 5921590 - DNA, 12 bp, Homo sapiens
gggcacctgcca

SEQ ID NO: 5921591 - DNA, 13 bp, Homo sapiens
gggcacctgccac

SEQ ID NO: 5921592 - DNA, 19 bp, Homo sapiens
gggcacctgccaccgccag

SEQ ID NO: 5921593 - DNA, 18 bp, Homo sapiens
gggcacctggggagtggg

SEQ ID NO: 5921594 - DNA, 18 bp, Homo sapiens
gggcacgaggctctagaa

SEQ ID NO: 5921595 - DNA, 16 bp, Homo sapiens
gggcacgcactgggtt

SEQ ID NO: 5921596 - DNA, 14 bp, Homo sapiens
gggcacgcctgctg

SEQ ID NO: 5921597 - DNA, 18 bp, Homo sapiens
gggcacgctgtgggcagg

SEQ ID NO: 5921598 - DNA, 13 bp, Homo sapiens
gggcacggaaatg

SEQ ID NO: 5921599 - DNA, 23 bp, Homo sapiens
gggcacggcgggatcctccacag

SEQ ID NO: 5921600 - DNA, 18 bp, Homo sapiens
gggcacggctccgagggc

SEQ ID NO: 5921601 - DNA, 13 bp, Homo sapiens
gggcacggctctg

SEQ ID NO: 5921602 - DNA, 15 bp, Homo sapiens
gggcacggctctggg

SEQ ID NO: 5921603 - DNA, 18 bp, Homo sapiens
gggcacgggagagcgcca

SEQ ID NO: 5921604 - DNA, 16 bp, Homo sapiens
gggcacggggacctgg

SEQ ID NO: 5921605 - DNA, 16 bp, Homo sapiens
gggcacggtcacacgg

SEQ ID NO: 5921606 - DNA, 22 bp, Homo sapiens
gggcacgtcgcccgctgagctg

SEQ ID NO: 5921607 - DNA, 19 bp, Homo sapiens
gggcacgtggttgagtggg

SEQ ID NO: 5921608 - DNA, 19 bp, Homo sapiens
gggcactaagggtggagag

SEQ ID NO: 5921609 - DNA, 18 bp, Homo sapiens
gggcactagctagatgct

SEQ ID NO: 5921610 - DNA, 19 bp, Homo sapiens
gggcactaggtaggcttct

SEQ ID NO: 5921611 - DNA, 19 bp, Homo sapiens
gggcactcagaagacactg

SEQ ID NO: 5921612 - DNA, 12 bp, Homo sapiens
gggcactccccc

SEQ ID NO: 5921613 - DNA, 13 bp, Homo sapiens
gggcactccccca

SEQ ID NO: 5921614 - DNA, 14 bp, Homo sapiens
gggcactcccccag

SEQ ID NO: 5921615 - DNA, 15 bp, Homo sapiens
gggcactcccccagg

SEQ ID NO: 5921616 - DNA, 22 bp, Homo sapiens
gggcactccgcgccgatgccac

SEQ ID NO: 5921617 - DNA, 18 bp, Homo sapiens
gggcactctctgccagct

SEQ ID NO: 5921618 - DNA, 22 bp, Homo sapiens
gggcactctgttcccctccccc

SEQ ID NO: 5921619 - DNA, 14 bp, Homo sapiens
gggcactgccagcc

SEQ ID NO: 5921620 - DNA, 19 bp, Homo sapiens
gggcactgctccaagggac

SEQ ID NO: 5921621 - DNA, 16 bp, Homo sapiens
gggcactgctctcacc

SEQ ID NO: 5921622 - DNA, 13 bp, Homo sapiens
gggcactgctggg

SEQ ID NO: 5921623 - DNA, 20 bp, Homo sapiens
gggcactggagctgggaggt

SEQ ID NO: 5921624 - DNA, 13 bp, Homo sapiens
gggcactggccca

SEQ ID NO: 5921625 - DNA, 15 bp, Homo sapiens
gggcactggcccagg

SEQ ID NO: 5921626 - DNA, 19 bp, Homo sapiens
gggcactggctgctctgtc

SEQ ID NO: 5921627 - DNA, 22 bp, Homo sapiens
gggcactgggccggcagcctgg

SEQ ID NO: 5921628 - DNA, 22 bp, Homo sapiens
gggcactgggtacccaagtgaa

SEQ ID NO: 5921629 - DNA, 20 bp, Homo sapiens
gggcactgtctgcgtgacta

SEQ ID NO: 5921630 - DNA, 22 bp, Homo sapiens
gggcactgtgccaagatttaaa

SEQ ID NO: 5921631 - DNA, 17 bp, Homo sapiens
gggcactgtggtcaggc

SEQ ID NO: 5921632 - DNA, 20 bp, Homo sapiens
gggcactgtggtcaggccca

SEQ ID NO: 5921633 - DNA, 22 bp, Homo sapiens
gggcactgtggtcaggcccagc

SEQ ID NO: 5921634 - DNA, 17 bp, Homo sapiens
gggcacttaatttgtaa

SEQ ID NO: 5921635 - DNA, 19 bp, Homo sapiens
gggcacttaatttgtaaac

SEQ ID NO: 5921636 - DNA, 14 bp, Homo sapiens
gggcacttcacaga

SEQ ID NO: 5921637 - DNA, 17 bp, Homo sapiens
gggcacttcacagagtg

SEQ ID NO: 5921638 - DNA, 23 bp, Homo sapiens
gggcacttcaggtccgtgggccg

SEQ ID NO: 5921639 - DNA, 20 bp, Homo sapiens
gggcactttaaatgaagcta

SEQ ID NO: 5921640 - DNA, 22 bp, Homo sapiens
gggcacttttgaactcacgagc

SEQ ID NO: 5921641 - DNA, 13 bp, Homo sapiens
gggccagccaggc

SEQ ID NO: 5921642 - DNA, 22 bp, Homo sapiens
gggccagccaggcgggctcaag

SEQ ID NO: 5921643 - DNA, 15 bp, Homo sapiens
gggccagcccctccc

SEQ ID NO: 5921644 - DNA, 17 bp, Homo sapiens
gggccagcccctcccac

SEQ ID NO: 5921645 - DNA, 21 bp, Homo sapiens
gggccagcccctccccgcctc

SEQ ID NO: 5921646 - DNA, 22 bp, Homo sapiens
gggccagcccctccccgcctcc

SEQ ID NO: 5921647 - DNA, 19 bp, Homo sapiens
gggccagccctacatcttc

SEQ ID NO: 5921648 - DNA, 19 bp, Homo sapiens
gggccagccctgcagccca

SEQ ID NO: 5921649 - DNA, 19 bp, Homo sapiens
gggccagcctagcccttgt

SEQ ID NO: 5921650 - DNA, 12 bp, Homo sapiens
gggccagcctct

SEQ ID NO: 5921651 - DNA, 21 bp, Homo sapiens
gggccagcggccctcccaggc

SEQ ID NO: 5921652 - DNA, 11 bp, Homo sapiens
gggccagctcc

SEQ ID NO: 5921653 - DNA, 22 bp, Homo sapiens
gggccagctccaggagggcttg

SEQ ID NO: 5921654 - DNA, 24 bp, Homo sapiens
gggccagctccaggagggcttgag

SEQ ID NO: 5921655 - DNA, 11 bp, Homo sapiens
gggccagctgc

SEQ ID NO: 5921656 - DNA, 13 bp, Homo sapiens
gggccagctgccc

SEQ ID NO: 5921657 - DNA, 15 bp, Homo sapiens
gggccagctggggag

SEQ ID NO: 5921658 - DNA, 18 bp, Homo sapiens
gggccagctggtgctgca

SEQ ID NO: 5921659 - DNA, 20 bp, Homo sapiens
gggccagctggtgctgcaag

SEQ ID NO: 5921660 - DNA, 21 bp, Homo sapiens
gggccagctggtgctgcaagg

SEQ ID NO: 5921661 - DNA, 16 bp, Homo sapiens
gggccaggaaggggac

SEQ ID NO: 5921662 - DNA, 17 bp, Homo sapiens
gggccaggagcccacag

SEQ ID NO: 5921663 - DNA, 14 bp, Homo sapiens
gggccaggagcctc

SEQ ID NO: 5921664 - DNA, 12 bp, Homo sapiens
gggccaggcact

SEQ ID NO: 5921665 - DNA, 13 bp, Homo sapiens
gggccaggcactg

SEQ ID NO: 5921666 - DNA, 13 bp, Homo sapiens
gggccaggcaggt

SEQ ID NO: 5921667 - DNA, 12 bp, Homo sapiens
gggccaggccag

SEQ ID NO: 5921668 - DNA, 13 bp, Homo sapiens
gggccaggccagg

SEQ ID NO: 5921669 - DNA, 18 bp, Homo sapiens
gggccaggccaggaccac

SEQ ID NO: 5921670 - DNA, 19 bp, Homo sapiens
gggccaggccaggaccaca

SEQ ID NO: 5921671 - DNA, 13 bp, Homo sapiens
gggccaggcccag

SEQ ID NO: 5921672 - DNA, 13 bp, Homo sapiens
gggccaggcccca

SEQ ID NO: 5921673 - DNA, 12 bp, Homo sapiens
gggccaggccct

SEQ ID NO: 5921674 - DNA, 15 bp, Homo sapiens
gggccaggccctgga

SEQ ID NO: 5921675 - DNA, 23 bp, Homo sapiens
gggccaggccctggagggcagag

SEQ ID NO: 5921676 - DNA, 14 bp, Homo sapiens
gggccaggccgggc

SEQ ID NO: 5921677 - DNA, 22 bp, Homo sapiens
gggccaggccgggcctgtacag

SEQ ID NO: 5921678 - DNA, 11 bp, Homo sapiens
gggccaggcct

SEQ ID NO: 5921679 - DNA, 13 bp, Homo sapiens
gggccaggctggg

SEQ ID NO: 5921680 - DNA, 21 bp, Homo sapiens
gggccaggctgggtcgccctg

SEQ ID NO: 5921681 - DNA, 20 bp, Homo sapiens
gggccagggacccaggtgtg

SEQ ID NO: 5921682 - DNA, 13 bp, Homo sapiens
gggccagggaggc

SEQ ID NO: 5921683 - DNA, 17 bp, Homo sapiens
gggccagggaggcagag

SEQ ID NO: 5921684 - DNA, 21 bp, Homo sapiens
gggccagggaggcagagcggg

SEQ ID NO: 5921685 - DNA, 23 bp, Homo sapiens
gggccagggaggcagagcgggag

SEQ ID NO: 5921686 - DNA, 17 bp, Homo sapiens
gggccagggcaatgcca

SEQ ID NO: 5921687 - DNA, 18 bp, Homo sapiens
gggccagggcaatgccat

SEQ ID NO: 5921688 - DNA, 13 bp, Homo sapiens
gggccagggccct

SEQ ID NO: 5921689 - DNA, 13 bp, Homo sapiens
gggccagggctgc

SEQ ID NO: 5921690 - DNA, 20 bp, Homo sapiens
gggccaggggcaggcagggc

SEQ ID NO: 5921691 - DNA, 23 bp, Homo sapiens
gggccaggggtctccctggagtg

SEQ ID NO: 5921692 - DNA, 16 bp, Homo sapiens
gggccagggtcctgtc

SEQ ID NO: 5921693 - DNA, 13 bp, Homo sapiens
gggccagggttgc

SEQ ID NO: 5921694 - DNA, 17 bp, Homo sapiens
gggccaggtcctcacag

SEQ ID NO: 5921695 - DNA, 21 bp, Homo sapiens
gggccaggtcctcacagcagt

SEQ ID NO: 5921696 - DNA, 19 bp, Homo sapiens
gggccaggtctggcgccag

SEQ ID NO: 5921697 - DNA, 12 bp, Homo sapiens
gggccaggtgcg

SEQ ID NO: 5921698 - DNA, 21 bp, Homo sapiens
gggccaggtgcggcctggggg

SEQ ID NO: 5921699 - DNA, 15 bp, Homo sapiens
gggccagtcaggctg

SEQ ID NO: 5921700 - DNA, 18 bp, Homo sapiens
gggccagtccctgaggca

SEQ ID NO: 5921701 - DNA, 22 bp, Homo sapiens
gggccagtcctgcctggccagg

SEQ ID NO: 5921702 - DNA, 14 bp, Homo sapiens
gggccagtcctggt

SEQ ID NO: 5921703 - DNA, 16 bp, Homo sapiens
gggccagtctgggctg

SEQ ID NO: 5921704 - DNA, 18 bp, Homo sapiens
gggccagtgagggctggg

SEQ ID NO: 5921705 - DNA, 14 bp, Homo sapiens
gggccagtgctcca

SEQ ID NO: 5921706 - DNA, 17 bp, Homo sapiens
gggccagtggctggggg

SEQ ID NO: 5921707 - DNA, 18 bp, Homo sapiens
gggccagtggggcctgtg

SEQ ID NO: 5921708 - DNA, 23 bp, Homo sapiens
gggccagttggtcccccttccat

SEQ ID NO: 5921709 - DNA, 15 bp, Homo sapiens
gggccatactggcct

SEQ ID NO: 5921710 - DNA, 22 bp, Homo sapiens
gggccatactggcctcgcctgg

SEQ ID NO: 5921711 - DNA, 23 bp, Homo sapiens
gggccatctcttaggtgagacag

SEQ ID NO: 5921712 - DNA, 19 bp, Homo sapiens
gggccatctgactgccaag

SEQ ID NO: 5921713 - DNA, 21 bp, Homo sapiens
gggccatctgactgccaagcc

SEQ ID NO: 5921714 - DNA, 15 bp, Homo sapiens
gggccatgaactttg

SEQ ID NO: 5921715 - DNA, 22 bp, Homo sapiens
gggccatgatggcaacagatct

SEQ ID NO: 5921716 - DNA, 12 bp, Homo sapiens
gggccatgcccc

SEQ ID NO: 5921717 - DNA, 13 bp, Homo sapiens
gggccatgcccca

SEQ ID NO: 5921718 - DNA, 22 bp, Homo sapiens
gggccatgccccacccccctcc

SEQ ID NO: 5921719 - DNA, 21 bp, Homo sapiens
gggccatgcgaggggccagca

SEQ ID NO: 5921720 - DNA, 14 bp, Homo sapiens
gggccatgctgaag

SEQ ID NO: 5921721 - DNA, 18 bp, Homo sapiens
gggccatgctgagagctg

SEQ ID NO: 5921722 - DNA, 13 bp, Homo sapiens
gggccatggctca

SEQ ID NO: 5921723 - DNA, 22 bp, Homo sapiens
gggccatggctttcatcctgtg

SEQ ID NO: 5921724 - DNA, 16 bp, Homo sapiens
gggccatgtccaaaga

SEQ ID NO: 5921725 - DNA, 21 bp, Homo sapiens
gggccatgtccaaagaggctg

SEQ ID NO: 5921726 - DNA, 15 bp, Homo sapiens
gggccattaccccat

SEQ ID NO: 5921727 - DNA, 18 bp, Homo sapiens
gggccattctccacagca

SEQ ID NO: 5921728 - DNA, 19 bp, Homo sapiens
gggccattgaactctgaga

SEQ ID NO: 5921729 - DNA, 19 bp, Homo sapiens
gggccatttcacattcctg

SEQ ID NO: 5921730 - DNA, 21 bp, Homo sapiens
gggccatttcacattcctgac

SEQ ID NO: 5921731 - DNA, 14 bp, Homo sapiens
gggccatttgcaat

SEQ ID NO: 5921732 - DNA, 20 bp, Homo sapiens
gggccatttggccggctctg

SEQ ID NO: 5921733 - DNA, 22 bp, Homo sapiens
gggccatttggccggctctggt

SEQ ID NO: 5921734 - DNA, 19 bp, Homo sapiens
gggcccaaagaattggaat

SEQ ID NO: 5921735 - DNA, 18 bp, Homo sapiens
gggcccaaagcccagctc

SEQ ID NO: 5921736 - DNA, 16 bp, Homo sapiens
gggcccaaaggggagc

SEQ ID NO: 5921737 - DNA, 16 bp, Homo sapiens
gggcccaacaggccct

SEQ ID NO: 5921738 - DNA, 14 bp, Homo sapiens
gggcccaagagaga

SEQ ID NO: 5921739 - DNA, 16 bp, Homo sapiens
gggcccaagtggggtg

SEQ ID NO: 5921740 - DNA, 17 bp, Homo sapiens
gggcccaagttgcagtg

SEQ ID NO: 5921741 - DNA, 21 bp, Homo sapiens
gggcccacaaaggggagaagg

SEQ ID NO: 5921742 - DNA, 24 bp, Homo sapiens
gggcccacaatggagtgggagatc

SEQ ID NO: 5921743 - DNA, 18 bp, Homo sapiens
gggcccacacctccttcc

SEQ ID NO: 5921744 - DNA, 15 bp, Homo sapiens
gggcccacacctggt

SEQ ID NO: 5921745 - DNA, 17 bp, Homo sapiens
gggcccacagagcctgg

SEQ ID NO: 5921746 - DNA, 12 bp, Homo sapiens
gggcccacagcc

SEQ ID NO: 5921747 - DNA, 18 bp, Homo sapiens
gggcccacagcccccacc

SEQ ID NO: 5921748 - DNA, 14 bp, Homo sapiens
gggcccacccacat

SEQ ID NO: 5921749 - DNA, 13 bp, Homo sapiens
gggcccaccccag

SEQ ID NO: 5921750 - DNA, 20 bp, Homo sapiens
gggcccaccctgcctgcacc

SEQ ID NO: 5921751 - DNA, 16 bp, Homo sapiens
gggcccacctggccac

SEQ ID NO: 5921752 - DNA, 18 bp, Homo sapiens
gggcccacctggccacct

SEQ ID NO: 5921753 - DNA, 13 bp, Homo sapiens
gggcccacttggg

SEQ ID NO: 5921754 - DNA, 22 bp, Homo sapiens
gggcccagaactgcccccactg

SEQ ID NO: 5921755 - DNA, 16 bp, Homo sapiens
gggcccagaccctggg

SEQ ID NO: 5921756 - DNA, 17 bp, Homo sapiens
gggcccagagagggtgg

SEQ ID NO: 5921757 - DNA, 11 bp, Homo sapiens
gggcccagagc

SEQ ID NO: 5921758 - DNA, 17 bp, Homo sapiens
gggcccagagcccagct

SEQ ID NO: 5921759 - DNA, 16 bp, Homo sapiens
gggcccagagcccttg

SEQ ID NO: 5921760 - DNA, 12 bp, Homo sapiens
gggcccagaggg

SEQ ID NO: 5921761 - DNA, 22 bp, Homo sapiens
gggcccagaggggcggggccag

SEQ ID NO: 5921762 - DNA, 13 bp, Homo sapiens
gggcccagatctg

SEQ ID NO: 5921763 - DNA, 16 bp, Homo sapiens
gggcccagccaggagc

SEQ ID NO: 5921764 - DNA, 12 bp, Homo sapiens
gggcccagcccc

SEQ ID NO: 5921765 - DNA, 18 bp, Homo sapiens
gggcccagcccccacagt

SEQ ID NO: 5921766 - DNA, 22 bp, Homo sapiens
gggcccagcccccacagtgctg

SEQ ID NO: 5921767 - DNA, 13 bp, Homo sapiens
gggcccagcccct

SEQ ID NO: 5921768 - DNA, 19 bp, Homo sapiens
gggcccagccggggtgggg

SEQ ID NO: 5921769 - DNA, 18 bp, Homo sapiens
gggcccagcggtccctgc

SEQ ID NO: 5921770 - DNA, 12 bp, Homo sapiens
gggcccagctgg

SEQ ID NO: 5921771 - DNA, 21 bp, Homo sapiens
gggcccagctgggctctgcca

SEQ ID NO: 5921772 - DNA, 12 bp, Homo sapiens
gggcccagctgt

SEQ ID NO: 5921773 - DNA, 22 bp, Homo sapiens
gggcccagctgtagccatggct

SEQ ID NO: 5921774 - DNA, 11 bp, Homo sapiens
gggcccaggaa

SEQ ID NO: 5921775 - DNA, 14 bp, Homo sapiens
gggcccaggaccag

SEQ ID NO: 5921776 - DNA, 17 bp, Homo sapiens
gggcccaggaccagctg

SEQ ID NO: 5921777 - DNA, 18 bp, Homo sapiens
gggcccaggaccagctgg

SEQ ID NO: 5921778 - DNA, 12 bp, Homo sapiens
gggcccaggact

SEQ ID NO: 5921779 - DNA, 17 bp, Homo sapiens
gggcccaggactctggc

SEQ ID NO: 5921780 - DNA, 22 bp, Homo sapiens
gggcccaggagagcccccacca

SEQ ID NO: 5921781 - DNA, 12 bp, Homo sapiens
gggcccaggagg

SEQ ID NO: 5921782 - DNA, 11 bp, Homo sapiens
gggcccaggca

SEQ ID NO: 5921783 - DNA, 12 bp, Homo sapiens
gggcccaggcag

SEQ ID NO: 5921784 - DNA, 21 bp, Homo sapiens
gggcccaggcagcacctggag

SEQ ID NO: 5921785 - DNA, 14 bp, Homo sapiens
gggcccaggcaggt

SEQ ID NO: 5921786 - DNA, 16 bp, Homo sapiens
gggcccaggcccagcc

SEQ ID NO: 5921787 - DNA, 20 bp, Homo sapiens
gggcccaggccctagaccct

SEQ ID NO: 5921788 - DNA, 15 bp, Homo sapiens
gggcccaggcctgga

SEQ ID NO: 5921789 - DNA, 13 bp, Homo sapiens
gggcccaggctct

SEQ ID NO: 5921790 - DNA, 14 bp, Homo sapiens
gggcccaggctctg

SEQ ID NO: 5921791 - DNA, 11 bp, Homo sapiens
gggcccaggga

SEQ ID NO: 5921792 - DNA, 22 bp, Homo sapiens
gggcccagggacaccagccagg

SEQ ID NO: 5921793 - DNA, 22 bp, Homo sapiens
gggcccagggacacccacacag

SEQ ID NO: 5921794 - DNA, 22 bp, Homo sapiens
gggcccagggacattgcagagt

SEQ ID NO: 5921795 - DNA, 15 bp, Homo sapiens
gggcccagggcctct

SEQ ID NO: 5921796 - DNA, 22 bp, Homo sapiens
gggcccagtgcatggtggccag

SEQ ID NO: 5921797 - DNA, 14 bp, Homo sapiens
gggcccatcaggca

SEQ ID NO: 5921798 - DNA, 23 bp, Homo sapiens
gggcccatctgccgcctggggct

SEQ ID NO: 5921799 - DNA, 14 bp, Homo sapiens
gggcccatggcctt

SEQ ID NO: 5921800 - DNA, 18 bp, Homo sapiens
gggcccatgggagggagc

SEQ ID NO: 5921801 - DNA, 15 bp, Homo sapiens
gggcccatgtgggct

SEQ ID NO: 5921802 - DNA, 17 bp, Homo sapiens
gggcccattcagcctcg

SEQ ID NO: 5921803 - DNA, 16 bp, Homo sapiens
gggccccaaagcccag

SEQ ID NO: 5921804 - DNA, 19 bp, Homo sapiens
gggccccaaagcccagccc

SEQ ID NO: 5921805 - DNA, 12 bp, Homo sapiens
gggccccacgga

SEQ ID NO: 5921806 - DNA, 16 bp, Homo sapiens
gggccccacggagagt

SEQ ID NO: 5921807 - DNA, 14 bp, Homo sapiens
gggccccactggac

SEQ ID NO: 5921808 - DNA, 12 bp, Homo sapiens
gggccccagacc

SEQ ID NO: 5921809 - DNA, 16 bp, Homo sapiens
gggccccagaccccag

SEQ ID NO: 5921810 - DNA, 21 bp, Homo sapiens
gggccccagaccccagggcag

SEQ ID NO: 5921811 - DNA, 13 bp, Homo sapiens
gggccccagatct

SEQ ID NO: 5921812 - DNA, 23 bp, Homo sapiens
gggccccagatctgcctgggcct

SEQ ID NO: 5921813 - DNA, 24 bp, Homo sapiens
gggccccagatctgcctgggcctg

SEQ ID NO: 5921814 - DNA, 11 bp, Homo sapiens
gggccccagcc

SEQ ID NO: 5921815 - DNA, 12 bp, Homo sapiens
gggccccagccc

SEQ ID NO: 5921816 - DNA, 17 bp, Homo sapiens
gggccccagcccaccct

SEQ ID NO: 5921817 - DNA, 15 bp, Homo sapiens
gggccccagccgtgg

SEQ ID NO: 5921818 - DNA, 15 bp, Homo sapiens
gggccccagcgtctg

SEQ ID NO: 5921819 - DNA, 22 bp, Homo sapiens
gggccccagcgtctgcagggtg

SEQ ID NO: 5921820 - DNA, 23 bp, Homo sapiens
gggccccaggcccgcgggcacag

SEQ ID NO: 5921821 - DNA, 19 bp, Homo sapiens
gggccgcgtgccgggcccc

SEQ ID NO: 5921822 - DNA, 23 bp, Homo sapiens
gggccgcgtggtgccatccccag

SEQ ID NO: 5921823 - DNA, 19 bp, Homo sapiens
gggccgctctccccctgca

SEQ ID NO: 5921824 - DNA, 17 bp, Homo sapiens
gggccgcttcgccatgt

SEQ ID NO: 5921825 - DNA, 20 bp, Homo sapiens
gggccgcttcgccatgtgct

SEQ ID NO: 5921826 - DNA, 15 bp, Homo sapiens
gggccgcttctcctg

SEQ ID NO: 5921827 - DNA, 19 bp, Homo sapiens
gggccgcttctcctgcagt

SEQ ID NO: 5921828 - DNA, 16 bp, Homo sapiens
gggccggcagcctggt

SEQ ID NO: 5921829 - DNA, 17 bp, Homo sapiens
gggccggccagtggcct

SEQ ID NO: 5921830 - DNA, 18 bp, Homo sapiens
gggccggccccaggctcc

SEQ ID NO: 5921831 - DNA, 17 bp, Homo sapiens
gggccggcccccttcct

SEQ ID NO: 5921832 - DNA, 12 bp, Homo sapiens
gggccggccctg

SEQ ID NO: 5921833 - DNA, 19 bp, Homo sapiens
gggccggccctgtgtgcag

SEQ ID NO: 5921834 - DNA, 15 bp, Homo sapiens
gggccggcggctctg

SEQ ID NO: 5921835 - DNA, 14 bp, Homo sapiens
gggccggctggcct

SEQ ID NO: 5921836 - DNA, 17 bp, Homo sapiens
gggccgggaggcagtgc

SEQ ID NO: 5921837 - DNA, 17 bp, Homo sapiens
gggccgggcaccacccc

SEQ ID NO: 5921838 - DNA, 21 bp, Homo sapiens
gggccgggcaccacccccagt

SEQ ID NO: 5921839 - DNA, 13 bp, Homo sapiens
gggccgggcaggg

SEQ ID NO: 5921840 - DNA, 17 bp, Homo sapiens
gggccggggaactggcc

SEQ ID NO: 5921841 - DNA, 23 bp, Homo sapiens
gggccggggaactggccaagctg

SEQ ID NO: 5921842 - DNA, 21 bp, Homo sapiens
gggccggggaagctgccagcc

SEQ ID NO: 5921843 - DNA, 20 bp, Homo sapiens
gggccggggagggggcacgg

SEQ ID NO: 5921844 - DNA, 14 bp, Homo sapiens
gggccggggcctct

SEQ ID NO: 5921845 - DNA, 13 bp, Homo sapiens
gggccggggctga

SEQ ID NO: 5921846 - DNA, 16 bp, Homo sapiens
gggccgggggcggggc

SEQ ID NO: 5921847 - DNA, 23 bp, Homo sapiens
gggccggggggggtaggagagga

SEQ ID NO: 5921848 - DNA, 21 bp, Homo sapiens
gggccggttttcctcagctct

SEQ ID NO: 5921849 - DNA, 15 bp, Homo sapiens
gggccgtaccccacc

SEQ ID NO: 5921850 - DNA, 16 bp, Homo sapiens
gggccgtaccccaccc

SEQ ID NO: 5921851 - DNA, 23 bp, Homo sapiens
gggccgtatctccggctcccagc

SEQ ID NO: 5921852 - DNA, 19 bp, Homo sapiens
gggccgtcccctctcccct

SEQ ID NO: 5921853 - DNA, 20 bp, Homo sapiens
gggccgtggcttgggctggt

SEQ ID NO: 5921854 - DNA, 21 bp, Homo sapiens
gggcctaaggagggtctccac

SEQ ID NO: 5921855 - DNA, 17 bp, Homo sapiens
gggcctactagagtctg

SEQ ID NO: 5921856 - DNA, 20 bp, Homo sapiens
gggcctagatccacacacag

SEQ ID NO: 5921857 - DNA, 22 bp, Homo sapiens
gggcctagatccacacacagag

SEQ ID NO: 5921858 - DNA, 23 bp, Homo sapiens
gggcctagatccacacacagagg

SEQ ID NO: 5921859 - DNA, 23 bp, Homo sapiens
gggcctagcgatctctcctggcc

SEQ ID NO: 5921860 - DNA, 22 bp, Homo sapiens
gggcctatcagtgtgcccccca

SEQ ID NO: 5921861 - DNA, 20 bp, Homo sapiens
gggcctcaaaggcccgctct

SEQ ID NO: 5921862 - DNA, 16 bp, Homo sapiens
gggcctcaaggacttg

SEQ ID NO: 5921863 - DNA, 14 bp, Homo sapiens
gggcctcacccaga

SEQ ID NO: 5921864 - DNA, 15 bp, Homo sapiens
gggcctcagagcctg

SEQ ID NO: 5921865 - DNA, 16 bp, Homo sapiens
gggcctcagagcctga

SEQ ID NO: 5921866 - DNA, 15 bp, Homo sapiens
gggcctcaggctccg

SEQ ID NO: 5921867 - DNA, 14 bp, Homo sapiens
gggcctcaggctct

SEQ ID NO: 5921868 - DNA, 15 bp, Homo sapiens
gggcctcaggctctg

SEQ ID NO: 5921869 - DNA, 20 bp, Homo sapiens
gggcctcagtgtgcccatct

SEQ ID NO: 5921870 - DNA, 15 bp, Homo sapiens
gggcctcagtttccc

SEQ ID NO: 5921871 - DNA, 18 bp, Homo sapiens
gggcctcagtttccccat

SEQ ID NO: 5921872 - DNA, 16 bp, Homo sapiens
gggcctcatcacagca

SEQ ID NO: 5921873 - DNA, 17 bp, Homo sapiens
gggcctcatctcacctc

SEQ ID NO: 5921874 - DNA, 21 bp, Homo sapiens
gggcctcatcttccccagccc

SEQ ID NO: 5921875 - DNA, 19 bp, Homo sapiens
gggcctccaaccttctgcc

SEQ ID NO: 5921876 - DNA, 22 bp, Homo sapiens
gggcctccaaccttctgccctc

SEQ ID NO: 5921877 - DNA, 14 bp, Homo sapiens
gggcctccagaact

SEQ ID NO: 5921878 - DNA, 19 bp, Homo sapiens
gggcctccagaagctgctc

SEQ ID NO: 5921879 - DNA, 14 bp, Homo sapiens
gggcctccagggcc

SEQ ID NO: 5921880 - DNA, 17 bp, Homo sapiens
gggcctccatgccccag

SEQ ID NO: 5921881 - DNA, 22 bp, Homo sapiens
gggcctcccaccgcagcgtccc

SEQ ID NO: 5921882 - DNA, 13 bp, Homo sapiens
gggcctcccactc

SEQ ID NO: 5921883 - DNA, 15 bp, Homo sapiens
gggcctcccactccc

SEQ ID NO: 5921884 - DNA, 16 bp, Homo sapiens
gggcctcccactccca

SEQ ID NO: 5921885 - DNA, 21 bp, Homo sapiens
gggcctcccactcctgttcct

SEQ ID NO: 5921886 - DNA, 23 bp, Homo sapiens
gggcctcccataattgctttgcc

SEQ ID NO: 5921887 - DNA, 19 bp, Homo sapiens
gggcctcccatagtgctgg

SEQ ID NO: 5921888 - DNA, 19 bp, Homo sapiens
gggcctccccccagcccct

SEQ ID NO: 5921889 - DNA, 16 bp, Homo sapiens
gggcctcccctgggca

SEQ ID NO: 5921890 - DNA, 21 bp, Homo sapiens
gggcctcccgtccgtccgccc

SEQ ID NO: 5921891 - DNA, 12 bp, Homo sapiens
gggcctccctcc

SEQ ID NO: 5921892 - DNA, 19 bp, Homo sapiens
gggcctccctccgagtgag

SEQ ID NO: 5921893 - DNA, 18 bp, Homo sapiens
gggcctccctccttgggt

SEQ ID NO: 5921894 - DNA, 15 bp, Homo sapiens
gggcctccctgttca

SEQ ID NO: 5921895 - DNA, 22 bp, Homo sapiens
gggcctccgcttatcctgctag

SEQ ID NO: 5921896 - DNA, 21 bp, Homo sapiens
gggcctcctcacccaccctgt

SEQ ID NO: 5921897 - DNA, 21 bp, Homo sapiens
gggcctcctcagcctctgcaa

SEQ ID NO: 5921898 - DNA, 23 bp, Homo sapiens
gggcctcctctaacaggggctgg

SEQ ID NO: 5921899 - DNA, 21 bp, Homo sapiens
gggcctcctctgtccagggcc

SEQ ID NO: 5921900 - DNA, 13 bp, Homo sapiens
gggcctcctgcct

SEQ ID NO: 5921901 - DNA, 15 bp, Homo sapiens
gggcctcctgtgtgt

SEQ ID NO: 5921902 - DNA, 22 bp, Homo sapiens
gggcctccttcccatgcctgtc

SEQ ID NO: 5921903 - DNA, 16 bp, Homo sapiens
gggcctccttgtccag

SEQ ID NO: 5921904 - DNA, 18 bp, Homo sapiens
gggcctccttgtccaggt

SEQ ID NO: 5921905 - DNA, 22 bp, Homo sapiens
gggcctcggacttagctgggag

SEQ ID NO: 5921906 - DNA, 21 bp, Homo sapiens
gggcctcggaggctcctccct

SEQ ID NO: 5921907 - DNA, 22 bp, Homo sapiens
gggcctcggaggctcctccctc

SEQ ID NO: 5921908 - DNA, 15 bp, Homo sapiens
gggcctcggcctggc

SEQ ID NO: 5921909 - DNA, 14 bp, Homo sapiens
gggcctcgggacct

SEQ ID NO: 5921910 - DNA, 18 bp, Homo sapiens
gggcctctcctgccctct

SEQ ID NO: 5921911 - DNA, 15 bp, Homo sapiens
gggcctctccttgga

SEQ ID NO: 5921912 - DNA, 21 bp, Homo sapiens
gggcctctctcctgcctgccc

SEQ ID NO: 5921913 - DNA, 14 bp, Homo sapiens
gggcctctctggaa

SEQ ID NO: 5921914 - DNA, 18 bp, Homo sapiens
gggcctctctggaagagg

SEQ ID NO: 5921915 - DNA, 19 bp, Homo sapiens
gggcctctctgggggaggc

SEQ ID NO: 5921916 - DNA, 14 bp, Homo sapiens
gggcctctgaaatt

SEQ ID NO: 5921917 - DNA, 12 bp, Homo sapiens
gggcctctgcct

SEQ ID NO: 5921918 - DNA, 18 bp, Homo sapiens
gggcctctggcttccctg

SEQ ID NO: 5921919 - DNA, 21 bp, Homo sapiens
gggcctctggcttccctgccc

SEQ ID NO: 5921920 - DNA, 22 bp, Homo sapiens
gggcctctggcttccctgccca

SEQ ID NO: 5921921 - DNA, 23 bp, Homo sapiens
gggcctctggcttccctgcccaa

SEQ ID NO: 5921922 - DNA, 23 bp, Homo sapiens
gggcctctggtttggggcgaggc

SEQ ID NO: 5921923 - DNA, 23 bp, Homo sapiens
gggcctctgttcctttctctggg

SEQ ID NO: 5921924 - DNA, 22 bp, Homo sapiens
gggcctgaaagcaacagctgga

SEQ ID NO: 5921925 - DNA, 18 bp, Homo sapiens
gggcctgacaccccctcc

SEQ ID NO: 5921926 - DNA, 23 bp, Homo sapiens
gggcctgacagtgtgggacaggc

SEQ ID NO: 5921927 - DNA, 14 bp, Homo sapiens
gggcctgacctcca

SEQ ID NO: 5921928 - DNA, 17 bp, Homo sapiens
gggcctgactgctcaga

SEQ ID NO: 5921929 - DNA, 20 bp, Homo sapiens
gggcctgagcagtccttggc

SEQ ID NO: 5921930 - DNA, 17 bp, Homo sapiens
gggcctgagccaagcta

SEQ ID NO: 5921931 - DNA, 20 bp, Homo sapiens
gggcctgatggtggggccat

SEQ ID NO: 5921932 - DNA, 24 bp, Homo sapiens
gggcctgcaggacctgcctgtagc

SEQ ID NO: 5921933 - DNA, 16 bp, Homo sapiens
gggcctgcaggcccca

SEQ ID NO: 5921934 - DNA, 20 bp, Homo sapiens
gggcctgcaggccccagcca

SEQ ID NO: 5921935 - DNA, 18 bp, Homo sapiens
gggcctgccacctggacc

SEQ ID NO: 5921936 - DNA, 19 bp, Homo sapiens
gggcctgccacctggaccc

SEQ ID NO: 5921937 - DNA, 18 bp, Homo sapiens
gggcctgccactctcctg

SEQ ID NO: 5921938 - DNA, 12 bp, Homo sapiens
gggcctgcccaa

SEQ ID NO: 5921939 - DNA, 16 bp, Homo sapiens
gggcctgcccagacaa

SEQ ID NO: 5921940 - DNA, 14 bp, Homo sapiens
gggcctgcccagtg

SEQ ID NO: 5921941 - DNA, 11 bp, Homo sapiens
gggcctgcccc

SEQ ID NO: 5921942 - DNA, 14 bp, Homo sapiens
gggcctgccctctg

SEQ ID NO: 5921943 - DNA, 19 bp, Homo sapiens
gggcctgccctctgcccca

SEQ ID NO: 5921944 - DNA, 15 bp, Homo sapiens
gggcctgccgggctg

SEQ ID NO: 5921945 - DNA, 14 bp, Homo sapiens
gggcctgcctcacc

SEQ ID NO: 5921946 - DNA, 15 bp, Homo sapiens
gggcctgcctcacca

SEQ ID NO: 5921947 - DNA, 19 bp, Homo sapiens
gggcctgcctctgactcac

SEQ ID NO: 5921948 - DNA, 19 bp, Homo sapiens
gggcctgcctgcctccacc

SEQ ID NO: 5921949 - DNA, 23 bp, Homo sapiens
gggcctgcctgcctccacccgtc

SEQ ID NO: 5921950 - DNA, 16 bp, Homo sapiens
gggcctgcgagggcag

SEQ ID NO: 5921951 - DNA, 19 bp, Homo sapiens
gggcctgcgccagtcctgc

SEQ ID NO: 5921952 - DNA, 14 bp, Homo sapiens
gggcctgcgcccag

SEQ ID NO: 5921953 - DNA, 20 bp, Homo sapiens
gggcctgcggaggcggtggc

SEQ ID NO: 5921954 - DNA, 21 bp, Homo sapiens
gggcctgcggaggcggtggca

SEQ ID NO: 5921955 - DNA, 17 bp, Homo sapiens
gggcctgctgcgtcaga

SEQ ID NO: 5921956 - DNA, 13 bp, Homo sapiens
gggcctgctgctg

SEQ ID NO: 5921957 - DNA, 19 bp, Homo sapiens
gggcctgctgctgagaacc

SEQ ID NO: 5921958 - DNA, 22 bp, Homo sapiens
gggcctgctgctgagaacctgg

SEQ ID NO: 5921959 - DNA, 23 bp, Homo sapiens
gggcctgctgctgagaacctggc

SEQ ID NO: 5921960 - DNA, 12 bp, Homo sapiens
gggcctgctgga

SEQ ID NO: 5921961 - DNA, 21 bp, Homo sapiens
gggcctgctggaggcctcagg

SEQ ID NO: 5921962 - DNA, 16 bp, Homo sapiens
gggcctggacaaggtc

SEQ ID NO: 5921963 - DNA, 14 bp, Homo sapiens
gggcctggacaggc

SEQ ID NO: 5921964 - DNA, 18 bp, Homo sapiens
gggcctggacaggcgggc

SEQ ID NO: 5921965 - DNA, 21 bp, Homo sapiens
gggcctggactgcacaggcag

SEQ ID NO: 5921966 - DNA, 18 bp, Homo sapiens
gggcctggagcaggcctt

SEQ ID NO: 5921967 - DNA, 16 bp, Homo sapiens
gggcctggagcatgga

SEQ ID NO: 5921968 - DNA, 12 bp, Homo sapiens
gggcctggatgc

SEQ ID NO: 5921969 - DNA, 21 bp, Homo sapiens
gggcctggattcatttcctgc

SEQ ID NO: 5921970 - DNA, 14 bp, Homo sapiens
gggcctggcataga

SEQ ID NO: 5921971 - DNA, 18 bp, Homo sapiens
gggcctggcatagagtag

SEQ ID NO: 5921972 - DNA, 22 bp, Homo sapiens
gggcctggcattcttgtacagt

SEQ ID NO: 5921973 - DNA, 12 bp, Homo sapiens
gggcctggccag

SEQ ID NO: 5921974 - DNA, 19 bp, Homo sapiens
gggcctggccagtcctggt

SEQ ID NO: 5921975 - DNA, 23 bp, Homo sapiens
gggcctggccagtcctggtcctg

SEQ ID NO: 5921976 - DNA, 17 bp, Homo sapiens
gggcctggccagtcttc

SEQ ID NO: 5921977 - DNA, 18 bp, Homo sapiens
gggcctggcccaaagcag

SEQ ID NO: 5921978 - DNA, 12 bp, Homo sapiens
gggcctggccct

SEQ ID NO: 5921979 - DNA, 13 bp, Homo sapiens
gggcctggccctc

SEQ ID NO: 5921980 - DNA, 15 bp, Homo sapiens
gggcctggccctgct

SEQ ID NO: 5921981 - DNA, 13 bp, Homo sapiens
gggcctggcctga

SEQ ID NO: 5921982 - DNA, 15 bp, Homo sapiens
gggcctggcggaggt

SEQ ID NO: 5921983 - DNA, 12 bp, Homo sapiens
gggcctggctca

SEQ ID NO: 5921984 - DNA, 17 bp, Homo sapiens
gggcctggctcaggtgg

SEQ ID NO: 5921985 - DNA, 17 bp, Homo sapiens
gggcctggctccctcac

SEQ ID NO: 5921986 - DNA, 21 bp, Homo sapiens
gggcctggctggctgagggca

SEQ ID NO: 5921987 - DNA, 16 bp, Homo sapiens
gggcctggcttgctcc

SEQ ID NO: 5921988 - DNA, 17 bp, Homo sapiens
gggcctggcttgctcca

SEQ ID NO: 5921989 - DNA, 21 bp, Homo sapiens
gggcctggcttgctccagggt

SEQ ID NO: 5921990 - DNA, 22 bp, Homo sapiens
gggcctggcttgctccagggtc

SEQ ID NO: 5921991 - DNA, 15 bp, Homo sapiens
gggcctgggcctctg

SEQ ID NO: 5921992 - DNA, 17 bp, Homo sapiens
gggcctgggctcctgga

SEQ ID NO: 5921993 - DNA, 14 bp, Homo sapiens
gggcctgggctgtg

SEQ ID NO: 5921994 - DNA, 13 bp, Homo sapiens
gggcctggggagc

SEQ ID NO: 5921995 - DNA, 16 bp, Homo sapiens
gggcctggggcctgag

SEQ ID NO: 5921996 - DNA, 13 bp, Homo sapiens
gggcctggggctc

SEQ ID NO: 5921997 - DNA, 15 bp, Homo sapiens
gggctgaggagcagc

SEQ ID NO: 5921998 - DNA, 18 bp, Homo sapiens
gggctgaggagcagcagg

SEQ ID NO: 5921999 - DNA, 18 bp, Homo sapiens
gggctgaggccagagtca

SEQ ID NO: 5922000 - DNA, 13 bp, Homo sapiens
gggctgagggagc

SEQ ID NO: 5922001 - DNA, 13 bp, Homo sapiens
gggctgagggcct

SEQ ID NO: 5922002 - DNA, 14 bp, Homo sapiens
gggctgagggcctg

SEQ ID NO: 5922003 - DNA, 18 bp, Homo sapiens
gggctgagtctggctagg

SEQ ID NO: 5922004 - DNA, 23 bp, Homo sapiens
gggctgagtgagttcaactacat

SEQ ID NO: 5922005 - DNA, 17 bp, Homo sapiens
gggctgagtgcagccaa

SEQ ID NO: 5922006 - DNA, 16 bp, Homo sapiens
gggctgatctcaggga

SEQ ID NO: 5922007 - DNA, 21 bp, Homo sapiens
gggctgatggcctggctgcct

SEQ ID NO: 5922008 - DNA, 15 bp, Homo sapiens
gggctgatttacatg

SEQ ID NO: 5922009 - DNA, 16 bp, Homo sapiens
gggctgatttacatgt

SEQ ID NO: 5922010 - DNA, 17 bp, Homo sapiens
gggctgatttacatgta

SEQ ID NO: 5922011 - DNA, 14 bp, Homo sapiens
gggctgcaccggct

SEQ ID NO: 5922012 - DNA, 21 bp, Homo sapiens
gggctgcaccggctggcctgg

SEQ ID NO: 5922013 - DNA, 18 bp, Homo sapiens
gggctgcacgctcccctc

SEQ ID NO: 5922014 - DNA, 16 bp, Homo sapiens
gggctgcactctgtgc

SEQ ID NO: 5922015 - DNA, 19 bp, Homo sapiens
gggctgcactctgtgccca

SEQ ID NO: 5922016 - DNA, 20 bp, Homo sapiens
gggctgcactctgtgcccat

SEQ ID NO: 5922017 - DNA, 23 bp, Homo sapiens
gggctgcagagggagacggccct

SEQ ID NO: 5922018 - DNA, 15 bp, Homo sapiens
gggctgcagcagagg

SEQ ID NO: 5922019 - DNA, 22 bp, Homo sapiens
gggctgcagcagaggcctgagg

SEQ ID NO: 5922020 - DNA, 13 bp, Homo sapiens
gggctgcagcagc

SEQ ID NO: 5922021 - DNA, 18 bp, Homo sapiens
gggctgcagcagccggaa

SEQ ID NO: 5922022 - DNA, 21 bp, Homo sapiens
gggctgcagccccctgcttct

SEQ ID NO: 5922023 - DNA, 13 bp, Homo sapiens
gggctgcaggcag

SEQ ID NO: 5922024 - DNA, 12 bp, Homo sapiens
gggctgcaggct

SEQ ID NO: 5922025 - DNA, 14 bp, Homo sapiens
gggctgcagggctg

SEQ ID NO: 5922026 - DNA, 16 bp, Homo sapiens
gggctgcaggtgctgc

SEQ ID NO: 5922027 - DNA, 13 bp, Homo sapiens
gggctgcatcctc

SEQ ID NO: 5922028 - DNA, 17 bp, Homo sapiens
gggctgcatcctcagcc

SEQ ID NO: 5922029 - DNA, 20 bp, Homo sapiens
gggctgcatcctcagcccca

SEQ ID NO: 5922030 - DNA, 21 bp, Homo sapiens
gggctgcatcctcagccccag

SEQ ID NO: 5922031 - DNA, 11 bp, Homo sapiens
gggctgcatga

SEQ ID NO: 5922032 - DNA, 18 bp, Homo sapiens
gggctgcatgcgggcttc

SEQ ID NO: 5922033 - DNA, 14 bp, Homo sapiens
gggctgccagcagc

SEQ ID NO: 5922034 - DNA, 14 bp, Homo sapiens
gggctgccaggaga

SEQ ID NO: 5922035 - DNA, 21 bp, Homo sapiens
gggctgccatagggtctgcag

SEQ ID NO: 5922036 - DNA, 22 bp, Homo sapiens
gggctgcccgctcccagtgtct

SEQ ID NO: 5922037 - DNA, 22 bp, Homo sapiens
gggctgccctcggcaaccgtgg

SEQ ID NO: 5922038 - DNA, 13 bp, Homo sapiens
gggctgccctgag

SEQ ID NO: 5922039 - DNA, 16 bp, Homo sapiens
gggctgccctgagaag

SEQ ID NO: 5922040 - DNA, 13 bp, Homo sapiens
gggctgccctgcc

SEQ ID NO: 5922041 - DNA, 20 bp, Homo sapiens
gggctgcccttcgctgccag

SEQ ID NO: 5922042 - DNA, 20 bp, Homo sapiens
gggctgccggatctgggctg

SEQ ID NO: 5922043 - DNA, 23 bp, Homo sapiens
gggctgcctcctcctgagagctg

SEQ ID NO: 5922044 - DNA, 20 bp, Homo sapiens
gggctgcctgcccctgctgc

SEQ ID NO: 5922045 - DNA, 13 bp, Homo sapiens
gggctgcctgggc

SEQ ID NO: 5922046 - DNA, 14 bp, Homo sapiens
gggctgcctgggct

SEQ ID NO: 5922047 - DNA, 21 bp, Homo sapiens
gggctgcctgggctgttggca

SEQ ID NO: 5922048 - DNA, 14 bp, Homo sapiens
gggctgcctgggga

SEQ ID NO: 5922049 - DNA, 17 bp, Homo sapiens
gggctgcgaccgccaga

SEQ ID NO: 5922050 - DNA, 14 bp, Homo sapiens
gggctgcgctagca

SEQ ID NO: 5922051 - DNA, 19 bp, Homo sapiens
gggctgcgggaggccctgg

SEQ ID NO: 5922052 - DNA, 22 bp, Homo sapiens
gggctgcgggaggccctggccc

SEQ ID NO: 5922053 - DNA, 18 bp, Homo sapiens
gggctgctcatcacccag

SEQ ID NO: 5922054 - DNA, 23 bp, Homo sapiens
gggctgctcatcacccagtcctg

SEQ ID NO: 5922055 - DNA, 17 bp, Homo sapiens
gggctgctccagtgggc

SEQ ID NO: 5922056 - DNA, 18 bp, Homo sapiens
gggctgctcccacctggc

SEQ ID NO: 5922057 - DNA, 22 bp, Homo sapiens
gggctgctcccacctggctctg

SEQ ID NO: 5922058 - DNA, 15 bp, Homo sapiens
gggctgctcctccag

SEQ ID NO: 5922059 - DNA, 18 bp, Homo sapiens
gggctgctcctccagggc

SEQ ID NO: 5922060 - DNA, 19 bp, Homo sapiens
gggctgctcctccagggcc

SEQ ID NO: 5922061 - DNA, 20 bp, Homo sapiens
gggctgctcctgaatgaggc

SEQ ID NO: 5922062 - DNA, 17 bp, Homo sapiens
gggctgctctttccact

SEQ ID NO: 5922063 - DNA, 20 bp, Homo sapiens
gggctgctctttccacttgc

SEQ ID NO: 5922064 - DNA, 12 bp, Homo sapiens
gggctgctgctc

SEQ ID NO: 5922065 - DNA, 17 bp, Homo sapiens
gggctgctgctgggctc

SEQ ID NO: 5922066 - DNA, 14 bp, Homo sapiens
gggctgctgcttct

SEQ ID NO: 5922067 - DNA, 15 bp, Homo sapiens
gggctgctgcttctg

SEQ ID NO: 5922068 - DNA, 21 bp, Homo sapiens
gggctgctgcttctgctccag

SEQ ID NO: 5922069 - DNA, 14 bp, Homo sapiens
gggctgctggcctg

SEQ ID NO: 5922070 - DNA, 14 bp, Homo sapiens
gggctgctgggcgt

SEQ ID NO: 5922071 - DNA, 18 bp, Homo sapiens
gggctgctgggcgtctgt

SEQ ID NO: 5922072 - DNA, 22 bp, Homo sapiens
gggctgctggggcagggcccag

SEQ ID NO: 5922073 - DNA, 14 bp, Homo sapiens
gggctgctgggggc

SEQ ID NO: 5922074 - DNA, 13 bp, Homo sapiens
gggctggaagcag

SEQ ID NO: 5922075 - DNA, 14 bp, Homo sapiens
gggctggaagcaga

SEQ ID NO: 5922076 - DNA, 16 bp, Homo sapiens
gggctggaagcagaaa

SEQ ID NO: 5922077 - DNA, 23 bp, Homo sapiens
gggctggaagcagaaacaaaatg

SEQ ID NO: 5922078 - DNA, 14 bp, Homo sapiens
gggctggactgagg

SEQ ID NO: 5922079 - DNA, 19 bp, Homo sapiens
gggctggactggaggtggg

SEQ ID NO: 5922080 - DNA, 11 bp, Homo sapiens
gggctggagaa

SEQ ID NO: 5922081 - DNA, 14 bp, Homo sapiens
gggctggagaaaga

SEQ ID NO: 5922082 - DNA, 20 bp, Homo sapiens
gggctggagaaagagctgcc

SEQ ID NO: 5922083 - DNA, 12 bp, Homo sapiens
gggctggagagt

SEQ ID NO: 5922084 - DNA, 15 bp, Homo sapiens
gggctggagcctggg

SEQ ID NO: 5922085 - DNA, 18 bp, Homo sapiens
gggctggagctcctccct

SEQ ID NO: 5922086 - DNA, 15 bp, Homo sapiens
gggctggaggagccc

SEQ ID NO: 5922087 - DNA, 16 bp, Homo sapiens
gggctggaggagccca

SEQ ID NO: 5922088 - DNA, 17 bp, Homo sapiens
gggctggaggagcccag

SEQ ID NO: 5922089 - DNA, 14 bp, Homo sapiens
gggctggaggccca

SEQ ID NO: 5922090 - DNA, 15 bp, Homo sapiens
gggctggatgagctc

SEQ ID NO: 5922091 - DNA, 22 bp, Homo sapiens
gggctggatggacagacacctc

SEQ ID NO: 5922092 - DNA, 13 bp, Homo sapiens
gggctggattggc

SEQ ID NO: 5922093 - DNA, 15 bp, Homo sapiens
gggctggcaagcagg

SEQ ID NO: 5922094 - DNA, 16 bp, Homo sapiens
gggctggcaagcaggg

SEQ ID NO: 5922095 - DNA, 15 bp, Homo sapiens
gggctggccagctgt

SEQ ID NO: 5922096 - DNA, 10 bp, Homo sapiens
gggctggccc

SEQ ID NO: 5922097 - DNA, 13 bp, Homo sapiens
gggctggcccagc

SEQ ID NO: 5922098 - DNA, 17 bp, Homo sapiens
gggctggcccagccctg

SEQ ID NO: 5922099 - DNA, 16 bp, Homo sapiens
gggctggcccggggag

SEQ ID NO: 5922100 - DNA, 20 bp, Homo sapiens
gggctggccctaggcactga

SEQ ID NO: 5922101 - DNA, 14 bp, Homo sapiens
gggctggccctgcc

SEQ ID NO: 5922102 - DNA, 15 bp, Homo sapiens
gggctggccctgtgc

SEQ ID NO: 5922103 - DNA, 13 bp, Homo sapiens
gggctggccgctg

SEQ ID NO: 5922104 - DNA, 14 bp, Homo sapiens
gggctggccgctgt

SEQ ID NO: 5922105 - DNA, 22 bp, Homo sapiens
gggctggccgctgtgccaggcg

SEQ ID NO: 5922106 - DNA, 15 bp, Homo sapiens
gggctggccttcctg

SEQ ID NO: 5922107 - DNA, 17 bp, Homo sapiens
gggctggcgggccctgg

SEQ ID NO: 5922108 - DNA, 15 bp, Homo sapiens
gggctggcggggcga

SEQ ID NO: 5922109 - DNA, 10 bp, Homo sapiens
gggctggctc

SEQ ID NO: 5922110 - DNA, 18 bp, Homo sapiens
gggctggctcccagggtg

SEQ ID NO: 5922111 - DNA, 12 bp, Homo sapiens
gggctggctctg

SEQ ID NO: 5922112 - DNA, 18 bp, Homo sapiens
gggctggctctgcactaa

SEQ ID NO: 5922113 - DNA, 20 bp, Homo sapiens
gggctggctgcttgcagcca

SEQ ID NO: 5922114 - DNA, 22 bp, Homo sapiens
gggctggctgcttgcagccagg

SEQ ID NO: 5922115 - DNA, 15 bp, Homo sapiens
gggctggctggagga

SEQ ID NO: 5922116 - DNA, 20 bp, Homo sapiens
gggctggcttttctgtttcc

SEQ ID NO: 5922117 - DNA, 21 bp, Homo sapiens
gggctgggaaacactccttgc

SEQ ID NO: 5922118 - DNA, 22 bp, Homo sapiens
gggctgggaatggggacacggt

SEQ ID NO: 5922119 - DNA, 22 bp, Homo sapiens
gggctgggcaccgtgtcctcct

SEQ ID NO: 5922120 - DNA, 23 bp, Homo sapiens
gggctgggcagaggggagaggaa

SEQ ID NO: 5922121 - DNA, 14 bp, Homo sapiens
gggctgggcagcct

SEQ ID NO: 5922122 - DNA, 13 bp, Homo sapiens
gggctgggcagct

SEQ ID NO: 5922123 - DNA, 18 bp, Homo sapiens
gggctgggcatcccagct

SEQ ID NO: 5922124 - DNA, 17 bp, Homo sapiens
gggctgggccaggtctc

SEQ ID NO: 5922125 - DNA, 18 bp, Homo sapiens
gggctgggccaggtctcc

SEQ ID NO: 5922126 - DNA, 15 bp, Homo sapiens
gggctgggcccacag

SEQ ID NO: 5922127 - DNA, 12 bp, Homo sapiens
gggctgggcccc

SEQ ID NO: 5922128 - DNA, 18 bp, Homo sapiens
gggctgggcccctccagg

SEQ ID NO: 5922129 - DNA, 15 bp, Homo sapiens
gggctgggctcacag

SEQ ID NO: 5922130 - DNA, 20 bp, Homo sapiens
gggctgggctgagcccctgg

SEQ ID NO: 5922131 - DNA, 13 bp, Homo sapiens
gggctggggaggg

SEQ ID NO: 5922132 - DNA, 14 bp, Homo sapiens
gggctggggcaggc

SEQ ID NO: 5922133 - DNA, 18 bp, Homo sapiens
gggctggggcaggggcct

SEQ ID NO: 5922134 - DNA, 19 bp, Homo sapiens
gggctggggcaggggcctg

SEQ ID NO: 5922135 - DNA, 11 bp, Homo sapiens
gggctggggcc

SEQ ID NO: 5922136 - DNA, 19 bp, Homo sapiens
gggctggggccaagaggaa

SEQ ID NO: 5922137 - DNA, 13 bp, Homo sapiens
gggctggggccac

SEQ ID NO: 5922138 - DNA, 15 bp, Homo sapiens
gggctggggccacct

SEQ ID NO: 5922139 - DNA, 16 bp, Homo sapiens
gggctgggggactggg

SEQ ID NO: 5922140 - DNA, 13 bp, Homo sapiens
gggctgggggagg

SEQ ID NO: 5922141 - DNA, 20 bp, Homo sapiens
gggctgggggtgaggggcca

SEQ ID NO: 5922142 - DNA, 22 bp, Homo sapiens
gggctggggtcacagaggcata

SEQ ID NO: 5922143 - DNA, 14 bp, Homo sapiens
gggctggggtcctc

SEQ ID NO: 5922144 - DNA, 20 bp, Homo sapiens
gggctggggtcctcctgtgc

SEQ ID NO: 5922145 - DNA, 18 bp, Homo sapiens
gggctggggttgccagag

SEQ ID NO: 5922146 - DNA, 15 bp, Homo sapiens
gggctgggtcacagg

SEQ ID NO: 5922147 - DNA, 18 bp, Homo sapiens
gggctgggtcacaggaag

SEQ ID NO: 5922148 - DNA, 19 bp, Homo sapiens
gggctgggtcacaggaagg

SEQ ID NO: 5922149 - DNA, 17 bp, Homo sapiens
gggctgggttctaccca

SEQ ID NO: 5922150 - DNA, 17 bp, Homo sapiens
gggctggtcacctccca

SEQ ID NO: 5922151 - DNA, 15 bp, Homo sapiens
gggctggtccttctc

SEQ ID NO: 5922152 - DNA, 22 bp, Homo sapiens
gggctggtgaggccggccctgc

SEQ ID NO: 5922153 - DNA, 15 bp, Homo sapiens
gggctggtgccagcc

SEQ ID NO: 5922154 - DNA, 20 bp, Homo sapiens
gggctggtgccagccttcct

SEQ ID NO: 5922155 - DNA, 17 bp, Homo sapiens
gggctggtgccccacag

SEQ ID NO: 5922156 - DNA, 11 bp, Homo sapiens
gggctggtggg

SEQ ID NO: 5922157 - DNA, 12 bp, Homo sapiens
gggctggtgggt

SEQ ID NO: 5922158 - DNA, 20 bp, Homo sapiens
gggctggtgtcttgagacca

SEQ ID NO: 5922159 - DNA, 21 bp, Homo sapiens
gggctggtgtcttgagaccag

SEQ ID NO: 5922160 - DNA, 14 bp, Homo sapiens
gggctggttctgta

SEQ ID NO: 5922161 - DNA, 18 bp, Homo sapiens
gggctggttgctgtagaa

SEQ ID NO: 5922162 - DNA, 22 bp, Homo sapiens
gggctggtttggtggccaggct

SEQ ID NO: 5922163 - DNA, 15 bp, Homo sapiens
gggctggttttgctt

SEQ ID NO: 5922164 - DNA, 18 bp, Homo sapiens
gggctgtaaaatgcatga

SEQ ID NO: 5922165 - DNA, 24 bp, Homo sapiens
gggctgtccactagaccagtgagc

SEQ ID NO: 5922166 - DNA, 16 bp, Homo sapiens
gggctgtccagcctta

SEQ ID NO: 5922167 - DNA, 19 bp, Homo sapiens
gggctgtccagttcccaga

SEQ ID NO: 5922168 - DNA, 23 bp, Homo sapiens
gggctgtccgtgtgcctcctgtg

SEQ ID NO: 5922169 - DNA, 21 bp, Homo sapiens
gggctgtcctccttcctggga

SEQ ID NO: 5922170 - DNA, 11 bp, Homo sapiens
gggctgtcctg

SEQ ID NO: 5922171 - DNA, 22 bp, Homo sapiens
gggctgtcctgctcacctgtgt

SEQ ID NO: 5922172 - DNA, 16 bp, Homo sapiens
gggctgtcgggggctg

SEQ ID NO: 5922173 - DNA, 21 bp, Homo sapiens
gggctgtcggtgtgctgtcag

SEQ ID NO: 5922174 - DNA, 22 bp, Homo sapiens
gggctgtgagcatcctggcagg

SEQ ID NO: 5922175 - DNA, 21 bp, Homo sapiens
gggctgtgaggacagggcccc

SEQ ID NO: 5922176 - DNA, 23 bp, Homo sapiens
ggggacaccccagaatcccctgg

SEQ ID NO: 5922177 - DNA, 21 bp, Homo sapiens
ggggacactgtggcagcagga

SEQ ID NO: 5922178 - DNA, 22 bp, Homo sapiens
ggggacagaccagcccttcccc

SEQ ID NO: 5922179 - DNA, 14 bp, Homo sapiens
ggggacagagccac

SEQ ID NO: 5922180 - DNA, 13 bp, Homo sapiens
ggggacagaggcc

SEQ ID NO: 5922181 - DNA, 19 bp, Homo sapiens
ggggacagatcttgagcaa

SEQ ID NO: 5922182 - DNA, 13 bp, Homo sapiens
ggggacagattca

SEQ ID NO: 5922183 - DNA, 14 bp, Homo sapiens
ggggacagccttca

SEQ ID NO: 5922184 - DNA, 13 bp, Homo sapiens
ggggacagctgtg

SEQ ID NO: 5922185 - DNA, 15 bp, Homo sapiens
ggggacagcttcctc

SEQ ID NO: 5922186 - DNA, 19 bp, Homo sapiens
ggggacaggcctcacctct

SEQ ID NO: 5922187 - DNA, 14 bp, Homo sapiens
ggggacagggaggg

SEQ ID NO: 5922188 - DNA, 13 bp, Homo sapiens
ggggacagggatg

SEQ ID NO: 5922189 - DNA, 16 bp, Homo sapiens
ggggacagggctggcc

SEQ ID NO: 5922190 - DNA, 22 bp, Homo sapiens
ggggacagggctggcccagccc

SEQ ID NO: 5922191 - DNA, 24 bp, Homo sapiens
ggggacagggctggcccagccctg

SEQ ID NO: 5922192 - DNA, 15 bp, Homo sapiens
ggggacaggtcctca

SEQ ID NO: 5922193 - DNA, 18 bp, Homo sapiens
ggggacataaagcctctg

SEQ ID NO: 5922194 - DNA, 19 bp, Homo sapiens
ggggacatttccctcctgg

SEQ ID NO: 5922195 - DNA, 14 bp, Homo sapiens
ggggaccacagagg

SEQ ID NO: 5922196 - DNA, 15 bp, Homo sapiens
ggggaccactgggcc

SEQ ID NO: 5922197 - DNA, 21 bp, Homo sapiens
ggggaccactgggcccctcag

SEQ ID NO: 5922198 - DNA, 13 bp, Homo sapiens
ggggaccaggagc

SEQ ID NO: 5922199 - DNA, 21 bp, Homo sapiens
ggggaccaggagtgggtgggg

SEQ ID NO: 5922200 - DNA, 22 bp, Homo sapiens
ggggacccaaaccccctgcagc

SEQ ID NO: 5922201 - DNA, 12 bp, Homo sapiens
ggggacccaccc

SEQ ID NO: 5922202 - DNA, 19 bp, Homo sapiens
ggggacccacccagcccct

SEQ ID NO: 5922203 - DNA, 11 bp, Homo sapiens
ggggacccacg

SEQ ID NO: 5922204 - DNA, 15 bp, Homo sapiens
ggggacccagctcct

SEQ ID NO: 5922205 - DNA, 21 bp, Homo sapiens
ggggacccagctcctctgagc

SEQ ID NO: 5922206 - DNA, 13 bp, Homo sapiens
ggggacccagtgc

SEQ ID NO: 5922207 - DNA, 15 bp, Homo sapiens
ggggacccagtgcag

SEQ ID NO: 5922208 - DNA, 21 bp, Homo sapiens
ggggacccagtgcagaatgta

SEQ ID NO: 5922209 - DNA, 16 bp, Homo sapiens
ggggacccatgggggc

SEQ ID NO: 5922210 - DNA, 13 bp, Homo sapiens
ggggaccccaccc

SEQ ID NO: 5922211 - DNA, 15 bp, Homo sapiens
ggggaccccacccct

SEQ ID NO: 5922212 - DNA, 15 bp, Homo sapiens
ggggacccccgcccc

SEQ ID NO: 5922213 - DNA, 13 bp, Homo sapiens
ggggaccctgcct

SEQ ID NO: 5922214 - DNA, 20 bp, Homo sapiens
ggggaccctgggcccatctc

SEQ ID NO: 5922215 - DNA, 16 bp, Homo sapiens
ggggacctcagcctgc

SEQ ID NO: 5922216 - DNA, 17 bp, Homo sapiens
ggggacctgatggagag

SEQ ID NO: 5922217 - DNA, 20 bp, Homo sapiens
ggggaccttttgggggaggg

SEQ ID NO: 5922218 - DNA, 17 bp, Homo sapiens
ggggacgcaggcccctc

SEQ ID NO: 5922219 - DNA, 21 bp, Homo sapiens
ggggacgcaggcccctctcct

SEQ ID NO: 5922220 - DNA, 22 bp, Homo sapiens
ggggacgcaggcccctctcctc

SEQ ID NO: 5922221 - DNA, 15 bp, Homo sapiens
ggggacgcccagccc

SEQ ID NO: 5922222 - DNA, 19 bp, Homo sapiens
ggggacgcccagcccccac

SEQ ID NO: 5922223 - DNA, 23 bp, Homo sapiens
ggggacgcttttgagtgggccct

SEQ ID NO: 5922224 - DNA, 13 bp, Homo sapiens
ggggacggagcac

SEQ ID NO: 5922225 - DNA, 13 bp, Homo sapiens
ggggacggcttct

SEQ ID NO: 5922226 - DNA, 20 bp, Homo sapiens
ggggacgggcaagtgagagg

SEQ ID NO: 5922227 - DNA, 17 bp, Homo sapiens
ggggacgtgggccctgc

SEQ ID NO: 5922228 - DNA, 14 bp, Homo sapiens
ggggactcagccct

SEQ ID NO: 5922229 - DNA, 15 bp, Homo sapiens
ggggactcagccctg

SEQ ID NO: 5922230 - DNA, 18 bp, Homo sapiens
ggggactccggctgtgct

SEQ ID NO: 5922231 - DNA, 13 bp, Homo sapiens
ggggactcctcaa

SEQ ID NO: 5922232 - DNA, 17 bp, Homo sapiens
ggggactccttccttga

SEQ ID NO: 5922233 - DNA, 23 bp, Homo sapiens
ggggactctggcacagtgatgcc

SEQ ID NO: 5922234 - DNA, 14 bp, Homo sapiens
ggggactgagctgg

SEQ ID NO: 5922235 - DNA, 22 bp, Homo sapiens
ggggactgctttcagtgcctgc

SEQ ID NO: 5922236 - DNA, 18 bp, Homo sapiens
ggggactgggggactggg

SEQ ID NO: 5922237 - DNA, 14 bp, Homo sapiens
ggggactgtctttc

SEQ ID NO: 5922238 - DNA, 20 bp, Homo sapiens
ggggactgttccaaagccag

SEQ ID NO: 5922239 - DNA, 22 bp, Homo sapiens
ggggactgttccaaagccagtg

SEQ ID NO: 5922240 - DNA, 21 bp, Homo sapiens
ggggacttctggggacagaca

SEQ ID NO: 5922241 - DNA, 18 bp, Homo sapiens
ggggacttggcctctctc

SEQ ID NO: 5922242 - DNA, 19 bp, Homo sapiens
ggggacttgtaggaatctg

SEQ ID NO: 5922243 - DNA, 11 bp, Homo sapiens
ggggagaaaaa

SEQ ID NO: 5922244 - DNA, 15 bp, Homo sapiens
ggggagaaaattaaa

SEQ ID NO: 5922245 - DNA, 19 bp, Homo sapiens
ggggagaaataaattttgt

SEQ ID NO: 5922246 - DNA, 18 bp, Homo sapiens
ggggagaacccttcctgc

SEQ ID NO: 5922247 - DNA, 17 bp, Homo sapiens
ggggagaagagccctgg

SEQ ID NO: 5922248 - DNA, 17 bp, Homo sapiens
ggggagaagctgaagcc

SEQ ID NO: 5922249 - DNA, 19 bp, Homo sapiens
ggggagaatgcagcccacc

SEQ ID NO: 5922250 - DNA, 17 bp, Homo sapiens
ggggagacacctcagag

SEQ ID NO: 5922251 - DNA, 16 bp, Homo sapiens
ggggagacagttgaga

SEQ ID NO: 5922252 - DNA, 21 bp, Homo sapiens
ggggagacttggggccagcgc

SEQ ID NO: 5922253 - DNA, 11 bp, Homo sapiens
ggggagagaag

SEQ ID NO: 5922254 - DNA, 17 bp, Homo sapiens
ggggagagacaggcagc

SEQ ID NO: 5922255 - DNA, 21 bp, Homo sapiens
ggggagagacaggcagcccag

SEQ ID NO: 5922256 - DNA, 22 bp, Homo sapiens
ggggagagagcccttcccaggg

SEQ ID NO: 5922257 - DNA, 14 bp, Homo sapiens
ggggagagcctgct

SEQ ID NO: 5922258 - DNA, 13 bp, Homo sapiens
ggggagaggaagc

SEQ ID NO: 5922259 - DNA, 16 bp, Homo sapiens
ggggagagggggaggt

SEQ ID NO: 5922260 - DNA, 13 bp, Homo sapiens
ggggagaggtcag

SEQ ID NO: 5922261 - DNA, 23 bp, Homo sapiens
ggggagaggtgattctcagggct

SEQ ID NO: 5922262 - DNA, 17 bp, Homo sapiens
ggggagatggggaggag

SEQ ID NO: 5922263 - DNA, 15 bp, Homo sapiens
ggggagatgggggct

SEQ ID NO: 5922264 - DNA, 14 bp, Homo sapiens
ggggagcaaggctg

SEQ ID NO: 5922265 - DNA, 11 bp, Homo sapiens
ggggagcagag

SEQ ID NO: 5922266 - DNA, 22 bp, Homo sapiens
ggggagcagagtataggatgga

SEQ ID NO: 5922267 - DNA, 18 bp, Homo sapiens
ggggagcaggaggccaat

SEQ ID NO: 5922268 - DNA, 13 bp, Homo sapiens
ggggagcaggcag

SEQ ID NO: 5922269 - DNA, 15 bp, Homo sapiens
ggggagcaggtctct

SEQ ID NO: 5922270 - DNA, 22 bp, Homo sapiens
ggggagcaggtctctggcagag

SEQ ID NO: 5922271 - DNA, 22 bp, Homo sapiens
ggggagcagtggccatcatcct

SEQ ID NO: 5922272 - DNA, 21 bp, Homo sapiens
ggggagcatgcttccctgcag

SEQ ID NO: 5922273 - DNA, 17 bp, Homo sapiens
ggggagccaccagcccc

SEQ ID NO: 5922274 - DNA, 11 bp, Homo sapiens
ggggagccagc

SEQ ID NO: 5922275 - DNA, 14 bp, Homo sapiens
ggggagccagctgc

SEQ ID NO: 5922276 - DNA, 16 bp, Homo sapiens
ggggagccagctgctt

SEQ ID NO: 5922277 - DNA, 23 bp, Homo sapiens
ggggagcccactgaggggccagg

SEQ ID NO: 5922278 - DNA, 12 bp, Homo sapiens
ggggagcccagt

SEQ ID NO: 5922279 - DNA, 22 bp, Homo sapiens
ggggagccccttctgctcagct

SEQ ID NO: 5922280 - DNA, 14 bp, Homo sapiens
ggggagccctcagg

SEQ ID NO: 5922281 - DNA, 13 bp, Homo sapiens
ggggagccctgat

SEQ ID NO: 5922282 - DNA, 22 bp, Homo sapiens
ggggagccgagggcgtcagaga

SEQ ID NO: 5922283 - DNA, 19 bp, Homo sapiens
ggggagcctgtggtggcct

SEQ ID NO: 5922284 - DNA, 19 bp, Homo sapiens
ggggagcgggtctgctccc

SEQ ID NO: 5922285 - DNA, 20 bp, Homo sapiens
ggggagctacagccagcggc

SEQ ID NO: 5922286 - DNA, 11 bp, Homo sapiens
ggggagctggc

SEQ ID NO: 5922287 - DNA, 12 bp, Homo sapiens
ggggagcttggg

SEQ ID NO: 5922288 - DNA, 21 bp, Homo sapiens
ggggagcttgggactcaggtc

SEQ ID NO: 5922289 - DNA, 18 bp, Homo sapiens
ggggaggaaactcacctg

SEQ ID NO: 5922290 - DNA, 11 bp, Homo sapiens
ggggaggaagg

SEQ ID NO: 5922291 - DNA, 20 bp, Homo sapiens
ggggaggaagggccaggaga

SEQ ID NO: 5922292 - DNA, 17 bp, Homo sapiens
ggggaggacccctgccc

SEQ ID NO: 5922293 - DNA, 23 bp, Homo sapiens
ggggaggacctgaccctactccc

SEQ ID NO: 5922294 - DNA, 11 bp, Homo sapiens
ggggaggagac

SEQ ID NO: 5922295 - DNA, 18 bp, Homo sapiens
ggggaggagcacccccag

SEQ ID NO: 5922296 - DNA, 13 bp, Homo sapiens
ggggaggagcctt

SEQ ID NO: 5922297 - DNA, 16 bp, Homo sapiens
ggggaggaggaagccg

SEQ ID NO: 5922298 - DNA, 16 bp, Homo sapiens
ggggaggaggagctgc

SEQ ID NO: 5922299 - DNA, 13 bp, Homo sapiens
ggggaggcagaga

SEQ ID NO: 5922300 - DNA, 14 bp, Homo sapiens
ggggaggcagccgg

SEQ ID NO: 5922301 - DNA, 13 bp, Homo sapiens
ggggaggccaagt

SEQ ID NO: 5922302 - DNA, 19 bp, Homo sapiens
ggggaggccgaggcagggg

SEQ ID NO: 5922303 - DNA, 22 bp, Homo sapiens
ggggaggcggacgttccagccg

SEQ ID NO: 5922304 - DNA, 18 bp, Homo sapiens
ggggaggcggcactccaa

SEQ ID NO: 5922305 - DNA, 14 bp, Homo sapiens
ggggaggctctgaa

SEQ ID NO: 5922306 - DNA, 16 bp, Homo sapiens
ggggaggctgagacgc

SEQ ID NO: 5922307 - DNA, 14 bp, Homo sapiens
ggggaggcttccag

SEQ ID NO: 5922308 - DNA, 18 bp, Homo sapiens
ggggagggaagggagcca

SEQ ID NO: 5922309 - DNA, 18 bp, Homo sapiens
ggggagggactgctgacc

SEQ ID NO: 5922310 - DNA, 12 bp, Homo sapiens
ggggagggaggg

SEQ ID NO: 5922311 - DNA, 15 bp, Homo sapiens
ggggagggcctctgg

SEQ ID NO: 5922312 - DNA, 13 bp, Homo sapiens
ggggaggggaagt

SEQ ID NO: 5922313 - DNA, 14 bp, Homo sapiens
ggggaggggacaga

SEQ ID NO: 5922314 - DNA, 13 bp, Homo sapiens
ggggaggggagag

SEQ ID NO: 5922315 - DNA, 13 bp, Homo sapiens
ggggaggggccct

SEQ ID NO: 5922316 - DNA, 16 bp, Homo sapiens
ggggaggggccctcag

SEQ ID NO: 5922317 - DNA, 20 bp, Homo sapiens
ggggaggggcctagggagcc

SEQ ID NO: 5922318 - DNA, 16 bp, Homo sapiens
ggggaggggcctggcc

SEQ ID NO: 5922319 - DNA, 11 bp, Homo sapiens
ggggaggggga

SEQ ID NO: 5922320 - DNA, 16 bp, Homo sapiens
ggggagggggaagcaa

SEQ ID NO: 5922321 - DNA, 15 bp, Homo sapiens
ggggaggggggaggg

SEQ ID NO: 5922322 - DNA, 18 bp, Homo sapiens
ggggaggggggaggggga

SEQ ID NO: 5922323 - DNA, 23 bp, Homo sapiens
ggggaggggggcgggtgacgccc

SEQ ID NO: 5922324 - DNA, 22 bp, Homo sapiens
ggggaggggttgccacaggcct

SEQ ID NO: 5922325 - DNA, 13 bp, Homo sapiens
ggggagggtaggc

SEQ ID NO: 5922326 - DNA, 22 bp, Homo sapiens
ggggagggtcatgtacttcttt

SEQ ID NO: 5922327 - DNA, 14 bp, Homo sapiens
ggggagggtgacag

SEQ ID NO: 5922328 - DNA, 20 bp, Homo sapiens
ggggagggtgacagtggccg

SEQ ID NO: 5922329 - DNA, 20 bp, Homo sapiens
ggggaggtgaaaagggcaga

SEQ ID NO: 5922330 - DNA, 15 bp, Homo sapiens
ggggaggtggcacta

SEQ ID NO: 5922331 - DNA, 14 bp, Homo sapiens
ggggaggtgggagg

SEQ ID NO: 5922332 - DNA, 19 bp, Homo sapiens
ggggaggtgggaggccagg

SEQ ID NO: 5922333 - DNA, 15 bp, Homo sapiens
ggggaggtgggtgtg

SEQ ID NO: 5922334 - DNA, 15 bp, Homo sapiens
ggggagtcaccttcc

SEQ ID NO: 5922335 - DNA, 22 bp, Homo sapiens
ggggagtcggttagtcattgat

SEQ ID NO: 5922336 - DNA, 21 bp, Homo sapiens
ggggagtctgcttgtcttaga

SEQ ID NO: 5922337 - DNA, 11 bp, Homo sapiens
ggggagtgagc

SEQ ID NO: 5922338 - DNA, 12 bp, Homo sapiens
ggggagtgagct

SEQ ID NO: 5922339 - DNA, 11 bp, Homo sapiens
ggggagtggaa

SEQ ID NO: 5922340 - DNA, 13 bp, Homo sapiens
ggggagtggccac

SEQ ID NO: 5922341 - DNA, 20 bp, Homo sapiens
ggggagtgggacagagtctg

SEQ ID NO: 5922342 - DNA, 22 bp, Homo sapiens
ggggagtggttaggcagcaagc

SEQ ID NO: 5922343 - DNA, 16 bp, Homo sapiens
ggggagttgttatgcc

SEQ ID NO: 5922344 - DNA, 18 bp, Homo sapiens
ggggagttgttatgccat

SEQ ID NO: 5922345 - DNA, 18 bp, Homo sapiens
ggggagtttagggtgggg

SEQ ID NO: 5922346 - DNA, 20 bp, Homo sapiens
ggggataaaatgactactta

SEQ ID NO: 5922347 - DNA, 17 bp, Homo sapiens
ggggataccagctgagt

SEQ ID NO: 5922348 - DNA, 13 bp, Homo sapiens
ggggatagatgtg

SEQ ID NO: 5922349 - DNA, 14 bp, Homo sapiens
ggggatagtctggg

SEQ ID NO: 5922350 - DNA, 17 bp, Homo sapiens
ggggatagtctgggtca

SEQ ID NO: 5922351 - DNA, 22 bp, Homo sapiens
ggggatcagagtctggcctgcc

SEQ ID NO: 5922352 - DNA, 21 bp, Homo sapiens
ggggatccagccacttccccc

SEQ ID NO: 5922353 - DNA, 20 bp, Homo sapiens
ggggatcccccgccccatcc

SEQ ID NO: 5922354 - DNA, 21 bp, Homo sapiens
ggggatccccgcctggccagg

SEQ ID NO: 5922355 - DNA, 23 bp, Homo sapiens
ggggatccccgcctggccaggag

SEQ ID NO: 5922356 - DNA, 21 bp, Homo sapiens
ggggatccctcccccccatgc

SEQ ID NO: 5922357 - DNA, 18 bp, Homo sapiens
ggggatctaaaaggagga

SEQ ID NO: 5922358 - DNA, 16 bp, Homo sapiens
ggggatctgggagggt

SEQ ID NO: 5922359 - DNA, 19 bp, Homo sapiens
ggggatgcaaataaagcct

SEQ ID NO: 5922360 - DNA, 14 bp, Homo sapiens
ggggatgcccctgg

SEQ ID NO: 5922361 - DNA, 15 bp, Homo sapiens
ggggatgcccctggc

SEQ ID NO: 5922362 - DNA, 20 bp, Homo sapiens
ggggatgcccctggccctgc

SEQ ID NO: 5922363 - DNA, 21 bp, Homo sapiens
ggggatgcccctggccctgcc

SEQ ID NO: 5922364 - DNA, 23 bp, Homo sapiens
ggggatggagaatgccagcccaa

SEQ ID NO: 5922365 - DNA, 15 bp, Homo sapiens
ggggatggaggccag

SEQ ID NO: 5922366 - DNA, 17 bp, Homo sapiens
ggggatggaggccagag

SEQ ID NO: 5922367 - DNA, 20 bp, Homo sapiens
ggggatggaggccagagtct

SEQ ID NO: 5922368 - DNA, 24 bp, Homo sapiens
ggggatggaggccagagtctccca

SEQ ID NO: 5922369 - DNA, 18 bp, Homo sapiens
ggggatggagtgagccca

SEQ ID NO: 5922370 - DNA, 13 bp, Homo sapiens
ggggatggatctt

SEQ ID NO: 5922371 - DNA, 14 bp, Homo sapiens
ggggatggcagaca

SEQ ID NO: 5922372 - DNA, 23 bp, Homo sapiens
ggggatgggaaataaagaaaatt

SEQ ID NO: 5922373 - DNA, 15 bp, Homo sapiens
ggggatggggaggga

SEQ ID NO: 5922374 - DNA, 14 bp, Homo sapiens
ggggatgggtgggg

SEQ ID NO: 5922375 - DNA, 17 bp, Homo sapiens
ggggatgggtggggagg

SEQ ID NO: 5922376 - DNA, 13 bp, Homo sapiens
ggggatggtggca

SEQ ID NO: 5922377 - DNA, 16 bp, Homo sapiens
ggggatgtgaagaaat

SEQ ID NO: 5922378 - DNA, 15 bp, Homo sapiens
ggggatgtggagtga

SEQ ID NO: 5922379 - DNA, 15 bp, Homo sapiens
ggggattcaggggct

SEQ ID NO: 5922380 - DNA, 15 bp, Homo sapiens
ggggattcttaaagt

SEQ ID NO: 5922381 - DNA, 23 bp, Homo sapiens
ggggattgcccctggctttgcct

SEQ ID NO: 5922382 - DNA, 18 bp, Homo sapiens
ggggattggagggaagac

SEQ ID NO: 5922383 - DNA, 21 bp, Homo sapiens
ggggatttccagccagggctg

SEQ ID NO: 5922384 - DNA, 21 bp, Homo sapiens
ggggatttcgaagtttgcaac

SEQ ID NO: 5922385 - DNA, 15 bp, Homo sapiens
ggggcaaagcctcct

SEQ ID NO: 5922386 - DNA, 16 bp, Homo sapiens
ggggcaaagctgctgg

SEQ ID NO: 5922387 - DNA, 18 bp, Homo sapiens
ggggcaacgattcacagc

SEQ ID NO: 5922388 - DNA, 22 bp, Homo sapiens
ggggcaagaagatcacgctccc

SEQ ID NO: 5922389 - DNA, 22 bp, Homo sapiens
ggggcaagacagaaaagtgcct

SEQ ID NO: 5922390 - DNA, 23 bp, Homo sapiens
ggggcaagagctcaggagaaggc

SEQ ID NO: 5922391 - DNA, 16 bp, Homo sapiens
ggggcaagccagggcc

SEQ ID NO: 5922392 - DNA, 20 bp, Homo sapiens
ggggcaagccagggcccaga

SEQ ID NO: 5922393 - DNA, 16 bp, Homo sapiens
ggggcaaggagaaagc

SEQ ID NO: 5922394 - DNA, 14 bp, Homo sapiens
ggggcaaggtctcc

SEQ ID NO: 5922395 - DNA, 18 bp, Homo sapiens
ggggcaaggtctccttac

SEQ ID NO: 5922396 - DNA, 22 bp, Homo sapiens
ggggcaaggtgggggagcctgg

SEQ ID NO: 5922397 - DNA, 16 bp, Homo sapiens
ggggcaatggggagag

SEQ ID NO: 5922398 - DNA, 15 bp, Homo sapiens
ggggcacaccactgc

SEQ ID NO: 5922399 - DNA, 19 bp, Homo sapiens
ggggcacaccactgccctg

SEQ ID NO: 5922400 - DNA, 22 bp, Homo sapiens
ggggcacaccactgccctgcct

SEQ ID NO: 5922401 - DNA, 22 bp, Homo sapiens
ggggcacagacctctcccaccc

SEQ ID NO: 5922402 - DNA, 14 bp, Homo sapiens
ggggcacagccaga

SEQ ID NO: 5922403 - DNA, 13 bp, Homo sapiens
ggggcacagggag

SEQ ID NO: 5922404 - DNA, 17 bp, Homo sapiens
ggggcacagtccaggaa

SEQ ID NO: 5922405 - DNA, 21 bp, Homo sapiens
ggggcaccggctcaggagagg

SEQ ID NO: 5922406 - DNA, 23 bp, Homo sapiens
ggggcacctctcttgaaccccaa

SEQ ID NO: 5922407 - DNA, 20 bp, Homo sapiens
ggggcaccttccgacatccc

SEQ ID NO: 5922408 - DNA, 19 bp, Homo sapiens
ggggcacggactgtccacc

SEQ ID NO: 5922409 - DNA, 15 bp, Homo sapiens
ggggcacggctctgg

SEQ ID NO: 5922410 - DNA, 17 bp, Homo sapiens
ggggcactagaagatga

SEQ ID NO: 5922411 - DNA, 15 bp, Homo sapiens
ggggcactcagccac

SEQ ID NO: 5922412 - DNA, 15 bp, Homo sapiens
ggggcactgaccagg

SEQ ID NO: 5922413 - DNA, 17 bp, Homo sapiens
ggggcactgcaggggcc

SEQ ID NO: 5922414 - DNA, 19 bp, Homo sapiens
ggggcactgtggtcaggcc

SEQ ID NO: 5922415 - DNA, 21 bp, Homo sapiens
ggggcagacaataaaccctca

SEQ ID NO: 5922416 - DNA, 14 bp, Homo sapiens
ggggcagagaggaa

SEQ ID NO: 5922417 - DNA, 13 bp, Homo sapiens
ggggcagagctga

SEQ ID NO: 5922418 - DNA, 15 bp, Homo sapiens
ggggcagagcttctc

SEQ ID NO: 5922419 - DNA, 22 bp, Homo sapiens
ggggcagagcttctcctgacca

SEQ ID NO: 5922420 - DNA, 17 bp, Homo sapiens
ggggcagaggcagtacc

SEQ ID NO: 5922421 - DNA, 21 bp, Homo sapiens
ggggcagagtggagcccaggg

SEQ ID NO: 5922422 - DNA, 20 bp, Homo sapiens
ggggcagatcttggactcat

SEQ ID NO: 5922423 - DNA, 16 bp, Homo sapiens
ggggcagcagcagtgg

SEQ ID NO: 5922424 - DNA, 12 bp, Homo sapiens
ggggcagcaggg

SEQ ID NO: 5922425 - DNA, 20 bp, Homo sapiens
ggggcagcagttgaggtggg

SEQ ID NO: 5922426 - DNA, 17 bp, Homo sapiens
ggggcagccagccctgg

SEQ ID NO: 5922427 - DNA, 12 bp, Homo sapiens
ggggcagccctg

SEQ ID NO: 5922428 - DNA, 15 bp, Homo sapiens
ggggcagcccttgct

SEQ ID NO: 5922429 - DNA, 12 bp, Homo sapiens
ggggcagcctcc

SEQ ID NO: 5922430 - DNA, 20 bp, Homo sapiens
ggggcagcctccagtctgct

SEQ ID NO: 5922431 - DNA, 17 bp, Homo sapiens
ggggcagcctgcgtggc

SEQ ID NO: 5922432 - DNA, 17 bp, Homo sapiens
ggggcagcggggctggc

SEQ ID NO: 5922433 - DNA, 12 bp, Homo sapiens
ggggcagctcct

SEQ ID NO: 5922434 - DNA, 14 bp, Homo sapiens
ggggcagctcctga

SEQ ID NO: 5922435 - DNA, 17 bp, Homo sapiens
ggggcagctcctgacca

SEQ ID NO: 5922436 - DNA, 19 bp, Homo sapiens
ggggcagctcctgaccaaa

SEQ ID NO: 5922437 - DNA, 20 bp, Homo sapiens
ggggcaggaaagccacatct

SEQ ID NO: 5922438 - DNA, 22 bp, Homo sapiens
ggggcaggaatcaaggagcctc

SEQ ID NO: 5922439 - DNA, 13 bp, Homo sapiens
ggggcaggactga

SEQ ID NO: 5922440 - DNA, 18 bp, Homo sapiens
ggggcaggaggcctggcc

SEQ ID NO: 5922441 - DNA, 19 bp, Homo sapiens
ggggcaggaggcctggcct

SEQ ID NO: 5922442 - DNA, 17 bp, Homo sapiens
ggggcaggagtagctga

SEQ ID NO: 5922443 - DNA, 21 bp, Homo sapiens
ggggcaggagtagctgagctc

SEQ ID NO: 5922444 - DNA, 16 bp, Homo sapiens
ggggcaggagtgccag

SEQ ID NO: 5922445 - DNA, 19 bp, Homo sapiens
ggggcaggagtgccaggac

SEQ ID NO: 5922446 - DNA, 21 bp, Homo sapiens
ggggcaggagtgccaggacca

SEQ ID NO: 5922447 - DNA, 13 bp, Homo sapiens
ggggcaggcacag

SEQ ID NO: 5922448 - DNA, 15 bp, Homo sapiens
ggggcaggcacagca

SEQ ID NO: 5922449 - DNA, 13 bp, Homo sapiens
ggggcaggcaggg

SEQ ID NO: 5922450 - DNA, 13 bp, Homo sapiens
ggggcaggccagc

SEQ ID NO: 5922451 - DNA, 13 bp, Homo sapiens
ggggcaggccctg

SEQ ID NO: 5922452 - DNA, 15 bp, Homo sapiens
ggggcaggccctgca

SEQ ID NO: 5922453 - DNA, 12 bp, Homo sapiens
ggggcaggcctc

SEQ ID NO: 5922454 - DNA, 19 bp, Homo sapiens
ggggcaggcctcccaagct

SEQ ID NO: 5922455 - DNA, 16 bp, Homo sapiens
ggggcaggcctgggac

SEQ ID NO: 5922456 - DNA, 21 bp, Homo sapiens
ggggcaggcctttttgagcca

SEQ ID NO: 5922457 - DNA, 12 bp, Homo sapiens
ggggcaggctga

SEQ ID NO: 5922458 - DNA, 21 bp, Homo sapiens
ggggcagggaaggggaggcag

SEQ ID NO: 5922459 - DNA, 22 bp, Homo sapiens
ggggcagggcccagggaggtgg

SEQ ID NO: 5922460 - DNA, 14 bp, Homo sapiens
ggggcagggccttc

SEQ ID NO: 5922461 - DNA, 18 bp, Homo sapiens
ggggcaggggcctgggcc

SEQ ID NO: 5922462 - DNA, 22 bp, Homo sapiens
ggggcagtatgtgatggactgg

SEQ ID NO: 5922463 - DNA, 15 bp, Homo sapiens
ggggcagtctgagag

SEQ ID NO: 5922464 - DNA, 18 bp, Homo sapiens
ggggcagtctgagagagg

SEQ ID NO: 5922465 - DNA, 20 bp, Homo sapiens
ggggcagtgctcacccacac

SEQ ID NO: 5922466 - DNA, 21 bp, Homo sapiens
ggggcagtgcttggcccagga

SEQ ID NO: 5922467 - DNA, 23 bp, Homo sapiens
ggggcagtgcttggcccaggagt

SEQ ID NO: 5922468 - DNA, 20 bp, Homo sapiens
ggggcagtggcctggatgca

SEQ ID NO: 5922469 - DNA, 20 bp, Homo sapiens
ggggcagttttagcagcact

SEQ ID NO: 5922470 - DNA, 15 bp, Homo sapiens
ggggcatagaaactg

SEQ ID NO: 5922471 - DNA, 19 bp, Homo sapiens
ggggcatcctgcttcctga

SEQ ID NO: 5922472 - DNA, 23 bp, Homo sapiens
ggggcatctgtctgtctgtgggc

SEQ ID NO: 5922473 - DNA, 15 bp, Homo sapiens
ggggcatgaccagat

SEQ ID NO: 5922474 - DNA, 18 bp, Homo sapiens
ggggcatggacagggcca

SEQ ID NO: 5922475 - DNA, 20 bp, Homo sapiens
ggggcatgtgtgcctgtggc

SEQ ID NO: 5922476 - DNA, 19 bp, Homo sapiens
ggggcattgagtattgttt

SEQ ID NO: 5922477 - DNA, 21 bp, Homo sapiens
ggggcattgctgactgtgtat

SEQ ID NO: 5922478 - DNA, 17 bp, Homo sapiens
ggggccaacctcaggct

SEQ ID NO: 5922479 - DNA, 18 bp, Homo sapiens
ggggccaagagtcacttc

SEQ ID NO: 5922480 - DNA, 16 bp, Homo sapiens
ggggccacacagaaac

SEQ ID NO: 5922481 - DNA, 18 bp, Homo sapiens
ggggccaccatgacccct

SEQ ID NO: 5922482 - DNA, 14 bp, Homo sapiens
ggggccactgtgtt

SEQ ID NO: 5922483 - DNA, 23 bp, Homo sapiens
ggggccactgtgtttctgtgctc

SEQ ID NO: 5922484 - DNA, 19 bp, Homo sapiens
ggggccagaccacgcccct

SEQ ID NO: 5922485 - DNA, 13 bp, Homo sapiens
ggggccagactgg

SEQ ID NO: 5922486 - DNA, 16 bp, Homo sapiens
ggggccagagagcagg

SEQ ID NO: 5922487 - DNA, 23 bp, Homo sapiens
ggggccagaggaactgtccagag

SEQ ID NO: 5922488 - DNA, 12 bp, Homo sapiens
ggggccagaggc

SEQ ID NO: 5922489 - DNA, 14 bp, Homo sapiens
ggggccagagggac

SEQ ID NO: 5922490 - DNA, 19 bp, Homo sapiens
ggggccagatccagcctgg

SEQ ID NO: 5922491 - DNA, 11 bp, Homo sapiens
ggggccagccc

SEQ ID NO: 5922492 - DNA, 16 bp, Homo sapiens
ggggccagcccctccc

SEQ ID NO: 5922493 - DNA, 22 bp, Homo sapiens
ggggccagcgcttctggtctgg

SEQ ID NO: 5922494 - DNA, 23 bp, Homo sapiens
ggggccagcggccctcccaggcg

SEQ ID NO: 5922495 - DNA, 18 bp, Homo sapiens
ggggccagctccaggagg

SEQ ID NO: 5922496 - DNA, 22 bp, Homo sapiens
ggggccagctccaggagggctt

SEQ ID NO: 5922497 - DNA, 16 bp, Homo sapiens
ggggccagctggggag

SEQ ID NO: 5922498 - DNA, 17 bp, Homo sapiens
ggggccagctggtgctg

SEQ ID NO: 5922499 - DNA, 21 bp, Homo sapiens
ggggccaggaaggggacagga

SEQ ID NO: 5922500 - DNA, 12 bp, Homo sapiens
ggggccaggagc

SEQ ID NO: 5922501 - DNA, 15 bp, Homo sapiens
ggggccaggccagga

SEQ ID NO: 5922502 - DNA, 16 bp, Homo sapiens
ggggccaggccaggac

SEQ ID NO: 5922503 - DNA, 13 bp, Homo sapiens
ggggccaggcccc

SEQ ID NO: 5922504 - DNA, 13 bp, Homo sapiens
ggggccaggctgg

SEQ ID NO: 5922505 - DNA, 16 bp, Homo sapiens
ggggccaggctgggtc

SEQ ID NO: 5922506 - DNA, 11 bp, Homo sapiens
ggggccagggc

SEQ ID NO: 5922507 - DNA, 12 bp, Homo sapiens
ggggccagggca

SEQ ID NO: 5922508 - DNA, 14 bp, Homo sapiens
ggggccagggctgg

SEQ ID NO: 5922509 - DNA, 16 bp, Homo sapiens
ggggccaggggcaggc

SEQ ID NO: 5922510 - DNA, 21 bp, Homo sapiens
ggggccataaacggttcctgg

SEQ ID NO: 5922511 - DNA, 22 bp, Homo sapiens
ggggccataaacggttcctggt

SEQ ID NO: 5922512 - DNA, 19 bp, Homo sapiens
ggggccatcacaggatgcc

SEQ ID NO: 5922513 - DNA, 22 bp, Homo sapiens
ggggccatgagctccagacccc

SEQ ID NO: 5922514 - DNA, 22 bp, Homo sapiens
ggggccatgccccacccccctc

SEQ ID NO: 5922515 - DNA, 14 bp, Homo sapiens
ggggccatgcctcc

SEQ ID NO: 5922516 - DNA, 15 bp, Homo sapiens
ggggccatgctgaga

SEQ ID NO: 5922517 - DNA, 13 bp, Homo sapiens
ggggccatgggtg

SEQ ID NO: 5922518 - DNA, 18 bp, Homo sapiens
ggggccatttggccggct

SEQ ID NO: 5922519 - DNA, 16 bp, Homo sapiens
ggggcccaagagagac

SEQ ID NO: 5922520 - DNA, 13 bp, Homo sapiens
ggggcccaagtgg

SEQ ID NO: 5922521 - DNA, 22 bp, Homo sapiens
ggggcccacagacagatcccat

SEQ ID NO: 5922522 - DNA, 20 bp, Homo sapiens
ggggcccaggagaccacggg

SEQ ID NO: 5922523 - DNA, 19 bp, Homo sapiens
ggggcccaggctcccctgc

SEQ ID NO: 5922524 - DNA, 12 bp, Homo sapiens
ggggcccagtgc

SEQ ID NO: 5922525 - DNA, 21 bp, Homo sapiens
ggggcccatggaggagacagg

SEQ ID NO: 5922526 - DNA, 15 bp, Homo sapiens
ggggcccatggcccc

SEQ ID NO: 5922527 - DNA, 17 bp, Homo sapiens
ggggcccatggccccag

SEQ ID NO: 5922528 - DNA, 12 bp, Homo sapiens
ggggccccaaag

SEQ ID NO: 5922529 - DNA, 20 bp, Homo sapiens
ggggccccagatctgcctgg

SEQ ID NO: 5922530 - DNA, 16 bp, Homo sapiens
ggggccccagtcagcc

SEQ ID NO: 5922531 - DNA, 18 bp, Homo sapiens
ggggcccccagcaccctc

SEQ ID NO: 5922532 - DNA, 15 bp, Homo sapiens
ggggccccgccaggg

SEQ ID NO: 5922533 - DNA, 16 bp, Homo sapiens
ggggccccggggctgg

SEQ ID NO: 5922534 - DNA, 14 bp, Homo sapiens
gggggtagagctga

SEQ ID NO: 5922535 - DNA, 15 bp, Homo sapiens
gggggtagagctgat

SEQ ID NO: 5922536 - DNA, 21 bp, Homo sapiens
gggggtaggagagcactgcct

SEQ ID NO: 5922537 - DNA, 18 bp, Homo sapiens
gggggtcccaggatcccc

SEQ ID NO: 5922538 - DNA, 13 bp, Homo sapiens
gggggtcctctct

SEQ ID NO: 5922539 - DNA, 23 bp, Homo sapiens
gggggtcctctctgagtcaaatc

SEQ ID NO: 5922540 - DNA, 15 bp, Homo sapiens
gggggtcggaagcct

SEQ ID NO: 5922541 - DNA, 20 bp, Homo sapiens
gggggtctatacattcctga

SEQ ID NO: 5922542 - DNA, 18 bp, Homo sapiens
gggggtctcacccatgca

SEQ ID NO: 5922543 - DNA, 16 bp, Homo sapiens
gggggtgagaggcagg

SEQ ID NO: 5922544 - DNA, 12 bp, Homo sapiens
gggggtgagcga

SEQ ID NO: 5922545 - DNA, 19 bp, Homo sapiens
gggggtgagcgaagccccc

SEQ ID NO: 5922546 - DNA, 20 bp, Homo sapiens
gggggtgatgagggcagcag

SEQ ID NO: 5922547 - DNA, 14 bp, Homo sapiens
gggggtgcggcagg

SEQ ID NO: 5922548 - DNA, 15 bp, Homo sapiens
gggggtgctgctctc

SEQ ID NO: 5922549 - DNA, 12 bp, Homo sapiens
gggggtggcagg

SEQ ID NO: 5922550 - DNA, 13 bp, Homo sapiens
gggggtggccagg

SEQ ID NO: 5922551 - DNA, 20 bp, Homo sapiens
gggggtggccaggccgggaa

SEQ ID NO: 5922552 - DNA, 15 bp, Homo sapiens
gggggtgtcagaagc

SEQ ID NO: 5922553 - DNA, 21 bp, Homo sapiens
gggggtgtcttccctgcctgt

SEQ ID NO: 5922554 - DNA, 14 bp, Homo sapiens
gggggtgtggcagg

SEQ ID NO: 5922555 - DNA, 20 bp, Homo sapiens
gggggtgtggctctgccctg

SEQ ID NO: 5922556 - DNA, 19 bp, Homo sapiens
gggggttccgtgtccaccc

SEQ ID NO: 5922557 - DNA, 15 bp, Homo sapiens
gggggttctggcagg

SEQ ID NO: 5922558 - DNA, 19 bp, Homo sapiens
gggggttgcagtggagagg

SEQ ID NO: 5922559 - DNA, 17 bp, Homo sapiens
gggggtttgagccctgg

SEQ ID NO: 5922560 - DNA, 23 bp, Homo sapiens
ggggtaaagcagttcctgtccca

SEQ ID NO: 5922561 - DNA, 18 bp, Homo sapiens
ggggtaagccagagcctg

SEQ ID NO: 5922562 - DNA, 21 bp, Homo sapiens
ggggtacagcccttgcactcc

SEQ ID NO: 5922563 - DNA, 19 bp, Homo sapiens
ggggtacaggtttggggag

SEQ ID NO: 5922564 - DNA, 20 bp, Homo sapiens
ggggtacatttctctgagca

SEQ ID NO: 5922565 - DNA, 13 bp, Homo sapiens
ggggtaccacatg

SEQ ID NO: 5922566 - DNA, 19 bp, Homo sapiens
ggggtagaccttgagggtg

SEQ ID NO: 5922567 - DNA, 20 bp, Homo sapiens
ggggtagaccttgagggtgg

SEQ ID NO: 5922568 - DNA, 16 bp, Homo sapiens
ggggtagagaggacag

SEQ ID NO: 5922569 - DNA, 18 bp, Homo sapiens
ggggtagctagaggaacc

SEQ ID NO: 5922570 - DNA, 22 bp, Homo sapiens
ggggtagctagcgtgtgccagg

SEQ ID NO: 5922571 - DNA, 15 bp, Homo sapiens
ggggtaggctgctgc

SEQ ID NO: 5922572 - DNA, 15 bp, Homo sapiens
ggggtagttggcaga

SEQ ID NO: 5922573 - DNA, 22 bp, Homo sapiens
ggggtatacagcattgactcag

SEQ ID NO: 5922574 - DNA, 15 bp, Homo sapiens
ggggtataggtctca

SEQ ID NO: 5922575 - DNA, 22 bp, Homo sapiens
ggggtatataaattggggtgat

SEQ ID NO: 5922576 - DNA, 22 bp, Homo sapiens
ggggtatttaccacagcagctg

SEQ ID NO: 5922577 - DNA, 20 bp, Homo sapiens
ggggtatttcaattaccttc

SEQ ID NO: 5922578 - DNA, 19 bp, Homo sapiens
ggggtattttctaattttt

SEQ ID NO: 5922579 - DNA, 17 bp, Homo sapiens
ggggtcaaagcaaggat

SEQ ID NO: 5922580 - DNA, 18 bp, Homo sapiens
ggggtcaagctgagctgg

SEQ ID NO: 5922581 - DNA, 15 bp, Homo sapiens
ggggtcacagaggca

SEQ ID NO: 5922582 - DNA, 16 bp, Homo sapiens
ggggtcacaggcccag

SEQ ID NO: 5922583 - DNA, 18 bp, Homo sapiens
ggggtcacaggcccagaa

SEQ ID NO: 5922584 - DNA, 22 bp, Homo sapiens
ggggtcactcaattctgcagta

SEQ ID NO: 5922585 - DNA, 21 bp, Homo sapiens
ggggtcactctggcagctcag

SEQ ID NO: 5922586 - DNA, 18 bp, Homo sapiens
ggggtcagagcactccct

SEQ ID NO: 5922587 - DNA, 12 bp, Homo sapiens
ggggtcagcagg

SEQ ID NO: 5922588 - DNA, 14 bp, Homo sapiens
ggggtcagcaggcc

SEQ ID NO: 5922589 - DNA, 15 bp, Homo sapiens
ggggtcagcaggccc

SEQ ID NO: 5922590 - DNA, 22 bp, Homo sapiens
ggggtcaggccgggcagagcac

SEQ ID NO: 5922591 - DNA, 15 bp, Homo sapiens
ggggtcaggctccat

SEQ ID NO: 5922592 - DNA, 23 bp, Homo sapiens
ggggtcaggtgtcaggcccgtcg

SEQ ID NO: 5922593 - DNA, 17 bp, Homo sapiens
ggggtcagttgggcccc

SEQ ID NO: 5922594 - DNA, 15 bp, Homo sapiens
ggggtcatccttgcc

SEQ ID NO: 5922595 - DNA, 21 bp, Homo sapiens
ggggtcatgccctcctctccc

SEQ ID NO: 5922596 - DNA, 12 bp, Homo sapiens
ggggtccaccag

SEQ ID NO: 5922597 - DNA, 22 bp, Homo sapiens
ggggtccaccagtgtgtggggg

SEQ ID NO: 5922598 - DNA, 15 bp, Homo sapiens
ggggtccatttgggt

SEQ ID NO: 5922599 - DNA, 12 bp, Homo sapiens
ggggtcccagga

SEQ ID NO: 5922600 - DNA, 15 bp, Homo sapiens
ggggtcccaggacct

SEQ ID NO: 5922601 - DNA, 23 bp, Homo sapiens
ggggtcccaggacctgagcctgg

SEQ ID NO: 5922602 - DNA, 18 bp, Homo sapiens
ggggtcccccctccctgt

SEQ ID NO: 5922603 - DNA, 15 bp, Homo sapiens
ggggtccccggacgc

SEQ ID NO: 5922604 - DNA, 13 bp, Homo sapiens
ggggtcccctctg

SEQ ID NO: 5922605 - DNA, 16 bp, Homo sapiens
ggggtccctagcagcc

SEQ ID NO: 5922606 - DNA, 17 bp, Homo sapiens
ggggtccctcaggttcc

SEQ ID NO: 5922607 - DNA, 12 bp, Homo sapiens
ggggtccctgca

SEQ ID NO: 5922608 - DNA, 22 bp, Homo sapiens
ggggtccgtcttcacactgcgc

SEQ ID NO: 5922609 - DNA, 20 bp, Homo sapiens
ggggtcctcctcgctcctcc

SEQ ID NO: 5922610 - DNA, 12 bp, Homo sapiens
ggggtcctgcag

SEQ ID NO: 5922611 - DNA, 13 bp, Homo sapiens
ggggtcctggcca

SEQ ID NO: 5922612 - DNA, 17 bp, Homo sapiens
ggggtcctgggaggctg

SEQ ID NO: 5922613 - DNA, 22 bp, Homo sapiens
ggggtccttcaagttagctcag

SEQ ID NO: 5922614 - DNA, 12 bp, Homo sapiens
ggggtccttgga

SEQ ID NO: 5922615 - DNA, 18 bp, Homo sapiens
ggggtcgtggagagctag

SEQ ID NO: 5922616 - DNA, 15 bp, Homo sapiens
ggggtctatacattc

SEQ ID NO: 5922617 - DNA, 17 bp, Homo sapiens
ggggtctatacattcct

SEQ ID NO: 5922618 - DNA, 12 bp, Homo sapiens
ggggtctcagca

SEQ ID NO: 5922619 - DNA, 21 bp, Homo sapiens
ggggtctcagtccagtcctca

SEQ ID NO: 5922620 - DNA, 13 bp, Homo sapiens
ggggtctcatgtc

SEQ ID NO: 5922621 - DNA, 21 bp, Homo sapiens
ggggtctcatgtcctgctggc

SEQ ID NO: 5922622 - DNA, 22 bp, Homo sapiens
ggggtctccacctcaggggaga

SEQ ID NO: 5922623 - DNA, 20 bp, Homo sapiens
ggggtctccctctcctgcct

SEQ ID NO: 5922624 - DNA, 19 bp, Homo sapiens
ggggtctccctgagcctgc

SEQ ID NO: 5922625 - DNA, 13 bp, Homo sapiens
ggggtctccctgg

SEQ ID NO: 5922626 - DNA, 16 bp, Homo sapiens
ggggtctcctggacct

SEQ ID NO: 5922627 - DNA, 17 bp, Homo sapiens
ggggtctctcacagaca

SEQ ID NO: 5922628 - DNA, 23 bp, Homo sapiens
ggggtctctcacagacaggaccc

SEQ ID NO: 5922629 - DNA, 20 bp, Homo sapiens
ggggtctctgcatcttcagt

SEQ ID NO: 5922630 - DNA, 20 bp, Homo sapiens
ggggtctggagttgatctgg

SEQ ID NO: 5922631 - DNA, 13 bp, Homo sapiens
ggggtctggctgg

SEQ ID NO: 5922632 - DNA, 16 bp, Homo sapiens
ggggtctggctggtgt

SEQ ID NO: 5922633 - DNA, 21 bp, Homo sapiens
ggggtctggctggtgttaaca

SEQ ID NO: 5922634 - DNA, 12 bp, Homo sapiens
ggggtctgggag

SEQ ID NO: 5922635 - DNA, 22 bp, Homo sapiens
ggggtctgggagtcaggcccgg

SEQ ID NO: 5922636 - DNA, 14 bp, Homo sapiens
ggggtctgtgctgt

SEQ ID NO: 5922637 - DNA, 20 bp, Homo sapiens
ggggtgaacagctggtgcca

SEQ ID NO: 5922638 - DNA, 23 bp, Homo sapiens
ggggtgacccggcaccccctgca

SEQ ID NO: 5922639 - DNA, 18 bp, Homo sapiens
ggggtgacctccggccag

SEQ ID NO: 5922640 - DNA, 21 bp, Homo sapiens
ggggtgagacagtgggggtgc

SEQ ID NO: 5922641 - DNA, 14 bp, Homo sapiens
ggggtgaggagctg

SEQ ID NO: 5922642 - DNA, 13 bp, Homo sapiens
ggggtgagggagt

SEQ ID NO: 5922643 - DNA, 14 bp, Homo sapiens
ggggtgagtcccct

SEQ ID NO: 5922644 - DNA, 22 bp, Homo sapiens
ggggtgatagaacaagaccctg

SEQ ID NO: 5922645 - DNA, 17 bp, Homo sapiens
ggggtgatcctgttctg

SEQ ID NO: 5922646 - DNA, 17 bp, Homo sapiens
ggggtgatgagggcagc

SEQ ID NO: 5922647 - DNA, 17 bp, Homo sapiens
ggggtgatggccagagg

SEQ ID NO: 5922648 - DNA, 17 bp, Homo sapiens
ggggtgatttcagagag

SEQ ID NO: 5922649 - DNA, 22 bp, Homo sapiens
ggggtgcacagtccacagctga

SEQ ID NO: 5922650 - DNA, 13 bp, Homo sapiens
ggggtgcagggat

SEQ ID NO: 5922651 - DNA, 18 bp, Homo sapiens
ggggtgcagggatgtggg

SEQ ID NO: 5922652 - DNA, 22 bp, Homo sapiens
ggggtgcatcccccagcactga

SEQ ID NO: 5922653 - DNA, 19 bp, Homo sapiens
ggggtgccatggtgttgga

SEQ ID NO: 5922654 - DNA, 16 bp, Homo sapiens
ggggtgcccacaggcc

SEQ ID NO: 5922655 - DNA, 23 bp, Homo sapiens
ggggtgccccctcctctcccatc

SEQ ID NO: 5922656 - DNA, 18 bp, Homo sapiens
ggggtgcccgtgtggcct

SEQ ID NO: 5922657 - DNA, 20 bp, Homo sapiens
ggggtgcccgtgtggcctgg

SEQ ID NO: 5922658 - DNA, 16 bp, Homo sapiens
ggggtgccgctctctc

SEQ ID NO: 5922659 - DNA, 22 bp, Homo sapiens
ggggtgcctggtgcgctgtgct

SEQ ID NO: 5922660 - DNA, 22 bp, Homo sapiens
ggggtgcgctcacctgcagccc

SEQ ID NO: 5922661 - DNA, 18 bp, Homo sapiens
ggggtgcggcaggagcag

SEQ ID NO: 5922662 - DNA, 18 bp, Homo sapiens
ggggtgctggggccaggg

SEQ ID NO: 5922663 - DNA, 16 bp, Homo sapiens
ggggtgcttccttgta

SEQ ID NO: 5922664 - DNA, 20 bp, Homo sapiens
ggggtgcttttatagaggct

SEQ ID NO: 5922665 - DNA, 21 bp, Homo sapiens
ggggtggaattattagcacca

SEQ ID NO: 5922666 - DNA, 17 bp, Homo sapiens
ggggtggagtcccagag

SEQ ID NO: 5922667 - DNA, 17 bp, Homo sapiens
ggggtggagtgagactg

SEQ ID NO: 5922668 - DNA, 15 bp, Homo sapiens
ggggtggagtttctg

SEQ ID NO: 5922669 - DNA, 16 bp, Homo sapiens
ggggtggccactcctg

SEQ ID NO: 5922670 - DNA, 13 bp, Homo sapiens
ggggtggccaggg

SEQ ID NO: 5922671 - DNA, 17 bp, Homo sapiens
ggggtggcccagagcca

SEQ ID NO: 5922672 - DNA, 23 bp, Homo sapiens
ggggtggcccagagccatactgc

SEQ ID NO: 5922673 - DNA, 15 bp, Homo sapiens
ggggtggccgtcctg

SEQ ID NO: 5922674 - DNA, 14 bp, Homo sapiens
ggggtggcctcaag

SEQ ID NO: 5922675 - DNA, 15 bp, Homo sapiens
ggggtggcctggccc

SEQ ID NO: 5922676 - DNA, 20 bp, Homo sapiens
ggggtggcctggccctcctg

SEQ ID NO: 5922677 - DNA, 14 bp, Homo sapiens
ggggtgggagccaa

SEQ ID NO: 5922678 - DNA, 12 bp, Homo sapiens
ggggtgggaggg

SEQ ID NO: 5922679 - DNA, 13 bp, Homo sapiens
ggggtgggcagca

SEQ ID NO: 5922680 - DNA, 15 bp, Homo sapiens
ggggtgggcagcagc

SEQ ID NO: 5922681 - DNA, 16 bp, Homo sapiens
ggggtgggcagggctg

SEQ ID NO: 5922682 - DNA, 13 bp, Homo sapiens
ggggtgggccagg

SEQ ID NO: 5922683 - DNA, 14 bp, Homo sapiens
ggggtgggcctctg

SEQ ID NO: 5922684 - DNA, 15 bp, Homo sapiens
ggggtgggcctctgg

SEQ ID NO: 5922685 - DNA, 11 bp, Homo sapiens
ggggtggggag

SEQ ID NO: 5922686 - DNA, 17 bp, Homo sapiens
ggggtggggagacctgg

SEQ ID NO: 5922687 - DNA, 12 bp, Homo sapiens
ggggtggggagg

SEQ ID NO: 5922688 - DNA, 16 bp, Homo sapiens
ggggtggggaggcaga

SEQ ID NO: 5922689 - DNA, 13 bp, Homo sapiens
ggggtggggaggg

SEQ ID NO: 5922690 - DNA, 12 bp, Homo sapiens
ggggtggggctc

SEQ ID NO: 5922691 - DNA, 19 bp, Homo sapiens
ggggtggggcttggaaggg

SEQ ID NO: 5922692 - DNA, 22 bp, Homo sapiens
ggggtgggggagaatggctctg

SEQ ID NO: 5922693 - DNA, 14 bp, Homo sapiens
ggggtgggggtgga

SEQ ID NO: 5922694 - DNA, 17 bp, Homo sapiens
ggggtgggggtggggag

SEQ ID NO: 5922695 - DNA, 16 bp, Homo sapiens
ggggtggggtcatgcc

SEQ ID NO: 5922696 - DNA, 13 bp, Homo sapiens
ggggtggtggagg

SEQ ID NO: 5922697 - DNA, 14 bp, Homo sapiens
ggggtggtgtcaga

SEQ ID NO: 5922698 - DNA, 16 bp, Homo sapiens
ggggtgtaacttcctg

SEQ ID NO: 5922699 - DNA, 22 bp, Homo sapiens
ggggtgtaacttcctgctgcac

SEQ ID NO: 5922700 - DNA, 14 bp, Homo sapiens
ggggtgtcccagtc

SEQ ID NO: 5922701 - DNA, 14 bp, Homo sapiens
ggggtgtctggaag

SEQ ID NO: 5922702 - DNA, 13 bp, Homo sapiens
ggggtgtcttttt

SEQ ID NO: 5922703 - DNA, 21 bp, Homo sapiens
ggggtgtgttccaactgcccc

SEQ ID NO: 5922704 - DNA, 16 bp, Homo sapiens
ggggtgttaatttatg

SEQ ID NO: 5922705 - DNA, 18 bp, Homo sapiens
ggggtgttagtggcaccg

SEQ ID NO: 5922706 - DNA, 22 bp, Homo sapiens
ggggttaacttggtcagagcca

SEQ ID NO: 5922707 - DNA, 16 bp, Homo sapiens
ggggttattttctggt

SEQ ID NO: 5922708 - DNA, 12 bp, Homo sapiens
ggggttcaagcc

SEQ ID NO: 5922709 - DNA, 23 bp, Homo sapiens
ggggttcagcccctcctctgcca

SEQ ID NO: 5922710 - DNA, 17 bp, Homo sapiens
ggggttcataggggcag

SEQ ID NO: 5922711 - DNA, 21 bp, Homo sapiens
ggggttccccacacagggcac

SEQ ID NO: 5922712 - DNA, 13 bp, Homo sapiens
ggggttcccccag

SEQ ID NO: 5922713 - DNA, 16 bp, Homo sapiens
gggtgatggccggctg

SEQ ID NO: 5922714 - DNA, 13 bp, Homo sapiens
gggtgattcctaa

SEQ ID NO: 5922715 - DNA, 16 bp, Homo sapiens
gggtgatttcagagag

SEQ ID NO: 5922716 - DNA, 19 bp, Homo sapiens
gggtgcaaagactctgagc

SEQ ID NO: 5922717 - DNA, 17 bp, Homo sapiens
gggtgcaagcactcggg

SEQ ID NO: 5922718 - DNA, 19 bp, Homo sapiens
gggtgcacaggagggggtc

SEQ ID NO: 5922719 - DNA, 14 bp, Homo sapiens
gggtgcagcagtga

SEQ ID NO: 5922720 - DNA, 15 bp, Homo sapiens
gggtgcagcttcacc

SEQ ID NO: 5922721 - DNA, 22 bp, Homo sapiens
gggtgcaggcgcgcaccgccca

SEQ ID NO: 5922722 - DNA, 12 bp, Homo sapiens
gggtgcaggtgg

SEQ ID NO: 5922723 - DNA, 18 bp, Homo sapiens
gggtgcatcctcctcagc

SEQ ID NO: 5922724 - DNA, 19 bp, Homo sapiens
gggtgcatggcttggggag

SEQ ID NO: 5922725 - DNA, 20 bp, Homo sapiens
gggtgcatttgagagaagcc

SEQ ID NO: 5922726 - DNA, 21 bp, Homo sapiens
gggtgcatttgagagaagcca

SEQ ID NO: 5922727 - DNA, 18 bp, Homo sapiens
gggtgccaaccacctctg

SEQ ID NO: 5922728 - DNA, 14 bp, Homo sapiens
gggtgccagggctg

SEQ ID NO: 5922729 - DNA, 12 bp, Homo sapiens
gggtgccatggt

SEQ ID NO: 5922730 - DNA, 22 bp, Homo sapiens
gggtgccccacaaggcccagcc

SEQ ID NO: 5922731 - DNA, 19 bp, Homo sapiens
gggtgccccccacccccag

SEQ ID NO: 5922732 - DNA, 16 bp, Homo sapiens
gggtgccccccatgcc

SEQ ID NO: 5922733 - DNA, 21 bp, Homo sapiens
gggtgcccgtgtggcctgggt

SEQ ID NO: 5922734 - DNA, 20 bp, Homo sapiens
gggtgccctccactgccctc

SEQ ID NO: 5922735 - DNA, 13 bp, Homo sapiens
gggtgccctctgg

SEQ ID NO: 5922736 - DNA, 21 bp, Homo sapiens
gggtgccctttcctggcagtc

SEQ ID NO: 5922737 - DNA, 14 bp, Homo sapiens
gggtgcccttttcc

SEQ ID NO: 5922738 - DNA, 14 bp, Homo sapiens
gggtgccgcctgcc

SEQ ID NO: 5922739 - DNA, 16 bp, Homo sapiens
gggtgccgctgtctct

SEQ ID NO: 5922740 - DNA, 24 bp, Homo sapiens
gggtgcctaggcctgggcagtgga

SEQ ID NO: 5922741 - DNA, 18 bp, Homo sapiens
gggtgcctcagagcaggc

SEQ ID NO: 5922742 - DNA, 22 bp, Homo sapiens
gggtgcctcagagcaggctcag

SEQ ID NO: 5922743 - DNA, 14 bp, Homo sapiens
gggtgcctgagccc

SEQ ID NO: 5922744 - DNA, 12 bp, Homo sapiens
gggtgcctggct

SEQ ID NO: 5922745 - DNA, 13 bp, Homo sapiens
gggtgcctggctg

SEQ ID NO: 5922746 - DNA, 13 bp, Homo sapiens
gggtgcctggtgc

SEQ ID NO: 5922747 - DNA, 18 bp, Homo sapiens
gggtgccttcactgggcc

SEQ ID NO: 5922748 - DNA, 23 bp, Homo sapiens
gggtgcgagagaggtgggcagca

SEQ ID NO: 5922749 - DNA, 21 bp, Homo sapiens
gggtgcggcggtcccagctcc

SEQ ID NO: 5922750 - DNA, 18 bp, Homo sapiens
gggtgcgggatacagctg

SEQ ID NO: 5922751 - DNA, 15 bp, Homo sapiens
gggtgcggggcctgc

SEQ ID NO: 5922752 - DNA, 18 bp, Homo sapiens
gggtgcggggcctgcagg

SEQ ID NO: 5922753 - DNA, 23 bp, Homo sapiens
gggtgcgtgaccggcccgccacc

SEQ ID NO: 5922754 - DNA, 17 bp, Homo sapiens
gggtgcgtgtgtttgta

SEQ ID NO: 5922755 - DNA, 16 bp, Homo sapiens
gggtgctactggggaa

SEQ ID NO: 5922756 - DNA, 18 bp, Homo sapiens
gggtgctagtggtgggca

SEQ ID NO: 5922757 - DNA, 9 bp, Homo sapiens
gggtgctca

SEQ ID NO: 5922758 - DNA, 14 bp, Homo sapiens
gggtgctcaataaa

SEQ ID NO: 5922759 - DNA, 15 bp, Homo sapiens
gggtgctcaataaac

SEQ ID NO: 5922760 - DNA, 18 bp, Homo sapiens
gggtgctcagaataaggc

SEQ ID NO: 5922761 - DNA, 17 bp, Homo sapiens
gggtgctgccctgtgta

SEQ ID NO: 5922762 - DNA, 13 bp, Homo sapiens
gggtgctgctctc

SEQ ID NO: 5922763 - DNA, 20 bp, Homo sapiens
gggtgctgctggtaacagtg

SEQ ID NO: 5922764 - DNA, 23 bp, Homo sapiens
gggtgctgcttccctctgcctgt

SEQ ID NO: 5922765 - DNA, 15 bp, Homo sapiens
gggtgctgggaggag

SEQ ID NO: 5922766 - DNA, 19 bp, Homo sapiens
gggtgctgggcccctgcct

SEQ ID NO: 5922767 - DNA, 15 bp, Homo sapiens
gggtgctggggcaga

SEQ ID NO: 5922768 - DNA, 16 bp, Homo sapiens
gggtgctggggcagag

SEQ ID NO: 5922769 - DNA, 17 bp, Homo sapiens
gggtgctggggccaggg

SEQ ID NO: 5922770 - DNA, 19 bp, Homo sapiens
gggtgctgtgaggcttgcc

SEQ ID NO: 5922771 - DNA, 21 bp, Homo sapiens
gggtgcttttatagaggctag

SEQ ID NO: 5922772 - DNA, 18 bp, Homo sapiens
gggtggaaatcctgccct

SEQ ID NO: 5922773 - DNA, 15 bp, Homo sapiens
gggtggaagggcagg

SEQ ID NO: 5922774 - DNA, 23 bp, Homo sapiens
gggtggaattattagcaccagct

SEQ ID NO: 5922775 - DNA, 20 bp, Homo sapiens
gggtggagaactcctagggt

SEQ ID NO: 5922776 - DNA, 13 bp, Homo sapiens
gggtggagaagcc

SEQ ID NO: 5922777 - DNA, 15 bp, Homo sapiens
gggtggagaagccat

SEQ ID NO: 5922778 - DNA, 18 bp, Homo sapiens
gggtggagaagggagggt

SEQ ID NO: 5922779 - DNA, 14 bp, Homo sapiens
gggtggagaagtgt

SEQ ID NO: 5922780 - DNA, 13 bp, Homo sapiens
gggtggagaggga

SEQ ID NO: 5922781 - DNA, 14 bp, Homo sapiens
gggtggagagttgg

SEQ ID NO: 5922782 - DNA, 22 bp, Homo sapiens
gggtggagctgagaagaggagg

SEQ ID NO: 5922783 - DNA, 13 bp, Homo sapiens
gggtggaggaccg

SEQ ID NO: 5922784 - DNA, 15 bp, Homo sapiens
gggtggaggagagcc

SEQ ID NO: 5922785 - DNA, 13 bp, Homo sapiens
gggtggagtcagg

SEQ ID NO: 5922786 - DNA, 21 bp, Homo sapiens
gggtggatccactgtgcagga

SEQ ID NO: 5922787 - DNA, 13 bp, Homo sapiens
gggtggatgcctg

SEQ ID NO: 5922788 - DNA, 18 bp, Homo sapiens
gggtggatgtgctggagg

SEQ ID NO: 5922789 - DNA, 12 bp, Homo sapiens
gggtggcacacc

SEQ ID NO: 5922790 - DNA, 19 bp, Homo sapiens
gggtggcaccagcagcctg

SEQ ID NO: 5922791 - DNA, 16 bp, Homo sapiens
gggtggcacctcctga

SEQ ID NO: 5922792 - DNA, 17 bp, Homo sapiens
gggtggcacctcctgag

SEQ ID NO: 5922793 - DNA, 22 bp, Homo sapiens
gggtggcacctgtttcccgggc

SEQ ID NO: 5922794 - DNA, 14 bp, Homo sapiens
gggtggcactgcca

SEQ ID NO: 5922795 - DNA, 23 bp, Homo sapiens
gggtggcactgggagggggtggg

SEQ ID NO: 5922796 - DNA, 21 bp, Homo sapiens
gggtggcagcgcccagcctgg

SEQ ID NO: 5922797 - DNA, 22 bp, Homo sapiens
gggtggcagcgcccagcctggc

SEQ ID NO: 5922798 - DNA, 17 bp, Homo sapiens
gggtggccacacaggca

SEQ ID NO: 5922799 - DNA, 24 bp, Homo sapiens
gggtggccacacaggcagggcctg

SEQ ID NO: 5922800 - DNA, 13 bp, Homo sapiens
gggtggccatccc

SEQ ID NO: 5922801 - DNA, 18 bp, Homo sapiens
gggtggcccagagccata

SEQ ID NO: 5922802 - DNA, 16 bp, Homo sapiens
gggtggcccagagcct

SEQ ID NO: 5922803 - DNA, 20 bp, Homo sapiens
gggtggccccctgtgccagc

SEQ ID NO: 5922804 - DNA, 23 bp, Homo sapiens
gggtggcccctgctgtctctctg

SEQ ID NO: 5922805 - DNA, 21 bp, Homo sapiens
gggtggccgctgagtggcagg

SEQ ID NO: 5922806 - DNA, 14 bp, Homo sapiens
gggtggccggccct

SEQ ID NO: 5922807 - DNA, 16 bp, Homo sapiens
gggtggccgggcacag

SEQ ID NO: 5922808 - DNA, 14 bp, Homo sapiens
gggtggccgtcctg

SEQ ID NO: 5922809 - DNA, 18 bp, Homo sapiens
gggtggccgtcctgaggg

SEQ ID NO: 5922810 - DNA, 19 bp, Homo sapiens
gggtggccgtcctgagggg

SEQ ID NO: 5922811 - DNA, 23 bp, Homo sapiens
gggtggcctaagagttgagctct

SEQ ID NO: 5922812 - DNA, 12 bp, Homo sapiens
gggtggcctcaa

SEQ ID NO: 5922813 - DNA, 17 bp, Homo sapiens
gggtggcctcaagagca

SEQ ID NO: 5922814 - DNA, 15 bp, Homo sapiens
gggtggcctggccct

SEQ ID NO: 5922815 - DNA, 11 bp, Homo sapiens
gggtggcctgt

SEQ ID NO: 5922816 - DNA, 13 bp, Homo sapiens
gggtggcggtgga

SEQ ID NO: 5922817 - DNA, 20 bp, Homo sapiens
gggtggctactctgtgccag

SEQ ID NO: 5922818 - DNA, 16 bp, Homo sapiens
gggtggctagtcagag

SEQ ID NO: 5922819 - DNA, 14 bp, Homo sapiens
gggtggctcctgcc

SEQ ID NO: 5922820 - DNA, 18 bp, Homo sapiens
gggtggctcctgccactg

SEQ ID NO: 5922821 - DNA, 15 bp, Homo sapiens
gggtggctgcagcct

SEQ ID NO: 5922822 - DNA, 17 bp, Homo sapiens
gggtggctgcagcctca

SEQ ID NO: 5922823 - DNA, 16 bp, Homo sapiens
gggtggctgccagccc

SEQ ID NO: 5922824 - DNA, 13 bp, Homo sapiens
gggtggctggagc

SEQ ID NO: 5922825 - DNA, 15 bp, Homo sapiens
gggtggctggagccc

SEQ ID NO: 5922826 - DNA, 17 bp, Homo sapiens
gggtggctggagcccca

SEQ ID NO: 5922827 - DNA, 21 bp, Homo sapiens
gggtggctggagccccatcgc

SEQ ID NO: 5922828 - DNA, 15 bp, Homo sapiens
gggtggctggagtga

SEQ ID NO: 5922829 - DNA, 21 bp, Homo sapiens
gggtggctttcaaggctgggg

SEQ ID NO: 5922830 - DNA, 14 bp, Homo sapiens
gggtgggaagaaag

SEQ ID NO: 5922831 - DNA, 15 bp, Homo sapiens
gggtgggaagaaaga

SEQ ID NO: 5922832 - DNA, 15 bp, Homo sapiens
gggtgggaaggggct

SEQ ID NO: 5922833 - DNA, 18 bp, Homo sapiens
gggtgggacaccctgtga

SEQ ID NO: 5922834 - DNA, 19 bp, Homo sapiens
gggtgggacaccctgtgat

SEQ ID NO: 5922835 - DNA, 12 bp, Homo sapiens
gggtgggacagg

SEQ ID NO: 5922836 - DNA, 16 bp, Homo sapiens
gggtgggacagggctt

SEQ ID NO: 5922837 - DNA, 22 bp, Homo sapiens
gggtgggaccaatgtccttgtg

SEQ ID NO: 5922838 - DNA, 19 bp, Homo sapiens
gggtgggagccacagggac

SEQ ID NO: 5922839 - DNA, 12 bp, Homo sapiens
gggtgggaggga

SEQ ID NO: 5922840 - DNA, 14 bp, Homo sapiens
gggtgggaggggaa

SEQ ID NO: 5922841 - DNA, 14 bp, Homo sapiens
gggtgggaggggcc

SEQ ID NO: 5922842 - DNA, 15 bp, Homo sapiens
gggtgggaggggccc

SEQ ID NO: 5922843 - DNA, 19 bp, Homo sapiens
gggtgggagggggcagggg

SEQ ID NO: 5922844 - DNA, 20 bp, Homo sapiens
gggtgggaggtaggctgtgg

SEQ ID NO: 5922845 - DNA, 17 bp, Homo sapiens
gggtgggcagcctatgg

SEQ ID NO: 5922846 - DNA, 15 bp, Homo sapiens
gggtgggcagggagg

SEQ ID NO: 5922847 - DNA, 13 bp, Homo sapiens
gggtgggccagca

SEQ ID NO: 5922848 - DNA, 14 bp, Homo sapiens
gggtgggccagcat

SEQ ID NO: 5922849 - DNA, 13 bp, Homo sapiens
gggtgggcccaga

SEQ ID NO: 5922850 - DNA, 23 bp, Homo sapiens
gggtgggccccacagtggtcagc

SEQ ID NO: 5922851 - DNA, 11 bp, Homo sapiens
gggtgggccct

SEQ ID NO: 5922852 - DNA, 13 bp, Homo sapiens
gggtgggcctctg

SEQ ID NO: 5922853 - DNA, 14 bp, Homo sapiens
gggtgggcctgact

SEQ ID NO: 5922854 - DNA, 23 bp, Homo sapiens
gggtgggctttgttgtgagaatg

SEQ ID NO: 5922855 - DNA, 13 bp, Homo sapiens
gggtggggacaga

SEQ ID NO: 5922856 - DNA, 19 bp, Homo sapiens
gggtggggacagaccagcc

SEQ ID NO: 5922857 - DNA, 14 bp, Homo sapiens
gggtggggagagac

SEQ ID NO: 5922858 - DNA, 11 bp, Homo sapiens
gggtggggagc

SEQ ID NO: 5922859 - DNA, 15 bp, Homo sapiens
gggtggggaggagga

SEQ ID NO: 5922860 - DNA, 12 bp, Homo sapiens
gggtggggaggg

SEQ ID NO: 5922861 - DNA, 16 bp, Homo sapiens
gggtggggaggggcct

SEQ ID NO: 5922862 - DNA, 20 bp, Homo sapiens
gggtggggcccaggcccgga

SEQ ID NO: 5922863 - DNA, 14 bp, Homo sapiens
gggtggggcttgga

SEQ ID NO: 5922864 - DNA, 23 bp, Homo sapiens
gggtgggggagaaaaaatcactg

SEQ ID NO: 5922865 - DNA, 14 bp, Homo sapiens
gggtgggggagcca

SEQ ID NO: 5922866 - DNA, 20 bp, Homo sapiens
gggtgggggagggaaaggga

SEQ ID NO: 5922867 - DNA, 21 bp, Homo sapiens
gggtgggggccacctgcctgc

SEQ ID NO: 5922868 - DNA, 15 bp, Homo sapiens
gggtgggggccaggc

SEQ ID NO: 5922869 - DNA, 14 bp, Homo sapiens
gggtgggggcctgc

SEQ ID NO: 5922870 - DNA, 19 bp, Homo sapiens
gggtgggggctcctggtgg

SEQ ID NO: 5922871 - DNA, 15 bp, Homo sapiens
gggtgggggctgtgg

SEQ ID NO: 5922872 - DNA, 19 bp, Homo sapiens
gggtggggggcttcataca

SEQ ID NO: 5922873 - DNA, 15 bp, Homo sapiens
gggtggggggggtgc

SEQ ID NO: 5922874 - DNA, 12 bp, Homo sapiens
gggtggggtgga

SEQ ID NO: 5922875 - DNA, 13 bp, Homo sapiens
gggtgggtgaagg

SEQ ID NO: 5922876 - DNA, 17 bp, Homo sapiens
gggtgggttggggaggg

SEQ ID NO: 5922877 - DNA, 14 bp, Homo sapiens
gggtggtacttggc

SEQ ID NO: 5922878 - DNA, 17 bp, Homo sapiens
gggtggtcttcaagcct

SEQ ID NO: 5922879 - DNA, 20 bp, Homo sapiens
gggtggtcttcaagcctggc

SEQ ID NO: 5922880 - DNA, 22 bp, Homo sapiens
gggtggtcttgtggttgtgtgt

SEQ ID NO: 5922881 - DNA, 12 bp, Homo sapiens
gggtggtgacct

SEQ ID NO: 5922882 - DNA, 12 bp, Homo sapiens
gggtggtgggga

SEQ ID NO: 5922883 - DNA, 19 bp, Homo sapiens
gggtggtggggaggggcgc

SEQ ID NO: 5922884 - DNA, 16 bp, Homo sapiens
gggtggtggggggcag

SEQ ID NO: 5922885 - DNA, 16 bp, Homo sapiens
gggtggtgtccttctc

SEQ ID NO: 5922886 - DNA, 21 bp, Homo sapiens
gggtggttattggactccagg

SEQ ID NO: 5922887 - DNA, 22 bp, Homo sapiens
gggtggttattggactccaggc

SEQ ID NO: 5922888 - DNA, 16 bp, Homo sapiens
gggtgtaacttcctgc

SEQ ID NO: 5922889 - DNA, 22 bp, Homo sapiens
gggtgtatagtgttcacaaact

SEQ ID NO: 5922890 - DNA, 23 bp, Homo sapiens
gggtgtatttattttcctcccca

SEQ ID NO: 5922891 - DNA, 20 bp, Homo sapiens
gggtgtcaagtgcctgcacc

SEQ ID NO: 5922892 - DNA, 18 bp, Homo sapiens
gggtgtcatttcattcca

SEQ ID NO: 5922893 - DNA, 20 bp, Homo sapiens
ggtactagtgtggtgtgttt

SEQ ID NO: 5922894 - DNA, 19 bp, Homo sapiens
ggtactcccccagccctca

SEQ ID NO: 5922895 - DNA, 21 bp, Homo sapiens
ggtactcgttggatgtctgtg

SEQ ID NO: 5922896 - DNA, 14 bp, Homo sapiens
ggtactctgtgaaa

SEQ ID NO: 5922897 - DNA, 16 bp, Homo sapiens
ggtactgacccaggac

SEQ ID NO: 5922898 - DNA, 16 bp, Homo sapiens
ggtactgagtggggag

SEQ ID NO: 5922899 - DNA, 19 bp, Homo sapiens
ggtactgcattctctccca

SEQ ID NO: 5922900 - DNA, 20 bp, Homo sapiens
ggtactgcattctctcccat

SEQ ID NO: 5922901 - DNA, 12 bp, Homo sapiens
ggtactgctgag

SEQ ID NO: 5922902 - DNA, 17 bp, Homo sapiens
ggtactgctgtcttcca

SEQ ID NO: 5922903 - DNA, 15 bp, Homo sapiens
ggtactgtacagctg

SEQ ID NO: 5922904 - DNA, 17 bp, Homo sapiens
ggtactgtatgatcaaa

SEQ ID NO: 5922905 - DNA, 23 bp, Homo sapiens
ggtactgtctcggcagaggtggt

SEQ ID NO: 5922906 - DNA, 21 bp, Homo sapiens
ggtactgtggggtggacctgg

SEQ ID NO: 5922907 - DNA, 14 bp, Homo sapiens
ggtactgttgcttt

SEQ ID NO: 5922908 - DNA, 20 bp, Homo sapiens
ggtacttaagctcccctgcc

SEQ ID NO: 5922909 - DNA, 13 bp, Homo sapiens
ggtacttagagtt

SEQ ID NO: 5922910 - DNA, 21 bp, Homo sapiens
ggtacttagagtttctgtttg

SEQ ID NO: 5922911 - DNA, 22 bp, Homo sapiens
ggtacttcagtattaaattaga

SEQ ID NO: 5922912 - DNA, 16 bp, Homo sapiens
ggtacttcctctgtga

SEQ ID NO: 5922913 - DNA, 15 bp, Homo sapiens
ggtacttcttgaagg

SEQ ID NO: 5922914 - DNA, 16 bp, Homo sapiens
ggtacttcttgaaggt

SEQ ID NO: 5922915 - DNA, 16 bp, Homo sapiens
ggtacttgtggacaca

SEQ ID NO: 5922916 - DNA, 12 bp, Homo sapiens
ggtactttctga

SEQ ID NO: 5922917 - DNA, 23 bp, Homo sapiens
ggtactttctgaaaatttatata

SEQ ID NO: 5922918 - DNA, 16 bp, Homo sapiens
ggtacttttaaaaaca

SEQ ID NO: 5922919 - DNA, 21 bp, Homo sapiens
ggtacttttatgatgtatatt

SEQ ID NO: 5922920 - DNA, 15 bp, Homo sapiens
ggtagaaaaacccaa

SEQ ID NO: 5922921 - DNA, 20 bp, Homo sapiens
ggtagaaaaattattagaac

SEQ ID NO: 5922922 - DNA, 22 bp, Homo sapiens
ggtagaaaaattattagaacat

SEQ ID NO: 5922923 - DNA, 20 bp, Homo sapiens
ggtagaaaatgcaccaaata

SEQ ID NO: 5922924 - DNA, 21 bp, Homo sapiens
ggtagaaaatgcaccaaatag

SEQ ID NO: 5922925 - DNA, 14 bp, Homo sapiens
ggtagaaattttta

SEQ ID NO: 5922926 - DNA, 11 bp, Homo sapiens
ggtagaacaca

SEQ ID NO: 5922927 - DNA, 21 bp, Homo sapiens
ggtagaagccacccttccctg

SEQ ID NO: 5922928 - DNA, 23 bp, Homo sapiens
ggtagaagccacccttccctgcc

SEQ ID NO: 5922929 - DNA, 21 bp, Homo sapiens
ggtagaaggggaggacactgg

SEQ ID NO: 5922930 - DNA, 19 bp, Homo sapiens
ggtagaagtagaatccttt

SEQ ID NO: 5922931 - DNA, 14 bp, Homo sapiens
ggtagaagtagttt

SEQ ID NO: 5922932 - DNA, 14 bp, Homo sapiens
ggtagaagtgagag

SEQ ID NO: 5922933 - DNA, 15 bp, Homo sapiens
ggtagaagtgagagc

SEQ ID NO: 5922934 - DNA, 20 bp, Homo sapiens
ggtagaatgaccttgtaatg

SEQ ID NO: 5922935 - DNA, 16 bp, Homo sapiens
ggtagaattgggaagc

SEQ ID NO: 5922936 - DNA, 22 bp, Homo sapiens
ggtagacacacatgaagtccaa

SEQ ID NO: 5922937 - DNA, 18 bp, Homo sapiens
ggtagaccttgagggtgg

SEQ ID NO: 5922938 - DNA, 21 bp, Homo sapiens
ggtagaccttgagggtgggcc

SEQ ID NO: 5922939 - DNA, 16 bp, Homo sapiens
ggtagagacccccagg

SEQ ID NO: 5922940 - DNA, 12 bp, Homo sapiens
ggtagagaggac

SEQ ID NO: 5922941 - DNA, 18 bp, Homo sapiens
ggtagagaggggactggg

SEQ ID NO: 5922942 - DNA, 21 bp, Homo sapiens
ggtagagaggggactggggga

SEQ ID NO: 5922943 - DNA, 14 bp, Homo sapiens
ggtagagatgtgtg

SEQ ID NO: 5922944 - DNA, 19 bp, Homo sapiens
ggtagagattcattatttt

SEQ ID NO: 5922945 - DNA, 17 bp, Homo sapiens
ggtagagctgatccaga

SEQ ID NO: 5922946 - DNA, 11 bp, Homo sapiens
ggtagaggaaa

SEQ ID NO: 5922947 - DNA, 14 bp, Homo sapiens
ggtagaggcctggg

SEQ ID NO: 5922948 - DNA, 16 bp, Homo sapiens
ggtagaggctccccag

SEQ ID NO: 5922949 - DNA, 20 bp, Homo sapiens
ggtagaggctccccagggct

SEQ ID NO: 5922950 - DNA, 15 bp, Homo sapiens
ggtagaggctgggag

SEQ ID NO: 5922951 - DNA, 20 bp, Homo sapiens
ggtagatcgcttgagcccag

SEQ ID NO: 5922952 - DNA, 18 bp, Homo sapiens
ggtagatgagaaaacagg

SEQ ID NO: 5922953 - DNA, 20 bp, Homo sapiens
ggtagatgcatgacttgtgt

SEQ ID NO: 5922954 - DNA, 18 bp, Homo sapiens
ggtagatgctgaggcccc

SEQ ID NO: 5922955 - DNA, 23 bp, Homo sapiens
ggtagatgggtgggggctcctgg

SEQ ID NO: 5922956 - DNA, 14 bp, Homo sapiens
ggtagattcgctgt

SEQ ID NO: 5922957 - DNA, 22 bp, Homo sapiens
ggtagattttaagaatggtctc

SEQ ID NO: 5922958 - DNA, 17 bp, Homo sapiens
ggtagcaaattttggac

SEQ ID NO: 5922959 - DNA, 16 bp, Homo sapiens
ggtagcagcaggctca

SEQ ID NO: 5922960 - DNA, 21 bp, Homo sapiens
ggtagcagccacacttccttt

SEQ ID NO: 5922961 - DNA, 13 bp, Homo sapiens
ggtagcagctgga

SEQ ID NO: 5922962 - DNA, 21 bp, Homo sapiens
ggtagcatgaccttttggcct

SEQ ID NO: 5922963 - DNA, 18 bp, Homo sapiens
ggtagcatttgtgttgaa

SEQ ID NO: 5922964 - DNA, 13 bp, Homo sapiens
ggtagccagcaca

SEQ ID NO: 5922965 - DNA, 16 bp, Homo sapiens
ggtagccagcacacag

SEQ ID NO: 5922966 - DNA, 23 bp, Homo sapiens
ggtagccatgatttgtcccagcc

SEQ ID NO: 5922967 - DNA, 13 bp, Homo sapiens
ggtagcccagcac

SEQ ID NO: 5922968 - DNA, 18 bp, Homo sapiens
ggtagcccagcactgtga

SEQ ID NO: 5922969 - DNA, 18 bp, Homo sapiens
ggtagccccgccccagcc

SEQ ID NO: 5922970 - DNA, 11 bp, Homo sapiens
ggtagcctatt

SEQ ID NO: 5922971 - DNA, 13 bp, Homo sapiens
ggtagcctgctgg

SEQ ID NO: 5922972 - DNA, 14 bp, Homo sapiens
ggtagcgagctgct

SEQ ID NO: 5922973 - DNA, 19 bp, Homo sapiens
ggtagcgagctgctctgct

SEQ ID NO: 5922974 - DNA, 20 bp, Homo sapiens
ggtagcgagctgctctgcta

SEQ ID NO: 5922975 - DNA, 22 bp, Homo sapiens
ggtagcgggggagggtaggcag

SEQ ID NO: 5922976 - DNA, 20 bp, Homo sapiens
ggtagctagcgtgtgccagg

SEQ ID NO: 5922977 - DNA, 12 bp, Homo sapiens
ggtagctccagc

SEQ ID NO: 5922978 - DNA, 14 bp, Homo sapiens
ggtagctccagcga

SEQ ID NO: 5922979 - DNA, 21 bp, Homo sapiens
ggtagctctgaagggagggga

SEQ ID NO: 5922980 - DNA, 14 bp, Homo sapiens
ggtagctctgagcc

SEQ ID NO: 5922981 - DNA, 15 bp, Homo sapiens
ggtagctgaaaaaac

SEQ ID NO: 5922982 - DNA, 12 bp, Homo sapiens
ggtagctgccac

SEQ ID NO: 5922983 - DNA, 15 bp, Homo sapiens
ggtagctgcccctgg

SEQ ID NO: 5922984 - DNA, 18 bp, Homo sapiens
ggtagctgcccctggctc

SEQ ID NO: 5922985 - DNA, 18 bp, Homo sapiens
ggtagctgggaaagcata

SEQ ID NO: 5922986 - DNA, 12 bp, Homo sapiens
ggtagctgggcg

SEQ ID NO: 5922987 - DNA, 12 bp, Homo sapiens
ggtaggagagca

SEQ ID NO: 5922988 - DNA, 15 bp, Homo sapiens
ggtaggagagcactg

SEQ ID NO: 5922989 - DNA, 19 bp, Homo sapiens
ggtaggagagcactgcctc

SEQ ID NO: 5922990 - DNA, 12 bp, Homo sapiens
ggtaggagagga

SEQ ID NO: 5922991 - DNA, 14 bp, Homo sapiens
ggtaggagcccttc

SEQ ID NO: 5922992 - DNA, 19 bp, Homo sapiens
ggtaggaggtttggatggg

SEQ ID NO: 5922993 - DNA, 22 bp, Homo sapiens
ggtaggagtcttatatcccagg

SEQ ID NO: 5922994 - DNA, 18 bp, Homo sapiens
ggtaggagttttgttcca

SEQ ID NO: 5922995 - DNA, 15 bp, Homo sapiens
ggtaggccaagctga

SEQ ID NO: 5922996 - DNA, 16 bp, Homo sapiens
ggtaggccaagctgaa

SEQ ID NO: 5922997 - DNA, 23 bp, Homo sapiens
ggtaggccaagctgaagtgaagg

SEQ ID NO: 5922998 - DNA, 24 bp, Homo sapiens
ggtaggccaaggtgtcctacagaa

SEQ ID NO: 5922999 - DNA, 22 bp, Homo sapiens
ggtaggccttggcccacctgag

SEQ ID NO: 5923000 - DNA, 14 bp, Homo sapiens
ggtaggctgtgggg

SEQ ID NO: 5923001 - DNA, 22 bp, Homo sapiens
ggtagggagcctcccctccctg

SEQ ID NO: 5923002 - DNA, 15 bp, Homo sapiens
ggtagggaggcagcc

SEQ ID NO: 5923003 - DNA, 17 bp, Homo sapiens
ggtagggaggcagcctc

SEQ ID NO: 5923004 - DNA, 21 bp, Homo sapiens
ggtaggggaagtgtgctgagg

SEQ ID NO: 5923005 - DNA, 23 bp, Homo sapiens
ggtaggggaagtgtgctgaggtg

SEQ ID NO: 5923006 - DNA, 19 bp, Homo sapiens
ggtaggggagggtggggca

SEQ ID NO: 5923007 - DNA, 16 bp, Homo sapiens
ggtaggggctgcaggg

SEQ ID NO: 5923008 - DNA, 17 bp, Homo sapiens
ggtagggggctggagga

SEQ ID NO: 5923009 - DNA, 23 bp, Homo sapiens
ggtagggggctggaggagcccag

SEQ ID NO: 5923010 - DNA, 19 bp, Homo sapiens
ggtaggggtagggagcctc

SEQ ID NO: 5923011 - DNA, 20 bp, Homo sapiens
ggtagggtaagtgagagagg

SEQ ID NO: 5923012 - DNA, 13 bp, Homo sapiens
ggtaggtaaatct

SEQ ID NO: 5923013 - DNA, 15 bp, Homo sapiens
ggtaggtgctggcct

SEQ ID NO: 5923014 - DNA, 16 bp, Homo sapiens
ggtaggtgctggcctc

SEQ ID NO: 5923015 - DNA, 18 bp, Homo sapiens
ggtaggtgtggtggcgtt

SEQ ID NO: 5923016 - DNA, 19 bp, Homo sapiens
ggtaggttcagccaaggtt

SEQ ID NO: 5923017 - DNA, 15 bp, Homo sapiens
ggtaggttgggacac

SEQ ID NO: 5923018 - DNA, 17 bp, Homo sapiens
ggtaggttgggacacca

SEQ ID NO: 5923019 - DNA, 19 bp, Homo sapiens
ggtaggttgggacaccagg

SEQ ID NO: 5923020 - DNA, 16 bp, Homo sapiens
ggtagtaaaacacaga

SEQ ID NO: 5923021 - DNA, 17 bp, Homo sapiens
ggtagtacccagggcca

SEQ ID NO: 5923022 - DNA, 22 bp, Homo sapiens
ggtagtactcctgcaaaatttt

SEQ ID NO: 5923023 - DNA, 13 bp, Homo sapiens
ggtagtactggga

SEQ ID NO: 5923024 - DNA, 18 bp, Homo sapiens
ggtagtagaatctcagca

SEQ ID NO: 5923025 - DNA, 17 bp, Homo sapiens
ggtagtaggttgcatta

SEQ ID NO: 5923026 - DNA, 21 bp, Homo sapiens
ggtagtatctcgtaatagctt

SEQ ID NO: 5923027 - DNA, 14 bp, Homo sapiens
ggtagtcaaaggca

SEQ ID NO: 5923028 - DNA, 18 bp, Homo sapiens
ggtagtcctcccaagctg

SEQ ID NO: 5923029 - DNA, 20 bp, Homo sapiens
ggtagtcctcccaagctgtg

SEQ ID NO: 5923030 - DNA, 16 bp, Homo sapiens
ggtagtcggagccccc

SEQ ID NO: 5923031 - DNA, 21 bp, Homo sapiens
ggtagtggaggaggtggcttc

SEQ ID NO: 5923032 - DNA, 20 bp, Homo sapiens
ggtagtggcaaagagaggtc

SEQ ID NO: 5923033 - DNA, 16 bp, Homo sapiens
ggtagtggctggggtg

SEQ ID NO: 5923034 - DNA, 16 bp, Homo sapiens
ggtagtgtagctgtgt

SEQ ID NO: 5923035 - DNA, 23 bp, Homo sapiens
ggtagtgtccccagcctacctct

SEQ ID NO: 5923036 - DNA, 21 bp, Homo sapiens
ggtagttcaaagagtctgtct

SEQ ID NO: 5923037 - DNA, 19 bp, Homo sapiens
ggtagttcaagaaatgaag

SEQ ID NO: 5923038 - DNA, 14 bp, Homo sapiens
ggtagttggaaaca

SEQ ID NO: 5923039 - DNA, 18 bp, Homo sapiens
ggtagttgggtagaaaaa

SEQ ID NO: 5923040 - DNA, 13 bp, Homo sapiens
ggtagtttctgtg

SEQ ID NO: 5923041 - DNA, 15 bp, Homo sapiens
ggtagtttttctgtc

SEQ ID NO: 5923042 - DNA, 20 bp, Homo sapiens
ggtagttttttcatcttcag

SEQ ID NO: 5923043 - DNA, 13 bp, Homo sapiens
ggtataaaagatg

SEQ ID NO: 5923044 - DNA, 16 bp, Homo sapiens
ggtataaaagatgggg

SEQ ID NO: 5923045 - DNA, 11 bp, Homo sapiens
ggtataaaagg

SEQ ID NO: 5923046 - DNA, 12 bp, Homo sapiens
ggtataaagaca

SEQ ID NO: 5923047 - DNA, 17 bp, Homo sapiens
ggtataatggttgactg

SEQ ID NO: 5923048 - DNA, 17 bp, Homo sapiens
ggtataatgtgtctgtg

SEQ ID NO: 5923049 - DNA, 15 bp, Homo sapiens
ggtataatgtttaaa

SEQ ID NO: 5923050 - DNA, 19 bp, Homo sapiens
ggtataattgtgtgatatt

SEQ ID NO: 5923051 - DNA, 22 bp, Homo sapiens
ggtatacaggtggtttttggtt

SEQ ID NO: 5923052 - DNA, 16 bp, Homo sapiens
ggtatacatgtgtaca

SEQ ID NO: 5923053 - DNA, 20 bp, Homo sapiens
ggtatacatgtgtacatata

SEQ ID NO: 5923054 - DNA, 13 bp, Homo sapiens
ggtatacatttta

SEQ ID NO: 5923055 - DNA, 21 bp, Homo sapiens
ggtataggacaaggggtggaa

SEQ ID NO: 5923056 - DNA, 21 bp, Homo sapiens
ggtataggtctcatctcttca

SEQ ID NO: 5923057 - DNA, 18 bp, Homo sapiens
ggtatataaattggggtg

SEQ ID NO: 5923058 - DNA, 22 bp, Homo sapiens
ggtatataaattggggtgatga

SEQ ID NO: 5923059 - DNA, 19 bp, Homo sapiens
ggtatatactttgccactg

SEQ ID NO: 5923060 - DNA, 18 bp, Homo sapiens
ggtatatatccgcctggc

SEQ ID NO: 5923061 - DNA, 21 bp, Homo sapiens
ggtatatccttttctgtgttt

SEQ ID NO: 5923062 - DNA, 14 bp, Homo sapiens
ggtatattgataaa

SEQ ID NO: 5923063 - DNA, 17 bp, Homo sapiens
ggtatatttgaaataaa

SEQ ID NO: 5923064 - DNA, 18 bp, Homo sapiens
ggtatatttgtgtatgtg

SEQ ID NO: 5923065 - DNA, 18 bp, Homo sapiens
ggtatcaaacagctcagg

SEQ ID NO: 5923066 - DNA, 21 bp, Homo sapiens
ggtatcaaacagctcaggctg

SEQ ID NO: 5923067 - DNA, 19 bp, Homo sapiens
ggtatcaactaggggagga

SEQ ID NO: 5923068 - DNA, 23 bp, Homo sapiens
ggtatcaggactgtgaccaaagc

SEQ ID NO: 5923069 - DNA, 15 bp, Homo sapiens
ggtatcaggcacagg

SEQ ID NO: 5923070 - DNA, 20 bp, Homo sapiens
ggtatcaggcacaggcagga

SEQ ID NO: 5923071 - DNA, 12 bp, Homo sapiens
ggtatcatatat

SEQ ID NO: 5923072 - DNA, 23 bp, Homo sapiens
ggtatcattacaattttctgtaa

SEQ ID NO: 5923073 - DNA, 19 bp, Homo sapiens
ggtatcattttctgcattt

SEQ ID NO: 5923074 - DNA, 23 bp, Homo sapiens
ggtatcctactgagcatttgcac

SEQ ID NO: 5923075 - DNA, 13 bp, Homo sapiens
ggtatcctccctg

SEQ ID NO: 5923076 - DNA, 21 bp, Homo sapiens
ggtatcctgggggaagaggag

SEQ ID NO: 5923077 - DNA, 22 bp, Homo sapiens
ggtatcgaaatttgttgtttgt

SEQ ID NO: 5923078 - DNA, 15 bp, Homo sapiens
ggtatctcagaaagt

SEQ ID NO: 5923079 - DNA, 20 bp, Homo sapiens
ggtatctcagaaagtgcctg

SEQ ID NO: 5923080 - DNA, 12 bp, Homo sapiens
ggtatctccagg

SEQ ID NO: 5923081 - DNA, 23 bp, Homo sapiens
ggtatctccaggattgaagagca

SEQ ID NO: 5923082 - DNA, 14 bp, Homo sapiens
ggtatctggcttcc

SEQ ID NO: 5923083 - DNA, 17 bp, Homo sapiens
ggtatctggcttccctg

SEQ ID NO: 5923084 - DNA, 19 bp, Homo sapiens
ggtatctggcttccctgga

SEQ ID NO: 5923085 - DNA, 14 bp, Homo sapiens
ggtatctttatagt

SEQ ID NO: 5923086 - DNA, 21 bp, Homo sapiens
ggtatgaaacaaactactgtg

SEQ ID NO: 5923087 - DNA, 22 bp, Homo sapiens
ggtatgaacttgaggacacatg

SEQ ID NO: 5923088 - DNA, 21 bp, Homo sapiens
ggtatgaccttctaggaagct

SEQ ID NO: 5923089 - DNA, 14 bp, Homo sapiens
ggtatgagctgagg

SEQ ID NO: 5923090 - DNA, 15 bp, Homo sapiens
ggtatgagctgaggg

SEQ ID NO: 5923091 - DNA, 16 bp, Homo sapiens
ggtatgagctgagggg

SEQ ID NO: 5923092 - DNA, 13 bp, Homo sapiens
ggtatgagctgga

SEQ ID NO: 5923093 - DNA, 22 bp, Homo sapiens
ggtatgatcacggctcactgca

SEQ ID NO: 5923094 - DNA, 15 bp, Homo sapiens
ggtatgatgctgccg

SEQ ID NO: 5923095 - DNA, 14 bp, Homo sapiens
ggtatgcagagctt

SEQ ID NO: 5923096 - DNA, 13 bp, Homo sapiens
ggtatgctggcca

SEQ ID NO: 5923097 - DNA, 14 bp, Homo sapiens
ggtatgctggccag

SEQ ID NO: 5923098 - DNA, 15 bp, Homo sapiens
ggtatgctggccagc

SEQ ID NO: 5923099 - DNA, 22 bp, Homo sapiens
ggtatggggggggcaagaaaga

SEQ ID NO: 5923100 - DNA, 18 bp, Homo sapiens
ggtatggtggggatattt

SEQ ID NO: 5923101 - DNA, 11 bp, Homo sapiens
ggtatgtacag

SEQ ID NO: 5923102 - DNA, 16 bp, Homo sapiens
ggtatgtagccagctg

SEQ ID NO: 5923103 - DNA, 19 bp, Homo sapiens
ggtatgtcacaaagagctg

SEQ ID NO: 5923104 - DNA, 21 bp, Homo sapiens
ggtatgtgcccctcctgggtg

SEQ ID NO: 5923105 - DNA, 18 bp, Homo sapiens
ggtatgtttaatctgtta

SEQ ID NO: 5923106 - DNA, 20 bp, Homo sapiens
ggtatgtttgtaacttttta

SEQ ID NO: 5923107 - DNA, 12 bp, Homo sapiens
ggtattaaagaa

SEQ ID NO: 5923108 - DNA, 18 bp, Homo sapiens
ggtattaaaggttaaatt

SEQ ID NO: 5923109 - DNA, 18 bp, Homo sapiens
ggtattaagattataatt

SEQ ID NO: 5923110 - DNA, 22 bp, Homo sapiens
ggtattaatatatagtccagac

SEQ ID NO: 5923111 - DNA, 18 bp, Homo sapiens
ggtattagtgtttgaaaa

SEQ ID NO: 5923112 - DNA, 17 bp, Homo sapiens
ggtattatatctctgta

SEQ ID NO: 5923113 - DNA, 17 bp, Homo sapiens
ggtattcaccaccctgg

SEQ ID NO: 5923114 - DNA, 14 bp, Homo sapiens
ggtattcctgcctc

SEQ ID NO: 5923115 - DNA, 18 bp, Homo sapiens
ggtattcgcttgagaaaa

SEQ ID NO: 5923116 - DNA, 15 bp, Homo sapiens
ggtattctctctatg

SEQ ID NO: 5923117 - DNA, 17 bp, Homo sapiens
ggtattgcactacatta

SEQ ID NO: 5923118 - DNA, 23 bp, Homo sapiens
ggtattggagggaaaaaacaagc

SEQ ID NO: 5923119 - DNA, 21 bp, Homo sapiens
ggtattggtgctttgtgtcta

SEQ ID NO: 5923120 - DNA, 14 bp, Homo sapiens
ggtattgtaatatt

SEQ ID NO: 5923121 - DNA, 19 bp, Homo sapiens
ggtattgtatttattcaat

SEQ ID NO: 5923122 - DNA, 20 bp, Homo sapiens
ggtattgtatttattcaata

SEQ ID NO: 5923123 - DNA, 11 bp, Homo sapiens
ggtattgtctt

SEQ ID NO: 5923124 - DNA, 23 bp, Homo sapiens
ggtattgtcttttgacatccagc

SEQ ID NO: 5923125 - DNA, 11 bp, Homo sapiens
ggtatttaatg

SEQ ID NO: 5923126 - DNA, 16 bp, Homo sapiens
ggtatttagaagcaga

SEQ ID NO: 5923127 - DNA, 21 bp, Homo sapiens
ggtatttatctattgtaagat

SEQ ID NO: 5923128 - DNA, 17 bp, Homo sapiens
ggtatttcgaaactgcc

SEQ ID NO: 5923129 - DNA, 23 bp, Homo sapiens
ggtatttggttaaaggtctccca

SEQ ID NO: 5923130 - DNA, 22 bp, Homo sapiens
ggtattttaggcagggatttga

SEQ ID NO: 5923131 - DNA, 21 bp, Homo sapiens
ggtattttattttggcttcat

SEQ ID NO: 5923132 - DNA, 20 bp, Homo sapiens
ggtattttcccccttttctg

SEQ ID NO: 5923133 - DNA, 18 bp, Homo sapiens
ggtattttcgtgcatttg

SEQ ID NO: 5923134 - DNA, 14 bp, Homo sapiens
ggtattttctaatt

SEQ ID NO: 5923135 - DNA, 16 bp, Homo sapiens
ggtattttttcctttt

SEQ ID NO: 5923136 - DNA, 12 bp, Homo sapiens
ggtcaaaaacaa

SEQ ID NO: 5923137 - DNA, 22 bp, Homo sapiens
ggtcaaaagagccctggctctg

SEQ ID NO: 5923138 - DNA, 21 bp, Homo sapiens
ggtcaaactttttccagcaaa

SEQ ID NO: 5923139 - DNA, 22 bp, Homo sapiens
ggtcaacaataaaaaccaaatt

SEQ ID NO: 5923140 - DNA, 14 bp, Homo sapiens
ggtcaacagagaag

SEQ ID NO: 5923141 - DNA, 14 bp, Homo sapiens
ggtcaacccgctgc

SEQ ID NO: 5923142 - DNA, 21 bp, Homo sapiens
ggtcaacctttgtgtggctcc

SEQ ID NO: 5923143 - DNA, 22 bp, Homo sapiens
ggtcaacttgagcatgttactg

SEQ ID NO: 5923144 - DNA, 23 bp, Homo sapiens
ggtcaacttgagcatgttactga

SEQ ID NO: 5923145 - DNA, 21 bp, Homo sapiens
ggtcaagaaaggaggggagaa

SEQ ID NO: 5923146 - DNA, 13 bp, Homo sapiens
ggtcaagcccaga

SEQ ID NO: 5923147 - DNA, 11 bp, Homo sapiens
ggtcaagcctc

SEQ ID NO: 5923148 - DNA, 15 bp, Homo sapiens
ggtcaagctgagctg

SEQ ID NO: 5923149 - DNA, 18 bp, Homo sapiens
ggtcaaggaaggaaaata

SEQ ID NO: 5923150 - DNA, 17 bp, Homo sapiens
ggtcaaggacagggctg

SEQ ID NO: 5923151 - DNA, 23 bp, Homo sapiens
ggtcaaggcagtagaactccagg

SEQ ID NO: 5923152 - DNA, 11 bp, Homo sapiens
ggtcaaggcct

SEQ ID NO: 5923153 - DNA, 20 bp, Homo sapiens
ggtcaagtaagaagacatga

SEQ ID NO: 5923154 - DNA, 23 bp, Homo sapiens
ggtcaataaacttagaggaaaat

SEQ ID NO: 5923155 - DNA, 19 bp, Homo sapiens
ggtcaataaagcagagcca

SEQ ID NO: 5923156 - DNA, 19 bp, Homo sapiens
ggtcaataattgtggagag

SEQ ID NO: 5923157 - DNA, 21 bp, Homo sapiens
ggtcaataattgtggagagga

SEQ ID NO: 5923158 - DNA, 21 bp, Homo sapiens
ggtcaatactgccttaatgag

SEQ ID NO: 5923159 - DNA, 14 bp, Homo sapiens
ggtcaatgctattt

SEQ ID NO: 5923160 - DNA, 17 bp, Homo sapiens
ggtcacaaagctattta

SEQ ID NO: 5923161 - DNA, 19 bp, Homo sapiens
ggtcacacaaaggcatgct

SEQ ID NO: 5923162 - DNA, 18 bp, Homo sapiens
ggtcacacaccagcactt

SEQ ID NO: 5923163 - DNA, 18 bp, Homo sapiens
ggtcacacccaccccctg

SEQ ID NO: 5923164 - DNA, 22 bp, Homo sapiens
ggtcacacccaccccctgcctg

SEQ ID NO: 5923165 - DNA, 18 bp, Homo sapiens
ggtcacacctcactgtca

SEQ ID NO: 5923166 - DNA, 23 bp, Homo sapiens
ggtcacacctcactgtcatctgc

SEQ ID NO: 5923167 - DNA, 20 bp, Homo sapiens
ggtcacacggccacccgccc

SEQ ID NO: 5923168 - DNA, 22 bp, Homo sapiens
ggtcacagaaaggcaggtttca

SEQ ID NO: 5923169 - DNA, 14 bp, Homo sapiens
ggtcacagccaggc

SEQ ID NO: 5923170 - DNA, 21 bp, Homo sapiens
ggtcacagcggaggtgtggag

SEQ ID NO: 5923171 - DNA, 13 bp, Homo sapiens
ggtcacagctgga

SEQ ID NO: 5923172 - DNA, 16 bp, Homo sapiens
ggtcacaggactctgc

SEQ ID NO: 5923173 - DNA, 17 bp, Homo sapiens
ggtcacaggcccagaag

SEQ ID NO: 5923174 - DNA, 12 bp, Homo sapiens
ggtcacaggctg

SEQ ID NO: 5923175 - DNA, 16 bp, Homo sapiens
ggtcacatccatccct

SEQ ID NO: 5923176 - DNA, 16 bp, Homo sapiens
ggtcaccaagcagtgg

SEQ ID NO: 5923177 - DNA, 22 bp, Homo sapiens
ggtcaccaaggcagtgcatgca

SEQ ID NO: 5923178 - DNA, 13 bp, Homo sapiens
ggtcaccagcctg

SEQ ID NO: 5923179 - DNA, 13 bp, Homo sapiens
ggtcaccagctgc

SEQ ID NO: 5923180 - DNA, 16 bp, Homo sapiens
ggtcaccagctgctgt

SEQ ID NO: 5923181 - DNA, 14 bp, Homo sapiens
ggtcaccaggggag

SEQ ID NO: 5923182 - DNA, 21 bp, Homo sapiens
ggtcaccagggggagctgtct

SEQ ID NO: 5923183 - DNA, 16 bp, Homo sapiens
ggtcaccatcctcaga

SEQ ID NO: 5923184 - DNA, 20 bp, Homo sapiens
ggtcaccatcctcagaggct

SEQ ID NO: 5923185 - DNA, 15 bp, Homo sapiens
ggtcaccatgaaact

SEQ ID NO: 5923186 - DNA, 21 bp, Homo sapiens
ggtcacccagactagacacct

SEQ ID NO: 5923187 - DNA, 15 bp, Homo sapiens
ggtcacccatcagga

SEQ ID NO: 5923188 - DNA, 13 bp, Homo sapiens
ggtcacccatgca

SEQ ID NO: 5923189 - DNA, 14 bp, Homo sapiens
ggtcacccatggcc

SEQ ID NO: 5923190 - DNA, 15 bp, Homo sapiens
ggtcacccatggcct

SEQ ID NO: 5923191 - DNA, 22 bp, Homo sapiens
ggtcaccgagactcagcctctg

SEQ ID NO: 5923192 - DNA, 20 bp, Homo sapiens
ggtcacctaggaagcctcag

SEQ ID NO: 5923193 - DNA, 19 bp, Homo sapiens
ggtcacctcactcagcacc

SEQ ID NO: 5923194 - DNA, 21 bp, Homo sapiens
ggtcacctcactcagcaccac

SEQ ID NO: 5923195 - DNA, 17 bp, Homo sapiens
ggtcacctcccatcccg

SEQ ID NO: 5923196 - DNA, 20 bp, Homo sapiens
ggtcacctgccgccctgtgg

SEQ ID NO: 5923197 - DNA, 12 bp, Homo sapiens
ggtcacctgtgc

SEQ ID NO: 5923198 - DNA, 15 bp, Homo sapiens
ggtcaccttcctggg

SEQ ID NO: 5923199 - DNA, 24 bp, Homo sapiens
ggtcaccttcctgggcagcccaga

SEQ ID NO: 5923200 - DNA, 20 bp, Homo sapiens
ggtcactcaggcctctgcag

SEQ ID NO: 5923201 - DNA, 17 bp, Homo sapiens
ggtcactccaccatccc

SEQ ID NO: 5923202 - DNA, 13 bp, Homo sapiens
ggtcactcctggg

SEQ ID NO: 5923203 - DNA, 15 bp, Homo sapiens
ggtcactctccagca

SEQ ID NO: 5923204 - DNA, 17 bp, Homo sapiens
ggtcactctgaccttat

SEQ ID NO: 5923205 - DNA, 18 bp, Homo sapiens
ggtcactctgccctctgc

SEQ ID NO: 5923206 - DNA, 12 bp, Homo sapiens
ggtcactctggc

SEQ ID NO: 5923207 - DNA, 18 bp, Homo sapiens
ggtcactctgggcctggg

SEQ ID NO: 5923208 - DNA, 22 bp, Homo sapiens
ggtcactcttcctgcaaggact

SEQ ID NO: 5923209 - DNA, 19 bp, Homo sapiens
ggtcactgaaacttcaagc

SEQ ID NO: 5923210 - DNA, 23 bp, Homo sapiens
ggtcactgaggcctgagacccag

SEQ ID NO: 5923211 - DNA, 12 bp, Homo sapiens
ggtcactgctgt

SEQ ID NO: 5923212 - DNA, 13 bp, Homo sapiens
ggtcactggaaag

SEQ ID NO: 5923213 - DNA, 17 bp, Homo sapiens
ggtcactggagtagttg

SEQ ID NO: 5923214 - DNA, 13 bp, Homo sapiens
ggtcactggctct

SEQ ID NO: 5923215 - DNA, 17 bp, Homo sapiens
ggtcactggtcagggca

SEQ ID NO: 5923216 - DNA, 23 bp, Homo sapiens
ggtcactggtcagggcagtggcc

SEQ ID NO: 5923217 - DNA, 14 bp, Homo sapiens
ggtcactgtcactg

SEQ ID NO: 5923218 - DNA, 21 bp, Homo sapiens
ggtcactgtgcactgccctgt

SEQ ID NO: 5923219 - DNA, 12 bp, Homo sapiens
ggtcacttggga

SEQ ID NO: 5923220 - DNA, 15 bp, Homo sapiens
ggtcacttgggaaga

SEQ ID NO: 5923221 - DNA, 23 bp, Homo sapiens
ggtcactttgccattatgcaaat

SEQ ID NO: 5923222 - DNA, 17 bp, Homo sapiens
ggtcagaaacaggaccg

SEQ ID NO: 5923223 - DNA, 15 bp, Homo sapiens
ggtcagaacatgtta

SEQ ID NO: 5923224 - DNA, 24 bp, Homo sapiens
ggtcagaacattcgaatctctgcc

SEQ ID NO: 5923225 - DNA, 17 bp, Homo sapiens
ggtcagaaccagagggc

SEQ ID NO: 5923226 - DNA, 18 bp, Homo sapiens
ggtcagaaccggcctgga

SEQ ID NO: 5923227 - DNA, 22 bp, Homo sapiens
ggtcagaagaagtgggagcagc

SEQ ID NO: 5923228 - DNA, 23 bp, Homo sapiens
ggtcagaagaagtgggagcagct

SEQ ID NO: 5923229 - DNA, 17 bp, Homo sapiens
ggtcagaagagagggtg

SEQ ID NO: 5923230 - DNA, 14 bp, Homo sapiens
ggtcagactggagg

SEQ ID NO: 5923231 - DNA, 22 bp, Homo sapiens
ggtcagagaaaatgagaaagga

SEQ ID NO: 5923232 - DNA, 20 bp, Homo sapiens
ggtcagagactgctgtgttt

SEQ ID NO: 5923233 - DNA, 20 bp, Homo sapiens
ggtcagagagacctcatcct

SEQ ID NO: 5923234 - DNA, 17 bp, Homo sapiens
ggtcagagatgggctga

SEQ ID NO: 5923235 - DNA, 23 bp, Homo sapiens
ggtcagagatgggctgaactgag

SEQ ID NO: 5923236 - DNA, 14 bp, Homo sapiens
ggtcagagccactc

SEQ ID NO: 5923237 - DNA, 16 bp, Homo sapiens
ggtcagagcctgcagt

SEQ ID NO: 5923238 - DNA, 18 bp, Homo sapiens
ggtcagaggacctgtatt

SEQ ID NO: 5923239 - DNA, 14 bp, Homo sapiens
ggtcagaggagtga

SEQ ID NO: 5923240 - DNA, 18 bp, Homo sapiens
ggtcagaggcccaaaaca

SEQ ID NO: 5923241 - DNA, 22 bp, Homo sapiens
ggtcagagggactgtcagctga

SEQ ID NO: 5923242 - DNA, 23 bp, Homo sapiens
ggtcagagggactgtcagctgag

SEQ ID NO: 5923243 - DNA, 19 bp, Homo sapiens
ggtcagagtggcgtgagct

SEQ ID NO: 5923244 - DNA, 22 bp, Homo sapiens
ggtcagagtggcgtgagctgcc

SEQ ID NO: 5923245 - DNA, 19 bp, Homo sapiens
ggtcagcagaaacccccag

SEQ ID NO: 5923246 - DNA, 13 bp, Homo sapiens
ggtcctgagtggc

SEQ ID NO: 5923247 - DNA, 16 bp, Homo sapiens
ggtcctgatgcccgtt

SEQ ID NO: 5923248 - DNA, 17 bp, Homo sapiens
ggtcctgattctccctg

SEQ ID NO: 5923249 - DNA, 15 bp, Homo sapiens
ggtcctgcacatgag

SEQ ID NO: 5923250 - DNA, 15 bp, Homo sapiens
ggtcctgcagcctgc

SEQ ID NO: 5923251 - DNA, 12 bp, Homo sapiens
ggtcctgcaggg

SEQ ID NO: 5923252 - DNA, 19 bp, Homo sapiens
ggtcctgcagtctggctga

SEQ ID NO: 5923253 - DNA, 13 bp, Homo sapiens
ggtcctgccagct

SEQ ID NO: 5923254 - DNA, 22 bp, Homo sapiens
ggtcctgccctccggaggagca

SEQ ID NO: 5923255 - DNA, 12 bp, Homo sapiens
ggtcctgcctgc

SEQ ID NO: 5923256 - DNA, 15 bp, Homo sapiens
ggtcctgcctgcagt

SEQ ID NO: 5923257 - DNA, 23 bp, Homo sapiens
ggtcctgctccgctgcctggaac

SEQ ID NO: 5923258 - DNA, 22 bp, Homo sapiens
ggtcctgctgaaactgcccact

SEQ ID NO: 5923259 - DNA, 11 bp, Homo sapiens
ggtcctgctgc

SEQ ID NO: 5923260 - DNA, 12 bp, Homo sapiens
ggtcctgctgca

SEQ ID NO: 5923261 - DNA, 23 bp, Homo sapiens
ggtcctgctgcagttgccagtca

SEQ ID NO: 5923262 - DNA, 21 bp, Homo sapiens
ggtcctgctgctcgggaaggc

SEQ ID NO: 5923263 - DNA, 16 bp, Homo sapiens
ggtcctggacacctcc

SEQ ID NO: 5923264 - DNA, 18 bp, Homo sapiens
ggtcctggacacctccca

SEQ ID NO: 5923265 - DNA, 18 bp, Homo sapiens
ggtcctggaggctcaaat

SEQ ID NO: 5923266 - DNA, 14 bp, Homo sapiens
ggtcctggcagggc

SEQ ID NO: 5923267 - DNA, 13 bp, Homo sapiens
ggtcctggcccca

SEQ ID NO: 5923268 - DNA, 14 bp, Homo sapiens
ggtcctggctcctg

SEQ ID NO: 5923269 - DNA, 16 bp, Homo sapiens
ggtcctggctcctgag

SEQ ID NO: 5923270 - DNA, 14 bp, Homo sapiens
ggtcctggctgcac

SEQ ID NO: 5923271 - DNA, 21 bp, Homo sapiens
ggtcctgggaggctgcagcca

SEQ ID NO: 5923272 - DNA, 12 bp, Homo sapiens
ggtcctggggcc

SEQ ID NO: 5923273 - DNA, 15 bp, Homo sapiens
ggtcctggggctctg

SEQ ID NO: 5923274 - DNA, 15 bp, Homo sapiens
ggtcctgggggcagg

SEQ ID NO: 5923275 - DNA, 15 bp, Homo sapiens
ggtcctgggggcctg

SEQ ID NO: 5923276 - DNA, 21 bp, Homo sapiens
ggtcctgggggcctgacctcc

SEQ ID NO: 5923277 - DNA, 18 bp, Homo sapiens
ggtcctgggggctgctgc

SEQ ID NO: 5923278 - DNA, 21 bp, Homo sapiens
ggtcctgggggctgctgcact

SEQ ID NO: 5923279 - DNA, 24 bp, Homo sapiens
ggtcctggtgccctggatgcccag

SEQ ID NO: 5923280 - DNA, 22 bp, Homo sapiens
ggtcctggtgctgccgagggct

SEQ ID NO: 5923281 - DNA, 17 bp, Homo sapiens
ggtcctggtggggcagc

SEQ ID NO: 5923282 - DNA, 18 bp, Homo sapiens
ggtcctggtggggcagct

SEQ ID NO: 5923283 - DNA, 21 bp, Homo sapiens
ggtcctggtggggcagctcct

SEQ ID NO: 5923284 - DNA, 23 bp, Homo sapiens
ggtcctggtgggtcagcccagca

SEQ ID NO: 5923285 - DNA, 15 bp, Homo sapiens
ggtcctgtcaccctg

SEQ ID NO: 5923286 - DNA, 17 bp, Homo sapiens
ggtcctgtcaccctggc

SEQ ID NO: 5923287 - DNA, 19 bp, Homo sapiens
ggtcctgtcaccctggccc

SEQ ID NO: 5923288 - DNA, 20 bp, Homo sapiens
ggtcctgtcaccctggcccc

SEQ ID NO: 5923289 - DNA, 15 bp, Homo sapiens
ggtcctgtccccgca

SEQ ID NO: 5923290 - DNA, 15 bp, Homo sapiens
ggtcctgtgcctgga

SEQ ID NO: 5923291 - DNA, 23 bp, Homo sapiens
ggtcctgtggatgggatcctctc

SEQ ID NO: 5923292 - DNA, 12 bp, Homo sapiens
ggtcctgtggca

SEQ ID NO: 5923293 - DNA, 16 bp, Homo sapiens
ggtcctgtggcaggca

SEQ ID NO: 5923294 - DNA, 18 bp, Homo sapiens
ggtcctgtggcaggcagc

SEQ ID NO: 5923295 - DNA, 20 bp, Homo sapiens
ggtcctgttaacgtcatctc

SEQ ID NO: 5923296 - DNA, 15 bp, Homo sapiens
ggtccttagtaaatt

SEQ ID NO: 5923297 - DNA, 23 bp, Homo sapiens
ggtccttcactggcgccttctcg

SEQ ID NO: 5923298 - DNA, 20 bp, Homo sapiens
ggtccttccactgtgcacct

SEQ ID NO: 5923299 - DNA, 11 bp, Homo sapiens
ggtccttcctg

SEQ ID NO: 5923300 - DNA, 14 bp, Homo sapiens
ggtccttgatgcca

SEQ ID NO: 5923301 - DNA, 16 bp, Homo sapiens
ggtccttgatgccaga

SEQ ID NO: 5923302 - DNA, 17 bp, Homo sapiens
ggtccttgatgccagag

SEQ ID NO: 5923303 - DNA, 16 bp, Homo sapiens
ggtccttgcacccctc

SEQ ID NO: 5923304 - DNA, 18 bp, Homo sapiens
ggtccttgcctcctggaa

SEQ ID NO: 5923305 - DNA, 15 bp, Homo sapiens
ggtccttgctgcagg

SEQ ID NO: 5923306 - DNA, 12 bp, Homo sapiens
ggtcctttctcc

SEQ ID NO: 5923307 - DNA, 16 bp, Homo sapiens
ggtcctttctggaagt

SEQ ID NO: 5923308 - DNA, 18 bp, Homo sapiens
ggtccttttgacactgct

SEQ ID NO: 5923309 - DNA, 17 bp, Homo sapiens
ggtcgacttcgggctgg

SEQ ID NO: 5923310 - DNA, 22 bp, Homo sapiens
ggtcgcagctaccctcagcctc

SEQ ID NO: 5923311 - DNA, 21 bp, Homo sapiens
ggtcgccacacccggctcccc

SEQ ID NO: 5923312 - DNA, 14 bp, Homo sapiens
ggtcgcccaggaga

SEQ ID NO: 5923313 - DNA, 14 bp, Homo sapiens
ggtcgcccatgaga

SEQ ID NO: 5923314 - DNA, 18 bp, Homo sapiens
ggtcgccccgtgtttgcg

SEQ ID NO: 5923315 - DNA, 18 bp, Homo sapiens
ggtcgcgatgatgggctg

SEQ ID NO: 5923316 - DNA, 18 bp, Homo sapiens
ggtcgctcaggccagtaa

SEQ ID NO: 5923317 - DNA, 14 bp, Homo sapiens
ggtcgctcctgccc

SEQ ID NO: 5923318 - DNA, 13 bp, Homo sapiens
ggtcggaaaacat

SEQ ID NO: 5923319 - DNA, 14 bp, Homo sapiens
ggtcggaaaacatg

SEQ ID NO: 5923320 - DNA, 13 bp, Homo sapiens
ggtcggaccagct

SEQ ID NO: 5923321 - DNA, 17 bp, Homo sapiens
ggtcggaggtgctgtcc

SEQ ID NO: 5923322 - DNA, 21 bp, Homo sapiens
ggtcggagtgcctggagtcag

SEQ ID NO: 5923323 - DNA, 17 bp, Homo sapiens
ggtcggccgccatagcc

SEQ ID NO: 5923324 - DNA, 17 bp, Homo sapiens
ggtcgggacagaccagc

SEQ ID NO: 5923325 - DNA, 20 bp, Homo sapiens
ggtcgggagttcaagaccag

SEQ ID NO: 5923326 - DNA, 22 bp, Homo sapiens
ggtcgggcagcacaagtgtaat

SEQ ID NO: 5923327 - DNA, 18 bp, Homo sapiens
ggtcgggcagtggaggct

SEQ ID NO: 5923328 - DNA, 22 bp, Homo sapiens
ggtcgggcagtggaggctgctg

SEQ ID NO: 5923329 - DNA, 15 bp, Homo sapiens
ggtcgggggaggagc

SEQ ID NO: 5923330 - DNA, 22 bp, Homo sapiens
ggtcgggggaggagcaccccca

SEQ ID NO: 5923331 - DNA, 14 bp, Homo sapiens
ggtcgggggggacc

SEQ ID NO: 5923332 - DNA, 13 bp, Homo sapiens
ggtcgggtgttaa

SEQ ID NO: 5923333 - DNA, 14 bp, Homo sapiens
ggtcgtaggggaga

SEQ ID NO: 5923334 - DNA, 14 bp, Homo sapiens
ggtcgtcatgctgt

SEQ ID NO: 5923335 - DNA, 18 bp, Homo sapiens
ggtcgtctttgtgtatgg

SEQ ID NO: 5923336 - DNA, 23 bp, Homo sapiens
ggtcgtcttttgaaaagctcact

SEQ ID NO: 5923337 - DNA, 14 bp, Homo sapiens
ggtcgtggagagct

SEQ ID NO: 5923338 - DNA, 19 bp, Homo sapiens
ggtcgtgggaaaggggagt

SEQ ID NO: 5923339 - DNA, 14 bp, Homo sapiens
ggtcgtgggccagt

SEQ ID NO: 5923340 - DNA, 19 bp, Homo sapiens
ggtcgtttatgtgtgcaga

SEQ ID NO: 5923341 - DNA, 15 bp, Homo sapiens
ggtctaaagagaaca

SEQ ID NO: 5923342 - DNA, 13 bp, Homo sapiens
ggtctaaagtgtt

SEQ ID NO: 5923343 - DNA, 17 bp, Homo sapiens
ggtctaaagtgtttagc

SEQ ID NO: 5923344 - DNA, 21 bp, Homo sapiens
ggtctaccaagtaagacatct

SEQ ID NO: 5923345 - DNA, 14 bp, Homo sapiens
ggtctactctagaa

SEQ ID NO: 5923346 - DNA, 14 bp, Homo sapiens
ggtctagaagaaca

SEQ ID NO: 5923347 - DNA, 21 bp, Homo sapiens
ggtctagaggcctgaaatcct

SEQ ID NO: 5923348 - DNA, 14 bp, Homo sapiens
ggtctagccgctgc

SEQ ID NO: 5923349 - DNA, 14 bp, Homo sapiens
ggtctaggacacag

SEQ ID NO: 5923350 - DNA, 22 bp, Homo sapiens
ggtctaggactttagggatctg

SEQ ID NO: 5923351 - DNA, 16 bp, Homo sapiens
ggtctagtgttcctgc

SEQ ID NO: 5923352 - DNA, 13 bp, Homo sapiens
ggtctataaaata

SEQ ID NO: 5923353 - DNA, 19 bp, Homo sapiens
ggtctataaaataaacttc

SEQ ID NO: 5923354 - DNA, 14 bp, Homo sapiens
ggtctatggggaga

SEQ ID NO: 5923355 - DNA, 23 bp, Homo sapiens
ggtctatgtcgagagctggccaa

SEQ ID NO: 5923356 - DNA, 15 bp, Homo sapiens
ggtctatgttcccca

SEQ ID NO: 5923357 - DNA, 16 bp, Homo sapiens
ggtctatgttccccag

SEQ ID NO: 5923358 - DNA, 23 bp, Homo sapiens
ggtctattgtcgctatgtgactt

SEQ ID NO: 5923359 - DNA, 12 bp, Homo sapiens
ggtctatttcta

SEQ ID NO: 5923360 - DNA, 20 bp, Homo sapiens
ggtctatttctcccttcaat

SEQ ID NO: 5923361 - DNA, 20 bp, Homo sapiens
ggtctcaaggttctcatttc

SEQ ID NO: 5923362 - DNA, 19 bp, Homo sapiens
ggtctcacactcctcctgc

SEQ ID NO: 5923363 - DNA, 23 bp, Homo sapiens
ggtctcacccatgcaagcagagg

SEQ ID NO: 5923364 - DNA, 15 bp, Homo sapiens
ggtctcaccctggag

SEQ ID NO: 5923365 - DNA, 20 bp, Homo sapiens
ggtctcaccctggaggcacc

SEQ ID NO: 5923366 - DNA, 22 bp, Homo sapiens
ggtctcactacttgaccattct

SEQ ID NO: 5923367 - DNA, 13 bp, Homo sapiens
ggtctcactgtgt

SEQ ID NO: 5923368 - DNA, 22 bp, Homo sapiens
ggtctcactgtgttgcccaggc

SEQ ID NO: 5923369 - DNA, 14 bp, Homo sapiens
ggtctcagaggagg

SEQ ID NO: 5923370 - DNA, 20 bp, Homo sapiens
ggtctcagcagcgaccaccc

SEQ ID NO: 5923371 - DNA, 13 bp, Homo sapiens
ggtctcagcatgt

SEQ ID NO: 5923372 - DNA, 18 bp, Homo sapiens
ggtctcagcccgggacag

SEQ ID NO: 5923373 - DNA, 11 bp, Homo sapiens
ggtctcagctt

SEQ ID NO: 5923374 - DNA, 23 bp, Homo sapiens
ggtctcagcttgtatatagagat

SEQ ID NO: 5923375 - DNA, 21 bp, Homo sapiens
ggtctcaggatatccttatca

SEQ ID NO: 5923376 - DNA, 22 bp, Homo sapiens
ggtctcaggatatccttatcag

SEQ ID NO: 5923377 - DNA, 14 bp, Homo sapiens
ggtctcaggcctcc

SEQ ID NO: 5923378 - DNA, 18 bp, Homo sapiens
ggtctcagggtgtcccag

SEQ ID NO: 5923379 - DNA, 18 bp, Homo sapiens
ggtctcatctcctttgct

SEQ ID NO: 5923380 - DNA, 16 bp, Homo sapiens
ggtctcatctcttcag

SEQ ID NO: 5923381 - DNA, 12 bp, Homo sapiens
ggtctcatgccc

SEQ ID NO: 5923382 - DNA, 17 bp, Homo sapiens
ggtctcatgccccgcca

SEQ ID NO: 5923383 - DNA, 13 bp, Homo sapiens
ggtctcatgcctg

SEQ ID NO: 5923384 - DNA, 12 bp, Homo sapiens
ggtctccacccc

SEQ ID NO: 5923385 - DNA, 17 bp, Homo sapiens
ggtctccaccccagggt

SEQ ID NO: 5923386 - DNA, 16 bp, Homo sapiens
ggtctccacctgtgct

SEQ ID NO: 5923387 - DNA, 13 bp, Homo sapiens
ggtctccaggggc

SEQ ID NO: 5923388 - DNA, 18 bp, Homo sapiens
ggtctccatatcagctct

SEQ ID NO: 5923389 - DNA, 17 bp, Homo sapiens
ggtctccatttttccca

SEQ ID NO: 5923390 - DNA, 19 bp, Homo sapiens
ggtctccatttttcccagg

SEQ ID NO: 5923391 - DNA, 19 bp, Homo sapiens
ggtctcccaaagtgctggg

SEQ ID NO: 5923392 - DNA, 20 bp, Homo sapiens
ggtctcccaaagtgctggga

SEQ ID NO: 5923393 - DNA, 21 bp, Homo sapiens
ggtctcccaaagtgctgggat

SEQ ID NO: 5923394 - DNA, 16 bp, Homo sapiens
ggtctcccacgtggga

SEQ ID NO: 5923395 - DNA, 15 bp, Homo sapiens
ggtctccccaattct

SEQ ID NO: 5923396 - DNA, 20 bp, Homo sapiens
ggtctccccaattctcccct

SEQ ID NO: 5923397 - DNA, 15 bp, Homo sapiens
ggtctccccatcccc

SEQ ID NO: 5923398 - DNA, 16 bp, Homo sapiens
ggtctcccctcctgca

SEQ ID NO: 5923399 - DNA, 19 bp, Homo sapiens
ggtctccctccagctggaa

SEQ ID NO: 5923400 - DNA, 14 bp, Homo sapiens
ggtctccctctcct

SEQ ID NO: 5923401 - DNA, 15 bp, Homo sapiens
ggtctccctctcctg

SEQ ID NO: 5923402 - DNA, 19 bp, Homo sapiens
ggtctccctctcctgccta

SEQ ID NO: 5923403 - DNA, 11 bp, Homo sapiens
ggtctccctgg

SEQ ID NO: 5923404 - DNA, 17 bp, Homo sapiens
ggtctccctggctccct

SEQ ID NO: 5923405 - DNA, 12 bp, Homo sapiens
ggtctccctggg

SEQ ID NO: 5923406 - DNA, 14 bp, Homo sapiens
ggtctccctgggca

SEQ ID NO: 5923407 - DNA, 23 bp, Homo sapiens
ggtctccctggtggggtgtgcat

SEQ ID NO: 5923408 - DNA, 21 bp, Homo sapiens
ggtctccctgtgttacccagg

SEQ ID NO: 5923409 - DNA, 21 bp, Homo sapiens
ggtctcccttctctacactct

SEQ ID NO: 5923410 - DNA, 18 bp, Homo sapiens
ggtctcctcagggtgggg

SEQ ID NO: 5923411 - DNA, 14 bp, Homo sapiens
ggtctcctccaccg

SEQ ID NO: 5923412 - DNA, 12 bp, Homo sapiens
ggtctcctccca

SEQ ID NO: 5923413 - DNA, 16 bp, Homo sapiens
ggtctcctctcagctt

SEQ ID NO: 5923414 - DNA, 20 bp, Homo sapiens
ggtctcctctgattatcagg

SEQ ID NO: 5923415 - DNA, 13 bp, Homo sapiens
ggtctcctgggaa

SEQ ID NO: 5923416 - DNA, 23 bp, Homo sapiens
ggtctccttaattaatgtacaca

SEQ ID NO: 5923417 - DNA, 18 bp, Homo sapiens
ggtctccttactctgagc

SEQ ID NO: 5923418 - DNA, 13 bp, Homo sapiens
ggtctccttcctt

SEQ ID NO: 5923419 - DNA, 14 bp, Homo sapiens
ggtctccttccttc

SEQ ID NO: 5923420 - DNA, 17 bp, Homo sapiens
ggtctcgaactcctgac

SEQ ID NO: 5923421 - DNA, 19 bp, Homo sapiens
ggtctcgaactcctgacct

SEQ ID NO: 5923422 - DNA, 19 bp, Homo sapiens
ggtctcgaactcctggcct

SEQ ID NO: 5923423 - DNA, 16 bp, Homo sapiens
ggtctcgatctcctga

SEQ ID NO: 5923424 - DNA, 18 bp, Homo sapiens
ggtctcgatgctgctggc

SEQ ID NO: 5923425 - DNA, 19 bp, Homo sapiens
ggtgaggccggccctgccc

SEQ ID NO: 5923426 - DNA, 23 bp, Homo sapiens
ggtgaggccggccctgcccctcc

SEQ ID NO: 5923427 - DNA, 18 bp, Homo sapiens
ggtgaggcgtgggatcca

SEQ ID NO: 5923428 - DNA, 19 bp, Homo sapiens
ggtgaggcgttctcctgct

SEQ ID NO: 5923429 - DNA, 20 bp, Homo sapiens
ggtgaggcgttctcctgctt

SEQ ID NO: 5923430 - DNA, 22 bp, Homo sapiens
ggtgaggctgacatgctcacac

SEQ ID NO: 5923431 - DNA, 13 bp, Homo sapiens
ggtgagggaagga

SEQ ID NO: 5923432 - DNA, 16 bp, Homo sapiens
ggtgagggacagagcc

SEQ ID NO: 5923433 - DNA, 15 bp, Homo sapiens
ggtgagggaggcctg

SEQ ID NO: 5923434 - DNA, 18 bp, Homo sapiens
ggtgagggctgagagggc

SEQ ID NO: 5923435 - DNA, 16 bp, Homo sapiens
ggtgaggggaggggcc

SEQ ID NO: 5923436 - DNA, 14 bp, Homo sapiens
ggtgaggggcagga

SEQ ID NO: 5923437 - DNA, 17 bp, Homo sapiens
ggtgaggggcaggacct

SEQ ID NO: 5923438 - DNA, 19 bp, Homo sapiens
ggtgaggggccactgggcc

SEQ ID NO: 5923439 - DNA, 17 bp, Homo sapiens
ggtgaggggctggcact

SEQ ID NO: 5923440 - DNA, 18 bp, Homo sapiens
ggtgaggggctttctctt

SEQ ID NO: 5923441 - DNA, 14 bp, Homo sapiens
ggtgagggtgacag

SEQ ID NO: 5923442 - DNA, 19 bp, Homo sapiens
ggtgagggtgacagaggga

SEQ ID NO: 5923443 - DNA, 14 bp, Homo sapiens
ggtgagggtgcccc

SEQ ID NO: 5923444 - DNA, 21 bp, Homo sapiens
ggtgagggtggggtgccccag

SEQ ID NO: 5923445 - DNA, 17 bp, Homo sapiens
ggtgaggtcaggtgcct

SEQ ID NO: 5923446 - DNA, 19 bp, Homo sapiens
ggtgaggtgaactccaggc

SEQ ID NO: 5923447 - DNA, 12 bp, Homo sapiens
ggtgaggtggcc

SEQ ID NO: 5923448 - DNA, 21 bp, Homo sapiens
ggtgaggtgggggtctggcct

SEQ ID NO: 5923449 - DNA, 23 bp, Homo sapiens
ggtgaggtgggggtctggcctag

SEQ ID NO: 5923450 - DNA, 21 bp, Homo sapiens
ggtgagtcccctactccctct

SEQ ID NO: 5923451 - DNA, 17 bp, Homo sapiens
ggtgagtctgaaccaat

SEQ ID NO: 5923452 - DNA, 17 bp, Homo sapiens
ggtgagtcttggcggca

SEQ ID NO: 5923453 - DNA, 23 bp, Homo sapiens
ggtgagtcttggttctaaaggta

SEQ ID NO: 5923454 - DNA, 23 bp, Homo sapiens
ggtgagtggaagggaggagcagc

SEQ ID NO: 5923455 - DNA, 13 bp, Homo sapiens
ggtgagtggctga

SEQ ID NO: 5923456 - DNA, 23 bp, Homo sapiens
ggtgagtggggagacacctcaga

SEQ ID NO: 5923457 - DNA, 20 bp, Homo sapiens
ggtgagtttgagctgccttc

SEQ ID NO: 5923458 - DNA, 15 bp, Homo sapiens
ggtgataaggacatg

SEQ ID NO: 5923459 - DNA, 12 bp, Homo sapiens
ggtgataagtgg

SEQ ID NO: 5923460 - DNA, 21 bp, Homo sapiens
ggtgatataaagaatgaaagt

SEQ ID NO: 5923461 - DNA, 15 bp, Homo sapiens
ggtgatatccattct

SEQ ID NO: 5923462 - DNA, 21 bp, Homo sapiens
ggtgatatttttatgtgcagc

SEQ ID NO: 5923463 - DNA, 12 bp, Homo sapiens
ggtgatcagaag

SEQ ID NO: 5923464 - DNA, 13 bp, Homo sapiens
ggtgatcagaagg

SEQ ID NO: 5923465 - DNA, 16 bp, Homo sapiens
ggtgatcagaaggctg

SEQ ID NO: 5923466 - DNA, 23 bp, Homo sapiens
ggtgatcagaaggctggggccag

SEQ ID NO: 5923467 - DNA, 23 bp, Homo sapiens
ggtgatccacccacctcagcctc

SEQ ID NO: 5923468 - DNA, 24 bp, Homo sapiens
ggtgatccacccacctcagcctcc

SEQ ID NO: 5923469 - DNA, 21 bp, Homo sapiens
ggtgatccactcgccttcatc

SEQ ID NO: 5923470 - DNA, 23 bp, Homo sapiens
ggtgatccgcccacctcagcctc

SEQ ID NO: 5923471 - DNA, 22 bp, Homo sapiens
ggtgatccgcccgcctctgcct

SEQ ID NO: 5923472 - DNA, 16 bp, Homo sapiens
ggtgatcctctatttt

SEQ ID NO: 5923473 - DNA, 18 bp, Homo sapiens
ggtgatcctctattttgt

SEQ ID NO: 5923474 - DNA, 19 bp, Homo sapiens
ggtgatctcctgtggctca

SEQ ID NO: 5923475 - DNA, 19 bp, Homo sapiens
ggtgatctgtagacttctg

SEQ ID NO: 5923476 - DNA, 12 bp, Homo sapiens
ggtgatgaattt

SEQ ID NO: 5923477 - DNA, 15 bp, Homo sapiens
ggtgatgagacctgg

SEQ ID NO: 5923478 - DNA, 19 bp, Homo sapiens
ggtgatgagggcagcagcc

SEQ ID NO: 5923479 - DNA, 12 bp, Homo sapiens
ggtgatgcaagt

SEQ ID NO: 5923480 - DNA, 20 bp, Homo sapiens
ggtgatgcttttgctgctgc

SEQ ID NO: 5923481 - DNA, 13 bp, Homo sapiens
ggtgatggagagg

SEQ ID NO: 5923482 - DNA, 13 bp, Homo sapiens
ggtgatgggcaga

SEQ ID NO: 5923483 - DNA, 13 bp, Homo sapiens
ggtgatggggagg

SEQ ID NO: 5923484 - DNA, 23 bp, Homo sapiens
ggtgatggggctgttgagatgcc

SEQ ID NO: 5923485 - DNA, 19 bp, Homo sapiens
ggtgatgtaaaacagaata

SEQ ID NO: 5923486 - DNA, 15 bp, Homo sapiens
ggtgatgtaaatagt

SEQ ID NO: 5923487 - DNA, 16 bp, Homo sapiens
ggtgatgtttccagct

SEQ ID NO: 5923488 - DNA, 19 bp, Homo sapiens
ggtgatgtttccagctgcc

SEQ ID NO: 5923489 - DNA, 13 bp, Homo sapiens
ggtgattaaaaag

SEQ ID NO: 5923490 - DNA, 14 bp, Homo sapiens
ggtgattaaatatt

SEQ ID NO: 5923491 - DNA, 17 bp, Homo sapiens
ggtgattaaatatttaa

SEQ ID NO: 5923492 - DNA, 16 bp, Homo sapiens
ggtgattacctgaaag

SEQ ID NO: 5923493 - DNA, 14 bp, Homo sapiens
ggtgattcaccaaa

SEQ ID NO: 5923494 - DNA, 20 bp, Homo sapiens
ggtgattcctcccaggaggt

SEQ ID NO: 5923495 - DNA, 21 bp, Homo sapiens
ggtgattccttcaattcaaaa

SEQ ID NO: 5923496 - DNA, 20 bp, Homo sapiens
ggtgattctaatcatctgca

SEQ ID NO: 5923497 - DNA, 14 bp, Homo sapiens
ggtgattgaaagaa

SEQ ID NO: 5923498 - DNA, 14 bp, Homo sapiens
ggtgattggctcct

SEQ ID NO: 5923499 - DNA, 23 bp, Homo sapiens
ggtgatttcagactgcagagggg

SEQ ID NO: 5923500 - DNA, 15 bp, Homo sapiens
ggtgatttcagagag

SEQ ID NO: 5923501 - DNA, 21 bp, Homo sapiens
ggtgatttcttgctaagctcc

SEQ ID NO: 5923502 - DNA, 15 bp, Homo sapiens
ggtgattttcctgtg

SEQ ID NO: 5923503 - DNA, 14 bp, Homo sapiens
ggtgcaaaaaaaaa

SEQ ID NO: 5923504 - DNA, 22 bp, Homo sapiens
ggtgcaaagactctgagccaag

SEQ ID NO: 5923505 - DNA, 15 bp, Homo sapiens
ggtgcaaattcagaa

SEQ ID NO: 5923506 - DNA, 13 bp, Homo sapiens
ggtgcaagagaca

SEQ ID NO: 5923507 - DNA, 14 bp, Homo sapiens
ggtgcaagagacag

SEQ ID NO: 5923508 - DNA, 16 bp, Homo sapiens
ggtgcaagagacagag

SEQ ID NO: 5923509 - DNA, 17 bp, Homo sapiens
ggtgcaagagacagagc

SEQ ID NO: 5923510 - DNA, 15 bp, Homo sapiens
ggtgcaagagggagc

SEQ ID NO: 5923511 - DNA, 20 bp, Homo sapiens
ggtgcaatgggggagggagg

SEQ ID NO: 5923512 - DNA, 21 bp, Homo sapiens
ggtgcaatgtgtgtatatgga

SEQ ID NO: 5923513 - DNA, 19 bp, Homo sapiens
ggtgcaattaactctggac

SEQ ID NO: 5923514 - DNA, 16 bp, Homo sapiens
ggtgcacacatcacca

SEQ ID NO: 5923515 - DNA, 21 bp, Homo sapiens
ggtgcacagacctcagagatg

SEQ ID NO: 5923516 - DNA, 20 bp, Homo sapiens
ggtgcacagacgtccctcca

SEQ ID NO: 5923517 - DNA, 13 bp, Homo sapiens
ggtgcacaggagg

SEQ ID NO: 5923518 - DNA, 15 bp, Homo sapiens
ggtgcacagtgattt

SEQ ID NO: 5923519 - DNA, 16 bp, Homo sapiens
ggtgcacagtgatttt

SEQ ID NO: 5923520 - DNA, 22 bp, Homo sapiens
ggtgcacattttccacggaaac

SEQ ID NO: 5923521 - DNA, 17 bp, Homo sapiens
ggtgcacccacctgttt

SEQ ID NO: 5923522 - DNA, 19 bp, Homo sapiens
ggtgcacccactcaccagg

SEQ ID NO: 5923523 - DNA, 20 bp, Homo sapiens
ggtgcactccagactctggg

SEQ ID NO: 5923524 - DNA, 17 bp, Homo sapiens
ggtgcactggccccacc

SEQ ID NO: 5923525 - DNA, 13 bp, Homo sapiens
ggtgcactgggag

SEQ ID NO: 5923526 - DNA, 15 bp, Homo sapiens
ggtgcactttgtaaa

SEQ ID NO: 5923527 - DNA, 16 bp, Homo sapiens
ggtgcactttgtaaat

SEQ ID NO: 5923528 - DNA, 17 bp, Homo sapiens
ggtgcagagaagctgga

SEQ ID NO: 5923529 - DNA, 20 bp, Homo sapiens
ggtgcagagaagctggactt

SEQ ID NO: 5923530 - DNA, 13 bp, Homo sapiens
ggtgcagaggctg

SEQ ID NO: 5923531 - DNA, 11 bp, Homo sapiens
ggtgcagaggt

SEQ ID NO: 5923532 - DNA, 13 bp, Homo sapiens
ggtgcagccagag

SEQ ID NO: 5923533 - DNA, 17 bp, Homo sapiens
ggtgcagccagaggcac

SEQ ID NO: 5923534 - DNA, 16 bp, Homo sapiens
ggtgcagccccaggac

SEQ ID NO: 5923535 - DNA, 22 bp, Homo sapiens
ggtgcagcggtggaaggagcct

SEQ ID NO: 5923536 - DNA, 23 bp, Homo sapiens
ggtgcagcggtggaaggagcctg

SEQ ID NO: 5923537 - DNA, 19 bp, Homo sapiens
ggtgcagcgtgtgtgccac

SEQ ID NO: 5923538 - DNA, 21 bp, Homo sapiens
ggtgcagcgtgtgtgccacct

SEQ ID NO: 5923539 - DNA, 19 bp, Homo sapiens
ggtgcagcttcacccacca

SEQ ID NO: 5923540 - DNA, 12 bp, Homo sapiens
ggtgcagggcct

SEQ ID NO: 5923541 - DNA, 18 bp, Homo sapiens
ggtgcagggcctggcata

SEQ ID NO: 5923542 - DNA, 18 bp, Homo sapiens
ggtgcaggggccaggggt

SEQ ID NO: 5923543 - DNA, 12 bp, Homo sapiens
ggtgcaggtaga

SEQ ID NO: 5923544 - DNA, 17 bp, Homo sapiens
ggtgcaggtctccacct

SEQ ID NO: 5923545 - DNA, 19 bp, Homo sapiens
ggtgcaggtctccacctgc

SEQ ID NO: 5923546 - DNA, 13 bp, Homo sapiens
ggtgcaggtgggc

SEQ ID NO: 5923547 - DNA, 15 bp, Homo sapiens
ggtgcaggtgggcac

SEQ ID NO: 5923548 - DNA, 16 bp, Homo sapiens
ggtgcaggtgggcact

SEQ ID NO: 5923549 - DNA, 13 bp, Homo sapiens
ggtgcagtggagg

SEQ ID NO: 5923550 - DNA, 17 bp, Homo sapiens
ggtgcagtggcaaagga

SEQ ID NO: 5923551 - DNA, 18 bp, Homo sapiens
ggtgcagtggcaaaggat

SEQ ID NO: 5923552 - DNA, 18 bp, Homo sapiens
ggtgcagttgacagcagg

SEQ ID NO: 5923553 - DNA, 20 bp, Homo sapiens
ggtgcagttgacagcaggtg

SEQ ID NO: 5923554 - DNA, 18 bp, Homo sapiens
ggtgcagttgctcattgt

SEQ ID NO: 5923555 - DNA, 22 bp, Homo sapiens
ggtgcatacacccccacctcct

SEQ ID NO: 5923556 - DNA, 21 bp, Homo sapiens
ggtgcatcctcctcagccccc

SEQ ID NO: 5923557 - DNA, 23 bp, Homo sapiens
ggtgcatctggcacgtggccagg

SEQ ID NO: 5923558 - DNA, 19 bp, Homo sapiens
ggtgcatgcatgccctctc

SEQ ID NO: 5923559 - DNA, 20 bp, Homo sapiens
ggtgcatgcatgccctctct

SEQ ID NO: 5923560 - DNA, 17 bp, Homo sapiens
ggtgcatggcttgggga

SEQ ID NO: 5923561 - DNA, 17 bp, Homo sapiens
ggtgcattgctgtgtga

SEQ ID NO: 5923562 - DNA, 18 bp, Homo sapiens
ggtgccaaaaccaggcct

SEQ ID NO: 5923563 - DNA, 20 bp, Homo sapiens
ggtgccaaaaccaggcctct

SEQ ID NO: 5923564 - DNA, 17 bp, Homo sapiens
ggtgccaaacccagccc

SEQ ID NO: 5923565 - DNA, 19 bp, Homo sapiens
ggtgccaaacccagcccct

SEQ ID NO: 5923566 - DNA, 17 bp, Homo sapiens
ggtgccaaatagcccca

SEQ ID NO: 5923567 - DNA, 22 bp, Homo sapiens
ggtgccaaatagccccagactg

SEQ ID NO: 5923568 - DNA, 22 bp, Homo sapiens
ggtgccaacagtgttaggcctg

SEQ ID NO: 5923569 - DNA, 22 bp, Homo sapiens
ggtgccaaccacctctggccct

SEQ ID NO: 5923570 - DNA, 13 bp, Homo sapiens
ggtgccaagatgg

SEQ ID NO: 5923571 - DNA, 19 bp, Homo sapiens
ggtgccaagggccccaggg

SEQ ID NO: 5923572 - DNA, 21 bp, Homo sapiens
ggtgccaagggccccaggggc

SEQ ID NO: 5923573 - DNA, 22 bp, Homo sapiens
ggtgccaagggccccaggggca

SEQ ID NO: 5923574 - DNA, 23 bp, Homo sapiens
ggtgccaatttcaagttccaagt

SEQ ID NO: 5923575 - DNA, 18 bp, Homo sapiens
ggtgccacaaataaaatg

SEQ ID NO: 5923576 - DNA, 22 bp, Homo sapiens
ggtgccacagagggctgtgtct

SEQ ID NO: 5923577 - DNA, 17 bp, Homo sapiens
ggtgccaccaataaaaa

SEQ ID NO: 5923578 - DNA, 21 bp, Homo sapiens
ggtgccaccaccctgcccccc

SEQ ID NO: 5923579 - DNA, 20 bp, Homo sapiens
ggtgccacccagtagcccag

SEQ ID NO: 5923580 - DNA, 22 bp, Homo sapiens
ggtgccaccgtccctctgcaga

SEQ ID NO: 5923581 - DNA, 18 bp, Homo sapiens
ggtgccactccctgagct

SEQ ID NO: 5923582 - DNA, 13 bp, Homo sapiens
ggtgccactgacc

SEQ ID NO: 5923583 - DNA, 23 bp, Homo sapiens
ggtgccacttcttaaaggcctgg

SEQ ID NO: 5923584 - DNA, 16 bp, Homo sapiens
ggtgccagcaaagccc

SEQ ID NO: 5923585 - DNA, 19 bp, Homo sapiens
ggtgccagcaactgaataa

SEQ ID NO: 5923586 - DNA, 20 bp, Homo sapiens
ggtgccagccttcctctgca

SEQ ID NO: 5923587 - DNA, 12 bp, Homo sapiens
ggtgccagctgc

SEQ ID NO: 5923588 - DNA, 13 bp, Homo sapiens
ggtgccagctgcc

SEQ ID NO: 5923589 - DNA, 15 bp, Homo sapiens
ggtgccagctgccct

SEQ ID NO: 5923590 - DNA, 16 bp, Homo sapiens
ggtgccagctgccctt

SEQ ID NO: 5923591 - DNA, 18 bp, Homo sapiens
ggtgccagctgcccttgc

SEQ ID NO: 5923592 - DNA, 12 bp, Homo sapiens
ggtgccaggaca

SEQ ID NO: 5923593 - DNA, 13 bp, Homo sapiens
ggtgccaggacaa

SEQ ID NO: 5923594 - DNA, 18 bp, Homo sapiens
ggtgccagggcccacccc

SEQ ID NO: 5923595 - DNA, 15 bp, Homo sapiens
ggtgccagggtgggt

SEQ ID NO: 5923596 - DNA, 17 bp, Homo sapiens
ggtgccaggttttctgg

SEQ ID NO: 5923597 - DNA, 23 bp, Homo sapiens
ggtgccagtcctcctcaggagaa

SEQ ID NO: 5923598 - DNA, 14 bp, Homo sapiens
ggtgccagttgggc

SEQ ID NO: 5923599 - DNA, 14 bp, Homo sapiens
ggtgccatcacgct

SEQ ID NO: 5923600 - DNA, 15 bp, Homo sapiens
ggtgccatcacgctt

SEQ ID NO: 5923601 - DNA, 18 bp, Homo sapiens
ggtgccatgcctgctccc

SEQ ID NO: 5923602 - DNA, 13 bp, Homo sapiens
ggtgctgctcagg

SEQ ID NO: 5923603 - DNA, 16 bp, Homo sapiens
ggtgctgctttgcttc

SEQ ID NO: 5923604 - DNA, 18 bp, Homo sapiens
ggtgctggcatgtctggg

SEQ ID NO: 5923605 - DNA, 19 bp, Homo sapiens
ggtgctgggaatacatctg

SEQ ID NO: 5923606 - DNA, 19 bp, Homo sapiens
ggtgctgggactgagccag

SEQ ID NO: 5923607 - DNA, 24 bp, Homo sapiens
ggtgctgggactgagccagtccca

SEQ ID NO: 5923608 - DNA, 15 bp, Homo sapiens
ggtgctgggaggagg

SEQ ID NO: 5923609 - DNA, 17 bp, Homo sapiens
ggtgctgggctggactg

SEQ ID NO: 5923610 - DNA, 22 bp, Homo sapiens
ggtgctgggctggactggccat

SEQ ID NO: 5923611 - DNA, 16 bp, Homo sapiens
ggtgctggggcagagt

SEQ ID NO: 5923612 - DNA, 14 bp, Homo sapiens
ggtgctggggccag

SEQ ID NO: 5923613 - DNA, 16 bp, Homo sapiens
ggtgctggggccaggg

SEQ ID NO: 5923614 - DNA, 19 bp, Homo sapiens
ggtgctggggccagggcag

SEQ ID NO: 5923615 - DNA, 14 bp, Homo sapiens
ggtgctggggctgc

SEQ ID NO: 5923616 - DNA, 15 bp, Homo sapiens
ggtgctggggctgca

SEQ ID NO: 5923617 - DNA, 15 bp, Homo sapiens
ggtgctggtagctga

SEQ ID NO: 5923618 - DNA, 19 bp, Homo sapiens
ggtgctggtagctgagggg

SEQ ID NO: 5923619 - DNA, 12 bp, Homo sapiens
ggtgctggttta

SEQ ID NO: 5923620 - DNA, 20 bp, Homo sapiens
ggtgctgtcatgcccagctt

SEQ ID NO: 5923621 - DNA, 15 bp, Homo sapiens
ggtgctgtcctcagg

SEQ ID NO: 5923622 - DNA, 22 bp, Homo sapiens
ggtgctgtcttttgttctctga

SEQ ID NO: 5923623 - DNA, 23 bp, Homo sapiens
ggtgctgtgaggcttgcccagga

SEQ ID NO: 5923624 - DNA, 14 bp, Homo sapiens
ggtgctgtgaggga

SEQ ID NO: 5923625 - DNA, 17 bp, Homo sapiens
ggtgctgtgagggaggg

SEQ ID NO: 5923626 - DNA, 17 bp, Homo sapiens
ggtgctgtggtggggag

SEQ ID NO: 5923627 - DNA, 15 bp, Homo sapiens
ggtgctgtgtgcccc

SEQ ID NO: 5923628 - DNA, 22 bp, Homo sapiens
ggtgctgtgtgccccactccag

SEQ ID NO: 5923629 - DNA, 22 bp, Homo sapiens
ggtgctgttgtcattgctttac

SEQ ID NO: 5923630 - DNA, 20 bp, Homo sapiens
ggtgcttaagcagaagcatt

SEQ ID NO: 5923631 - DNA, 17 bp, Homo sapiens
ggtgcttacacatctca

SEQ ID NO: 5923632 - DNA, 19 bp, Homo sapiens
ggtgcttattctcaaagca

SEQ ID NO: 5923633 - DNA, 15 bp, Homo sapiens
ggtgcttcagccctg

SEQ ID NO: 5923634 - DNA, 13 bp, Homo sapiens
ggtgcttccccca

SEQ ID NO: 5923635 - DNA, 15 bp, Homo sapiens
ggtgcttctggaaac

SEQ ID NO: 5923636 - DNA, 13 bp, Homo sapiens
ggtgcttgctccc

SEQ ID NO: 5923637 - DNA, 14 bp, Homo sapiens
ggtgcttggagggg

SEQ ID NO: 5923638 - DNA, 14 bp, Homo sapiens
ggtgcttggcagga

SEQ ID NO: 5923639 - DNA, 13 bp, Homo sapiens
ggtgcttgggctt

SEQ ID NO: 5923640 - DNA, 18 bp, Homo sapiens
ggtgcttggtgagtcttg

SEQ ID NO: 5923641 - DNA, 15 bp, Homo sapiens
ggtgcttgtgtcact

SEQ ID NO: 5923642 - DNA, 21 bp, Homo sapiens
ggtgctttcaggtctggggct

SEQ ID NO: 5923643 - DNA, 14 bp, Homo sapiens
ggtgctttccttca

SEQ ID NO: 5923644 - DNA, 16 bp, Homo sapiens
ggtgctttctgtgaaa

SEQ ID NO: 5923645 - DNA, 17 bp, Homo sapiens
ggtgcttttggcagaga

SEQ ID NO: 5923646 - DNA, 18 bp, Homo sapiens
ggtgctttttataaaaag

SEQ ID NO: 5923647 - DNA, 18 bp, Homo sapiens
ggtggaacaactctggga

SEQ ID NO: 5923648 - DNA, 15 bp, Homo sapiens
ggtggaacaagcaca

SEQ ID NO: 5923649 - DNA, 15 bp, Homo sapiens
ggtggaacaggagga

SEQ ID NO: 5923650 - DNA, 19 bp, Homo sapiens
ggtggaacatatggtctcc

SEQ ID NO: 5923651 - DNA, 14 bp, Homo sapiens
ggtggaagagctca

SEQ ID NO: 5923652 - DNA, 18 bp, Homo sapiens
ggtggaagcagaggccct

SEQ ID NO: 5923653 - DNA, 13 bp, Homo sapiens
ggtggaagccctc

SEQ ID NO: 5923654 - DNA, 18 bp, Homo sapiens
ggtggaagccctccttcc

SEQ ID NO: 5923655 - DNA, 19 bp, Homo sapiens
ggtggaagcttggggaaga

SEQ ID NO: 5923656 - DNA, 17 bp, Homo sapiens
ggtggaaggaccctgtg

SEQ ID NO: 5923657 - DNA, 13 bp, Homo sapiens
ggtggaaggagaa

SEQ ID NO: 5923658 - DNA, 16 bp, Homo sapiens
ggtggaaggagcctgc

SEQ ID NO: 5923659 - DNA, 15 bp, Homo sapiens
ggtggaaggaggcgc

SEQ ID NO: 5923660 - DNA, 16 bp, Homo sapiens
ggtggaaggcccgagg

SEQ ID NO: 5923661 - DNA, 17 bp, Homo sapiens
ggtggaagggcaggagc

SEQ ID NO: 5923662 - DNA, 21 bp, Homo sapiens
ggtggaagggcaggagctcac

SEQ ID NO: 5923663 - DNA, 17 bp, Homo sapiens
ggtggaagggctgggtg

SEQ ID NO: 5923664 - DNA, 21 bp, Homo sapiens
ggtggaagggggtgtgcgtgc

SEQ ID NO: 5923665 - DNA, 20 bp, Homo sapiens
ggtggaaggtaagaggttgg

SEQ ID NO: 5923666 - DNA, 20 bp, Homo sapiens
ggtggaatgcgggggagcag

SEQ ID NO: 5923667 - DNA, 16 bp, Homo sapiens
ggtggaattacttaaa

SEQ ID NO: 5923668 - DNA, 18 bp, Homo sapiens
ggtggacatctgacccca

SEQ ID NO: 5923669 - DNA, 20 bp, Homo sapiens
ggtggaccacgccgccctcc

SEQ ID NO: 5923670 - DNA, 20 bp, Homo sapiens
ggtggacctggcagtggtgg

SEQ ID NO: 5923671 - DNA, 23 bp, Homo sapiens
ggtggacttagaaagcaggggct

SEQ ID NO: 5923672 - DNA, 21 bp, Homo sapiens
ggtggagaaaattggaactct

SEQ ID NO: 5923673 - DNA, 21 bp, Homo sapiens
ggtggagaagatcgcatggca

SEQ ID NO: 5923674 - DNA, 13 bp, Homo sapiens
ggtggagaagcca

SEQ ID NO: 5923675 - DNA, 15 bp, Homo sapiens
ggtggagaagccatt

SEQ ID NO: 5923676 - DNA, 14 bp, Homo sapiens
ggtggagaagggag

SEQ ID NO: 5923677 - DNA, 19 bp, Homo sapiens
ggtggagaagggagggtgg

SEQ ID NO: 5923678 - DNA, 16 bp, Homo sapiens
ggtggagaagtgtcgt

SEQ ID NO: 5923679 - DNA, 20 bp, Homo sapiens
ggtggagagggagatgtgtg

SEQ ID NO: 5923680 - DNA, 15 bp, Homo sapiens
ggtggagagtggaag

SEQ ID NO: 5923681 - DNA, 18 bp, Homo sapiens
ggtggagcactggactcc

SEQ ID NO: 5923682 - DNA, 12 bp, Homo sapiens
ggtggagccagg

SEQ ID NO: 5923683 - DNA, 21 bp, Homo sapiens
ggtggaggaagggctgggcca

SEQ ID NO: 5923684 - DNA, 16 bp, Homo sapiens
ggtggaggaccgaggc

SEQ ID NO: 5923685 - DNA, 17 bp, Homo sapiens
ggtggaggaccgaggct

SEQ ID NO: 5923686 - DNA, 13 bp, Homo sapiens
ggtggaggagagc

SEQ ID NO: 5923687 - DNA, 18 bp, Homo sapiens
ggtggaggattgctgcca

SEQ ID NO: 5923688 - DNA, 15 bp, Homo sapiens
ggtggaggcttcctg

SEQ ID NO: 5923689 - DNA, 15 bp, Homo sapiens
ggtggagggcacagc

SEQ ID NO: 5923690 - DNA, 23 bp, Homo sapiens
ggtggagggccacatgggaggct

SEQ ID NO: 5923691 - DNA, 17 bp, Homo sapiens
ggtggaggggcgcccag

SEQ ID NO: 5923692 - DNA, 19 bp, Homo sapiens
ggtggagggggaggggaga

SEQ ID NO: 5923693 - DNA, 20 bp, Homo sapiens
ggtggagggtggggggcgct

SEQ ID NO: 5923694 - DNA, 17 bp, Homo sapiens
ggtggaggttgcagtga

SEQ ID NO: 5923695 - DNA, 21 bp, Homo sapiens
ggtggaggttgcagtgagcca

SEQ ID NO: 5923696 - DNA, 20 bp, Homo sapiens
ggtggaggttgcagtgagct

SEQ ID NO: 5923697 - DNA, 15 bp, Homo sapiens
ggtggagtgagactg

SEQ ID NO: 5923698 - DNA, 16 bp, Homo sapiens
ggtggagtgagactga

SEQ ID NO: 5923699 - DNA, 15 bp, Homo sapiens
ggtggagttgaaaga

SEQ ID NO: 5923700 - DNA, 20 bp, Homo sapiens
ggtggatactggggggcagg

SEQ ID NO: 5923701 - DNA, 17 bp, Homo sapiens
ggtggatcacagaggct

SEQ ID NO: 5923702 - DNA, 17 bp, Homo sapiens
ggtggatctccttgaga

SEQ ID NO: 5923703 - DNA, 20 bp, Homo sapiens
ggtggatgatccccacgcca

SEQ ID NO: 5923704 - DNA, 13 bp, Homo sapiens
ggtggatgcctgg

SEQ ID NO: 5923705 - DNA, 21 bp, Homo sapiens
ggtggatgcctggtggcagct

SEQ ID NO: 5923706 - DNA, 15 bp, Homo sapiens
ggtggatggtgactt

SEQ ID NO: 5923707 - DNA, 22 bp, Homo sapiens
ggtggatggtgacttttgaaga

SEQ ID NO: 5923708 - DNA, 14 bp, Homo sapiens
ggtggatgtgagca

SEQ ID NO: 5923709 - DNA, 17 bp, Homo sapiens
ggtggatgtgctggagg

SEQ ID NO: 5923710 - DNA, 18 bp, Homo sapiens
ggtggatgttatgaacag

SEQ ID NO: 5923711 - DNA, 21 bp, Homo sapiens
ggtggcaacatttggggagag

SEQ ID NO: 5923712 - DNA, 17 bp, Homo sapiens
ggtggcaaggctgtgct

SEQ ID NO: 5923713 - DNA, 20 bp, Homo sapiens
ggtggcaaggctgtgctccc

SEQ ID NO: 5923714 - DNA, 20 bp, Homo sapiens
ggtggcacacgcctgtaatc

SEQ ID NO: 5923715 - DNA, 14 bp, Homo sapiens
ggtggcacaggcac

SEQ ID NO: 5923716 - DNA, 17 bp, Homo sapiens
ggtggcacatctgtcct

SEQ ID NO: 5923717 - DNA, 12 bp, Homo sapiens
ggtggcaccaga

SEQ ID NO: 5923718 - DNA, 18 bp, Homo sapiens
ggtggcacccaccactct

SEQ ID NO: 5923719 - DNA, 22 bp, Homo sapiens
ggtggcacccaccactctcagg

SEQ ID NO: 5923720 - DNA, 23 bp, Homo sapiens
ggtggcacccaccactctcagga

SEQ ID NO: 5923721 - DNA, 13 bp, Homo sapiens
ggtggcacctgca

SEQ ID NO: 5923722 - DNA, 20 bp, Homo sapiens
ggtggcacgggccctccctc

SEQ ID NO: 5923723 - DNA, 22 bp, Homo sapiens
ggtggcacttccacctccagcc

SEQ ID NO: 5923724 - DNA, 17 bp, Homo sapiens
ggtggcagatgtcttcc

SEQ ID NO: 5923725 - DNA, 15 bp, Homo sapiens
ggtggcagccctgta

SEQ ID NO: 5923726 - DNA, 13 bp, Homo sapiens
ggtggcagctgcg

SEQ ID NO: 5923727 - DNA, 15 bp, Homo sapiens
ggtggcagctgcggt

SEQ ID NO: 5923728 - DNA, 18 bp, Homo sapiens
ggtggcaggaccaggact

SEQ ID NO: 5923729 - DNA, 19 bp, Homo sapiens
ggtggcaggcgcctataat

SEQ ID NO: 5923730 - DNA, 14 bp, Homo sapiens
ggtggcagggaagg

SEQ ID NO: 5923731 - DNA, 19 bp, Homo sapiens
ggtggcagggaagggtgcc

SEQ ID NO: 5923732 - DNA, 23 bp, Homo sapiens
ggtggcagggaagggtgcctggc

SEQ ID NO: 5923733 - DNA, 14 bp, Homo sapiens
ggtggcagggctgt

SEQ ID NO: 5923734 - DNA, 14 bp, Homo sapiens
ggtggcaggtgggg

SEQ ID NO: 5923735 - DNA, 21 bp, Homo sapiens
ggtggcagtgcagcaaccaga

SEQ ID NO: 5923736 - DNA, 18 bp, Homo sapiens
ggtggcagtggaggtggg

SEQ ID NO: 5923737 - DNA, 19 bp, Homo sapiens
ggtggcagtgggagctgcc

SEQ ID NO: 5923738 - DNA, 21 bp, Homo sapiens
ggtggcatcattccaggcccg

SEQ ID NO: 5923739 - DNA, 18 bp, Homo sapiens
ggtggcatcctccggaga

SEQ ID NO: 5923740 - DNA, 16 bp, Homo sapiens
ggtggcatgaggaggt

SEQ ID NO: 5923741 - DNA, 20 bp, Homo sapiens
ggtggcatgcatggaggact

SEQ ID NO: 5923742 - DNA, 14 bp, Homo sapiens
ggtggcatgtgcct

SEQ ID NO: 5923743 - DNA, 23 bp, Homo sapiens
ggtggcatgtgcctatagtccca

SEQ ID NO: 5923744 - DNA, 19 bp, Homo sapiens
ggtggcatgtgcctgtatt

SEQ ID NO: 5923745 - DNA, 15 bp, Homo sapiens
ggtggcatttgcagg

SEQ ID NO: 5923746 - DNA, 17 bp, Homo sapiens
ggtggccaagcctgccc

SEQ ID NO: 5923747 - DNA, 18 bp, Homo sapiens
ggtggccaagcctgcccc

SEQ ID NO: 5923748 - DNA, 15 bp, Homo sapiens
ggtggccaagcctgg

SEQ ID NO: 5923749 - DNA, 16 bp, Homo sapiens
ggtggccaagcctggc

SEQ ID NO: 5923750 - DNA, 20 bp, Homo sapiens
ggtggccacacaggcagggc

SEQ ID NO: 5923751 - DNA, 14 bp, Homo sapiens
ggtggccacagcag

SEQ ID NO: 5923752 - DNA, 18 bp, Homo sapiens
ggtggccacagcaggact

SEQ ID NO: 5923753 - DNA, 20 bp, Homo sapiens
ggtggccacagcaggactga

SEQ ID NO: 5923754 - DNA, 13 bp, Homo sapiens
ggtggccacagcg

SEQ ID NO: 5923755 - DNA, 23 bp, Homo sapiens
ggtggccactccagacccctggc

SEQ ID NO: 5923756 - DNA, 23 bp, Homo sapiens
ggtggccactcctgggccccaga

SEQ ID NO: 5923757 - DNA, 14 bp, Homo sapiens
ggtggccagcccgc

SEQ ID NO: 5923758 - DNA, 23 bp, Homo sapiens
ggtggccagcccgcagaggtggg

SEQ ID NO: 5923759 - DNA, 22 bp, Homo sapiens
ggtggccaggcaggcgggggct

SEQ ID NO: 5923760 - DNA, 16 bp, Homo sapiens
ggtggccaggccggga

SEQ ID NO: 5923761 - DNA, 19 bp, Homo sapiens
ggtggccaggcctgccagc

SEQ ID NO: 5923762 - DNA, 15 bp, Homo sapiens
ggtggccaggctggt

SEQ ID NO: 5923763 - DNA, 12 bp, Homo sapiens
ggtggccagggc

SEQ ID NO: 5923764 - DNA, 14 bp, Homo sapiens
ggtggccagggctt

SEQ ID NO: 5923765 - DNA, 21 bp, Homo sapiens
ggtggccatccctgggcccct

SEQ ID NO: 5923766 - DNA, 22 bp, Homo sapiens
ggtggccatccctgggcccctc

SEQ ID NO: 5923767 - DNA, 20 bp, Homo sapiens
ggtggccatgcctcagccct

SEQ ID NO: 5923768 - DNA, 15 bp, Homo sapiens
ggtggccatgctcct

SEQ ID NO: 5923769 - DNA, 19 bp, Homo sapiens
ggtggccatgcttcttgcc

SEQ ID NO: 5923770 - DNA, 19 bp, Homo sapiens
ggtggccatgtcgcctgcc

SEQ ID NO: 5923771 - DNA, 19 bp, Homo sapiens
ggtggcccacgcctgtaat

SEQ ID NO: 5923772 - DNA, 12 bp, Homo sapiens
ggtggcccagag

SEQ ID NO: 5923773 - DNA, 17 bp, Homo sapiens
ggtggcccagagccata

SEQ ID NO: 5923774 - DNA, 14 bp, Homo sapiens
ggtggcccaggccc

SEQ ID NO: 5923775 - DNA, 22 bp, Homo sapiens
ggtggccccacctgagccccca

SEQ ID NO: 5923776 - DNA, 13 bp, Homo sapiens
ggtggccccagct

SEQ ID NO: 5923777 - DNA, 18 bp, Homo sapiens
ggtggccccctgtgccag

SEQ ID NO: 5923778 - DNA, 22 bp, Homo sapiens
ggtggccccctgtgccagctca

SEQ ID NO: 5923779 - DNA, 23 bp, Homo sapiens
ggtggccccctgtgccagctcag

SEQ ID NO: 5923780 - DNA, 23 bp, Homo sapiens
ggtgtgcctgtgctcctgcccag

SEQ ID NO: 5923781 - DNA, 18 bp, Homo sapiens
ggtgtgcggaggcaggag

SEQ ID NO: 5923782 - DNA, 19 bp, Homo sapiens
ggtgtgctagaacaaggtc

SEQ ID NO: 5923783 - DNA, 21 bp, Homo sapiens
ggtgtgctccaggcttcctgc

SEQ ID NO: 5923784 - DNA, 13 bp, Homo sapiens
ggtgtgctctgat

SEQ ID NO: 5923785 - DNA, 19 bp, Homo sapiens
ggtgtgctgggagctccac

SEQ ID NO: 5923786 - DNA, 17 bp, Homo sapiens
ggtgtggaggctcctgt

SEQ ID NO: 5923787 - DNA, 15 bp, Homo sapiens
ggtgtggatggcagt

SEQ ID NO: 5923788 - DNA, 18 bp, Homo sapiens
ggtgtggcccatggctgt

SEQ ID NO: 5923789 - DNA, 12 bp, Homo sapiens
ggtgtggcctca

SEQ ID NO: 5923790 - DNA, 14 bp, Homo sapiens
ggtgtggcctcagc

SEQ ID NO: 5923791 - DNA, 19 bp, Homo sapiens
ggtgtggcctcagccctca

SEQ ID NO: 5923792 - DNA, 19 bp, Homo sapiens
ggtgtggctcctaccagca

SEQ ID NO: 5923793 - DNA, 12 bp, Homo sapiens
ggtgtggctctg

SEQ ID NO: 5923794 - DNA, 19 bp, Homo sapiens
ggtgtggctttccaggcac

SEQ ID NO: 5923795 - DNA, 15 bp, Homo sapiens
ggtgtgggacacctg

SEQ ID NO: 5923796 - DNA, 13 bp, Homo sapiens
ggtgtgggctccc

SEQ ID NO: 5923797 - DNA, 23 bp, Homo sapiens
ggtgtgggctcccacgccctcct

SEQ ID NO: 5923798 - DNA, 23 bp, Homo sapiens
ggtgtggggctgccgatgggaaa

SEQ ID NO: 5923799 - DNA, 17 bp, Homo sapiens
ggtgtgggtgccctgtt

SEQ ID NO: 5923800 - DNA, 16 bp, Homo sapiens
ggtgtgggtggaaggg

SEQ ID NO: 5923801 - DNA, 15 bp, Homo sapiens
ggtgtggtacagaga

SEQ ID NO: 5923802 - DNA, 15 bp, Homo sapiens
ggtgtggtgaatgtg

SEQ ID NO: 5923803 - DNA, 15 bp, Homo sapiens
ggtgtggtgcagtgt

SEQ ID NO: 5923804 - DNA, 17 bp, Homo sapiens
ggtgtggtgcagtgtga

SEQ ID NO: 5923805 - DNA, 15 bp, Homo sapiens
ggtgtggtggctcat

SEQ ID NO: 5923806 - DNA, 16 bp, Homo sapiens
ggtgtgtccctggaca

SEQ ID NO: 5923807 - DNA, 20 bp, Homo sapiens
ggtgtgtccctggacacagc

SEQ ID NO: 5923808 - DNA, 21 bp, Homo sapiens
ggtgtgtccctggacacagct

SEQ ID NO: 5923809 - DNA, 23 bp, Homo sapiens
ggtgtgtccctggacacagctct

SEQ ID NO: 5923810 - DNA, 20 bp, Homo sapiens
ggtgtgtcctctgtgcccac

SEQ ID NO: 5923811 - DNA, 21 bp, Homo sapiens
ggtgtgtccttgaactgaggc

SEQ ID NO: 5923812 - DNA, 23 bp, Homo sapiens
ggtgtgtccttgaactgaggccc

SEQ ID NO: 5923813 - DNA, 12 bp, Homo sapiens
ggtgtgtctgct

SEQ ID NO: 5923814 - DNA, 18 bp, Homo sapiens
ggtgtgtggagatgcaga

SEQ ID NO: 5923815 - DNA, 22 bp, Homo sapiens
ggtgtgtggcctccctggctcc

SEQ ID NO: 5923816 - DNA, 16 bp, Homo sapiens
ggtgtgtgtctctgac

SEQ ID NO: 5923817 - DNA, 21 bp, Homo sapiens
ggtgtgttcgtggagccacag

SEQ ID NO: 5923818 - DNA, 22 bp, Homo sapiens
ggtgtgtttttgggatgtctta

SEQ ID NO: 5923819 - DNA, 13 bp, Homo sapiens
ggtgttaaacttt

SEQ ID NO: 5923820 - DNA, 18 bp, Homo sapiens
ggtgttaaagctgtacac

SEQ ID NO: 5923821 - DNA, 19 bp, Homo sapiens
ggtgttactagaaggcgtc

SEQ ID NO: 5923822 - DNA, 22 bp, Homo sapiens
ggtgttaggcatgtcccaccca

SEQ ID NO: 5923823 - DNA, 21 bp, Homo sapiens
ggtgttatcaccgtgggctcc

SEQ ID NO: 5923824 - DNA, 12 bp, Homo sapiens
ggtgttatttgg

SEQ ID NO: 5923825 - DNA, 21 bp, Homo sapiens
ggtgttattttcaatgaaaca

SEQ ID NO: 5923826 - DNA, 22 bp, Homo sapiens
ggtgttccacctggaaactgct

SEQ ID NO: 5923827 - DNA, 22 bp, Homo sapiens
ggtgttcctggaagcaggtgct

SEQ ID NO: 5923828 - DNA, 12 bp, Homo sapiens
ggtgttctgaag

SEQ ID NO: 5923829 - DNA, 13 bp, Homo sapiens
ggtgttctgctga

SEQ ID NO: 5923830 - DNA, 13 bp, Homo sapiens
ggtgttctggcct

SEQ ID NO: 5923831 - DNA, 21 bp, Homo sapiens
ggtgttctggcctctggcctg

SEQ ID NO: 5923832 - DNA, 23 bp, Homo sapiens
ggtgttcttcttctcttctctgc

SEQ ID NO: 5923833 - DNA, 13 bp, Homo sapiens
ggtgttgagattt

SEQ ID NO: 5923834 - DNA, 21 bp, Homo sapiens
ggtgttgccaaatatgtcctg

SEQ ID NO: 5923835 - DNA, 13 bp, Homo sapiens
ggtgttgggtcag

SEQ ID NO: 5923836 - DNA, 15 bp, Homo sapiens
ggtgttgtatgcctt

SEQ ID NO: 5923837 - DNA, 16 bp, Homo sapiens
ggtgttgtatggctga

SEQ ID NO: 5923838 - DNA, 21 bp, Homo sapiens
ggtgttgtcagcaggcaggct

SEQ ID NO: 5923839 - DNA, 13 bp, Homo sapiens
ggtgtttatacag

SEQ ID NO: 5923840 - DNA, 21 bp, Homo sapiens
ggtgtttattacaagtggctc

SEQ ID NO: 5923841 - DNA, 16 bp, Homo sapiens
ggtgtttcccttcctc

SEQ ID NO: 5923842 - DNA, 22 bp, Homo sapiens
ggtgtttctccctctcactgtc

SEQ ID NO: 5923843 - DNA, 23 bp, Homo sapiens
ggtgtttcttgtgtttgagaacc

SEQ ID NO: 5923844 - DNA, 14 bp, Homo sapiens
ggtgtttgaaaata

SEQ ID NO: 5923845 - DNA, 16 bp, Homo sapiens
ggtgtttgcttgaatg

SEQ ID NO: 5923846 - DNA, 19 bp, Homo sapiens
ggtgtttggaggctgctgc

SEQ ID NO: 5923847 - DNA, 22 bp, Homo sapiens
ggtgtttggaggctgctgcccc

SEQ ID NO: 5923848 - DNA, 21 bp, Homo sapiens
ggtgtttggtttcttcattct

SEQ ID NO: 5923849 - DNA, 13 bp, Homo sapiens
ggtgtttgtcatg

SEQ ID NO: 5923850 - DNA, 21 bp, Homo sapiens
ggtgtttgtcatggtgaaatt

SEQ ID NO: 5923851 - DNA, 16 bp, Homo sapiens
ggtgttttataggtca

SEQ ID NO: 5923852 - DNA, 16 bp, Homo sapiens
ggtgttttatttccta

SEQ ID NO: 5923853 - DNA, 17 bp, Homo sapiens
ggtgttttatttcctat

SEQ ID NO: 5923854 - DNA, 22 bp, Homo sapiens
ggtgttttcattcccccttcct

SEQ ID NO: 5923855 - DNA, 15 bp, Homo sapiens
ggtgtttttaataaa

SEQ ID NO: 5923856 - DNA, 16 bp, Homo sapiens
ggtgtttttctctctg

SEQ ID NO: 5923857 - DNA, 20 bp, Homo sapiens
ggtgttttttttaagggcat

SEQ ID NO: 5923858 - DNA, 16 bp, Homo sapiens
ggttaaaaaaaaaagt

SEQ ID NO: 5923859 - DNA, 23 bp, Homo sapiens
ggttaaaaaaaggcattgtttga

SEQ ID NO: 5923860 - DNA, 13 bp, Homo sapiens
ggttaaaaacctg

SEQ ID NO: 5923861 - DNA, 16 bp, Homo sapiens
ggttaaaacaaaaaca

SEQ ID NO: 5923862 - DNA, 11 bp, Homo sapiens
ggttaaaactg

SEQ ID NO: 5923863 - DNA, 13 bp, Homo sapiens
ggttaaaactgtc

SEQ ID NO: 5923864 - DNA, 18 bp, Homo sapiens
ggttaaaagggaacacaa

SEQ ID NO: 5923865 - DNA, 19 bp, Homo sapiens
ggttaaacattaatattta

SEQ ID NO: 5923866 - DNA, 22 bp, Homo sapiens
ggttaaacggtgcccatcctgc

SEQ ID NO: 5923867 - DNA, 18 bp, Homo sapiens
ggttaaacgtagcatgtg

SEQ ID NO: 5923868 - DNA, 14 bp, Homo sapiens
ggttaaactgcagg

SEQ ID NO: 5923869 - DNA, 17 bp, Homo sapiens
ggttaaagcaaaccagc

SEQ ID NO: 5923870 - DNA, 13 bp, Homo sapiens
ggttaaagctaaa

SEQ ID NO: 5923871 - DNA, 16 bp, Homo sapiens
ggttaaagctaaactg

SEQ ID NO: 5923872 - DNA, 13 bp, Homo sapiens
ggttaaatatttt

SEQ ID NO: 5923873 - DNA, 13 bp, Homo sapiens
ggttaaatgtttt

SEQ ID NO: 5923874 - DNA, 13 bp, Homo sapiens
ggttaaattgctt

SEQ ID NO: 5923875 - DNA, 13 bp, Homo sapiens
ggttaacaaataa

SEQ ID NO: 5923876 - DNA, 20 bp, Homo sapiens
ggttaacaataaagtgacaa

SEQ ID NO: 5923877 - DNA, 17 bp, Homo sapiens
ggttaagatctgaaagt

SEQ ID NO: 5923878 - DNA, 21 bp, Homo sapiens
ggttaagcattaccactcagg

SEQ ID NO: 5923879 - DNA, 14 bp, Homo sapiens
ggttaaggcctgaa

SEQ ID NO: 5923880 - DNA, 19 bp, Homo sapiens
ggttaaggggatctaaaag

SEQ ID NO: 5923881 - DNA, 14 bp, Homo sapiens
ggttaagtagcagg

SEQ ID NO: 5923882 - DNA, 12 bp, Homo sapiens
ggttaagtctca

SEQ ID NO: 5923883 - DNA, 13 bp, Homo sapiens
ggttaagtctgtt

SEQ ID NO: 5923884 - DNA, 12 bp, Homo sapiens
ggttaagtgttt

SEQ ID NO: 5923885 - DNA, 14 bp, Homo sapiens
ggttaataaataaa

SEQ ID NO: 5923886 - DNA, 13 bp, Homo sapiens
ggttaataagttt

SEQ ID NO: 5923887 - DNA, 19 bp, Homo sapiens
ggttaataggaggacagaa

SEQ ID NO: 5923888 - DNA, 19 bp, Homo sapiens
ggttaatcatatttgaaaa

SEQ ID NO: 5923889 - DNA, 17 bp, Homo sapiens
ggttaatggctagtact

SEQ ID NO: 5923890 - DNA, 22 bp, Homo sapiens
ggttaatttatccatgctggca

SEQ ID NO: 5923891 - DNA, 21 bp, Homo sapiens
ggttaatttttcctgcatgtt

SEQ ID NO: 5923892 - DNA, 16 bp, Homo sapiens
ggttaatttttccttc

SEQ ID NO: 5923893 - DNA, 14 bp, Homo sapiens
ggttacaaactgca

SEQ ID NO: 5923894 - DNA, 15 bp, Homo sapiens
ggttacaaactgcaa

SEQ ID NO: 5923895 - DNA, 19 bp, Homo sapiens
ggttacaacagatttgtga

SEQ ID NO: 5923896 - DNA, 21 bp, Homo sapiens
ggttacaacagatttgtgaac

SEQ ID NO: 5923897 - DNA, 22 bp, Homo sapiens
ggttaccactcttttgctgtgc

SEQ ID NO: 5923898 - DNA, 13 bp, Homo sapiens
ggttacctccctc

SEQ ID NO: 5923899 - DNA, 18 bp, Homo sapiens
ggttactacttaatgctt

SEQ ID NO: 5923900 - DNA, 13 bp, Homo sapiens
ggttactcatttt

SEQ ID NO: 5923901 - DNA, 13 bp, Homo sapiens
ggttactgagtga

SEQ ID NO: 5923902 - DNA, 19 bp, Homo sapiens
ggttactgggagtgtgggc

SEQ ID NO: 5923903 - DNA, 23 bp, Homo sapiens
ggttacttcagccaccctttctg

SEQ ID NO: 5923904 - DNA, 16 bp, Homo sapiens
ggttagaaccagcaga

SEQ ID NO: 5923905 - DNA, 17 bp, Homo sapiens
ggttagacaagcctgga

SEQ ID NO: 5923906 - DNA, 20 bp, Homo sapiens
ggttagacaagcctggagga

SEQ ID NO: 5923907 - DNA, 17 bp, Homo sapiens
ggttagagccaagctgc

SEQ ID NO: 5923908 - DNA, 19 bp, Homo sapiens
ggttagagccaagctgcac

SEQ ID NO: 5923909 - DNA, 18 bp, Homo sapiens
ggttagatgttgccatgt

SEQ ID NO: 5923910 - DNA, 15 bp, Homo sapiens
ggttagcaatattta

SEQ ID NO: 5923911 - DNA, 17 bp, Homo sapiens
ggttagcagagctggac

SEQ ID NO: 5923912 - DNA, 17 bp, Homo sapiens
ggttaggaatctcttca

SEQ ID NO: 5923913 - DNA, 16 bp, Homo sapiens
ggttagggaaaacatt

SEQ ID NO: 5923914 - DNA, 15 bp, Homo sapiens
ggttaggtcttagga

SEQ ID NO: 5923915 - DNA, 14 bp, Homo sapiens
ggttagtcgggtgc

SEQ ID NO: 5923916 - DNA, 17 bp, Homo sapiens
ggttagtgcatgtcaca

SEQ ID NO: 5923917 - DNA, 14 bp, Homo sapiens
ggttataaaagtga

SEQ ID NO: 5923918 - DNA, 19 bp, Homo sapiens
ggttataacagcaaatgaa

SEQ ID NO: 5923919 - DNA, 23 bp, Homo sapiens
ggttatacaataacccagttact

SEQ ID NO: 5923920 - DNA, 12 bp, Homo sapiens
ggttatacatga

SEQ ID NO: 5923921 - DNA, 23 bp, Homo sapiens
ggttatagacagtcgttcccagt

SEQ ID NO: 5923922 - DNA, 17 bp, Homo sapiens
ggttatcctatttttaa

SEQ ID NO: 5923923 - DNA, 23 bp, Homo sapiens
ggttatcgaaataacaatgttaa

SEQ ID NO: 5923924 - DNA, 19 bp, Homo sapiens
ggttatctcaaattttaag

SEQ ID NO: 5923925 - DNA, 14 bp, Homo sapiens
ggttatctgcctgg

SEQ ID NO: 5923926 - DNA, 23 bp, Homo sapiens
ggttatctgcctggcctggctcc

SEQ ID NO: 5923927 - DNA, 18 bp, Homo sapiens
ggttatctttttaaaaac

SEQ ID NO: 5923928 - DNA, 11 bp, Homo sapiens
ggttatgaaac

SEQ ID NO: 5923929 - DNA, 12 bp, Homo sapiens
ggttatgaaaga

SEQ ID NO: 5923930 - DNA, 13 bp, Homo sapiens
ggttatgaatatt

SEQ ID NO: 5923931 - DNA, 16 bp, Homo sapiens
ggttatgcctcatgct

SEQ ID NO: 5923932 - DNA, 13 bp, Homo sapiens
ggttatggagagg

SEQ ID NO: 5923933 - DNA, 15 bp, Homo sapiens
ggttatgtcagcagc

SEQ ID NO: 5923934 - DNA, 20 bp, Homo sapiens
ggttatgtcagcagctctga

SEQ ID NO: 5923935 - DNA, 20 bp, Homo sapiens
ggttatgttcccagcagtgg

SEQ ID NO: 5923936 - DNA, 23 bp, Homo sapiens
ggttatgtttccatggttaccat

SEQ ID NO: 5923937 - DNA, 20 bp, Homo sapiens
ggttattagcaaggctgggt

SEQ ID NO: 5923938 - DNA, 16 bp, Homo sapiens
ggttattcattattcc

SEQ ID NO: 5923939 - DNA, 20 bp, Homo sapiens
ggttatttagggaactgctt

SEQ ID NO: 5923940 - DNA, 23 bp, Homo sapiens
ggttatttagtaaagtttgttga

SEQ ID NO: 5923941 - DNA, 14 bp, Homo sapiens
ggttatttatttaa

SEQ ID NO: 5923942 - DNA, 13 bp, Homo sapiens
ggttatttctctg

SEQ ID NO: 5923943 - DNA, 23 bp, Homo sapiens
ggttattttagtttctgttctgt

SEQ ID NO: 5923944 - DNA, 19 bp, Homo sapiens
ggttattttatatttgagt

SEQ ID NO: 5923945 - DNA, 18 bp, Homo sapiens
ggttatttttattaaatg

SEQ ID NO: 5923946 - DNA, 21 bp, Homo sapiens
ggttatttttattaaatgtat

SEQ ID NO: 5923947 - DNA, 16 bp, Homo sapiens
ggttatttttctcttg

SEQ ID NO: 5923948 - DNA, 17 bp, Homo sapiens
ggttatttttgtccctg

SEQ ID NO: 5923949 - DNA, 21 bp, Homo sapiens
ggttatttttgtccctgctcc

SEQ ID NO: 5923950 - DNA, 23 bp, Homo sapiens
ggttcaaattctctatgtacaga

SEQ ID NO: 5923951 - DNA, 14 bp, Homo sapiens
ggttcaacttatta

SEQ ID NO: 5923952 - DNA, 19 bp, Homo sapiens
ggttcaagagacactgctt

SEQ ID NO: 5923953 - DNA, 17 bp, Homo sapiens
ggttcaagagattctgc

SEQ ID NO: 5923954 - DNA, 13 bp, Homo sapiens
ggttcaagcccag

SEQ ID NO: 5923955 - DNA, 15 bp, Homo sapiens
ggttcaagccttcca

SEQ ID NO: 5923956 - DNA, 18 bp, Homo sapiens
ggttcaaggtcactgttt

SEQ ID NO: 5923957 - DNA, 17 bp, Homo sapiens
ggttcaagtattaagca

SEQ ID NO: 5923958 - DNA, 18 bp, Homo sapiens
ggttgaggggctccccag

SEQ ID NO: 5923959 - DNA, 18 bp, Homo sapiens
ggttgaggggctcctgga

SEQ ID NO: 5923960 - DNA, 17 bp, Homo sapiens
ggttgagtgagccggga

SEQ ID NO: 5923961 - DNA, 19 bp, Homo sapiens
ggttgataactttgcttgc

SEQ ID NO: 5923962 - DNA, 13 bp, Homo sapiens
ggttgatcttgaa

SEQ ID NO: 5923963 - DNA, 19 bp, Homo sapiens
ggttgatggaaaataaaca

SEQ ID NO: 5923964 - DNA, 20 bp, Homo sapiens
ggttgattctcgactgcttt

SEQ ID NO: 5923965 - DNA, 20 bp, Homo sapiens
ggttgcaaaacggatgagtt

SEQ ID NO: 5923966 - DNA, 13 bp, Homo sapiens
ggttgcaaagtgt

SEQ ID NO: 5923967 - DNA, 14 bp, Homo sapiens
ggttgcagctgctc

SEQ ID NO: 5923968 - DNA, 13 bp, Homo sapiens
ggttgcagggctg

SEQ ID NO: 5923969 - DNA, 17 bp, Homo sapiens
ggttgcagtcactgtga

SEQ ID NO: 5923970 - DNA, 17 bp, Homo sapiens
ggttgcagtgagctgag

SEQ ID NO: 5923971 - DNA, 14 bp, Homo sapiens
ggttgcatcagaaa

SEQ ID NO: 5923972 - DNA, 14 bp, Homo sapiens
ggttgccacaggcc

SEQ ID NO: 5923973 - DNA, 20 bp, Homo sapiens
ggttgccacaggcctccctg

SEQ ID NO: 5923974 - DNA, 13 bp, Homo sapiens
ggttgccagaggc

SEQ ID NO: 5923975 - DNA, 18 bp, Homo sapiens
ggttgccagaggccctgg

SEQ ID NO: 5923976 - DNA, 19 bp, Homo sapiens
ggttgccagaggccctgga

SEQ ID NO: 5923977 - DNA, 14 bp, Homo sapiens
ggttgccaggacga

SEQ ID NO: 5923978 - DNA, 22 bp, Homo sapiens
ggttgccccttccccatctcca

SEQ ID NO: 5923979 - DNA, 20 bp, Homo sapiens
ggttgccgtctctggcccct

SEQ ID NO: 5923980 - DNA, 23 bp, Homo sapiens
ggttgcctcaacagcaggaggca

SEQ ID NO: 5923981 - DNA, 11 bp, Homo sapiens
ggttgcctctc

SEQ ID NO: 5923982 - DNA, 24 bp, Homo sapiens
ggttgcctggacaccccacgggag

SEQ ID NO: 5923983 - DNA, 14 bp, Homo sapiens
ggttgcctgggggc

SEQ ID NO: 5923984 - DNA, 17 bp, Homo sapiens
ggttgcgggacagagta

SEQ ID NO: 5923985 - DNA, 21 bp, Homo sapiens
ggttgcgggggagctggaaat

SEQ ID NO: 5923986 - DNA, 21 bp, Homo sapiens
ggttgcgtcctgacggcgccc

SEQ ID NO: 5923987 - DNA, 13 bp, Homo sapiens
ggttgctccattt

SEQ ID NO: 5923988 - DNA, 16 bp, Homo sapiens
ggttgctccgcctggc

SEQ ID NO: 5923989 - DNA, 16 bp, Homo sapiens
ggttgctggtcctgca

SEQ ID NO: 5923990 - DNA, 17 bp, Homo sapiens
ggttgctggtcctgcac

SEQ ID NO: 5923991 - DNA, 18 bp, Homo sapiens
ggttgctggttgctgtgt

SEQ ID NO: 5923992 - DNA, 11 bp, Homo sapiens
ggttgctgtag

SEQ ID NO: 5923993 - DNA, 20 bp, Homo sapiens
ggttgctgttttcctccctt

SEQ ID NO: 5923994 - DNA, 19 bp, Homo sapiens
ggttgcttaaaagggacag

SEQ ID NO: 5923995 - DNA, 15 bp, Homo sapiens
ggttgcttaattcct

SEQ ID NO: 5923996 - DNA, 19 bp, Homo sapiens
ggttgcttcaccttggagc

SEQ ID NO: 5923997 - DNA, 19 bp, Homo sapiens
ggttgcttctggctcctcc

SEQ ID NO: 5923998 - DNA, 20 bp, Homo sapiens
ggttgcttgggccactgccc

SEQ ID NO: 5923999 - DNA, 22 bp, Homo sapiens
ggttggaagtgagggtcagaga

SEQ ID NO: 5924000 - DNA, 16 bp, Homo sapiens
ggttggagagccctgg

SEQ ID NO: 5924001 - DNA, 18 bp, Homo sapiens
ggttggagagccctggat

SEQ ID NO: 5924002 - DNA, 14 bp, Homo sapiens
ggttggagcccagg

SEQ ID NO: 5924003 - DNA, 21 bp, Homo sapiens
ggttggaggcccttttctggc

SEQ ID NO: 5924004 - DNA, 21 bp, Homo sapiens
ggttggaggcctcaccctgct

SEQ ID NO: 5924005 - DNA, 17 bp, Homo sapiens
ggttggatgggagtggg

SEQ ID NO: 5924006 - DNA, 14 bp, Homo sapiens
ggttggattaatct

SEQ ID NO: 5924007 - DNA, 15 bp, Homo sapiens
ggttggcagcatctg

SEQ ID NO: 5924008 - DNA, 13 bp, Homo sapiens
ggttggcagccca

SEQ ID NO: 5924009 - DNA, 14 bp, Homo sapiens
ggttggcagtaagg

SEQ ID NO: 5924010 - DNA, 20 bp, Homo sapiens
ggttggccagagggcccctc

SEQ ID NO: 5924011 - DNA, 21 bp, Homo sapiens
ggttggccagagggcccctca

SEQ ID NO: 5924012 - DNA, 15 bp, Homo sapiens
ggttggccaggaggt

SEQ ID NO: 5924013 - DNA, 17 bp, Homo sapiens
ggttggccggctggccg

SEQ ID NO: 5924014 - DNA, 22 bp, Homo sapiens
ggttggccgtggtccagctctt

SEQ ID NO: 5924015 - DNA, 23 bp, Homo sapiens
ggttggccgtggtccagctcttg

SEQ ID NO: 5924016 - DNA, 19 bp, Homo sapiens
ggttggctgggaaatcgag

SEQ ID NO: 5924017 - DNA, 19 bp, Homo sapiens
ggttggctgggcccagaag

SEQ ID NO: 5924018 - DNA, 11 bp, Homo sapiens
ggttggcttat

SEQ ID NO: 5924019 - DNA, 21 bp, Homo sapiens
ggttgggacccagtggcaggg

SEQ ID NO: 5924020 - DNA, 13 bp, Homo sapiens
ggttgggaggcag

SEQ ID NO: 5924021 - DNA, 15 bp, Homo sapiens
ggttgggatgggata

SEQ ID NO: 5924022 - DNA, 21 bp, Homo sapiens
ggttgggcagccagaccagca

SEQ ID NO: 5924023 - DNA, 17 bp, Homo sapiens
ggttgggcccagatctg

SEQ ID NO: 5924024 - DNA, 16 bp, Homo sapiens
ggttgggctgtgcctg

SEQ ID NO: 5924025 - DNA, 14 bp, Homo sapiens
ggttggggcaaagc

SEQ ID NO: 5924026 - DNA, 19 bp, Homo sapiens
ggttggggcaaagcctcct

SEQ ID NO: 5924027 - DNA, 18 bp, Homo sapiens
ggttggggcttcacagcc

SEQ ID NO: 5924028 - DNA, 20 bp, Homo sapiens
ggttgggggaatgcacctcc

SEQ ID NO: 5924029 - DNA, 19 bp, Homo sapiens
ggttgggggacagccttca

SEQ ID NO: 5924030 - DNA, 15 bp, Homo sapiens
ggttgggggcaccat

SEQ ID NO: 5924031 - DNA, 14 bp, Homo sapiens
ggttggggtgacag

SEQ ID NO: 5924032 - DNA, 15 bp, Homo sapiens
ggttggggtgacagt

SEQ ID NO: 5924033 - DNA, 19 bp, Homo sapiens
ggttggtatctcaggtctg

SEQ ID NO: 5924034 - DNA, 23 bp, Homo sapiens
ggttggtccttgtctgcaccctc

SEQ ID NO: 5924035 - DNA, 13 bp, Homo sapiens
ggttggttccttg

SEQ ID NO: 5924036 - DNA, 22 bp, Homo sapiens
ggttgtaaagcagtaccctacc

SEQ ID NO: 5924037 - DNA, 14 bp, Homo sapiens
ggttgtaacatatg

SEQ ID NO: 5924038 - DNA, 23 bp, Homo sapiens
ggttgtacgttttgcacattttg

SEQ ID NO: 5924039 - DNA, 20 bp, Homo sapiens
ggttgtattctttgatgtta

SEQ ID NO: 5924040 - DNA, 16 bp, Homo sapiens
ggttgtatttctatat

SEQ ID NO: 5924041 - DNA, 23 bp, Homo sapiens
ggttgtcaaaactccactcagca

SEQ ID NO: 5924042 - DNA, 10 bp, Homo sapiens
ggttgtcaat

SEQ ID NO: 5924043 - DNA, 15 bp, Homo sapiens
ggttgtcactcaaca

SEQ ID NO: 5924044 - DNA, 21 bp, Homo sapiens
ggttgtcatcactagtggcaa

SEQ ID NO: 5924045 - DNA, 21 bp, Homo sapiens
ggttgtctctcttcggtggcc

SEQ ID NO: 5924046 - DNA, 16 bp, Homo sapiens
ggttgtctgtagagaa

SEQ ID NO: 5924047 - DNA, 21 bp, Homo sapiens
ggttgtctgtttttgtaactt

SEQ ID NO: 5924048 - DNA, 14 bp, Homo sapiens
ggttgtgaaatgta

SEQ ID NO: 5924049 - DNA, 17 bp, Homo sapiens
ggttgtgaaatgtaaca

SEQ ID NO: 5924050 - DNA, 20 bp, Homo sapiens
ggttgtgaaccaactgcctt

SEQ ID NO: 5924051 - DNA, 21 bp, Homo sapiens
ggttgtgaaccaactgcctta

SEQ ID NO: 5924052 - DNA, 19 bp, Homo sapiens
ggttgtgattttttgttct

SEQ ID NO: 5924053 - DNA, 14 bp, Homo sapiens
ggttgtgcactgtt

SEQ ID NO: 5924054 - DNA, 13 bp, Homo sapiens
ggttgtgcagggt

SEQ ID NO: 5924055 - DNA, 23 bp, Homo sapiens
ggttgtgtagggagatggagaaa

SEQ ID NO: 5924056 - DNA, 17 bp, Homo sapiens
ggttgtgtgtgttctgt

SEQ ID NO: 5924057 - DNA, 15 bp, Homo sapiens
ggttgtgttgaggtt

SEQ ID NO: 5924058 - DNA, 19 bp, Homo sapiens
ggttgttaatgttgggatt

SEQ ID NO: 5924059 - DNA, 14 bp, Homo sapiens
ggttgttccttttt

SEQ ID NO: 5924060 - DNA, 19 bp, Homo sapiens
ggttgttgatattgtttgc

SEQ ID NO: 5924061 - DNA, 20 bp, Homo sapiens
ggttgttgcatatagttaaa

SEQ ID NO: 5924062 - DNA, 22 bp, Homo sapiens
ggttgttgccaactaagccctc

SEQ ID NO: 5924063 - DNA, 14 bp, Homo sapiens
ggttgttgccaggt

SEQ ID NO: 5924064 - DNA, 22 bp, Homo sapiens
ggttgttgccaggttgcagctg

SEQ ID NO: 5924065 - DNA, 23 bp, Homo sapiens
ggttgttgccaggttgcagctgc

SEQ ID NO: 5924066 - DNA, 16 bp, Homo sapiens
ggttgtttccaggaga

SEQ ID NO: 5924067 - DNA, 21 bp, Homo sapiens
ggttgtttctctgagctttgt

SEQ ID NO: 5924068 - DNA, 14 bp, Homo sapiens
ggttgtttctgttc

SEQ ID NO: 5924069 - DNA, 19 bp, Homo sapiens
ggttgtttctgttccaaat

SEQ ID NO: 5924070 - DNA, 17 bp, Homo sapiens
ggttgttttctactttg

SEQ ID NO: 5924071 - DNA, 17 bp, Homo sapiens
ggttgtttttgttcttt

SEQ ID NO: 5924072 - DNA, 19 bp, Homo sapiens
ggtttaaacttctctgaag

SEQ ID NO: 5924073 - DNA, 20 bp, Homo sapiens
ggtttaaacttgtttgctgt

SEQ ID NO: 5924074 - DNA, 15 bp, Homo sapiens
ggtttaaagagtcta

SEQ ID NO: 5924075 - DNA, 14 bp, Homo sapiens
ggtttaaagtttga

SEQ ID NO: 5924076 - DNA, 22 bp, Homo sapiens
ggtttaaatgaacaagagaagc

SEQ ID NO: 5924077 - DNA, 17 bp, Homo sapiens
ggtttaaccacattaat

SEQ ID NO: 5924078 - DNA, 18 bp, Homo sapiens
ggtttaactgtcccagcg

SEQ ID NO: 5924079 - DNA, 18 bp, Homo sapiens
ggtttaagctctgcccct

SEQ ID NO: 5924080 - DNA, 13 bp, Homo sapiens
ggtttaagctgtt

SEQ ID NO: 5924081 - DNA, 19 bp, Homo sapiens
ggtttaatccccagtaaaa

SEQ ID NO: 5924082 - DNA, 22 bp, Homo sapiens
ggtttaatccccagtaaaattg

SEQ ID NO: 5924083 - DNA, 16 bp, Homo sapiens
ggtttaattcagcaga

SEQ ID NO: 5924084 - DNA, 14 bp, Homo sapiens
ggtttacatgaaca

SEQ ID NO: 5924085 - DNA, 17 bp, Homo sapiens
ggtttacctagagaaca

SEQ ID NO: 5924086 - DNA, 18 bp, Homo sapiens
ggtttactcactgctgca

SEQ ID NO: 5924087 - DNA, 22 bp, Homo sapiens
ggtttactctgtgctaagttgt

SEQ ID NO: 5924088 - DNA, 12 bp, Homo sapiens
ggtttactgctg

SEQ ID NO: 5924089 - DNA, 14 bp, Homo sapiens
ggtttactgctgtc

SEQ ID NO: 5924090 - DNA, 12 bp, Homo sapiens
ggtttactttca

SEQ ID NO: 5924091 - DNA, 14 bp, Homo sapiens
ggtttactttcaaa

SEQ ID NO: 5924092 - DNA, 22 bp, Homo sapiens
ggtttaggctggtggcccagga

SEQ ID NO: 5924093 - DNA, 16 bp, Homo sapiens
ggtttagtcaatcact

SEQ ID NO: 5924094 - DNA, 16 bp, Homo sapiens
ggtttagtgtaaaaat

SEQ ID NO: 5924095 - DNA, 13 bp, Homo sapiens
ggtttataataaa

SEQ ID NO: 5924096 - DNA, 18 bp, Homo sapiens
ggtttatattgggaagct

SEQ ID NO: 5924097 - DNA, 23 bp, Homo sapiens
ggtttatcgccctggcaggcagg

SEQ ID NO: 5924098 - DNA, 22 bp, Homo sapiens
ggtttattcccaagtatgcctt

SEQ ID NO: 5924099 - DNA, 15 bp, Homo sapiens
ggtttatttcccagt

SEQ ID NO: 5924100 - DNA, 14 bp, Homo sapiens
ggtttatttgttgt

SEQ ID NO: 5924101 - DNA, 16 bp, Homo sapiens
ggtttcaaactcctga

SEQ ID NO: 5924102 - DNA, 16 bp, Homo sapiens
ggtttcaaagatgctg

SEQ ID NO: 5924103 - DNA, 18 bp, Homo sapiens
ggtttcaacaaatttcat

SEQ ID NO: 5924104 - DNA, 22 bp, Homo sapiens
ggtttcacatggttacatatca

SEQ ID NO: 5924105 - DNA, 12 bp, Homo sapiens
ggtttcaccatg

SEQ ID NO: 5924106 - DNA, 19 bp, Homo sapiens
ggtttcaccatgttgccca

SEQ ID NO: 5924107 - DNA, 15 bp, Homo sapiens
ggtttcaccttccct

SEQ ID NO: 5924108 - DNA, 14 bp, Homo sapiens
ggtttcagaagctg

SEQ ID NO: 5924109 - DNA, 14 bp, Homo sapiens
ggtttcagatgagg

SEQ ID NO: 5924110 - DNA, 19 bp, Homo sapiens
ggtttcagatgtgcaataa

SEQ ID NO: 5924111 - DNA, 17 bp, Homo sapiens
ggtttcagtagctcctt

SEQ ID NO: 5924112 - DNA, 10 bp, Homo sapiens
ggtttcagtg

SEQ ID NO: 5924113 - DNA, 13 bp, Homo sapiens
ggtttcagtggct

SEQ ID NO: 5924114 - DNA, 17 bp, Homo sapiens
ggtttcatgttcactgt

SEQ ID NO: 5924115 - DNA, 13 bp, Homo sapiens
ggtttcatttgaa

SEQ ID NO: 5924116 - DNA, 20 bp, Homo sapiens
ggtttccaatcaacagcagt

SEQ ID NO: 5924117 - DNA, 14 bp, Homo sapiens
ggtttccacatgct

SEQ ID NO: 5924118 - DNA, 15 bp, Homo sapiens
ggtttccactactgt

SEQ ID NO: 5924119 - DNA, 22 bp, Homo sapiens
ggtttccactgtcttgcctgcc

SEQ ID NO: 5924120 - DNA, 13 bp, Homo sapiens
ggtttccaggcca

SEQ ID NO: 5924121 - DNA, 18 bp, Homo sapiens
ggtttccatcaaagccct

SEQ ID NO: 5924122 - DNA, 19 bp, Homo sapiens
ggtttccatcaaagccctc

SEQ ID NO: 5924123 - DNA, 20 bp, Homo sapiens
ggtttccatcaaagccctcc

SEQ ID NO: 5924124 - DNA, 17 bp, Homo sapiens
ggtttcccagtgagcct

SEQ ID NO: 5924125 - DNA, 18 bp, Homo sapiens
ggtttcccagtgagcctc

SEQ ID NO: 5924126 - DNA, 21 bp, Homo sapiens
ggtttcccatttgttgctgct

SEQ ID NO: 5924127 - DNA, 13 bp, Homo sapiens
ggtttccctgccc

SEQ ID NO: 5924128 - DNA, 16 bp, Homo sapiens
ggtttccgtagcagtt

SEQ ID NO: 5924129 - DNA, 19 bp, Homo sapiens
ggtttccgtagcagttttg

SEQ ID NO: 5924130 - DNA, 12 bp, Homo sapiens
ggtttcctctgg

SEQ ID NO: 5924131 - DNA, 14 bp, Homo sapiens
ggtttcctgcccag

SEQ ID NO: 5924132 - DNA, 13 bp, Homo sapiens
ggtttcctgccct

SEQ ID NO: 5924133 - DNA, 16 bp, Homo sapiens
ggtttcctgccctggg

SEQ ID NO: 5924134 - DNA, 16 bp, Homo sapiens
ggtttcctgctccagt

SEQ ID NO: 5924135 - DNA, 14 bp, Homo sapiens
ggtttcctttctca

SEQ ID NO: 5924136 - DNA, 15 bp, Homo sapiens
ggtttccttttggaa

SEQ ID NO: 5924137 - DNA, 21 bp, Homo sapiens
gtaaagtatgtaaacaggaga

SEQ ID NO: 5924138 - DNA, 15 bp, Homo sapiens
gtaaagtatgtatta

SEQ ID NO: 5924139 - DNA, 19 bp, Homo sapiens
gtaaagtatgtttttacat

SEQ ID NO: 5924140 - DNA, 20 bp, Homo sapiens
gtaaagtatgtttttacatt

SEQ ID NO: 5924141 - DNA, 15 bp, Homo sapiens
gtaaagtcaaggaga

SEQ ID NO: 5924142 - DNA, 18 bp, Homo sapiens
gtaaagtccccagagaaa

SEQ ID NO: 5924143 - DNA, 19 bp, Homo sapiens
gtaaagtccttttcttgct

SEQ ID NO: 5924144 - DNA, 14 bp, Homo sapiens
gtaaagtgaagaat

SEQ ID NO: 5924145 - DNA, 15 bp, Homo sapiens
gtaaagtggttctct

SEQ ID NO: 5924146 - DNA, 12 bp, Homo sapiens
gtaaagtgttaa

SEQ ID NO: 5924147 - DNA, 15 bp, Homo sapiens
gtaaagttaaaagaa

SEQ ID NO: 5924148 - DNA, 16 bp, Homo sapiens
gtaaagttaattcatt

SEQ ID NO: 5924149 - DNA, 16 bp, Homo sapiens
gtaaagttatgtattt

SEQ ID NO: 5924150 - DNA, 16 bp, Homo sapiens
gtaaagtttaaaaaat

SEQ ID NO: 5924151 - DNA, 20 bp, Homo sapiens
gtaaagtttaaaaaatacac

SEQ ID NO: 5924152 - DNA, 16 bp, Homo sapiens
gtaaagtttatttcat

SEQ ID NO: 5924153 - DNA, 15 bp, Homo sapiens
gtaaataaaaatagc

SEQ ID NO: 5924154 - DNA, 15 bp, Homo sapiens
gtaaataaaatgtgt

SEQ ID NO: 5924155 - DNA, 16 bp, Homo sapiens
gtaaataaaatgtgta

SEQ ID NO: 5924156 - DNA, 19 bp, Homo sapiens
gtaaataaaatgtgtacag

SEQ ID NO: 5924157 - DNA, 11 bp, Homo sapiens
gtaaataaact

SEQ ID NO: 5924158 - DNA, 19 bp, Homo sapiens
gtaaataaactatttatat

SEQ ID NO: 5924159 - DNA, 21 bp, Homo sapiens
gtaaataaactatttatatca

SEQ ID NO: 5924160 - DNA, 14 bp, Homo sapiens
gtaaataaactctt

SEQ ID NO: 5924161 - DNA, 15 bp, Homo sapiens
gtaaataaactcttc

SEQ ID NO: 5924162 - DNA, 18 bp, Homo sapiens
gtaaataaactcttcaag

SEQ ID NO: 5924163 - DNA, 15 bp, Homo sapiens
gtaaataaagtctat

SEQ ID NO: 5924164 - DNA, 13 bp, Homo sapiens
gtaaataaatttt

SEQ ID NO: 5924165 - DNA, 14 bp, Homo sapiens
gtaaataaattttg

SEQ ID NO: 5924166 - DNA, 18 bp, Homo sapiens
gtaaataaccacaaggtc

SEQ ID NO: 5924167 - DNA, 13 bp, Homo sapiens
gtaaataactgtg

SEQ ID NO: 5924168 - DNA, 14 bp, Homo sapiens
gtaaataactgtga

SEQ ID NO: 5924169 - DNA, 20 bp, Homo sapiens
gtaaataactgtgactgtgg

SEQ ID NO: 5924170 - DNA, 14 bp, Homo sapiens
gtaaataatacatt

SEQ ID NO: 5924171 - DNA, 19 bp, Homo sapiens
gtaaataatgattcaatgt

SEQ ID NO: 5924172 - DNA, 20 bp, Homo sapiens
gtaaataatgattcaatgtg

SEQ ID NO: 5924173 - DNA, 16 bp, Homo sapiens
gtaaataatgctttga

SEQ ID NO: 5924174 - DNA, 15 bp, Homo sapiens
gtaaataatttattt

SEQ ID NO: 5924175 - DNA, 21 bp, Homo sapiens
gtaaatacaaaataaaattat

SEQ ID NO: 5924176 - DNA, 17 bp, Homo sapiens
gtaaatacaacacatct

SEQ ID NO: 5924177 - DNA, 16 bp, Homo sapiens
gtaaatacaagactgt

SEQ ID NO: 5924178 - DNA, 19 bp, Homo sapiens
gtaaatacaagactgttgt

SEQ ID NO: 5924179 - DNA, 21 bp, Homo sapiens
gtaaatacaattttgtttctg

SEQ ID NO: 5924180 - DNA, 22 bp, Homo sapiens
gtaaatacaattttgtttctgt

SEQ ID NO: 5924181 - DNA, 23 bp, Homo sapiens
gtaaatacaattttgtttctgta

SEQ ID NO: 5924182 - DNA, 21 bp, Homo sapiens
gtaaatacaattttttttatt

SEQ ID NO: 5924183 - DNA, 19 bp, Homo sapiens
gtaaatacacaacacacac

SEQ ID NO: 5924184 - DNA, 22 bp, Homo sapiens
gtaaatacatgtgtggatgtgt

SEQ ID NO: 5924185 - DNA, 18 bp, Homo sapiens
gtaaatactccattattt

SEQ ID NO: 5924186 - DNA, 17 bp, Homo sapiens
gtaaatactggactcag

SEQ ID NO: 5924187 - DNA, 19 bp, Homo sapiens
gtaaatactggactcagga

SEQ ID NO: 5924188 - DNA, 22 bp, Homo sapiens
gtaaatactggactcaggaact

SEQ ID NO: 5924189 - DNA, 18 bp, Homo sapiens
gtaaatactgtgaaatac

SEQ ID NO: 5924190 - DNA, 22 bp, Homo sapiens
gtaaatagacagcctttctgct

SEQ ID NO: 5924191 - DNA, 17 bp, Homo sapiens
gtaaataggaatcattc

SEQ ID NO: 5924192 - DNA, 16 bp, Homo sapiens
gtaaatagtatttgag

SEQ ID NO: 5924193 - DNA, 17 bp, Homo sapiens
gtaaatagtatttgaga

SEQ ID NO: 5924194 - DNA, 23 bp, Homo sapiens
gtaaatagtgtcatataaactca

SEQ ID NO: 5924195 - DNA, 20 bp, Homo sapiens
gtaaatagttttaaatatga

SEQ ID NO: 5924196 - DNA, 23 bp, Homo sapiens
gtaaatataaagacgttttataa

SEQ ID NO: 5924197 - DNA, 13 bp, Homo sapiens
gtaaatatacact

SEQ ID NO: 5924198 - DNA, 16 bp, Homo sapiens
gtaaatatataaatat

SEQ ID NO: 5924199 - DNA, 19 bp, Homo sapiens
gtaaatatataaatatata

SEQ ID NO: 5924200 - DNA, 18 bp, Homo sapiens
gtaaatatatatgtcaat

SEQ ID NO: 5924201 - DNA, 14 bp, Homo sapiens
gtaaatatatgttt

SEQ ID NO: 5924202 - DNA, 17 bp, Homo sapiens
gtaaatatatgttttga

SEQ ID NO: 5924203 - DNA, 19 bp, Homo sapiens
gtaaatatatgttttgaga

SEQ ID NO: 5924204 - DNA, 21 bp, Homo sapiens
gtaaatatatgttttgagaaa

SEQ ID NO: 5924205 - DNA, 19 bp, Homo sapiens
gtaaatatcccagagaaca

SEQ ID NO: 5924206 - DNA, 21 bp, Homo sapiens
gtaaatatcccagagaacaat

SEQ ID NO: 5924207 - DNA, 19 bp, Homo sapiens
gtaaatatccctcccctct

SEQ ID NO: 5924208 - DNA, 23 bp, Homo sapiens
gtaaatatgaatctgctcacttt

SEQ ID NO: 5924209 - DNA, 16 bp, Homo sapiens
gtaaatatggggatag

SEQ ID NO: 5924210 - DNA, 14 bp, Homo sapiens
gtaaatatgtacat

SEQ ID NO: 5924211 - DNA, 16 bp, Homo sapiens
gtaaatatgtacattt

SEQ ID NO: 5924212 - DNA, 17 bp, Homo sapiens
gtaaatatgtgaagaaa

SEQ ID NO: 5924213 - DNA, 13 bp, Homo sapiens
gtaaatattagtg

SEQ ID NO: 5924214 - DNA, 22 bp, Homo sapiens
gtaaatattctacacatgtaaa

SEQ ID NO: 5924215 - DNA, 13 bp, Homo sapiens
gtaaatattctat

SEQ ID NO: 5924216 - DNA, 20 bp, Homo sapiens
gtaaatattgctaaaagcat

SEQ ID NO: 5924217 - DNA, 22 bp, Homo sapiens
gtaaatattgctgtctgaaaaa

SEQ ID NO: 5924218 - DNA, 16 bp, Homo sapiens
gtaaatatttcataaa

SEQ ID NO: 5924219 - DNA, 22 bp, Homo sapiens
gtaaatattttcaaagagatgg

SEQ ID NO: 5924220 - DNA, 20 bp, Homo sapiens
gtaaatattttgatacaaat

SEQ ID NO: 5924221 - DNA, 23 bp, Homo sapiens
gtaaatcaacttgtcacaaagtg

SEQ ID NO: 5924222 - DNA, 11 bp, Homo sapiens
gtaaatcactt

SEQ ID NO: 5924223 - DNA, 12 bp, Homo sapiens
gtaaatcacttg

SEQ ID NO: 5924224 - DNA, 15 bp, Homo sapiens
gtaaatcacttgtaa

SEQ ID NO: 5924225 - DNA, 24 bp, Homo sapiens
gtaaatcacttgtaaataaataga

SEQ ID NO: 5924226 - DNA, 14 bp, Homo sapiens
gtaaatcagggaca

SEQ ID NO: 5924227 - DNA, 17 bp, Homo sapiens
gtaaatcagtaagaggt

SEQ ID NO: 5924228 - DNA, 13 bp, Homo sapiens
gtaaatcataatg

SEQ ID NO: 5924229 - DNA, 16 bp, Homo sapiens
gtaaatccacagccaa

SEQ ID NO: 5924230 - DNA, 19 bp, Homo sapiens
gtaaatcccattattcaaa

SEQ ID NO: 5924231 - DNA, 19 bp, Homo sapiens
gtaaatcctgagctcaaat

SEQ ID NO: 5924232 - DNA, 16 bp, Homo sapiens
gtaaatcctgccattt

SEQ ID NO: 5924233 - DNA, 17 bp, Homo sapiens
gtaaatcctgccattta

SEQ ID NO: 5924234 - DNA, 19 bp, Homo sapiens
gtaaatcctgccatttaaa

SEQ ID NO: 5924235 - DNA, 15 bp, Homo sapiens
gtaaatcctttttct

SEQ ID NO: 5924236 - DNA, 14 bp, Homo sapiens
gtaaatctatctct

SEQ ID NO: 5924237 - DNA, 15 bp, Homo sapiens
gtaaatctatctcta

SEQ ID NO: 5924238 - DNA, 17 bp, Homo sapiens
gtaaatctatgagcaac

SEQ ID NO: 5924239 - DNA, 14 bp, Homo sapiens
gtaaatctgaaaaa

SEQ ID NO: 5924240 - DNA, 12 bp, Homo sapiens
gtaaatctgcca

SEQ ID NO: 5924241 - DNA, 15 bp, Homo sapiens
gtaaatctgccacaa

SEQ ID NO: 5924242 - DNA, 21 bp, Homo sapiens
gtaaatctttgtgaacattct

SEQ ID NO: 5924243 - DNA, 14 bp, Homo sapiens
gtaaatcttttaca

SEQ ID NO: 5924244 - DNA, 22 bp, Homo sapiens
gtaaatgaagtaacttgtctta

SEQ ID NO: 5924245 - DNA, 16 bp, Homo sapiens
gtaaatgactttcata

SEQ ID NO: 5924246 - DNA, 13 bp, Homo sapiens
gtaaatgagaaga

SEQ ID NO: 5924247 - DNA, 19 bp, Homo sapiens
gtaaatgagacacatacaa

SEQ ID NO: 5924248 - DNA, 20 bp, Homo sapiens
gtaaatgaggtctttgcatt

SEQ ID NO: 5924249 - DNA, 12 bp, Homo sapiens
gtaaatgatgtg

SEQ ID NO: 5924250 - DNA, 16 bp, Homo sapiens
gtaaatgattttaatt

SEQ ID NO: 5924251 - DNA, 17 bp, Homo sapiens
gtaaatgcaaagttctg

SEQ ID NO: 5924252 - DNA, 12 bp, Homo sapiens
gtaaatgcatat

SEQ ID NO: 5924253 - DNA, 10 bp, Homo sapiens
gtaaatgcct

SEQ ID NO: 5924254 - DNA, 20 bp, Homo sapiens
gtaaatgctacctctgatca

SEQ ID NO: 5924255 - DNA, 14 bp, Homo sapiens
gtaaatgctccagc

SEQ ID NO: 5924256 - DNA, 21 bp, Homo sapiens
gtaaatgctcgtgtgatttcc

SEQ ID NO: 5924257 - DNA, 22 bp, Homo sapiens
gtaaatggcttatccagctggt

SEQ ID NO: 5924258 - DNA, 20 bp, Homo sapiens
gtaaatgggggtgcatttga

SEQ ID NO: 5924259 - DNA, 12 bp, Homo sapiens
gtaaatggtatc

SEQ ID NO: 5924260 - DNA, 22 bp, Homo sapiens
gtaaatggtatgatcaataaag

SEQ ID NO: 5924261 - DNA, 16 bp, Homo sapiens
gtaaatggtatgtcat

SEQ ID NO: 5924262 - DNA, 20 bp, Homo sapiens
gtaaatggttttcaacaagc

SEQ ID NO: 5924263 - DNA, 13 bp, Homo sapiens
gtaaatgtaaact

SEQ ID NO: 5924264 - DNA, 22 bp, Homo sapiens
gtaaatgtactggtaattgtac

SEQ ID NO: 5924265 - DNA, 23 bp, Homo sapiens
gtaaatgtactggtaattgtaca

SEQ ID NO: 5924266 - DNA, 15 bp, Homo sapiens
gtaaatgtagttcat

SEQ ID NO: 5924267 - DNA, 17 bp, Homo sapiens
gtaaatgtattcattct

SEQ ID NO: 5924268 - DNA, 19 bp, Homo sapiens
gtaaatgtattcattctta

SEQ ID NO: 5924269 - DNA, 19 bp, Homo sapiens
gtaaatgtattggcacagt

SEQ ID NO: 5924270 - DNA, 12 bp, Homo sapiens
gtaaatgtctgc

SEQ ID NO: 5924271 - DNA, 12 bp, Homo sapiens
gtaaatgtcttc

SEQ ID NO: 5924272 - DNA, 15 bp, Homo sapiens
gtaaatgtctttgta

SEQ ID NO: 5924273 - DNA, 18 bp, Homo sapiens
gtaaatgtggtgagaatg

SEQ ID NO: 5924274 - DNA, 21 bp, Homo sapiens
gtaaatgtgttagcactgata

SEQ ID NO: 5924275 - DNA, 16 bp, Homo sapiens
gtaaatgttagtttct

SEQ ID NO: 5924276 - DNA, 19 bp, Homo sapiens
gtaaatgttagtttcttgg

SEQ ID NO: 5924277 - DNA, 17 bp, Homo sapiens
gtaaatgttatgactcc

SEQ ID NO: 5924278 - DNA, 17 bp, Homo sapiens
gtaaatgttcttggtgt

SEQ ID NO: 5924279 - DNA, 11 bp, Homo sapiens
gtaaatgtttc

SEQ ID NO: 5924280 - DNA, 12 bp, Homo sapiens
gtaaatgtttct

SEQ ID NO: 5924281 - DNA, 17 bp, Homo sapiens
gtaaattacaaatgtgg

SEQ ID NO: 5924282 - DNA, 15 bp, Homo sapiens
gtaaattagtttgac

SEQ ID NO: 5924283 - DNA, 21 bp, Homo sapiens
gtaaattagtttgacactgct

SEQ ID NO: 5924284 - DNA, 15 bp, Homo sapiens
gtaaattatatttgt

SEQ ID NO: 5924285 - DNA, 19 bp, Homo sapiens
gtaaattatatttgtgcta

SEQ ID NO: 5924286 - DNA, 22 bp, Homo sapiens
gtaaattattaatttatgcaga

SEQ ID NO: 5924287 - DNA, 20 bp, Homo sapiens
gtaaattattcagttaagaa

SEQ ID NO: 5924288 - DNA, 17 bp, Homo sapiens
gtaaattattgtaaact

SEQ ID NO: 5924289 - DNA, 15 bp, Homo sapiens
gtaaattatttcata

SEQ ID NO: 5924290 - DNA, 16 bp, Homo sapiens
gtaaattatttgctaa

SEQ ID NO: 5924291 - DNA, 17 bp, Homo sapiens
gtaaattattttaaatt

SEQ ID NO: 5924292 - DNA, 15 bp, Homo sapiens
gtaaattattttatg

SEQ ID NO: 5924293 - DNA, 12 bp, Homo sapiens
gtaaattcagac

SEQ ID NO: 5924294 - DNA, 13 bp, Homo sapiens
gtaaattcagaca

SEQ ID NO: 5924295 - DNA, 18 bp, Homo sapiens
gtaaattcagacaacatt

SEQ ID NO: 5924296 - DNA, 18 bp, Homo sapiens
gtaaattcctaattctat

SEQ ID NO: 5924297 - DNA, 12 bp, Homo sapiens
gtaaattctgat

SEQ ID NO: 5924298 - DNA, 15 bp, Homo sapiens
gtaaattctgttgaa

SEQ ID NO: 5924299 - DNA, 16 bp, Homo sapiens
gtaaattgcagaattc

SEQ ID NO: 5924300 - DNA, 19 bp, Homo sapiens
gtaaattgtattctcataa

SEQ ID NO: 5924301 - DNA, 12 bp, Homo sapiens
gtaaatttaact

SEQ ID NO: 5924302 - DNA, 14 bp, Homo sapiens
gtaaatttaactgc

SEQ ID NO: 5924303 - DNA, 19 bp, Homo sapiens
gtaaatttagcatatcaat

SEQ ID NO: 5924304 - DNA, 20 bp, Homo sapiens
gtaaatttccccaacagtgt

SEQ ID NO: 5924305 - DNA, 14 bp, Homo sapiens
gtaaatttggattt

SEQ ID NO: 5924306 - DNA, 15 bp, Homo sapiens
gtaaattttataatg

SEQ ID NO: 5924307 - DNA, 12 bp, Homo sapiens
gtaaatttttga

SEQ ID NO: 5924308 - DNA, 19 bp, Homo sapiens
gtaaatttttgaaaaatat

SEQ ID NO: 5924309 - DNA, 13 bp, Homo sapiens
gtaacaaatgaac

SEQ ID NO: 5924310 - DNA, 12 bp, Homo sapiens
gtaacaagaaaa

SEQ ID NO: 5924311 - DNA, 13 bp, Homo sapiens
gtaacaagaaagg

SEQ ID NO: 5924312 - DNA, 14 bp, Homo sapiens
gtaacaagaaagga

SEQ ID NO: 5924313 - DNA, 16 bp, Homo sapiens
gtaacaagccagattt

SEQ ID NO: 5924314 - DNA, 14 bp, Homo sapiens
gtaacaatacaaat

SEQ ID NO: 5924315 - DNA, 22 bp, Homo sapiens
gtaacaatactgggcagccttt

SEQ ID NO: 5924316 - DNA, 13 bp, Homo sapiens
gtaagaagggtgg

SEQ ID NO: 5924317 - DNA, 18 bp, Homo sapiens
gtaagaagggtgggagtg

SEQ ID NO: 5924318 - DNA, 22 bp, Homo sapiens
gtaagaagtttcttaaacattg

SEQ ID NO: 5924319 - DNA, 13 bp, Homo sapiens
gtaagaatcattg

SEQ ID NO: 5924320 - DNA, 14 bp, Homo sapiens
gtaagaatggccaa

SEQ ID NO: 5924321 - DNA, 21 bp, Homo sapiens
gtaagacacacagcctttctg

SEQ ID NO: 5924322 - DNA, 20 bp, Homo sapiens
gtaagacattagtttgaggt

SEQ ID NO: 5924323 - DNA, 14 bp, Homo sapiens
gtaagacatttcct

SEQ ID NO: 5924324 - DNA, 14 bp, Homo sapiens
gtaagacatttgta

SEQ ID NO: 5924325 - DNA, 16 bp, Homo sapiens
gtaagaccaaatgtag

SEQ ID NO: 5924326 - DNA, 16 bp, Homo sapiens
gtaagaccccatctct

SEQ ID NO: 5924327 - DNA, 16 bp, Homo sapiens
gtaagaccttggtagg

SEQ ID NO: 5924328 - DNA, 13 bp, Homo sapiens
gtaagactgctgg

SEQ ID NO: 5924329 - DNA, 14 bp, Homo sapiens
gtaagactgctggt

SEQ ID NO: 5924330 - DNA, 16 bp, Homo sapiens
gtaagacttcagattt

SEQ ID NO: 5924331 - DNA, 19 bp, Homo sapiens
gtaagacttcagatttcaa

SEQ ID NO: 5924332 - DNA, 17 bp, Homo sapiens
gtaagacttgattggtt

SEQ ID NO: 5924333 - DNA, 20 bp, Homo sapiens
gtaagactttctgaaaacac

SEQ ID NO: 5924334 - DNA, 19 bp, Homo sapiens
gtaagagaaaagagagaaa

SEQ ID NO: 5924335 - DNA, 13 bp, Homo sapiens
gtaagagaatgtt

SEQ ID NO: 5924336 - DNA, 13 bp, Homo sapiens
gtaagagcacagg

SEQ ID NO: 5924337 - DNA, 16 bp, Homo sapiens
gtaagagctggtgtct

SEQ ID NO: 5924338 - DNA, 16 bp, Homo sapiens
gtaagagcttgctcca

SEQ ID NO: 5924339 - DNA, 17 bp, Homo sapiens
gtaagagcttgctccag

SEQ ID NO: 5924340 - DNA, 11 bp, Homo sapiens
gtaagagggag

SEQ ID NO: 5924341 - DNA, 13 bp, Homo sapiens
gtaagagggagcc

SEQ ID NO: 5924342 - DNA, 16 bp, Homo sapiens
gtaagaggtactaaaa

SEQ ID NO: 5924343 - DNA, 14 bp, Homo sapiens
gtaagagtgtagaa

SEQ ID NO: 5924344 - DNA, 15 bp, Homo sapiens
gtaagagtttacaag

SEQ ID NO: 5924345 - DNA, 20 bp, Homo sapiens
gtaagagtttacaagaaata

SEQ ID NO: 5924346 - DNA, 22 bp, Homo sapiens
gtaagagtttacaagaaataaa

SEQ ID NO: 5924347 - DNA, 23 bp, Homo sapiens
gtaagatacaagtttcagacagg

SEQ ID NO: 5924348 - DNA, 13 bp, Homo sapiens
gtaagatatttgc

SEQ ID NO: 5924349 - DNA, 18 bp, Homo sapiens
gtaagatcactgtttaga

SEQ ID NO: 5924350 - DNA, 16 bp, Homo sapiens
gtaagatccaccccct

SEQ ID NO: 5924351 - DNA, 19 bp, Homo sapiens
gtaagatcgttctctgcct

SEQ ID NO: 5924352 - DNA, 11 bp, Homo sapiens
gtaagatgctg

SEQ ID NO: 5924353 - DNA, 20 bp, Homo sapiens
gtaagatgctgggttggtgc

SEQ ID NO: 5924354 - DNA, 16 bp, Homo sapiens
gtaagatgtaaattga

SEQ ID NO: 5924355 - DNA, 13 bp, Homo sapiens
gtaagatgttaat

SEQ ID NO: 5924356 - DNA, 13 bp, Homo sapiens
gtaagattgttat

SEQ ID NO: 5924357 - DNA, 21 bp, Homo sapiens
gtaagattgttattaaatgta

SEQ ID NO: 5924358 - DNA, 13 bp, Homo sapiens
gtaagatttcctt

SEQ ID NO: 5924359 - DNA, 22 bp, Homo sapiens
gtaagattttattttcaagcaa

SEQ ID NO: 5924360 - DNA, 17 bp, Homo sapiens
gtaagattttgaaaact

SEQ ID NO: 5924361 - DNA, 21 bp, Homo sapiens
gtaagcagattacaataaatc

SEQ ID NO: 5924362 - DNA, 15 bp, Homo sapiens
gtaagcatctacttc

SEQ ID NO: 5924363 - DNA, 12 bp, Homo sapiens
gtaagccagagc

SEQ ID NO: 5924364 - DNA, 13 bp, Homo sapiens
gtaagccagagtc

SEQ ID NO: 5924365 - DNA, 17 bp, Homo sapiens
gtaagccatcagaagtt

SEQ ID NO: 5924366 - DNA, 17 bp, Homo sapiens
gtaagcctccctcctcg

SEQ ID NO: 5924367 - DNA, 23 bp, Homo sapiens
gtaagctagagagaaaaagaaag

SEQ ID NO: 5924368 - DNA, 24 bp, Homo sapiens
gtaagctcctttgtggagtgctgg

SEQ ID NO: 5924369 - DNA, 11 bp, Homo sapiens
gtaagctcttt

SEQ ID NO: 5924370 - DNA, 21 bp, Homo sapiens
gtaagctggtttacagatgtt

SEQ ID NO: 5924371 - DNA, 12 bp, Homo sapiens
gtaagctgttta

SEQ ID NO: 5924372 - DNA, 21 bp, Homo sapiens
gtaagctgtttggttttaaaa

SEQ ID NO: 5924373 - DNA, 20 bp, Homo sapiens
gtaagcttagattttctgta

SEQ ID NO: 5924374 - DNA, 19 bp, Homo sapiens
gtaaggaaaaataaaagtg

SEQ ID NO: 5924375 - DNA, 20 bp, Homo sapiens
gtaaggaacacgattttcaa

SEQ ID NO: 5924376 - DNA, 21 bp, Homo sapiens
gtaaggaacggcccttttagt

SEQ ID NO: 5924377 - DNA, 20 bp, Homo sapiens
gtaaggaatacctgtccccc

SEQ ID NO: 5924378 - DNA, 18 bp, Homo sapiens
gtaaggatccggaaagaa

SEQ ID NO: 5924379 - DNA, 22 bp, Homo sapiens
gtaaggcaatcctaagcaaaaa

SEQ ID NO: 5924380 - DNA, 13 bp, Homo sapiens
gtaaggcactgtc

SEQ ID NO: 5924381 - DNA, 16 bp, Homo sapiens
gtaaggcagctctgtc

SEQ ID NO: 5924382 - DNA, 22 bp, Homo sapiens
gtaaggcatactgccttgttta

SEQ ID NO: 5924383 - DNA, 13 bp, Homo sapiens
gtaaggccttagc

SEQ ID NO: 5924384 - DNA, 13 bp, Homo sapiens
gtaaggctctaga

SEQ ID NO: 5924385 - DNA, 11 bp, Homo sapiens
gtaaggctgta

SEQ ID NO: 5924386 - DNA, 18 bp, Homo sapiens
gtaaggctgtacatagtc

SEQ ID NO: 5924387 - DNA, 19 bp, Homo sapiens
gtaaggctgtgtaagattt

SEQ ID NO: 5924388 - DNA, 20 bp, Homo sapiens
gtaaggctgtgtacactgac

SEQ ID NO: 5924389 - DNA, 13 bp, Homo sapiens
gtaagggaataaa

SEQ ID NO: 5924390 - DNA, 16 bp, Homo sapiens
gtaagggaataaattt

SEQ ID NO: 5924391 - DNA, 15 bp, Homo sapiens
gtaagggaccttcag

SEQ ID NO: 5924392 - DNA, 20 bp, Homo sapiens
gtaagggactccagaagcag

SEQ ID NO: 5924393 - DNA, 24 bp, Homo sapiens
gtaagggactccagaagcagcagc

SEQ ID NO: 5924394 - DNA, 20 bp, Homo sapiens
gtaagggagagggagggagc

SEQ ID NO: 5924395 - DNA, 14 bp, Homo sapiens
gtaagggagggaag

SEQ ID NO: 5924396 - DNA, 18 bp, Homo sapiens
gtaagggagtcattgcct

SEQ ID NO: 5924397 - DNA, 17 bp, Homo sapiens
gtaagggattccttgtt

SEQ ID NO: 5924398 - DNA, 15 bp, Homo sapiens
gtaagggatttctta

SEQ ID NO: 5924399 - DNA, 12 bp, Homo sapiens
gtaagggcagtg

SEQ ID NO: 5924400 - DNA, 13 bp, Homo sapiens
gtaagggcgtggc

SEQ ID NO: 5924401 - DNA, 22 bp, Homo sapiens
gtaagggcgtggctctgggtgg

SEQ ID NO: 5924402 - DNA, 19 bp, Homo sapiens
gtaagggggtccctgtgct

SEQ ID NO: 5924403 - DNA, 18 bp, Homo sapiens
gtaagggtaaaaaagata

SEQ ID NO: 5924404 - DNA, 16 bp, Homo sapiens
gtaagggtctgttgta

SEQ ID NO: 5924405 - DNA, 23 bp, Homo sapiens
gtaagggtctttggtgtttttaa

SEQ ID NO: 5924406 - DNA, 22 bp, Homo sapiens
gtaaggtcttacattgcctgac

SEQ ID NO: 5924407 - DNA, 14 bp, Homo sapiens
gtaaggtctttgta

SEQ ID NO: 5924408 - DNA, 16 bp, Homo sapiens
gtaaggtctttgtaaa

SEQ ID NO: 5924409 - DNA, 21 bp, Homo sapiens
gtaaggtctttgtaaaatctt

SEQ ID NO: 5924410 - DNA, 14 bp, Homo sapiens
gtaaggtgagggaa

SEQ ID NO: 5924411 - DNA, 16 bp, Homo sapiens
gtaaggtgcagttccc

SEQ ID NO: 5924412 - DNA, 12 bp, Homo sapiens
gtaaggtgcctt

SEQ ID NO: 5924413 - DNA, 17 bp, Homo sapiens
gtaagtaaactgccctg

SEQ ID NO: 5924414 - DNA, 13 bp, Homo sapiens
gtaagtaattatc

SEQ ID NO: 5924415 - DNA, 18 bp, Homo sapiens
gtaagtaattatgcacta

SEQ ID NO: 5924416 - DNA, 18 bp, Homo sapiens
gtaagtatatctcagttt

SEQ ID NO: 5924417 - DNA, 13 bp, Homo sapiens
gtaagtcaggagt

SEQ ID NO: 5924418 - DNA, 12 bp, Homo sapiens
gtaagtcatcta

SEQ ID NO: 5924419 - DNA, 21 bp, Homo sapiens
gtaagtcccatgaatacacaa

SEQ ID NO: 5924420 - DNA, 17 bp, Homo sapiens
gtaagtctcaactctgt

SEQ ID NO: 5924421 - DNA, 12 bp, Homo sapiens
gtaagtcttttt

SEQ ID NO: 5924422 - DNA, 12 bp, Homo sapiens
gtaagtgccttc

SEQ ID NO: 5924423 - DNA, 13 bp, Homo sapiens
gtaagtgccttcc

SEQ ID NO: 5924424 - DNA, 16 bp, Homo sapiens
gtaagtgcttgtttta

SEQ ID NO: 5924425 - DNA, 23 bp, Homo sapiens
gtaagtggaattagagggccttg

SEQ ID NO: 5924426 - DNA, 13 bp, Homo sapiens
gtaagtggagcat

SEQ ID NO: 5924427 - DNA, 19 bp, Homo sapiens
gtaagtggattcagttcat

SEQ ID NO: 5924428 - DNA, 20 bp, Homo sapiens
gtaagtggcaggaccctgtc

SEQ ID NO: 5924429 - DNA, 12 bp, Homo sapiens
gtaagtgtacaa

SEQ ID NO: 5924430 - DNA, 14 bp, Homo sapiens
gtaagtgtacaatt

SEQ ID NO: 5924431 - DNA, 20 bp, Homo sapiens
gtaagtgtgagtaagagctg

SEQ ID NO: 5924432 - DNA, 17 bp, Homo sapiens
gtaagtgttctcatgaa

SEQ ID NO: 5924433 - DNA, 18 bp, Homo sapiens
gtaagttaataatgtatt

SEQ ID NO: 5924434 - DNA, 18 bp, Homo sapiens
gtaagttaatgtatataa

SEQ ID NO: 5924435 - DNA, 14 bp, Homo sapiens
gtaagttcctacta

SEQ ID NO: 5924436 - DNA, 15 bp, Homo sapiens
gtaagttctgaaaac

SEQ ID NO: 5924437 - DNA, 22 bp, Homo sapiens
gtaagttctgaaaactgtttat

SEQ ID NO: 5924438 - DNA, 12 bp, Homo sapiens
gtaagttctgtg

SEQ ID NO: 5924439 - DNA, 21 bp, Homo sapiens
gtaagttctgtggttccagta

SEQ ID NO: 5924440 - DNA, 22 bp, Homo sapiens
gtaagttgaagggaaatcaatt

SEQ ID NO: 5924441 - DNA, 23 bp, Homo sapiens
gtaagttgaatggcctgccttga

SEQ ID NO: 5924442 - DNA, 18 bp, Homo sapiens
gtaagttgagtggaatgt

SEQ ID NO: 5924443 - DNA, 17 bp, Homo sapiens
gtaagttgggcttgcta

SEQ ID NO: 5924444 - DNA, 17 bp, Homo sapiens
gtaataaaaagccacca

SEQ ID NO: 5924445 - DNA, 23 bp, Homo sapiens
gtaataaaacccagcatgtacaa

SEQ ID NO: 5924446 - DNA, 21 bp, Homo sapiens
gtaataaaactatttgtataa

SEQ ID NO: 5924447 - DNA, 12 bp, Homo sapiens
gtaataaaactg

SEQ ID NO: 5924448 - DNA, 21 bp, Homo sapiens
gtaataaaattcaacaaacat

SEQ ID NO: 5924449 - DNA, 12 bp, Homo sapiens
gtaataaacagg

SEQ ID NO: 5924450 - DNA, 13 bp, Homo sapiens
gtaataaactctc

SEQ ID NO: 5924451 - DNA, 14 bp, Homo sapiens
gtaataaactctct

SEQ ID NO: 5924452 - DNA, 13 bp, Homo sapiens
gtaataaagagaa

SEQ ID NO: 5924453 - DNA, 14 bp, Homo sapiens
gtaataaaggtctt

SEQ ID NO: 5924454 - DNA, 14 bp, Homo sapiens
gtaataaagtatat

SEQ ID NO: 5924455 - DNA, 13 bp, Homo sapiens
gtaataaatacac

SEQ ID NO: 5924456 - DNA, 15 bp, Homo sapiens
gtaataaatacacag

SEQ ID NO: 5924457 - DNA, 19 bp, Homo sapiens
gtaataacaaacgtgtttt

SEQ ID NO: 5924458 - DNA, 11 bp, Homo sapiens
gtaataacatt

SEQ ID NO: 5924459 - DNA, 13 bp, Homo sapiens
gtaataacattta

SEQ ID NO: 5924460 - DNA, 15 bp, Homo sapiens
gtaataacattttat

SEQ ID NO: 5924461 - DNA, 15 bp, Homo sapiens
gtaataactgtgaag

SEQ ID NO: 5924462 - DNA, 13 bp, Homo sapiens
gtaataagcactg

SEQ ID NO: 5924463 - DNA, 18 bp, Homo sapiens
gtaataagggaaaaatca

SEQ ID NO: 5924464 - DNA, 21 bp, Homo sapiens
gtaataatacctcaatgtttg

SEQ ID NO: 5924465 - DNA, 13 bp, Homo sapiens
gtaataatgtaat

SEQ ID NO: 5924466 - DNA, 22 bp, Homo sapiens
gtaatacaaactaatttagtaa

SEQ ID NO: 5924467 - DNA, 17 bp, Homo sapiens
gtaatacccgtcctctc

SEQ ID NO: 5924468 - DNA, 15 bp, Homo sapiens
gtaatacctgattga

SEQ ID NO: 5924469 - DNA, 18 bp, Homo sapiens
gtaatactaagtcctcag

SEQ ID NO: 5924470 - DNA, 12 bp, Homo sapiens
gtaatactggaa

SEQ ID NO: 5924471 - DNA, 16 bp, Homo sapiens
gtaatactggaataat

SEQ ID NO: 5924472 - DNA, 18 bp, Homo sapiens
gtaatactggaataattt

SEQ ID NO: 5924473 - DNA, 22 bp, Homo sapiens
gtaatactggaataatttgtaa

SEQ ID NO: 5924474 - DNA, 12 bp, Homo sapiens
gtaatactgtct

SEQ ID NO: 5924475 - DNA, 16 bp, Homo sapiens
gtaatacttaaataaa

SEQ ID NO: 5924476 - DNA, 17 bp, Homo sapiens
gtaatacttaaataaac

SEQ ID NO: 5924477 - DNA, 20 bp, Homo sapiens
gtaatacttttgtaatctat

SEQ ID NO: 5924478 - DNA, 19 bp, Homo sapiens
gtaatagaaaactgaaaat

SEQ ID NO: 5924479 - DNA, 13 bp, Homo sapiens
gtaatagctgaac

SEQ ID NO: 5924480 - DNA, 20 bp, Homo sapiens
gtaatagcttctgtgtgtga

SEQ ID NO: 5924481 - DNA, 22 bp, Homo sapiens
gtaataggaagaacagtacatt

SEQ ID NO: 5924482 - DNA, 16 bp, Homo sapiens
gtaataggaccagagc

SEQ ID NO: 5924483 - DNA, 20 bp, Homo sapiens
gtaatagtaaaatgcttaca

SEQ ID NO: 5924484 - DNA, 19 bp, Homo sapiens
gtaatagtccaatatttgg

SEQ ID NO: 5924485 - DNA, 14 bp, Homo sapiens
gtaatagtttatct

SEQ ID NO: 5924486 - DNA, 15 bp, Homo sapiens
gtaatagtttatctt

SEQ ID NO: 5924487 - DNA, 19 bp, Homo sapiens
gtaatataacaatatatga

SEQ ID NO: 5924488 - DNA, 13 bp, Homo sapiens
gtaatataagaca

SEQ ID NO: 5924489 - DNA, 14 bp, Homo sapiens
gtaatataagacaa

SEQ ID NO: 5924490 - DNA, 15 bp, Homo sapiens
gtaatataagacaag

SEQ ID NO: 5924491 - DNA, 20 bp, Homo sapiens
gtaatataagacaagtctga

SEQ ID NO: 5924492 - DNA, 21 bp, Homo sapiens
gtaatataagacaagtctgag

SEQ ID NO: 5924493 - DNA, 22 bp, Homo sapiens
gtaatataataatgtcctttcc

SEQ ID NO: 5924494 - DNA, 14 bp, Homo sapiens
gtaatataatacac

SEQ ID NO: 5924495 - DNA, 22 bp, Homo sapiens
gtaatataatacacaaaatcaa

SEQ ID NO: 5924496 - DNA, 12 bp, Homo sapiens
gtagttaaaaca

SEQ ID NO: 5924497 - DNA, 15 bp, Homo sapiens
gtagttaaataactg

SEQ ID NO: 5924498 - DNA, 13 bp, Homo sapiens
gtagttaatataa

SEQ ID NO: 5924499 - DNA, 17 bp, Homo sapiens
gtagttaatataaatgt

SEQ ID NO: 5924500 - DNA, 13 bp, Homo sapiens
gtagttaatttat

SEQ ID NO: 5924501 - DNA, 20 bp, Homo sapiens
gtagttacattaatgcccag

SEQ ID NO: 5924502 - DNA, 13 bp, Homo sapiens
gtagttacattta

SEQ ID NO: 5924503 - DNA, 16 bp, Homo sapiens
gtagttaggaaataaa

SEQ ID NO: 5924504 - DNA, 17 bp, Homo sapiens
gtagttatataattgtt

SEQ ID NO: 5924505 - DNA, 16 bp, Homo sapiens
gtagttatcatgttag

SEQ ID NO: 5924506 - DNA, 19 bp, Homo sapiens
gtagttcaagaaatgaaga

SEQ ID NO: 5924507 - DNA, 20 bp, Homo sapiens
gtagttcaagaaatgaagag

SEQ ID NO: 5924508 - DNA, 15 bp, Homo sapiens
gtagttcactttaat

SEQ ID NO: 5924509 - DNA, 17 bp, Homo sapiens
gtagttccaggactcag

SEQ ID NO: 5924510 - DNA, 19 bp, Homo sapiens
gtagttccaggactcaggg

SEQ ID NO: 5924511 - DNA, 18 bp, Homo sapiens
gtagttccctctgcctgg

SEQ ID NO: 5924512 - DNA, 20 bp, Homo sapiens
gtagttccctctgcctggga

SEQ ID NO: 5924513 - DNA, 13 bp, Homo sapiens
gtagttccctgaa

SEQ ID NO: 5924514 - DNA, 14 bp, Homo sapiens
gtagttctcaaagt

SEQ ID NO: 5924515 - DNA, 20 bp, Homo sapiens
gtagttctcttggtgttaaa

SEQ ID NO: 5924516 - DNA, 17 bp, Homo sapiens
gtagttctgtgtacttt

SEQ ID NO: 5924517 - DNA, 21 bp, Homo sapiens
gtagttctgtttggtgtgtcc

SEQ ID NO: 5924518 - DNA, 17 bp, Homo sapiens
gtagttctttaaactgt

SEQ ID NO: 5924519 - DNA, 24 bp, Homo sapiens
gtagttgatgaccaatctctgtga

SEQ ID NO: 5924520 - DNA, 13 bp, Homo sapiens
gtagttgctttgc

SEQ ID NO: 5924521 - DNA, 17 bp, Homo sapiens
gtagttgggtagaaaaa

SEQ ID NO: 5924522 - DNA, 12 bp, Homo sapiens
gtagttgtagaa

SEQ ID NO: 5924523 - DNA, 10 bp, Homo sapiens
gtagttgttt

SEQ ID NO: 5924524 - DNA, 21 bp, Homo sapiens
gtagtttatggcagaagggaa

SEQ ID NO: 5924525 - DNA, 19 bp, Homo sapiens
gtagtttctccaagtactt

SEQ ID NO: 5924526 - DNA, 20 bp, Homo sapiens
gtagtttgaatatttaagca

SEQ ID NO: 5924527 - DNA, 22 bp, Homo sapiens
gtagtttgaatatttaagcaat

SEQ ID NO: 5924528 - DNA, 12 bp, Homo sapiens
gtagtttgatca

SEQ ID NO: 5924529 - DNA, 17 bp, Homo sapiens
gtagtttgctttgcttt

SEQ ID NO: 5924530 - DNA, 23 bp, Homo sapiens
gtagtttgttatgtgtctggaag

SEQ ID NO: 5924531 - DNA, 15 bp, Homo sapiens
gtagttttaaataaa

SEQ ID NO: 5924532 - DNA, 16 bp, Homo sapiens
gtagttttcaaaacac

SEQ ID NO: 5924533 - DNA, 16 bp, Homo sapiens
gtagttttctttttta

SEQ ID NO: 5924534 - DNA, 13 bp, Homo sapiens
gtagttttgttta

SEQ ID NO: 5924535 - DNA, 20 bp, Homo sapiens
gtagtttttatatgttgtaa

SEQ ID NO: 5924536 - DNA, 16 bp, Homo sapiens
gtagtttttgctgaag

SEQ ID NO: 5924537 - DNA, 17 bp, Homo sapiens
gtataaaaaggaaatta

SEQ ID NO: 5924538 - DNA, 16 bp, Homo sapiens
gtataaaaataaaaaa

SEQ ID NO: 5924539 - DNA, 19 bp, Homo sapiens
gtataaaaattatcaaaaa

SEQ ID NO: 5924540 - DNA, 20 bp, Homo sapiens
gtataaaaattatcaaaaag

SEQ ID NO: 5924541 - DNA, 17 bp, Homo sapiens
gtataaaacagtgtttc

SEQ ID NO: 5924542 - DNA, 15 bp, Homo sapiens
gtataaaactttcct

SEQ ID NO: 5924543 - DNA, 16 bp, Homo sapiens
gtataaaactttcctc

SEQ ID NO: 5924544 - DNA, 21 bp, Homo sapiens
gtataaaactttcctcgcctg

SEQ ID NO: 5924545 - DNA, 23 bp, Homo sapiens
gtataaaagatggggtctgtaaa

SEQ ID NO: 5924546 - DNA, 17 bp, Homo sapiens
gtataaaagcctgttta

SEQ ID NO: 5924547 - DNA, 18 bp, Homo sapiens
gtataaaagcctgtttaa

SEQ ID NO: 5924548 - DNA, 14 bp, Homo sapiens
gtataaaaggttgc

SEQ ID NO: 5924549 - DNA, 23 bp, Homo sapiens
gtataaaatcagccaattatgtt

SEQ ID NO: 5924550 - DNA, 19 bp, Homo sapiens
gtataaaatccatagattt

SEQ ID NO: 5924551 - DNA, 17 bp, Homo sapiens
gtataaaatctgaattt

SEQ ID NO: 5924552 - DNA, 11 bp, Homo sapiens
gtataaaatgt

SEQ ID NO: 5924553 - DNA, 12 bp, Homo sapiens
gtataaaatgta

SEQ ID NO: 5924554 - DNA, 17 bp, Homo sapiens
gtataaaatgtaaaaac

SEQ ID NO: 5924555 - DNA, 14 bp, Homo sapiens
gtataaacaaagtt

SEQ ID NO: 5924556 - DNA, 15 bp, Homo sapiens
gtataaacaagaaaa

SEQ ID NO: 5924557 - DNA, 22 bp, Homo sapiens
gtataaacaagaaaaataaaga

SEQ ID NO: 5924558 - DNA, 14 bp, Homo sapiens
gtataaacaagcct

SEQ ID NO: 5924559 - DNA, 11 bp, Homo sapiens
gtataaacatt

SEQ ID NO: 5924560 - DNA, 18 bp, Homo sapiens
gtataaacattaaatgtc

SEQ ID NO: 5924561 - DNA, 18 bp, Homo sapiens
gtataaactgctgtcaat

SEQ ID NO: 5924562 - DNA, 19 bp, Homo sapiens
gtataaactgtattttgaa

SEQ ID NO: 5924563 - DNA, 12 bp, Homo sapiens
gtataaactttt

SEQ ID NO: 5924564 - DNA, 20 bp, Homo sapiens
gtataaagctctcaaatgtg

SEQ ID NO: 5924565 - DNA, 18 bp, Homo sapiens
gtataaaggcattgatat

SEQ ID NO: 5924566 - DNA, 14 bp, Homo sapiens
gtataaagtcagga

SEQ ID NO: 5924567 - DNA, 15 bp, Homo sapiens
gtataaataagcact

SEQ ID NO: 5924568 - DNA, 14 bp, Homo sapiens
gtataaataataaa

SEQ ID NO: 5924569 - DNA, 13 bp, Homo sapiens
gtataaatgtaca

SEQ ID NO: 5924570 - DNA, 13 bp, Homo sapiens
gtataaatgtata

SEQ ID NO: 5924571 - DNA, 11 bp, Homo sapiens
gtataaatgtc

SEQ ID NO: 5924572 - DNA, 18 bp, Homo sapiens
gtataaatgtctttaatg

SEQ ID NO: 5924573 - DNA, 14 bp, Homo sapiens
gtataaatttattt

SEQ ID NO: 5924574 - DNA, 19 bp, Homo sapiens
gtataacaagccaaacatt

SEQ ID NO: 5924575 - DNA, 20 bp, Homo sapiens
gtataacacaatatgaatac

SEQ ID NO: 5924576 - DNA, 21 bp, Homo sapiens
gtataacattaagaaaatatt

SEQ ID NO: 5924577 - DNA, 20 bp, Homo sapiens
gtataactaatttgctctgt

SEQ ID NO: 5924578 - DNA, 18 bp, Homo sapiens
gtataactttaacttctg

SEQ ID NO: 5924579 - DNA, 20 bp, Homo sapiens
gtataacttttgatgacttc

SEQ ID NO: 5924580 - DNA, 22 bp, Homo sapiens
gtataagatcctagatcctaag

SEQ ID NO: 5924581 - DNA, 17 bp, Homo sapiens
gtataagatgctgctga

SEQ ID NO: 5924582 - DNA, 21 bp, Homo sapiens
gtataagatgctgctgagcac

SEQ ID NO: 5924583 - DNA, 17 bp, Homo sapiens
gtataagatttttgaaa

SEQ ID NO: 5924584 - DNA, 22 bp, Homo sapiens
gtataagcactgaaaaacaaca

SEQ ID NO: 5924585 - DNA, 13 bp, Homo sapiens
gtataagccccga

SEQ ID NO: 5924586 - DNA, 12 bp, Homo sapiens
gtataaggaaat

SEQ ID NO: 5924587 - DNA, 20 bp, Homo sapiens
gtataaggagctttgctctt

SEQ ID NO: 5924588 - DNA, 12 bp, Homo sapiens
gtataaggatct

SEQ ID NO: 5924589 - DNA, 17 bp, Homo sapiens
gtataaggatcttttgt

SEQ ID NO: 5924590 - DNA, 19 bp, Homo sapiens
gtataaggatcttttgtaa

SEQ ID NO: 5924591 - DNA, 15 bp, Homo sapiens
gtataagtaagaaaa

SEQ ID NO: 5924592 - DNA, 15 bp, Homo sapiens
gtataagtagaattc

SEQ ID NO: 5924593 - DNA, 21 bp, Homo sapiens
gtataagtagatctgctttct

SEQ ID NO: 5924594 - DNA, 17 bp, Homo sapiens
gtataagttgaaggaaa

SEQ ID NO: 5924595 - DNA, 18 bp, Homo sapiens
gtataagttgctgtaaaa

SEQ ID NO: 5924596 - DNA, 21 bp, Homo sapiens
gtataatacatccattctaca

SEQ ID NO: 5924597 - DNA, 14 bp, Homo sapiens
gtataatacattac

SEQ ID NO: 5924598 - DNA, 16 bp, Homo sapiens
gtataatatatatcta

SEQ ID NO: 5924599 - DNA, 20 bp, Homo sapiens
gtataatattaaggcttact

SEQ ID NO: 5924600 - DNA, 15 bp, Homo sapiens
gtataatatttctta

SEQ ID NO: 5924601 - DNA, 15 bp, Homo sapiens
gtataatatttttaa

SEQ ID NO: 5924602 - DNA, 13 bp, Homo sapiens
gtataatcttgta

SEQ ID NO: 5924603 - DNA, 14 bp, Homo sapiens
gtataatctttcta

SEQ ID NO: 5924604 - DNA, 21 bp, Homo sapiens
gtataatctttctatagccaa

SEQ ID NO: 5924605 - DNA, 16 bp, Homo sapiens
gtataatgctttctga

SEQ ID NO: 5924606 - DNA, 19 bp, Homo sapiens
gtataatggagaattaaaa

SEQ ID NO: 5924607 - DNA, 21 bp, Homo sapiens
gtataatgtatgaattttgta

SEQ ID NO: 5924608 - DNA, 18 bp, Homo sapiens
gtataatgtgctttattt

SEQ ID NO: 5924609 - DNA, 13 bp, Homo sapiens
gtataatgtttaa

SEQ ID NO: 5924610 - DNA, 18 bp, Homo sapiens
gtataattgtatcgtata

SEQ ID NO: 5924611 - DNA, 23 bp, Homo sapiens
gtataattgtgtgatatttcaga

SEQ ID NO: 5924612 - DNA, 13 bp, Homo sapiens
gtataatttacct

SEQ ID NO: 5924613 - DNA, 20 bp, Homo sapiens
gtataatttacctctcatta

SEQ ID NO: 5924614 - DNA, 16 bp, Homo sapiens
gtataatttagtccct

SEQ ID NO: 5924615 - DNA, 14 bp, Homo sapiens
gtataatttcgaga

SEQ ID NO: 5924616 - DNA, 18 bp, Homo sapiens
gtataatttcgagatttg

SEQ ID NO: 5924617 - DNA, 21 bp, Homo sapiens
gtataatttcgagatttgtag

SEQ ID NO: 5924618 - DNA, 15 bp, Homo sapiens
gtatacaaatatatt

SEQ ID NO: 5924619 - DNA, 19 bp, Homo sapiens
gtatacaaatatattgtta

SEQ ID NO: 5924620 - DNA, 17 bp, Homo sapiens
gtatacaacaggagaga

SEQ ID NO: 5924621 - DNA, 14 bp, Homo sapiens
gtatacaatatata

SEQ ID NO: 5924622 - DNA, 15 bp, Homo sapiens
gtatacacacatata

SEQ ID NO: 5924623 - DNA, 23 bp, Homo sapiens
gtatacaccatatactgttcttc

SEQ ID NO: 5924624 - DNA, 12 bp, Homo sapiens
gtatacaggtgg

SEQ ID NO: 5924625 - DNA, 21 bp, Homo sapiens
gtatacagtggattaattaaa

SEQ ID NO: 5924626 - DNA, 17 bp, Homo sapiens
gtatacatatgtatgtg

SEQ ID NO: 5924627 - DNA, 18 bp, Homo sapiens
gtatacatatgtatgtgt

SEQ ID NO: 5924628 - DNA, 20 bp, Homo sapiens
gtatacatatgtatgtgtga

SEQ ID NO: 5924629 - DNA, 20 bp, Homo sapiens
gtatacatcctgggtaatga

SEQ ID NO: 5924630 - DNA, 12 bp, Homo sapiens
gtatacatgcca

SEQ ID NO: 5924631 - DNA, 14 bp, Homo sapiens
gtatacatgtcaat

SEQ ID NO: 5924632 - DNA, 16 bp, Homo sapiens
gtatacatgtgtacat

SEQ ID NO: 5924633 - DNA, 14 bp, Homo sapiens
gtatacatttagtt

SEQ ID NO: 5924634 - DNA, 21 bp, Homo sapiens
gtatacattttgttatagaat

SEQ ID NO: 5924635 - DNA, 19 bp, Homo sapiens
gtataccaatgtgttttct

SEQ ID NO: 5924636 - DNA, 16 bp, Homo sapiens
gtataccacctgtaca

SEQ ID NO: 5924637 - DNA, 17 bp, Homo sapiens
gtataccacctgtacat

SEQ ID NO: 5924638 - DNA, 13 bp, Homo sapiens
gtataccagagaa

SEQ ID NO: 5924639 - DNA, 15 bp, Homo sapiens
gtataccagagaagg

SEQ ID NO: 5924640 - DNA, 14 bp, Homo sapiens
gtatacccactgca

SEQ ID NO: 5924641 - DNA, 19 bp, Homo sapiens
gtataccggaattactttt

SEQ ID NO: 5924642 - DNA, 15 bp, Homo sapiens
gtatacctatttcat

SEQ ID NO: 5924643 - DNA, 13 bp, Homo sapiens
gtatacctcactt

SEQ ID NO: 5924644 - DNA, 11 bp, Homo sapiens
gtatacctcat

SEQ ID NO: 5924645 - DNA, 12 bp, Homo sapiens
gtatacctcatt

SEQ ID NO: 5924646 - DNA, 17 bp, Homo sapiens
gtatacctcatttttca

SEQ ID NO: 5924647 - DNA, 18 bp, Homo sapiens
gtatacctcatttttcat

SEQ ID NO: 5924648 - DNA, 17 bp, Homo sapiens
gtatacctctaactgtg

SEQ ID NO: 5924649 - DNA, 21 bp, Homo sapiens
gtatacctggctttttaaaat

SEQ ID NO: 5924650 - DNA, 18 bp, Homo sapiens
gtatacgtataaatatca

SEQ ID NO: 5924651 - DNA, 20 bp, Homo sapiens
gtatacgtataaatatcagt

SEQ ID NO: 5924652 - DNA, 23 bp, Homo sapiens
gtatactagggagccatttgaga

SEQ ID NO: 5924653 - DNA, 22 bp, Homo sapiens
gtatactatgtaagggctttaa

SEQ ID NO: 5924654 - DNA, 16 bp, Homo sapiens
gtatactcctgtcacc

SEQ ID NO: 5924655 - DNA, 13 bp, Homo sapiens
gtatactcttgaa

SEQ ID NO: 5924656 - DNA, 12 bp, Homo sapiens
gtatactgtaaa

SEQ ID NO: 5924657 - DNA, 16 bp, Homo sapiens
gtatactgtaaaagtt

SEQ ID NO: 5924658 - DNA, 20 bp, Homo sapiens
gtatactgtaaaagttataa

SEQ ID NO: 5924659 - DNA, 13 bp, Homo sapiens
gtatactgtgtgg

SEQ ID NO: 5924660 - DNA, 20 bp, Homo sapiens
gtatacttcagtgctcaccc

SEQ ID NO: 5924661 - DNA, 17 bp, Homo sapiens
gtatacttcattagcaa

SEQ ID NO: 5924662 - DNA, 21 bp, Homo sapiens
gtatacttccttacttttaag

SEQ ID NO: 5924663 - DNA, 23 bp, Homo sapiens
gtatactttaaataatttaacta

SEQ ID NO: 5924664 - DNA, 13 bp, Homo sapiens
gtatactttagta

SEQ ID NO: 5924665 - DNA, 14 bp, Homo sapiens
gtatactttagtat

SEQ ID NO: 5924666 - DNA, 14 bp, Homo sapiens
gtatagaaatgctg

SEQ ID NO: 5924667 - DNA, 15 bp, Homo sapiens
gtatagaaatgctgg

SEQ ID NO: 5924668 - DNA, 18 bp, Homo sapiens
gtatagaagtctggaaaa

SEQ ID NO: 5924669 - DNA, 21 bp, Homo sapiens
gtatagaataggcactttaaa

SEQ ID NO: 5924670 - DNA, 16 bp, Homo sapiens
gtatagactcctgaaa

SEQ ID NO: 5924671 - DNA, 18 bp, Homo sapiens
gtatagagaaaagtgtat

SEQ ID NO: 5924672 - DNA, 20 bp, Homo sapiens
gtatagatataatgaacaaa

SEQ ID NO: 5924673 - DNA, 14 bp, Homo sapiens
gtatagatgcaaga

SEQ ID NO: 5924674 - DNA, 16 bp, Homo sapiens
gtatagatgcaagata

SEQ ID NO: 5924675 - DNA, 15 bp, Homo sapiens
gtatagatgttgcta

SEQ ID NO: 5924676 - DNA, 18 bp, Homo sapiens
gtatcaatccttgttcag

SEQ ID NO: 5924677 - DNA, 19 bp, Homo sapiens
gtatcaatctttagaaaag

SEQ ID NO: 5924678 - DNA, 16 bp, Homo sapiens
gtatcacaaagctgtg

SEQ ID NO: 5924679 - DNA, 16 bp, Homo sapiens
gtatcaccctcagctg

SEQ ID NO: 5924680 - DNA, 15 bp, Homo sapiens
gtatcactctaaaaa

SEQ ID NO: 5924681 - DNA, 20 bp, Homo sapiens
gtatcagaatacttgcactc

SEQ ID NO: 5924682 - DNA, 17 bp, Homo sapiens
gtatcagaggcctataa

SEQ ID NO: 5924683 - DNA, 17 bp, Homo sapiens
gtatcagagggtggaga

SEQ ID NO: 5924684 - DNA, 22 bp, Homo sapiens
gtatcagagttgcttttctaat

SEQ ID NO: 5924685 - DNA, 22 bp, Homo sapiens
gtatcaggacccagaggaaggg

SEQ ID NO: 5924686 - DNA, 18 bp, Homo sapiens
gtatcaggactgtgacca

SEQ ID NO: 5924687 - DNA, 19 bp, Homo sapiens
gtatcaggcacaggcagga

SEQ ID NO: 5924688 - DNA, 20 bp, Homo sapiens
gtatcaggcacaggcaggaa

SEQ ID NO: 5924689 - DNA, 16 bp, Homo sapiens
gtatcaggtgctgcca

SEQ ID NO: 5924690 - DNA, 18 bp, Homo sapiens
gtatcagtcagtgctgga

SEQ ID NO: 5924691 - DNA, 17 bp, Homo sapiens
gtatcagtgtcctttcc

SEQ ID NO: 5924692 - DNA, 14 bp, Homo sapiens
gtatcagtgtttat

SEQ ID NO: 5924693 - DNA, 24 bp, Homo sapiens
gtatcagtgtttatgtgctattaa

SEQ ID NO: 5924694 - DNA, 16 bp, Homo sapiens
gtatcagttatatgat

SEQ ID NO: 5924695 - DNA, 17 bp, Homo sapiens
gtatcagttatatgata

SEQ ID NO: 5924696 - DNA, 13 bp, Homo sapiens
gtatcagtttcca

SEQ ID NO: 5924697 - DNA, 18 bp, Homo sapiens
gtatcatatattaaaaca

SEQ ID NO: 5924698 - DNA, 16 bp, Homo sapiens
gtatcatatatttaat

SEQ ID NO: 5924699 - DNA, 13 bp, Homo sapiens
gtatcatctccat

SEQ ID NO: 5924700 - DNA, 14 bp, Homo sapiens
gtatcatctggata

SEQ ID NO: 5924701 - DNA, 17 bp, Homo sapiens
gtatcatgccctgtgca

SEQ ID NO: 5924702 - DNA, 18 bp, Homo sapiens
gtatcatgccctgtgcaa

SEQ ID NO: 5924703 - DNA, 16 bp, Homo sapiens
gtatcatggaaatatt

SEQ ID NO: 5924704 - DNA, 16 bp, Homo sapiens
gtatcattaaaatata

SEQ ID NO: 5924705 - DNA, 19 bp, Homo sapiens
gtatcattaaaatatatgt

SEQ ID NO: 5924706 - DNA, 14 bp, Homo sapiens
gtatcatttcatgc

SEQ ID NO: 5924707 - DNA, 17 bp, Homo sapiens
gtatcatttctaatttt

SEQ ID NO: 5924708 - DNA, 20 bp, Homo sapiens
gtatcatttctaattttaag

SEQ ID NO: 5924709 - DNA, 20 bp, Homo sapiens
gtatccaaaaatagccctgc

SEQ ID NO: 5924710 - DNA, 21 bp, Homo sapiens
gtatccaactgcatccaggcc

SEQ ID NO: 5924711 - DNA, 19 bp, Homo sapiens
gtatccaattatgtgacaa

SEQ ID NO: 5924712 - DNA, 20 bp, Homo sapiens
gtatccaattatgtgacaac

SEQ ID NO: 5924713 - DNA, 19 bp, Homo sapiens
gtatccacacaaattcagt

SEQ ID NO: 5924714 - DNA, 15 bp, Homo sapiens
gtatccatattttat

SEQ ID NO: 5924715 - DNA, 14 bp, Homo sapiens
gtatccatgctctt

SEQ ID NO: 5924716 - DNA, 18 bp, Homo sapiens
gtatccatgggggcaggg

SEQ ID NO: 5924717 - DNA, 17 bp, Homo sapiens
gtatccatgtaatgatc

SEQ ID NO: 5924718 - DNA, 16 bp, Homo sapiens
gtatccattatcatgt

SEQ ID NO: 5924719 - DNA, 19 bp, Homo sapiens
gtatcccaactcctataat

SEQ ID NO: 5924720 - DNA, 11 bp, Homo sapiens
gtatcccacct

SEQ ID NO: 5924721 - DNA, 23 bp, Homo sapiens
gtatcccacctccagcccacagt

SEQ ID NO: 5924722 - DNA, 19 bp, Homo sapiens
gtatcccatgagcctcagc

SEQ ID NO: 5924723 - DNA, 13 bp, Homo sapiens
gtatccccagtgc

SEQ ID NO: 5924724 - DNA, 15 bp, Homo sapiens
gtatccccagtgccc

SEQ ID NO: 5924725 - DNA, 16 bp, Homo sapiens
gtatccccagtgcccg

SEQ ID NO: 5924726 - DNA, 22 bp, Homo sapiens
gtatccccagtgcccggtgcag

SEQ ID NO: 5924727 - DNA, 16 bp, Homo sapiens
gtatcccctgcctcct

SEQ ID NO: 5924728 - DNA, 18 bp, Homo sapiens
gtatcccctgcctcctgc

SEQ ID NO: 5924729 - DNA, 19 bp, Homo sapiens
gtatcccgagtctgggaca

SEQ ID NO: 5924730 - DNA, 20 bp, Homo sapiens
gtatcccgagtctgggacac

SEQ ID NO: 5924731 - DNA, 18 bp, Homo sapiens
gtatcccttctcacagca

SEQ ID NO: 5924732 - DNA, 19 bp, Homo sapiens
gtatcccttctcacagcac

SEQ ID NO: 5924733 - DNA, 19 bp, Homo sapiens
gtatccgactctaagctgt

SEQ ID NO: 5924734 - DNA, 18 bp, Homo sapiens
gtatccgtgaattgcttt

SEQ ID NO: 5924735 - DNA, 22 bp, Homo sapiens
gtatcctcatttggggtagcta

SEQ ID NO: 5924736 - DNA, 19 bp, Homo sapiens
gtatcctccaggtttttca

SEQ ID NO: 5924737 - DNA, 20 bp, Homo sapiens
gtatcctccaggtttttcaa

SEQ ID NO: 5924738 - DNA, 21 bp, Homo sapiens
gtatcctccaggtttttcaat

SEQ ID NO: 5924739 - DNA, 23 bp, Homo sapiens
gtatcctccaggtttttcaatta

SEQ ID NO: 5924740 - DNA, 18 bp, Homo sapiens
gtatcctccctgcccatc

SEQ ID NO: 5924741 - DNA, 17 bp, Homo sapiens
gtatcctccctggcaga

SEQ ID NO: 5924742 - DNA, 18 bp, Homo sapiens
gtatcctgcccagtgttg

SEQ ID NO: 5924743 - DNA, 13 bp, Homo sapiens
gtatcctgctggt

SEQ ID NO: 5924744 - DNA, 14 bp, Homo sapiens
gtatcctggccctg

SEQ ID NO: 5924745 - DNA, 18 bp, Homo sapiens
gtatcctggccctggggg

SEQ ID NO: 5924746 - DNA, 13 bp, Homo sapiens
gtatcctggggct

SEQ ID NO: 5924747 - DNA, 17 bp, Homo sapiens
gtatcctggggctccct

SEQ ID NO: 5924748 - DNA, 20 bp, Homo sapiens
gtatcctgggggaagaggag

SEQ ID NO: 5924749 - DNA, 12 bp, Homo sapiens
gtatcctgtgca

SEQ ID NO: 5924750 - DNA, 22 bp, Homo sapiens
gtatccttatctagtgtttgat

SEQ ID NO: 5924751 - DNA, 14 bp, Homo sapiens
gtatcgaggcttgt

SEQ ID NO: 5924752 - DNA, 14 bp, Homo sapiens
gtatcgatgtttta

SEQ ID NO: 5924753 - DNA, 15 bp, Homo sapiens
gtatcgatgttttat

SEQ ID NO: 5924754 - DNA, 18 bp, Homo sapiens
gtatcgctgccttgccat

SEQ ID NO: 5924755 - DNA, 14 bp, Homo sapiens
gtatcggagacagt

SEQ ID NO: 5924756 - DNA, 20 bp, Homo sapiens
gtatcgggggctggggcagg

SEQ ID NO: 5924757 - DNA, 15 bp, Homo sapiens
gtatcgtaaccagcc

SEQ ID NO: 5924758 - DNA, 16 bp, Homo sapiens
gtatcgtaaccagcca

SEQ ID NO: 5924759 - DNA, 16 bp, Homo sapiens
gtatcgtatagctgta

SEQ ID NO: 5924760 - DNA, 18 bp, Homo sapiens
gtatcgttcgcttgtttt

SEQ ID NO: 5924761 - DNA, 16 bp, Homo sapiens
gtatctaaaagtgtca

SEQ ID NO: 5924762 - DNA, 18 bp, Homo sapiens
gtatctaatttcattcaa

SEQ ID NO: 5924763 - DNA, 14 bp, Homo sapiens
gtatctacaataca

SEQ ID NO: 5924764 - DNA, 18 bp, Homo sapiens
gtatctacaatacatata

SEQ ID NO: 5924765 - DNA, 18 bp, Homo sapiens
gtatctacagtaatgaaa

SEQ ID NO: 5924766 - DNA, 19 bp, Homo sapiens
gtatctacagtaatgaaat

SEQ ID NO: 5924767 - DNA, 18 bp, Homo sapiens
gtatctacattaaaatga

SEQ ID NO: 5924768 - DNA, 23 bp, Homo sapiens
gtatctagaaagagatcacccac

SEQ ID NO: 5924769 - DNA, 24 bp, Homo sapiens
gtatctagcaatcacaacactggc

SEQ ID NO: 5924770 - DNA, 17 bp, Homo sapiens
gtatctaggcatttcat

SEQ ID NO: 5924771 - DNA, 17 bp, Homo sapiens
gtatctagtgcagctga

SEQ ID NO: 5924772 - DNA, 18 bp, Homo sapiens
gtatctagtgcagctgat

SEQ ID NO: 5924773 - DNA, 17 bp, Homo sapiens
gtatctagtggtctgat

SEQ ID NO: 5924774 - DNA, 18 bp, Homo sapiens
gtatctagtggtctgatt

SEQ ID NO: 5924775 - DNA, 23 bp, Homo sapiens
gtatctatgcaaagcactctctg

SEQ ID NO: 5924776 - DNA, 14 bp, Homo sapiens
gtatctattgtgtt

SEQ ID NO: 5924777 - DNA, 14 bp, Homo sapiens
gtatctatttgtac

SEQ ID NO: 5924778 - DNA, 17 bp, Homo sapiens
gtatctatttgtacaat

SEQ ID NO: 5924779 - DNA, 14 bp, Homo sapiens
gtatctattttcaa

SEQ ID NO: 5924780 - DNA, 20 bp, Homo sapiens
gtatctatttttttttcttt

SEQ ID NO: 5924781 - DNA, 23 bp, Homo sapiens
gtatctcaaatctgctttcatcc

SEQ ID NO: 5924782 - DNA, 13 bp, Homo sapiens
gtatctcagaaag

SEQ ID NO: 5924783 - DNA, 21 bp, Homo sapiens
gtatctcagaaagtgcctgac

SEQ ID NO: 5924784 - DNA, 23 bp, Homo sapiens
gtatctcatactgtctgggatta

SEQ ID NO: 5924785 - DNA, 20 bp, Homo sapiens
gtatctccctggagaagcac

SEQ ID NO: 5924786 - DNA, 22 bp, Homo sapiens
gtatctccggctcccagcctca

SEQ ID NO: 5924787 - DNA, 14 bp, Homo sapiens
gtatctcctttaat

SEQ ID NO: 5924788 - DNA, 13 bp, Homo sapiens
gtatctctctgcc

SEQ ID NO: 5924789 - DNA, 20 bp, Homo sapiens
gtatctctgaagcatgtttc

SEQ ID NO: 5924790 - DNA, 15 bp, Homo sapiens
gtatctctggcctcc

SEQ ID NO: 5924791 - DNA, 19 bp, Homo sapiens
gtatctcttacatcagtag

SEQ ID NO: 5924792 - DNA, 17 bp, Homo sapiens
gtatctcttcagtctct

SEQ ID NO: 5924793 - DNA, 19 bp, Homo sapiens
gtatctgaactcacagact

SEQ ID NO: 5924794 - DNA, 12 bp, Homo sapiens
gtatctgaagac

SEQ ID NO: 5924795 - DNA, 12 bp, Homo sapiens
gtatctgagcag

SEQ ID NO: 5924796 - DNA, 14 bp, Homo sapiens
gtatctgagttgcc

SEQ ID NO: 5924797 - DNA, 15 bp, Homo sapiens
gtatctgagttgcca

SEQ ID NO: 5924798 - DNA, 19 bp, Homo sapiens
gtatctgatgatgttctga

SEQ ID NO: 5924799 - DNA, 21 bp, Homo sapiens
gtatctgcatgtaaaatcttc

SEQ ID NO: 5924800 - DNA, 13 bp, Homo sapiens
gtatctgccctcc

SEQ ID NO: 5924801 - DNA, 15 bp, Homo sapiens
gtatctgctgttctt

SEQ ID NO: 5924802 - DNA, 21 bp, Homo sapiens
gtatctggattcaaatttatt

SEQ ID NO: 5924803 - DNA, 18 bp, Homo sapiens
gtatctggcttccctgga

SEQ ID NO: 5924804 - DNA, 18 bp, Homo sapiens
gtatctgggattattctt

SEQ ID NO: 5924805 - DNA, 19 bp, Homo sapiens
gtatctgggtaagaagaaa

SEQ ID NO: 5924806 - DNA, 13 bp, Homo sapiens
gtatctgtaaccc

SEQ ID NO: 5924807 - DNA, 18 bp, Homo sapiens
gtatctgtaacccttgaa

SEQ ID NO: 5924808 - DNA, 21 bp, Homo sapiens
gtatctgtatataagttgctg

SEQ ID NO: 5924809 - DNA, 16 bp, Homo sapiens
gtatctgtatctctct

SEQ ID NO: 5924810 - DNA, 14 bp, Homo sapiens
gtatctgtcacaat

SEQ ID NO: 5924811 - DNA, 21 bp, Homo sapiens
gtatctgtcacaataaatggc

SEQ ID NO: 5924812 - DNA, 19 bp, Homo sapiens
gtatctgtctttccactct

SEQ ID NO: 5924813 - DNA, 18 bp, Homo sapiens
gtatctgttactccaaaa

SEQ ID NO: 5924814 - DNA, 21 bp, Homo sapiens
gtatcttaaaggacataaaat

SEQ ID NO: 5924815 - DNA, 13 bp, Homo sapiens
gtatcttaaatct

SEQ ID NO: 5924816 - DNA, 13 bp, Homo sapiens
gtatcttaaattt

SEQ ID NO: 5924817 - DNA, 23 bp, Homo sapiens
gtatcttacctagtgtttactcc

SEQ ID NO: 5924818 - DNA, 16 bp, Homo sapiens
gtatcttactctgtcc

SEQ ID NO: 5924819 - DNA, 19 bp, Homo sapiens
gtatcttagagtttacagt

SEQ ID NO: 5924820 - DNA, 21 bp, Homo sapiens
gtatcttagagtttacagttt

SEQ ID NO: 5924821 - DNA, 17 bp, Homo sapiens
gtatcttattataaaat

SEQ ID NO: 5924822 - DNA, 14 bp, Homo sapiens
gtatcttcatgtat

SEQ ID NO: 5924823 - DNA, 14 bp, Homo sapiens
gtatcttcctttct

SEQ ID NO: 5924824 - DNA, 19 bp, Homo sapiens
gtatcttcctttcttgtct

SEQ ID NO: 5924825 - DNA, 21 bp, Homo sapiens
gtatcttcctttcttgtcttt

SEQ ID NO: 5924826 - DNA, 15 bp, Homo sapiens
gtatcttctattttt

SEQ ID NO: 5924827 - DNA, 22 bp, Homo sapiens
gtatcttctatttttatcatga

SEQ ID NO: 5924828 - DNA, 20 bp, Homo sapiens
gtatcttgaaatcctggaaa

SEQ ID NO: 5924829 - DNA, 13 bp, Homo sapiens
gtatcttgattaa

SEQ ID NO: 5924830 - DNA, 18 bp, Homo sapiens
gtatcttgattaatgtac

SEQ ID NO: 5924831 - DNA, 19 bp, Homo sapiens
gtatcttgattaatgtact

SEQ ID NO: 5924832 - DNA, 21 bp, Homo sapiens
gtatcttgattaatgtacttt

SEQ ID NO: 5924833 - DNA, 23 bp, Homo sapiens
gtatcttgattaatgtacttttt

SEQ ID NO: 5924834 - DNA, 22 bp, Homo sapiens
gtatcttgcagtatcggcactg

SEQ ID NO: 5924835 - DNA, 21 bp, Homo sapiens
gtatcttggggcaagactgca

SEQ ID NO: 5924836 - DNA, 22 bp, Homo sapiens
gtatctttaaaaaaaaatcttg

SEQ ID NO: 5924837 - DNA, 21 bp, Homo sapiens
gtatctttaaaaagcagtcct

SEQ ID NO: 5924838 - DNA, 23 bp, Homo sapiens
gtatctttaacaattgtcttaaa

SEQ ID NO: 5924839 - DNA, 15 bp, Homo sapiens
gtatctttattaaaa

SEQ ID NO: 5924840 - DNA, 20 bp, Homo sapiens
gtatctttctatgctgcttt

SEQ ID NO: 5924841 - DNA, 19 bp, Homo sapiens
gtatctttctttctctaat

SEQ ID NO: 5924842 - DNA, 23 bp, Homo sapiens
gtatctttgacaattctgggtgc

SEQ ID NO: 5924843 - DNA, 22 bp, Homo sapiens
gtatctttgggtctttgataaa

SEQ ID NO: 5924844 - DNA, 18 bp, Homo sapiens
gtatcttttatcctggga

SEQ ID NO: 5924845 - DNA, 14 bp, Homo sapiens
gtatcttttctttc

SEQ ID NO: 5924846 - DNA, 16 bp, Homo sapiens
gtatcttttttcaaaa

SEQ ID NO: 5924847 - DNA, 17 bp, Homo sapiens
gtatgaaaacatggaac

SEQ ID NO: 5924848 - DNA, 23 bp, Homo sapiens
gtatgaaaatctttatagtaaaa

SEQ ID NO: 5924849 - DNA, 11 bp, Homo sapiens
gtatgaaatat

SEQ ID NO: 5924850 - DNA, 17 bp, Homo sapiens
gtatgaaatatatgtga

SEQ ID NO: 5924851 - DNA, 20 bp, Homo sapiens
gtatgaaatatatgtgaaag

SEQ ID NO: 5924852 - DNA, 17 bp, Homo sapiens
gtattgagatattacac

SEQ ID NO: 5924853 - DNA, 18 bp, Homo sapiens
gtattgagggccagtgat

SEQ ID NO: 5924854 - DNA, 23 bp, Homo sapiens
gtattgagggccagtgatgatgt

SEQ ID NO: 5924855 - DNA, 14 bp, Homo sapiens
gtattgagtgttct

SEQ ID NO: 5924856 - DNA, 13 bp, Homo sapiens
gtattgattacaa

SEQ ID NO: 5924857 - DNA, 22 bp, Homo sapiens
gtattgattacaaataaacagt

SEQ ID NO: 5924858 - DNA, 22 bp, Homo sapiens
gtattgattcaaatgtcagcag

SEQ ID NO: 5924859 - DNA, 19 bp, Homo sapiens
gtattgatttttaagaaag

SEQ ID NO: 5924860 - DNA, 13 bp, Homo sapiens
gtattgcacattg

SEQ ID NO: 5924861 - DNA, 18 bp, Homo sapiens
gtattgcacattgtaaaa

SEQ ID NO: 5924862 - DNA, 15 bp, Homo sapiens
gtattgcatctgtat

SEQ ID NO: 5924863 - DNA, 23 bp, Homo sapiens
gtattgccaaacattaatgttga

SEQ ID NO: 5924864 - DNA, 23 bp, Homo sapiens
gtattgcgaatgtgcagaaagca

SEQ ID NO: 5924865 - DNA, 20 bp, Homo sapiens
gtattgctatgttcttctgt

SEQ ID NO: 5924866 - DNA, 11 bp, Homo sapiens
gtattgctgct

SEQ ID NO: 5924867 - DNA, 14 bp, Homo sapiens
gtattgctgctgtg

SEQ ID NO: 5924868 - DNA, 18 bp, Homo sapiens
gtattgctgctgtgcgtg

SEQ ID NO: 5924869 - DNA, 14 bp, Homo sapiens
gtattgcttgccac

SEQ ID NO: 5924870 - DNA, 17 bp, Homo sapiens
gtattggaattgcaata

SEQ ID NO: 5924871 - DNA, 23 bp, Homo sapiens
gtattggacggtttctagcctct

SEQ ID NO: 5924872 - DNA, 18 bp, Homo sapiens
gtattggagcacatgtta

SEQ ID NO: 5924873 - DNA, 23 bp, Homo sapiens
gtattggagcacatgttactgct

SEQ ID NO: 5924874 - DNA, 13 bp, Homo sapiens
gtattggcacagt

SEQ ID NO: 5924875 - DNA, 14 bp, Homo sapiens
gtattggcctggag

SEQ ID NO: 5924876 - DNA, 15 bp, Homo sapiens
gtattggcctgttca

SEQ ID NO: 5924877 - DNA, 17 bp, Homo sapiens
gtattgggcagcagact

SEQ ID NO: 5924878 - DNA, 17 bp, Homo sapiens
gtattggtgctttgtgt

SEQ ID NO: 5924879 - DNA, 21 bp, Homo sapiens
gtattgtaaaaaattcacata

SEQ ID NO: 5924880 - DNA, 13 bp, Homo sapiens
gtattgtaaaaca

SEQ ID NO: 5924881 - DNA, 14 bp, Homo sapiens
gtattgtaaaacat

SEQ ID NO: 5924882 - DNA, 11 bp, Homo sapiens
gtattgtaaat

SEQ ID NO: 5924883 - DNA, 20 bp, Homo sapiens
gtattgtaaattatatttgt

SEQ ID NO: 5924884 - DNA, 11 bp, Homo sapiens
gtattgtaata

SEQ ID NO: 5924885 - DNA, 16 bp, Homo sapiens
gtattgtaatattaaa

SEQ ID NO: 5924886 - DNA, 15 bp, Homo sapiens
gtattgtaatgaata

SEQ ID NO: 5924887 - DNA, 21 bp, Homo sapiens
gtattgtacaaagtattaagc

SEQ ID NO: 5924888 - DNA, 22 bp, Homo sapiens
gtattgtacaaagtattaagca

SEQ ID NO: 5924889 - DNA, 15 bp, Homo sapiens
gtattgtagaaagct

SEQ ID NO: 5924890 - DNA, 22 bp, Homo sapiens
gtattgtcagccatcgtcctgg

SEQ ID NO: 5924891 - DNA, 21 bp, Homo sapiens
gtattgtccatatcagacctc

SEQ ID NO: 5924892 - DNA, 21 bp, Homo sapiens
gtattgtcctattagtgttat

SEQ ID NO: 5924893 - DNA, 20 bp, Homo sapiens
gtattgtctgacttctcagg

SEQ ID NO: 5924894 - DNA, 13 bp, Homo sapiens
gtattgtgaccac

SEQ ID NO: 5924895 - DNA, 16 bp, Homo sapiens
gtattgtgattatcaa

SEQ ID NO: 5924896 - DNA, 19 bp, Homo sapiens
gtattgtgcaatgtgtata

SEQ ID NO: 5924897 - DNA, 22 bp, Homo sapiens
gtattgtgcaatgtgtataaac

SEQ ID NO: 5924898 - DNA, 23 bp, Homo sapiens
gtattgtgtttatgcatttcaat

SEQ ID NO: 5924899 - DNA, 23 bp, Homo sapiens
gtattgtgttttgctttggaaac

SEQ ID NO: 5924900 - DNA, 21 bp, Homo sapiens
gtattgttgtccttttcatag

SEQ ID NO: 5924901 - DNA, 18 bp, Homo sapiens
gtattgtttattatacca

SEQ ID NO: 5924902 - DNA, 23 bp, Homo sapiens
gtattgtttgggatcctattgaa

SEQ ID NO: 5924903 - DNA, 20 bp, Homo sapiens
gtatttaaaaaaaagaaact

SEQ ID NO: 5924904 - DNA, 15 bp, Homo sapiens
gtatttaaaaacatt

SEQ ID NO: 5924905 - DNA, 16 bp, Homo sapiens
gtatttaaaaacattt

SEQ ID NO: 5924906 - DNA, 20 bp, Homo sapiens
gtatttaaaaatagaaacat

SEQ ID NO: 5924907 - DNA, 18 bp, Homo sapiens
gtatttaaactatcttgt

SEQ ID NO: 5924908 - DNA, 17 bp, Homo sapiens
gtatttaacagaaattg

SEQ ID NO: 5924909 - DNA, 20 bp, Homo sapiens
gtatttaacagaaattgtat

SEQ ID NO: 5924910 - DNA, 20 bp, Homo sapiens
gtatttaactacatctgcct

SEQ ID NO: 5924911 - DNA, 13 bp, Homo sapiens
gtatttaagacat

SEQ ID NO: 5924912 - DNA, 17 bp, Homo sapiens
gtatttaagacataaac

SEQ ID NO: 5924913 - DNA, 13 bp, Homo sapiens
gtatttaagactg

SEQ ID NO: 5924914 - DNA, 19 bp, Homo sapiens
gtatttaagatgtacattt

SEQ ID NO: 5924915 - DNA, 14 bp, Homo sapiens
gtatttaagcttta

SEQ ID NO: 5924916 - DNA, 20 bp, Homo sapiens
gtatttaataggtttggaca

SEQ ID NO: 5924917 - DNA, 13 bp, Homo sapiens
gtatttaatcgca

SEQ ID NO: 5924918 - DNA, 22 bp, Homo sapiens
gtatttaatgatttttgtgtat

SEQ ID NO: 5924919 - DNA, 23 bp, Homo sapiens
gtatttaatgatttttgtgtatc

SEQ ID NO: 5924920 - DNA, 13 bp, Homo sapiens
gtatttaattaaa

SEQ ID NO: 5924921 - DNA, 21 bp, Homo sapiens
gtatttaattagtgctaagtg

SEQ ID NO: 5924922 - DNA, 16 bp, Homo sapiens
gtatttaattgtaaac

SEQ ID NO: 5924923 - DNA, 17 bp, Homo sapiens
gtatttaattgtaaact

SEQ ID NO: 5924924 - DNA, 21 bp, Homo sapiens
gtatttaattgtaaactgtac

SEQ ID NO: 5924925 - DNA, 14 bp, Homo sapiens
gtatttacacatac

SEQ ID NO: 5924926 - DNA, 17 bp, Homo sapiens
gtatttaccttcctttg

SEQ ID NO: 5924927 - DNA, 16 bp, Homo sapiens
gtatttacgctttgat

SEQ ID NO: 5924928 - DNA, 18 bp, Homo sapiens
gtatttactgcaatgtct

SEQ ID NO: 5924929 - DNA, 19 bp, Homo sapiens
gtatttagactgtggccat

SEQ ID NO: 5924930 - DNA, 13 bp, Homo sapiens
gtatttataaaaa

SEQ ID NO: 5924931 - DNA, 11 bp, Homo sapiens
gtatttataat

SEQ ID NO: 5924932 - DNA, 15 bp, Homo sapiens
gtatttataatttaa

SEQ ID NO: 5924933 - DNA, 18 bp, Homo sapiens
gtatttatagtaaccatt

SEQ ID NO: 5924934 - DNA, 12 bp, Homo sapiens
gtatttatatat

SEQ ID NO: 5924935 - DNA, 15 bp, Homo sapiens
gtatttatatattta

SEQ ID NO: 5924936 - DNA, 16 bp, Homo sapiens
gtatttatatatttat

SEQ ID NO: 5924937 - DNA, 20 bp, Homo sapiens
gtatttatatttaaattata

SEQ ID NO: 5924938 - DNA, 14 bp, Homo sapiens
gtatttatatttgg

SEQ ID NO: 5924939 - DNA, 15 bp, Homo sapiens
gtatttatatttgga

SEQ ID NO: 5924940 - DNA, 16 bp, Homo sapiens
gtatttatatttggaa

SEQ ID NO: 5924941 - DNA, 18 bp, Homo sapiens
gtatttatatttggaaag

SEQ ID NO: 5924942 - DNA, 18 bp, Homo sapiens
gtatttatctattgtaag

SEQ ID NO: 5924943 - DNA, 20 bp, Homo sapiens
gtatttatctattgtaagat

SEQ ID NO: 5924944 - DNA, 13 bp, Homo sapiens
gtatttatcttta

SEQ ID NO: 5924945 - DNA, 13 bp, Homo sapiens
gtatttatggatt

SEQ ID NO: 5924946 - DNA, 19 bp, Homo sapiens
gtatttatgtaatgaagta

SEQ ID NO: 5924947 - DNA, 17 bp, Homo sapiens
gtatttatgtaatttgt

SEQ ID NO: 5924948 - DNA, 11 bp, Homo sapiens
gtatttattca

SEQ ID NO: 5924949 - DNA, 13 bp, Homo sapiens
gtatttattcaat

SEQ ID NO: 5924950 - DNA, 16 bp, Homo sapiens
gtatttattcaataaa

SEQ ID NO: 5924951 - DNA, 22 bp, Homo sapiens
gtatttattcaataaagtattt

SEQ ID NO: 5924952 - DNA, 23 bp, Homo sapiens
gtatttattcaataaagtattta

SEQ ID NO: 5924953 - DNA, 13 bp, Homo sapiens
gtatttattccat

SEQ ID NO: 5924954 - DNA, 14 bp, Homo sapiens
gtatttattcccat

SEQ ID NO: 5924955 - DNA, 16 bp, Homo sapiens
gtatttattcctctgt

SEQ ID NO: 5924956 - DNA, 15 bp, Homo sapiens
gtatttattgtcagt

SEQ ID NO: 5924957 - DNA, 20 bp, Homo sapiens
gtatttatttaaaactctgg

SEQ ID NO: 5924958 - DNA, 14 bp, Homo sapiens
gtatttatttatgt

SEQ ID NO: 5924959 - DNA, 16 bp, Homo sapiens
gtatttatttatgtac

SEQ ID NO: 5924960 - DNA, 15 bp, Homo sapiens
gtatttatttccaga

SEQ ID NO: 5924961 - DNA, 18 bp, Homo sapiens
gtatttcaactgctgtaa

SEQ ID NO: 5924962 - DNA, 21 bp, Homo sapiens
gtatttcagggacctcagggg

SEQ ID NO: 5924963 - DNA, 14 bp, Homo sapiens
gtatttcagtattt

SEQ ID NO: 5924964 - DNA, 19 bp, Homo sapiens
gtatttcagtattttccag

SEQ ID NO: 5924965 - DNA, 21 bp, Homo sapiens
gtatttcagtgtagttaattt

SEQ ID NO: 5924966 - DNA, 11 bp, Homo sapiens
gtatttccctt

SEQ ID NO: 5924967 - DNA, 10 bp, Homo sapiens
gtatttctaa

SEQ ID NO: 5924968 - DNA, 18 bp, Homo sapiens
gtatttctatacagtagc

SEQ ID NO: 5924969 - DNA, 22 bp, Homo sapiens
gtatttctatgaaatattatgt

SEQ ID NO: 5924970 - DNA, 13 bp, Homo sapiens
gtatttctccaga

SEQ ID NO: 5924971 - DNA, 12 bp, Homo sapiens
gtatttctcctt

SEQ ID NO: 5924972 - DNA, 18 bp, Homo sapiens
gtatttctcctttgcaat

SEQ ID NO: 5924973 - DNA, 13 bp, Homo sapiens
gtatttctctgtg

SEQ ID NO: 5924974 - DNA, 16 bp, Homo sapiens
gtatttctctgtgaat

SEQ ID NO: 5924975 - DNA, 11 bp, Homo sapiens
gtatttctgta

SEQ ID NO: 5924976 - DNA, 14 bp, Homo sapiens
gtatttctgtagaa

SEQ ID NO: 5924977 - DNA, 21 bp, Homo sapiens
gtatttctgtagaatgctgta

SEQ ID NO: 5924978 - DNA, 21 bp, Homo sapiens
gtatttctgtggaaaacaatt

SEQ ID NO: 5924979 - DNA, 23 bp, Homo sapiens
gtatttcttaagaattcaaattt

SEQ ID NO: 5924980 - DNA, 16 bp, Homo sapiens
gtatttcttggcatgc

SEQ ID NO: 5924981 - DNA, 22 bp, Homo sapiens
gtatttcttggcatgcatcttt

SEQ ID NO: 5924982 - DNA, 14 bp, Homo sapiens
gtatttctttagaa

SEQ ID NO: 5924983 - DNA, 23 bp, Homo sapiens
gtatttctttagaacaacataaa

SEQ ID NO: 5924984 - DNA, 19 bp, Homo sapiens
gtatttctttgtagaataa

SEQ ID NO: 5924985 - DNA, 21 bp, Homo sapiens
gtatttctttgtagaataaat

SEQ ID NO: 5924986 - DNA, 12 bp, Homo sapiens
gtatttctttta

SEQ ID NO: 5924987 - DNA, 15 bp, Homo sapiens
gtatttgaaaacaga

SEQ ID NO: 5924988 - DNA, 21 bp, Homo sapiens
gtatttgaaaattacatgttt

SEQ ID NO: 5924989 - DNA, 18 bp, Homo sapiens
gtatttgaattaaaactt

SEQ ID NO: 5924990 - DNA, 22 bp, Homo sapiens
gtatttgaattaaaacttctta

SEQ ID NO: 5924991 - DNA, 23 bp, Homo sapiens
gtatttgaattaaaacttcttaa

SEQ ID NO: 5924992 - DNA, 11 bp, Homo sapiens
gtatttgagaa

SEQ ID NO: 5924993 - DNA, 15 bp, Homo sapiens
gtatttgagagactg

SEQ ID NO: 5924994 - DNA, 22 bp, Homo sapiens
gtatttgagagagagaaccttt

SEQ ID NO: 5924995 - DNA, 21 bp, Homo sapiens
gtatttgagagttctaaattt

SEQ ID NO: 5924996 - DNA, 23 bp, Homo sapiens
gtatttgaggaaactcatacagt

SEQ ID NO: 5924997 - DNA, 18 bp, Homo sapiens
gtatttgattcaaaatat

SEQ ID NO: 5924998 - DNA, 14 bp, Homo sapiens
gtatttgatttcct

SEQ ID NO: 5924999 - DNA, 11 bp, Homo sapiens
gtatttgctaa

SEQ ID NO: 5925000 - DNA, 15 bp, Homo sapiens
gtatttgctgtattg

SEQ ID NO: 5925001 - DNA, 12 bp, Homo sapiens
gtatttgctgtc

SEQ ID NO: 5925002 - DNA, 13 bp, Homo sapiens
gtatttgctgttg

SEQ ID NO: 5925003 - DNA, 14 bp, Homo sapiens
gtatttgctgtttg

SEQ ID NO: 5925004 - DNA, 20 bp, Homo sapiens
gtatttggaaataaagtcag

SEQ ID NO: 5925005 - DNA, 21 bp, Homo sapiens
gtatttggaaataaagtcaga

SEQ ID NO: 5925006 - DNA, 20 bp, Homo sapiens
gtatttggaagcaacgtgtt

SEQ ID NO: 5925007 - DNA, 20 bp, Homo sapiens
gtatttggctgggctacaat

SEQ ID NO: 5925008 - DNA, 15 bp, Homo sapiens
gtatttgggaaactt

SEQ ID NO: 5925009 - DNA, 22 bp, Homo sapiens
gtatttggtccaaaaaaaggaa

SEQ ID NO: 5925010 - DNA, 18 bp, Homo sapiens
gtatttgtacaaatactg

SEQ ID NO: 5925011 - DNA, 16 bp, Homo sapiens
gtatttgtattaataa

SEQ ID NO: 5925012 - DNA, 17 bp, Homo sapiens
gtatttgtattaataaa

SEQ ID NO: 5925013 - DNA, 17 bp, Homo sapiens
gtatttgtattctctgc

SEQ ID NO: 5925014 - DNA, 22 bp, Homo sapiens
gtatttgtattctctgcaattt

SEQ ID NO: 5925015 - DNA, 20 bp, Homo sapiens
gtatttgtgactaattgtat

SEQ ID NO: 5925016 - DNA, 14 bp, Homo sapiens
gtatttgttaaaga

SEQ ID NO: 5925017 - DNA, 15 bp, Homo sapiens
gtatttgttaatttc

SEQ ID NO: 5925018 - DNA, 16 bp, Homo sapiens
gtatttgttatatata

SEQ ID NO: 5925019 - DNA, 22 bp, Homo sapiens
gtatttgttatatataataaat

SEQ ID NO: 5925020 - DNA, 15 bp, Homo sapiens
gtatttgttcatgtt

SEQ ID NO: 5925021 - DNA, 17 bp, Homo sapiens
gtatttgttcatgtttg

SEQ ID NO: 5925022 - DNA, 18 bp, Homo sapiens
gtatttgttcatgtttgg

SEQ ID NO: 5925023 - DNA, 16 bp, Homo sapiens
gtatttgtttgtagct

SEQ ID NO: 5925024 - DNA, 17 bp, Homo sapiens
gtattttaaaagaatga

SEQ ID NO: 5925025 - DNA, 15 bp, Homo sapiens
gtattttaaaagcca

SEQ ID NO: 5925026 - DNA, 13 bp, Homo sapiens
gtattttaaaata

SEQ ID NO: 5925027 - DNA, 18 bp, Homo sapiens
gtattttaaaatagcgtt

SEQ ID NO: 5925028 - DNA, 16 bp, Homo sapiens
gtattttaaatgtttt

SEQ ID NO: 5925029 - DNA, 13 bp, Homo sapiens
gtattttaacact

SEQ ID NO: 5925030 - DNA, 15 bp, Homo sapiens
gtattttaacatagc

SEQ ID NO: 5925031 - DNA, 14 bp, Homo sapiens
gtcacatcacaata

SEQ ID NO: 5925032 - DNA, 15 bp, Homo sapiens
gtcacatcacaggac

SEQ ID NO: 5925033 - DNA, 16 bp, Homo sapiens
gtcacatcagtgagga

SEQ ID NO: 5925034 - DNA, 19 bp, Homo sapiens
gtcacatcagtgaggaggg

SEQ ID NO: 5925035 - DNA, 22 bp, Homo sapiens
gtcacatcagtgaggagggatg

SEQ ID NO: 5925036 - DNA, 21 bp, Homo sapiens
gtcacatcctaatagaaagaa

SEQ ID NO: 5925037 - DNA, 19 bp, Homo sapiens
gtcacatgactctcatttt

SEQ ID NO: 5925038 - DNA, 14 bp, Homo sapiens
gtcacatgccacaa

SEQ ID NO: 5925039 - DNA, 19 bp, Homo sapiens
gtcacatgcccccacttcc

SEQ ID NO: 5925040 - DNA, 18 bp, Homo sapiens
gtcacatgctttgtttcc

SEQ ID NO: 5925041 - DNA, 19 bp, Homo sapiens
gtcacatggggcctggccc

SEQ ID NO: 5925042 - DNA, 15 bp, Homo sapiens
gtcacattatttatt

SEQ ID NO: 5925043 - DNA, 22 bp, Homo sapiens
gtcacattatttattaaaaatg

SEQ ID NO: 5925044 - DNA, 14 bp, Homo sapiens
gtcacattcaggaa

SEQ ID NO: 5925045 - DNA, 18 bp, Homo sapiens
gtcacattcctgaacagg

SEQ ID NO: 5925046 - DNA, 22 bp, Homo sapiens
gtcacattgatgtaaggactgt

SEQ ID NO: 5925047 - DNA, 18 bp, Homo sapiens
gtcacattgcattctatt

SEQ ID NO: 5925048 - DNA, 19 bp, Homo sapiens
gtcaccaaaagacactgca

SEQ ID NO: 5925049 - DNA, 14 bp, Homo sapiens
gtcaccaaatttgt

SEQ ID NO: 5925050 - DNA, 14 bp, Homo sapiens
gtcaccaagaaggg

SEQ ID NO: 5925051 - DNA, 17 bp, Homo sapiens
gtcaccaagctcacagt

SEQ ID NO: 5925052 - DNA, 20 bp, Homo sapiens
gtcaccaaggcagtgcatgc

SEQ ID NO: 5925053 - DNA, 22 bp, Homo sapiens
gtcaccaaggcagtgcatgcat

SEQ ID NO: 5925054 - DNA, 23 bp, Homo sapiens
gtcaccaccacccgaaatgccac

SEQ ID NO: 5925055 - DNA, 14 bp, Homo sapiens
gtcaccacccagcc

SEQ ID NO: 5925056 - DNA, 15 bp, Homo sapiens
gtcaccacccagccc

SEQ ID NO: 5925057 - DNA, 16 bp, Homo sapiens
gtcaccaccttcccag

SEQ ID NO: 5925058 - DNA, 20 bp, Homo sapiens
gtcaccaccttcccagctct

SEQ ID NO: 5925059 - DNA, 22 bp, Homo sapiens
gtcaccaccttcccagctctcc

SEQ ID NO: 5925060 - DNA, 17 bp, Homo sapiens
gtcaccacgactggcca

SEQ ID NO: 5925061 - DNA, 21 bp, Homo sapiens
gtcaccactacagtaagctgg

SEQ ID NO: 5925062 - DNA, 14 bp, Homo sapiens
gtcaccagaattag

SEQ ID NO: 5925063 - DNA, 16 bp, Homo sapiens
gtcaccagacggggct

SEQ ID NO: 5925064 - DNA, 17 bp, Homo sapiens
gtcaccagacggggctg

SEQ ID NO: 5925065 - DNA, 13 bp, Homo sapiens
gtcaccagagact

SEQ ID NO: 5925066 - DNA, 13 bp, Homo sapiens
gtcaccagagctt

SEQ ID NO: 5925067 - DNA, 21 bp, Homo sapiens
gtcaccagagcttctctgggc

SEQ ID NO: 5925068 - DNA, 14 bp, Homo sapiens
gtcaccagcaacat

SEQ ID NO: 5925069 - DNA, 14 bp, Homo sapiens
gtcaccagctgctg

SEQ ID NO: 5925070 - DNA, 23 bp, Homo sapiens
gtcaccaggaatgttaaagtcag

SEQ ID NO: 5925071 - DNA, 13 bp, Homo sapiens
gtcaccaggactt

SEQ ID NO: 5925072 - DNA, 15 bp, Homo sapiens
gtcaccaggacttgg

SEQ ID NO: 5925073 - DNA, 17 bp, Homo sapiens
gtcaccaggcaaccagg

SEQ ID NO: 5925074 - DNA, 18 bp, Homo sapiens
gtcaccaggggaggagcc

SEQ ID NO: 5925075 - DNA, 15 bp, Homo sapiens
gtcaccatcatttct

SEQ ID NO: 5925076 - DNA, 12 bp, Homo sapiens
gtcaccatcctc

SEQ ID NO: 5925077 - DNA, 17 bp, Homo sapiens
gtcaccatcctcagagg

SEQ ID NO: 5925078 - DNA, 20 bp, Homo sapiens
gtcaccatcctcagaggctg

SEQ ID NO: 5925079 - DNA, 23 bp, Homo sapiens
gtcaccatcttaagagatgcctc

SEQ ID NO: 5925080 - DNA, 13 bp, Homo sapiens
gtcaccatgcaag

SEQ ID NO: 5925081 - DNA, 14 bp, Homo sapiens
gtcaccatgcaagg

SEQ ID NO: 5925082 - DNA, 21 bp, Homo sapiens
gtcaccattctgcatttagct

SEQ ID NO: 5925083 - DNA, 20 bp, Homo sapiens
gtcacccaaacacttctgct

SEQ ID NO: 5925084 - DNA, 22 bp, Homo sapiens
gtcacccaaagcctgtcccagg

SEQ ID NO: 5925085 - DNA, 15 bp, Homo sapiens
gtcacccaacatcaa

SEQ ID NO: 5925086 - DNA, 14 bp, Homo sapiens
gtcacccacagacc

SEQ ID NO: 5925087 - DNA, 12 bp, Homo sapiens
gtcacccagact

SEQ ID NO: 5925088 - DNA, 23 bp, Homo sapiens
gtcacccaggctctggagccaga

SEQ ID NO: 5925089 - DNA, 21 bp, Homo sapiens
gtcacccaggctgcagtgcaa

SEQ ID NO: 5925090 - DNA, 21 bp, Homo sapiens
gtcaccccaactctgtggggc

SEQ ID NO: 5925091 - DNA, 23 bp, Homo sapiens
gtcaccccaagtagtctgctcac

SEQ ID NO: 5925092 - DNA, 15 bp, Homo sapiens
gtcaccccagagcca

SEQ ID NO: 5925093 - DNA, 12 bp, Homo sapiens
gtcacccccact

SEQ ID NO: 5925094 - DNA, 16 bp, Homo sapiens
gtcacccccactcccg

SEQ ID NO: 5925095 - DNA, 14 bp, Homo sapiens
gtcacccccccagg

SEQ ID NO: 5925096 - DNA, 17 bp, Homo sapiens
gtcacccccccaggcct

SEQ ID NO: 5925097 - DNA, 18 bp, Homo sapiens
gtcaccccgctcttccca

SEQ ID NO: 5925098 - DNA, 22 bp, Homo sapiens
gtcaccccggccacctgcggtg

SEQ ID NO: 5925099 - DNA, 21 bp, Homo sapiens
gtcacccctccctccctcttt

SEQ ID NO: 5925100 - DNA, 17 bp, Homo sapiens
gtcacccctctgtccag

SEQ ID NO: 5925101 - DNA, 15 bp, Homo sapiens
gtcacccggccccca

SEQ ID NO: 5925102 - DNA, 20 bp, Homo sapiens
gtcaccctagccctctccct

SEQ ID NO: 5925103 - DNA, 22 bp, Homo sapiens
gtcaccctcaggaacccaccct

SEQ ID NO: 5925104 - DNA, 19 bp, Homo sapiens
gtcaccctccaccgagcca

SEQ ID NO: 5925105 - DNA, 16 bp, Homo sapiens
gtcaccctccacctct

SEQ ID NO: 5925106 - DNA, 16 bp, Homo sapiens
gtcaccctcctcacag

SEQ ID NO: 5925107 - DNA, 13 bp, Homo sapiens
gtcaccctcctga

SEQ ID NO: 5925108 - DNA, 17 bp, Homo sapiens
gtcaccctcctgagcct

SEQ ID NO: 5925109 - DNA, 13 bp, Homo sapiens
gtcaccctgcaga

SEQ ID NO: 5925110 - DNA, 21 bp, Homo sapiens
gtcaccctgctttggcggccc

SEQ ID NO: 5925111 - DNA, 13 bp, Homo sapiens
gtcaccctggccc

SEQ ID NO: 5925112 - DNA, 16 bp, Homo sapiens
gtcaccctggccccaa

SEQ ID NO: 5925113 - DNA, 17 bp, Homo sapiens
gtcaccctggggatagt

SEQ ID NO: 5925114 - DNA, 13 bp, Homo sapiens
gtcaccctgtgac

SEQ ID NO: 5925115 - DNA, 19 bp, Homo sapiens
gtcacccttggtagagttt

SEQ ID NO: 5925116 - DNA, 16 bp, Homo sapiens
gtcaccgacagcggcc

SEQ ID NO: 5925117 - DNA, 17 bp, Homo sapiens
gtcaccgacagcggcct

SEQ ID NO: 5925118 - DNA, 19 bp, Homo sapiens
gtcaccgagactcagcctc

SEQ ID NO: 5925119 - DNA, 15 bp, Homo sapiens
gtcaccgcaggtgct

SEQ ID NO: 5925120 - DNA, 15 bp, Homo sapiens
gtcaccgccatgcaa

SEQ ID NO: 5925121 - DNA, 16 bp, Homo sapiens
gtcaccgccatgcaac

SEQ ID NO: 5925122 - DNA, 17 bp, Homo sapiens
gtcaccggatcctgggt

SEQ ID NO: 5925123 - DNA, 23 bp, Homo sapiens
gtcaccggatcctgggtggtctg

SEQ ID NO: 5925124 - DNA, 22 bp, Homo sapiens
gtcaccgggatgaacctatcct

SEQ ID NO: 5925125 - DNA, 22 bp, Homo sapiens
gtcacctaagcaatcactgggc

SEQ ID NO: 5925126 - DNA, 17 bp, Homo sapiens
gtcacctacaggactgg

SEQ ID NO: 5925127 - DNA, 20 bp, Homo sapiens
gtcacctacaggactgggcc

SEQ ID NO: 5925128 - DNA, 15 bp, Homo sapiens
gtcacctcactcagc

SEQ ID NO: 5925129 - DNA, 21 bp, Homo sapiens
gtcacctcactcagcaccact

SEQ ID NO: 5925130 - DNA, 14 bp, Homo sapiens
gtcacctcatggaa

SEQ ID NO: 5925131 - DNA, 13 bp, Homo sapiens
gtcacctcctcca

SEQ ID NO: 5925132 - DNA, 22 bp, Homo sapiens
gtcacctcctccaagaagccct

SEQ ID NO: 5925133 - DNA, 13 bp, Homo sapiens
gtcacctccttcc

SEQ ID NO: 5925134 - DNA, 23 bp, Homo sapiens
gtcacctccttccccagctcccc

SEQ ID NO: 5925135 - DNA, 14 bp, Homo sapiens
gtcacctctcagct

SEQ ID NO: 5925136 - DNA, 13 bp, Homo sapiens
gtcacctctctca

SEQ ID NO: 5925137 - DNA, 16 bp, Homo sapiens
gtcacctctctcagag

SEQ ID NO: 5925138 - DNA, 19 bp, Homo sapiens
gtcacctctctcagagcat

SEQ ID NO: 5925139 - DNA, 20 bp, Homo sapiens
gtcacctctctcagagcatc

SEQ ID NO: 5925140 - DNA, 13 bp, Homo sapiens
gtcacctcttcta

SEQ ID NO: 5925141 - DNA, 18 bp, Homo sapiens
gtcacctgcaagccccag

SEQ ID NO: 5925142 - DNA, 19 bp, Homo sapiens
gtcacctgccccagcactc

SEQ ID NO: 5925143 - DNA, 18 bp, Homo sapiens
gtcacctgccgccctgtg

SEQ ID NO: 5925144 - DNA, 13 bp, Homo sapiens
gtcacctgctcac

SEQ ID NO: 5925145 - DNA, 20 bp, Homo sapiens
gtcacctgctcacagggatg

SEQ ID NO: 5925146 - DNA, 15 bp, Homo sapiens
gtcacctgctccaga

SEQ ID NO: 5925147 - DNA, 12 bp, Homo sapiens
gtcacctgctgg

SEQ ID NO: 5925148 - DNA, 19 bp, Homo sapiens
gtcacctgctggttgttgc

SEQ ID NO: 5925149 - DNA, 13 bp, Homo sapiens
gtcacctgcttct

SEQ ID NO: 5925150 - DNA, 17 bp, Homo sapiens
gtcacctggctgctagg

SEQ ID NO: 5925151 - DNA, 20 bp, Homo sapiens
gtcacctggctgctaggcca

SEQ ID NO: 5925152 - DNA, 13 bp, Homo sapiens
gtcacctgtgctt

SEQ ID NO: 5925153 - DNA, 19 bp, Homo sapiens
gtcaccttccaggacccct

SEQ ID NO: 5925154 - DNA, 21 bp, Homo sapiens
gtcaccttcctcagctcagct

SEQ ID NO: 5925155 - DNA, 14 bp, Homo sapiens
gtcaccttcctggg

SEQ ID NO: 5925156 - DNA, 17 bp, Homo sapiens
gtcaccttcctgggcag

SEQ ID NO: 5925157 - DNA, 21 bp, Homo sapiens
gtcaccttcctgggcagccca

SEQ ID NO: 5925158 - DNA, 14 bp, Homo sapiens
gtcaccttctgggc

SEQ ID NO: 5925159 - DNA, 16 bp, Homo sapiens
gtcaccttctgggcaa

SEQ ID NO: 5925160 - DNA, 16 bp, Homo sapiens
gtcaccttgcactcct

SEQ ID NO: 5925161 - DNA, 15 bp, Homo sapiens
gtcacctttctgggc

SEQ ID NO: 5925162 - DNA, 14 bp, Homo sapiens
gtcaccttttaaat

SEQ ID NO: 5925163 - DNA, 17 bp, Homo sapiens
gtcaccttttctgtggc

SEQ ID NO: 5925164 - DNA, 22 bp, Homo sapiens
gtcaccttttctgtggctggct

SEQ ID NO: 5925165 - DNA, 20 bp, Homo sapiens
gtcacctttttaatttccag

SEQ ID NO: 5925166 - DNA, 21 bp, Homo sapiens
gtcacgaattccatcttgtaa

SEQ ID NO: 5925167 - DNA, 16 bp, Homo sapiens
gtcacgagcacaatgg

SEQ ID NO: 5925168 - DNA, 16 bp, Homo sapiens
gtcacgcaggctgagt

SEQ ID NO: 5925169 - DNA, 14 bp, Homo sapiens
gtcacgcctgaaac

SEQ ID NO: 5925170 - DNA, 13 bp, Homo sapiens
gtcacgctcaagg

SEQ ID NO: 5925171 - DNA, 22 bp, Homo sapiens
gtcacgctcatgtcctgtcctg

SEQ ID NO: 5925172 - DNA, 23 bp, Homo sapiens
gtcacgctcatgtcctgtcctgg

SEQ ID NO: 5925173 - DNA, 16 bp, Homo sapiens
gtcacgctccctgact

SEQ ID NO: 5925174 - DNA, 17 bp, Homo sapiens
gtcacgcttgcctggtc

SEQ ID NO: 5925175 - DNA, 19 bp, Homo sapiens
gtcacgctttcatgaccac

SEQ ID NO: 5925176 - DNA, 15 bp, Homo sapiens
gtcacggccaggcag

SEQ ID NO: 5925177 - DNA, 14 bp, Homo sapiens
gtcacggctactct

SEQ ID NO: 5925178 - DNA, 15 bp, Homo sapiens
gtcacgtgaccctgt

SEQ ID NO: 5925179 - DNA, 19 bp, Homo sapiens
gtcacgtgaccctgtgccc

SEQ ID NO: 5925180 - DNA, 15 bp, Homo sapiens
gtcacgtgaggcccc

SEQ ID NO: 5925181 - DNA, 17 bp, Homo sapiens
gtcacgtgtattttcat

SEQ ID NO: 5925182 - DNA, 15 bp, Homo sapiens
gtcacgtgtggaatt

SEQ ID NO: 5925183 - DNA, 16 bp, Homo sapiens
gtcacgttctggaaca

SEQ ID NO: 5925184 - DNA, 22 bp, Homo sapiens
gtcactaaagcaggccttttga

SEQ ID NO: 5925185 - DNA, 18 bp, Homo sapiens
gtcactacaaaaatacaa

SEQ ID NO: 5925186 - DNA, 16 bp, Homo sapiens
gtcactacagggagaa

SEQ ID NO: 5925187 - DNA, 16 bp, Homo sapiens
gtcactacctggctgc

SEQ ID NO: 5925188 - DNA, 16 bp, Homo sapiens
gtcactacgcctggct

SEQ ID NO: 5925189 - DNA, 23 bp, Homo sapiens
gtcactacgtgactgtggcacac

SEQ ID NO: 5925190 - DNA, 17 bp, Homo sapiens
gtcactactcacagtct

SEQ ID NO: 5925191 - DNA, 13 bp, Homo sapiens
gtcactagcagct

SEQ ID NO: 5925192 - DNA, 15 bp, Homo sapiens
gtcactagcagctgc

SEQ ID NO: 5925193 - DNA, 18 bp, Homo sapiens
gtcactaggatgcagatg

SEQ ID NO: 5925194 - DNA, 14 bp, Homo sapiens
gtcactagtctttg

SEQ ID NO: 5925195 - DNA, 22 bp, Homo sapiens
gtcactatgctatttctggcct

SEQ ID NO: 5925196 - DNA, 24 bp, Homo sapiens
gtcactatgctatttctggcctca

SEQ ID NO: 5925197 - DNA, 18 bp, Homo sapiens
gtcactattcatcaatga

SEQ ID NO: 5925198 - DNA, 19 bp, Homo sapiens
gtcactattcatcaatgaa

SEQ ID NO: 5925199 - DNA, 20 bp, Homo sapiens
gtcactcaaatgaatttgct

SEQ ID NO: 5925200 - DNA, 13 bp, Homo sapiens
gtcactcaaggcg

SEQ ID NO: 5925201 - DNA, 19 bp, Homo sapiens
gtcactcacaaaaggctgg

SEQ ID NO: 5925202 - DNA, 15 bp, Homo sapiens
gtcactcacactggc

SEQ ID NO: 5925203 - DNA, 17 bp, Homo sapiens
gtcactcagccccttcc

SEQ ID NO: 5925204 - DNA, 18 bp, Homo sapiens
gtcactcagccccttccc

SEQ ID NO: 5925205 - DNA, 15 bp, Homo sapiens
gtcactcagctgaga

SEQ ID NO: 5925206 - DNA, 14 bp, Homo sapiens
gtcactcaggcctc

SEQ ID NO: 5925207 - DNA, 20 bp, Homo sapiens
gtcactcattaatgaatcac

SEQ ID NO: 5925208 - DNA, 21 bp, Homo sapiens
gtcactcattgctgagcctct

SEQ ID NO: 5925209 - DNA, 15 bp, Homo sapiens
gtcactccaccatcc

SEQ ID NO: 5925210 - DNA, 16 bp, Homo sapiens
gtcactccaccatccc

SEQ ID NO: 5925211 - DNA, 21 bp, Homo sapiens
gtcactccagtagctcctgga

SEQ ID NO: 5925212 - DNA, 17 bp, Homo sapiens
gtcactccagtgctcag

SEQ ID NO: 5925213 - DNA, 21 bp, Homo sapiens
gtcactccagtgctcagctgt

SEQ ID NO: 5925214 - DNA, 22 bp, Homo sapiens
gtcactccagtgctcagctgtg

SEQ ID NO: 5925215 - DNA, 18 bp, Homo sapiens
gtcactcccaagccccct

SEQ ID NO: 5925216 - DNA, 21 bp, Homo sapiens
gtcactcctggggcctcttgg

SEQ ID NO: 5925217 - DNA, 20 bp, Homo sapiens
gtcactctgaccttattact

SEQ ID NO: 5925218 - DNA, 12 bp, Homo sapiens
gtcactctgccc

SEQ ID NO: 5925219 - DNA, 14 bp, Homo sapiens
gtcactctgccctc

SEQ ID NO: 5925220 - DNA, 23 bp, Homo sapiens
gtcactctgcctctaaggccaag

SEQ ID NO: 5925221 - DNA, 16 bp, Homo sapiens
gtcactctggcagctc

SEQ ID NO: 5925222 - DNA, 19 bp, Homo sapiens
gtcactctggcagctcaga

SEQ ID NO: 5925223 - DNA, 23 bp, Homo sapiens
gtcactcttttgggatctaactg

SEQ ID NO: 5925224 - DNA, 14 bp, Homo sapiens
gtcactctttttta

SEQ ID NO: 5925225 - DNA, 14 bp, Homo sapiens
gtcactgaacaaaa

SEQ ID NO: 5925226 - DNA, 18 bp, Homo sapiens
gtcactgaaccactgctt

SEQ ID NO: 5925227 - DNA, 22 bp, Homo sapiens
gtcactgaaccactgcttctct

SEQ ID NO: 5925228 - DNA, 11 bp, Homo sapiens
gtcactgaaga

SEQ ID NO: 5925229 - DNA, 14 bp, Homo sapiens
gtcactgacacaaa

SEQ ID NO: 5925230 - DNA, 16 bp, Homo sapiens
gtcactgacacacacg

SEQ ID NO: 5925231 - DNA, 16 bp, Homo sapiens
gtcactgagacagccc

SEQ ID NO: 5925232 - DNA, 18 bp, Homo sapiens
gtcactgagacagcccgg

SEQ ID NO: 5925233 - DNA, 12 bp, Homo sapiens
gtcactgagact

SEQ ID NO: 5925234 - DNA, 18 bp, Homo sapiens
gtcactgaggcctgagac

SEQ ID NO: 5925235 - DNA, 23 bp, Homo sapiens
gtcactgaggcctgagacccagg

SEQ ID NO: 5925236 - DNA, 22 bp, Homo sapiens
gtcactgatgtacaattaaaaa

SEQ ID NO: 5925237 - DNA, 20 bp, Homo sapiens
gtcactgcacagtgcatctc

SEQ ID NO: 5925238 - DNA, 23 bp, Homo sapiens
gtcactgcacagtgcatctcagc

SEQ ID NO: 5925239 - DNA, 12 bp, Homo sapiens
gtcactgccaaa

SEQ ID NO: 5925240 - DNA, 16 bp, Homo sapiens
gtcactgccatggagg

SEQ ID NO: 5925241 - DNA, 13 bp, Homo sapiens
gtcactgcccacc

SEQ ID NO: 5925242 - DNA, 20 bp, Homo sapiens
gtcactgcctctccctggcc

SEQ ID NO: 5925243 - DNA, 22 bp, Homo sapiens
gtcactgcctctccctggccct

SEQ ID NO: 5925244 - DNA, 15 bp, Homo sapiens
gtcactgcctggagt

SEQ ID NO: 5925245 - DNA, 11 bp, Homo sapiens
gtcactgctgt

SEQ ID NO: 5925246 - DNA, 23 bp, Homo sapiens
gtcactgctgtaaagcaaaatat

SEQ ID NO: 5925247 - DNA, 12 bp, Homo sapiens
gtcactgctgtc

SEQ ID NO: 5925248 - DNA, 21 bp, Homo sapiens
gtcactgcttaacttcacata

SEQ ID NO: 5925249 - DNA, 17 bp, Homo sapiens
gtcactgcttttggcct

SEQ ID NO: 5925250 - DNA, 19 bp, Homo sapiens
gtcactgcttttggcctgg

SEQ ID NO: 5925251 - DNA, 20 bp, Homo sapiens
gtcactggaaaggggagagc

SEQ ID NO: 5925252 - DNA, 17 bp, Homo sapiens
gtcactggaacctccct

SEQ ID NO: 5925253 - DNA, 18 bp, Homo sapiens
gtcactggaacctccctg

SEQ ID NO: 5925254 - DNA, 19 bp, Homo sapiens
gtcactggaacctccctgg

SEQ ID NO: 5925255 - DNA, 22 bp, Homo sapiens
gtcactggaacctccctgggcc

SEQ ID NO: 5925256 - DNA, 23 bp, Homo sapiens
gtcactggaacctccctgggcct

SEQ ID NO: 5925257 - DNA, 23 bp, Homo sapiens
gtcactggaggttgaagccaagt

SEQ ID NO: 5925258 - DNA, 13 bp, Homo sapiens
gtcactggcagag

SEQ ID NO: 5925259 - DNA, 14 bp, Homo sapiens
gtcactggcagagc

SEQ ID NO: 5925260 - DNA, 15 bp, Homo sapiens
gtcactggcagagca

SEQ ID NO: 5925261 - DNA, 22 bp, Homo sapiens
gtcactggcagagcacagccca

SEQ ID NO: 5925262 - DNA, 16 bp, Homo sapiens
gtcactggcagcctgc

SEQ ID NO: 5925263 - DNA, 16 bp, Homo sapiens
gtcactggctctccaa

SEQ ID NO: 5925264 - DNA, 18 bp, Homo sapiens
gtcactggctctccaagt

SEQ ID NO: 5925265 - DNA, 23 bp, Homo sapiens
gtcactggctgcctccactccca

SEQ ID NO: 5925266 - DNA, 12 bp, Homo sapiens
gtcactggctgg

SEQ ID NO: 5925267 - DNA, 13 bp, Homo sapiens
gtcactgggttct

SEQ ID NO: 5925268 - DNA, 18 bp, Homo sapiens
gtcactggtcagggcagt

SEQ ID NO: 5925269 - DNA, 21 bp, Homo sapiens
gtcactggtcagggcagtggc

SEQ ID NO: 5925270 - DNA, 20 bp, Homo sapiens
gtcactgtactgacttgagg

SEQ ID NO: 5925271 - DNA, 21 bp, Homo sapiens
gtcactgtccaggtaggaaac

SEQ ID NO: 5925272 - DNA, 23 bp, Homo sapiens
gtcactgtccaggtaggaaacaa

SEQ ID NO: 5925273 - DNA, 21 bp, Homo sapiens
gtcactgtccctcctggtgtc

SEQ ID NO: 5925274 - DNA, 16 bp, Homo sapiens
gtcactgtgcactgcc

SEQ ID NO: 5925275 - DNA, 14 bp, Homo sapiens
gtcactgtggtcct

SEQ ID NO: 5925276 - DNA, 14 bp, Homo sapiens
gtcactgttataaa

SEQ ID NO: 5925277 - DNA, 18 bp, Homo sapiens
gtcactgttcgtcactca

SEQ ID NO: 5925278 - DNA, 22 bp, Homo sapiens
gtcactgtttttattccttcca

SEQ ID NO: 5925279 - DNA, 20 bp, Homo sapiens
gtcacttacctagatttaca

SEQ ID NO: 5925280 - DNA, 18 bp, Homo sapiens
gtcacttaggtagtacca

SEQ ID NO: 5925281 - DNA, 16 bp, Homo sapiens
gtcacttatttcataa

SEQ ID NO: 5925282 - DNA, 14 bp, Homo sapiens
gtcacttccagtgt

SEQ ID NO: 5925283 - DNA, 22 bp, Homo sapiens
gtcacttccagtgttggctgtg

SEQ ID NO: 5925284 - DNA, 13 bp, Homo sapiens
gtcacttccttca

SEQ ID NO: 5925285 - DNA, 17 bp, Homo sapiens
gtcacttcgtggctaag

SEQ ID NO: 5925286 - DNA, 19 bp, Homo sapiens
gtcacttctgggggtcact

SEQ ID NO: 5925287 - DNA, 17 bp, Homo sapiens
gtcacttcttctgtcca

SEQ ID NO: 5925288 - DNA, 14 bp, Homo sapiens
gtcacttgccacat

SEQ ID NO: 5925289 - DNA, 21 bp, Homo sapiens
gtcacttgccacatggtgtct

SEQ ID NO: 5925290 - DNA, 23 bp, Homo sapiens
gtcacttgctgctttttctgcgc

SEQ ID NO: 5925291 - DNA, 21 bp, Homo sapiens
gtcacttgggaagaggacttc

SEQ ID NO: 5925292 - DNA, 16 bp, Homo sapiens
gtcacttgggagctgc

SEQ ID NO: 5925293 - DNA, 23 bp, Homo sapiens
gtcacttggtggcggggtggggt

SEQ ID NO: 5925294 - DNA, 21 bp, Homo sapiens
gtcacttgtaggtttctctgc

SEQ ID NO: 5925295 - DNA, 23 bp, Homo sapiens
gtcacttgtaggtttctctgcct

SEQ ID NO: 5925296 - DNA, 19 bp, Homo sapiens
gtcacttgtcgggggccca

SEQ ID NO: 5925297 - DNA, 15 bp, Homo sapiens
gtcactttctctctt

SEQ ID NO: 5925298 - DNA, 16 bp, Homo sapiens
gtcactttctctctta

SEQ ID NO: 5925299 - DNA, 16 bp, Homo sapiens
gtcactttgctctggg

SEQ ID NO: 5925300 - DNA, 21 bp, Homo sapiens
gtcactttgcttaagatgcta

SEQ ID NO: 5925301 - DNA, 18 bp, Homo sapiens
gtcacttttccttttctt

SEQ ID NO: 5925302 - DNA, 14 bp, Homo sapiens
gtcactttttctga

SEQ ID NO: 5925303 - DNA, 18 bp, Homo sapiens
gtcactttttgaggcaaa

SEQ ID NO: 5925304 - DNA, 18 bp, Homo sapiens
gtcacttttttcctgtca

SEQ ID NO: 5925305 - DNA, 18 bp, Homo sapiens
gtcacttttttctgcctt

SEQ ID NO: 5925306 - DNA, 15 bp, Homo sapiens
gtcactttttttctt

SEQ ID NO: 5925307 - DNA, 21 bp, Homo sapiens
gtcagaaaccattgttcagaa

SEQ ID NO: 5925308 - DNA, 23 bp, Homo sapiens
gtcagaaaccattgttcagaaga

SEQ ID NO: 5925309 - DNA, 18 bp, Homo sapiens
gtcagaaaccctggtctc

SEQ ID NO: 5925310 - DNA, 15 bp, Homo sapiens
gtcagaaatgattca

SEQ ID NO: 5925311 - DNA, 19 bp, Homo sapiens
gtcagaaatgattcagggt

SEQ ID NO: 5925312 - DNA, 13 bp, Homo sapiens
gtcagaaattcta

SEQ ID NO: 5925313 - DNA, 12 bp, Homo sapiens
gtcagaacatgt

SEQ ID NO: 5925314 - DNA, 22 bp, Homo sapiens
gtcagaacattcgaatctctgc

SEQ ID NO: 5925315 - DNA, 23 bp, Homo sapiens
gtcagaacattcgaatctctgcc

SEQ ID NO: 5925316 - DNA, 17 bp, Homo sapiens
gtcagaaccggcctgga

SEQ ID NO: 5925317 - DNA, 18 bp, Homo sapiens
gtcagaaccggcctggag

SEQ ID NO: 5925318 - DNA, 21 bp, Homo sapiens
gtcagaagaagtgggagcagc

SEQ ID NO: 5925319 - DNA, 22 bp, Homo sapiens
gtcagaagaagtgggagcagct

SEQ ID NO: 5925320 - DNA, 22 bp, Homo sapiens
gtcagaagagagggtgagtcct

SEQ ID NO: 5925321 - DNA, 20 bp, Homo sapiens
gtcagaagcccattaaaata

SEQ ID NO: 5925322 - DNA, 19 bp, Homo sapiens
gtcagaagtctagttttat

SEQ ID NO: 5925323 - DNA, 23 bp, Homo sapiens
gtcagaagtttctgccgcagccc

SEQ ID NO: 5925324 - DNA, 12 bp, Homo sapiens
gtcagaataaaa

SEQ ID NO: 5925325 - DNA, 23 bp, Homo sapiens
gtcagaatggaatccatctgtct

SEQ ID NO: 5925326 - DNA, 23 bp, Homo sapiens
gtcagaatgggtgcagtttgagg

SEQ ID NO: 5925327 - DNA, 20 bp, Homo sapiens
gtcagacacaaacaaacaag

SEQ ID NO: 5925328 - DNA, 17 bp, Homo sapiens
gtcagacacgattgaga

SEQ ID NO: 5925329 - DNA, 20 bp, Homo sapiens
gtcagacactacatgatgac

SEQ ID NO: 5925330 - DNA, 18 bp, Homo sapiens
gtcagacagaacttgaat

SEQ ID NO: 5925331 - DNA, 20 bp, Homo sapiens
gtcagacagatgtcagcttc

SEQ ID NO: 5925332 - DNA, 13 bp, Homo sapiens
gtcagacataaag

SEQ ID NO: 5925333 - DNA, 14 bp, Homo sapiens
gtcagacataaagc

SEQ ID NO: 5925334 - DNA, 13 bp, Homo sapiens
gtcagacatttct

SEQ ID NO: 5925335 - DNA, 17 bp, Homo sapiens
gtcagacatttctttgg

SEQ ID NO: 5925336 - DNA, 14 bp, Homo sapiens
gtcagacccatctc

SEQ ID NO: 5925337 - DNA, 19 bp, Homo sapiens
gtcagaccttcttccacag

SEQ ID NO: 5925338 - DNA, 15 bp, Homo sapiens
gtcagacgccaggca

SEQ ID NO: 5925339 - DNA, 20 bp, Homo sapiens
gtcagacgttggtcccaagt

SEQ ID NO: 5925340 - DNA, 19 bp, Homo sapiens
gtcagacttccaaatcctg

SEQ ID NO: 5925341 - DNA, 20 bp, Homo sapiens
gtcagactttgctgcatttt

SEQ ID NO: 5925342 - DNA, 22 bp, Homo sapiens
gtcagactttgctgcattttac

SEQ ID NO: 5925343 - DNA, 15 bp, Homo sapiens
gtcagagaaaacact

SEQ ID NO: 5925344 - DNA, 16 bp, Homo sapiens
gtcagagaaaatgaga

SEQ ID NO: 5925345 - DNA, 20 bp, Homo sapiens
gtcagagaaaatgagaaagg

SEQ ID NO: 5925346 - DNA, 16 bp, Homo sapiens
gtcagagactgctgtg

SEQ ID NO: 5925347 - DNA, 12 bp, Homo sapiens
gtcagagagacc

SEQ ID NO: 5925348 - DNA, 17 bp, Homo sapiens
gtcagagaggagtcaga

SEQ ID NO: 5925349 - DNA, 21 bp, Homo sapiens
gtcagagaggagtcagagaga

SEQ ID NO: 5925350 - DNA, 22 bp, Homo sapiens
gtcagagagggaagctgaggcc

SEQ ID NO: 5925351 - DNA, 15 bp, Homo sapiens
gtcagagatgttttc

SEQ ID NO: 5925352 - DNA, 13 bp, Homo sapiens
gtcagagccacag

SEQ ID NO: 5925353 - DNA, 18 bp, Homo sapiens
gtcagagccaggctctgc

SEQ ID NO: 5925354 - DNA, 14 bp, Homo sapiens
gtcagagcccagcc

SEQ ID NO: 5925355 - DNA, 18 bp, Homo sapiens
gtcagagcccaggggaga

SEQ ID NO: 5925356 - DNA, 18 bp, Homo sapiens
gtcagagccctggctggg

SEQ ID NO: 5925357 - DNA, 13 bp, Homo sapiens
gtcagagctatgt

SEQ ID NO: 5925358 - DNA, 15 bp, Homo sapiens
gtcagagctgggagt

SEQ ID NO: 5925359 - DNA, 19 bp, Homo sapiens
gtcagagctgttggcctcg

SEQ ID NO: 5925360 - DNA, 15 bp, Homo sapiens
gtcagagctttcagg

SEQ ID NO: 5925361 - DNA, 22 bp, Homo sapiens
gtcagaggaacagtcctgttca

SEQ ID NO: 5925362 - DNA, 17 bp, Homo sapiens
gtcagaggaccccaggg

SEQ ID NO: 5925363 - DNA, 19 bp, Homo sapiens
gtcagaggaccccagggtg

SEQ ID NO: 5925364 - DNA, 15 bp, Homo sapiens
gtcagaggacctgta

SEQ ID NO: 5925365 - DNA, 21 bp, Homo sapiens
gtcagaggagagatagcctgt

SEQ ID NO: 5925366 - DNA, 22 bp, Homo sapiens
gtcagaggagagatagcctgtg

SEQ ID NO: 5925367 - DNA, 13 bp, Homo sapiens
gtcagaggagcgc

SEQ ID NO: 5925368 - DNA, 14 bp, Homo sapiens
gtcagaggatggcc

SEQ ID NO: 5925369 - DNA, 19 bp, Homo sapiens
gtcagaggatggccagtgt

SEQ ID NO: 5925370 - DNA, 20 bp, Homo sapiens
gtcagagggactgtcagctg

SEQ ID NO: 5925371 - DNA, 22 bp, Homo sapiens
gtcagagggactgtcagctgag

SEQ ID NO: 5925372 - DNA, 19 bp, Homo sapiens
gtcagagtaagctgctttt

SEQ ID NO: 5925373 - DNA, 16 bp, Homo sapiens
gtcagagtccagtgct

SEQ ID NO: 5925374 - DNA, 22 bp, Homo sapiens
gtcagagtccagtgctctgcct

SEQ ID NO: 5925375 - DNA, 15 bp, Homo sapiens
gtcagagtgccactg

SEQ ID NO: 5925376 - DNA, 19 bp, Homo sapiens
gtcagagtggcgtgagctg

SEQ ID NO: 5925377 - DNA, 22 bp, Homo sapiens
gtcagagtggcgtgagctgccc

SEQ ID NO: 5925378 - DNA, 16 bp, Homo sapiens
gtcagagttaaaatat

SEQ ID NO: 5925379 - DNA, 19 bp, Homo sapiens
gtcagagttaaaatatata

SEQ ID NO: 5925380 - DNA, 17 bp, Homo sapiens
gtcagatccaggagctc

SEQ ID NO: 5925381 - DNA, 20 bp, Homo sapiens
gtcagatccaggagctccag

SEQ ID NO: 5925382 - DNA, 17 bp, Homo sapiens
gtcagatcctgttactt

SEQ ID NO: 5925383 - DNA, 18 bp, Homo sapiens
gtcagatctgcctaagga

SEQ ID NO: 5925384 - DNA, 20 bp, Homo sapiens
gtcatccacacaacaccagg

SEQ ID NO: 5925385 - DNA, 21 bp, Homo sapiens
gtcatccacctgtcttggcct

SEQ ID NO: 5925386 - DNA, 22 bp, Homo sapiens
gtcatccacctgtcttggcctc

SEQ ID NO: 5925387 - DNA, 18 bp, Homo sapiens
gtcatccagactcagagc

SEQ ID NO: 5925388 - DNA, 14 bp, Homo sapiens
gtcatccatgccct

SEQ ID NO: 5925389 - DNA, 17 bp, Homo sapiens
gtcatccatgccctccc

SEQ ID NO: 5925390 - DNA, 21 bp, Homo sapiens
gtcatccatgccctcccagga

SEQ ID NO: 5925391 - DNA, 14 bp, Homo sapiens
gtcatcccctacac

SEQ ID NO: 5925392 - DNA, 20 bp, Homo sapiens
gtcatcccctctcaggagag

SEQ ID NO: 5925393 - DNA, 19 bp, Homo sapiens
gtcatcccggggccatgga

SEQ ID NO: 5925394 - DNA, 23 bp, Homo sapiens
gtcatcccttcctcctctcctgg

SEQ ID NO: 5925395 - DNA, 15 bp, Homo sapiens
gtcatcctcccttgc

SEQ ID NO: 5925396 - DNA, 20 bp, Homo sapiens
gtcatcctcccttgccccag

SEQ ID NO: 5925397 - DNA, 22 bp, Homo sapiens
gtcatcctcctggtgcccacag

SEQ ID NO: 5925398 - DNA, 18 bp, Homo sapiens
gtcatcctgccctgcagc

SEQ ID NO: 5925399 - DNA, 21 bp, Homo sapiens
gtcatcctgccctgcagcacg

SEQ ID NO: 5925400 - DNA, 18 bp, Homo sapiens
gtcatccttggtgctctt

SEQ ID NO: 5925401 - DNA, 19 bp, Homo sapiens
gtcatcggaggctgggccc

SEQ ID NO: 5925402 - DNA, 12 bp, Homo sapiens
gtcatctagttt

SEQ ID NO: 5925403 - DNA, 19 bp, Homo sapiens
gtcatctccatcagctgta

SEQ ID NO: 5925404 - DNA, 22 bp, Homo sapiens
gtcatctccggggtggccacag

SEQ ID NO: 5925405 - DNA, 22 bp, Homo sapiens
gtcatctctctggggccctggg

SEQ ID NO: 5925406 - DNA, 13 bp, Homo sapiens
gtcatctctgttc

SEQ ID NO: 5925407 - DNA, 15 bp, Homo sapiens
gtcatctgagaatga

SEQ ID NO: 5925408 - DNA, 19 bp, Homo sapiens
gtcatctgagaatgaacaa

SEQ ID NO: 5925409 - DNA, 14 bp, Homo sapiens
gtcatctgatgaga

SEQ ID NO: 5925410 - DNA, 21 bp, Homo sapiens
gtcatctgcggggcttctggg

SEQ ID NO: 5925411 - DNA, 12 bp, Homo sapiens
gtcatctgctcc

SEQ ID NO: 5925412 - DNA, 20 bp, Homo sapiens
gtcatctggcggaggtctct

SEQ ID NO: 5925413 - DNA, 13 bp, Homo sapiens
gtcatctgggcca

SEQ ID NO: 5925414 - DNA, 16 bp, Homo sapiens
gtcatctggtagattt

SEQ ID NO: 5925415 - DNA, 17 bp, Homo sapiens
gtcatctgtaagagctt

SEQ ID NO: 5925416 - DNA, 19 bp, Homo sapiens
gtcatctgtaagagcttgc

SEQ ID NO: 5925417 - DNA, 20 bp, Homo sapiens
gtcatctgtcagcttcccaa

SEQ ID NO: 5925418 - DNA, 16 bp, Homo sapiens
gtcatcttccctgccc

SEQ ID NO: 5925419 - DNA, 18 bp, Homo sapiens
gtcatcttgaccaagcag

SEQ ID NO: 5925420 - DNA, 13 bp, Homo sapiens
gtcatcttgagct

SEQ ID NO: 5925421 - DNA, 15 bp, Homo sapiens
gtcatcttgctacca

SEQ ID NO: 5925422 - DNA, 18 bp, Homo sapiens
gtcatcttgctaccagta

SEQ ID NO: 5925423 - DNA, 22 bp, Homo sapiens
gtcatcttgctaccagtattta

SEQ ID NO: 5925424 - DNA, 14 bp, Homo sapiens
gtcatctttgattt

SEQ ID NO: 5925425 - DNA, 16 bp, Homo sapiens
gtcatctttttcccct

SEQ ID NO: 5925426 - DNA, 20 bp, Homo sapiens
gtcatctttttctagagtta

SEQ ID NO: 5925427 - DNA, 22 bp, Homo sapiens
gtcatctttttctctaaaatag

SEQ ID NO: 5925428 - DNA, 23 bp, Homo sapiens
gtcatgaaaacagcccctttacc

SEQ ID NO: 5925429 - DNA, 20 bp, Homo sapiens
gtcatgaaactgtacatact

SEQ ID NO: 5925430 - DNA, 14 bp, Homo sapiens
gtcatgaagaatgt

SEQ ID NO: 5925431 - DNA, 19 bp, Homo sapiens
gtcatgaagaatgtttctg

SEQ ID NO: 5925432 - DNA, 22 bp, Homo sapiens
gtcatgaaggacactctgcagg

SEQ ID NO: 5925433 - DNA, 15 bp, Homo sapiens
gtcatgaatgccttc

SEQ ID NO: 5925434 - DNA, 20 bp, Homo sapiens
gtcatgaattcatactctgt

SEQ ID NO: 5925435 - DNA, 10 bp, Homo sapiens
gtcatgacag

SEQ ID NO: 5925436 - DNA, 15 bp, Homo sapiens
gtcatgacagatgaa

SEQ ID NO: 5925437 - DNA, 17 bp, Homo sapiens
gtcatgacagtgcttgc

SEQ ID NO: 5925438 - DNA, 17 bp, Homo sapiens
gtcatgactttcagatt

SEQ ID NO: 5925439 - DNA, 16 bp, Homo sapiens
gtcatgagaattacag

SEQ ID NO: 5925440 - DNA, 16 bp, Homo sapiens
gtcatgagctgagcag

SEQ ID NO: 5925441 - DNA, 19 bp, Homo sapiens
gtcatgaggaaagacacag

SEQ ID NO: 5925442 - DNA, 22 bp, Homo sapiens
gtcatgaggagattctgccttt

SEQ ID NO: 5925443 - DNA, 18 bp, Homo sapiens
gtcatgatctccctgccg

SEQ ID NO: 5925444 - DNA, 15 bp, Homo sapiens
gtcatgatgtctgca

SEQ ID NO: 5925445 - DNA, 13 bp, Homo sapiens
gtcatgatgtttt

SEQ ID NO: 5925446 - DNA, 20 bp, Homo sapiens
gtcatgatgtttttaaaatc

SEQ ID NO: 5925447 - DNA, 22 bp, Homo sapiens
gtcatgatgtttttaaaatctt

SEQ ID NO: 5925448 - DNA, 14 bp, Homo sapiens
gtcatgatttctgt

SEQ ID NO: 5925449 - DNA, 14 bp, Homo sapiens
gtcatgcaaagatt

SEQ ID NO: 5925450 - DNA, 14 bp, Homo sapiens
gtcatgcataaata

SEQ ID NO: 5925451 - DNA, 19 bp, Homo sapiens
gtcatgcataaatatgcag

SEQ ID NO: 5925452 - DNA, 13 bp, Homo sapiens
gtcatgcattggt

SEQ ID NO: 5925453 - DNA, 15 bp, Homo sapiens
gtcatgcccccctca

SEQ ID NO: 5925454 - DNA, 20 bp, Homo sapiens
gtcatgcctcactttcttct

SEQ ID NO: 5925455 - DNA, 16 bp, Homo sapiens
gtcatgcggtttccaa

SEQ ID NO: 5925456 - DNA, 15 bp, Homo sapiens
gtcatgcgtccactt

SEQ ID NO: 5925457 - DNA, 16 bp, Homo sapiens
gtcatgcgtctctggc

SEQ ID NO: 5925458 - DNA, 15 bp, Homo sapiens
gtcatgctcccctgt

SEQ ID NO: 5925459 - DNA, 18 bp, Homo sapiens
gtcatgctgctagatctt

SEQ ID NO: 5925460 - DNA, 20 bp, Homo sapiens
gtcatgctgctgttgctgga

SEQ ID NO: 5925461 - DNA, 14 bp, Homo sapiens
gtcatgctggtggg

SEQ ID NO: 5925462 - DNA, 15 bp, Homo sapiens
gtcatggaatcttgc

SEQ ID NO: 5925463 - DNA, 18 bp, Homo sapiens
gtcatggaatcttgctgc

SEQ ID NO: 5925464 - DNA, 16 bp, Homo sapiens
gtcatggagaaccacc

SEQ ID NO: 5925465 - DNA, 21 bp, Homo sapiens
gtcatggagaatctgctgcat

SEQ ID NO: 5925466 - DNA, 14 bp, Homo sapiens
gtcatggagcagcc

SEQ ID NO: 5925467 - DNA, 15 bp, Homo sapiens
gtcatggccacactg

SEQ ID NO: 5925468 - DNA, 16 bp, Homo sapiens
gtcatggccacactgt

SEQ ID NO: 5925469 - DNA, 14 bp, Homo sapiens
gtcatggcctgaga

SEQ ID NO: 5925470 - DNA, 19 bp, Homo sapiens
gtcatggctctgaactgca

SEQ ID NO: 5925471 - DNA, 19 bp, Homo sapiens
gtcatgggaacgcagcctc

SEQ ID NO: 5925472 - DNA, 16 bp, Homo sapiens
gtcatgggagaagagg

SEQ ID NO: 5925473 - DNA, 21 bp, Homo sapiens
gtcatggtagatttttttcat

SEQ ID NO: 5925474 - DNA, 15 bp, Homo sapiens
gtcatggtcctggct

SEQ ID NO: 5925475 - DNA, 16 bp, Homo sapiens
gtcatggtctgagtgg

SEQ ID NO: 5925476 - DNA, 19 bp, Homo sapiens
gtcatggtctgagtggggc

SEQ ID NO: 5925477 - DNA, 17 bp, Homo sapiens
gtcatggtgatgcaagt

SEQ ID NO: 5925478 - DNA, 20 bp, Homo sapiens
gtcatggtggccacggccac

SEQ ID NO: 5925479 - DNA, 19 bp, Homo sapiens
gtcatgtaaatactgttgg

SEQ ID NO: 5925480 - DNA, 17 bp, Homo sapiens
gtcatgtacttcctgtg

SEQ ID NO: 5925481 - DNA, 18 bp, Homo sapiens
gtcatgtacttcctgtgt

SEQ ID NO: 5925482 - DNA, 13 bp, Homo sapiens
gtcatgtatttta

SEQ ID NO: 5925483 - DNA, 16 bp, Homo sapiens
gtcatgtattttatga

SEQ ID NO: 5925484 - DNA, 12 bp, Homo sapiens
gtcatgtctgct

SEQ ID NO: 5925485 - DNA, 14 bp, Homo sapiens
gtcatgtctgcttg

SEQ ID NO: 5925486 - DNA, 12 bp, Homo sapiens
gtcatgtgagtc

SEQ ID NO: 5925487 - DNA, 16 bp, Homo sapiens
gtcatgtgagtctggg

SEQ ID NO: 5925488 - DNA, 19 bp, Homo sapiens
gtcatgtgagtctgggata

SEQ ID NO: 5925489 - DNA, 18 bp, Homo sapiens
gtcatgtgcatctggtgt

SEQ ID NO: 5925490 - DNA, 12 bp, Homo sapiens
gtcatgtggcta

SEQ ID NO: 5925491 - DNA, 17 bp, Homo sapiens
gtcatgtgggtcttcca

SEQ ID NO: 5925492 - DNA, 16 bp, Homo sapiens
gtcatgttatgcagtg

SEQ ID NO: 5925493 - DNA, 17 bp, Homo sapiens
gtcatgttatgcagtga

SEQ ID NO: 5925494 - DNA, 19 bp, Homo sapiens
gtcatgttggccaggctgg

SEQ ID NO: 5925495 - DNA, 23 bp, Homo sapiens
gtcatgttggtcaaaagctggat

SEQ ID NO: 5925496 - DNA, 17 bp, Homo sapiens
gtcatgttttaaatgta

SEQ ID NO: 5925497 - DNA, 22 bp, Homo sapiens
gtcattaaaataaataaatgca

SEQ ID NO: 5925498 - DNA, 12 bp, Homo sapiens
gtcattaaactg

SEQ ID NO: 5925499 - DNA, 14 bp, Homo sapiens
gtcattaaagtgca

SEQ ID NO: 5925500 - DNA, 21 bp, Homo sapiens
gtcattaaagtgcactgtgtc

SEQ ID NO: 5925501 - DNA, 21 bp, Homo sapiens
gtcattaaccatctttaatca

SEQ ID NO: 5925502 - DNA, 14 bp, Homo sapiens
gtcattaatgtgtt

SEQ ID NO: 5925503 - DNA, 16 bp, Homo sapiens
gtcattactgcctttg

SEQ ID NO: 5925504 - DNA, 20 bp, Homo sapiens
gtcattacttctgagcccca

SEQ ID NO: 5925505 - DNA, 21 bp, Homo sapiens
gtcattagcctgagtagaaag

SEQ ID NO: 5925506 - DNA, 16 bp, Homo sapiens
gtcattatattctaat

SEQ ID NO: 5925507 - DNA, 23 bp, Homo sapiens
gtcattatattctaattaaaatt

SEQ ID NO: 5925508 - DNA, 17 bp, Homo sapiens
gtcattatcaaaagtga

SEQ ID NO: 5925509 - DNA, 19 bp, Homo sapiens
gtcattatccttgctatga

SEQ ID NO: 5925510 - DNA, 19 bp, Homo sapiens
gtcattatgttaatatttc

SEQ ID NO: 5925511 - DNA, 14 bp, Homo sapiens
gtcattatttaaag

SEQ ID NO: 5925512 - DNA, 16 bp, Homo sapiens
gtcattatttaaagca

SEQ ID NO: 5925513 - DNA, 15 bp, Homo sapiens
gtcattatttattgt

SEQ ID NO: 5925514 - DNA, 21 bp, Homo sapiens
gtcattatttgataacatttt

SEQ ID NO: 5925515 - DNA, 17 bp, Homo sapiens
gtcattatttttgttag

SEQ ID NO: 5925516 - DNA, 14 bp, Homo sapiens
gtcattcactcggg

SEQ ID NO: 5925517 - DNA, 20 bp, Homo sapiens
gtcattcagagtcagccagg

SEQ ID NO: 5925518 - DNA, 15 bp, Homo sapiens
gtcattcagttctag

SEQ ID NO: 5925519 - DNA, 20 bp, Homo sapiens
gtcattcagttctaggcctt

SEQ ID NO: 5925520 - DNA, 11 bp, Homo sapiens
gtcattcatat

SEQ ID NO: 5925521 - DNA, 18 bp, Homo sapiens
gtcattcccctttgcact

SEQ ID NO: 5925522 - DNA, 15 bp, Homo sapiens
gtcattcctgtcaac

SEQ ID NO: 5925523 - DNA, 21 bp, Homo sapiens
gtcattcgctactatgattta

SEQ ID NO: 5925524 - DNA, 12 bp, Homo sapiens
gtcattctcatc

SEQ ID NO: 5925525 - DNA, 18 bp, Homo sapiens
gtcattctgcctgccctg

SEQ ID NO: 5925526 - DNA, 15 bp, Homo sapiens
gtcattctgcctgct

SEQ ID NO: 5925527 - DNA, 14 bp, Homo sapiens
gtcattctgctaat

SEQ ID NO: 5925528 - DNA, 18 bp, Homo sapiens
gtcattctgctaatttat

SEQ ID NO: 5925529 - DNA, 21 bp, Homo sapiens
gtcattcttacaattgcactg

SEQ ID NO: 5925530 - DNA, 14 bp, Homo sapiens
gtcattcttcccta

SEQ ID NO: 5925531 - DNA, 22 bp, Homo sapiens
gtcattcttttgccacatccct

SEQ ID NO: 5925532 - DNA, 21 bp, Homo sapiens
gtcattgacctctcagggcct

SEQ ID NO: 5925533 - DNA, 14 bp, Homo sapiens
gtcattgacttcat

SEQ ID NO: 5925534 - DNA, 15 bp, Homo sapiens
gtcattgacttcatt

SEQ ID NO: 5925535 - DNA, 12 bp, Homo sapiens
gtcattgcccct

SEQ ID NO: 5925536 - DNA, 18 bp, Homo sapiens
gtcattgccttcgctcca

SEQ ID NO: 5925537 - DNA, 16 bp, Homo sapiens
gtcattgctgacagag

SEQ ID NO: 5925538 - DNA, 18 bp, Homo sapiens
gtcattgctgacagagcc

SEQ ID NO: 5925539 - DNA, 21 bp, Homo sapiens
gtcattgctgacagagcccta

SEQ ID NO: 5925540 - DNA, 11 bp, Homo sapiens
gtcattgctgt

SEQ ID NO: 5925541 - DNA, 18 bp, Homo sapiens
gtcattgctgttgtccct

SEQ ID NO: 5925542 - DNA, 15 bp, Homo sapiens
gtcattgcttcttct

SEQ ID NO: 5925543 - DNA, 16 bp, Homo sapiens
gtcattgcttcttctg

SEQ ID NO: 5925544 - DNA, 21 bp, Homo sapiens
gtcattggcaaagtgacaaag

SEQ ID NO: 5925545 - DNA, 21 bp, Homo sapiens
gtcattggttacaaattttta

SEQ ID NO: 5925546 - DNA, 12 bp, Homo sapiens
gtcattgtaatg

SEQ ID NO: 5925547 - DNA, 21 bp, Homo sapiens
gtcattgtaatgttgtgaata

SEQ ID NO: 5925548 - DNA, 12 bp, Homo sapiens
gtcattgtccag

SEQ ID NO: 5925549 - DNA, 21 bp, Homo sapiens
gtcattgttatataatcatta

SEQ ID NO: 5925550 - DNA, 14 bp, Homo sapiens
gtcattgttctcct

SEQ ID NO: 5925551 - DNA, 17 bp, Homo sapiens
gtcatttaccctggtgg

SEQ ID NO: 5925552 - DNA, 17 bp, Homo sapiens
gtcatttactaaacata

SEQ ID NO: 5925553 - DNA, 15 bp, Homo sapiens
gtcatttatattttc

SEQ ID NO: 5925554 - DNA, 16 bp, Homo sapiens
gtcatttattttaaaa

SEQ ID NO: 5925555 - DNA, 16 bp, Homo sapiens
gtcatttcagagccct

SEQ ID NO: 5925556 - DNA, 17 bp, Homo sapiens
gtcatttcatacaaatt

SEQ ID NO: 5925557 - DNA, 13 bp, Homo sapiens
gtcatttcatgtc

SEQ ID NO: 5925558 - DNA, 12 bp, Homo sapiens
gtcatttcattc

SEQ ID NO: 5925559 - DNA, 15 bp, Homo sapiens
gtcatttcattccat

SEQ ID NO: 5925560 - DNA, 11 bp, Homo sapiens
gtcatttccat

SEQ ID NO: 5925561 - DNA, 12 bp, Homo sapiens
gtcatttccatg

SEQ ID NO: 5925562 - DNA, 18 bp, Homo sapiens
gtcatttccatgtatgca

SEQ ID NO: 5925563 - DNA, 18 bp, Homo sapiens
gtccatctctgaaaacaa

SEQ ID NO: 5925564 - DNA, 13 bp, Homo sapiens
gtccatctgcccg

SEQ ID NO: 5925565 - DNA, 19 bp, Homo sapiens
gtccatctgcccgcctgcc

SEQ ID NO: 5925566 - DNA, 21 bp, Homo sapiens
gtccatctgcccgcctgccca

SEQ ID NO: 5925567 - DNA, 18 bp, Homo sapiens
gtccatcttgtttcattt

SEQ ID NO: 5925568 - DNA, 20 bp, Homo sapiens
gtccatgaaaaacagcagag

SEQ ID NO: 5925569 - DNA, 12 bp, Homo sapiens
gtccatgaaaat

SEQ ID NO: 5925570 - DNA, 22 bp, Homo sapiens
gtccatgaagatgtagaggaga

SEQ ID NO: 5925571 - DNA, 10 bp, Homo sapiens
gtccatgccc

SEQ ID NO: 5925572 - DNA, 22 bp, Homo sapiens
gtccatgcccactgctggtgcc

SEQ ID NO: 5925573 - DNA, 19 bp, Homo sapiens
gtccatgcctacagataat

SEQ ID NO: 5925574 - DNA, 15 bp, Homo sapiens
gtccatgctccaggg

SEQ ID NO: 5925575 - DNA, 15 bp, Homo sapiens
gtccatgctgatgat

SEQ ID NO: 5925576 - DNA, 14 bp, Homo sapiens
gtccatggaatgct

SEQ ID NO: 5925577 - DNA, 21 bp, Homo sapiens
gtccatggaatgcttgaaaaa

SEQ ID NO: 5925578 - DNA, 17 bp, Homo sapiens
gtccatggcaccagccc

SEQ ID NO: 5925579 - DNA, 18 bp, Homo sapiens
gtccatggcaccagcccc

SEQ ID NO: 5925580 - DNA, 16 bp, Homo sapiens
gtccatggcctttcta

SEQ ID NO: 5925581 - DNA, 18 bp, Homo sapiens
gtccatgggcagagccca

SEQ ID NO: 5925582 - DNA, 13 bp, Homo sapiens
gtccatggtgcta

SEQ ID NO: 5925583 - DNA, 17 bp, Homo sapiens
gtccatggtgctaagcg

SEQ ID NO: 5925584 - DNA, 18 bp, Homo sapiens
gtccatgtattcacacac

SEQ ID NO: 5925585 - DNA, 15 bp, Homo sapiens
gtccatgtcctatgc

SEQ ID NO: 5925586 - DNA, 16 bp, Homo sapiens
gtccatgtcctatgcc

SEQ ID NO: 5925587 - DNA, 19 bp, Homo sapiens
gtccatgtcctatgcctca

SEQ ID NO: 5925588 - DNA, 13 bp, Homo sapiens
gtccattctccca

SEQ ID NO: 5925589 - DNA, 15 bp, Homo sapiens
gtccattctcccagg

SEQ ID NO: 5925590 - DNA, 18 bp, Homo sapiens
gtccattgacatgtacag

SEQ ID NO: 5925591 - DNA, 18 bp, Homo sapiens
gtccattgcaaaaggtta

SEQ ID NO: 5925592 - DNA, 19 bp, Homo sapiens
gtccatttatatatgaaaa

SEQ ID NO: 5925593 - DNA, 15 bp, Homo sapiens
gtccatttcatgtga

SEQ ID NO: 5925594 - DNA, 20 bp, Homo sapiens
gtccatttcatgtgatctat

SEQ ID NO: 5925595 - DNA, 22 bp, Homo sapiens
gtccatttggcaggggtggctg

SEQ ID NO: 5925596 - DNA, 21 bp, Homo sapiens
gtccatttgggtacgtctggg

SEQ ID NO: 5925597 - DNA, 14 bp, Homo sapiens
gtccattttgtgaa

SEQ ID NO: 5925598 - DNA, 15 bp, Homo sapiens
gtccattttgtgaag

SEQ ID NO: 5925599 - DNA, 22 bp, Homo sapiens
gtccattttgtgaagccctgtt

SEQ ID NO: 5925600 - DNA, 23 bp, Homo sapiens
gtccatttttacaagttatagta

SEQ ID NO: 5925601 - DNA, 18 bp, Homo sapiens
gtccatttttcttccagg

SEQ ID NO: 5925602 - DNA, 14 bp, Homo sapiens
gtcccaaaaccctt

SEQ ID NO: 5925603 - DNA, 18 bp, Homo sapiens
gtcccaaaacccttacag

SEQ ID NO: 5925604 - DNA, 16 bp, Homo sapiens
gtcccaaaatcccctc

SEQ ID NO: 5925605 - DNA, 19 bp, Homo sapiens
gtcccaaaatcccctcagc

SEQ ID NO: 5925606 - DNA, 23 bp, Homo sapiens
gtcccaaaatcccctcagcctct

SEQ ID NO: 5925607 - DNA, 16 bp, Homo sapiens
gtcccaaacagagggc

SEQ ID NO: 5925608 - DNA, 22 bp, Homo sapiens
gtcccaaatatgtattttccta

SEQ ID NO: 5925609 - DNA, 19 bp, Homo sapiens
gtcccaaatccgccagtgt

SEQ ID NO: 5925610 - DNA, 19 bp, Homo sapiens
gtcccaaatccttcccaag

SEQ ID NO: 5925611 - DNA, 15 bp, Homo sapiens
gtcccaagcctgata

SEQ ID NO: 5925612 - DNA, 13 bp, Homo sapiens
gtcccaaggagct

SEQ ID NO: 5925613 - DNA, 16 bp, Homo sapiens
gtcccaaggagctgat

SEQ ID NO: 5925614 - DNA, 22 bp, Homo sapiens
gtcccaaggagggggcctcatt

SEQ ID NO: 5925615 - DNA, 23 bp, Homo sapiens
gtcccaaggagggggcctcattg

SEQ ID NO: 5925616 - DNA, 23 bp, Homo sapiens
gtcccaaggtgaaatgaagcaac

SEQ ID NO: 5925617 - DNA, 18 bp, Homo sapiens
gtcccaaggttctgggtg

SEQ ID NO: 5925618 - DNA, 15 bp, Homo sapiens
gtcccaagtctgaca

SEQ ID NO: 5925619 - DNA, 17 bp, Homo sapiens
gtcccaagtctgacagc

SEQ ID NO: 5925620 - DNA, 14 bp, Homo sapiens
gtcccaagtgccaa

SEQ ID NO: 5925621 - DNA, 18 bp, Homo sapiens
gtcccaatagctctactg

SEQ ID NO: 5925622 - DNA, 22 bp, Homo sapiens
gtcccaatcttaccagatgcta

SEQ ID NO: 5925623 - DNA, 14 bp, Homo sapiens
gtcccaattaaaat

SEQ ID NO: 5925624 - DNA, 15 bp, Homo sapiens
gtcccaattaaaata

SEQ ID NO: 5925625 - DNA, 23 bp, Homo sapiens
gtcccaattcggggcctgctgga

SEQ ID NO: 5925626 - DNA, 20 bp, Homo sapiens
gtcccaatttaagagtcctg

SEQ ID NO: 5925627 - DNA, 17 bp, Homo sapiens
gtcccacactggtgact

SEQ ID NO: 5925628 - DNA, 12 bp, Homo sapiens
gtcccacactgt

SEQ ID NO: 5925629 - DNA, 22 bp, Homo sapiens
gtcccacactgtgcagacccag

SEQ ID NO: 5925630 - DNA, 14 bp, Homo sapiens
gtcccacagccacg

SEQ ID NO: 5925631 - DNA, 12 bp, Homo sapiens
gtcccacagccc

SEQ ID NO: 5925632 - DNA, 14 bp, Homo sapiens
gtcccacagcccct

SEQ ID NO: 5925633 - DNA, 12 bp, Homo sapiens
gtcccacaggga

SEQ ID NO: 5925634 - DNA, 14 bp, Homo sapiens
gtcccacagggacc

SEQ ID NO: 5925635 - DNA, 19 bp, Homo sapiens
gtcccacatccctgggcct

SEQ ID NO: 5925636 - DNA, 19 bp, Homo sapiens
gtcccaccaactctgcact

SEQ ID NO: 5925637 - DNA, 22 bp, Homo sapiens
gtcccaccaactctgcactcca

SEQ ID NO: 5925638 - DNA, 20 bp, Homo sapiens
gtcccaccatgcagtgcccc

SEQ ID NO: 5925639 - DNA, 23 bp, Homo sapiens
gtcccacccacacagctgcccta

SEQ ID NO: 5925640 - DNA, 15 bp, Homo sapiens
gtcccacccaggaag

SEQ ID NO: 5925641 - DNA, 15 bp, Homo sapiens
gtcccaccccacaca

SEQ ID NO: 5925642 - DNA, 15 bp, Homo sapiens
gtcccaccccacctc

SEQ ID NO: 5925643 - DNA, 12 bp, Homo sapiens
gtcccaccccca

SEQ ID NO: 5925644 - DNA, 14 bp, Homo sapiens
gtcccacccccaac

SEQ ID NO: 5925645 - DNA, 20 bp, Homo sapiens
gtcccacccccaacccccag

SEQ ID NO: 5925646 - DNA, 15 bp, Homo sapiens
gtcccacccccaccc

SEQ ID NO: 5925647 - DNA, 19 bp, Homo sapiens
gtcccacccccacccccag

SEQ ID NO: 5925648 - DNA, 19 bp, Homo sapiens
gtcccacccccttccccca

SEQ ID NO: 5925649 - DNA, 17 bp, Homo sapiens
gtcccacccctagccac

SEQ ID NO: 5925650 - DNA, 17 bp, Homo sapiens
gtcccacccctccctct

SEQ ID NO: 5925651 - DNA, 20 bp, Homo sapiens
gtcccaccggttgcttctgg

SEQ ID NO: 5925652 - DNA, 21 bp, Homo sapiens
gtcccaccggttgcttctggg

SEQ ID NO: 5925653 - DNA, 22 bp, Homo sapiens
gtcccacctccagcccgggagc

SEQ ID NO: 5925654 - DNA, 13 bp, Homo sapiens
gtcccacctggct

SEQ ID NO: 5925655 - DNA, 19 bp, Homo sapiens
gtcccaccttggagcattt

SEQ ID NO: 5925656 - DNA, 14 bp, Homo sapiens
gtcccaccttggct

SEQ ID NO: 5925657 - DNA, 16 bp, Homo sapiens
gtcccaccttggctgc

SEQ ID NO: 5925658 - DNA, 19 bp, Homo sapiens
gtcccaccttggctgcagg

SEQ ID NO: 5925659 - DNA, 23 bp, Homo sapiens
gtcccaccttggctgcagggagt

SEQ ID NO: 5925660 - DNA, 16 bp, Homo sapiens
gtcccacgccaggcca

SEQ ID NO: 5925661 - DNA, 17 bp, Homo sapiens
gtcccacggctctgtgc

SEQ ID NO: 5925662 - DNA, 14 bp, Homo sapiens
gtcccacgtgtctt

SEQ ID NO: 5925663 - DNA, 17 bp, Homo sapiens
gtcccactatctgggtg

SEQ ID NO: 5925664 - DNA, 18 bp, Homo sapiens
gtcccactcaagccaagc

SEQ ID NO: 5925665 - DNA, 14 bp, Homo sapiens
gtcccactcagtcc

SEQ ID NO: 5925666 - DNA, 14 bp, Homo sapiens
gtcccactgagtct

SEQ ID NO: 5925667 - DNA, 17 bp, Homo sapiens
gtcccactgcctcaggt

SEQ ID NO: 5925668 - DNA, 18 bp, Homo sapiens
gtcccactgcctcaggtt

SEQ ID NO: 5925669 - DNA, 19 bp, Homo sapiens
gtcccactgcctcaggttc

SEQ ID NO: 5925670 - DNA, 17 bp, Homo sapiens
gtcccactggctcctcc

SEQ ID NO: 5925671 - DNA, 20 bp, Homo sapiens
gtcccactggctcctcccag

SEQ ID NO: 5925672 - DNA, 14 bp, Homo sapiens
gtcccactgggaca

SEQ ID NO: 5925673 - DNA, 19 bp, Homo sapiens
gtcccacttcacagctgga

SEQ ID NO: 5925674 - DNA, 21 bp, Homo sapiens
gtcccacttcacagctggaga

SEQ ID NO: 5925675 - DNA, 20 bp, Homo sapiens
gtcccagaaccacactgttg

SEQ ID NO: 5925676 - DNA, 13 bp, Homo sapiens
gtcccagaatgga

SEQ ID NO: 5925677 - DNA, 21 bp, Homo sapiens
gtcccagactaaaggatccag

SEQ ID NO: 5925678 - DNA, 15 bp, Homo sapiens
gtcccagagacctca

SEQ ID NO: 5925679 - DNA, 10 bp, Homo sapiens
gtcccagagc

SEQ ID NO: 5925680 - DNA, 12 bp, Homo sapiens
gtcccagagcag

SEQ ID NO: 5925681 - DNA, 18 bp, Homo sapiens
gtcccagagcaggaggcc

SEQ ID NO: 5925682 - DNA, 19 bp, Homo sapiens
gtcccagagcaggaggccc

SEQ ID NO: 5925683 - DNA, 12 bp, Homo sapiens
gtcccagagctg

SEQ ID NO: 5925684 - DNA, 21 bp, Homo sapiens
gtcccagaggccgctgcccct

SEQ ID NO: 5925685 - DNA, 22 bp, Homo sapiens
gtcccagaggccgctgcccctg

SEQ ID NO: 5925686 - DNA, 19 bp, Homo sapiens
gtcccagaggttatctgcc

SEQ ID NO: 5925687 - DNA, 22 bp, Homo sapiens
gtcccagaggttatctgcctgg

SEQ ID NO: 5925688 - DNA, 15 bp, Homo sapiens
gtcccagagtggctg

SEQ ID NO: 5925689 - DNA, 22 bp, Homo sapiens
gtcccagattggctcacactga

SEQ ID NO: 5925690 - DNA, 22 bp, Homo sapiens
gtcccagcacatttcctctcta

SEQ ID NO: 5925691 - DNA, 20 bp, Homo sapiens
gtcccagcagaagagggagg

SEQ ID NO: 5925692 - DNA, 21 bp, Homo sapiens
gtcccagcagaagagggaggc

SEQ ID NO: 5925693 - DNA, 17 bp, Homo sapiens
gtcccagcagccagcca

SEQ ID NO: 5925694 - DNA, 15 bp, Homo sapiens
gtcccagcagctgcc

SEQ ID NO: 5925695 - DNA, 16 bp, Homo sapiens
gtcccagcatccctgg

SEQ ID NO: 5925696 - DNA, 15 bp, Homo sapiens
gtcccagccaccccg

SEQ ID NO: 5925697 - DNA, 18 bp, Homo sapiens
gtcccagccaccccgggc

SEQ ID NO: 5925698 - DNA, 23 bp, Homo sapiens
gtcccagccaccccgggctctct

SEQ ID NO: 5925699 - DNA, 13 bp, Homo sapiens
gtcccagccccag

SEQ ID NO: 5925700 - DNA, 19 bp, Homo sapiens
gtcccagccccaggcctgg

SEQ ID NO: 5925701 - DNA, 22 bp, Homo sapiens
gtcccagccccaggcctggcct

SEQ ID NO: 5925702 - DNA, 13 bp, Homo sapiens
gtcccagcccctc

SEQ ID NO: 5925703 - DNA, 16 bp, Homo sapiens
gtcccagcccctcctc

SEQ ID NO: 5925704 - DNA, 20 bp, Homo sapiens
gtcccagcccctcctccctc

SEQ ID NO: 5925705 - DNA, 22 bp, Homo sapiens
gtcccagcccctcctccctcag

SEQ ID NO: 5925706 - DNA, 16 bp, Homo sapiens
gtcccagccctggggg

SEQ ID NO: 5925707 - DNA, 13 bp, Homo sapiens
gtcccagcctctg

SEQ ID NO: 5925708 - DNA, 15 bp, Homo sapiens
gtcccagcctctggg

SEQ ID NO: 5925709 - DNA, 17 bp, Homo sapiens
gtcccagcctctggggc

SEQ ID NO: 5925710 - DNA, 18 bp, Homo sapiens
gtcccagcctctggggca

SEQ ID NO: 5925711 - DNA, 16 bp, Homo sapiens
gtcccagcctgggctc

SEQ ID NO: 5925712 - DNA, 21 bp, Homo sapiens
gtcccagcctgggctcctctg

SEQ ID NO: 5925713 - DNA, 15 bp, Homo sapiens
gtcccagcctggggc

SEQ ID NO: 5925714 - DNA, 23 bp, Homo sapiens
gtcccagcctggggctccctctc

SEQ ID NO: 5925715 - DNA, 18 bp, Homo sapiens
gtcccagcggcctcaggg

SEQ ID NO: 5925716 - DNA, 11 bp, Homo sapiens
gtcccagctcc

SEQ ID NO: 5925717 - DNA, 17 bp, Homo sapiens
gtcccagctcccctctt

SEQ ID NO: 5925718 - DNA, 12 bp, Homo sapiens
gtcccagctgaa

SEQ ID NO: 5925719 - DNA, 20 bp, Homo sapiens
gtcccaggaagccggtgcct

SEQ ID NO: 5925720 - DNA, 19 bp, Homo sapiens
gtcccaggacctgagcctg

SEQ ID NO: 5925721 - DNA, 16 bp, Homo sapiens
gtcccaggatcccctg

SEQ ID NO: 5925722 - DNA, 22 bp, Homo sapiens
gtcccaggatcccctgctactc

SEQ ID NO: 5925723 - DNA, 22 bp, Homo sapiens
gtcccaggcatgcagctgcctg

SEQ ID NO: 5925724 - DNA, 14 bp, Homo sapiens
gtcccaggccaccc

SEQ ID NO: 5925725 - DNA, 17 bp, Homo sapiens
gtcccaggccgcatggc

SEQ ID NO: 5925726 - DNA, 16 bp, Homo sapiens
gtcccaggctgagcct

SEQ ID NO: 5925727 - DNA, 17 bp, Homo sapiens
gtcccaggctgagcctc

SEQ ID NO: 5925728 - DNA, 21 bp, Homo sapiens
gtcccaggctgccggctcccc

SEQ ID NO: 5925729 - DNA, 19 bp, Homo sapiens
gtcccagggccctcccagc

SEQ ID NO: 5925730 - DNA, 17 bp, Homo sapiens
gtcccagggccctggat

SEQ ID NO: 5925731 - DNA, 18 bp, Homo sapiens
gtcccagggctctgcagg

SEQ ID NO: 5925732 - DNA, 16 bp, Homo sapiens
gtcccagggctggccc

SEQ ID NO: 5925733 - DNA, 15 bp, Homo sapiens
gtcccaggggcagcc

SEQ ID NO: 5925734 - DNA, 17 bp, Homo sapiens
gtcccaggggtctccct

SEQ ID NO: 5925735 - DNA, 18 bp, Homo sapiens
gtcccaggggtctccctg

SEQ ID NO: 5925736 - DNA, 17 bp, Homo sapiens
gtcccagtcagaaataa

SEQ ID NO: 5925737 - DNA, 19 bp, Homo sapiens
gtcccagtcccagcctctg

SEQ ID NO: 5925738 - DNA, 15 bp, Homo sapiens
gtcccagtccggtgc

SEQ ID NO: 5925739 - DNA, 16 bp, Homo sapiens
gtcccagtccggtgcc

SEQ ID NO: 5925740 - DNA, 18 bp, Homo sapiens
gtcccagtccggtgcctt

SEQ ID NO: 5925741 - DNA, 12 bp, Homo sapiens
gtccctgtcccc

SEQ ID NO: 5925742 - DNA, 15 bp, Homo sapiens
gtccctgtccccagg

SEQ ID NO: 5925743 - DNA, 15 bp, Homo sapiens
gtccctgtcccccag

SEQ ID NO: 5925744 - DNA, 20 bp, Homo sapiens
gtccctgtccctctagtgcc

SEQ ID NO: 5925745 - DNA, 14 bp, Homo sapiens
gtccctgtccctgc

SEQ ID NO: 5925746 - DNA, 18 bp, Homo sapiens
gtccctgtgatggccagg

SEQ ID NO: 5925747 - DNA, 21 bp, Homo sapiens
gtccctgtgctgatcctgctg

SEQ ID NO: 5925748 - DNA, 14 bp, Homo sapiens
gtccctgtgggctc

SEQ ID NO: 5925749 - DNA, 18 bp, Homo sapiens
gtccctgtgggctcacac

SEQ ID NO: 5925750 - DNA, 18 bp, Homo sapiens
gtccctgtggtaccctgg

SEQ ID NO: 5925751 - DNA, 21 bp, Homo sapiens
gtccctgtggtaccctggcag

SEQ ID NO: 5925752 - DNA, 22 bp, Homo sapiens
gtccctgtgtgtaggctggggc

SEQ ID NO: 5925753 - DNA, 15 bp, Homo sapiens
gtccctgtgttgtcc

SEQ ID NO: 5925754 - DNA, 22 bp, Homo sapiens
gtccctgtgttgtcccatctgc

SEQ ID NO: 5925755 - DNA, 17 bp, Homo sapiens
gtccctgttctcagctc

SEQ ID NO: 5925756 - DNA, 15 bp, Homo sapiens
gtccctgttttctga

SEQ ID NO: 5925757 - DNA, 20 bp, Homo sapiens
gtccctgttttctgagcccg

SEQ ID NO: 5925758 - DNA, 17 bp, Homo sapiens
gtcccttacctggctta

SEQ ID NO: 5925759 - DNA, 23 bp, Homo sapiens
gtcccttatgagcgtcactgccc

SEQ ID NO: 5925760 - DNA, 18 bp, Homo sapiens
gtcccttccaatgctgtg

SEQ ID NO: 5925761 - DNA, 19 bp, Homo sapiens
gtcccttccaatgctgtgg

SEQ ID NO: 5925762 - DNA, 16 bp, Homo sapiens
gtcccttccaggccat

SEQ ID NO: 5925763 - DNA, 11 bp, Homo sapiens
gtcccttccat

SEQ ID NO: 5925764 - DNA, 20 bp, Homo sapiens
gtcccttccatgccctggga

SEQ ID NO: 5925765 - DNA, 16 bp, Homo sapiens
gtcccttccatttcta

SEQ ID NO: 5925766 - DNA, 17 bp, Homo sapiens
gtcccttccatttctac

SEQ ID NO: 5925767 - DNA, 16 bp, Homo sapiens
gtcccttccccctgct

SEQ ID NO: 5925768 - DNA, 12 bp, Homo sapiens
gtcccttcccct

SEQ ID NO: 5925769 - DNA, 20 bp, Homo sapiens
gtcccttcccctccctggct

SEQ ID NO: 5925770 - DNA, 14 bp, Homo sapiens
gtcccttccccttc

SEQ ID NO: 5925771 - DNA, 19 bp, Homo sapiens
gtcccttcccgacccagcc

SEQ ID NO: 5925772 - DNA, 20 bp, Homo sapiens
gtcccttcccgacccagcca

SEQ ID NO: 5925773 - DNA, 22 bp, Homo sapiens
gtcccttcctattctcctgcca

SEQ ID NO: 5925774 - DNA, 12 bp, Homo sapiens
gtcccttcctgc

SEQ ID NO: 5925775 - DNA, 16 bp, Homo sapiens
gtcccttcctttctcc

SEQ ID NO: 5925776 - DNA, 19 bp, Homo sapiens
gtcccttgaaggaagaggg

SEQ ID NO: 5925777 - DNA, 14 bp, Homo sapiens
gtcccttgagacct

SEQ ID NO: 5925778 - DNA, 20 bp, Homo sapiens
gtcccttgagacctcagcca

SEQ ID NO: 5925779 - DNA, 21 bp, Homo sapiens
gtcccttgagacctcagccat

SEQ ID NO: 5925780 - DNA, 22 bp, Homo sapiens
gtcccttgagacctcagccatg

SEQ ID NO: 5925781 - DNA, 23 bp, Homo sapiens
gtcccttgatgcacagagaagct

SEQ ID NO: 5925782 - DNA, 13 bp, Homo sapiens
gtcccttgcagct

SEQ ID NO: 5925783 - DNA, 19 bp, Homo sapiens
gtcccttgcccccctggcc

SEQ ID NO: 5925784 - DNA, 20 bp, Homo sapiens
gtcccttgcccccctggcct

SEQ ID NO: 5925785 - DNA, 14 bp, Homo sapiens
gtcccttgcctctg

SEQ ID NO: 5925786 - DNA, 18 bp, Homo sapiens
gtcccttgcctctgccct

SEQ ID NO: 5925787 - DNA, 21 bp, Homo sapiens
gtcccttgcctctgccctgga

SEQ ID NO: 5925788 - DNA, 11 bp, Homo sapiens
gtcccttgctg

SEQ ID NO: 5925789 - DNA, 15 bp, Homo sapiens
gtcccttgctgacat

SEQ ID NO: 5925790 - DNA, 18 bp, Homo sapiens
gtcccttgctgacatggc

SEQ ID NO: 5925791 - DNA, 15 bp, Homo sapiens
gtcccttgctgcaaa

SEQ ID NO: 5925792 - DNA, 23 bp, Homo sapiens
gtcccttggaaagttcagccaga

SEQ ID NO: 5925793 - DNA, 18 bp, Homo sapiens
gtcccttggatcagaggt

SEQ ID NO: 5925794 - DNA, 21 bp, Homo sapiens
gtcccttggatcagaggtcat

SEQ ID NO: 5925795 - DNA, 19 bp, Homo sapiens
gtcccttgtatcccctgca

SEQ ID NO: 5925796 - DNA, 20 bp, Homo sapiens
gtccctttcacactgtggtg

SEQ ID NO: 5925797 - DNA, 17 bp, Homo sapiens
gtccctttcagagacag

SEQ ID NO: 5925798 - DNA, 20 bp, Homo sapiens
gtccctttcccctagatcca

SEQ ID NO: 5925799 - DNA, 22 bp, Homo sapiens
gtccctttcccctagatccaga

SEQ ID NO: 5925800 - DNA, 16 bp, Homo sapiens
gtccctttccctgcat

SEQ ID NO: 5925801 - DNA, 23 bp, Homo sapiens
gtccctttcgacttgcatttttg

SEQ ID NO: 5925802 - DNA, 15 bp, Homo sapiens
gtccctttgctcccg

SEQ ID NO: 5925803 - DNA, 19 bp, Homo sapiens
gtccctttggacaaatgca

SEQ ID NO: 5925804 - DNA, 22 bp, Homo sapiens
gtccgaaagggacttggaagct

SEQ ID NO: 5925805 - DNA, 21 bp, Homo sapiens
gtccgatggcccgagagctgg

SEQ ID NO: 5925806 - DNA, 14 bp, Homo sapiens
gtccgattaattta

SEQ ID NO: 5925807 - DNA, 20 bp, Homo sapiens
gtccgcaagttcagggaagc

SEQ ID NO: 5925808 - DNA, 22 bp, Homo sapiens
gtccgcaagttcagggaagcag

SEQ ID NO: 5925809 - DNA, 18 bp, Homo sapiens
gtccgcaccagctgctct

SEQ ID NO: 5925810 - DNA, 18 bp, Homo sapiens
gtccgcagttgtagcaga

SEQ ID NO: 5925811 - DNA, 23 bp, Homo sapiens
gtccgcagttgtagcagaaacca

SEQ ID NO: 5925812 - DNA, 16 bp, Homo sapiens
gtccgcataagaaaaa

SEQ ID NO: 5925813 - DNA, 17 bp, Homo sapiens
gtccgccatccagggtc

SEQ ID NO: 5925814 - DNA, 19 bp, Homo sapiens
gtccgccatccagggtctg

SEQ ID NO: 5925815 - DNA, 22 bp, Homo sapiens
gtccgccatccagggtctggca

SEQ ID NO: 5925816 - DNA, 13 bp, Homo sapiens
gtccgcccgccca

SEQ ID NO: 5925817 - DNA, 20 bp, Homo sapiens
gtccgcccgcttccctcctt

SEQ ID NO: 5925818 - DNA, 19 bp, Homo sapiens
gtccgccctcttcccctct

SEQ ID NO: 5925819 - DNA, 14 bp, Homo sapiens
gtccgcctgcgcct

SEQ ID NO: 5925820 - DNA, 16 bp, Homo sapiens
gtccgcctgcgcctcc

SEQ ID NO: 5925821 - DNA, 14 bp, Homo sapiens
gtccgccttaatct

SEQ ID NO: 5925822 - DNA, 15 bp, Homo sapiens
gtccgcggcctgcac

SEQ ID NO: 5925823 - DNA, 22 bp, Homo sapiens
gtccgctgggtggtaccctctg

SEQ ID NO: 5925824 - DNA, 19 bp, Homo sapiens
gtccgctgtctccctcctg

SEQ ID NO: 5925825 - DNA, 16 bp, Homo sapiens
gtccgctttcctggag

SEQ ID NO: 5925826 - DNA, 18 bp, Homo sapiens
gtccgctttcctggagcc

SEQ ID NO: 5925827 - DNA, 16 bp, Homo sapiens
gtccggaaggatggga

SEQ ID NO: 5925828 - DNA, 18 bp, Homo sapiens
gtccggacactcctagag

SEQ ID NO: 5925829 - DNA, 15 bp, Homo sapiens
gtccggagcgaccct

SEQ ID NO: 5925830 - DNA, 19 bp, Homo sapiens
gtccggagcgaccctggct

SEQ ID NO: 5925831 - DNA, 20 bp, Homo sapiens
gtccggagcgaccctggctc

SEQ ID NO: 5925832 - DNA, 21 bp, Homo sapiens
gtccggaggatattaaaatgc

SEQ ID NO: 5925833 - DNA, 14 bp, Homo sapiens
gtccggaggcagca

SEQ ID NO: 5925834 - DNA, 15 bp, Homo sapiens
gtccggaggcagcag

SEQ ID NO: 5925835 - DNA, 16 bp, Homo sapiens
gtccggcccagtgcca

SEQ ID NO: 5925836 - DNA, 18 bp, Homo sapiens
gtccggcccagtgccagc

SEQ ID NO: 5925837 - DNA, 21 bp, Homo sapiens
gtccggcccagtgccagctcc

SEQ ID NO: 5925838 - DNA, 20 bp, Homo sapiens
gtccggcctctccctgcctg

SEQ ID NO: 5925839 - DNA, 15 bp, Homo sapiens
gtccggcctcttttt

SEQ ID NO: 5925840 - DNA, 14 bp, Homo sapiens
gtccggcctgcagc

SEQ ID NO: 5925841 - DNA, 17 bp, Homo sapiens
gtccggcctgcagccca

SEQ ID NO: 5925842 - DNA, 18 bp, Homo sapiens
gtccggcctgcagcccag

SEQ ID NO: 5925843 - DNA, 15 bp, Homo sapiens
gtccggcttggctag

SEQ ID NO: 5925844 - DNA, 16 bp, Homo sapiens
gtccggtgccttccac

SEQ ID NO: 5925845 - DNA, 17 bp, Homo sapiens
gtccggtgccttccacc

SEQ ID NO: 5925846 - DNA, 18 bp, Homo sapiens
gtccggtgccttccaccc

SEQ ID NO: 5925847 - DNA, 19 bp, Homo sapiens
gtccggtgccttccaccct

SEQ ID NO: 5925848 - DNA, 17 bp, Homo sapiens
gtccggtgtccttttca

SEQ ID NO: 5925849 - DNA, 15 bp, Homo sapiens
gtccggtttacttta

SEQ ID NO: 5925850 - DNA, 17 bp, Homo sapiens
gtccgtccacccttcca

SEQ ID NO: 5925851 - DNA, 19 bp, Homo sapiens
gtccgtccgcccgcccacc

SEQ ID NO: 5925852 - DNA, 23 bp, Homo sapiens
gtccgtccgcccgcccaccccgc

SEQ ID NO: 5925853 - DNA, 20 bp, Homo sapiens
gtccgtcctgctcgccctgt

SEQ ID NO: 5925854 - DNA, 14 bp, Homo sapiens
gtccgtcctggcac

SEQ ID NO: 5925855 - DNA, 15 bp, Homo sapiens
gtccgtctctcttgc

SEQ ID NO: 5925856 - DNA, 14 bp, Homo sapiens
gtccgtctgtcctg

SEQ ID NO: 5925857 - DNA, 12 bp, Homo sapiens
gtccgtctgtct

SEQ ID NO: 5925858 - DNA, 13 bp, Homo sapiens
gtccgtctgtgta

SEQ ID NO: 5925859 - DNA, 15 bp, Homo sapiens
gtccgtctgtgtatg

SEQ ID NO: 5925860 - DNA, 18 bp, Homo sapiens
gtccgtgaagagaaagac

SEQ ID NO: 5925861 - DNA, 16 bp, Homo sapiens
gtccgtgcccaggccc

SEQ ID NO: 5925862 - DNA, 22 bp, Homo sapiens
gtccgtgcccaggcccttggct

SEQ ID NO: 5925863 - DNA, 20 bp, Homo sapiens
gtccgtgctgacagctgctc

SEQ ID NO: 5925864 - DNA, 21 bp, Homo sapiens
gtccgtgctgacagctgctcc

SEQ ID NO: 5925865 - DNA, 22 bp, Homo sapiens
gtccgtgggccgtatctgtcac

SEQ ID NO: 5925866 - DNA, 18 bp, Homo sapiens
gtccgtgggttgctaact

SEQ ID NO: 5925867 - DNA, 20 bp, Homo sapiens
gtccgtgggttgctaactga

SEQ ID NO: 5925868 - DNA, 22 bp, Homo sapiens
gtccgtgggttgctaactgaac

SEQ ID NO: 5925869 - DNA, 18 bp, Homo sapiens
gtccgtggtagaggcctg

SEQ ID NO: 5925870 - DNA, 19 bp, Homo sapiens
gtccgtggtagaggcctgg

SEQ ID NO: 5925871 - DNA, 23 bp, Homo sapiens
gtccgtggtagaggcctggggcc

SEQ ID NO: 5925872 - DNA, 13 bp, Homo sapiens
gtccgtgtgcctc

SEQ ID NO: 5925873 - DNA, 15 bp, Homo sapiens
gtccgtgtgcctcct

SEQ ID NO: 5925874 - DNA, 19 bp, Homo sapiens
gtccgttcacatgtgtggt

SEQ ID NO: 5925875 - DNA, 16 bp, Homo sapiens
gtccgttgacgtgacc

SEQ ID NO: 5925876 - DNA, 19 bp, Homo sapiens
gtccgtttgagtgtctgcg

SEQ ID NO: 5925877 - DNA, 13 bp, Homo sapiens
gtcctaaaacacc

SEQ ID NO: 5925878 - DNA, 19 bp, Homo sapiens
gtcctaaaagttctcaatg

SEQ ID NO: 5925879 - DNA, 16 bp, Homo sapiens
gtcctaaccactaaca

SEQ ID NO: 5925880 - DNA, 22 bp, Homo sapiens
gtcctaaccactaacattgtga

SEQ ID NO: 5925881 - DNA, 15 bp, Homo sapiens
gtcctaactttctga

SEQ ID NO: 5925882 - DNA, 13 bp, Homo sapiens
gtcctaagcacct

SEQ ID NO: 5925883 - DNA, 19 bp, Homo sapiens
gtcctaaggacacactaat

SEQ ID NO: 5925884 - DNA, 14 bp, Homo sapiens
gtcctaaggcccat

SEQ ID NO: 5925885 - DNA, 20 bp, Homo sapiens
gtcctaataatatcccactg

SEQ ID NO: 5925886 - DNA, 22 bp, Homo sapiens
gtcctaatcatacaccagaaga

SEQ ID NO: 5925887 - DNA, 14 bp, Homo sapiens
gtcctacagaaaaa

SEQ ID NO: 5925888 - DNA, 16 bp, Homo sapiens
gtcctacagaaaaacc

SEQ ID NO: 5925889 - DNA, 18 bp, Homo sapiens
gtcctacagtgactccct

SEQ ID NO: 5925890 - DNA, 15 bp, Homo sapiens
gtcctacccaccctc

SEQ ID NO: 5925891 - DNA, 14 bp, Homo sapiens
gtcctacccatccc

SEQ ID NO: 5925892 - DNA, 18 bp, Homo sapiens
gtcctacccatccccgca

SEQ ID NO: 5925893 - DNA, 14 bp, Homo sapiens
gtcctacccgcccg

SEQ ID NO: 5925894 - DNA, 16 bp, Homo sapiens
gtcctacccgcccgcg

SEQ ID NO: 5925895 - DNA, 15 bp, Homo sapiens
gtcctacggagggac

SEQ ID NO: 5925896 - DNA, 15 bp, Homo sapiens
gtcctactcctggag

SEQ ID NO: 5925897 - DNA, 16 bp, Homo sapiens
gtcctactcctggagc

SEQ ID NO: 5925898 - DNA, 13 bp, Homo sapiens
gtcctactctgtg

SEQ ID NO: 5925899 - DNA, 17 bp, Homo sapiens
gtcctactggggaaact

SEQ ID NO: 5925900 - DNA, 18 bp, Homo sapiens
gtcctacttctgacttta

SEQ ID NO: 5925901 - DNA, 21 bp, Homo sapiens
gtcctactttacatatgcttt

SEQ ID NO: 5925902 - DNA, 16 bp, Homo sapiens
gtcctagagaattcct

SEQ ID NO: 5925903 - DNA, 19 bp, Homo sapiens
gtcctagaggccctttgct

SEQ ID NO: 5925904 - DNA, 21 bp, Homo sapiens
gtcctagccaggtctcctggg

SEQ ID NO: 5925905 - DNA, 23 bp, Homo sapiens
gtcctagccccaaaccagcccag

SEQ ID NO: 5925906 - DNA, 19 bp, Homo sapiens
gtcctagcccttccctgag

SEQ ID NO: 5925907 - DNA, 21 bp, Homo sapiens
gtcctagctcctcctcctggg

SEQ ID NO: 5925908 - DNA, 15 bp, Homo sapiens
gtcctaggctctggg

SEQ ID NO: 5925909 - DNA, 22 bp, Homo sapiens
gtcctagtcgggcagggcccct

SEQ ID NO: 5925910 - DNA, 16 bp, Homo sapiens
gtcctagttgttcagc

SEQ ID NO: 5925911 - DNA, 17 bp, Homo sapiens
gtcctatagtcgtgggt

SEQ ID NO: 5925912 - DNA, 17 bp, Homo sapiens
gtcctatccccggacgc

SEQ ID NO: 5925913 - DNA, 17 bp, Homo sapiens
gtcctatctgggcttcc

SEQ ID NO: 5925914 - DNA, 19 bp, Homo sapiens
gtcctatgaatgctttgca

SEQ ID NO: 5925915 - DNA, 13 bp, Homo sapiens
gtcctatgcaata

SEQ ID NO: 5925916 - DNA, 20 bp, Homo sapiens
gtcctatgcaataaaattat

SEQ ID NO: 5925917 - DNA, 21 bp, Homo sapiens
gtcctatgcaataaaattatt

SEQ ID NO: 5925918 - DNA, 15 bp, Homo sapiens
gtcctatggaaaaaa

SEQ ID NO: 5925919 - DNA, 17 bp, Homo sapiens
gtcctatggacaactta

SEQ ID NO: 5925920 - DNA, 15 bp, Homo sapiens
gtcctatgtacagag

SEQ ID NO: 5925921 - DNA, 17 bp, Homo sapiens
gtcctatgtacagagct

SEQ ID NO: 5925922 - DNA, 20 bp, Homo sapiens
gtcctattagtgttatatga

SEQ ID NO: 5925923 - DNA, 22 bp, Homo sapiens
gtcctattagtgttatatgaac

SEQ ID NO: 5925924 - DNA, 18 bp, Homo sapiens
gtcctcaagcttctcaga

SEQ ID NO: 5925925 - DNA, 19 bp, Homo sapiens
gtcctcaaggggccatcct

SEQ ID NO: 5925926 - DNA, 15 bp, Homo sapiens
gtcctcacaagcctc

SEQ ID NO: 5925927 - DNA, 21 bp, Homo sapiens
gtcctcacaagcctcttctga

SEQ ID NO: 5925928 - DNA, 15 bp, Homo sapiens
gtcctcacacacgga

SEQ ID NO: 5925929 - DNA, 21 bp, Homo sapiens
gtcctcacacacggaggccag

SEQ ID NO: 5925930 - DNA, 22 bp, Homo sapiens
gtcctcacacacggaggccaga

SEQ ID NO: 5925931 - DNA, 12 bp, Homo sapiens
gtcctcacagca

SEQ ID NO: 5925932 - DNA, 13 bp, Homo sapiens
gtcctcacagcct

SEQ ID NO: 5925933 - DNA, 17 bp, Homo sapiens
gtcctcacagcctctcc

SEQ ID NO: 5925934 - DNA, 20 bp, Homo sapiens
gtcctcacagcctctccctt

SEQ ID NO: 5925935 - DNA, 22 bp, Homo sapiens
gtcctcacatgactgaagggac

SEQ ID NO: 5925936 - DNA, 16 bp, Homo sapiens
gtcctcacatgcagag

SEQ ID NO: 5925937 - DNA, 14 bp, Homo sapiens
gtcctcacccctgt

SEQ ID NO: 5925938 - DNA, 17 bp, Homo sapiens
gtcctcacccctgtcct

SEQ ID NO: 5925939 - DNA, 20 bp, Homo sapiens
gtcctcacccctgtcctcac

SEQ ID NO: 5925940 - DNA, 23 bp, Homo sapiens
gtcctcacccctgtcctcactgc

SEQ ID NO: 5925941 - DNA, 15 bp, Homo sapiens
gtcctcaccctgtgg

SEQ ID NO: 5925942 - DNA, 17 bp, Homo sapiens
gtcctcaccctgtggga

SEQ ID NO: 5925943 - DNA, 20 bp, Homo sapiens
gtcctcaccctgtgggaccg

SEQ ID NO: 5925944 - DNA, 21 bp, Homo sapiens
gtcctcactgctccctgaagc

SEQ ID NO: 5925945 - DNA, 20 bp, Homo sapiens
gtcctcactggtctacactg

SEQ ID NO: 5925946 - DNA, 17 bp, Homo sapiens
gtcctcactgtcctgtt

SEQ ID NO: 5925947 - DNA, 23 bp, Homo sapiens
gtcctcacttctagatctcagcc

SEQ ID NO: 5925948 - DNA, 20 bp, Homo sapiens
gtcctcagagaatttctacc

SEQ ID NO: 5925949 - DNA, 13 bp, Homo sapiens
gtcctcagagcag

SEQ ID NO: 5925950 - DNA, 18 bp, Homo sapiens
gtcctcagagcaggggcc

SEQ ID NO: 5925951 - DNA, 19 bp, Homo sapiens
gtcctcagcagtccacaaa

SEQ ID NO: 5925952 - DNA, 12 bp, Homo sapiens
gtcctcagcctt

SEQ ID NO: 5925953 - DNA, 14 bp, Homo sapiens
gtcctcagccttgc

SEQ ID NO: 5925954 - DNA, 13 bp, Homo sapiens
gtcctcaggcagt

SEQ ID NO: 5925955 - DNA, 19 bp, Homo sapiens
gtcctcaggcagtggccca

SEQ ID NO: 5925956 - DNA, 23 bp, Homo sapiens
gtcctcaggcagtggcccaggga

SEQ ID NO: 5925957 - DNA, 16 bp, Homo sapiens
gtcctcagggagcagg

SEQ ID NO: 5925958 - DNA, 21 bp, Homo sapiens
gtcctcaggtacagcgggctg

SEQ ID NO: 5925959 - DNA, 23 bp, Homo sapiens
gtcctcaggtacagcgggctgtg

SEQ ID NO: 5925960 - DNA, 12 bp, Homo sapiens
gtcctcaggtca

SEQ ID NO: 5925961 - DNA, 13 bp, Homo sapiens
gtcctcaggtcag

SEQ ID NO: 5925962 - DNA, 19 bp, Homo sapiens
gtcctcaggtcagctggga

SEQ ID NO: 5925963 - DNA, 15 bp, Homo sapiens
gtcctcaggtggcca

SEQ ID NO: 5925964 - DNA, 18 bp, Homo sapiens
gtcctcagtccatttata

SEQ ID NO: 5925965 - DNA, 22 bp, Homo sapiens
gtcctcatctctgtcgtgcttc

SEQ ID NO: 5925966 - DNA, 13 bp, Homo sapiens
gtcctccaaaaca

SEQ ID NO: 5925967 - DNA, 23 bp, Homo sapiens
gtcctccaacaataaagagctca

SEQ ID NO: 5925968 - DNA, 21 bp, Homo sapiens
gtcctccaacaccaagcacag

SEQ ID NO: 5925969 - DNA, 17 bp, Homo sapiens
gtcctccaagtgccccc

SEQ ID NO: 5925970 - DNA, 18 bp, Homo sapiens
gtcctccacacaagggaa

SEQ ID NO: 5925971 - DNA, 21 bp, Homo sapiens
gtcctccaccacaagagctcc

SEQ ID NO: 5925972 - DNA, 20 bp, Homo sapiens
gtcctccactcgacccagaa

SEQ ID NO: 5925973 - DNA, 20 bp, Homo sapiens
gtcctccagaactcttcctc

SEQ ID NO: 5925974 - DNA, 14 bp, Homo sapiens
gtcctccagaagcc

SEQ ID NO: 5925975 - DNA, 16 bp, Homo sapiens
gtcctccatcacccct

SEQ ID NO: 5925976 - DNA, 17 bp, Homo sapiens
gtcctccatcacccctg

SEQ ID NO: 5925977 - DNA, 22 bp, Homo sapiens
gtcctccatcacccctggtggc

SEQ ID NO: 5925978 - DNA, 22 bp, Homo sapiens
gtcctccatcccaacagccatg

SEQ ID NO: 5925979 - DNA, 19 bp, Homo sapiens
gtcctccatttcaactcca

SEQ ID NO: 5925980 - DNA, 22 bp, Homo sapiens
gtcctccatttcaactccagaa

SEQ ID NO: 5925981 - DNA, 12 bp, Homo sapiens
gtcctcccaagc

SEQ ID NO: 5925982 - DNA, 13 bp, Homo sapiens
gtcctcccaagct

SEQ ID NO: 5925983 - DNA, 18 bp, Homo sapiens
gtcctcccaagctgtgct

SEQ ID NO: 5925984 - DNA, 16 bp, Homo sapiens
gtcctcccacagacct

SEQ ID NO: 5925985 - DNA, 17 bp, Homo sapiens
gtcctcccacagacctg

SEQ ID NO: 5925986 - DNA, 23 bp, Homo sapiens
gtcctcccacagacctgcagtga

SEQ ID NO: 5925987 - DNA, 16 bp, Homo sapiens
gtcctcccacccctcc

SEQ ID NO: 5925988 - DNA, 18 bp, Homo sapiens
gtcctcccacccctcccc

SEQ ID NO: 5925989 - DNA, 18 bp, Homo sapiens
gtcctcccaggaaccaaa

SEQ ID NO: 5925990 - DNA, 16 bp, Homo sapiens
gtcctcccatcccctc

SEQ ID NO: 5925991 - DNA, 17 bp, Homo sapiens
gtcctcccatcccctgg

SEQ ID NO: 5925992 - DNA, 18 bp, Homo sapiens
gtcctcccatcccctgga

SEQ ID NO: 5925993 - DNA, 12 bp, Homo sapiens
gtcctcccatct

SEQ ID NO: 5925994 - DNA, 14 bp, Homo sapiens
gtcctcccatctca

SEQ ID NO: 5925995 - DNA, 15 bp, Homo sapiens
gtcctccccctgcca

SEQ ID NO: 5925996 - DNA, 17 bp, Homo sapiens
gtcctccccctgccagt

SEQ ID NO: 5925997 - DNA, 22 bp, Homo sapiens
gtcctccccctgccagtgcctt

SEQ ID NO: 5925998 - DNA, 16 bp, Homo sapiens
gtcctcccctcacagc

SEQ ID NO: 5925999 - DNA, 17 bp, Homo sapiens
gtcctcccctcacagcc

SEQ ID NO: 5926000 - DNA, 17 bp, Homo sapiens
gtcctcccctctcttgt

SEQ ID NO: 5926001 - DNA, 18 bp, Homo sapiens
gtcctccccttgggcggc

SEQ ID NO: 5926002 - DNA, 12 bp, Homo sapiens
gtcctcccgggc

SEQ ID NO: 5926003 - DNA, 16 bp, Homo sapiens
gtcctcccgggccctc

SEQ ID NO: 5926004 - DNA, 13 bp, Homo sapiens
gtcctccctagct

SEQ ID NO: 5926005 - DNA, 16 bp, Homo sapiens
gtcctccctagctctt

SEQ ID NO: 5926006 - DNA, 15 bp, Homo sapiens
gtcctccctcccaag

SEQ ID NO: 5926007 - DNA, 12 bp, Homo sapiens
gtcctccctgct

SEQ ID NO: 5926008 - DNA, 14 bp, Homo sapiens
gtcctccctgctca

SEQ ID NO: 5926009 - DNA, 14 bp, Homo sapiens
gtcctccgcctact

SEQ ID NO: 5926010 - DNA, 20 bp, Homo sapiens
gtcctccgcctactgtccct

SEQ ID NO: 5926011 - DNA, 18 bp, Homo sapiens
gtcctccgccttaccagg

SEQ ID NO: 5926012 - DNA, 20 bp, Homo sapiens
gtcctccggttcttcctcgg

SEQ ID NO: 5926013 - DNA, 19 bp, Homo sapiens
gtcctcctaagtcccttcc

SEQ ID NO: 5926014 - DNA, 22 bp, Homo sapiens
gtcctcctaccgaaaccttgcc

SEQ ID NO: 5926015 - DNA, 20 bp, Homo sapiens
gtcctcctccagggacagca

SEQ ID NO: 5926016 - DNA, 22 bp, Homo sapiens
gtcctcctcggatcaccgagag

SEQ ID NO: 5926017 - DNA, 11 bp, Homo sapiens
gtcctcctcta

SEQ ID NO: 5926018 - DNA, 13 bp, Homo sapiens
gtcctcctctgag

SEQ ID NO: 5926019 - DNA, 13 bp, Homo sapiens
gtcctcctctgtg

SEQ ID NO: 5926020 - DNA, 15 bp, Homo sapiens
gtcctcctctgtgaa

SEQ ID NO: 5926021 - DNA, 20 bp, Homo sapiens
gtcctcctgctctgcttcct

SEQ ID NO: 5926022 - DNA, 22 bp, Homo sapiens
gtcctcctgctctgcttcctca

SEQ ID NO: 5926023 - DNA, 14 bp, Homo sapiens
gtcctcctggaagg

SEQ ID NO: 5926024 - DNA, 19 bp, Homo sapiens
gtcctcctggaagggacct

SEQ ID NO: 5926025 - DNA, 17 bp, Homo sapiens
gtcctcctggcctgagc

SEQ ID NO: 5926026 - DNA, 15 bp, Homo sapiens
gtcctcctgggagcc

SEQ ID NO: 5926027 - DNA, 21 bp, Homo sapiens
gtcctcctggtgggtccaggg

SEQ ID NO: 5926028 - DNA, 22 bp, Homo sapiens
gtcctcctggtgggtccagggg

SEQ ID NO: 5926029 - DNA, 23 bp, Homo sapiens
gtcctcctggtgggtccaggggc

SEQ ID NO: 5926030 - DNA, 13 bp, Homo sapiens
gtcctcctgtgct

SEQ ID NO: 5926031 - DNA, 12 bp, Homo sapiens
gtcctcctttct

SEQ ID NO: 5926032 - DNA, 16 bp, Homo sapiens
gtcctccttttcactt

SEQ ID NO: 5926033 - DNA, 20 bp, Homo sapiens
gtcctcgaattctcagacga

SEQ ID NO: 5926034 - DNA, 21 bp, Homo sapiens
gtcctcgaattttatctgtgg

SEQ ID NO: 5926035 - DNA, 13 bp, Homo sapiens
gtcctcgatggga

SEQ ID NO: 5926036 - DNA, 22 bp, Homo sapiens
gtcctcgatgggagggatggcc

SEQ ID NO: 5926037 - DNA, 21 bp, Homo sapiens
gtcctcgcactgcccagggaa

SEQ ID NO: 5926038 - DNA, 14 bp, Homo sapiens
gtcctcggcagctc

SEQ ID NO: 5926039 - DNA, 14 bp, Homo sapiens
gtcctcggcccatc

SEQ ID NO: 5926040 - DNA, 18 bp, Homo sapiens
gtcctcggccctgtagcc

SEQ ID NO: 5926041 - DNA, 20 bp, Homo sapiens
gtcctcgggcccctgagcct

SEQ ID NO: 5926042 - DNA, 21 bp, Homo sapiens
gtcctcgggcccctgagcctg

SEQ ID NO: 5926043 - DNA, 22 bp, Homo sapiens
gtcctcgggcccctgagcctgt

SEQ ID NO: 5926044 - DNA, 16 bp, Homo sapiens
gtcctcgtggcggggc

SEQ ID NO: 5926045 - DNA, 19 bp, Homo sapiens
gtcctcgtggcggggcagc

SEQ ID NO: 5926046 - DNA, 16 bp, Homo sapiens
gtcctcgttcaaaaca

SEQ ID NO: 5926047 - DNA, 18 bp, Homo sapiens
gtcctcgtttgtgttctg

SEQ ID NO: 5926048 - DNA, 20 bp, Homo sapiens
gtcctctcagaactcctgtg

SEQ ID NO: 5926049 - DNA, 21 bp, Homo sapiens
gtcctctcagaactcctgtgt

SEQ ID NO: 5926050 - DNA, 16 bp, Homo sapiens
gtcctctcagagcctc

SEQ ID NO: 5926051 - DNA, 19 bp, Homo sapiens
gtcctctcagagcctcagc

SEQ ID NO: 5926052 - DNA, 20 bp, Homo sapiens
gtcctctcagagcctcagct

SEQ ID NO: 5926053 - DNA, 19 bp, Homo sapiens
gtcctctcagttctctccc

SEQ ID NO: 5926054 - DNA, 19 bp, Homo sapiens
gtcctctcccaagtccaca

SEQ ID NO: 5926055 - DNA, 15 bp, Homo sapiens
gtcctctccccagcc

SEQ ID NO: 5926056 - DNA, 15 bp, Homo sapiens
gtcctctcccccttc

SEQ ID NO: 5926057 - DNA, 16 bp, Homo sapiens
gtcctctcccccttca

SEQ ID NO: 5926058 - DNA, 17 bp, Homo sapiens
gtcctctcccccttcag

SEQ ID NO: 5926059 - DNA, 18 bp, Homo sapiens
gtcctctcccccttcagc

SEQ ID NO: 5926060 - DNA, 20 bp, Homo sapiens
gtcctctcccccttcagctc

SEQ ID NO: 5926061 - DNA, 22 bp, Homo sapiens
gtcctctcccccttcagctcct

SEQ ID NO: 5926062 - DNA, 23 bp, Homo sapiens
gtcctctcccccttcagctcctg

SEQ ID NO: 5926063 - DNA, 17 bp, Homo sapiens
gtcctctcccctccagc

SEQ ID NO: 5926064 - DNA, 20 bp, Homo sapiens
gtcctctcccctccagcctt

SEQ ID NO: 5926065 - DNA, 19 bp, Homo sapiens
gtcctctccctcctggcca

SEQ ID NO: 5926066 - DNA, 18 bp, Homo sapiens
gtcctctccctgccaagt

SEQ ID NO: 5926067 - DNA, 18 bp, Homo sapiens
gtcctctcgtagaacctg

SEQ ID NO: 5926068 - DNA, 12 bp, Homo sapiens
gtcctctctctg

SEQ ID NO: 5926069 - DNA, 18 bp, Homo sapiens
gtcctctctgagtcaaat

SEQ ID NO: 5926070 - DNA, 17 bp, Homo sapiens
gtcctctcttccacagt

SEQ ID NO: 5926071 - DNA, 18 bp, Homo sapiens
gtcctctcttccacagtg

SEQ ID NO: 5926072 - DNA, 20 bp, Homo sapiens
gtcctctcttccacagtggc

SEQ ID NO: 5926073 - DNA, 20 bp, Homo sapiens
gtcctctcttctctattcct

SEQ ID NO: 5926074 - DNA, 13 bp, Homo sapiens
gtcctctgaatga

SEQ ID NO: 5926075 - DNA, 13 bp, Homo sapiens
gtcctctgaggca

SEQ ID NO: 5926076 - DNA, 13 bp, Homo sapiens
gtcctctgcctgg

SEQ ID NO: 5926077 - DNA, 15 bp, Homo sapiens
gtcctctgctccagc

SEQ ID NO: 5926078 - DNA, 13 bp, Homo sapiens
gtcctctggagcc

SEQ ID NO: 5926079 - DNA, 18 bp, Homo sapiens
gtcctctggatggcacca

SEQ ID NO: 5926080 - DNA, 20 bp, Homo sapiens
gtcctctgtcagtcacagcc

SEQ ID NO: 5926081 - DNA, 20 bp, Homo sapiens
gtcctctgtccgtctgtcct

SEQ ID NO: 5926082 - DNA, 17 bp, Homo sapiens
gtcctctgtggccagct

SEQ ID NO: 5926083 - DNA, 18 bp, Homo sapiens
gtcctcttaactgtggtg

SEQ ID NO: 5926084 - DNA, 18 bp, Homo sapiens
gtcctcttccaccacaga

SEQ ID NO: 5926085 - DNA, 19 bp, Homo sapiens
gtcctcttccctctctgca

SEQ ID NO: 5926086 - DNA, 20 bp, Homo sapiens
gtcctcttccctctctgcag

SEQ ID NO: 5926087 - DNA, 23 bp, Homo sapiens
gtcctcttctgctcttttcctgg

SEQ ID NO: 5926088 - DNA, 13 bp, Homo sapiens
gtcctcttctggg

SEQ ID NO: 5926089 - DNA, 15 bp, Homo sapiens
gtcctcttgccagct

SEQ ID NO: 5926090 - DNA, 16 bp, Homo sapiens
gtcctcttgccagctc

SEQ ID NO: 5926091 - DNA, 17 bp, Homo sapiens
gtcctcttgccagctca

SEQ ID NO: 5926092 - DNA, 17 bp, Homo sapiens
gtcctcttgcctcctgg

SEQ ID NO: 5926093 - DNA, 23 bp, Homo sapiens
gtcctctttactcccttcctggc

SEQ ID NO: 5926094 - DNA, 17 bp, Homo sapiens
gtcctctttagtttttg

SEQ ID NO: 5926095 - DNA, 15 bp, Homo sapiens
gtcgcatttcatcaa

SEQ ID NO: 5926096 - DNA, 16 bp, Homo sapiens
gtcgccaatccatgct

SEQ ID NO: 5926097 - DNA, 19 bp, Homo sapiens
gtcgccacacccggctccc

SEQ ID NO: 5926098 - DNA, 22 bp, Homo sapiens
gtcgccacacccggctccccct

SEQ ID NO: 5926099 - DNA, 17 bp, Homo sapiens
gtcgccacacgcctctg

SEQ ID NO: 5926100 - DNA, 20 bp, Homo sapiens
gtcgccacacgcctctgtgt

SEQ ID NO: 5926101 - DNA, 21 bp, Homo sapiens
gtcgccacacgcctctgtgta

SEQ ID NO: 5926102 - DNA, 17 bp, Homo sapiens
gtcgccagtcactgctg

SEQ ID NO: 5926103 - DNA, 18 bp, Homo sapiens
gtcgccagtcactgctgc

SEQ ID NO: 5926104 - DNA, 22 bp, Homo sapiens
gtcgcccacctgtgggccagcc

SEQ ID NO: 5926105 - DNA, 13 bp, Homo sapiens
gtcgcccagtctg

SEQ ID NO: 5926106 - DNA, 14 bp, Homo sapiens
gtcgcccagtctgg

SEQ ID NO: 5926107 - DNA, 23 bp, Homo sapiens
gtcgccccaggccctccctgact

SEQ ID NO: 5926108 - DNA, 13 bp, Homo sapiens
gtcgccccagtgg

SEQ ID NO: 5926109 - DNA, 20 bp, Homo sapiens
gtcgcccctcctcgggcgcc

SEQ ID NO: 5926110 - DNA, 20 bp, Homo sapiens
gtcgcccctccttttggcct

SEQ ID NO: 5926111 - DNA, 22 bp, Homo sapiens
gtcgcccctccttttggcctgg

SEQ ID NO: 5926112 - DNA, 17 bp, Homo sapiens
gtcgccctctgtgccta

SEQ ID NO: 5926113 - DNA, 19 bp, Homo sapiens
gtcgccctctgtgcctaat

SEQ ID NO: 5926114 - DNA, 18 bp, Homo sapiens
gtcgccctggactgtgtg

SEQ ID NO: 5926115 - DNA, 17 bp, Homo sapiens
gtcgccctttgctgcat

SEQ ID NO: 5926116 - DNA, 22 bp, Homo sapiens
gtcgccctttgctgcatggcag

SEQ ID NO: 5926117 - DNA, 14 bp, Homo sapiens
gtcgcctgcctgca

SEQ ID NO: 5926118 - DNA, 18 bp, Homo sapiens
gtcgcctgcctgcagcag

SEQ ID NO: 5926119 - DNA, 16 bp, Homo sapiens
gtcgcctgcggactcc

SEQ ID NO: 5926120 - DNA, 20 bp, Homo sapiens
gtcgcctttcagcaggcagc

SEQ ID NO: 5926121 - DNA, 23 bp, Homo sapiens
gtcgcgcgcagcgcgtgcacagc

SEQ ID NO: 5926122 - DNA, 20 bp, Homo sapiens
gtcgcgcgtctcccatcctg

SEQ ID NO: 5926123 - DNA, 13 bp, Homo sapiens
gtcgcggctgcag

SEQ ID NO: 5926124 - DNA, 14 bp, Homo sapiens
gtcgctatgtgact

SEQ ID NO: 5926125 - DNA, 22 bp, Homo sapiens
gtcgctctcatgaagcccttag

SEQ ID NO: 5926126 - DNA, 14 bp, Homo sapiens
gtcgctgcagggag

SEQ ID NO: 5926127 - DNA, 16 bp, Homo sapiens
gtcgctgcagggagca

SEQ ID NO: 5926128 - DNA, 16 bp, Homo sapiens
gtcgctggacaaccca

SEQ ID NO: 5926129 - DNA, 17 bp, Homo sapiens
gtcgctgtgccacaggc

SEQ ID NO: 5926130 - DNA, 16 bp, Homo sapiens
gtcgcttgccaaagca

SEQ ID NO: 5926131 - DNA, 18 bp, Homo sapiens
gtcgcttgccaaagcaga

SEQ ID NO: 5926132 - DNA, 17 bp, Homo sapiens
gtcgctttctcagtgtg

SEQ ID NO: 5926133 - DNA, 22 bp, Homo sapiens
gtcgcttttggtgcctggctgg

SEQ ID NO: 5926134 - DNA, 15 bp, Homo sapiens
gtcggaacagcagat

SEQ ID NO: 5926135 - DNA, 16 bp, Homo sapiens
gtcggactgcccccag

SEQ ID NO: 5926136 - DNA, 19 bp, Homo sapiens
gtcggagaggctgtctggg

SEQ ID NO: 5926137 - DNA, 16 bp, Homo sapiens
gtcggagccctgtctc

SEQ ID NO: 5926138 - DNA, 13 bp, Homo sapiens
gtcggagctgcct

SEQ ID NO: 5926139 - DNA, 15 bp, Homo sapiens
gtcggagctgcctgc

SEQ ID NO: 5926140 - DNA, 16 bp, Homo sapiens
gtcggagctgcctgca

SEQ ID NO: 5926141 - DNA, 21 bp, Homo sapiens
gtcggagctgcctgcagcaca

SEQ ID NO: 5926142 - DNA, 16 bp, Homo sapiens
gtcggaggcttgggac

SEQ ID NO: 5926143 - DNA, 17 bp, Homo sapiens
gtcggagggctggacat

SEQ ID NO: 5926144 - DNA, 17 bp, Homo sapiens
gtcggaggtgctgtccc

SEQ ID NO: 5926145 - DNA, 16 bp, Homo sapiens
gtcggagtgtgggcgc

SEQ ID NO: 5926146 - DNA, 14 bp, Homo sapiens
gtcggatcctgtga

SEQ ID NO: 5926147 - DNA, 13 bp, Homo sapiens
gtcggatctcaca

SEQ ID NO: 5926148 - DNA, 15 bp, Homo sapiens
gtcggcatgccagga

SEQ ID NO: 5926149 - DNA, 21 bp, Homo sapiens
gtcggccacaccccagactcc

SEQ ID NO: 5926150 - DNA, 23 bp, Homo sapiens
gtcggccacaccccagactccag

SEQ ID NO: 5926151 - DNA, 15 bp, Homo sapiens
gtcggccccaccagt

SEQ ID NO: 5926152 - DNA, 19 bp, Homo sapiens
gtcggccccaccagtgcct

SEQ ID NO: 5926153 - DNA, 12 bp, Homo sapiens
gtcggccctgcg

SEQ ID NO: 5926154 - DNA, 17 bp, Homo sapiens
gtcggccgaccaggctg

SEQ ID NO: 5926155 - DNA, 20 bp, Homo sapiens
gtcggcctctaaccccaggc

SEQ ID NO: 5926156 - DNA, 22 bp, Homo sapiens
gtcggcctctaaccccaggccc

SEQ ID NO: 5926157 - DNA, 15 bp, Homo sapiens
gtcggctaagtggga

SEQ ID NO: 5926158 - DNA, 22 bp, Homo sapiens
gtcggctccagtccccagaact

SEQ ID NO: 5926159 - DNA, 18 bp, Homo sapiens
gtcggctgaccatgctca

SEQ ID NO: 5926160 - DNA, 12 bp, Homo sapiens
gtcggctgggca

SEQ ID NO: 5926161 - DNA, 13 bp, Homo sapiens
gtcggctgtgagg

SEQ ID NO: 5926162 - DNA, 18 bp, Homo sapiens
gtcgggaaattctgctgc

SEQ ID NO: 5926163 - DNA, 20 bp, Homo sapiens
gtcgggacagaccagcagca

SEQ ID NO: 5926164 - DNA, 16 bp, Homo sapiens
gtcgggacagctgtgc

SEQ ID NO: 5926165 - DNA, 17 bp, Homo sapiens
gtcgggacttgtaacat

SEQ ID NO: 5926166 - DNA, 15 bp, Homo sapiens
gtcgggagagccagg

SEQ ID NO: 5926167 - DNA, 15 bp, Homo sapiens
gtcgggagaggggac

SEQ ID NO: 5926168 - DNA, 21 bp, Homo sapiens
gtcgggagaggggacgcaggc

SEQ ID NO: 5926169 - DNA, 18 bp, Homo sapiens
gtcgggcaccagccagcg

SEQ ID NO: 5926170 - DNA, 15 bp, Homo sapiens
gtcgggcagccagca

SEQ ID NO: 5926171 - DNA, 13 bp, Homo sapiens
gtcgggcagggcc

SEQ ID NO: 5926172 - DNA, 16 bp, Homo sapiens
gtcgggcatgacacga

SEQ ID NO: 5926173 - DNA, 21 bp, Homo sapiens
gtcgggcatgagtctgtttcc

SEQ ID NO: 5926174 - DNA, 13 bp, Homo sapiens
gtcgggcccctgc

SEQ ID NO: 5926175 - DNA, 17 bp, Homo sapiens
gtcgggcccctgcctgc

SEQ ID NO: 5926176 - DNA, 21 bp, Homo sapiens
gtcgggcccttcttgctgccc

SEQ ID NO: 5926177 - DNA, 21 bp, Homo sapiens
gtcgggcgtgggtctctgggg

SEQ ID NO: 5926178 - DNA, 13 bp, Homo sapiens
gtcgggctgccag

SEQ ID NO: 5926179 - DNA, 15 bp, Homo sapiens
gtcgggctgccagcc

SEQ ID NO: 5926180 - DNA, 17 bp, Homo sapiens
gtcgggctgccagccca

SEQ ID NO: 5926181 - DNA, 15 bp, Homo sapiens
gtcgggcttccctgg

SEQ ID NO: 5926182 - DNA, 20 bp, Homo sapiens
gtcgggcttccctggcctcc

SEQ ID NO: 5926183 - DNA, 13 bp, Homo sapiens
gtcggggcaggcc

SEQ ID NO: 5926184 - DNA, 15 bp, Homo sapiens
gtcgggggctggcct

SEQ ID NO: 5926185 - DNA, 13 bp, Homo sapiens
gtcgggggtggca

SEQ ID NO: 5926186 - DNA, 13 bp, Homo sapiens
gtcggggtggggg

SEQ ID NO: 5926187 - DNA, 23 bp, Homo sapiens
gtcggggttggggtgggagggcg

SEQ ID NO: 5926188 - DNA, 11 bp, Homo sapiens
gtcgggtcccc

SEQ ID NO: 5926189 - DNA, 14 bp, Homo sapiens
gtcgggttttcaat

SEQ ID NO: 5926190 - DNA, 17 bp, Homo sapiens
gtcggtcctggtgccct

SEQ ID NO: 5926191 - DNA, 18 bp, Homo sapiens
gtcggtcctggtgccctg

SEQ ID NO: 5926192 - DNA, 13 bp, Homo sapiens
gtcggtgtcccct

SEQ ID NO: 5926193 - DNA, 12 bp, Homo sapiens
gtcgtaaagatt

SEQ ID NO: 5926194 - DNA, 14 bp, Homo sapiens
gtcgtaaagatttg

SEQ ID NO: 5926195 - DNA, 15 bp, Homo sapiens
gtcgtacattgagca

SEQ ID NO: 5926196 - DNA, 15 bp, Homo sapiens
gtcgtagttactctc

SEQ ID NO: 5926197 - DNA, 18 bp, Homo sapiens
gtcgtcaactttcctcaa

SEQ ID NO: 5926198 - DNA, 18 bp, Homo sapiens
gtcgtcacctgggcggcc

SEQ ID NO: 5926199 - DNA, 19 bp, Homo sapiens
gtcgtcactaatacacagt

SEQ ID NO: 5926200 - DNA, 22 bp, Homo sapiens
gtcgtccccagaccagtagtga

SEQ ID NO: 5926201 - DNA, 20 bp, Homo sapiens
gtcgtccccctccagtgctt

SEQ ID NO: 5926202 - DNA, 19 bp, Homo sapiens
gtcgtcgcacagtctctct

SEQ ID NO: 5926203 - DNA, 15 bp, Homo sapiens
gtcgtctggcatctc

SEQ ID NO: 5926204 - DNA, 22 bp, Homo sapiens
gtcgtcttgaacgagcagccca

SEQ ID NO: 5926205 - DNA, 23 bp, Homo sapiens
gtcgtcttgaacgagcagcccag

SEQ ID NO: 5926206 - DNA, 11 bp, Homo sapiens
gtcgtctttgt

SEQ ID NO: 5926207 - DNA, 12 bp, Homo sapiens
gtcgtgcctgtg

SEQ ID NO: 5926208 - DNA, 13 bp, Homo sapiens
gtcgtgcctgtgt

SEQ ID NO: 5926209 - DNA, 14 bp, Homo sapiens
gtcgtgcctgtgtc

SEQ ID NO: 5926210 - DNA, 23 bp, Homo sapiens
gtcgtggacacacacagactatt

SEQ ID NO: 5926211 - DNA, 17 bp, Homo sapiens
gtcgtggagatgtcttc

SEQ ID NO: 5926212 - DNA, 15 bp, Homo sapiens
gtcgtgggaaagggg

SEQ ID NO: 5926213 - DNA, 18 bp, Homo sapiens
gtcgtgggaaaggggagt

SEQ ID NO: 5926214 - DNA, 19 bp, Homo sapiens
gtcgtggggtgtgctggga

SEQ ID NO: 5926215 - DNA, 21 bp, Homo sapiens
gtcgtggggtgtgctgggagc

SEQ ID NO: 5926216 - DNA, 14 bp, Homo sapiens
gtcgtgggtgtgtg

SEQ ID NO: 5926217 - DNA, 13 bp, Homo sapiens
gtcgtgtccagcc

SEQ ID NO: 5926218 - DNA, 23 bp, Homo sapiens
gtcgttaaaaacagatttggaaa

SEQ ID NO: 5926219 - DNA, 19 bp, Homo sapiens
gtcgttgactttagggact

SEQ ID NO: 5926220 - DNA, 18 bp, Homo sapiens
gtcgtttatattgtagca

SEQ ID NO: 5926221 - DNA, 14 bp, Homo sapiens
gtcgtttatgtgtg

SEQ ID NO: 5926222 - DNA, 22 bp, Homo sapiens
gtcgtttcattcattttgtgta

SEQ ID NO: 5926223 - DNA, 13 bp, Homo sapiens
gtcgtttgaccac

SEQ ID NO: 5926224 - DNA, 19 bp, Homo sapiens
gtcgttttagtgtctgacc

SEQ ID NO: 5926225 - DNA, 19 bp, Homo sapiens
gtcgttttcataacttgct

SEQ ID NO: 5926226 - DNA, 15 bp, Homo sapiens
gtcgttttccaaaga

SEQ ID NO: 5926227 - DNA, 16 bp, Homo sapiens
gtcgttttttttttgt

SEQ ID NO: 5926228 - DNA, 21 bp, Homo sapiens
gtctaaaaagacctggccttt

SEQ ID NO: 5926229 - DNA, 23 bp, Homo sapiens
gtctaaaaagacctggcctttca

SEQ ID NO: 5926230 - DNA, 23 bp, Homo sapiens
gtctaaaataggttttccctgtt

SEQ ID NO: 5926231 - DNA, 12 bp, Homo sapiens
gtctaaacataa

SEQ ID NO: 5926232 - DNA, 11 bp, Homo sapiens
gtctaaagatc

SEQ ID NO: 5926233 - DNA, 22 bp, Homo sapiens
gtctaaagatggagtttctaag

SEQ ID NO: 5926234 - DNA, 17 bp, Homo sapiens
gtctaaagccttaacta

SEQ ID NO: 5926235 - DNA, 21 bp, Homo sapiens
gtctaaagctggtttaatgtt

SEQ ID NO: 5926236 - DNA, 23 bp, Homo sapiens
gtctaaaggggttttttgggaag

SEQ ID NO: 5926237 - DNA, 21 bp, Homo sapiens
gtctaaagtgtttagctgtca

SEQ ID NO: 5926238 - DNA, 18 bp, Homo sapiens
gtctaaagttactactga

SEQ ID NO: 5926239 - DNA, 11 bp, Homo sapiens
gtctaaagttt

SEQ ID NO: 5926240 - DNA, 13 bp, Homo sapiens
gtctaaatatttc

SEQ ID NO: 5926241 - DNA, 23 bp, Homo sapiens
gtctaaatatttccttaaactgt

SEQ ID NO: 5926242 - DNA, 23 bp, Homo sapiens
gtctaacacaccactttctgctt

SEQ ID NO: 5926243 - DNA, 23 bp, Homo sapiens
gtctaacagtttgcctgctgtat

SEQ ID NO: 5926244 - DNA, 20 bp, Homo sapiens
gtctaaccccaggttttctg

SEQ ID NO: 5926245 - DNA, 15 bp, Homo sapiens
gtctaacccccagct

SEQ ID NO: 5926246 - DNA, 19 bp, Homo sapiens
gtctaactgtggaatataa

SEQ ID NO: 5926247 - DNA, 23 bp, Homo sapiens
gtctaactttagaagtgcatttc

SEQ ID NO: 5926248 - DNA, 19 bp, Homo sapiens
gtctaagaaacattggaag

SEQ ID NO: 5926249 - DNA, 23 bp, Homo sapiens
gtctaagactatatatataaatg

SEQ ID NO: 5926250 - DNA, 21 bp, Homo sapiens
gtctaagatagtaacaatgaa

SEQ ID NO: 5926251 - DNA, 23 bp, Homo sapiens
gtctaagatagtaacaatgaaga

SEQ ID NO: 5926252 - DNA, 12 bp, Homo sapiens
gtctaagattct

SEQ ID NO: 5926253 - DNA, 23 bp, Homo sapiens
gtctaagcagttttgtaaatgta

SEQ ID NO: 5926254 - DNA, 21 bp, Homo sapiens
gtctaaggagcgctagtgcct

SEQ ID NO: 5926255 - DNA, 20 bp, Homo sapiens
gtctaaggatgctaaacctt

SEQ ID NO: 5926256 - DNA, 15 bp, Homo sapiens
gtctaagtagggcca

SEQ ID NO: 5926257 - DNA, 16 bp, Homo sapiens
gtctaagtgtaaatgt

SEQ ID NO: 5926258 - DNA, 17 bp, Homo sapiens
gtctaagtgtaaatgtt

SEQ ID NO: 5926259 - DNA, 17 bp, Homo sapiens
gtctaatcagtgattat

SEQ ID NO: 5926260 - DNA, 21 bp, Homo sapiens
gtctaatctagatatcgactt

SEQ ID NO: 5926261 - DNA, 23 bp, Homo sapiens
gtctaatctagtgacacctcagt

SEQ ID NO: 5926262 - DNA, 22 bp, Homo sapiens
gtctaattaaaacactttcaaa

SEQ ID NO: 5926263 - DNA, 13 bp, Homo sapiens
gtctaattttctt

SEQ ID NO: 5926264 - DNA, 21 bp, Homo sapiens
gtctacaaaaaggtataaata

SEQ ID NO: 5926265 - DNA, 20 bp, Homo sapiens
gtctacaaatataagatttt

SEQ ID NO: 5926266 - DNA, 20 bp, Homo sapiens
gtctacaagtatatgtgaaa

SEQ ID NO: 5926267 - DNA, 17 bp, Homo sapiens
gtctacactaagagaga

SEQ ID NO: 5926268 - DNA, 23 bp, Homo sapiens
gtctacactcacaatcatcttct

SEQ ID NO: 5926269 - DNA, 19 bp, Homo sapiens
gtctacactgcaatcatat

SEQ ID NO: 5926270 - DNA, 21 bp, Homo sapiens
gtctacactgcaatcatatgt

SEQ ID NO: 5926271 - DNA, 22 bp, Homo sapiens
gtctacactgcaatcatatgtg

SEQ ID NO: 5926272 - DNA, 18 bp, Homo sapiens
gtctcagccgagcccagg

SEQ ID NO: 5926273 - DNA, 14 bp, Homo sapiens
gtctcagcctcctc

SEQ ID NO: 5926274 - DNA, 15 bp, Homo sapiens
gtctcagcctcctca

SEQ ID NO: 5926275 - DNA, 15 bp, Homo sapiens
gtctcagcctcctga

SEQ ID NO: 5926276 - DNA, 16 bp, Homo sapiens
gtctcagcctcctgag

SEQ ID NO: 5926277 - DNA, 17 bp, Homo sapiens
gtctcagcctcctgagt

SEQ ID NO: 5926278 - DNA, 13 bp, Homo sapiens
gtctcagcctctg

SEQ ID NO: 5926279 - DNA, 14 bp, Homo sapiens
gtctcagcctctgc

SEQ ID NO: 5926280 - DNA, 16 bp, Homo sapiens
gtctcagcctctgcca

SEQ ID NO: 5926281 - DNA, 20 bp, Homo sapiens
gtctcagcctctgccagcgc

SEQ ID NO: 5926282 - DNA, 15 bp, Homo sapiens
gtctcagcctgggcc

SEQ ID NO: 5926283 - DNA, 12 bp, Homo sapiens
gtctcagctgct

SEQ ID NO: 5926284 - DNA, 17 bp, Homo sapiens
gtctcaggaggaggctg

SEQ ID NO: 5926285 - DNA, 16 bp, Homo sapiens
gtctcaggagtctctg

SEQ ID NO: 5926286 - DNA, 19 bp, Homo sapiens
gtctcaggcagcaccacac

SEQ ID NO: 5926287 - DNA, 13 bp, Homo sapiens
gtctcaggccctg

SEQ ID NO: 5926288 - DNA, 19 bp, Homo sapiens
gtctcaggcctccagcggc

SEQ ID NO: 5926289 - DNA, 18 bp, Homo sapiens
gtctcaggctcaagtttt

SEQ ID NO: 5926290 - DNA, 13 bp, Homo sapiens
gtctcaggctggt

SEQ ID NO: 5926291 - DNA, 18 bp, Homo sapiens
gtctcagggtgcagaggt

SEQ ID NO: 5926292 - DNA, 15 bp, Homo sapiens
gtctcaggtccctgc

SEQ ID NO: 5926293 - DNA, 17 bp, Homo sapiens
gtctcagtacctcccct

SEQ ID NO: 5926294 - DNA, 22 bp, Homo sapiens
gtctcagtcattgctgttgtat

SEQ ID NO: 5926295 - DNA, 12 bp, Homo sapiens
gtctcagtccag

SEQ ID NO: 5926296 - DNA, 23 bp, Homo sapiens
gtctcagtccatgaagatgtaga

SEQ ID NO: 5926297 - DNA, 11 bp, Homo sapiens
gtctcagtgaa

SEQ ID NO: 5926298 - DNA, 12 bp, Homo sapiens
gtctcagtgaag

SEQ ID NO: 5926299 - DNA, 16 bp, Homo sapiens
gtctcagtgaagacta

SEQ ID NO: 5926300 - DNA, 17 bp, Homo sapiens
gtctcagtgattcgctt

SEQ ID NO: 5926301 - DNA, 22 bp, Homo sapiens
gtctcagtgattcgcttttggt

SEQ ID NO: 5926302 - DNA, 15 bp, Homo sapiens
gtctcagtttcactt

SEQ ID NO: 5926303 - DNA, 14 bp, Homo sapiens
gtctcatagttgtg

SEQ ID NO: 5926304 - DNA, 23 bp, Homo sapiens
gtctcatcctcccattgcccagt

SEQ ID NO: 5926305 - DNA, 14 bp, Homo sapiens
gtctcatcctcctt

SEQ ID NO: 5926306 - DNA, 13 bp, Homo sapiens
gtctcatctccca

SEQ ID NO: 5926307 - DNA, 15 bp, Homo sapiens
gtctcatctcccagg

SEQ ID NO: 5926308 - DNA, 17 bp, Homo sapiens
gtctcatctcctttgct

SEQ ID NO: 5926309 - DNA, 22 bp, Homo sapiens
gtctcatctcctttgctagtgt

SEQ ID NO: 5926310 - DNA, 14 bp, Homo sapiens
gtctcatctcttca

SEQ ID NO: 5926311 - DNA, 18 bp, Homo sapiens
gtctcatctcttcaggtt

SEQ ID NO: 5926312 - DNA, 19 bp, Homo sapiens
gtctcatctcttcaggttc

SEQ ID NO: 5926313 - DNA, 14 bp, Homo sapiens
gtctcatcttctct

SEQ ID NO: 5926314 - DNA, 14 bp, Homo sapiens
gtctcatgcccact

SEQ ID NO: 5926315 - DNA, 18 bp, Homo sapiens
gtctcatgtaatttgcat

SEQ ID NO: 5926316 - DNA, 14 bp, Homo sapiens
gtctcatgtcctgc

SEQ ID NO: 5926317 - DNA, 16 bp, Homo sapiens
gtctcatgtcctgctg

SEQ ID NO: 5926318 - DNA, 17 bp, Homo sapiens
gtctcatgtcctgctgg

SEQ ID NO: 5926319 - DNA, 20 bp, Homo sapiens
gtctcatgtcctgctggctt

SEQ ID NO: 5926320 - DNA, 22 bp, Homo sapiens
gtctcatgtcctgctggcttcc

SEQ ID NO: 5926321 - DNA, 23 bp, Homo sapiens
gtctcattcgcctttgtcttgta

SEQ ID NO: 5926322 - DNA, 19 bp, Homo sapiens
gtctcattctgttgcccag

SEQ ID NO: 5926323 - DNA, 15 bp, Homo sapiens
gtctcattgccaagg

SEQ ID NO: 5926324 - DNA, 23 bp, Homo sapiens
gtctcattgccaaggcatcccca

SEQ ID NO: 5926325 - DNA, 13 bp, Homo sapiens
gtctcattgccag

SEQ ID NO: 5926326 - DNA, 15 bp, Homo sapiens
gtctcattgccagtg

SEQ ID NO: 5926327 - DNA, 16 bp, Homo sapiens
gtctcattgccagtgg

SEQ ID NO: 5926328 - DNA, 18 bp, Homo sapiens
gtctcattgcttctgact

SEQ ID NO: 5926329 - DNA, 16 bp, Homo sapiens
gtctcatttaggactg

SEQ ID NO: 5926330 - DNA, 21 bp, Homo sapiens
gtctcattttggtctgttttg

SEQ ID NO: 5926331 - DNA, 18 bp, Homo sapiens
gtctcattttgtccatgt

SEQ ID NO: 5926332 - DNA, 22 bp, Homo sapiens
gtctccaaaaaaaaaaaaaata

SEQ ID NO: 5926333 - DNA, 23 bp, Homo sapiens
gtctccaaaaaaaaaaaaaatac

SEQ ID NO: 5926334 - DNA, 17 bp, Homo sapiens
gtctccaaaacatttct

SEQ ID NO: 5926335 - DNA, 21 bp, Homo sapiens
gtctccaaccccccagcactg

SEQ ID NO: 5926336 - DNA, 23 bp, Homo sapiens
gtctccaagggagggtgcagccc

SEQ ID NO: 5926337 - DNA, 17 bp, Homo sapiens
gtctccaccaggaacct

SEQ ID NO: 5926338 - DNA, 19 bp, Homo sapiens
gtctccaccaggaacctct

SEQ ID NO: 5926339 - DNA, 16 bp, Homo sapiens
gtctccacccctcaag

SEQ ID NO: 5926340 - DNA, 14 bp, Homo sapiens
gtctccacctcagg

SEQ ID NO: 5926341 - DNA, 14 bp, Homo sapiens
gtctccacctgcac

SEQ ID NO: 5926342 - DNA, 15 bp, Homo sapiens
gtctccactgaggat

SEQ ID NO: 5926343 - DNA, 19 bp, Homo sapiens
gtctccactgtgcctttgc

SEQ ID NO: 5926344 - DNA, 15 bp, Homo sapiens
gtctccagaaagccc

SEQ ID NO: 5926345 - DNA, 21 bp, Homo sapiens
gtctccagagagaaatcaggc

SEQ ID NO: 5926346 - DNA, 19 bp, Homo sapiens
gtctccagctcctctccag

SEQ ID NO: 5926347 - DNA, 12 bp, Homo sapiens
gtctccagctgc

SEQ ID NO: 5926348 - DNA, 18 bp, Homo sapiens
gtctccagctgcctgggc

SEQ ID NO: 5926349 - DNA, 19 bp, Homo sapiens
gtctccagctgcctgggcc

SEQ ID NO: 5926350 - DNA, 13 bp, Homo sapiens
gtctccagggacc

SEQ ID NO: 5926351 - DNA, 19 bp, Homo sapiens
gtctccagggcccccaccg

SEQ ID NO: 5926352 - DNA, 20 bp, Homo sapiens
gtctccagggccccccaact

SEQ ID NO: 5926353 - DNA, 19 bp, Homo sapiens
gtctccaggggcctgcaga

SEQ ID NO: 5926354 - DNA, 15 bp, Homo sapiens
gtctccaggggctgc

SEQ ID NO: 5926355 - DNA, 16 bp, Homo sapiens
gtctccaggggctgct

SEQ ID NO: 5926356 - DNA, 21 bp, Homo sapiens
gtctccaggggctgcttcctc

SEQ ID NO: 5926357 - DNA, 18 bp, Homo sapiens
gtctccagtgttcccccc

SEQ ID NO: 5926358 - DNA, 21 bp, Homo sapiens
gtctccagttggttatctgaa

SEQ ID NO: 5926359 - DNA, 18 bp, Homo sapiens
gtctccatatcagctctc

SEQ ID NO: 5926360 - DNA, 13 bp, Homo sapiens
gtctccatctctg

SEQ ID NO: 5926361 - DNA, 14 bp, Homo sapiens
gtctccatctctgg

SEQ ID NO: 5926362 - DNA, 15 bp, Homo sapiens
gtctccatgataact

SEQ ID NO: 5926363 - DNA, 13 bp, Homo sapiens
gtctccatgtttg

SEQ ID NO: 5926364 - DNA, 16 bp, Homo sapiens
gtctccatttttccca

SEQ ID NO: 5926365 - DNA, 17 bp, Homo sapiens
gtctcccaaagtgctgg

SEQ ID NO: 5926366 - DNA, 21 bp, Homo sapiens
gtctcccacacccaccctttt

SEQ ID NO: 5926367 - DNA, 21 bp, Homo sapiens
gtctcccaccctttctgccag

SEQ ID NO: 5926368 - DNA, 14 bp, Homo sapiens
gtctcccactttct

SEQ ID NO: 5926369 - DNA, 21 bp, Homo sapiens
gtctcccaggctggagtgcag

SEQ ID NO: 5926370 - DNA, 19 bp, Homo sapiens
gtctcccagggccttaaaa

SEQ ID NO: 5926371 - DNA, 20 bp, Homo sapiens
gtctcccaggtgcatttctt

SEQ ID NO: 5926372 - DNA, 16 bp, Homo sapiens
gtctcccagtgggtga

SEQ ID NO: 5926373 - DNA, 21 bp, Homo sapiens
gtctcccagtgggtgatgctt

SEQ ID NO: 5926374 - DNA, 20 bp, Homo sapiens
gtctcccagttatgaatcag

SEQ ID NO: 5926375 - DNA, 18 bp, Homo sapiens
gtctcccatcttaactct

SEQ ID NO: 5926376 - DNA, 15 bp, Homo sapiens
gtctcccattctcat

SEQ ID NO: 5926377 - DNA, 19 bp, Homo sapiens
gtctccccacctgcactcc

SEQ ID NO: 5926378 - DNA, 16 bp, Homo sapiens
gtctccccactccacc

SEQ ID NO: 5926379 - DNA, 22 bp, Homo sapiens
gtctccccactccaccctgtta

SEQ ID NO: 5926380 - DNA, 12 bp, Homo sapiens
gtctccccatgc

SEQ ID NO: 5926381 - DNA, 16 bp, Homo sapiens
gtctccccatgctggg

SEQ ID NO: 5926382 - DNA, 18 bp, Homo sapiens
gtctccccatgctgggct

SEQ ID NO: 5926383 - DNA, 19 bp, Homo sapiens
gtctccccatgctgggctc

SEQ ID NO: 5926384 - DNA, 18 bp, Homo sapiens
gtctccccatgtgcctgc

SEQ ID NO: 5926385 - DNA, 18 bp, Homo sapiens
gtctcccccacccttgtt

SEQ ID NO: 5926386 - DNA, 12 bp, Homo sapiens
gtctcccccaga

SEQ ID NO: 5926387 - DNA, 20 bp, Homo sapiens
gtctcccccagagtgctgtc

SEQ ID NO: 5926388 - DNA, 23 bp, Homo sapiens
gtctcccccgtgttcccctcttg

SEQ ID NO: 5926389 - DNA, 19 bp, Homo sapiens
gtctccccgcagccctctc

SEQ ID NO: 5926390 - DNA, 24 bp, Homo sapiens
gtctccccgcagccctctccaccc

SEQ ID NO: 5926391 - DNA, 18 bp, Homo sapiens
gtctcccctaccaggctg

SEQ ID NO: 5926392 - DNA, 19 bp, Homo sapiens
gtctcccctgatccagaca

SEQ ID NO: 5926393 - DNA, 17 bp, Homo sapiens
gtctcccctgttcccct

SEQ ID NO: 5926394 - DNA, 19 bp, Homo sapiens
gtctcccctgttcccctct

SEQ ID NO: 5926395 - DNA, 13 bp, Homo sapiens
gtctccccttcct

SEQ ID NO: 5926396 - DNA, 21 bp, Homo sapiens
gtctcccctttccccgcgtcc

SEQ ID NO: 5926397 - DNA, 20 bp, Homo sapiens
gtctcccgattcccaactga

SEQ ID NO: 5926398 - DNA, 18 bp, Homo sapiens
gtctcccgtgcatgctct

SEQ ID NO: 5926399 - DNA, 23 bp, Homo sapiens
gtctcccgtgcatgctctgcagc

SEQ ID NO: 5926400 - DNA, 15 bp, Homo sapiens
gtctccctaaaataa

SEQ ID NO: 5926401 - DNA, 19 bp, Homo sapiens
gtctccctaaaataaaaac

SEQ ID NO: 5926402 - DNA, 20 bp, Homo sapiens
gtctccctacttagacccag

SEQ ID NO: 5926403 - DNA, 17 bp, Homo sapiens
gtctccctccagctgga

SEQ ID NO: 5926404 - DNA, 16 bp, Homo sapiens
gtctccctcccctctc

SEQ ID NO: 5926405 - DNA, 19 bp, Homo sapiens
gtctccctcccctctcaga

SEQ ID NO: 5926406 - DNA, 23 bp, Homo sapiens
gtctccctcccctctcagaacat

SEQ ID NO: 5926407 - DNA, 12 bp, Homo sapiens
gtctccctcctg

SEQ ID NO: 5926408 - DNA, 13 bp, Homo sapiens
gtctccctcctga

SEQ ID NO: 5926409 - DNA, 10 bp, Homo sapiens
gtctccctcg

SEQ ID NO: 5926410 - DNA, 18 bp, Homo sapiens
gtctccctctcctgccta

SEQ ID NO: 5926411 - DNA, 13 bp, Homo sapiens
gtctccctctgat

SEQ ID NO: 5926412 - DNA, 14 bp, Homo sapiens
gtctccctgagcct

SEQ ID NO: 5926413 - DNA, 14 bp, Homo sapiens
gtctccctgatgga

SEQ ID NO: 5926414 - DNA, 13 bp, Homo sapiens
gtctccctgcaca

SEQ ID NO: 5926415 - DNA, 15 bp, Homo sapiens
gtctccctgcacagc

SEQ ID NO: 5926416 - DNA, 19 bp, Homo sapiens
gtctccctgcacagcctct

SEQ ID NO: 5926417 - DNA, 20 bp, Homo sapiens
gtctccctggatcagaacag

SEQ ID NO: 5926418 - DNA, 11 bp, Homo sapiens
gtctccctggc

SEQ ID NO: 5926419 - DNA, 17 bp, Homo sapiens
gtctccctggccccagt

SEQ ID NO: 5926420 - DNA, 14 bp, Homo sapiens
gtctccctggccct

SEQ ID NO: 5926421 - DNA, 16 bp, Homo sapiens
gtctccctggccctca

SEQ ID NO: 5926422 - DNA, 12 bp, Homo sapiens
gtctccctggct

SEQ ID NO: 5926423 - DNA, 14 bp, Homo sapiens
gtctccctggctcc

SEQ ID NO: 5926424 - DNA, 20 bp, Homo sapiens
gtctccctgggcaccctgca

SEQ ID NO: 5926425 - DNA, 23 bp, Homo sapiens
gtctccctgggcaccctgcaggc

SEQ ID NO: 5926426 - DNA, 18 bp, Homo sapiens
gtctccctggtgcctctg

SEQ ID NO: 5926427 - DNA, 21 bp, Homo sapiens
gtctccctggtggggtgtgca

SEQ ID NO: 5926428 - DNA, 22 bp, Homo sapiens
gtctccctggttgcctctcttg

SEQ ID NO: 5926429 - DNA, 15 bp, Homo sapiens
gtctccctgtgttac

SEQ ID NO: 5926430 - DNA, 13 bp, Homo sapiens
gtctcccttctcc

SEQ ID NO: 5926431 - DNA, 15 bp, Homo sapiens
gtctcccttctccca

SEQ ID NO: 5926432 - DNA, 19 bp, Homo sapiens
gtctcccttctcccatgag

SEQ ID NO: 5926433 - DNA, 16 bp, Homo sapiens
gtctcccttctctctc

SEQ ID NO: 5926434 - DNA, 14 bp, Homo sapiens
gtctcccttctgtt

SEQ ID NO: 5926435 - DNA, 23 bp, Homo sapiens
gtctcccttcttgggtagggcag

SEQ ID NO: 5926436 - DNA, 18 bp, Homo sapiens
gtctccctttcccttctt

SEQ ID NO: 5926437 - DNA, 16 bp, Homo sapiens
gtctccgaaatgctgt

SEQ ID NO: 5926438 - DNA, 15 bp, Homo sapiens
gtctccgcctttcta

SEQ ID NO: 5926439 - DNA, 18 bp, Homo sapiens
gtctccgcctttctaatc

SEQ ID NO: 5926440 - DNA, 20 bp, Homo sapiens
gtctcctaagctggagtgca

SEQ ID NO: 5926441 - DNA, 17 bp, Homo sapiens
gtctcctacctgctgct

SEQ ID NO: 5926442 - DNA, 18 bp, Homo sapiens
gtctcctacctgctgctg

SEQ ID NO: 5926443 - DNA, 21 bp, Homo sapiens
gtctcctacctgctgctgcta

SEQ ID NO: 5926444 - DNA, 19 bp, Homo sapiens
gtctcctacgcaccatttt

SEQ ID NO: 5926445 - DNA, 14 bp, Homo sapiens
gtctcctactcctg

SEQ ID NO: 5926446 - DNA, 15 bp, Homo sapiens
gtctcctactcctga

SEQ ID NO: 5926447 - DNA, 16 bp, Homo sapiens
gtctcctactctgtgt

SEQ ID NO: 5926448 - DNA, 18 bp, Homo sapiens
gtctcctaggggcttggt

SEQ ID NO: 5926449 - DNA, 21 bp, Homo sapiens
gtctcctaggggcttggtcct

SEQ ID NO: 5926450 - DNA, 18 bp, Homo sapiens
gtctcctatcctggtttt

SEQ ID NO: 5926451 - DNA, 12 bp, Homo sapiens
gtctgatgtttg

SEQ ID NO: 5926452 - DNA, 13 bp, Homo sapiens
gtctgatgttttg

SEQ ID NO: 5926453 - DNA, 21 bp, Homo sapiens
gtctgatgttttgatgccatt

SEQ ID NO: 5926454 - DNA, 21 bp, Homo sapiens
gtctgattcccaagctctgct

SEQ ID NO: 5926455 - DNA, 22 bp, Homo sapiens
gtctgattctatgcctgtattt

SEQ ID NO: 5926456 - DNA, 12 bp, Homo sapiens
gtctgattggct

SEQ ID NO: 5926457 - DNA, 13 bp, Homo sapiens
gtctgattggctg

SEQ ID NO: 5926458 - DNA, 14 bp, Homo sapiens
gtctgattggctgc

SEQ ID NO: 5926459 - DNA, 15 bp, Homo sapiens
gtctgattggctgct

SEQ ID NO: 5926460 - DNA, 20 bp, Homo sapiens
gtctgattgttcctccccag

SEQ ID NO: 5926461 - DNA, 20 bp, Homo sapiens
gtctgatttatggttttttt

SEQ ID NO: 5926462 - DNA, 22 bp, Homo sapiens
gtctgatttcaggatactctgt

SEQ ID NO: 5926463 - DNA, 13 bp, Homo sapiens
gtctgatttctta

SEQ ID NO: 5926464 - DNA, 18 bp, Homo sapiens
gtctgatttttaaagtac

SEQ ID NO: 5926465 - DNA, 21 bp, Homo sapiens
gtctgatttttaaagtacttt

SEQ ID NO: 5926466 - DNA, 21 bp, Homo sapiens
gtctgcaaaatgaggaatgta

SEQ ID NO: 5926467 - DNA, 20 bp, Homo sapiens
gtctgcaaaggagggcctca

SEQ ID NO: 5926468 - DNA, 23 bp, Homo sapiens
gtctgcaaaggagggcctcagag

SEQ ID NO: 5926469 - DNA, 18 bp, Homo sapiens
gtctgcaagggcccagag

SEQ ID NO: 5926470 - DNA, 19 bp, Homo sapiens
gtctgcaagggcccagagt

SEQ ID NO: 5926471 - DNA, 17 bp, Homo sapiens
gtctgcaagtcagagga

SEQ ID NO: 5926472 - DNA, 21 bp, Homo sapiens
gtctgcacacataacacacat

SEQ ID NO: 5926473 - DNA, 15 bp, Homo sapiens
gtctgcacagagggt

SEQ ID NO: 5926474 - DNA, 15 bp, Homo sapiens
gtctgcacctccgct

SEQ ID NO: 5926475 - DNA, 14 bp, Homo sapiens
gtctgcaccttaga

SEQ ID NO: 5926476 - DNA, 16 bp, Homo sapiens
gtctgcaccttagaaa

SEQ ID NO: 5926477 - DNA, 20 bp, Homo sapiens
gtctgcaccttagaaaaaaa

SEQ ID NO: 5926478 - DNA, 14 bp, Homo sapiens
gtctgcacttaaat

SEQ ID NO: 5926479 - DNA, 13 bp, Homo sapiens
gtctgcagcctgc

SEQ ID NO: 5926480 - DNA, 15 bp, Homo sapiens
gtctgcagcctgctg

SEQ ID NO: 5926481 - DNA, 16 bp, Homo sapiens
gtctgcagcctgctgg

SEQ ID NO: 5926482 - DNA, 22 bp, Homo sapiens
gtctgcagctattcacacacac

SEQ ID NO: 5926483 - DNA, 21 bp, Homo sapiens
gtctgcagctcaagggctggc

SEQ ID NO: 5926484 - DNA, 23 bp, Homo sapiens
gtctgcagctcaagggctggcac

SEQ ID NO: 5926485 - DNA, 16 bp, Homo sapiens
gtctgcagctcctgga

SEQ ID NO: 5926486 - DNA, 12 bp, Homo sapiens
gtctgcagctgt

SEQ ID NO: 5926487 - DNA, 22 bp, Homo sapiens
gtctgcaggattgattatgcag

SEQ ID NO: 5926488 - DNA, 12 bp, Homo sapiens
gtctgcaggcag

SEQ ID NO: 5926489 - DNA, 13 bp, Homo sapiens
gtctgcaggccac

SEQ ID NO: 5926490 - DNA, 15 bp, Homo sapiens
gtctgcaggccacca

SEQ ID NO: 5926491 - DNA, 18 bp, Homo sapiens
gtctgcaggggcctggag

SEQ ID NO: 5926492 - DNA, 21 bp, Homo sapiens
gtctgcaggtgggctgctgag

SEQ ID NO: 5926493 - DNA, 15 bp, Homo sapiens
gtctgcaggtgtctg

SEQ ID NO: 5926494 - DNA, 14 bp, Homo sapiens
gtctgcagtcctgg

SEQ ID NO: 5926495 - DNA, 17 bp, Homo sapiens
gtctgcagtgcccggct

SEQ ID NO: 5926496 - DNA, 19 bp, Homo sapiens
gtctgcatacgagagactt

SEQ ID NO: 5926497 - DNA, 14 bp, Homo sapiens
gtctgcatttcata

SEQ ID NO: 5926498 - DNA, 18 bp, Homo sapiens
gtctgcatttcatattat

SEQ ID NO: 5926499 - DNA, 16 bp, Homo sapiens
gtctgcattttctcag

SEQ ID NO: 5926500 - DNA, 15 bp, Homo sapiens
gtctgccaaacacat

SEQ ID NO: 5926501 - DNA, 21 bp, Homo sapiens
gtctgccaacctaaaactctt

SEQ ID NO: 5926502 - DNA, 22 bp, Homo sapiens
gtctgccaatctgtacaaaatg

SEQ ID NO: 5926503 - DNA, 21 bp, Homo sapiens
gtctgccaatttttgccttca

SEQ ID NO: 5926504 - DNA, 22 bp, Homo sapiens
gtctgccaccagcgcccccact

SEQ ID NO: 5926505 - DNA, 15 bp, Homo sapiens
gtctgccagccagca

SEQ ID NO: 5926506 - DNA, 20 bp, Homo sapiens
gtctgccagctgggcccagc

SEQ ID NO: 5926507 - DNA, 12 bp, Homo sapiens
gtctgccaggca

SEQ ID NO: 5926508 - DNA, 15 bp, Homo sapiens
gtctgccaggcactc

SEQ ID NO: 5926509 - DNA, 20 bp, Homo sapiens
gtctgccaggcactctcatc

SEQ ID NO: 5926510 - DNA, 21 bp, Homo sapiens
gtctgccaggcccatctcagg

SEQ ID NO: 5926511 - DNA, 21 bp, Homo sapiens
gtctgccaggcccccaccaca

SEQ ID NO: 5926512 - DNA, 12 bp, Homo sapiens
gtctgccagggc

SEQ ID NO: 5926513 - DNA, 13 bp, Homo sapiens
gtctgccagggcc

SEQ ID NO: 5926514 - DNA, 22 bp, Homo sapiens
gtctgccaggggtaacctggcc

SEQ ID NO: 5926515 - DNA, 18 bp, Homo sapiens
gtctgccccaagttttgt

SEQ ID NO: 5926516 - DNA, 19 bp, Homo sapiens
gtctgccccaagttttgtg

SEQ ID NO: 5926517 - DNA, 15 bp, Homo sapiens
gtctgccccacatgt

SEQ ID NO: 5926518 - DNA, 17 bp, Homo sapiens
gtctgccccacatgtgg

SEQ ID NO: 5926519 - DNA, 13 bp, Homo sapiens
gtctgccccaccc

SEQ ID NO: 5926520 - DNA, 14 bp, Homo sapiens
gtctgccccaccct

SEQ ID NO: 5926521 - DNA, 15 bp, Homo sapiens
gtctgccccctcctg

SEQ ID NO: 5926522 - DNA, 19 bp, Homo sapiens
gtctgccccttgaccccac

SEQ ID NO: 5926523 - DNA, 15 bp, Homo sapiens
gtctgccctgcccat

SEQ ID NO: 5926524 - DNA, 23 bp, Homo sapiens
gtctgccggacccggaggccgag

SEQ ID NO: 5926525 - DNA, 22 bp, Homo sapiens
gtctgcctagatccacgtgtgg

SEQ ID NO: 5926526 - DNA, 17 bp, Homo sapiens
gtctgcctaggagctgg

SEQ ID NO: 5926527 - DNA, 22 bp, Homo sapiens
gtctgcctcccacgctgggaca

SEQ ID NO: 5926528 - DNA, 16 bp, Homo sapiens
gtctgcctcctgcttt

SEQ ID NO: 5926529 - DNA, 12 bp, Homo sapiens
gtctgcctctcc

SEQ ID NO: 5926530 - DNA, 17 bp, Homo sapiens
gtctgcctgcctcatgc

SEQ ID NO: 5926531 - DNA, 20 bp, Homo sapiens
gtctgcctgcctcatgctct

SEQ ID NO: 5926532 - DNA, 12 bp, Homo sapiens
gtctgcctggag

SEQ ID NO: 5926533 - DNA, 11 bp, Homo sapiens
gtctgcctgta

SEQ ID NO: 5926534 - DNA, 15 bp, Homo sapiens
gtctgcctgtatttt

SEQ ID NO: 5926535 - DNA, 15 bp, Homo sapiens
gtctgcctgtcccca

SEQ ID NO: 5926536 - DNA, 13 bp, Homo sapiens
gtctgccttaaag

SEQ ID NO: 5926537 - DNA, 13 bp, Homo sapiens
gtctgccttcaca

SEQ ID NO: 5926538 - DNA, 23 bp, Homo sapiens
gtctgccttctgctgaaagactc

SEQ ID NO: 5926539 - DNA, 15 bp, Homo sapiens
gtctgcgaagtccta

SEQ ID NO: 5926540 - DNA, 17 bp, Homo sapiens
gtctgcgattttatctg

SEQ ID NO: 5926541 - DNA, 20 bp, Homo sapiens
gtctgcgccccgcctcccca

SEQ ID NO: 5926542 - DNA, 14 bp, Homo sapiens
gtctgcgccgctgt

SEQ ID NO: 5926543 - DNA, 22 bp, Homo sapiens
gtctgcgcctgaaaagggcgga

SEQ ID NO: 5926544 - DNA, 15 bp, Homo sapiens
gtctgcgtgggtcag

SEQ ID NO: 5926545 - DNA, 16 bp, Homo sapiens
gtctgcgtgggtcaga

SEQ ID NO: 5926546 - DNA, 17 bp, Homo sapiens
gtctgctaaataaacat

SEQ ID NO: 5926547 - DNA, 15 bp, Homo sapiens
gtctgctatattttc

SEQ ID NO: 5926548 - DNA, 22 bp, Homo sapiens
gtctgctcataggacctgcatc

SEQ ID NO: 5926549 - DNA, 16 bp, Homo sapiens
gtctgctccaatgact

SEQ ID NO: 5926550 - DNA, 13 bp, Homo sapiens
gtctgctccacca

SEQ ID NO: 5926551 - DNA, 14 bp, Homo sapiens
gtctgctccagctc

SEQ ID NO: 5926552 - DNA, 16 bp, Homo sapiens
gtctgctccagctctg

SEQ ID NO: 5926553 - DNA, 21 bp, Homo sapiens
gtctgctcctgaaccagtcct

SEQ ID NO: 5926554 - DNA, 21 bp, Homo sapiens
gtctgctcgggcccaggccat

SEQ ID NO: 5926555 - DNA, 17 bp, Homo sapiens
gtctgctctcaaggatg

SEQ ID NO: 5926556 - DNA, 14 bp, Homo sapiens
gtctgctctcagct

SEQ ID NO: 5926557 - DNA, 22 bp, Homo sapiens
gtctgctctcagcttgtgcctt

SEQ ID NO: 5926558 - DNA, 13 bp, Homo sapiens
gtctgctctgctg

SEQ ID NO: 5926559 - DNA, 14 bp, Homo sapiens
gtctgctctgctgc

SEQ ID NO: 5926560 - DNA, 12 bp, Homo sapiens
gtctgctctggt

SEQ ID NO: 5926561 - DNA, 14 bp, Homo sapiens
gtctgctctgtgcc

SEQ ID NO: 5926562 - DNA, 19 bp, Homo sapiens
gtctgctgaataataaact

SEQ ID NO: 5926563 - DNA, 19 bp, Homo sapiens
gtctgctgccgcaggagca

SEQ ID NO: 5926564 - DNA, 12 bp, Homo sapiens
gtctgctgcctc

SEQ ID NO: 5926565 - DNA, 16 bp, Homo sapiens
gtctgctgctcccagc

SEQ ID NO: 5926566 - DNA, 17 bp, Homo sapiens
gtctgcttaaagcttcc

SEQ ID NO: 5926567 - DNA, 12 bp, Homo sapiens
gtctgcttctgt

SEQ ID NO: 5926568 - DNA, 19 bp, Homo sapiens
gtctgcttctgtccaggac

SEQ ID NO: 5926569 - DNA, 19 bp, Homo sapiens
gtctgctttcactgtgact

SEQ ID NO: 5926570 - DNA, 17 bp, Homo sapiens
gtctgcttttgctgggg

SEQ ID NO: 5926571 - DNA, 12 bp, Homo sapiens
gtctggaaacag

SEQ ID NO: 5926572 - DNA, 20 bp, Homo sapiens
gtctggaaagtgatgtcaga

SEQ ID NO: 5926573 - DNA, 16 bp, Homo sapiens
gtctggaactgctgct

SEQ ID NO: 5926574 - DNA, 18 bp, Homo sapiens
gtctggaactgctgctga

SEQ ID NO: 5926575 - DNA, 21 bp, Homo sapiens
gtctggaactgctgctgaccc

SEQ ID NO: 5926576 - DNA, 22 bp, Homo sapiens
gtctggaagaagaggaggaaga

SEQ ID NO: 5926577 - DNA, 23 bp, Homo sapiens
gtctggaagaagaggaggaagac

SEQ ID NO: 5926578 - DNA, 17 bp, Homo sapiens
gtctggaagctgagcag

SEQ ID NO: 5926579 - DNA, 17 bp, Homo sapiens
gtctggaatcccagctc

SEQ ID NO: 5926580 - DNA, 19 bp, Homo sapiens
gtctggaatcccagctccg

SEQ ID NO: 5926581 - DNA, 21 bp, Homo sapiens
gtctggaatcccagctccgct

SEQ ID NO: 5926582 - DNA, 13 bp, Homo sapiens
gtctggaatggac

SEQ ID NO: 5926583 - DNA, 15 bp, Homo sapiens
gtctggaatggactg

SEQ ID NO: 5926584 - DNA, 17 bp, Homo sapiens
gtctggaatggactggg

SEQ ID NO: 5926585 - DNA, 22 bp, Homo sapiens
gtctggactatattgggactgg

SEQ ID NO: 5926586 - DNA, 16 bp, Homo sapiens
gtctggactgctattc

SEQ ID NO: 5926587 - DNA, 23 bp, Homo sapiens
gtctggactttgcttcccctcca

SEQ ID NO: 5926588 - DNA, 14 bp, Homo sapiens
gtctggagaagcag

SEQ ID NO: 5926589 - DNA, 24 bp, Homo sapiens
gtctggagcccctatcctgcaccc

SEQ ID NO: 5926590 - DNA, 19 bp, Homo sapiens
gtctggagcctgcaggcag

SEQ ID NO: 5926591 - DNA, 10 bp, Homo sapiens
gtctggagct

SEQ ID NO: 5926592 - DNA, 11 bp, Homo sapiens
gtctggagggg

SEQ ID NO: 5926593 - DNA, 17 bp, Homo sapiens
gtctggaggggcccctg

SEQ ID NO: 5926594 - DNA, 18 bp, Homo sapiens
gtctggaggggcccctgc

SEQ ID NO: 5926595 - DNA, 13 bp, Homo sapiens
gtctggagtccca

SEQ ID NO: 5926596 - DNA, 18 bp, Homo sapiens
gtctggagtcccacccgg

SEQ ID NO: 5926597 - DNA, 21 bp, Homo sapiens
gtctggagtcccacccggaca

SEQ ID NO: 5926598 - DNA, 14 bp, Homo sapiens
gtctggagtgggca

SEQ ID NO: 5926599 - DNA, 21 bp, Homo sapiens
gtctggagtggtaacagctct

SEQ ID NO: 5926600 - DNA, 21 bp, Homo sapiens
gtctggagttgatctggaacc

SEQ ID NO: 5926601 - DNA, 16 bp, Homo sapiens
gtctggataatttgta

SEQ ID NO: 5926602 - DNA, 22 bp, Homo sapiens
gtctggatcccgaggtatggca

SEQ ID NO: 5926603 - DNA, 14 bp, Homo sapiens
gtctggatgggagg

SEQ ID NO: 5926604 - DNA, 15 bp, Homo sapiens
gtctggatgggagga

SEQ ID NO: 5926605 - DNA, 19 bp, Homo sapiens
gtctggatgggaggagagc

SEQ ID NO: 5926606 - DNA, 16 bp, Homo sapiens
gtctggattttcaaag

SEQ ID NO: 5926607 - DNA, 17 bp, Homo sapiens
gtctggattttcaaaga

SEQ ID NO: 5926608 - DNA, 16 bp, Homo sapiens
gtctggcaatgccaca

SEQ ID NO: 5926609 - DNA, 18 bp, Homo sapiens
gtctggcaatgccacagc

SEQ ID NO: 5926610 - DNA, 23 bp, Homo sapiens
gtctggcaatgccacagccctgt

SEQ ID NO: 5926611 - DNA, 19 bp, Homo sapiens
gtctggcagagcctctgag

SEQ ID NO: 5926612 - DNA, 18 bp, Homo sapiens
gtctggcagatgagggct

SEQ ID NO: 5926613 - DNA, 19 bp, Homo sapiens
gtctggcagtttatattta

SEQ ID NO: 5926614 - DNA, 22 bp, Homo sapiens
gtctggccaatatggagaaacc

SEQ ID NO: 5926615 - DNA, 15 bp, Homo sapiens
gtctggccagggagg

SEQ ID NO: 5926616 - DNA, 15 bp, Homo sapiens
gtctggcccaccagg

SEQ ID NO: 5926617 - DNA, 19 bp, Homo sapiens
gtctggcccagccatggct

SEQ ID NO: 5926618 - DNA, 17 bp, Homo sapiens
gtctggcccccctggtc

SEQ ID NO: 5926619 - DNA, 15 bp, Homo sapiens
gtctggcccctccgc

SEQ ID NO: 5926620 - DNA, 12 bp, Homo sapiens
gtctggcctgag

SEQ ID NO: 5926621 - DNA, 15 bp, Homo sapiens
gtctggcctgccagg

SEQ ID NO: 5926622 - DNA, 18 bp, Homo sapiens
gtctggcgttgtggggat

SEQ ID NO: 5926623 - DNA, 18 bp, Homo sapiens
gtctggctagagggccca

SEQ ID NO: 5926624 - DNA, 14 bp, Homo sapiens
gtctggctaggggc

SEQ ID NO: 5926625 - DNA, 17 bp, Homo sapiens
gtctggctccctgcccc

SEQ ID NO: 5926626 - DNA, 19 bp, Homo sapiens
gtctggctgagcccctggg

SEQ ID NO: 5926627 - DNA, 12 bp, Homo sapiens
gtctggctgcag

SEQ ID NO: 5926628 - DNA, 14 bp, Homo sapiens
gtctggctgcagag

SEQ ID NO: 5926629 - DNA, 14 bp, Homo sapiens
gtctggctggtgtt

SEQ ID NO: 5926630 - DNA, 12 bp, Homo sapiens
gtcttccctggg

SEQ ID NO: 5926631 - DNA, 16 bp, Homo sapiens
gtcttccctgggctgc

SEQ ID NO: 5926632 - DNA, 22 bp, Homo sapiens
gtcttccgatcaacatttatga

SEQ ID NO: 5926633 - DNA, 19 bp, Homo sapiens
gtcttccgcccctgcctgc

SEQ ID NO: 5926634 - DNA, 21 bp, Homo sapiens
gtcttccgcccctgcctgcca

SEQ ID NO: 5926635 - DNA, 19 bp, Homo sapiens
gtcttccggggccatgggc

SEQ ID NO: 5926636 - DNA, 14 bp, Homo sapiens
gtcttccgtctccc

SEQ ID NO: 5926637 - DNA, 21 bp, Homo sapiens
gtcttcctaattgtgccccta

SEQ ID NO: 5926638 - DNA, 16 bp, Homo sapiens
gtcttcctactcttct

SEQ ID NO: 5926639 - DNA, 13 bp, Homo sapiens
gtcttcctcccaa

SEQ ID NO: 5926640 - DNA, 14 bp, Homo sapiens
gtcttcctcccaag

SEQ ID NO: 5926641 - DNA, 14 bp, Homo sapiens
gtcttcctctgcaa

SEQ ID NO: 5926642 - DNA, 15 bp, Homo sapiens
gtcttcctctgcaag

SEQ ID NO: 5926643 - DNA, 19 bp, Homo sapiens
gtcttcctctgcaagtgct

SEQ ID NO: 5926644 - DNA, 14 bp, Homo sapiens
gtcttcctctgtct

SEQ ID NO: 5926645 - DNA, 16 bp, Homo sapiens
gtcttcctcttagcct

SEQ ID NO: 5926646 - DNA, 19 bp, Homo sapiens
gtcttcctcttagcctctg

SEQ ID NO: 5926647 - DNA, 22 bp, Homo sapiens
gtcttcctcttagcctctggat

SEQ ID NO: 5926648 - DNA, 18 bp, Homo sapiens
gtcttcctgaaatgcagt

SEQ ID NO: 5926649 - DNA, 14 bp, Homo sapiens
gtcttcctgacact

SEQ ID NO: 5926650 - DNA, 20 bp, Homo sapiens
gtcttcctgcattcacccag

SEQ ID NO: 5926651 - DNA, 14 bp, Homo sapiens
gtcttcctgtagtg

SEQ ID NO: 5926652 - DNA, 22 bp, Homo sapiens
gtcttcctgtggctccctctct

SEQ ID NO: 5926653 - DNA, 23 bp, Homo sapiens
gtcttcctgtggctccctctctc

SEQ ID NO: 5926654 - DNA, 15 bp, Homo sapiens
gtcttccttaaatga

SEQ ID NO: 5926655 - DNA, 19 bp, Homo sapiens
gtcttcctttgcttccctt

SEQ ID NO: 5926656 - DNA, 17 bp, Homo sapiens
gtcttcgctggctccta

SEQ ID NO: 5926657 - DNA, 14 bp, Homo sapiens
gtcttcgtacagtt

SEQ ID NO: 5926658 - DNA, 15 bp, Homo sapiens
gtcttctaactttat

SEQ ID NO: 5926659 - DNA, 13 bp, Homo sapiens
gtcttctaatttc

SEQ ID NO: 5926660 - DNA, 20 bp, Homo sapiens
gtcttctactgccttgaaaa

SEQ ID NO: 5926661 - DNA, 21 bp, Homo sapiens
gtcttctactgccttgaaaaa

SEQ ID NO: 5926662 - DNA, 15 bp, Homo sapiens
gtcttctagtttaga

SEQ ID NO: 5926663 - DNA, 12 bp, Homo sapiens
gtcttctattta

SEQ ID NO: 5926664 - DNA, 17 bp, Homo sapiens
gtcttctatttatttat

SEQ ID NO: 5926665 - DNA, 22 bp, Homo sapiens
gtcttctcaggctctgccctgc

SEQ ID NO: 5926666 - DNA, 17 bp, Homo sapiens
gtcttctcatagcatta

SEQ ID NO: 5926667 - DNA, 20 bp, Homo sapiens
gtcttctccaacaccacctc

SEQ ID NO: 5926668 - DNA, 20 bp, Homo sapiens
gtcttctccaccacgctggg

SEQ ID NO: 5926669 - DNA, 19 bp, Homo sapiens
gtcttctcccaactcagcc

SEQ ID NO: 5926670 - DNA, 20 bp, Homo sapiens
gtcttctcccaactcagcct

SEQ ID NO: 5926671 - DNA, 23 bp, Homo sapiens
gtcttctcccaactcagcctgtt

SEQ ID NO: 5926672 - DNA, 15 bp, Homo sapiens
gtcttctcccagagc

SEQ ID NO: 5926673 - DNA, 13 bp, Homo sapiens
gtcttctccctgt

SEQ ID NO: 5926674 - DNA, 14 bp, Homo sapiens
gtcttctccctgtc

SEQ ID NO: 5926675 - DNA, 13 bp, Homo sapiens
gtcttctctatcc

SEQ ID NO: 5926676 - DNA, 18 bp, Homo sapiens
gtcttctctatcctctct

SEQ ID NO: 5926677 - DNA, 14 bp, Homo sapiens
gtcttctctccact

SEQ ID NO: 5926678 - DNA, 24 bp, Homo sapiens
gtcttctgagcgagtgctctcact

SEQ ID NO: 5926679 - DNA, 17 bp, Homo sapiens
gtcttctgcctgttata

SEQ ID NO: 5926680 - DNA, 13 bp, Homo sapiens
gtcttctgctttg

SEQ ID NO: 5926681 - DNA, 18 bp, Homo sapiens
gtcttctgggctgcggga

SEQ ID NO: 5926682 - DNA, 12 bp, Homo sapiens
gtcttctggtct

SEQ ID NO: 5926683 - DNA, 17 bp, Homo sapiens
gtcttctggtctgtgtg

SEQ ID NO: 5926684 - DNA, 22 bp, Homo sapiens
gtcttctggtctgtgtgtgttc

SEQ ID NO: 5926685 - DNA, 18 bp, Homo sapiens
gtcttctgtatataaatg

SEQ ID NO: 5926686 - DNA, 20 bp, Homo sapiens
gtcttctgtatataaatggg

SEQ ID NO: 5926687 - DNA, 12 bp, Homo sapiens
gtcttctgttcc

SEQ ID NO: 5926688 - DNA, 17 bp, Homo sapiens
gtcttcttacttggaac

SEQ ID NO: 5926689 - DNA, 20 bp, Homo sapiens
gtcttcttacttggaactga

SEQ ID NO: 5926690 - DNA, 17 bp, Homo sapiens
gtcttcttatctaaacc

SEQ ID NO: 5926691 - DNA, 15 bp, Homo sapiens
gtcttcttgtgtcct

SEQ ID NO: 5926692 - DNA, 15 bp, Homo sapiens
gtcttctttctccat

SEQ ID NO: 5926693 - DNA, 23 bp, Homo sapiens
gtcttctttctccatggagccta

SEQ ID NO: 5926694 - DNA, 16 bp, Homo sapiens
gtcttctttctcctgt

SEQ ID NO: 5926695 - DNA, 17 bp, Homo sapiens
gtcttctttgcccacaa

SEQ ID NO: 5926696 - DNA, 20 bp, Homo sapiens
gtcttctttgcccacaatgc

SEQ ID NO: 5926697 - DNA, 15 bp, Homo sapiens
gtcttgaaaactgtg

SEQ ID NO: 5926698 - DNA, 12 bp, Homo sapiens
gtcttgaaagat

SEQ ID NO: 5926699 - DNA, 16 bp, Homo sapiens
gtcttgaaagtggcac

SEQ ID NO: 5926700 - DNA, 19 bp, Homo sapiens
gtcttgaaatgaaagggaa

SEQ ID NO: 5926701 - DNA, 21 bp, Homo sapiens
gtcttgaaatgaaagggaaac

SEQ ID NO: 5926702 - DNA, 22 bp, Homo sapiens
gtcttgaacgagcagcccaggg

SEQ ID NO: 5926703 - DNA, 22 bp, Homo sapiens
gtcttgaactcctgacctcagg

SEQ ID NO: 5926704 - DNA, 15 bp, Homo sapiens
gtcttgaactcctgg

SEQ ID NO: 5926705 - DNA, 16 bp, Homo sapiens
gtcttgaactcctggc

SEQ ID NO: 5926706 - DNA, 17 bp, Homo sapiens
gtcttgaactcctggcc

SEQ ID NO: 5926707 - DNA, 20 bp, Homo sapiens
gtcttgaactcctgggctca

SEQ ID NO: 5926708 - DNA, 18 bp, Homo sapiens
gtcttgaactcttggcct

SEQ ID NO: 5926709 - DNA, 16 bp, Homo sapiens
gtcttgaagtcctggc

SEQ ID NO: 5926710 - DNA, 22 bp, Homo sapiens
gtcttgaagttgggtgtttcca

SEQ ID NO: 5926711 - DNA, 15 bp, Homo sapiens
gtcttgacctctcca

SEQ ID NO: 5926712 - DNA, 21 bp, Homo sapiens
gtcttgacgggagcattggcc

SEQ ID NO: 5926713 - DNA, 12 bp, Homo sapiens
gtcttgactcat

SEQ ID NO: 5926714 - DNA, 19 bp, Homo sapiens
gtcttgactcatggcagct

SEQ ID NO: 5926715 - DNA, 22 bp, Homo sapiens
gtcttgactcatggcagctgtt

SEQ ID NO: 5926716 - DNA, 14 bp, Homo sapiens
gtcttgagaaatac

SEQ ID NO: 5926717 - DNA, 18 bp, Homo sapiens
gtcttgagagaaaagaaa

SEQ ID NO: 5926718 - DNA, 22 bp, Homo sapiens
gtcttgagcaatgtttttctca

SEQ ID NO: 5926719 - DNA, 14 bp, Homo sapiens
gtcttgagccagta

SEQ ID NO: 5926720 - DNA, 16 bp, Homo sapiens
gtcttgagtgggcccc

SEQ ID NO: 5926721 - DNA, 19 bp, Homo sapiens
gtcttgagtgggccccctc

SEQ ID NO: 5926722 - DNA, 20 bp, Homo sapiens
gtcttgagtttcatttttca

SEQ ID NO: 5926723 - DNA, 16 bp, Homo sapiens
gtcttgatgttttttc

SEQ ID NO: 5926724 - DNA, 21 bp, Homo sapiens
gtcttgatgttttttctgtaa

SEQ ID NO: 5926725 - DNA, 16 bp, Homo sapiens
gtcttgcaatggcagc

SEQ ID NO: 5926726 - DNA, 19 bp, Homo sapiens
gtcttgcaatggcagcctt

SEQ ID NO: 5926727 - DNA, 20 bp, Homo sapiens
gtcttgcagtggacggagag

SEQ ID NO: 5926728 - DNA, 18 bp, Homo sapiens
gtcttgccaactccatct

SEQ ID NO: 5926729 - DNA, 16 bp, Homo sapiens
gtcttgccagccagaa

SEQ ID NO: 5926730 - DNA, 19 bp, Homo sapiens
gtcttgccagccagaagcc

SEQ ID NO: 5926731 - DNA, 13 bp, Homo sapiens
gtcttgccccagt

SEQ ID NO: 5926732 - DNA, 13 bp, Homo sapiens
gtcttgccccatc

SEQ ID NO: 5926733 - DNA, 14 bp, Homo sapiens
gtcttgcctaggcc

SEQ ID NO: 5926734 - DNA, 23 bp, Homo sapiens
gtcttgctatattgcccaggctg

SEQ ID NO: 5926735 - DNA, 13 bp, Homo sapiens
gtcttgctatgtt

SEQ ID NO: 5926736 - DNA, 16 bp, Homo sapiens
gtcttgctctgtcacc

SEQ ID NO: 5926737 - DNA, 16 bp, Homo sapiens
gtcttgctctgtcccc

SEQ ID NO: 5926738 - DNA, 23 bp, Homo sapiens
gtcttgctctgtctcccaggctg

SEQ ID NO: 5926739 - DNA, 19 bp, Homo sapiens
gtcttgctggaagacagag

SEQ ID NO: 5926740 - DNA, 21 bp, Homo sapiens
gtcttgctggaagacagagaa

SEQ ID NO: 5926741 - DNA, 13 bp, Homo sapiens
gtcttgctgtgct

SEQ ID NO: 5926742 - DNA, 18 bp, Homo sapiens
gtcttggacactgtacaa

SEQ ID NO: 5926743 - DNA, 23 bp, Homo sapiens
gtcttggagctgagcctctcacc

SEQ ID NO: 5926744 - DNA, 20 bp, Homo sapiens
gtcttggcagcacctgtctc

SEQ ID NO: 5926745 - DNA, 22 bp, Homo sapiens
gtcttggcagcacctgtctcct

SEQ ID NO: 5926746 - DNA, 22 bp, Homo sapiens
gtcttggccgactcagggacct

SEQ ID NO: 5926747 - DNA, 12 bp, Homo sapiens
gtcttggcctcc

SEQ ID NO: 5926748 - DNA, 16 bp, Homo sapiens
gtcttggcggcagcag

SEQ ID NO: 5926749 - DNA, 20 bp, Homo sapiens
gtcttggctttcatgttatt

SEQ ID NO: 5926750 - DNA, 16 bp, Homo sapiens
gtcttgggcctggccc

SEQ ID NO: 5926751 - DNA, 19 bp, Homo sapiens
gtcttgggctactggcagc

SEQ ID NO: 5926752 - DNA, 22 bp, Homo sapiens
gtcttgggctactggcagctcc

SEQ ID NO: 5926753 - DNA, 18 bp, Homo sapiens
gtcttggggtcccactgc

SEQ ID NO: 5926754 - DNA, 18 bp, Homo sapiens
gtcttggtctgttgccca

SEQ ID NO: 5926755 - DNA, 22 bp, Homo sapiens
gtcttggtgccttttgtgtgat

SEQ ID NO: 5926756 - DNA, 19 bp, Homo sapiens
gtcttggtggatgggccct

SEQ ID NO: 5926757 - DNA, 16 bp, Homo sapiens
gtcttggtggttctat

SEQ ID NO: 5926758 - DNA, 23 bp, Homo sapiens
gtcttgtaaaaaggggaggagaa

SEQ ID NO: 5926759 - DNA, 12 bp, Homo sapiens
gtcttgtaagag

SEQ ID NO: 5926760 - DNA, 20 bp, Homo sapiens
gtcttgtaatattttgtatt

SEQ ID NO: 5926761 - DNA, 13 bp, Homo sapiens
gtcttgtaattgt

SEQ ID NO: 5926762 - DNA, 13 bp, Homo sapiens
gtcttgtacactt

SEQ ID NO: 5926763 - DNA, 17 bp, Homo sapiens
gtcttgtactgtgacct

SEQ ID NO: 5926764 - DNA, 12 bp, Homo sapiens
gtcttgtacttc

SEQ ID NO: 5926765 - DNA, 21 bp, Homo sapiens
gtcttgtacttctgtgttcat

SEQ ID NO: 5926766 - DNA, 22 bp, Homo sapiens
gtcttgtacttctgtgttcatt

SEQ ID NO: 5926767 - DNA, 13 bp, Homo sapiens
gtcttgtattatc

SEQ ID NO: 5926768 - DNA, 13 bp, Homo sapiens
gtcttgtattttc

SEQ ID NO: 5926769 - DNA, 17 bp, Homo sapiens
gtcttgtcatacaaatt

SEQ ID NO: 5926770 - DNA, 15 bp, Homo sapiens
gtcttgtcatctttt

SEQ ID NO: 5926771 - DNA, 20 bp, Homo sapiens
gtcttgtcccaattaaaata

SEQ ID NO: 5926772 - DNA, 14 bp, Homo sapiens
gtcttgtccccacc

SEQ ID NO: 5926773 - DNA, 12 bp, Homo sapiens
gtcttgtgaaag

SEQ ID NO: 5926774 - DNA, 20 bp, Homo sapiens
gtcttgtgactagtgctgaa

SEQ ID NO: 5926775 - DNA, 23 bp, Homo sapiens
gtcttgtgtttccacagcctgca

SEQ ID NO: 5926776 - DNA, 21 bp, Homo sapiens
gtcttgttaatattctttcaa

SEQ ID NO: 5926777 - DNA, 17 bp, Homo sapiens
gtcttgttcattttgag

SEQ ID NO: 5926778 - DNA, 16 bp, Homo sapiens
gtcttgttcctgtgca

SEQ ID NO: 5926779 - DNA, 16 bp, Homo sapiens
gtcttgttctgtcact

SEQ ID NO: 5926780 - DNA, 14 bp, Homo sapiens
gtcttgttctgtcc

SEQ ID NO: 5926781 - DNA, 18 bp, Homo sapiens
gtcttgttctgtcccttc

SEQ ID NO: 5926782 - DNA, 18 bp, Homo sapiens
gtcttgtttaatatttgt

SEQ ID NO: 5926783 - DNA, 14 bp, Homo sapiens
gtcttgtttcagtg

SEQ ID NO: 5926784 - DNA, 17 bp, Homo sapiens
gtcttgtttccaggagc

SEQ ID NO: 5926785 - DNA, 22 bp, Homo sapiens
gtcttgtttgtagccaatacat

SEQ ID NO: 5926786 - DNA, 22 bp, Homo sapiens
gtcttgttttttttttccactt

SEQ ID NO: 5926787 - DNA, 15 bp, Homo sapiens
gtctttaaaagagag

SEQ ID NO: 5926788 - DNA, 16 bp, Homo sapiens
gtctttaaaagatata

SEQ ID NO: 5926789 - DNA, 22 bp, Homo sapiens
gtctttaaaggcccagccccta

SEQ ID NO: 5926790 - DNA, 13 bp, Homo sapiens
gtctttaaatcat

SEQ ID NO: 5926791 - DNA, 17 bp, Homo sapiens
gtctttaaatgctgctt

SEQ ID NO: 5926792 - DNA, 14 bp, Homo sapiens
gtctttaactgtca

SEQ ID NO: 5926793 - DNA, 19 bp, Homo sapiens
gtctttaagagactcactg

SEQ ID NO: 5926794 - DNA, 21 bp, Homo sapiens
gtctttaatataataaaagtt

SEQ ID NO: 5926795 - DNA, 16 bp, Homo sapiens
gtctttaatcattggt

SEQ ID NO: 5926796 - DNA, 23 bp, Homo sapiens
gtctttaatttctgtcagaatgc

SEQ ID NO: 5926797 - DNA, 20 bp, Homo sapiens
gtctttactggacctgaaat

SEQ ID NO: 5926798 - DNA, 20 bp, Homo sapiens
gtctttagaatcgctttcct

SEQ ID NO: 5926799 - DNA, 21 bp, Homo sapiens
gtctttagaatcgctttcctt

SEQ ID NO: 5926800 - DNA, 21 bp, Homo sapiens
gtctttagatagccctgtcct

SEQ ID NO: 5926801 - DNA, 24 bp, Homo sapiens
gtctttagatagccctgtcctggt

SEQ ID NO: 5926802 - DNA, 13 bp, Homo sapiens
gtctttagctatt

SEQ ID NO: 5926803 - DNA, 21 bp, Homo sapiens
gtctttaggtctttgtaagaa

SEQ ID NO: 5926804 - DNA, 17 bp, Homo sapiens
gtctttattagtaacat

SEQ ID NO: 5926805 - DNA, 15 bp, Homo sapiens
gtctttattcttatt

SEQ ID NO: 5926806 - DNA, 24 bp, Homo sapiens
gtctttattgtccaccatgctctc

SEQ ID NO: 5926807 - DNA, 21 bp, Homo sapiens
gtgaaagtttttctgaaagtg

SEQ ID NO: 5926808 - DNA, 16 bp, Homo sapiens
gtgaaataaattctga

SEQ ID NO: 5926809 - DNA, 17 bp, Homo sapiens
gtgaaataacaaaatgg

SEQ ID NO: 5926810 - DNA, 13 bp, Homo sapiens
gtgaaataataaa

SEQ ID NO: 5926811 - DNA, 17 bp, Homo sapiens
gtgaaataataaaatgc

SEQ ID NO: 5926812 - DNA, 20 bp, Homo sapiens
gtgaaataataaaatgcaaa

SEQ ID NO: 5926813 - DNA, 22 bp, Homo sapiens
gtgaaataataaaatgcaaatg

SEQ ID NO: 5926814 - DNA, 23 bp, Homo sapiens
gtgaaataataaaatgcaaatga

SEQ ID NO: 5926815 - DNA, 18 bp, Homo sapiens
gtgaaataccacaagcct

SEQ ID NO: 5926816 - DNA, 17 bp, Homo sapiens
gtgaaataccagtgtgg

SEQ ID NO: 5926817 - DNA, 20 bp, Homo sapiens
gtgaaatacttcgatgatga

SEQ ID NO: 5926818 - DNA, 14 bp, Homo sapiens
gtgaaatataattg

SEQ ID NO: 5926819 - DNA, 21 bp, Homo sapiens
gtgaaatattgtaaatgctat

SEQ ID NO: 5926820 - DNA, 13 bp, Homo sapiens
gtgaaatctgtct

SEQ ID NO: 5926821 - DNA, 16 bp, Homo sapiens
gtgaaatctgtctttg

SEQ ID NO: 5926822 - DNA, 14 bp, Homo sapiens
gtgaaatcttgttt

SEQ ID NO: 5926823 - DNA, 15 bp, Homo sapiens
gtgaaatctttcaag

SEQ ID NO: 5926824 - DNA, 16 bp, Homo sapiens
gtgaaatctttcaagt

SEQ ID NO: 5926825 - DNA, 19 bp, Homo sapiens
gtgaaatggatactacatc

SEQ ID NO: 5926826 - DNA, 15 bp, Homo sapiens
gtgaaatggctgggg

SEQ ID NO: 5926827 - DNA, 17 bp, Homo sapiens
gtgaaatgtaacatgaa

SEQ ID NO: 5926828 - DNA, 11 bp, Homo sapiens
gtgaaatgtga

SEQ ID NO: 5926829 - DNA, 15 bp, Homo sapiens
gtgaaattaagcatt

SEQ ID NO: 5926830 - DNA, 22 bp, Homo sapiens
gtgaaattataactattacagt

SEQ ID NO: 5926831 - DNA, 20 bp, Homo sapiens
gtgaaattattcataattat

SEQ ID NO: 5926832 - DNA, 16 bp, Homo sapiens
gtgaaattcaattcat

SEQ ID NO: 5926833 - DNA, 15 bp, Homo sapiens
gtgaaattgtgtaga

SEQ ID NO: 5926834 - DNA, 17 bp, Homo sapiens
gtgaaatttacaaatca

SEQ ID NO: 5926835 - DNA, 22 bp, Homo sapiens
gtgaaatttacagttactgcct

SEQ ID NO: 5926836 - DNA, 20 bp, Homo sapiens
gtgaaatttacatcatttct

SEQ ID NO: 5926837 - DNA, 21 bp, Homo sapiens
gtgaaatttattagttaatat

SEQ ID NO: 5926838 - DNA, 14 bp, Homo sapiens
gtgaaatttcatga

SEQ ID NO: 5926839 - DNA, 22 bp, Homo sapiens
gtgaaatttctagcctgcactt

SEQ ID NO: 5926840 - DNA, 15 bp, Homo sapiens
gtgaaatttgcctct

SEQ ID NO: 5926841 - DNA, 13 bp, Homo sapiens
gtgaaatttgtta

SEQ ID NO: 5926842 - DNA, 15 bp, Homo sapiens
gtgaaattttaaatg

SEQ ID NO: 5926843 - DNA, 20 bp, Homo sapiens
gtgaaattttggtgaatgtg

SEQ ID NO: 5926844 - DNA, 14 bp, Homo sapiens
gtgaaatttttcat

SEQ ID NO: 5926845 - DNA, 18 bp, Homo sapiens
gtgaacaaaagatgctct

SEQ ID NO: 5926846 - DNA, 23 bp, Homo sapiens
gtgaacaaagaaaagacattgaa

SEQ ID NO: 5926847 - DNA, 18 bp, Homo sapiens
gtgaacaaagcagccacg

SEQ ID NO: 5926848 - DNA, 21 bp, Homo sapiens
gtgaacaaagtgagaaatgaa

SEQ ID NO: 5926849 - DNA, 20 bp, Homo sapiens
gtgaacaaatcaaattgctt

SEQ ID NO: 5926850 - DNA, 21 bp, Homo sapiens
gtgaacaaatttacagagaca

SEQ ID NO: 5926851 - DNA, 14 bp, Homo sapiens
gtgaacaaatttca

SEQ ID NO: 5926852 - DNA, 21 bp, Homo sapiens
gtgaacaactatttataaact

SEQ ID NO: 5926853 - DNA, 17 bp, Homo sapiens
gtgaacaactgtttgtc

SEQ ID NO: 5926854 - DNA, 13 bp, Homo sapiens
gtgaacacacacg

SEQ ID NO: 5926855 - DNA, 18 bp, Homo sapiens
gtgaacacagcagaccta

SEQ ID NO: 5926856 - DNA, 13 bp, Homo sapiens
gtgaacactgtga

SEQ ID NO: 5926857 - DNA, 17 bp, Homo sapiens
gtgaacacttagtgatc

SEQ ID NO: 5926858 - DNA, 18 bp, Homo sapiens
gtgaacagcttgctgtca

SEQ ID NO: 5926859 - DNA, 21 bp, Homo sapiens
gtgaacagtcacgcctgaaac

SEQ ID NO: 5926860 - DNA, 18 bp, Homo sapiens
gtgaacataactgtaaca

SEQ ID NO: 5926861 - DNA, 18 bp, Homo sapiens
gtgaacatactaattcta

SEQ ID NO: 5926862 - DNA, 20 bp, Homo sapiens
gtgaacatgcctcctcctgc

SEQ ID NO: 5926863 - DNA, 22 bp, Homo sapiens
gtgaacatgcctcctcctgccc

SEQ ID NO: 5926864 - DNA, 19 bp, Homo sapiens
gtgaacatgccttatattt

SEQ ID NO: 5926865 - DNA, 14 bp, Homo sapiens
gtgaacattcccag

SEQ ID NO: 5926866 - DNA, 15 bp, Homo sapiens
gtgaacattcccagc

SEQ ID NO: 5926867 - DNA, 13 bp, Homo sapiens
gtgaacattccta

SEQ ID NO: 5926868 - DNA, 18 bp, Homo sapiens
gtgaaccaaaaatagaaa

SEQ ID NO: 5926869 - DNA, 21 bp, Homo sapiens
gtgaaccaacccccatctccc

SEQ ID NO: 5926870 - DNA, 17 bp, Homo sapiens
gtgaaccaactgcctta

SEQ ID NO: 5926871 - DNA, 23 bp, Homo sapiens
gtgaaccaagctataaaagccca

SEQ ID NO: 5926872 - DNA, 14 bp, Homo sapiens
gtgaaccaatgcaa

SEQ ID NO: 5926873 - DNA, 13 bp, Homo sapiens
gtgaaccacaggt

SEQ ID NO: 5926874 - DNA, 21 bp, Homo sapiens
gtgaaccacaggttttagcat

SEQ ID NO: 5926875 - DNA, 19 bp, Homo sapiens
gtgaaccaccacacccagc

SEQ ID NO: 5926876 - DNA, 21 bp, Homo sapiens
gtgaaccaccacacccagccc

SEQ ID NO: 5926877 - DNA, 19 bp, Homo sapiens
gtgaaccctggggcctgac

SEQ ID NO: 5926878 - DNA, 21 bp, Homo sapiens
gtgaaccctggggcctgactg

SEQ ID NO: 5926879 - DNA, 23 bp, Homo sapiens
gtgaacctcaccccgaggccctg

SEQ ID NO: 5926880 - DNA, 14 bp, Homo sapiens
gtgaacgatttaga

SEQ ID NO: 5926881 - DNA, 19 bp, Homo sapiens
gtgaacgctgtgatgctgt

SEQ ID NO: 5926882 - DNA, 22 bp, Homo sapiens
gtgaacgtggggtgagggatca

SEQ ID NO: 5926883 - DNA, 17 bp, Homo sapiens
gtgaactaagttattgc

SEQ ID NO: 5926884 - DNA, 19 bp, Homo sapiens
gtgaactaagttattgctg

SEQ ID NO: 5926885 - DNA, 20 bp, Homo sapiens
gtgaactaagttttttactt

SEQ ID NO: 5926886 - DNA, 19 bp, Homo sapiens
gtgaactaccatgctttgt

SEQ ID NO: 5926887 - DNA, 20 bp, Homo sapiens
gtgaactattttgaagaaaa

SEQ ID NO: 5926888 - DNA, 21 bp, Homo sapiens
gtgaactattttgaagaaaac

SEQ ID NO: 5926889 - DNA, 23 bp, Homo sapiens
gtgaactcaccctgggagccagt

SEQ ID NO: 5926890 - DNA, 22 bp, Homo sapiens
gtgaactcagccaagcacagtg

SEQ ID NO: 5926891 - DNA, 13 bp, Homo sapiens
gtgaactccaggc

SEQ ID NO: 5926892 - DNA, 15 bp, Homo sapiens
gtgaactccaggcat

SEQ ID NO: 5926893 - DNA, 14 bp, Homo sapiens
gtgaactccatcat

SEQ ID NO: 5926894 - DNA, 13 bp, Homo sapiens
gtgaactcctgag

SEQ ID NO: 5926895 - DNA, 13 bp, Homo sapiens
gtgaactcctgcc

SEQ ID NO: 5926896 - DNA, 13 bp, Homo sapiens
gtgaactgaaatt

SEQ ID NO: 5926897 - DNA, 20 bp, Homo sapiens
gtgaactgcaaagctttggc

SEQ ID NO: 5926898 - DNA, 14 bp, Homo sapiens
gtgaactgcagtga

SEQ ID NO: 5926899 - DNA, 23 bp, Homo sapiens
gtgaactgctggagtctggcttt

SEQ ID NO: 5926900 - DNA, 19 bp, Homo sapiens
gtgaactggaccctgttgc

SEQ ID NO: 5926901 - DNA, 18 bp, Homo sapiens
gtgaactgttggagcccg

SEQ ID NO: 5926902 - DNA, 18 bp, Homo sapiens
gtgaacttcctttgactt

SEQ ID NO: 5926903 - DNA, 18 bp, Homo sapiens
gtgaacttgattttaaaa

SEQ ID NO: 5926904 - DNA, 12 bp, Homo sapiens
gtgaacttgtag

SEQ ID NO: 5926905 - DNA, 15 bp, Homo sapiens
gtgaacttgtagctg

SEQ ID NO: 5926906 - DNA, 20 bp, Homo sapiens
gtgaacttgtagctgtaaaa

SEQ ID NO: 5926907 - DNA, 19 bp, Homo sapiens
gtgaacttgtctggctttg

SEQ ID NO: 5926908 - DNA, 20 bp, Homo sapiens
gtgaagaaagccagacaact

SEQ ID NO: 5926909 - DNA, 17 bp, Homo sapiens
gtgaagaagccctgttc

SEQ ID NO: 5926910 - DNA, 13 bp, Homo sapiens
gtgaagaagcctg

SEQ ID NO: 5926911 - DNA, 14 bp, Homo sapiens
gtgaagaatacatc

SEQ ID NO: 5926912 - DNA, 15 bp, Homo sapiens
gtgaagacagaaacc

SEQ ID NO: 5926913 - DNA, 24 bp, Homo sapiens
gtgaagacagaaacccagtaactt

SEQ ID NO: 5926914 - DNA, 17 bp, Homo sapiens
gtgaagaccagagcagt

SEQ ID NO: 5926915 - DNA, 18 bp, Homo sapiens
gtgaagactgggtgagga

SEQ ID NO: 5926916 - DNA, 15 bp, Homo sapiens
gtgaagacttcttgg

SEQ ID NO: 5926917 - DNA, 12 bp, Homo sapiens
gtgaagaggctg

SEQ ID NO: 5926918 - DNA, 20 bp, Homo sapiens
gtgaagaggctgcttctcta

SEQ ID NO: 5926919 - DNA, 13 bp, Homo sapiens
gtgaagaggggca

SEQ ID NO: 5926920 - DNA, 16 bp, Homo sapiens
gtgaagaggggccaga

SEQ ID NO: 5926921 - DNA, 20 bp, Homo sapiens
gtgaagaggtctgattggct

SEQ ID NO: 5926922 - DNA, 15 bp, Homo sapiens
gtgaagagtgaagag

SEQ ID NO: 5926923 - DNA, 16 bp, Homo sapiens
gtgaagagtgaagagc

SEQ ID NO: 5926924 - DNA, 17 bp, Homo sapiens
gtgaagagtgaagagca

SEQ ID NO: 5926925 - DNA, 21 bp, Homo sapiens
gtgaagagtgactagtacaaa

SEQ ID NO: 5926926 - DNA, 14 bp, Homo sapiens
gtgaagataatttg

SEQ ID NO: 5926927 - DNA, 20 bp, Homo sapiens
gtgaagatactttgtattgt

SEQ ID NO: 5926928 - DNA, 17 bp, Homo sapiens
gtgaagatgctgtaaat

SEQ ID NO: 5926929 - DNA, 15 bp, Homo sapiens
gtgaagatgtttgca

SEQ ID NO: 5926930 - DNA, 14 bp, Homo sapiens
gtgaagcaatttca

SEQ ID NO: 5926931 - DNA, 16 bp, Homo sapiens
gtgaagcaatttgaaa

SEQ ID NO: 5926932 - DNA, 22 bp, Homo sapiens
gtgaagcaccagggagaggcct

SEQ ID NO: 5926933 - DNA, 23 bp, Homo sapiens
gtgaagcagccttactattcata

SEQ ID NO: 5926934 - DNA, 15 bp, Homo sapiens
gtgaagcatccaggc

SEQ ID NO: 5926935 - DNA, 16 bp, Homo sapiens
gtgaagcatccaggca

SEQ ID NO: 5926936 - DNA, 20 bp, Homo sapiens
gtgaagccaattcagacagg

SEQ ID NO: 5926937 - DNA, 22 bp, Homo sapiens
gtgaagccccttgtcctctccc

SEQ ID NO: 5926938 - DNA, 23 bp, Homo sapiens
gtgaagccccttgtcctctcccg

SEQ ID NO: 5926939 - DNA, 12 bp, Homo sapiens
gtgaagcccttt

SEQ ID NO: 5926940 - DNA, 19 bp, Homo sapiens
gtgaagcctaccagaagaa

SEQ ID NO: 5926941 - DNA, 19 bp, Homo sapiens
gtgaagctcacactgatgg

SEQ ID NO: 5926942 - DNA, 18 bp, Homo sapiens
gtgaagctggggacagct

SEQ ID NO: 5926943 - DNA, 16 bp, Homo sapiens
gtgaaggaaaaacatg

SEQ ID NO: 5926944 - DNA, 12 bp, Homo sapiens
gtgaaggaaata

SEQ ID NO: 5926945 - DNA, 15 bp, Homo sapiens
gtgaaggaatatatg

SEQ ID NO: 5926946 - DNA, 19 bp, Homo sapiens
gtgaaggaccctggctctt

SEQ ID NO: 5926947 - DNA, 20 bp, Homo sapiens
gtgaaggaccctggctcttc

SEQ ID NO: 5926948 - DNA, 21 bp, Homo sapiens
gtgaaggaccttcactctaag

SEQ ID NO: 5926949 - DNA, 23 bp, Homo sapiens
gtgaaggaccttcactctaagat

SEQ ID NO: 5926950 - DNA, 20 bp, Homo sapiens
gtgaaggagaaaggagccgg

SEQ ID NO: 5926951 - DNA, 14 bp, Homo sapiens
gtgaaggagaagtc

SEQ ID NO: 5926952 - DNA, 22 bp, Homo sapiens
gtgaaggattatggaaaaataa

SEQ ID NO: 5926953 - DNA, 22 bp, Homo sapiens
gtgaaggcccatgaaggaaatt

SEQ ID NO: 5926954 - DNA, 12 bp, Homo sapiens
gtgaaggcctcg

SEQ ID NO: 5926955 - DNA, 16 bp, Homo sapiens
gtgaaggcctggctgg

SEQ ID NO: 5926956 - DNA, 15 bp, Homo sapiens
gtgaaggcttcactc

SEQ ID NO: 5926957 - DNA, 17 bp, Homo sapiens
gtgaaggcttctctctg

SEQ ID NO: 5926958 - DNA, 22 bp, Homo sapiens
gtgaaggcttctctctgtggga

SEQ ID NO: 5926959 - DNA, 15 bp, Homo sapiens
gtgaagggaagtggg

SEQ ID NO: 5926960 - DNA, 18 bp, Homo sapiens
gtgaagggaagtggggag

SEQ ID NO: 5926961 - DNA, 14 bp, Homo sapiens
gtgaagggcaccga

SEQ ID NO: 5926962 - DNA, 12 bp, Homo sapiens
gtgaaggggctg

SEQ ID NO: 5926963 - DNA, 20 bp, Homo sapiens
gtgaaggtcctgctattact

SEQ ID NO: 5926964 - DNA, 23 bp, Homo sapiens
gtgaaggtctttgttatgacagt

SEQ ID NO: 5926965 - DNA, 19 bp, Homo sapiens
gtgaagtaacccctcctgg

SEQ ID NO: 5926966 - DNA, 19 bp, Homo sapiens
gtgaagtaagctgtaactt

SEQ ID NO: 5926967 - DNA, 13 bp, Homo sapiens
gtgaagtcacatt

SEQ ID NO: 5926968 - DNA, 21 bp, Homo sapiens
gtgaagtcacattccacatct

SEQ ID NO: 5926969 - DNA, 23 bp, Homo sapiens
gtgaagtcacattccacatctgt

SEQ ID NO: 5926970 - DNA, 22 bp, Homo sapiens
gtgaagtccctgttctcagctc

SEQ ID NO: 5926971 - DNA, 16 bp, Homo sapiens
gtgaagtccttcacct

SEQ ID NO: 5926972 - DNA, 15 bp, Homo sapiens
gtgaagtgaatctga

SEQ ID NO: 5926973 - DNA, 13 bp, Homo sapiens
gtgaagtgcctgc

SEQ ID NO: 5926974 - DNA, 17 bp, Homo sapiens
gtgaagtggcctcttgg

SEQ ID NO: 5926975 - DNA, 20 bp, Homo sapiens
gtgaagtgtggctggtgtcc

SEQ ID NO: 5926976 - DNA, 16 bp, Homo sapiens
gtgaagtgttaataca

SEQ ID NO: 5926977 - DNA, 22 bp, Homo sapiens
gtgaagtgttgtggagaaaaga

SEQ ID NO: 5926978 - DNA, 14 bp, Homo sapiens
gtgaagttacatgc

SEQ ID NO: 5926979 - DNA, 18 bp, Homo sapiens
gtgaagttagaattcctt

SEQ ID NO: 5926980 - DNA, 12 bp, Homo sapiens
gtgaagttaggt

SEQ ID NO: 5926981 - DNA, 17 bp, Homo sapiens
gtgaagttcatcttgca

SEQ ID NO: 5926982 - DNA, 18 bp, Homo sapiens
gtgaagttcatcttgcag

SEQ ID NO: 5926983 - DNA, 19 bp, Homo sapiens
gtgaagttcatcttgcagc

SEQ ID NO: 5926984 - DNA, 14 bp, Homo sapiens
gtgactgctgcgct

SEQ ID NO: 5926985 - DNA, 15 bp, Homo sapiens
gtgactgctgcgctg

SEQ ID NO: 5926986 - DNA, 12 bp, Homo sapiens
gtgactggcagg

SEQ ID NO: 5926987 - DNA, 13 bp, Homo sapiens
gtgactggcaggt

SEQ ID NO: 5926988 - DNA, 15 bp, Homo sapiens
gtgactgggaaagtt

SEQ ID NO: 5926989 - DNA, 15 bp, Homo sapiens
gtgactgtatataaa

SEQ ID NO: 5926990 - DNA, 12 bp, Homo sapiens
gtgactgtccca

SEQ ID NO: 5926991 - DNA, 16 bp, Homo sapiens
gtgactgtcgtgttta

SEQ ID NO: 5926992 - DNA, 21 bp, Homo sapiens
gtgactgtgtttgcattgtct

SEQ ID NO: 5926993 - DNA, 19 bp, Homo sapiens
gtgacttaaaaaatcagaa

SEQ ID NO: 5926994 - DNA, 15 bp, Homo sapiens
gtgacttaaggagaa

SEQ ID NO: 5926995 - DNA, 18 bp, Homo sapiens
gtgacttaggaggctgag

SEQ ID NO: 5926996 - DNA, 12 bp, Homo sapiens
gtgacttcactg

SEQ ID NO: 5926997 - DNA, 14 bp, Homo sapiens
gtgacttcactgta

SEQ ID NO: 5926998 - DNA, 17 bp, Homo sapiens
gtgacttccctggtcac

SEQ ID NO: 5926999 - DNA, 21 bp, Homo sapiens
gtgacttcctcgcctctccca

SEQ ID NO: 5927000 - DNA, 23 bp, Homo sapiens
gtgacttcgaattagtttgcact

SEQ ID NO: 5927001 - DNA, 24 bp, Homo sapiens
gtgacttcgaattagtttgcactt

SEQ ID NO: 5927002 - DNA, 13 bp, Homo sapiens
gtgacttctgaga

SEQ ID NO: 5927003 - DNA, 15 bp, Homo sapiens
gtgacttctgctgct

SEQ ID NO: 5927004 - DNA, 16 bp, Homo sapiens
gtgacttctgctgctg

SEQ ID NO: 5927005 - DNA, 14 bp, Homo sapiens
gtgacttgaatgta

SEQ ID NO: 5927006 - DNA, 21 bp, Homo sapiens
gtgacttgcatcgtggagaca

SEQ ID NO: 5927007 - DNA, 18 bp, Homo sapiens
gtgacttgtctgcctcct

SEQ ID NO: 5927008 - DNA, 19 bp, Homo sapiens
gtgacttgtctgcctcctg

SEQ ID NO: 5927009 - DNA, 17 bp, Homo sapiens
gtgacttgtgtcccatg

SEQ ID NO: 5927010 - DNA, 23 bp, Homo sapiens
gtgacttgtgtcccatgatccct

SEQ ID NO: 5927011 - DNA, 12 bp, Homo sapiens
gtgactttctga

SEQ ID NO: 5927012 - DNA, 15 bp, Homo sapiens
gtgactttgaacaca

SEQ ID NO: 5927013 - DNA, 15 bp, Homo sapiens
gtgactttggggaca

SEQ ID NO: 5927014 - DNA, 24 bp, Homo sapiens
gtgactttgtctctcctggctggg

SEQ ID NO: 5927015 - DNA, 13 bp, Homo sapiens
gtgacttttgctt

SEQ ID NO: 5927016 - DNA, 23 bp, Homo sapiens
gtgactttttaaaaaatgctggg

SEQ ID NO: 5927017 - DNA, 14 bp, Homo sapiens
gtgagaaaaatgta

SEQ ID NO: 5927018 - DNA, 15 bp, Homo sapiens
gtgagaaaactgtga

SEQ ID NO: 5927019 - DNA, 20 bp, Homo sapiens
gtgagaaacctgtatctttc

SEQ ID NO: 5927020 - DNA, 20 bp, Homo sapiens
gtgagaaagacatctgagga

SEQ ID NO: 5927021 - DNA, 22 bp, Homo sapiens
gtgagaaagacatctgaggaaa

SEQ ID NO: 5927022 - DNA, 14 bp, Homo sapiens
gtgagaaatttttt

SEQ ID NO: 5927023 - DNA, 14 bp, Homo sapiens
gtgagaacccagag

SEQ ID NO: 5927024 - DNA, 17 bp, Homo sapiens
gtgagaacccagtttcc

SEQ ID NO: 5927025 - DNA, 20 bp, Homo sapiens
gtgagaacctgggttgcaga

SEQ ID NO: 5927026 - DNA, 21 bp, Homo sapiens
gtgagaactcagaagagaaat

SEQ ID NO: 5927027 - DNA, 17 bp, Homo sapiens
gtgagaactgtgaatat

SEQ ID NO: 5927028 - DNA, 20 bp, Homo sapiens
gtgagaactgttctcatgga

SEQ ID NO: 5927029 - DNA, 15 bp, Homo sapiens
gtgagaagaatattg

SEQ ID NO: 5927030 - DNA, 19 bp, Homo sapiens
gtgagaagatcattgccat

SEQ ID NO: 5927031 - DNA, 18 bp, Homo sapiens
gtgagaagctagatgccc

SEQ ID NO: 5927032 - DNA, 16 bp, Homo sapiens
gtgagaagggcctgct

SEQ ID NO: 5927033 - DNA, 17 bp, Homo sapiens
gtgagaaggtttattgt

SEQ ID NO: 5927034 - DNA, 16 bp, Homo sapiens
gtgagaagtacagggc

SEQ ID NO: 5927035 - DNA, 22 bp, Homo sapiens
gtgagaagtgaatgctgggact

SEQ ID NO: 5927036 - DNA, 14 bp, Homo sapiens
gtgagaataagaga

SEQ ID NO: 5927037 - DNA, 18 bp, Homo sapiens
gtgagaataattgtgtac

SEQ ID NO: 5927038 - DNA, 18 bp, Homo sapiens
gtgagaatcctgcctctc

SEQ ID NO: 5927039 - DNA, 22 bp, Homo sapiens
gtgagaatcgacctcactgtca

SEQ ID NO: 5927040 - DNA, 16 bp, Homo sapiens
gtgagaattaaaataa

SEQ ID NO: 5927041 - DNA, 19 bp, Homo sapiens
gtgagaattaagttttaaa

SEQ ID NO: 5927042 - DNA, 22 bp, Homo sapiens
gtgagacactgcacagaagaca

SEQ ID NO: 5927043 - DNA, 16 bp, Homo sapiens
gtgagacagtgggaaa

SEQ ID NO: 5927044 - DNA, 21 bp, Homo sapiens
gtgagacagtgggggtgcctg

SEQ ID NO: 5927045 - DNA, 17 bp, Homo sapiens
gtgagacatcagggagt

SEQ ID NO: 5927046 - DNA, 14 bp, Homo sapiens
gtgagaccacctct

SEQ ID NO: 5927047 - DNA, 20 bp, Homo sapiens
gtgagaccacctctcaatat

SEQ ID NO: 5927048 - DNA, 15 bp, Homo sapiens
gtgagaccaggggac

SEQ ID NO: 5927049 - DNA, 18 bp, Homo sapiens
gtgagaccaggggaccag

SEQ ID NO: 5927050 - DNA, 18 bp, Homo sapiens
gtgagaccatgtttcaaa

SEQ ID NO: 5927051 - DNA, 15 bp, Homo sapiens
gtgagacccagtgca

SEQ ID NO: 5927052 - DNA, 16 bp, Homo sapiens
gtgagacccctgtctc

SEQ ID NO: 5927053 - DNA, 15 bp, Homo sapiens
gtgagaccctcgcag

SEQ ID NO: 5927054 - DNA, 17 bp, Homo sapiens
gtgagaccctgtctcta

SEQ ID NO: 5927055 - DNA, 18 bp, Homo sapiens
gtgagaccctgtctctaa

SEQ ID NO: 5927056 - DNA, 15 bp, Homo sapiens
gtgagacctgcccct

SEQ ID NO: 5927057 - DNA, 16 bp, Homo sapiens
gtgagacctgcccctc

SEQ ID NO: 5927058 - DNA, 23 bp, Homo sapiens
gtgagacgtgatgggctaggcct

SEQ ID NO: 5927059 - DNA, 22 bp, Homo sapiens
gtgagactgacacctcactgag

SEQ ID NO: 5927060 - DNA, 18 bp, Homo sapiens
gtgagactgcaggtgggc

SEQ ID NO: 5927061 - DNA, 15 bp, Homo sapiens
gtgagactgtacata

SEQ ID NO: 5927062 - DNA, 17 bp, Homo sapiens
gtgagactgtacataat

SEQ ID NO: 5927063 - DNA, 14 bp, Homo sapiens
gtgagacttaaaac

SEQ ID NO: 5927064 - DNA, 15 bp, Homo sapiens
gtgagacttaaaaca

SEQ ID NO: 5927065 - DNA, 12 bp, Homo sapiens
gtgagagaaaga

SEQ ID NO: 5927066 - DNA, 22 bp, Homo sapiens
gtgagagaaagagaaatcagaa

SEQ ID NO: 5927067 - DNA, 21 bp, Homo sapiens
gtgagagaaagagagaagcca

SEQ ID NO: 5927068 - DNA, 17 bp, Homo sapiens
gtgagagaaatgaagtt

SEQ ID NO: 5927069 - DNA, 16 bp, Homo sapiens
gtgagagaatctgcct

SEQ ID NO: 5927070 - DNA, 23 bp, Homo sapiens
gtgagagaatgtattttcataga

SEQ ID NO: 5927071 - DNA, 22 bp, Homo sapiens
gtgagagaccctcgcaaaatga

SEQ ID NO: 5927072 - DNA, 11 bp, Homo sapiens
gtgagagagac

SEQ ID NO: 5927073 - DNA, 13 bp, Homo sapiens
gtgagagagaggg

SEQ ID NO: 5927074 - DNA, 20 bp, Homo sapiens
gtgagagagagggcgcccag

SEQ ID NO: 5927075 - DNA, 17 bp, Homo sapiens
gtgagagaggacctcca

SEQ ID NO: 5927076 - DNA, 14 bp, Homo sapiens
gtgagagaggaggc

SEQ ID NO: 5927077 - DNA, 19 bp, Homo sapiens
gtgagagagtggctggggc

SEQ ID NO: 5927078 - DNA, 20 bp, Homo sapiens
gtgagagagtggctggggca

SEQ ID NO: 5927079 - DNA, 14 bp, Homo sapiens
gtgagagattctgt

SEQ ID NO: 5927080 - DNA, 18 bp, Homo sapiens
gtgagagcacaaagataa

SEQ ID NO: 5927081 - DNA, 15 bp, Homo sapiens
gtgagagcacccact

SEQ ID NO: 5927082 - DNA, 11 bp, Homo sapiens
gtgagagctgg

SEQ ID NO: 5927083 - DNA, 15 bp, Homo sapiens
gtgagaggcaatgac

SEQ ID NO: 5927084 - DNA, 13 bp, Homo sapiens
gtgagaggcagct

SEQ ID NO: 5927085 - DNA, 12 bp, Homo sapiens
gtgagaggcccc

SEQ ID NO: 5927086 - DNA, 13 bp, Homo sapiens
gtgagaggccccc

SEQ ID NO: 5927087 - DNA, 23 bp, Homo sapiens
gtgagagggcatgcgcacaaggc

SEQ ID NO: 5927088 - DNA, 17 bp, Homo sapiens
gtgagaggggagggctc

SEQ ID NO: 5927089 - DNA, 23 bp, Homo sapiens
gtgagaggggagggctcctgggg

SEQ ID NO: 5927090 - DNA, 14 bp, Homo sapiens
gtgagatacaaagc

SEQ ID NO: 5927091 - DNA, 18 bp, Homo sapiens
gtgagatacccagagaga

SEQ ID NO: 5927092 - DNA, 16 bp, Homo sapiens
gtgagatagttttcat

SEQ ID NO: 5927093 - DNA, 15 bp, Homo sapiens
gtgagatcaatgtga

SEQ ID NO: 5927094 - DNA, 22 bp, Homo sapiens
gtgagatccgtgaattctcgga

SEQ ID NO: 5927095 - DNA, 22 bp, Homo sapiens
gtgagatcctctttactctggg

SEQ ID NO: 5927096 - DNA, 22 bp, Homo sapiens
gtgagatgagggatgggcctgg

SEQ ID NO: 5927097 - DNA, 15 bp, Homo sapiens
gtgagatgtaattgt

SEQ ID NO: 5927098 - DNA, 17 bp, Homo sapiens
gtgagattaaaaatcta

SEQ ID NO: 5927099 - DNA, 13 bp, Homo sapiens
gtgagattctaaa

SEQ ID NO: 5927100 - DNA, 12 bp, Homo sapiens
gtgagatttttt

SEQ ID NO: 5927101 - DNA, 13 bp, Homo sapiens
gtgagatttttta

SEQ ID NO: 5927102 - DNA, 19 bp, Homo sapiens
gtgagattttttattgcta

SEQ ID NO: 5927103 - DNA, 21 bp, Homo sapiens
gtgagattttttattgctagt

SEQ ID NO: 5927104 - DNA, 15 bp, Homo sapiens
gtgagcaaccagctg

SEQ ID NO: 5927105 - DNA, 14 bp, Homo sapiens
gtgagcaagagcca

SEQ ID NO: 5927106 - DNA, 15 bp, Homo sapiens
gtgagcaagagccag

SEQ ID NO: 5927107 - DNA, 21 bp, Homo sapiens
gtgagcaagagccaggggtgt

SEQ ID NO: 5927108 - DNA, 23 bp, Homo sapiens
gtgagcaagcaccaacctccaga

SEQ ID NO: 5927109 - DNA, 13 bp, Homo sapiens
gtgagcacaaaga

SEQ ID NO: 5927110 - DNA, 20 bp, Homo sapiens
gtgagcacgttggcgaggaa

SEQ ID NO: 5927111 - DNA, 21 bp, Homo sapiens
gtgagcactaaggtgtgctct

SEQ ID NO: 5927112 - DNA, 17 bp, Homo sapiens
gtgagcactatctttca

SEQ ID NO: 5927113 - DNA, 20 bp, Homo sapiens
gtgagcactctggggtggga

SEQ ID NO: 5927114 - DNA, 22 bp, Homo sapiens
gtgagcactctggggtgggagg

SEQ ID NO: 5927115 - DNA, 19 bp, Homo sapiens
gtgagcagagatgtactgc

SEQ ID NO: 5927116 - DNA, 21 bp, Homo sapiens
gtgagcagcctccactgtgtc

SEQ ID NO: 5927117 - DNA, 22 bp, Homo sapiens
gtgagcagctactgtaactttt

SEQ ID NO: 5927118 - DNA, 19 bp, Homo sapiens
gtgagcaggcggggaggag

SEQ ID NO: 5927119 - DNA, 19 bp, Homo sapiens
gtgagcaggctttgggaac

SEQ ID NO: 5927120 - DNA, 17 bp, Homo sapiens
gtgagcagggccctcag

SEQ ID NO: 5927121 - DNA, 19 bp, Homo sapiens
gtgagcagggccctcagag

SEQ ID NO: 5927122 - DNA, 13 bp, Homo sapiens
gtgagcagggtgg

SEQ ID NO: 5927123 - DNA, 16 bp, Homo sapiens
gtgagcagggtggggt

SEQ ID NO: 5927124 - DNA, 15 bp, Homo sapiens
gtgagcagtaactgt

SEQ ID NO: 5927125 - DNA, 16 bp, Homo sapiens
gtgagcagtcaggaaa

SEQ ID NO: 5927126 - DNA, 15 bp, Homo sapiens
gtgagcatacagagt

SEQ ID NO: 5927127 - DNA, 15 bp, Homo sapiens
gtgagcatcagaggg

SEQ ID NO: 5927128 - DNA, 13 bp, Homo sapiens
gtgagcatcctgc

SEQ ID NO: 5927129 - DNA, 20 bp, Homo sapiens
gtgagcatccttcccagcag

SEQ ID NO: 5927130 - DNA, 15 bp, Homo sapiens
gtgagcatctctgtg

SEQ ID NO: 5927131 - DNA, 16 bp, Homo sapiens
gtgagcatctctgtgt

SEQ ID NO: 5927132 - DNA, 17 bp, Homo sapiens
gtgagcatctctgtgta

SEQ ID NO: 5927133 - DNA, 22 bp, Homo sapiens
gtgagcatgaaactatgcacct

SEQ ID NO: 5927134 - DNA, 19 bp, Homo sapiens
gtgagcatgcacactgaga

SEQ ID NO: 5927135 - DNA, 22 bp, Homo sapiens
gtgagcatgcacactgagaatg

SEQ ID NO: 5927136 - DNA, 13 bp, Homo sapiens
gtgagcatgtttg

SEQ ID NO: 5927137 - DNA, 15 bp, Homo sapiens
gtgagccaaagagaa

SEQ ID NO: 5927138 - DNA, 23 bp, Homo sapiens
gtgagccaagatcgcaccactgc

SEQ ID NO: 5927139 - DNA, 15 bp, Homo sapiens
gtgagccacagacca

SEQ ID NO: 5927140 - DNA, 13 bp, Homo sapiens
gtgagccacagca

SEQ ID NO: 5927141 - DNA, 18 bp, Homo sapiens
gtgagccaccgctgccag

SEQ ID NO: 5927142 - DNA, 20 bp, Homo sapiens
gtgagccaccgctgccagca

SEQ ID NO: 5927143 - DNA, 24 bp, Homo sapiens
gtgagccaccgctgccagcacaga

SEQ ID NO: 5927144 - DNA, 17 bp, Homo sapiens
gtgagccaccgtgcctg

SEQ ID NO: 5927145 - DNA, 18 bp, Homo sapiens
gtgagccaccgtgcctgg

SEQ ID NO: 5927146 - DNA, 22 bp, Homo sapiens
gtgagccaccgtgcctggccag

SEQ ID NO: 5927147 - DNA, 14 bp, Homo sapiens
gtgagccactgcac

SEQ ID NO: 5927148 - DNA, 15 bp, Homo sapiens
gtgagccactgcacc

SEQ ID NO: 5927149 - DNA, 13 bp, Homo sapiens
gtgagccactgct

SEQ ID NO: 5927150 - DNA, 19 bp, Homo sapiens
gtgagccagagggagctgt

SEQ ID NO: 5927151 - DNA, 12 bp, Homo sapiens
gtgagccagtga

SEQ ID NO: 5927152 - DNA, 24 bp, Homo sapiens
gtgagccatgatcgagccactgca

SEQ ID NO: 5927153 - DNA, 16 bp, Homo sapiens
gtgagccatgcctccc

SEQ ID NO: 5927154 - DNA, 16 bp, Homo sapiens
gtgagccccatcttca

SEQ ID NO: 5927155 - DNA, 14 bp, Homo sapiens
gtgagcccccccct

SEQ ID NO: 5927156 - DNA, 16 bp, Homo sapiens
gtgagcccctccccag

SEQ ID NO: 5927157 - DNA, 14 bp, Homo sapiens
gtgagcccctggtc

SEQ ID NO: 5927158 - DNA, 17 bp, Homo sapiens
gtgagccctctagggca

SEQ ID NO: 5927159 - DNA, 23 bp, Homo sapiens
gtgagccctctagggcagggtgg

SEQ ID NO: 5927160 - DNA, 12 bp, Homo sapiens
gtgagccctgct

SEQ ID NO: 5927161 - DNA, 13 bp, Homo sapiens
gtgagccctgctc

SEQ ID NO: 5927162 - DNA, 21 bp, Homo sapiens
gtgagccgcatcttctccatc

SEQ ID NO: 5927163 - DNA, 13 bp, Homo sapiens
gtgagcctatgat

SEQ ID NO: 5927164 - DNA, 15 bp, Homo sapiens
gtgagcctcctgtgc

SEQ ID NO: 5927165 - DNA, 18 bp, Homo sapiens
gtgagcctcctgtgcctg

SEQ ID NO: 5927166 - DNA, 20 bp, Homo sapiens
gtgagcctcctgtgcctggc

SEQ ID NO: 5927167 - DNA, 13 bp, Homo sapiens
gtgagcctgactg

SEQ ID NO: 5927168 - DNA, 21 bp, Homo sapiens
gtgagcctgactgccaggacc

SEQ ID NO: 5927169 - DNA, 15 bp, Homo sapiens
gtgagcctgggcagc

SEQ ID NO: 5927170 - DNA, 20 bp, Homo sapiens
gtgagcctgggcagcttctg

SEQ ID NO: 5927171 - DNA, 15 bp, Homo sapiens
gtgagccttcccatt

SEQ ID NO: 5927172 - DNA, 16 bp, Homo sapiens
gtgagccttgctgcca

SEQ ID NO: 5927173 - DNA, 14 bp, Homo sapiens
gtgagccttggctg

SEQ ID NO: 5927174 - DNA, 22 bp, Homo sapiens
gtgagccttttgcaggaaaagg

SEQ ID NO: 5927175 - DNA, 23 bp, Homo sapiens
gtgagcgagtggatgctgtgcta

SEQ ID NO: 5927176 - DNA, 11 bp, Homo sapiens
gtgagcgcccc

SEQ ID NO: 5927177 - DNA, 20 bp, Homo sapiens
gtgagcgccccgcccccacc

SEQ ID NO: 5927178 - DNA, 12 bp, Homo sapiens
gtgagctaagca

SEQ ID NO: 5927179 - DNA, 20 bp, Homo sapiens
gtgagctcaaactggccttg

SEQ ID NO: 5927180 - DNA, 15 bp, Homo sapiens
gtgagctcaggagag

SEQ ID NO: 5927181 - DNA, 16 bp, Homo sapiens
gtgagctcctaagcca

SEQ ID NO: 5927182 - DNA, 22 bp, Homo sapiens
gtgagctctcaggccgagagcc

SEQ ID NO: 5927183 - DNA, 19 bp, Homo sapiens
gtgagctctctcagaccct

SEQ ID NO: 5927184 - DNA, 15 bp, Homo sapiens
gtgagctctgaccct

SEQ ID NO: 5927185 - DNA, 23 bp, Homo sapiens
gtgagctgcccggcgcctgccct

SEQ ID NO: 5927186 - DNA, 17 bp, Homo sapiens
gtgagctgctgccatga

SEQ ID NO: 5927187 - DNA, 13 bp, Homo sapiens
gtgagctggggcc

SEQ ID NO: 5927188 - DNA, 15 bp, Homo sapiens
gtgagctggtgcctg

SEQ ID NO: 5927189 - DNA, 22 bp, Homo sapiens
gtgagctgtgactgctttgctg

SEQ ID NO: 5927190 - DNA, 16 bp, Homo sapiens
gtgagctttgctgcta

SEQ ID NO: 5927191 - DNA, 21 bp, Homo sapiens
gtgagctttttgttccctcat

SEQ ID NO: 5927192 - DNA, 22 bp, Homo sapiens
gtgaggaaatcaaagtgctatt

SEQ ID NO: 5927193 - DNA, 18 bp, Homo sapiens
gtgaggaaatccattgtt

SEQ ID NO: 5927194 - DNA, 21 bp, Homo sapiens
gtgaggaaatccattgtttaa

SEQ ID NO: 5927195 - DNA, 22 bp, Homo sapiens
gtgaggaaatggcaacacgtgg

SEQ ID NO: 5927196 - DNA, 22 bp, Homo sapiens
gtgaggaaccctgatctctcag

SEQ ID NO: 5927197 - DNA, 18 bp, Homo sapiens
gtgaggaaggcaggaaga

SEQ ID NO: 5927198 - DNA, 20 bp, Homo sapiens
gtgaggaatgctctgtgcca

SEQ ID NO: 5927199 - DNA, 23 bp, Homo sapiens
gtgaggacacccaggaatgaccc

SEQ ID NO: 5927200 - DNA, 18 bp, Homo sapiens
gtgaggacctgcggcctt

SEQ ID NO: 5927201 - DNA, 20 bp, Homo sapiens
gtgaggacctgtaaggcagg

SEQ ID NO: 5927202 - DNA, 23 bp, Homo sapiens
gtgaggactgttggctgattgga

SEQ ID NO: 5927203 - DNA, 20 bp, Homo sapiens
gtgaggagagggtggcatca

SEQ ID NO: 5927204 - DNA, 17 bp, Homo sapiens
gtgaggagccccatctg

SEQ ID NO: 5927205 - DNA, 17 bp, Homo sapiens
gtgaggagctgctggct

SEQ ID NO: 5927206 - DNA, 13 bp, Homo sapiens
gtgaggagctggg

SEQ ID NO: 5927207 - DNA, 14 bp, Homo sapiens
gtgaggaggaaaag

SEQ ID NO: 5927208 - DNA, 15 bp, Homo sapiens
gtgaggaggaaaagg

SEQ ID NO: 5927209 - DNA, 18 bp, Homo sapiens
gtgaggaggaaaaggaaa

SEQ ID NO: 5927210 - DNA, 14 bp, Homo sapiens
gtgaggaggacaag

SEQ ID NO: 5927211 - DNA, 13 bp, Homo sapiens
gtgaggagggatg

SEQ ID NO: 5927212 - DNA, 21 bp, Homo sapiens
gtgaggagggatgtgggtaag

SEQ ID NO: 5927213 - DNA, 14 bp, Homo sapiens
gtgaggagggcagt

SEQ ID NO: 5927214 - DNA, 16 bp, Homo sapiens
gtgaggagggggagaa

SEQ ID NO: 5927215 - DNA, 18 bp, Homo sapiens
gtgaggagggggagaagg

SEQ ID NO: 5927216 - DNA, 21 bp, Homo sapiens
gtgaggagtctgggtccatcc

SEQ ID NO: 5927217 - DNA, 21 bp, Homo sapiens
gtgaggataacacaagtaaaa

SEQ ID NO: 5927218 - DNA, 15 bp, Homo sapiens
gtgaggataggacag

SEQ ID NO: 5927219 - DNA, 21 bp, Homo sapiens
gtgaggatggcctctgctaag

SEQ ID NO: 5927220 - DNA, 21 bp, Homo sapiens
gtgaggattatgggtcctgca

SEQ ID NO: 5927221 - DNA, 18 bp, Homo sapiens
gtgaggcaagagaaatga

SEQ ID NO: 5927222 - DNA, 23 bp, Homo sapiens
gtgaggcaatgggagctgaggcc

SEQ ID NO: 5927223 - DNA, 15 bp, Homo sapiens
gtgaggcaggctttg

SEQ ID NO: 5927224 - DNA, 13 bp, Homo sapiens
gtgaggcagggac

SEQ ID NO: 5927225 - DNA, 13 bp, Homo sapiens
gtgaggcagtggg

SEQ ID NO: 5927226 - DNA, 20 bp, Homo sapiens
gtgaggcattcggggaagct

SEQ ID NO: 5927227 - DNA, 15 bp, Homo sapiens
gtgaggccactgaag

SEQ ID NO: 5927228 - DNA, 11 bp, Homo sapiens
gtgaggccaga

SEQ ID NO: 5927229 - DNA, 13 bp, Homo sapiens
gtgaggccagaga

SEQ ID NO: 5927230 - DNA, 22 bp, Homo sapiens
gtgaggccagagacacaagcct

SEQ ID NO: 5927231 - DNA, 20 bp, Homo sapiens
gtgaggccatacttgtgaaa

SEQ ID NO: 5927232 - DNA, 13 bp, Homo sapiens
gtgaggcccaagg

SEQ ID NO: 5927233 - DNA, 23 bp, Homo sapiens
gtgaggcccagcctgtcctggta

SEQ ID NO: 5927234 - DNA, 23 bp, Homo sapiens
gtgaggcccccgcacgcaagcct

SEQ ID NO: 5927235 - DNA, 21 bp, Homo sapiens
gtgaggcccccggaggcgccc

SEQ ID NO: 5927236 - DNA, 22 bp, Homo sapiens
gtgaggcccccggaggcgccca

SEQ ID NO: 5927237 - DNA, 13 bp, Homo sapiens
gtgaggcccctgt

SEQ ID NO: 5927238 - DNA, 19 bp, Homo sapiens
gtgaggcccctgtgcagta

SEQ ID NO: 5927239 - DNA, 21 bp, Homo sapiens
gtgaggcccctgtgcagtaga

SEQ ID NO: 5927240 - DNA, 19 bp, Homo sapiens
gtgaggcccgaggcagaag

SEQ ID NO: 5927241 - DNA, 18 bp, Homo sapiens
gtgaggccggccctgccc

SEQ ID NO: 5927242 - DNA, 20 bp, Homo sapiens
gtgaggccgggcgcagtggc

SEQ ID NO: 5927243 - DNA, 14 bp, Homo sapiens
gtgaggcctgtctg

SEQ ID NO: 5927244 - DNA, 15 bp, Homo sapiens
gtgaggcctgtctgt

SEQ ID NO: 5927245 - DNA, 19 bp, Homo sapiens
gtgaggcgttctcctgctt

SEQ ID NO: 5927246 - DNA, 20 bp, Homo sapiens
gtgaggcgttctcctgcttg

SEQ ID NO: 5927247 - DNA, 23 bp, Homo sapiens
gtgaggctccctccctccctgct

SEQ ID NO: 5927248 - DNA, 15 bp, Homo sapiens
gtgaggctctgccct

SEQ ID NO: 5927249 - DNA, 19 bp, Homo sapiens
gtgaggctgacatgctcac

SEQ ID NO: 5927250 - DNA, 15 bp, Homo sapiens
gtgaggctgctgcca

SEQ ID NO: 5927251 - DNA, 16 bp, Homo sapiens
gtgaggctgctgccat

SEQ ID NO: 5927252 - DNA, 14 bp, Homo sapiens
gtgaggctgtcctg

SEQ ID NO: 5927253 - DNA, 17 bp, Homo sapiens
gtgaggctgtgtctctg

SEQ ID NO: 5927254 - DNA, 21 bp, Homo sapiens
gtgaggcttaacaatgtcttg

SEQ ID NO: 5927255 - DNA, 15 bp, Homo sapiens
gtgaggcttccaggc

SEQ ID NO: 5927256 - DNA, 16 bp, Homo sapiens
gtgagggagacaggaa

SEQ ID NO: 5927257 - DNA, 13 bp, Homo sapiens
gtgagggagagaa

SEQ ID NO: 5927258 - DNA, 14 bp, Homo sapiens
gtgagggaggcctg

SEQ ID NO: 5927259 - DNA, 17 bp, Homo sapiens
gtgagggagggctgtca

SEQ ID NO: 5927260 - DNA, 21 bp, Homo sapiens
gtgagggaggggaaaagcatt

SEQ ID NO: 5927261 - DNA, 14 bp, Homo sapiens
gtgagggcaagagg

SEQ ID NO: 5927262 - DNA, 19 bp, Homo sapiens
gtgagggcaccaccaagaa

SEQ ID NO: 5927263 - DNA, 12 bp, Homo sapiens
gtgagggcagca

SEQ ID NO: 5927264 - DNA, 15 bp, Homo sapiens
gtgagggccacctcc

SEQ ID NO: 5927265 - DNA, 15 bp, Homo sapiens
gtgagggcctcagag

SEQ ID NO: 5927266 - DNA, 19 bp, Homo sapiens
gtgagggcctcagagcctg

SEQ ID NO: 5927267 - DNA, 20 bp, Homo sapiens
gtgagggcctcagagcctga

SEQ ID NO: 5927268 - DNA, 13 bp, Homo sapiens
gtgagggctgggc

SEQ ID NO: 5927269 - DNA, 16 bp, Homo sapiens
gtgagggctgggcagc

SEQ ID NO: 5927270 - DNA, 19 bp, Homo sapiens
gtgaggggcaagctaggcc

SEQ ID NO: 5927271 - DNA, 16 bp, Homo sapiens
gtgaggggccactggg

SEQ ID NO: 5927272 - DNA, 17 bp, Homo sapiens
gtgaggggccactgggc

SEQ ID NO: 5927273 - DNA, 13 bp, Homo sapiens
gtgaggggccagg

SEQ ID NO: 5927274 - DNA, 18 bp, Homo sapiens
gtgaggggcccctggccc

SEQ ID NO: 5927275 - DNA, 14 bp, Homo sapiens
gtgaggggctgtga

SEQ ID NO: 5927276 - DNA, 22 bp, Homo sapiens
gtgaggggtttcttttggaaat

SEQ ID NO: 5927277 - DNA, 18 bp, Homo sapiens
gtgagggtaagtattttc

SEQ ID NO: 5927278 - DNA, 15 bp, Homo sapiens
gtgagggtcccatgt

SEQ ID NO: 5927279 - DNA, 16 bp, Homo sapiens
gtgagggtcccatgtg

SEQ ID NO: 5927280 - DNA, 23 bp, Homo sapiens
gtgagggtcctgcagcctgcagg

SEQ ID NO: 5927281 - DNA, 24 bp, Homo sapiens
gtgagggtcctgcagcctgcagga

SEQ ID NO: 5927282 - DNA, 16 bp, Homo sapiens
gtgagggtgacagagg

SEQ ID NO: 5927283 - DNA, 22 bp, Homo sapiens
gtgagggtgcggggcctgcagg

SEQ ID NO: 5927284 - DNA, 18 bp, Homo sapiens
gtgagggtttctgagctg

SEQ ID NO: 5927285 - DNA, 23 bp, Homo sapiens
gtgaggtcatcccggggccatgg

SEQ ID NO: 5927286 - DNA, 12 bp, Homo sapiens
gtgaggtcctgg

SEQ ID NO: 5927287 - DNA, 20 bp, Homo sapiens
gtgaggtcctgggggcctga

SEQ ID NO: 5927288 - DNA, 16 bp, Homo sapiens
gtgaggtgaactccag

SEQ ID NO: 5927289 - DNA, 20 bp, Homo sapiens
gtgaggtgaactccaggcat

SEQ ID NO: 5927290 - DNA, 23 bp, Homo sapiens
gtgaggtgacttgcctggggcca

SEQ ID NO: 5927291 - DNA, 21 bp, Homo sapiens
gtgaggtgcagagtgcccaga

SEQ ID NO: 5927292 - DNA, 18 bp, Homo sapiens
gtgaggtgctgatgagtg

SEQ ID NO: 5927293 - DNA, 21 bp, Homo sapiens
gtgaggtggaattattttaaa

SEQ ID NO: 5927294 - DNA, 11 bp, Homo sapiens
gtgaggtggcc

SEQ ID NO: 5927295 - DNA, 21 bp, Homo sapiens
gtgaggtgtgcctggcctctg

SEQ ID NO: 5927296 - DNA, 16 bp, Homo sapiens
gtgaggttgggcagct

SEQ ID NO: 5927297 - DNA, 15 bp, Homo sapiens
gtgaggtttcagtag

SEQ ID NO: 5927298 - DNA, 17 bp, Homo sapiens
gtgagtactacagtcct

SEQ ID NO: 5927299 - DNA, 16 bp, Homo sapiens
gtgagtagttgttggt

SEQ ID NO: 5927300 - DNA, 20 bp, Homo sapiens
gtgagtattctatgtaaaaa

SEQ ID NO: 5927301 - DNA, 18 bp, Homo sapiens
gtgagtatttctgttcct

SEQ ID NO: 5927302 - DNA, 22 bp, Homo sapiens
gtgagtcaatacatagtgctgc

SEQ ID NO: 5927303 - DNA, 19 bp, Homo sapiens
gtgagtcaccaagcccagt

SEQ ID NO: 5927304 - DNA, 14 bp, Homo sapiens
gtgagtcacctgct

SEQ ID NO: 5927305 - DNA, 16 bp, Homo sapiens
gtgagtcacctgctcc

SEQ ID NO: 5927306 - DNA, 14 bp, Homo sapiens
gtgagtcagaatgt

SEQ ID NO: 5927307 - DNA, 13 bp, Homo sapiens
gtgagtcagcacc

SEQ ID NO: 5927308 - DNA, 18 bp, Homo sapiens
gtgagtcccctactccct

SEQ ID NO: 5927309 - DNA, 13 bp, Homo sapiens
gtgagtcctgttg

SEQ ID NO: 5927310 - DNA, 21 bp, Homo sapiens
gtgagtcctgttgaagacttc

SEQ ID NO: 5927311 - DNA, 16 bp, Homo sapiens
gtgagtctatttttaa

SEQ ID NO: 5927312 - DNA, 18 bp, Homo sapiens
gtgagtctctctgggcct

SEQ ID NO: 5927313 - DNA, 20 bp, Homo sapiens
gtgagtctgaaccaatagaa

SEQ ID NO: 5927314 - DNA, 14 bp, Homo sapiens
gtgagtctgggata

SEQ ID NO: 5927315 - DNA, 20 bp, Homo sapiens
gtgagtctgggatattcttt

SEQ ID NO: 5927316 - DNA, 18 bp, Homo sapiens
gtgagtctgtcataatat

SEQ ID NO: 5927317 - DNA, 14 bp, Homo sapiens
gtgagtctgtcctt

SEQ ID NO: 5927318 - DNA, 22 bp, Homo sapiens
gtgagtctgtgtggccagcagc

SEQ ID NO: 5927319 - DNA, 20 bp, Homo sapiens
gtgagtcttggcggcagcag

SEQ ID NO: 5927320 - DNA, 22 bp, Homo sapiens
gtgagtcttggcggcagcagcc

SEQ ID NO: 5927321 - DNA, 18 bp, Homo sapiens
gtgagtcttggttctaaa

SEQ ID NO: 5927322 - DNA, 11 bp, Homo sapiens
gtgagtgaatc

SEQ ID NO: 5927323 - DNA, 18 bp, Homo sapiens
gtgagtgagcctggctct

SEQ ID NO: 5927324 - DNA, 19 bp, Homo sapiens
gtgagtgcaagagcctgag

SEQ ID NO: 5927325 - DNA, 14 bp, Homo sapiens
gtgagtgcgcctca

SEQ ID NO: 5927326 - DNA, 17 bp, Homo sapiens
gtgagtgcgcctcacca

SEQ ID NO: 5927327 - DNA, 17 bp, Homo sapiens
gtgagtgcgtctgaggg

SEQ ID NO: 5927328 - DNA, 14 bp, Homo sapiens
gtgagtggcatgtg

SEQ ID NO: 5927329 - DNA, 16 bp, Homo sapiens
gtgagtggcatgtggg

SEQ ID NO: 5927330 - DNA, 14 bp, Homo sapiens
gtgagtgggagagt

SEQ ID NO: 5927331 - DNA, 23 bp, Homo sapiens
gtgagtgggagagtacctgtgtg

SEQ ID NO: 5927332 - DNA, 12 bp, Homo sapiens
gtgagtgggagg

SEQ ID NO: 5927333 - DNA, 16 bp, Homo sapiens
gtgagtggttgaatat

SEQ ID NO: 5927334 - DNA, 12 bp, Homo sapiens
gtgagtgtaaat

SEQ ID NO: 5927335 - DNA, 16 bp, Homo sapiens
gtgagtgtaagtgtga

SEQ ID NO: 5927336 - DNA, 23 bp, Homo sapiens
gtgagtgtatgtatacacacaca

SEQ ID NO: 5927337 - DNA, 14 bp, Homo sapiens
gtgagtgtatgtgt

SEQ ID NO: 5927338 - DNA, 16 bp, Homo sapiens
gtgagtgtatgtgtgt

SEQ ID NO: 5927339 - DNA, 14 bp, Homo sapiens
gtgagtgtgaaagg

SEQ ID NO: 5927340 - DNA, 17 bp, Homo sapiens
gtgcacagacctcagag

SEQ ID NO: 5927341 - DNA, 13 bp, Homo sapiens
gtgcacaggaggg

SEQ ID NO: 5927342 - DNA, 14 bp, Homo sapiens
gtgcacaggagggg

SEQ ID NO: 5927343 - DNA, 14 bp, Homo sapiens
gtgcacaggcctct

SEQ ID NO: 5927344 - DNA, 15 bp, Homo sapiens
gtgcacaggcctctg

SEQ ID NO: 5927345 - DNA, 16 bp, Homo sapiens
gtgcacaggcctctgc

SEQ ID NO: 5927346 - DNA, 21 bp, Homo sapiens
gtgcacaggcctctgcctgct

SEQ ID NO: 5927347 - DNA, 14 bp, Homo sapiens
gtgcacagtggctt

SEQ ID NO: 5927348 - DNA, 17 bp, Homo sapiens
gtgcacatctacatgcc

SEQ ID NO: 5927349 - DNA, 21 bp, Homo sapiens
gtgcacatgcacgtgtgtgca

SEQ ID NO: 5927350 - DNA, 15 bp, Homo sapiens
gtgcacatgcctctg

SEQ ID NO: 5927351 - DNA, 22 bp, Homo sapiens
gtgcaccaccatgccaggctaa

SEQ ID NO: 5927352 - DNA, 16 bp, Homo sapiens
gtgcaccatccctttt

SEQ ID NO: 5927353 - DNA, 15 bp, Homo sapiens
gtgcacccacctgtt

SEQ ID NO: 5927354 - DNA, 20 bp, Homo sapiens
gtgcacccactcaccagggt

SEQ ID NO: 5927355 - DNA, 15 bp, Homo sapiens
gtgcacccactctgc

SEQ ID NO: 5927356 - DNA, 19 bp, Homo sapiens
gtgcacccatgggctctga

SEQ ID NO: 5927357 - DNA, 16 bp, Homo sapiens
gtgcacccctccccat

SEQ ID NO: 5927358 - DNA, 23 bp, Homo sapiens
gtgcacctatggcccagccactg

SEQ ID NO: 5927359 - DNA, 22 bp, Homo sapiens
gtgcacctcaaatcttctaatt

SEQ ID NO: 5927360 - DNA, 19 bp, Homo sapiens
gtgcacctccctccccagc

SEQ ID NO: 5927361 - DNA, 13 bp, Homo sapiens
gtgcacctgcccc

SEQ ID NO: 5927362 - DNA, 17 bp, Homo sapiens
gtgcacctgccccaggc

SEQ ID NO: 5927363 - DNA, 22 bp, Homo sapiens
gtgcacctgggacagggagcag

SEQ ID NO: 5927364 - DNA, 21 bp, Homo sapiens
gtgcacctgtactcaggaggc

SEQ ID NO: 5927365 - DNA, 20 bp, Homo sapiens
gtgcaccttaccaactttct

SEQ ID NO: 5927366 - DNA, 21 bp, Homo sapiens
gtgcaccttaccaactttctg

SEQ ID NO: 5927367 - DNA, 18 bp, Homo sapiens
gtgcacgcacactgtctg

SEQ ID NO: 5927368 - DNA, 18 bp, Homo sapiens
gtgcacgcagattagcag

SEQ ID NO: 5927369 - DNA, 18 bp, Homo sapiens
gtgcacgccaccacacct

SEQ ID NO: 5927370 - DNA, 22 bp, Homo sapiens
gtgcacgccaccacacctggct

SEQ ID NO: 5927371 - DNA, 13 bp, Homo sapiens
gtgcacggcagct

SEQ ID NO: 5927372 - DNA, 15 bp, Homo sapiens
gtgcacggccagctg

SEQ ID NO: 5927373 - DNA, 14 bp, Homo sapiens
gtgcacggggccag

SEQ ID NO: 5927374 - DNA, 19 bp, Homo sapiens
gtgcacggggccagcatcc

SEQ ID NO: 5927375 - DNA, 23 bp, Homo sapiens
gtgcacgtaaagtacttgtagtt

SEQ ID NO: 5927376 - DNA, 18 bp, Homo sapiens
gtgcacgtacacacacat

SEQ ID NO: 5927377 - DNA, 16 bp, Homo sapiens
gtgcacgtggagagct

SEQ ID NO: 5927378 - DNA, 13 bp, Homo sapiens
gtgcactccagac

SEQ ID NO: 5927379 - DNA, 20 bp, Homo sapiens
gtgcactccagactctgggg

SEQ ID NO: 5927380 - DNA, 17 bp, Homo sapiens
gtgcactccctaagaaa

SEQ ID NO: 5927381 - DNA, 22 bp, Homo sapiens
gtgcactgaatcgtttcatgta

SEQ ID NO: 5927382 - DNA, 12 bp, Homo sapiens
gtgcactgacag

SEQ ID NO: 5927383 - DNA, 18 bp, Homo sapiens
gtgcactgacagccttgc

SEQ ID NO: 5927384 - DNA, 18 bp, Homo sapiens
gtgcactgacctgtaggt

SEQ ID NO: 5927385 - DNA, 15 bp, Homo sapiens
gtgcactgcccatgg

SEQ ID NO: 5927386 - DNA, 13 bp, Homo sapiens
gtgcactgccctg

SEQ ID NO: 5927387 - DNA, 20 bp, Homo sapiens
gtgcactgctccctggggtt

SEQ ID NO: 5927388 - DNA, 14 bp, Homo sapiens
gtgcactgggcagg

SEQ ID NO: 5927389 - DNA, 22 bp, Homo sapiens
gtgcactgggcaggttcctggg

SEQ ID NO: 5927390 - DNA, 23 bp, Homo sapiens
gtgcactgggcaggttcctgggg

SEQ ID NO: 5927391 - DNA, 23 bp, Homo sapiens
gtgcactgtcactttgctctggg

SEQ ID NO: 5927392 - DNA, 20 bp, Homo sapiens
gtgcactgtgaatcctggca

SEQ ID NO: 5927393 - DNA, 13 bp, Homo sapiens
gtgcactgtgtcc

SEQ ID NO: 5927394 - DNA, 22 bp, Homo sapiens
gtgcacttagtagtttttacaa

SEQ ID NO: 5927395 - DNA, 22 bp, Homo sapiens
gtgcactttatcttgggaccaa

SEQ ID NO: 5927396 - DNA, 14 bp, Homo sapiens
gtgcactttgtaaa

SEQ ID NO: 5927397 - DNA, 22 bp, Homo sapiens
gtgcagaaaaaaaaaaagaaac

SEQ ID NO: 5927398 - DNA, 17 bp, Homo sapiens
gtgcagaaaacattgtt

SEQ ID NO: 5927399 - DNA, 19 bp, Homo sapiens
gtgcagaaaagctcagagt

SEQ ID NO: 5927400 - DNA, 16 bp, Homo sapiens
gtgcagaaatttgaat

SEQ ID NO: 5927401 - DNA, 15 bp, Homo sapiens
gtgcagaacacctgg

SEQ ID NO: 5927402 - DNA, 16 bp, Homo sapiens
gtgcagaacacctggc

SEQ ID NO: 5927403 - DNA, 22 bp, Homo sapiens
gtgcagaaggtctggtcggcaa

SEQ ID NO: 5927404 - DNA, 21 bp, Homo sapiens
gtgcagaaggtgaaatggagg

SEQ ID NO: 5927405 - DNA, 12 bp, Homo sapiens
gtgcagaataat

SEQ ID NO: 5927406 - DNA, 16 bp, Homo sapiens
gtgcagaataatggaa

SEQ ID NO: 5927407 - DNA, 19 bp, Homo sapiens
gtgcagaataatggaaaca

SEQ ID NO: 5927408 - DNA, 12 bp, Homo sapiens
gtgcagaatgta

SEQ ID NO: 5927409 - DNA, 22 bp, Homo sapiens
gtgcagaatgtaagtgggccca

SEQ ID NO: 5927410 - DNA, 22 bp, Homo sapiens
gtgcagacacctaaccccaggg

SEQ ID NO: 5927411 - DNA, 14 bp, Homo sapiens
gtgcagacagccat

SEQ ID NO: 5927412 - DNA, 13 bp, Homo sapiens
gtgcagacaggcc

SEQ ID NO: 5927413 - DNA, 22 bp, Homo sapiens
gtgcagacaggccatgtgagcc

SEQ ID NO: 5927414 - DNA, 23 bp, Homo sapiens
gtgcagacaggccatgtgagcca

SEQ ID NO: 5927415 - DNA, 17 bp, Homo sapiens
gtgcagacagtgtcaga

SEQ ID NO: 5927416 - DNA, 13 bp, Homo sapiens
gtgcagacccagt

SEQ ID NO: 5927417 - DNA, 16 bp, Homo sapiens
gtgcagacccagtccc

SEQ ID NO: 5927418 - DNA, 20 bp, Homo sapiens
gtgcagaccccttggccagc

SEQ ID NO: 5927419 - DNA, 23 bp, Homo sapiens
gtgcagaccctgaacccacacct

SEQ ID NO: 5927420 - DNA, 23 bp, Homo sapiens
gtgcagaccttactcaggggatg

SEQ ID NO: 5927421 - DNA, 19 bp, Homo sapiens
gtgcagagaagctggactt

SEQ ID NO: 5927422 - DNA, 19 bp, Homo sapiens
gtgcagagaggttgtgaaa

SEQ ID NO: 5927423 - DNA, 14 bp, Homo sapiens
gtgcagagcagaca

SEQ ID NO: 5927424 - DNA, 16 bp, Homo sapiens
gtgcagagcagacagg

SEQ ID NO: 5927425 - DNA, 18 bp, Homo sapiens
gtgcagagcagacaggct

SEQ ID NO: 5927426 - DNA, 19 bp, Homo sapiens
gtgcagagcagacaggcta

SEQ ID NO: 5927427 - DNA, 23 bp, Homo sapiens
gtgcagagccttctcagaagcac

SEQ ID NO: 5927428 - DNA, 21 bp, Homo sapiens
gtgcagagctgcacttggcct

SEQ ID NO: 5927429 - DNA, 23 bp, Homo sapiens
gtgcagagctgcacttggcctca

SEQ ID NO: 5927430 - DNA, 12 bp, Homo sapiens
gtgcagaggaag

SEQ ID NO: 5927431 - DNA, 23 bp, Homo sapiens
gtgcagaggaagtggaaggcatc

SEQ ID NO: 5927432 - DNA, 21 bp, Homo sapiens
gtgcagaggcggctctggttc

SEQ ID NO: 5927433 - DNA, 16 bp, Homo sapiens
gtgcagaggctgagca

SEQ ID NO: 5927434 - DNA, 18 bp, Homo sapiens
gtgcagaggctgagcagg

SEQ ID NO: 5927435 - DNA, 17 bp, Homo sapiens
gtgcagaggctgtggct

SEQ ID NO: 5927436 - DNA, 22 bp, Homo sapiens
gtgcagaggtcagactaagaaa

SEQ ID NO: 5927437 - DNA, 16 bp, Homo sapiens
gtgcagagtgcccaga

SEQ ID NO: 5927438 - DNA, 22 bp, Homo sapiens
gtgcagatcatccgtctgtgtg

SEQ ID NO: 5927439 - DNA, 23 bp, Homo sapiens
gtgcagatgagcagtcacactgt

SEQ ID NO: 5927440 - DNA, 13 bp, Homo sapiens
gtgcagatgctgc

SEQ ID NO: 5927441 - DNA, 19 bp, Homo sapiens
gtgcagatggtactgctga

SEQ ID NO: 5927442 - DNA, 18 bp, Homo sapiens
gtgcagcaaccagagcac

SEQ ID NO: 5927443 - DNA, 15 bp, Homo sapiens
gtgcagcaagcctgg

SEQ ID NO: 5927444 - DNA, 14 bp, Homo sapiens
gtgcagcagattgg

SEQ ID NO: 5927445 - DNA, 16 bp, Homo sapiens
gtgcagcagcccagct

SEQ ID NO: 5927446 - DNA, 19 bp, Homo sapiens
gtgcagcagcccagcttcc

SEQ ID NO: 5927447 - DNA, 20 bp, Homo sapiens
gtgcagccaaaggggagcca

SEQ ID NO: 5927448 - DNA, 22 bp, Homo sapiens
gtgcagccaaaggggagccaga

SEQ ID NO: 5927449 - DNA, 13 bp, Homo sapiens
gtgcagccagagg

SEQ ID NO: 5927450 - DNA, 14 bp, Homo sapiens
gtgcagccagaggc

SEQ ID NO: 5927451 - DNA, 19 bp, Homo sapiens
gtgcagccccagggcctgc

SEQ ID NO: 5927452 - DNA, 19 bp, Homo sapiens
gtgcagccccgccctctgc

SEQ ID NO: 5927453 - DNA, 21 bp, Homo sapiens
gtgcagccccgccctctgcgt

SEQ ID NO: 5927454 - DNA, 22 bp, Homo sapiens
gtgcagccccgcctccaggcca

SEQ ID NO: 5927455 - DNA, 24 bp, Homo sapiens
gtgcagcccctctcacaggcagct

SEQ ID NO: 5927456 - DNA, 18 bp, Homo sapiens
gtgcagcccttcctcctg

SEQ ID NO: 5927457 - DNA, 19 bp, Homo sapiens
gtgcagcccttcctcctga

SEQ ID NO: 5927458 - DNA, 18 bp, Homo sapiens
gtgcagccggggagctga

SEQ ID NO: 5927459 - DNA, 13 bp, Homo sapiens
gtgcagccttccc

SEQ ID NO: 5927460 - DNA, 20 bp, Homo sapiens
gtgcagccttcccctccctg

SEQ ID NO: 5927461 - DNA, 13 bp, Homo sapiens
gtgcagccttctc

SEQ ID NO: 5927462 - DNA, 17 bp, Homo sapiens
gtgcagcgacccttggt

SEQ ID NO: 5927463 - DNA, 16 bp, Homo sapiens
gtgcagcgggccaggc

SEQ ID NO: 5927464 - DNA, 19 bp, Homo sapiens
gtgcagcgggccaggcagg

SEQ ID NO: 5927465 - DNA, 15 bp, Homo sapiens
gtgcagcggtggaag

SEQ ID NO: 5927466 - DNA, 17 bp, Homo sapiens
gtgcagcgtgtgtgcca

SEQ ID NO: 5927467 - DNA, 23 bp, Homo sapiens
gtgcagctcaaggaaaggcctga

SEQ ID NO: 5927468 - DNA, 14 bp, Homo sapiens
gtgcagctcctcag

SEQ ID NO: 5927469 - DNA, 15 bp, Homo sapiens
gtgcagctcctcagc

SEQ ID NO: 5927470 - DNA, 18 bp, Homo sapiens
gtgcagctgattttaaca

SEQ ID NO: 5927471 - DNA, 23 bp, Homo sapiens
gtgcagctgattttaacaataac

SEQ ID NO: 5927472 - DNA, 16 bp, Homo sapiens
gtgcagctgcgttctg

SEQ ID NO: 5927473 - DNA, 13 bp, Homo sapiens
gtgcagctgggtg

SEQ ID NO: 5927474 - DNA, 15 bp, Homo sapiens
gtgcagctgggtggg

SEQ ID NO: 5927475 - DNA, 16 bp, Homo sapiens
gtgcagctgggtgggg

SEQ ID NO: 5927476 - DNA, 19 bp, Homo sapiens
gtgcagcttcacccaccag

SEQ ID NO: 5927477 - DNA, 20 bp, Homo sapiens
gtgcagcttcacccaccagg

SEQ ID NO: 5927478 - DNA, 19 bp, Homo sapiens
gtgcagcttcgaggacagg

SEQ ID NO: 5927479 - DNA, 16 bp, Homo sapiens
gtgcagcttctgtcct

SEQ ID NO: 5927480 - DNA, 15 bp, Homo sapiens
gtgcagcttgcagtc

SEQ ID NO: 5927481 - DNA, 22 bp, Homo sapiens
gtgcaggaaaaggctgcagcta

SEQ ID NO: 5927482 - DNA, 16 bp, Homo sapiens
gtgcaggacagctctt

SEQ ID NO: 5927483 - DNA, 17 bp, Homo sapiens
gtgcaggacagctcttg

SEQ ID NO: 5927484 - DNA, 11 bp, Homo sapiens
gtgcaggactc

SEQ ID NO: 5927485 - DNA, 16 bp, Homo sapiens
gtgcaggagcaaggct

SEQ ID NO: 5927486 - DNA, 18 bp, Homo sapiens
gtgcaggagcctccctgc

SEQ ID NO: 5927487 - DNA, 15 bp, Homo sapiens
gtgcaggagcgctcc

SEQ ID NO: 5927488 - DNA, 17 bp, Homo sapiens
gtgcaggagcgctccct

SEQ ID NO: 5927489 - DNA, 12 bp, Homo sapiens
gtgcaggcaggc

SEQ ID NO: 5927490 - DNA, 18 bp, Homo sapiens
gtgcaggcctgctcaggg

SEQ ID NO: 5927491 - DNA, 17 bp, Homo sapiens
gtgcaggcctgtccctg

SEQ ID NO: 5927492 - DNA, 20 bp, Homo sapiens
gtgcaggcctgtccctggga

SEQ ID NO: 5927493 - DNA, 20 bp, Homo sapiens
gtgcaggcgcgcaccgccca

SEQ ID NO: 5927494 - DNA, 11 bp, Homo sapiens
gtgcaggctgc

SEQ ID NO: 5927495 - DNA, 22 bp, Homo sapiens
gtgcaggctgcagtggctcccc

SEQ ID NO: 5927496 - DNA, 17 bp, Homo sapiens
gtgcaggctggccagcc

SEQ ID NO: 5927497 - DNA, 23 bp, Homo sapiens
gtgcagggaaagggatggtcagg

SEQ ID NO: 5927498 - DNA, 17 bp, Homo sapiens
gtgcagggacaaagagg

SEQ ID NO: 5927499 - DNA, 14 bp, Homo sapiens
gtgcagggcacaga

SEQ ID NO: 5927500 - DNA, 17 bp, Homo sapiens
gtgcagggcacagaagg

SEQ ID NO: 5927501 - DNA, 15 bp, Homo sapiens
gtgcagggcctggca

SEQ ID NO: 5927502 - DNA, 16 bp, Homo sapiens
gtgcagggcctggcat

SEQ ID NO: 5927503 - DNA, 12 bp, Homo sapiens
gtgcagggctgc

SEQ ID NO: 5927504 - DNA, 16 bp, Homo sapiens
gtgcagggctggtctt

SEQ ID NO: 5927505 - DNA, 21 bp, Homo sapiens
gtgcaggggatggggtggggg

SEQ ID NO: 5927506 - DNA, 20 bp, Homo sapiens
gtgcagggtgtgtactgcac

SEQ ID NO: 5927507 - DNA, 15 bp, Homo sapiens
gtgcaggtagacctg

SEQ ID NO: 5927508 - DNA, 21 bp, Homo sapiens
gtgcaggtagacctgtctcct

SEQ ID NO: 5927509 - DNA, 22 bp, Homo sapiens
gtgcaggtagacctgtctcctg

SEQ ID NO: 5927510 - DNA, 21 bp, Homo sapiens
gtgcaggtatttcagaaggag

SEQ ID NO: 5927511 - DNA, 13 bp, Homo sapiens
gtgcaggtctcca

SEQ ID NO: 5927512 - DNA, 14 bp, Homo sapiens
gtgcaggtctccac

SEQ ID NO: 5927513 - DNA, 18 bp, Homo sapiens
gtgcaggtctccacctgc

SEQ ID NO: 5927514 - DNA, 16 bp, Homo sapiens
gtgcaggtgggcactg

SEQ ID NO: 5927515 - DNA, 15 bp, Homo sapiens
gtgcaggtggggaga

SEQ ID NO: 5927516 - DNA, 13 bp, Homo sapiens
gtgccagcagcct

SEQ ID NO: 5927517 - DNA, 21 bp, Homo sapiens
gtgccagcagcctcgcacagg

SEQ ID NO: 5927518 - DNA, 22 bp, Homo sapiens
gtgccagcagcctcgcacaggc

SEQ ID NO: 5927519 - DNA, 23 bp, Homo sapiens
gtgccagcatacattttctggtg

SEQ ID NO: 5927520 - DNA, 14 bp, Homo sapiens
gtgccagcattcca

SEQ ID NO: 5927521 - DNA, 20 bp, Homo sapiens
gtgccagcccggaggggact

SEQ ID NO: 5927522 - DNA, 22 bp, Homo sapiens
gtgccagccgtgatgctcaggc

SEQ ID NO: 5927523 - DNA, 19 bp, Homo sapiens
gtgccagccttcctctgca

SEQ ID NO: 5927524 - DNA, 14 bp, Homo sapiens
gtgccagctgccct

SEQ ID NO: 5927525 - DNA, 18 bp, Homo sapiens
gtgccagctgcccttgca

SEQ ID NO: 5927526 - DNA, 22 bp, Homo sapiens
gtgccagctgcttctgcccacc

SEQ ID NO: 5927527 - DNA, 11 bp, Homo sapiens
gtgccagctgg

SEQ ID NO: 5927528 - DNA, 11 bp, Homo sapiens
gtgccaggaca

SEQ ID NO: 5927529 - DNA, 13 bp, Homo sapiens
gtgccaggacaat

SEQ ID NO: 5927530 - DNA, 16 bp, Homo sapiens
gtgccaggacagctgg

SEQ ID NO: 5927531 - DNA, 22 bp, Homo sapiens
gtgccaggacagctggctgctg

SEQ ID NO: 5927532 - DNA, 21 bp, Homo sapiens
gtgccaggactccccaggcca

SEQ ID NO: 5927533 - DNA, 23 bp, Homo sapiens
gtgccaggactccccaggccagg

SEQ ID NO: 5927534 - DNA, 16 bp, Homo sapiens
gtgccaggagcaatgg

SEQ ID NO: 5927535 - DNA, 19 bp, Homo sapiens
gtgccaggagcaatgggac

SEQ ID NO: 5927536 - DNA, 22 bp, Homo sapiens
gtgccaggagcaatgggactgg

SEQ ID NO: 5927537 - DNA, 11 bp, Homo sapiens
gtgccaggagg

SEQ ID NO: 5927538 - DNA, 17 bp, Homo sapiens
gtgccaggaggcggcag

SEQ ID NO: 5927539 - DNA, 14 bp, Homo sapiens
gtgccaggagtggg

SEQ ID NO: 5927540 - DNA, 19 bp, Homo sapiens
gtgccaggagtgggtggga

SEQ ID NO: 5927541 - DNA, 22 bp, Homo sapiens
gtgccaggagtgggtgggacac

SEQ ID NO: 5927542 - DNA, 21 bp, Homo sapiens
gtgccaggatggaatgatggg

SEQ ID NO: 5927543 - DNA, 20 bp, Homo sapiens
gtgccaggcagatcctctgg

SEQ ID NO: 5927544 - DNA, 13 bp, Homo sapiens
gtgccaggcccgg

SEQ ID NO: 5927545 - DNA, 19 bp, Homo sapiens
gtgccaggcccggggctgg

SEQ ID NO: 5927546 - DNA, 12 bp, Homo sapiens
gtgccaggctgg

SEQ ID NO: 5927547 - DNA, 18 bp, Homo sapiens
gtgccaggctgggaggct

SEQ ID NO: 5927548 - DNA, 15 bp, Homo sapiens
gtgccaggcttgcct

SEQ ID NO: 5927549 - DNA, 17 bp, Homo sapiens
gtgccagggcccacccc

SEQ ID NO: 5927550 - DNA, 23 bp, Homo sapiens
gtgccagtcctcctcaggagaag

SEQ ID NO: 5927551 - DNA, 16 bp, Homo sapiens
gtgccagtcgcgctgc

SEQ ID NO: 5927552 - DNA, 22 bp, Homo sapiens
gtgccagtcgcgctgcctgtgt

SEQ ID NO: 5927553 - DNA, 15 bp, Homo sapiens
gtgccagttcctgta

SEQ ID NO: 5927554 - DNA, 23 bp, Homo sapiens
gtgccagttgggctcgcactgcc

SEQ ID NO: 5927555 - DNA, 17 bp, Homo sapiens
gtgccatactaatgatg

SEQ ID NO: 5927556 - DNA, 24 bp, Homo sapiens
gtgccatcaccacggctcactgca

SEQ ID NO: 5927557 - DNA, 21 bp, Homo sapiens
gtgccatcaccataacctctg

SEQ ID NO: 5927558 - DNA, 14 bp, Homo sapiens
gtgccatccctgag

SEQ ID NO: 5927559 - DNA, 15 bp, Homo sapiens
gtgccatccctgaga

SEQ ID NO: 5927560 - DNA, 16 bp, Homo sapiens
gtgccatgcctgctcc

SEQ ID NO: 5927561 - DNA, 24 bp, Homo sapiens
gtgccatgcctgctccctgtctgt

SEQ ID NO: 5927562 - DNA, 17 bp, Homo sapiens
gtgccatggatctgatc

SEQ ID NO: 5927563 - DNA, 20 bp, Homo sapiens
gtgccatggatttccactgc

SEQ ID NO: 5927564 - DNA, 21 bp, Homo sapiens
gtgccatggtgttggaggggc

SEQ ID NO: 5927565 - DNA, 22 bp, Homo sapiens
gtgccatggtgttggaggggca

SEQ ID NO: 5927566 - DNA, 19 bp, Homo sapiens
gtgccatgtcaaacaaata

SEQ ID NO: 5927567 - DNA, 12 bp, Homo sapiens
gtgccatgtctg

SEQ ID NO: 5927568 - DNA, 16 bp, Homo sapiens
gtgccatgtgccaggt

SEQ ID NO: 5927569 - DNA, 16 bp, Homo sapiens
gtgccatgtggagtgg

SEQ ID NO: 5927570 - DNA, 19 bp, Homo sapiens
gtgccattacactccagcc

SEQ ID NO: 5927571 - DNA, 22 bp, Homo sapiens
gtgccattacactccagcctgg

SEQ ID NO: 5927572 - DNA, 17 bp, Homo sapiens
gtgccattactactgta

SEQ ID NO: 5927573 - DNA, 19 bp, Homo sapiens
gtgccattatatttgcatt

SEQ ID NO: 5927574 - DNA, 12 bp, Homo sapiens
gtgccattcatc

SEQ ID NO: 5927575 - DNA, 21 bp, Homo sapiens
gtgccattccactccactcag

SEQ ID NO: 5927576 - DNA, 21 bp, Homo sapiens
gtgccattgtactccagcctg

SEQ ID NO: 5927577 - DNA, 21 bp, Homo sapiens
gtgccatttctgaactgttac

SEQ ID NO: 5927578 - DNA, 16 bp, Homo sapiens
gtgccattttaataaa

SEQ ID NO: 5927579 - DNA, 20 bp, Homo sapiens
gtgcccaagaatagatgctg

SEQ ID NO: 5927580 - DNA, 16 bp, Homo sapiens
gtgcccaagctcagaa

SEQ ID NO: 5927581 - DNA, 14 bp, Homo sapiens
gtgcccaagtgggc

SEQ ID NO: 5927582 - DNA, 23 bp, Homo sapiens
gtgcccaagttgtggtgctgaca

SEQ ID NO: 5927583 - DNA, 13 bp, Homo sapiens
gtgcccacaggcc

SEQ ID NO: 5927584 - DNA, 21 bp, Homo sapiens
gtgcccacaggccgccctgcg

SEQ ID NO: 5927585 - DNA, 22 bp, Homo sapiens
gtgcccacagtgtcaggcactg

SEQ ID NO: 5927586 - DNA, 15 bp, Homo sapiens
gtgcccacatcccag

SEQ ID NO: 5927587 - DNA, 16 bp, Homo sapiens
gtgcccacatttgatg

SEQ ID NO: 5927588 - DNA, 17 bp, Homo sapiens
gtgcccacccagggccc

SEQ ID NO: 5927589 - DNA, 20 bp, Homo sapiens
gtgcccaccgccctcctcca

SEQ ID NO: 5927590 - DNA, 20 bp, Homo sapiens
gtgcccactccgccagccac

SEQ ID NO: 5927591 - DNA, 17 bp, Homo sapiens
gtgcccagaacttccct

SEQ ID NO: 5927592 - DNA, 19 bp, Homo sapiens
gtgcccagaacttccctga

SEQ ID NO: 5927593 - DNA, 20 bp, Homo sapiens
gtgcccagagatgggactgg

SEQ ID NO: 5927594 - DNA, 13 bp, Homo sapiens
gtgcccagcagag

SEQ ID NO: 5927595 - DNA, 12 bp, Homo sapiens
gtgcccagcagg

SEQ ID NO: 5927596 - DNA, 13 bp, Homo sapiens
gtgcccagcaggc

SEQ ID NO: 5927597 - DNA, 20 bp, Homo sapiens
gtgcccagcccctgccccta

SEQ ID NO: 5927598 - DNA, 10 bp, Homo sapiens
gtgcccagga

SEQ ID NO: 5927599 - DNA, 22 bp, Homo sapiens
gtgcccaggacggtctgtgccc

SEQ ID NO: 5927600 - DNA, 13 bp, Homo sapiens
gtgcccaggagaa

SEQ ID NO: 5927601 - DNA, 12 bp, Homo sapiens
gtgcccaggccc

SEQ ID NO: 5927602 - DNA, 17 bp, Homo sapiens
gtgcccaggcccttggc

SEQ ID NO: 5927603 - DNA, 18 bp, Homo sapiens
gtgcccaggcccttggct

SEQ ID NO: 5927604 - DNA, 14 bp, Homo sapiens
gtgcccagggtggc

SEQ ID NO: 5927605 - DNA, 22 bp, Homo sapiens
gtgcccagggttttgccccaag

SEQ ID NO: 5927606 - DNA, 15 bp, Homo sapiens
gtgcccagtcttgag

SEQ ID NO: 5927607 - DNA, 21 bp, Homo sapiens
gtgcccatgggcactgctggg

SEQ ID NO: 5927608 - DNA, 19 bp, Homo sapiens
gtgcccattaccactcaag

SEQ ID NO: 5927609 - DNA, 12 bp, Homo sapiens
gtgccccaagag

SEQ ID NO: 5927610 - DNA, 14 bp, Homo sapiens
gtgccccaaggagg

SEQ ID NO: 5927611 - DNA, 17 bp, Homo sapiens
gtgccccaaggaggtgg

SEQ ID NO: 5927612 - DNA, 12 bp, Homo sapiens
gtgccccacagc

SEQ ID NO: 5927613 - DNA, 13 bp, Homo sapiens
gtgccccacagct

SEQ ID NO: 5927614 - DNA, 17 bp, Homo sapiens
gtgccccacagctacct

SEQ ID NO: 5927615 - DNA, 18 bp, Homo sapiens
gtgccccaccactcccca

SEQ ID NO: 5927616 - DNA, 17 bp, Homo sapiens
gtgccccacctccccac

SEQ ID NO: 5927617 - DNA, 20 bp, Homo sapiens
gtgccccacctcccgccctc

SEQ ID NO: 5927618 - DNA, 12 bp, Homo sapiens
gtgccccacctg

SEQ ID NO: 5927619 - DNA, 18 bp, Homo sapiens
gtgccccacctgcctggt

SEQ ID NO: 5927620 - DNA, 15 bp, Homo sapiens
gtgccccactccagc

SEQ ID NO: 5927621 - DNA, 19 bp, Homo sapiens
gtgccccactccagcctgg

SEQ ID NO: 5927622 - DNA, 20 bp, Homo sapiens
gtgccccactccagcctggg

SEQ ID NO: 5927623 - DNA, 17 bp, Homo sapiens
gtgccccacttctggcc

SEQ ID NO: 5927624 - DNA, 12 bp, Homo sapiens
gtgccccagact

SEQ ID NO: 5927625 - DNA, 18 bp, Homo sapiens
gtgccccagactgagctc

SEQ ID NO: 5927626 - DNA, 21 bp, Homo sapiens
gtgccccagactgagctctcc

SEQ ID NO: 5927627 - DNA, 23 bp, Homo sapiens
gtgccccagactgagctctccag

SEQ ID NO: 5927628 - DNA, 14 bp, Homo sapiens
gtgccccagctgcc

SEQ ID NO: 5927629 - DNA, 16 bp, Homo sapiens
gtgccccagctgccag

SEQ ID NO: 5927630 - DNA, 12 bp, Homo sapiens
gtgccccaggac

SEQ ID NO: 5927631 - DNA, 16 bp, Homo sapiens
gtgccccatgcctgtc

SEQ ID NO: 5927632 - DNA, 21 bp, Homo sapiens
gtgccccatgcctgtccagcc

SEQ ID NO: 5927633 - DNA, 12 bp, Homo sapiens
gtgcccccaccc

SEQ ID NO: 5927634 - DNA, 15 bp, Homo sapiens
gtgcccccactgacc

SEQ ID NO: 5927635 - DNA, 19 bp, Homo sapiens
gtgcccccactgaccagaa

SEQ ID NO: 5927636 - DNA, 20 bp, Homo sapiens
gtgcccccagacagctgctc

SEQ ID NO: 5927637 - DNA, 14 bp, Homo sapiens
gtgcccccagagtg

SEQ ID NO: 5927638 - DNA, 13 bp, Homo sapiens
gtgcccccagcct

SEQ ID NO: 5927639 - DNA, 22 bp, Homo sapiens
gtgcccccagggtcctgggagg

SEQ ID NO: 5927640 - DNA, 14 bp, Homo sapiens
gtgcccccatcttt

SEQ ID NO: 5927641 - DNA, 14 bp, Homo sapiens
gtgccccccagttc

SEQ ID NO: 5927642 - DNA, 22 bp, Homo sapiens
gtgccccccatcctggcccatc

SEQ ID NO: 5927643 - DNA, 18 bp, Homo sapiens
gtgcccccctcctccagt

SEQ ID NO: 5927644 - DNA, 19 bp, Homo sapiens
gtgcccccgcctgccaccg

SEQ ID NO: 5927645 - DNA, 17 bp, Homo sapiens
gtgcccccgggaatgga

SEQ ID NO: 5927646 - DNA, 14 bp, Homo sapiens
gtgccccctcctct

SEQ ID NO: 5927647 - DNA, 18 bp, Homo sapiens
gtgccccctcctctccca

SEQ ID NO: 5927648 - DNA, 14 bp, Homo sapiens
gtgccccctctacc

SEQ ID NO: 5927649 - DNA, 17 bp, Homo sapiens
gtgccccctctaccatt

SEQ ID NO: 5927650 - DNA, 12 bp, Homo sapiens
gtgccccctggg

SEQ ID NO: 5927651 - DNA, 23 bp, Homo sapiens
gtgccccctggggggcacagcca

SEQ ID NO: 5927652 - DNA, 21 bp, Homo sapiens
gtgcccccttcaagcctgtgc

SEQ ID NO: 5927653 - DNA, 14 bp, Homo sapiens
gtgccccgcctccc

SEQ ID NO: 5927654 - DNA, 17 bp, Homo sapiens
gtgccccgcctcccggg

SEQ ID NO: 5927655 - DNA, 17 bp, Homo sapiens
gtgccccgcgggctttg

SEQ ID NO: 5927656 - DNA, 22 bp, Homo sapiens
gtgccccgcgggctttgttgct

SEQ ID NO: 5927657 - DNA, 23 bp, Homo sapiens
gtgcccctaaagagcatcctgat

SEQ ID NO: 5927658 - DNA, 13 bp, Homo sapiens
gtgcccctagctt

SEQ ID NO: 5927659 - DNA, 17 bp, Homo sapiens
gtgcccctcccatggcc

SEQ ID NO: 5927660 - DNA, 15 bp, Homo sapiens
gtgcccctcctgggt

SEQ ID NO: 5927661 - DNA, 20 bp, Homo sapiens
gtgcccctcctgggtgctca

SEQ ID NO: 5927662 - DNA, 16 bp, Homo sapiens
gtgcccctcgccagct

SEQ ID NO: 5927663 - DNA, 21 bp, Homo sapiens
gtgcccctcttccaaaggcag

SEQ ID NO: 5927664 - DNA, 14 bp, Homo sapiens
gtgcccctgatgca

SEQ ID NO: 5927665 - DNA, 14 bp, Homo sapiens
gtgcccctgctcac

SEQ ID NO: 5927666 - DNA, 15 bp, Homo sapiens
gtgcccctgctcaca

SEQ ID NO: 5927667 - DNA, 12 bp, Homo sapiens
gtgcccctgctg

SEQ ID NO: 5927668 - DNA, 19 bp, Homo sapiens
gtgcccctgctgcctcccc

SEQ ID NO: 5927669 - DNA, 20 bp, Homo sapiens
gtgcccctgctgcctcccca

SEQ ID NO: 5927670 - DNA, 19 bp, Homo sapiens
gtgcccctgggatccgagg

SEQ ID NO: 5927671 - DNA, 13 bp, Homo sapiens
gtgcccctgtccc

SEQ ID NO: 5927672 - DNA, 15 bp, Homo sapiens
gtgccccttccgcca

SEQ ID NO: 5927673 - DNA, 17 bp, Homo sapiens
gtgcccctttccttcac

SEQ ID NO: 5927674 - DNA, 23 bp, Homo sapiens
gtgcccgactgactggaggaggc

SEQ ID NO: 5927675 - DNA, 20 bp, Homo sapiens
gtgcccgcatgtgtgcctgg

SEQ ID NO: 5927676 - DNA, 15 bp, Homo sapiens
gtgcccgccaccaca

SEQ ID NO: 5927677 - DNA, 14 bp, Homo sapiens
gtgcccgcccacct

SEQ ID NO: 5927678 - DNA, 21 bp, Homo sapiens
gtgcccgcccacctctgctgc

SEQ ID NO: 5927679 - DNA, 19 bp, Homo sapiens
gtgcccgccctgcccctgc

SEQ ID NO: 5927680 - DNA, 15 bp, Homo sapiens
gtgcccgcgccaggc

SEQ ID NO: 5927681 - DNA, 21 bp, Homo sapiens
gtgcccgcgccaggccctcag

SEQ ID NO: 5927682 - DNA, 16 bp, Homo sapiens
gtgcccgctgcgctgc

SEQ ID NO: 5927683 - DNA, 18 bp, Homo sapiens
gtgcccgctgcgctgccc

SEQ ID NO: 5927684 - DNA, 22 bp, Homo sapiens
gtgcccgctgcgctgccctgca

SEQ ID NO: 5927685 - DNA, 13 bp, Homo sapiens
gtgcccggcccca

SEQ ID NO: 5927686 - DNA, 22 bp, Homo sapiens
gtgcccggctaatttttttgta

SEQ ID NO: 5927687 - DNA, 18 bp, Homo sapiens
gtgcccggggatcccccg

SEQ ID NO: 5927688 - DNA, 21 bp, Homo sapiens
gtgcccggtgcagggcctggc

SEQ ID NO: 5927689 - DNA, 22 bp, Homo sapiens
gtgcccggtgcagggcctggca

SEQ ID NO: 5927690 - DNA, 16 bp, Homo sapiens
gtgcccggtgccatct

SEQ ID NO: 5927691 - DNA, 15 bp, Homo sapiens
gtgccctagatcaac

SEQ ID NO: 5927692 - DNA, 17 bp, Homo sapiens
gtgccctagggctcaga

SEQ ID NO: 5927693 - DNA, 19 bp, Homo sapiens
gtgccctagggctcagagg

SEQ ID NO: 5927694 - DNA, 11 bp, Homo sapiens
gtgcctggtca

SEQ ID NO: 5927695 - DNA, 20 bp, Homo sapiens
gtgcctggtgcgctgtgctc

SEQ ID NO: 5927696 - DNA, 18 bp, Homo sapiens
gtgcctggtgttctgaag

SEQ ID NO: 5927697 - DNA, 19 bp, Homo sapiens
gtgcctggttcgtgccatg

SEQ ID NO: 5927698 - DNA, 21 bp, Homo sapiens
gtgcctgtatgcaacaggcac

SEQ ID NO: 5927699 - DNA, 17 bp, Homo sapiens
gtgcctgtcactactgg

SEQ ID NO: 5927700 - DNA, 16 bp, Homo sapiens
gtgcctgtcaggctct

SEQ ID NO: 5927701 - DNA, 17 bp, Homo sapiens
gtgcctgtcaggctctg

SEQ ID NO: 5927702 - DNA, 20 bp, Homo sapiens
gtgcctgtctgttacactgg

SEQ ID NO: 5927703 - DNA, 15 bp, Homo sapiens
gtgcctgtgctcctg

SEQ ID NO: 5927704 - DNA, 18 bp, Homo sapiens
gtgcctgtgggaggggga

SEQ ID NO: 5927705 - DNA, 12 bp, Homo sapiens
gtgcctgtgtcc

SEQ ID NO: 5927706 - DNA, 22 bp, Homo sapiens
gtgcctgtgtttcatgttctgt

SEQ ID NO: 5927707 - DNA, 17 bp, Homo sapiens
gtgccttaaagatacaa

SEQ ID NO: 5927708 - DNA, 20 bp, Homo sapiens
gtgccttaacctagagggtc

SEQ ID NO: 5927709 - DNA, 19 bp, Homo sapiens
gtgccttacatcttttcta

SEQ ID NO: 5927710 - DNA, 15 bp, Homo sapiens
gtgccttacctcctg

SEQ ID NO: 5927711 - DNA, 20 bp, Homo sapiens
gtgccttacctcctgcccag

SEQ ID NO: 5927712 - DNA, 16 bp, Homo sapiens
gtgccttaggaatact

SEQ ID NO: 5927713 - DNA, 16 bp, Homo sapiens
gtgccttaggggaacc

SEQ ID NO: 5927714 - DNA, 21 bp, Homo sapiens
gtgccttatggaacactctga

SEQ ID NO: 5927715 - DNA, 20 bp, Homo sapiens
gtgccttcaacacagcttgt

SEQ ID NO: 5927716 - DNA, 22 bp, Homo sapiens
gtgccttcaagaaaacaggcac

SEQ ID NO: 5927717 - DNA, 17 bp, Homo sapiens
gtgccttcactgggcca

SEQ ID NO: 5927718 - DNA, 11 bp, Homo sapiens
gtgccttcatt

SEQ ID NO: 5927719 - DNA, 16 bp, Homo sapiens
gtgccttccaccctgc

SEQ ID NO: 5927720 - DNA, 20 bp, Homo sapiens
gtgccttccaccctgccctg

SEQ ID NO: 5927721 - DNA, 23 bp, Homo sapiens
gtgccttccaccctgccctggcc

SEQ ID NO: 5927722 - DNA, 22 bp, Homo sapiens
gtgccttccagatcctctctgg

SEQ ID NO: 5927723 - DNA, 14 bp, Homo sapiens
gtgccttccccgtg

SEQ ID NO: 5927724 - DNA, 11 bp, Homo sapiens
gtgccttccct

SEQ ID NO: 5927725 - DNA, 20 bp, Homo sapiens
gtgccttccgtgggtcatcc

SEQ ID NO: 5927726 - DNA, 23 bp, Homo sapiens
gtgccttcctgtttttcacattt

SEQ ID NO: 5927727 - DNA, 19 bp, Homo sapiens
gtgccttctccttccccag

SEQ ID NO: 5927728 - DNA, 21 bp, Homo sapiens
gtgccttctccttccccagga

SEQ ID NO: 5927729 - DNA, 11 bp, Homo sapiens
gtgccttctct

SEQ ID NO: 5927730 - DNA, 12 bp, Homo sapiens
gtgccttctctc

SEQ ID NO: 5927731 - DNA, 16 bp, Homo sapiens
gtgccttctctcagct

SEQ ID NO: 5927732 - DNA, 18 bp, Homo sapiens
gtgccttctctcagctcc

SEQ ID NO: 5927733 - DNA, 21 bp, Homo sapiens
gtgccttctctcagctcccag

SEQ ID NO: 5927734 - DNA, 15 bp, Homo sapiens
gtgccttctctctcc

SEQ ID NO: 5927735 - DNA, 17 bp, Homo sapiens
gtgccttctgtggggac

SEQ ID NO: 5927736 - DNA, 23 bp, Homo sapiens
gtgccttgagctgcctgctctgc

SEQ ID NO: 5927737 - DNA, 12 bp, Homo sapiens
gtgccttgccca

SEQ ID NO: 5927738 - DNA, 14 bp, Homo sapiens
gtgccttgcccaca

SEQ ID NO: 5927739 - DNA, 19 bp, Homo sapiens
gtgccttggggaaatgtgg

SEQ ID NO: 5927740 - DNA, 18 bp, Homo sapiens
gtgccttggtctctcctt

SEQ ID NO: 5927741 - DNA, 19 bp, Homo sapiens
gtgccttgtccaggaactg

SEQ ID NO: 5927742 - DNA, 18 bp, Homo sapiens
gtgcctttatgtatttgc

SEQ ID NO: 5927743 - DNA, 18 bp, Homo sapiens
gtgcctttatttccactg

SEQ ID NO: 5927744 - DNA, 12 bp, Homo sapiens
gtgcctttcaaa

SEQ ID NO: 5927745 - DNA, 23 bp, Homo sapiens
gtgcctttccccattcattcctg

SEQ ID NO: 5927746 - DNA, 19 bp, Homo sapiens
gtgcctttcccgggccctc

SEQ ID NO: 5927747 - DNA, 21 bp, Homo sapiens
gtgcctttcccgggccctcag

SEQ ID NO: 5927748 - DNA, 21 bp, Homo sapiens
gtgcctttcctgttcagcatt

SEQ ID NO: 5927749 - DNA, 22 bp, Homo sapiens
gtgcctttcctgttcagcattc

SEQ ID NO: 5927750 - DNA, 18 bp, Homo sapiens
gtgcctttctacaactga

SEQ ID NO: 5927751 - DNA, 21 bp, Homo sapiens
gtgcctttctctggctccaga

SEQ ID NO: 5927752 - DNA, 23 bp, Homo sapiens
gtgcctttctctggctccagaat

SEQ ID NO: 5927753 - DNA, 16 bp, Homo sapiens
gtgcctttctttgcct

SEQ ID NO: 5927754 - DNA, 17 bp, Homo sapiens
gtgcctttgcaaatcag

SEQ ID NO: 5927755 - DNA, 20 bp, Homo sapiens
gtgcctttgggcacggccct

SEQ ID NO: 5927756 - DNA, 14 bp, Homo sapiens
gtgccttttatagc

SEQ ID NO: 5927757 - DNA, 18 bp, Homo sapiens
gtgccttttatagctatt

SEQ ID NO: 5927758 - DNA, 19 bp, Homo sapiens
gtgccttttgcacccctcc

SEQ ID NO: 5927759 - DNA, 21 bp, Homo sapiens
gtgccttttgcacccctccca

SEQ ID NO: 5927760 - DNA, 21 bp, Homo sapiens
gtgccttttgcagaagagggt

SEQ ID NO: 5927761 - DNA, 20 bp, Homo sapiens
gtgccttttgctgcgcacca

SEQ ID NO: 5927762 - DNA, 14 bp, Homo sapiens
gtgccttttggaac

SEQ ID NO: 5927763 - DNA, 14 bp, Homo sapiens
gtgccttttggttt

SEQ ID NO: 5927764 - DNA, 23 bp, Homo sapiens
gtgcgacagagagaggggagaga

SEQ ID NO: 5927765 - DNA, 18 bp, Homo sapiens
gtgcgaccccatctgccc

SEQ ID NO: 5927766 - DNA, 14 bp, Homo sapiens
gtgcgaccccccac

SEQ ID NO: 5927767 - DNA, 15 bp, Homo sapiens
gtgcgacttcacaaa

SEQ ID NO: 5927768 - DNA, 17 bp, Homo sapiens
gtgcgacttcacaaaat

SEQ ID NO: 5927769 - DNA, 14 bp, Homo sapiens
gtgcgagcacacac

SEQ ID NO: 5927770 - DNA, 12 bp, Homo sapiens
gtgcgagctgcc

SEQ ID NO: 5927771 - DNA, 23 bp, Homo sapiens
gtgcgagtgtgtgcatgtgtgtg

SEQ ID NO: 5927772 - DNA, 18 bp, Homo sapiens
gtgcgatctcggctcagt

SEQ ID NO: 5927773 - DNA, 17 bp, Homo sapiens
gtgcgcaacaacaagga

SEQ ID NO: 5927774 - DNA, 14 bp, Homo sapiens
gtgcgcacacacag

SEQ ID NO: 5927775 - DNA, 16 bp, Homo sapiens
gtgcgcactgcatggg

SEQ ID NO: 5927776 - DNA, 15 bp, Homo sapiens
gtgcgcagccgcgct

SEQ ID NO: 5927777 - DNA, 15 bp, Homo sapiens
gtgcgcagtggcatg

SEQ ID NO: 5927778 - DNA, 20 bp, Homo sapiens
gtgcgcatcttgcctccagg

SEQ ID NO: 5927779 - DNA, 24 bp, Homo sapiens
gtgcgcatcttgcctccaggtgca

SEQ ID NO: 5927780 - DNA, 18 bp, Homo sapiens
gtgcgcccctccccaccc

SEQ ID NO: 5927781 - DNA, 12 bp, Homo sapiens
gtgcgcccgtgg

SEQ ID NO: 5927782 - DNA, 22 bp, Homo sapiens
gtgcgccgagtctgtctctgtc

SEQ ID NO: 5927783 - DNA, 15 bp, Homo sapiens
gtgcgccggcgcccc

SEQ ID NO: 5927784 - DNA, 23 bp, Homo sapiens
gtgcgcgccaccgtgcctggcta

SEQ ID NO: 5927785 - DNA, 17 bp, Homo sapiens
gtgcgcgtggcgtggcc

SEQ ID NO: 5927786 - DNA, 19 bp, Homo sapiens
gtgcgctagagcattctgg

SEQ ID NO: 5927787 - DNA, 17 bp, Homo sapiens
gtgcgctcacctgcagc

SEQ ID NO: 5927788 - DNA, 18 bp, Homo sapiens
gtgcgctcttggtccctg

SEQ ID NO: 5927789 - DNA, 14 bp, Homo sapiens
gtgcgctgcctggc

SEQ ID NO: 5927790 - DNA, 22 bp, Homo sapiens
gtgcgctgctctgcaggctggg

SEQ ID NO: 5927791 - DNA, 21 bp, Homo sapiens
gtgcgctgggcacttccctgc

SEQ ID NO: 5927792 - DNA, 22 bp, Homo sapiens
gtgcgctgggcacttccctgct

SEQ ID NO: 5927793 - DNA, 13 bp, Homo sapiens
gtgcgctgtgctc

SEQ ID NO: 5927794 - DNA, 21 bp, Homo sapiens
gtgcgctgtgctccagcagtg

SEQ ID NO: 5927795 - DNA, 13 bp, Homo sapiens
gtgcggcaggagc

SEQ ID NO: 5927796 - DNA, 15 bp, Homo sapiens
gtgcggcaggagcag

SEQ ID NO: 5927797 - DNA, 19 bp, Homo sapiens
gtgcggcccgtgcgcagcc

SEQ ID NO: 5927798 - DNA, 22 bp, Homo sapiens
gtgcggcggtcccagctccctg

SEQ ID NO: 5927799 - DNA, 15 bp, Homo sapiens
gtgcggcgtggagac

SEQ ID NO: 5927800 - DNA, 22 bp, Homo sapiens
gtgcggcgtggagactggcagg

SEQ ID NO: 5927801 - DNA, 16 bp, Homo sapiens
gtgcggctggccatgg

SEQ ID NO: 5927802 - DNA, 20 bp, Homo sapiens
gtgcggcttttcagaagaaa

SEQ ID NO: 5927803 - DNA, 18 bp, Homo sapiens
gtgcgggatacagctgag

SEQ ID NO: 5927804 - DNA, 17 bp, Homo sapiens
gtgcgggccaggtctgg

SEQ ID NO: 5927805 - DNA, 12 bp, Homo sapiens
gtgcgggcctgg

SEQ ID NO: 5927806 - DNA, 16 bp, Homo sapiens
gtgcgggcctggccct

SEQ ID NO: 5927807 - DNA, 14 bp, Homo sapiens
gtgcgggcgcccgg

SEQ ID NO: 5927808 - DNA, 17 bp, Homo sapiens
gtgcgggctgaggccag

SEQ ID NO: 5927809 - DNA, 14 bp, Homo sapiens
gtgcggggcctgca

SEQ ID NO: 5927810 - DNA, 20 bp, Homo sapiens
gtgcggggcctgcaggccag

SEQ ID NO: 5927811 - DNA, 13 bp, Homo sapiens
gtgcggggtacac

SEQ ID NO: 5927812 - DNA, 18 bp, Homo sapiens
gtgcggtaggtgctggcc

SEQ ID NO: 5927813 - DNA, 13 bp, Homo sapiens
gtgcggttcctca

SEQ ID NO: 5927814 - DNA, 14 bp, Homo sapiens
gtgcggttcctcat

SEQ ID NO: 5927815 - DNA, 19 bp, Homo sapiens
gtgcgtatgcagtgtagat

SEQ ID NO: 5927816 - DNA, 15 bp, Homo sapiens
gtgcgtccacgagct

SEQ ID NO: 5927817 - DNA, 19 bp, Homo sapiens
gtgcgtcccccgttgtgcc

SEQ ID NO: 5927818 - DNA, 13 bp, Homo sapiens
gtgcgtcctgtcg

SEQ ID NO: 5927819 - DNA, 16 bp, Homo sapiens
gtgcgtctccagtcat

SEQ ID NO: 5927820 - DNA, 15 bp, Homo sapiens
gtgcgtctgttttgt

SEQ ID NO: 5927821 - DNA, 15 bp, Homo sapiens
gtgcgtgaaacacac

SEQ ID NO: 5927822 - DNA, 21 bp, Homo sapiens
gtgcgtgaaacacaccaggct

SEQ ID NO: 5927823 - DNA, 22 bp, Homo sapiens
gtgcgtgaccggcccgccacct

SEQ ID NO: 5927824 - DNA, 21 bp, Homo sapiens
gtgcgtggaatgcccttcact

SEQ ID NO: 5927825 - DNA, 15 bp, Homo sapiens
gtgcgtggctgtggc

SEQ ID NO: 5927826 - DNA, 21 bp, Homo sapiens
gtgcgtggcttccctgtccca

SEQ ID NO: 5927827 - DNA, 14 bp, Homo sapiens
gtgcgtgggtgaag

SEQ ID NO: 5927828 - DNA, 20 bp, Homo sapiens
gtgcgtggtggtccctgggt

SEQ ID NO: 5927829 - DNA, 12 bp, Homo sapiens
gtgcgtgtggcc

SEQ ID NO: 5927830 - DNA, 18 bp, Homo sapiens
gtgcgtgtggccctgtgg

SEQ ID NO: 5927831 - DNA, 21 bp, Homo sapiens
gtgcgtgtggccctgtgggag

SEQ ID NO: 5927832 - DNA, 17 bp, Homo sapiens
gtgcgtgtgtagagtta

SEQ ID NO: 5927833 - DNA, 13 bp, Homo sapiens
gtgcgtgtgtgca

SEQ ID NO: 5927834 - DNA, 15 bp, Homo sapiens
gtgcgtgtgtgtatg

SEQ ID NO: 5927835 - DNA, 14 bp, Homo sapiens
gtgctaaaaatggg

SEQ ID NO: 5927836 - DNA, 21 bp, Homo sapiens
gtgctaaaaatgggacttctt

SEQ ID NO: 5927837 - DNA, 14 bp, Homo sapiens
gtgctaaaccaagt

SEQ ID NO: 5927838 - DNA, 22 bp, Homo sapiens
gtgctaaacctatctgtattgg

SEQ ID NO: 5927839 - DNA, 17 bp, Homo sapiens
gtgctaaagccaaccag

SEQ ID NO: 5927840 - DNA, 20 bp, Homo sapiens
gtgctaaagccaaccagcct

SEQ ID NO: 5927841 - DNA, 22 bp, Homo sapiens
gtgctaaatggtcgcccaggag

SEQ ID NO: 5927842 - DNA, 23 bp, Homo sapiens
gtgctaaccacgtctgtcttcac

SEQ ID NO: 5927843 - DNA, 18 bp, Homo sapiens
gtgctaagagcctctgga

SEQ ID NO: 5927844 - DNA, 14 bp, Homo sapiens
gtgctaagctgccc

SEQ ID NO: 5927845 - DNA, 15 bp, Homo sapiens
gtgctaaggttctaa

SEQ ID NO: 5927846 - DNA, 16 bp, Homo sapiens
gtgctaaggttctaag

SEQ ID NO: 5927847 - DNA, 17 bp, Homo sapiens
gtgctaaggttctaagg

SEQ ID NO: 5927848 - DNA, 18 bp, Homo sapiens
gtgctaagtctttcccaa

SEQ ID NO: 5927849 - DNA, 17 bp, Homo sapiens
gtgctaagtgtgaactg

SEQ ID NO: 5927850 - DNA, 21 bp, Homo sapiens
gtgctaataacagtgcatatt

SEQ ID NO: 5927851 - DNA, 14 bp, Homo sapiens
gtgctaatatactt

SEQ ID NO: 5927852 - DNA, 16 bp, Homo sapiens
gtgctaatattttatt

SEQ ID NO: 5927853 - DNA, 16 bp, Homo sapiens
gtgctaattaataaag

SEQ ID NO: 5927854 - DNA, 19 bp, Homo sapiens
gtgctaatttctgtccaga

SEQ ID NO: 5927855 - DNA, 13 bp, Homo sapiens
gtgctaattttga

SEQ ID NO: 5927856 - DNA, 15 bp, Homo sapiens
gtgctacaaaaacac

SEQ ID NO: 5927857 - DNA, 11 bp, Homo sapiens
gtgctacagaa

SEQ ID NO: 5927858 - DNA, 16 bp, Homo sapiens
gtgctacagaaagcac

SEQ ID NO: 5927859 - DNA, 12 bp, Homo sapiens
gtgctacatttt

SEQ ID NO: 5927860 - DNA, 18 bp, Homo sapiens
gtgctacgtgtgaaatct

SEQ ID NO: 5927861 - DNA, 16 bp, Homo sapiens
gtgctactcatcccta

SEQ ID NO: 5927862 - DNA, 20 bp, Homo sapiens
gtgctactccatgcaggggt

SEQ ID NO: 5927863 - DNA, 14 bp, Homo sapiens
gtgctacttcttct

SEQ ID NO: 5927864 - DNA, 17 bp, Homo sapiens
gtgctagaacaatggga

SEQ ID NO: 5927865 - DNA, 21 bp, Homo sapiens
gtgctagaggattagtaagat

SEQ ID NO: 5927866 - DNA, 16 bp, Homo sapiens
gtgctagatccagccc

SEQ ID NO: 5927867 - DNA, 13 bp, Homo sapiens
gtgctagctttcc

SEQ ID NO: 5927868 - DNA, 19 bp, Homo sapiens
gtgctaggaagaggagtgg

SEQ ID NO: 5927869 - DNA, 22 bp, Homo sapiens
gtgctagggtgcctgctctcct

SEQ ID NO: 5927870 - DNA, 12 bp, Homo sapiens
gtgctaggtctg

SEQ ID NO: 5927871 - DNA, 18 bp, Homo sapiens
gtgctagtaattggaaag

SEQ ID NO: 5927872 - DNA, 19 bp, Homo sapiens
gtgctgccatgccactgcc

SEQ ID NO: 5927873 - DNA, 23 bp, Homo sapiens
gtgctgcccagcagcccctgaga

SEQ ID NO: 5927874 - DNA, 22 bp, Homo sapiens
gtgctgcccatgcaccttccag

SEQ ID NO: 5927875 - DNA, 21 bp, Homo sapiens
gtgctgccccttgcaagccat

SEQ ID NO: 5927876 - DNA, 18 bp, Homo sapiens
gtgctgcccgagggcagg

SEQ ID NO: 5927877 - DNA, 18 bp, Homo sapiens
gtgctgcccgtcttcagc

SEQ ID NO: 5927878 - DNA, 12 bp, Homo sapiens
gtgctgccctgc

SEQ ID NO: 5927879 - DNA, 21 bp, Homo sapiens
gtgctgccctgcccacctggc

SEQ ID NO: 5927880 - DNA, 13 bp, Homo sapiens
gtgctgccctgct

SEQ ID NO: 5927881 - DNA, 16 bp, Homo sapiens
gtgctgccgagggctg

SEQ ID NO: 5927882 - DNA, 17 bp, Homo sapiens
gtgctgccgagggctgg

SEQ ID NO: 5927883 - DNA, 16 bp, Homo sapiens
gtgctgcgcctgcagg

SEQ ID NO: 5927884 - DNA, 20 bp, Homo sapiens
gtgctgcgcctgcaggcaga

SEQ ID NO: 5927885 - DNA, 17 bp, Homo sapiens
gtgctgctaattctttg

SEQ ID NO: 5927886 - DNA, 19 bp, Homo sapiens
gtgctgctaccctccctgc

SEQ ID NO: 5927887 - DNA, 23 bp, Homo sapiens
gtgctgctaccctccctgctgtc

SEQ ID NO: 5927888 - DNA, 20 bp, Homo sapiens
gtgctgctctaggcccacaa

SEQ ID NO: 5927889 - DNA, 15 bp, Homo sapiens
gtgctgctgcaccaa

SEQ ID NO: 5927890 - DNA, 11 bp, Homo sapiens
gtgctgctgct

SEQ ID NO: 5927891 - DNA, 13 bp, Homo sapiens
gtgctgctgctgc

SEQ ID NO: 5927892 - DNA, 14 bp, Homo sapiens
gtgctgctgtaaat

SEQ ID NO: 5927893 - DNA, 13 bp, Homo sapiens
gtgctgctgtgga

SEQ ID NO: 5927894 - DNA, 14 bp, Homo sapiens
gtgctgctgtggag

SEQ ID NO: 5927895 - DNA, 15 bp, Homo sapiens
gtgctgctgtgtgct

SEQ ID NO: 5927896 - DNA, 13 bp, Homo sapiens
gtgctgcttctct

SEQ ID NO: 5927897 - DNA, 12 bp, Homo sapiens
gtgctgcttctt

SEQ ID NO: 5927898 - DNA, 13 bp, Homo sapiens
gtgctgctttgct

SEQ ID NO: 5927899 - DNA, 13 bp, Homo sapiens
gtgctgctttggc

SEQ ID NO: 5927900 - DNA, 13 bp, Homo sapiens
gtgctggaagtct

SEQ ID NO: 5927901 - DNA, 20 bp, Homo sapiens
gtgctggaattccacaggga

SEQ ID NO: 5927902 - DNA, 23 bp, Homo sapiens
gtgctggaattccacagggacca

SEQ ID NO: 5927903 - DNA, 19 bp, Homo sapiens
gtgctggaccagctggcct

SEQ ID NO: 5927904 - DNA, 12 bp, Homo sapiens
gtgctggactgt

SEQ ID NO: 5927905 - DNA, 22 bp, Homo sapiens
gtgctggactttaaaaaaacaa

SEQ ID NO: 5927906 - DNA, 14 bp, Homo sapiens
gtgctggaggactg

SEQ ID NO: 5927907 - DNA, 12 bp, Homo sapiens
gtgctggaggat

SEQ ID NO: 5927908 - DNA, 15 bp, Homo sapiens
gtgctggaggggtgg

SEQ ID NO: 5927909 - DNA, 20 bp, Homo sapiens
gtgctggaggggtggcccag

SEQ ID NO: 5927910 - DNA, 19 bp, Homo sapiens
gtgctggaggtgggagcag

SEQ ID NO: 5927911 - DNA, 18 bp, Homo sapiens
gtgctggaggttggatct

SEQ ID NO: 5927912 - DNA, 19 bp, Homo sapiens
gtgctggatggagcccagg

SEQ ID NO: 5927913 - DNA, 15 bp, Homo sapiens
gtgctggcatgtctg

SEQ ID NO: 5927914 - DNA, 19 bp, Homo sapiens
gtgctggcatgtctgggtc

SEQ ID NO: 5927915 - DNA, 19 bp, Homo sapiens
gtgctggccacacagcagc

SEQ ID NO: 5927916 - DNA, 16 bp, Homo sapiens
gtgctggcccagcatg

SEQ ID NO: 5927917 - DNA, 13 bp, Homo sapiens
gtgctggccccca

SEQ ID NO: 5927918 - DNA, 14 bp, Homo sapiens
gtgctggcgacact

SEQ ID NO: 5927919 - DNA, 21 bp, Homo sapiens
gtgctggctcacagtacagca

SEQ ID NO: 5927920 - DNA, 22 bp, Homo sapiens
gtgctggctcacagtacagcat

SEQ ID NO: 5927921 - DNA, 11 bp, Homo sapiens
gtgctggctcc

SEQ ID NO: 5927922 - DNA, 15 bp, Homo sapiens
gtgctggctgctggc

SEQ ID NO: 5927923 - DNA, 22 bp, Homo sapiens
gtgctggctgctggcccacagc

SEQ ID NO: 5927924 - DNA, 17 bp, Homo sapiens
gtgctgggaaatgcaga

SEQ ID NO: 5927925 - DNA, 18 bp, Homo sapiens
gtgctgggaaatgcagaa

SEQ ID NO: 5927926 - DNA, 22 bp, Homo sapiens
gtgctgggaacctcagggtatt

SEQ ID NO: 5927927 - DNA, 14 bp, Homo sapiens
gtgctgggaaggga

SEQ ID NO: 5927928 - DNA, 18 bp, Homo sapiens
gtgctgggaagggagggt

SEQ ID NO: 5927929 - DNA, 22 bp, Homo sapiens
gtgctgggaatacatctgtgga

SEQ ID NO: 5927930 - DNA, 21 bp, Homo sapiens
gtgctgggaattacaggcgtg

SEQ ID NO: 5927931 - DNA, 14 bp, Homo sapiens
gtgctgggaccaga

SEQ ID NO: 5927932 - DNA, 16 bp, Homo sapiens
gtgctgggaccagagc

SEQ ID NO: 5927933 - DNA, 19 bp, Homo sapiens
gtgctgggaccagagccag

SEQ ID NO: 5927934 - DNA, 16 bp, Homo sapiens
gtgctgggagatgctc

SEQ ID NO: 5927935 - DNA, 18 bp, Homo sapiens
gtgctgggagatgctctc

SEQ ID NO: 5927936 - DNA, 23 bp, Homo sapiens
gtgctgggagctccactctgctt

SEQ ID NO: 5927937 - DNA, 15 bp, Homo sapiens
gtgctgggaggaggg

SEQ ID NO: 5927938 - DNA, 17 bp, Homo sapiens
gtgctgggaggagggag

SEQ ID NO: 5927939 - DNA, 19 bp, Homo sapiens
gtgctgggaggagggagag

SEQ ID NO: 5927940 - DNA, 21 bp, Homo sapiens
gtgctgggaggtcccagggcc

SEQ ID NO: 5927941 - DNA, 19 bp, Homo sapiens
gtgctgggataactggcca

SEQ ID NO: 5927942 - DNA, 22 bp, Homo sapiens
gtgctgggataactggccagcc

SEQ ID NO: 5927943 - DNA, 20 bp, Homo sapiens
gtgctgggatgacaggtgtg

SEQ ID NO: 5927944 - DNA, 20 bp, Homo sapiens
gtgctgggattacagccgtg

SEQ ID NO: 5927945 - DNA, 19 bp, Homo sapiens
gtgctgggattacaggtgt

SEQ ID NO: 5927946 - DNA, 20 bp, Homo sapiens
gtgctgggattacaggtgta

SEQ ID NO: 5927947 - DNA, 12 bp, Homo sapiens
gtgctgggcagc

SEQ ID NO: 5927948 - DNA, 15 bp, Homo sapiens
gtgctgggcagcccg

SEQ ID NO: 5927949 - DNA, 14 bp, Homo sapiens
gtgctgggccagtg

SEQ ID NO: 5927950 - DNA, 12 bp, Homo sapiens
gtgctgggccca

SEQ ID NO: 5927951 - DNA, 14 bp, Homo sapiens
gtgctgggcccagc

SEQ ID NO: 5927952 - DNA, 16 bp, Homo sapiens
gtgctgggcccctgcc

SEQ ID NO: 5927953 - DNA, 18 bp, Homo sapiens
gtgctggggcagagtgga

SEQ ID NO: 5927954 - DNA, 20 bp, Homo sapiens
gtgctggggcagagtggagc

SEQ ID NO: 5927955 - DNA, 19 bp, Homo sapiens
gtgctggggcctggttccc

SEQ ID NO: 5927956 - DNA, 21 bp, Homo sapiens
gtgctgggggcacagctgtct

SEQ ID NO: 5927957 - DNA, 18 bp, Homo sapiens
gtgctgggtcccagcctg

SEQ ID NO: 5927958 - DNA, 17 bp, Homo sapiens
gtgctgggtgcctccca

SEQ ID NO: 5927959 - DNA, 20 bp, Homo sapiens
gtgctgggtgcctcccacac

SEQ ID NO: 5927960 - DNA, 16 bp, Homo sapiens
gtgctggtcccctcct

SEQ ID NO: 5927961 - DNA, 20 bp, Homo sapiens
gtgctggtcccctcctcagt

SEQ ID NO: 5927962 - DNA, 21 bp, Homo sapiens
gtgctggtctattttgatttt

SEQ ID NO: 5927963 - DNA, 19 bp, Homo sapiens
gtgctggtctctaggcctg

SEQ ID NO: 5927964 - DNA, 21 bp, Homo sapiens
gtgctggtgaacactgtgacc

SEQ ID NO: 5927965 - DNA, 22 bp, Homo sapiens
gtgctggtgcggatggacacta

SEQ ID NO: 5927966 - DNA, 14 bp, Homo sapiens
gtgctggtttattt

SEQ ID NO: 5927967 - DNA, 14 bp, Homo sapiens
gtgctgtaaataag

SEQ ID NO: 5927968 - DNA, 16 bp, Homo sapiens
gtgctgtataaaatca

SEQ ID NO: 5927969 - DNA, 21 bp, Homo sapiens
gtgctgtataaaatcagccaa

SEQ ID NO: 5927970 - DNA, 19 bp, Homo sapiens
gtgctgtatggcccaggca

SEQ ID NO: 5927971 - DNA, 21 bp, Homo sapiens
gtgctgtatggcccaggcagc

SEQ ID NO: 5927972 - DNA, 16 bp, Homo sapiens
gtgctgtattttgata

SEQ ID NO: 5927973 - DNA, 21 bp, Homo sapiens
gtgctgtcatgcccagcttgg

SEQ ID NO: 5927974 - DNA, 23 bp, Homo sapiens
gtgctgtcatgcccagcttggag

SEQ ID NO: 5927975 - DNA, 18 bp, Homo sapiens
gtgctgtccatgcttctc

SEQ ID NO: 5927976 - DNA, 14 bp, Homo sapiens
gtgctgtcttctgg

SEQ ID NO: 5927977 - DNA, 20 bp, Homo sapiens
gtgctgtcttctggtctgtg

SEQ ID NO: 5927978 - DNA, 22 bp, Homo sapiens
gtgctgtcttctggtctgtgtg

SEQ ID NO: 5927979 - DNA, 22 bp, Homo sapiens
gtgctgtcttgatgactgctga

SEQ ID NO: 5927980 - DNA, 12 bp, Homo sapiens
gtgctgtgaaaa

SEQ ID NO: 5927981 - DNA, 12 bp, Homo sapiens
gtgctgtgacac

SEQ ID NO: 5927982 - DNA, 15 bp, Homo sapiens
gtgctgtgaccattt

SEQ ID NO: 5927983 - DNA, 21 bp, Homo sapiens
gtgctgtgaggcttgcccagg

SEQ ID NO: 5927984 - DNA, 16 bp, Homo sapiens
gtgctgtgagggaggg

SEQ ID NO: 5927985 - DNA, 19 bp, Homo sapiens
gtgctgtgcacccgtgcca

SEQ ID NO: 5927986 - DNA, 17 bp, Homo sapiens
gtgctgtgctctggcac

SEQ ID NO: 5927987 - DNA, 14 bp, Homo sapiens
gtgctgtggagaga

SEQ ID NO: 5927988 - DNA, 17 bp, Homo sapiens
gtgctgtggccagggtg

SEQ ID NO: 5927989 - DNA, 17 bp, Homo sapiens
gtgctgtggcctgggca

SEQ ID NO: 5927990 - DNA, 15 bp, Homo sapiens
gtgctgtgggcagca

SEQ ID NO: 5927991 - DNA, 17 bp, Homo sapiens
gtgctgtgggcagcacc

SEQ ID NO: 5927992 - DNA, 18 bp, Homo sapiens
gtgctgtgggcagcaccc

SEQ ID NO: 5927993 - DNA, 14 bp, Homo sapiens
gtgctgtggggctg

SEQ ID NO: 5927994 - DNA, 23 bp, Homo sapiens
gtgctgtggggctggtagctcag

SEQ ID NO: 5927995 - DNA, 21 bp, Homo sapiens
gtgctgtgggtattcaccacc

SEQ ID NO: 5927996 - DNA, 18 bp, Homo sapiens
gtgctgtgtaaagttagt

SEQ ID NO: 5927997 - DNA, 22 bp, Homo sapiens
gtgctgtgtaaagttagtctac

SEQ ID NO: 5927998 - DNA, 17 bp, Homo sapiens
gtgctgtgtgagtgagc

SEQ ID NO: 5927999 - DNA, 17 bp, Homo sapiens
gtgctgtgtgccccact

SEQ ID NO: 5928000 - DNA, 20 bp, Homo sapiens
gtgctgtgtgccccactcca

SEQ ID NO: 5928001 - DNA, 22 bp, Homo sapiens
gtgctgtgtgccccactccagc

SEQ ID NO: 5928002 - DNA, 15 bp, Homo sapiens
gtgctgttgattctt

SEQ ID NO: 5928003 - DNA, 17 bp, Homo sapiens
gtgctgttgattctttc

SEQ ID NO: 5928004 - DNA, 14 bp, Homo sapiens
gtgctgttgttatg

SEQ ID NO: 5928005 - DNA, 15 bp, Homo sapiens
gtgctgttgttatga

SEQ ID NO: 5928006 - DNA, 15 bp, Homo sapiens
gtgctgtttattaat

SEQ ID NO: 5928007 - DNA, 13 bp, Homo sapiens
gtgctgtttgaga

SEQ ID NO: 5928008 - DNA, 18 bp, Homo sapiens
gtgctgtttgagatgtga

SEQ ID NO: 5928009 - DNA, 22 bp, Homo sapiens
gtgctgtttgagggattttatt

SEQ ID NO: 5928010 - DNA, 17 bp, Homo sapiens
gtgctgtttgggcagga

SEQ ID NO: 5928011 - DNA, 16 bp, Homo sapiens
gtgctgttttgttata

SEQ ID NO: 5928012 - DNA, 19 bp, Homo sapiens
gtgctgttttgttatataa

SEQ ID NO: 5928013 - DNA, 20 bp, Homo sapiens
gtgcttaacgttttcttaaa

SEQ ID NO: 5928014 - DNA, 17 bp, Homo sapiens
gtgcttaagcagaagca

SEQ ID NO: 5928015 - DNA, 15 bp, Homo sapiens
gtgcttacctcacac

SEQ ID NO: 5928016 - DNA, 14 bp, Homo sapiens
gtgcttacctgtga

SEQ ID NO: 5928017 - DNA, 16 bp, Homo sapiens
gtgcttacctgtgaca

SEQ ID NO: 5928018 - DNA, 18 bp, Homo sapiens
gtgcttatgtatgaggta

SEQ ID NO: 5928019 - DNA, 18 bp, Homo sapiens
gtgcttatgtcatttctt

SEQ ID NO: 5928020 - DNA, 21 bp, Homo sapiens
gtgcttattgatattctaaga

SEQ ID NO: 5928021 - DNA, 16 bp, Homo sapiens
gtgcttattgtttgca

SEQ ID NO: 5928022 - DNA, 21 bp, Homo sapiens
gtgcttcaaatgatccttcct

SEQ ID NO: 5928023 - DNA, 22 bp, Homo sapiens
gtgcttcaaatgatccttccta

SEQ ID NO: 5928024 - DNA, 20 bp, Homo sapiens
gtgcttcacacaaagtgaaa

SEQ ID NO: 5928025 - DNA, 21 bp, Homo sapiens
gtgcttcacacaaagtgaaat

SEQ ID NO: 5928026 - DNA, 13 bp, Homo sapiens
gtgcttcacattt

SEQ ID NO: 5928027 - DNA, 21 bp, Homo sapiens
gtgcttcagagtttgtgtgta

SEQ ID NO: 5928028 - DNA, 13 bp, Homo sapiens
gtgcttcagcctg

SEQ ID NO: 5928029 - DNA, 22 bp, Homo sapiens
gtgcttcatctgtgggatgctg

SEQ ID NO: 5928030 - DNA, 19 bp, Homo sapiens
gtgcttccaacaaggacag

SEQ ID NO: 5928031 - DNA, 17 bp, Homo sapiens
gtgcttcccaaatacat

SEQ ID NO: 5928032 - DNA, 20 bp, Homo sapiens
gtgcttcccccacccctcca

SEQ ID NO: 5928033 - DNA, 21 bp, Homo sapiens
gtgcttcccccacccctccac

SEQ ID NO: 5928034 - DNA, 20 bp, Homo sapiens
gtgcttccctaggctgagct

SEQ ID NO: 5928035 - DNA, 17 bp, Homo sapiens
gtgcttcctcctcaggc

SEQ ID NO: 5928036 - DNA, 15 bp, Homo sapiens
gtgcttcgagccaac

SEQ ID NO: 5928037 - DNA, 17 bp, Homo sapiens
gtgcttcgggcccttcc

SEQ ID NO: 5928038 - DNA, 21 bp, Homo sapiens
gtgcttctaatatttattgct

SEQ ID NO: 5928039 - DNA, 21 bp, Homo sapiens
gtgcttctacacatttcatct

SEQ ID NO: 5928040 - DNA, 22 bp, Homo sapiens
gtgcttctacacatttcatcta

SEQ ID NO: 5928041 - DNA, 20 bp, Homo sapiens
gtgcttctagttctgccagg

SEQ ID NO: 5928042 - DNA, 14 bp, Homo sapiens
gtgcttgaaggccc

SEQ ID NO: 5928043 - DNA, 19 bp, Homo sapiens
gtgcttgaaggccctgctg

SEQ ID NO: 5928044 - DNA, 20 bp, Homo sapiens
gtgcttgaaggccctgctga

SEQ ID NO: 5928045 - DNA, 14 bp, Homo sapiens
gtgcttgagccagg

SEQ ID NO: 5928046 - DNA, 13 bp, Homo sapiens
gtgcttgatctat

SEQ ID NO: 5928047 - DNA, 16 bp, Homo sapiens
gtgcttgatctatcta

SEQ ID NO: 5928048 - DNA, 17 bp, Homo sapiens
gtgcttgcatcctattt

SEQ ID NO: 5928049 - DNA, 16 bp, Homo sapiens
gtggatgggaatttgt

SEQ ID NO: 5928050 - DNA, 16 bp, Homo sapiens
gtggatgggccctgca

SEQ ID NO: 5928051 - DNA, 18 bp, Homo sapiens
gtggatggtgacttttga

SEQ ID NO: 5928052 - DNA, 22 bp, Homo sapiens
gtggatggtgacttttgaagaa

SEQ ID NO: 5928053 - DNA, 21 bp, Homo sapiens
gtggatgtaattagctctggg

SEQ ID NO: 5928054 - DNA, 14 bp, Homo sapiens
gtggatgtcccttc

SEQ ID NO: 5928055 - DNA, 15 bp, Homo sapiens
gtggatgtcttcctt

SEQ ID NO: 5928056 - DNA, 15 bp, Homo sapiens
gtggatgtgagcaga

SEQ ID NO: 5928057 - DNA, 17 bp, Homo sapiens
gtggatgtgagcagaag

SEQ ID NO: 5928058 - DNA, 12 bp, Homo sapiens
gtggatgttact

SEQ ID NO: 5928059 - DNA, 17 bp, Homo sapiens
gtggatgttatgaacag

SEQ ID NO: 5928060 - DNA, 18 bp, Homo sapiens
gtggatgtttttgagtaa

SEQ ID NO: 5928061 - DNA, 14 bp, Homo sapiens
gtggattaaactta

SEQ ID NO: 5928062 - DNA, 21 bp, Homo sapiens
gtggattcagcttctgttgga

SEQ ID NO: 5928063 - DNA, 18 bp, Homo sapiens
gtggattcagttcattcg

SEQ ID NO: 5928064 - DNA, 17 bp, Homo sapiens
gtggattccagtgcatg

SEQ ID NO: 5928065 - DNA, 16 bp, Homo sapiens
gtggattctccctggg

SEQ ID NO: 5928066 - DNA, 18 bp, Homo sapiens
gtggattctgaggccctg

SEQ ID NO: 5928067 - DNA, 22 bp, Homo sapiens
gtggattcttgttttgcttccc

SEQ ID NO: 5928068 - DNA, 17 bp, Homo sapiens
gtggattgcctctgaaa

SEQ ID NO: 5928069 - DNA, 21 bp, Homo sapiens
gtggattgtatttaagacata

SEQ ID NO: 5928070 - DNA, 12 bp, Homo sapiens
gtggattgtttt

SEQ ID NO: 5928071 - DNA, 15 bp, Homo sapiens
gtggattgttttttc

SEQ ID NO: 5928072 - DNA, 19 bp, Homo sapiens
gtggatttaacagaaatgt

SEQ ID NO: 5928073 - DNA, 21 bp, Homo sapiens
gtggatttaacagaaatgtac

SEQ ID NO: 5928074 - DNA, 23 bp, Homo sapiens
gtggatttaacagaaatgtacag

SEQ ID NO: 5928075 - DNA, 12 bp, Homo sapiens
gtggatttactg

SEQ ID NO: 5928076 - DNA, 20 bp, Homo sapiens
gtggatttactgagagaagg

SEQ ID NO: 5928077 - DNA, 23 bp, Homo sapiens
gtggatttcctattttaaaacca

SEQ ID NO: 5928078 - DNA, 18 bp, Homo sapiens
gtggatttgattcatttt

SEQ ID NO: 5928079 - DNA, 22 bp, Homo sapiens
gtggatttgattcattttcctg

SEQ ID NO: 5928080 - DNA, 21 bp, Homo sapiens
gtggattttggttttgttccc

SEQ ID NO: 5928081 - DNA, 23 bp, Homo sapiens
gtggattttgtccattcatctca

SEQ ID NO: 5928082 - DNA, 15 bp, Homo sapiens
gtggattttgtggct

SEQ ID NO: 5928083 - DNA, 18 bp, Homo sapiens
gtggattttgtttaaaaa

SEQ ID NO: 5928084 - DNA, 17 bp, Homo sapiens
gtggcaaaaaagaacag

SEQ ID NO: 5928085 - DNA, 13 bp, Homo sapiens
gtggcaaacattt

SEQ ID NO: 5928086 - DNA, 22 bp, Homo sapiens
gtggcaaagagaggtccagagt

SEQ ID NO: 5928087 - DNA, 22 bp, Homo sapiens
gtggcaaagctgttcttcctgg

SEQ ID NO: 5928088 - DNA, 16 bp, Homo sapiens
gtggcaaagtgctgta

SEQ ID NO: 5928089 - DNA, 20 bp, Homo sapiens
gtggcaaagtgctgtaccct

SEQ ID NO: 5928090 - DNA, 15 bp, Homo sapiens
gtggcaaatataaaa

SEQ ID NO: 5928091 - DNA, 15 bp, Homo sapiens
gtggcaaatgccaac

SEQ ID NO: 5928092 - DNA, 18 bp, Homo sapiens
gtggcaacatttggggag

SEQ ID NO: 5928093 - DNA, 18 bp, Homo sapiens
gtggcaactgagatgtca

SEQ ID NO: 5928094 - DNA, 22 bp, Homo sapiens
gtggcaagcaagagctcttgtg

SEQ ID NO: 5928095 - DNA, 18 bp, Homo sapiens
gtggcaagctcttcattg

SEQ ID NO: 5928096 - DNA, 21 bp, Homo sapiens
gtggcaagctgtgacttctcc

SEQ ID NO: 5928097 - DNA, 16 bp, Homo sapiens
gtggcaaggctgtgct

SEQ ID NO: 5928098 - DNA, 13 bp, Homo sapiens
gtggcaagggggc

SEQ ID NO: 5928099 - DNA, 16 bp, Homo sapiens
gtggcaatctgtgggc

SEQ ID NO: 5928100 - DNA, 13 bp, Homo sapiens
gtggcaattagtg

SEQ ID NO: 5928101 - DNA, 22 bp, Homo sapiens
gtggcacagacttctggaaggc

SEQ ID NO: 5928102 - DNA, 14 bp, Homo sapiens
gtggcacagccctg

SEQ ID NO: 5928103 - DNA, 23 bp, Homo sapiens
gtggcacagccctgagtgtccca

SEQ ID NO: 5928104 - DNA, 13 bp, Homo sapiens
gtggcacagctgg

SEQ ID NO: 5928105 - DNA, 14 bp, Homo sapiens
gtggcacagctggg

SEQ ID NO: 5928106 - DNA, 15 bp, Homo sapiens
gtggcacagctggga

SEQ ID NO: 5928107 - DNA, 21 bp, Homo sapiens
gtggcacaggcactgaacagg

SEQ ID NO: 5928108 - DNA, 22 bp, Homo sapiens
gtggcacattcctttgggtatg

SEQ ID NO: 5928109 - DNA, 18 bp, Homo sapiens
gtggcaccagcagcctgg

SEQ ID NO: 5928110 - DNA, 15 bp, Homo sapiens
gtggcacccaccact

SEQ ID NO: 5928111 - DNA, 17 bp, Homo sapiens
gtggcacccaccactct

SEQ ID NO: 5928112 - DNA, 20 bp, Homo sapiens
gtggcacccaccactctcag

SEQ ID NO: 5928113 - DNA, 14 bp, Homo sapiens
gtggcacctgtctg

SEQ ID NO: 5928114 - DNA, 17 bp, Homo sapiens
gtggcacgatctcagct

SEQ ID NO: 5928115 - DNA, 19 bp, Homo sapiens
gtggcacggagagaaggcc

SEQ ID NO: 5928116 - DNA, 15 bp, Homo sapiens
gtggcacgggccctc

SEQ ID NO: 5928117 - DNA, 20 bp, Homo sapiens
gtggcacgggccctccctcc

SEQ ID NO: 5928118 - DNA, 22 bp, Homo sapiens
gtggcacgggccctccctccca

SEQ ID NO: 5928119 - DNA, 22 bp, Homo sapiens
gtggcactcagtctctcttctc

SEQ ID NO: 5928120 - DNA, 16 bp, Homo sapiens
gtggcactgagccccc

SEQ ID NO: 5928121 - DNA, 13 bp, Homo sapiens
gtggcactgccac

SEQ ID NO: 5928122 - DNA, 15 bp, Homo sapiens
gtggcactgccacca

SEQ ID NO: 5928123 - DNA, 17 bp, Homo sapiens
gtggcactgccaccagc

SEQ ID NO: 5928124 - DNA, 18 bp, Homo sapiens
gtggcactggggaaacat

SEQ ID NO: 5928125 - DNA, 14 bp, Homo sapiens
gtggcactggggca

SEQ ID NO: 5928126 - DNA, 17 bp, Homo sapiens
gtggcactggggcaggg

SEQ ID NO: 5928127 - DNA, 20 bp, Homo sapiens
gtggcacttccacctccagc

SEQ ID NO: 5928128 - DNA, 15 bp, Homo sapiens
gtggcacttctgcct

SEQ ID NO: 5928129 - DNA, 17 bp, Homo sapiens
gtggcacttgcctgggt

SEQ ID NO: 5928130 - DNA, 18 bp, Homo sapiens
gtggcagaaaagaggaga

SEQ ID NO: 5928131 - DNA, 20 bp, Homo sapiens
gtggcagaaaagaggagacc

SEQ ID NO: 5928132 - DNA, 24 bp, Homo sapiens
gtggcagaaaagaggagaccctgg

SEQ ID NO: 5928133 - DNA, 18 bp, Homo sapiens
gtggcagaaatcccagtt

SEQ ID NO: 5928134 - DNA, 23 bp, Homo sapiens
gtggcagaaatcccagttcatgt

SEQ ID NO: 5928135 - DNA, 13 bp, Homo sapiens
gtggcagaccggg

SEQ ID NO: 5928136 - DNA, 18 bp, Homo sapiens
gtggcagaccgggggcca

SEQ ID NO: 5928137 - DNA, 19 bp, Homo sapiens
gtggcagaccgggggccag

SEQ ID NO: 5928138 - DNA, 9 bp, Homo sapiens
gtggcagag

SEQ ID NO: 5928139 - DNA, 14 bp, Homo sapiens
gtggcagagacagt

SEQ ID NO: 5928140 - DNA, 17 bp, Homo sapiens
gtggcagagagagagaa

SEQ ID NO: 5928141 - DNA, 19 bp, Homo sapiens
gtggcagagcttggactgg

SEQ ID NO: 5928142 - DNA, 23 bp, Homo sapiens
gtggcagagcttggactggatgc

SEQ ID NO: 5928143 - DNA, 19 bp, Homo sapiens
gtggcagatgtcttccctg

SEQ ID NO: 5928144 - DNA, 19 bp, Homo sapiens
gtggcagattttacaaaag

SEQ ID NO: 5928145 - DNA, 12 bp, Homo sapiens
gtggcagcagga

SEQ ID NO: 5928146 - DNA, 14 bp, Homo sapiens
gtggcagcaggagg

SEQ ID NO: 5928147 - DNA, 18 bp, Homo sapiens
gtggcagcatcctccaaa

SEQ ID NO: 5928148 - DNA, 13 bp, Homo sapiens
gtggcagccacac

SEQ ID NO: 5928149 - DNA, 20 bp, Homo sapiens
gtggcagccatgcctcatgc

SEQ ID NO: 5928150 - DNA, 16 bp, Homo sapiens
gtggcagcccagccag

SEQ ID NO: 5928151 - DNA, 18 bp, Homo sapiens
gtggcagcccagccagcg

SEQ ID NO: 5928152 - DNA, 14 bp, Homo sapiens
gtggcagccctgta

SEQ ID NO: 5928153 - DNA, 21 bp, Homo sapiens
gtggcagccgtcccaggccac

SEQ ID NO: 5928154 - DNA, 15 bp, Homo sapiens
gtggcagcgcccagc

SEQ ID NO: 5928155 - DNA, 14 bp, Homo sapiens
gtggcagctcacct

SEQ ID NO: 5928156 - DNA, 16 bp, Homo sapiens
gtggcagctcacctct

SEQ ID NO: 5928157 - DNA, 23 bp, Homo sapiens
gtggcagctgcggtccacccagg

SEQ ID NO: 5928158 - DNA, 13 bp, Homo sapiens
gtggcagctgctt

SEQ ID NO: 5928159 - DNA, 19 bp, Homo sapiens
gtggcagctgcttttgtct

SEQ ID NO: 5928160 - DNA, 11 bp, Homo sapiens
gtggcagctgg

SEQ ID NO: 5928161 - DNA, 12 bp, Homo sapiens
gtggcagctggg

SEQ ID NO: 5928162 - DNA, 15 bp, Homo sapiens
gtggcagctggggct

SEQ ID NO: 5928163 - DNA, 19 bp, Homo sapiens
gtggcagctgttagggctg

SEQ ID NO: 5928164 - DNA, 17 bp, Homo sapiens
gtggcaggacactgcag

SEQ ID NO: 5928165 - DNA, 13 bp, Homo sapiens
gtggcaggaccag

SEQ ID NO: 5928166 - DNA, 17 bp, Homo sapiens
gtggcaggaccaggact

SEQ ID NO: 5928167 - DNA, 19 bp, Homo sapiens
gtggcaggaggacaggtgg

SEQ ID NO: 5928168 - DNA, 13 bp, Homo sapiens
gtggcaggagggc

SEQ ID NO: 5928169 - DNA, 23 bp, Homo sapiens
gtggcaggcagaggcccaggctg

SEQ ID NO: 5928170 - DNA, 17 bp, Homo sapiens
gtggcaggcctaggacc

SEQ ID NO: 5928171 - DNA, 23 bp, Homo sapiens
gtggcagggaagggtgcctggct

SEQ ID NO: 5928172 - DNA, 18 bp, Homo sapiens
gtggcagggagcagtaca

SEQ ID NO: 5928173 - DNA, 15 bp, Homo sapiens
gtggcagggcacagg

SEQ ID NO: 5928174 - DNA, 19 bp, Homo sapiens
gtggcagggcacagggcct

SEQ ID NO: 5928175 - DNA, 22 bp, Homo sapiens
gtggcagggcctagctgctaca

SEQ ID NO: 5928176 - DNA, 23 bp, Homo sapiens
gtggcagggcctagctgctacaa

SEQ ID NO: 5928177 - DNA, 16 bp, Homo sapiens
gtggcagggctcagga

SEQ ID NO: 5928178 - DNA, 12 bp, Homo sapiens
gtggcagggctg

SEQ ID NO: 5928179 - DNA, 18 bp, Homo sapiens
gtggcaggggacaggagt

SEQ ID NO: 5928180 - DNA, 15 bp, Homo sapiens
gtggcaggggagcag

SEQ ID NO: 5928181 - DNA, 21 bp, Homo sapiens
gtggcaggtgaccttctggga

SEQ ID NO: 5928182 - DNA, 17 bp, Homo sapiens
gtggcagtaaagagaaa

SEQ ID NO: 5928183 - DNA, 11 bp, Homo sapiens
gtggcagtctg

SEQ ID NO: 5928184 - DNA, 22 bp, Homo sapiens
gtggcagtgcagcaaccagagc

SEQ ID NO: 5928185 - DNA, 12 bp, Homo sapiens
gtggcagtgctg

SEQ ID NO: 5928186 - DNA, 14 bp, Homo sapiens
gtggcagtttaaaa

SEQ ID NO: 5928187 - DNA, 15 bp, Homo sapiens
gtggcatagcccaga

SEQ ID NO: 5928188 - DNA, 17 bp, Homo sapiens
gtggcatagcccagaca

SEQ ID NO: 5928189 - DNA, 20 bp, Homo sapiens
gtggcatcaccttaggcagg

SEQ ID NO: 5928190 - DNA, 19 bp, Homo sapiens
gtggcatcatctcagctca

SEQ ID NO: 5928191 - DNA, 22 bp, Homo sapiens
gtggcatcgtagaagagatgtg

SEQ ID NO: 5928192 - DNA, 16 bp, Homo sapiens
gtggcatgcaaaagaa

SEQ ID NO: 5928193 - DNA, 19 bp, Homo sapiens
gtggcatgcatggaggact

SEQ ID NO: 5928194 - DNA, 23 bp, Homo sapiens
gtggcatgcatggaggactctcc

SEQ ID NO: 5928195 - DNA, 17 bp, Homo sapiens
gtggcatggtcctgtgc

SEQ ID NO: 5928196 - DNA, 19 bp, Homo sapiens
gtggcatggtcctgtgccc

SEQ ID NO: 5928197 - DNA, 23 bp, Homo sapiens
gtggcatgtgggttgtgatattg

SEQ ID NO: 5928198 - DNA, 22 bp, Homo sapiens
gtggcatgttcatcgtataaca

SEQ ID NO: 5928199 - DNA, 23 bp, Homo sapiens
gtggcatgttgtaacatttcaca

SEQ ID NO: 5928200 - DNA, 14 bp, Homo sapiens
gtggcattgaaatg

SEQ ID NO: 5928201 - DNA, 22 bp, Homo sapiens
gtggcattggcagcaggtgctg

SEQ ID NO: 5928202 - DNA, 13 bp, Homo sapiens
gtggcattgggtg

SEQ ID NO: 5928203 - DNA, 14 bp, Homo sapiens
gtggcatttccaaa

SEQ ID NO: 5928204 - DNA, 15 bp, Homo sapiens
gtggcatttgcaggt

SEQ ID NO: 5928205 - DNA, 16 bp, Homo sapiens
gtggcatttgcaggtg

SEQ ID NO: 5928206 - DNA, 19 bp, Homo sapiens
gtggccaaattatttgtgt

SEQ ID NO: 5928207 - DNA, 18 bp, Homo sapiens
gtggccaacgtggacctg

SEQ ID NO: 5928208 - DNA, 23 bp, Homo sapiens
gtggccaactgcaaaaaaagcct

SEQ ID NO: 5928209 - DNA, 18 bp, Homo sapiens
gtggccaagagaaacttc

SEQ ID NO: 5928210 - DNA, 13 bp, Homo sapiens
gtggccaagcctg

SEQ ID NO: 5928211 - DNA, 16 bp, Homo sapiens
gtggccaagcctgctg

SEQ ID NO: 5928212 - DNA, 23 bp, Homo sapiens
gtggccaagcctgctgtgtcctt

SEQ ID NO: 5928213 - DNA, 14 bp, Homo sapiens
gtggccaagcctgg

SEQ ID NO: 5928214 - DNA, 18 bp, Homo sapiens
gtggccaagcctggccct

SEQ ID NO: 5928215 - DNA, 15 bp, Homo sapiens
gtggccaaggagctg

SEQ ID NO: 5928216 - DNA, 16 bp, Homo sapiens
gtggccaaggagctgc

SEQ ID NO: 5928217 - DNA, 20 bp, Homo sapiens
gtggccaagggctccagggc

SEQ ID NO: 5928218 - DNA, 14 bp, Homo sapiens
gtggccaagttctt

SEQ ID NO: 5928219 - DNA, 17 bp, Homo sapiens
gtggccacaactgctgt

SEQ ID NO: 5928220 - DNA, 15 bp, Homo sapiens
gtggccacacaggca

SEQ ID NO: 5928221 - DNA, 19 bp, Homo sapiens
gtggccacacaggcagggc

SEQ ID NO: 5928222 - DNA, 21 bp, Homo sapiens
gtggccacacaggcagggcct

SEQ ID NO: 5928223 - DNA, 15 bp, Homo sapiens
gtggccacagactga

SEQ ID NO: 5928224 - DNA, 19 bp, Homo sapiens
gtggccacagcaagtacag

SEQ ID NO: 5928225 - DNA, 16 bp, Homo sapiens
gtggccacagccccct

SEQ ID NO: 5928226 - DNA, 17 bp, Homo sapiens
gtgggaagcaagcaggg

SEQ ID NO: 5928227 - DNA, 20 bp, Homo sapiens
gtgggaagcccatcctgacc

SEQ ID NO: 5928228 - DNA, 21 bp, Homo sapiens
gtgggaagcccatcctgacca

SEQ ID NO: 5928229 - DNA, 17 bp, Homo sapiens
gtgggaagcgtctgtcc

SEQ ID NO: 5928230 - DNA, 15 bp, Homo sapiens
gtgggaagcttgctg

SEQ ID NO: 5928231 - DNA, 11 bp, Homo sapiens
gtgggaaggaa

SEQ ID NO: 5928232 - DNA, 15 bp, Homo sapiens
gtgggaaggaaaggc

SEQ ID NO: 5928233 - DNA, 15 bp, Homo sapiens
gtgggaaggacttgg

SEQ ID NO: 5928234 - DNA, 14 bp, Homo sapiens
gtgggaaggccagc

SEQ ID NO: 5928235 - DNA, 14 bp, Homo sapiens
gtgggaagggagag

SEQ ID NO: 5928236 - DNA, 16 bp, Homo sapiens
gtgggaagtgaagccc

SEQ ID NO: 5928237 - DNA, 18 bp, Homo sapiens
gtgggaattttatctttt

SEQ ID NO: 5928238 - DNA, 21 bp, Homo sapiens
gtgggacaacaaagaggacac

SEQ ID NO: 5928239 - DNA, 20 bp, Homo sapiens
gtgggacacctgggagaagg

SEQ ID NO: 5928240 - DNA, 17 bp, Homo sapiens
gtgggacactgggcagc

SEQ ID NO: 5928241 - DNA, 22 bp, Homo sapiens
gtgggacactgggcagcaaggc

SEQ ID NO: 5928242 - DNA, 12 bp, Homo sapiens
gtgggacagaca

SEQ ID NO: 5928243 - DNA, 13 bp, Homo sapiens
gtgggacagacag

SEQ ID NO: 5928244 - DNA, 17 bp, Homo sapiens
gtgggacagaggagcaa

SEQ ID NO: 5928245 - DNA, 14 bp, Homo sapiens
gtgggacagcctct

SEQ ID NO: 5928246 - DNA, 20 bp, Homo sapiens
gtgggacagggcttctcctg

SEQ ID NO: 5928247 - DNA, 18 bp, Homo sapiens
gtgggacatggaaaagaa

SEQ ID NO: 5928248 - DNA, 13 bp, Homo sapiens
gtgggacccacag

SEQ ID NO: 5928249 - DNA, 14 bp, Homo sapiens
gtgggacccacagt

SEQ ID NO: 5928250 - DNA, 16 bp, Homo sapiens
gtgggacccaggctcc

SEQ ID NO: 5928251 - DNA, 17 bp, Homo sapiens
gtgggacccaggctccc

SEQ ID NO: 5928252 - DNA, 13 bp, Homo sapiens
gtgggaccccagg

SEQ ID NO: 5928253 - DNA, 15 bp, Homo sapiens
gtgggaccccaggcc

SEQ ID NO: 5928254 - DNA, 15 bp, Homo sapiens
gtgggaccctcagca

SEQ ID NO: 5928255 - DNA, 21 bp, Homo sapiens
gtgggaccctcagcagctctg

SEQ ID NO: 5928256 - DNA, 22 bp, Homo sapiens
gtgggaccctcagcagctctgg

SEQ ID NO: 5928257 - DNA, 19 bp, Homo sapiens
gtgggaccctgtccggccc

SEQ ID NO: 5928258 - DNA, 18 bp, Homo sapiens
gtgggaccgcctggccct

SEQ ID NO: 5928259 - DNA, 17 bp, Homo sapiens
gtgggacctagggaggc

SEQ ID NO: 5928260 - DNA, 19 bp, Homo sapiens
gtgggacggtgcccaagcc

SEQ ID NO: 5928261 - DNA, 16 bp, Homo sapiens
gtgggactcttccctg

SEQ ID NO: 5928262 - DNA, 17 bp, Homo sapiens
gtgggactcttccctgg

SEQ ID NO: 5928263 - DNA, 14 bp, Homo sapiens
gtgggactgtacac

SEQ ID NO: 5928264 - DNA, 18 bp, Homo sapiens
gtgggagaagtggcccct

SEQ ID NO: 5928265 - DNA, 22 bp, Homo sapiens
gtgggagaccggcctgccagga

SEQ ID NO: 5928266 - DNA, 13 bp, Homo sapiens
gtgggagagccca

SEQ ID NO: 5928267 - DNA, 14 bp, Homo sapiens
gtgggagagcccag

SEQ ID NO: 5928268 - DNA, 10 bp, Homo sapiens
gtgggagagg

SEQ ID NO: 5928269 - DNA, 12 bp, Homo sapiens
gtgggagaggaa

SEQ ID NO: 5928270 - DNA, 14 bp, Homo sapiens
gtgggagaggaagc

SEQ ID NO: 5928271 - DNA, 20 bp, Homo sapiens
gtgggagcaaactgcatgcc

SEQ ID NO: 5928272 - DNA, 23 bp, Homo sapiens
gtgggagcaaactgcatgcccag

SEQ ID NO: 5928273 - DNA, 12 bp, Homo sapiens
gtgggagcagct

SEQ ID NO: 5928274 - DNA, 18 bp, Homo sapiens
gtgggagcagcttcttgg

SEQ ID NO: 5928275 - DNA, 22 bp, Homo sapiens
gtgggagcaggagattgagaag

SEQ ID NO: 5928276 - DNA, 23 bp, Homo sapiens
gtgggagcataggaggggtctgg

SEQ ID NO: 5928277 - DNA, 12 bp, Homo sapiens
gtgggagccctg

SEQ ID NO: 5928278 - DNA, 21 bp, Homo sapiens
gtgggagccctgaccttggct

SEQ ID NO: 5928279 - DNA, 18 bp, Homo sapiens
gtgggagccgcagagcct

SEQ ID NO: 5928280 - DNA, 20 bp, Homo sapiens
gtgggagccgcagagcctga

SEQ ID NO: 5928281 - DNA, 11 bp, Homo sapiens
gtgggagcctc

SEQ ID NO: 5928282 - DNA, 12 bp, Homo sapiens
gtgggagcctcg

SEQ ID NO: 5928283 - DNA, 20 bp, Homo sapiens
gtgggagctcagctcgctgc

SEQ ID NO: 5928284 - DNA, 23 bp, Homo sapiens
gtgggagctcctccgcagaaggt

SEQ ID NO: 5928285 - DNA, 17 bp, Homo sapiens
gtgggagctgaaaagga

SEQ ID NO: 5928286 - DNA, 14 bp, Homo sapiens
gtgggagctgagct

SEQ ID NO: 5928287 - DNA, 17 bp, Homo sapiens
gtgggagctgagctgga

SEQ ID NO: 5928288 - DNA, 15 bp, Homo sapiens
gtgggagctgcctgt

SEQ ID NO: 5928289 - DNA, 13 bp, Homo sapiens
gtgggagcttccc

SEQ ID NO: 5928290 - DNA, 12 bp, Homo sapiens
gtgggaggaaga

SEQ ID NO: 5928291 - DNA, 13 bp, Homo sapiens
gtgggaggagagg

SEQ ID NO: 5928292 - DNA, 15 bp, Homo sapiens
gtgggaggagggagg

SEQ ID NO: 5928293 - DNA, 23 bp, Homo sapiens
gtgggaggatctcttgagcctgg

SEQ ID NO: 5928294 - DNA, 16 bp, Homo sapiens
gtgggaggcagaaacc

SEQ ID NO: 5928295 - DNA, 17 bp, Homo sapiens
gtgggaggcccctggtg

SEQ ID NO: 5928296 - DNA, 15 bp, Homo sapiens
gtgggaggctcccag

SEQ ID NO: 5928297 - DNA, 23 bp, Homo sapiens
gtgggaggctcctgttagctcct

SEQ ID NO: 5928298 - DNA, 16 bp, Homo sapiens
gtgggagggaggaggg

SEQ ID NO: 5928299 - DNA, 17 bp, Homo sapiens
gtgggagggaggaggga

SEQ ID NO: 5928300 - DNA, 21 bp, Homo sapiens
gtgggagggcgtcaggcagag

SEQ ID NO: 5928301 - DNA, 14 bp, Homo sapiens
gtgggaggggaaga

SEQ ID NO: 5928302 - DNA, 23 bp, Homo sapiens
gtgggaggggaagaaaaactcta

SEQ ID NO: 5928303 - DNA, 15 bp, Homo sapiens
gtgggagggggagga

SEQ ID NO: 5928304 - DNA, 16 bp, Homo sapiens
gtgggagggggaggaa

SEQ ID NO: 5928305 - DNA, 13 bp, Homo sapiens
gtgggagggggca

SEQ ID NO: 5928306 - DNA, 22 bp, Homo sapiens
gtgggagggggcgttggattta

SEQ ID NO: 5928307 - DNA, 20 bp, Homo sapiens
gtgggagggtaccagcagaa

SEQ ID NO: 5928308 - DNA, 19 bp, Homo sapiens
gtgggagggtctgcaggga

SEQ ID NO: 5928309 - DNA, 17 bp, Homo sapiens
gtgggaggtaggctgtg

SEQ ID NO: 5928310 - DNA, 17 bp, Homo sapiens
gtgggaggtgagaccac

SEQ ID NO: 5928311 - DNA, 17 bp, Homo sapiens
gtgggaggtggaagaag

SEQ ID NO: 5928312 - DNA, 22 bp, Homo sapiens
gtgggagtcaagtgtgcctgct

SEQ ID NO: 5928313 - DNA, 12 bp, Homo sapiens
gtgggagtccac

SEQ ID NO: 5928314 - DNA, 18 bp, Homo sapiens
gtgggagtccactttcct

SEQ ID NO: 5928315 - DNA, 22 bp, Homo sapiens
gtgggagtccactttcctctct

SEQ ID NO: 5928316 - DNA, 12 bp, Homo sapiens
gtgggagtggga

SEQ ID NO: 5928317 - DNA, 16 bp, Homo sapiens
gtgggagtgggagagg

SEQ ID NO: 5928318 - DNA, 19 bp, Homo sapiens
gtgggagtgggagaggaag

SEQ ID NO: 5928319 - DNA, 14 bp, Homo sapiens
gtgggagtggggcc

SEQ ID NO: 5928320 - DNA, 14 bp, Homo sapiens
gtgggagtgtgtaa

SEQ ID NO: 5928321 - DNA, 18 bp, Homo sapiens
gtgggagttttgctctct

SEQ ID NO: 5928322 - DNA, 11 bp, Homo sapiens
gtgggataatg

SEQ ID NO: 5928323 - DNA, 15 bp, Homo sapiens
gtgggatacttagtg

SEQ ID NO: 5928324 - DNA, 23 bp, Homo sapiens
gtgggataggagggtgcccctgg

SEQ ID NO: 5928325 - DNA, 17 bp, Homo sapiens
gtgggatatccctatgc

SEQ ID NO: 5928326 - DNA, 21 bp, Homo sapiens
gtgggatcagggcattgcctg

SEQ ID NO: 5928327 - DNA, 13 bp, Homo sapiens
gtgggatccagag

SEQ ID NO: 5928328 - DNA, 21 bp, Homo sapiens
gtgggatcttacccacttccc

SEQ ID NO: 5928329 - DNA, 23 bp, Homo sapiens
gtgggatcttacccacttccctg

SEQ ID NO: 5928330 - DNA, 16 bp, Homo sapiens
gtgggatgagcctctc

SEQ ID NO: 5928331 - DNA, 22 bp, Homo sapiens
gtgggatgagggagacagacca

SEQ ID NO: 5928332 - DNA, 16 bp, Homo sapiens
gtgggatgagttttta

SEQ ID NO: 5928333 - DNA, 17 bp, Homo sapiens
gtgggatggaggagaag

SEQ ID NO: 5928334 - DNA, 23 bp, Homo sapiens
gtgggatgttcagcactgtccct

SEQ ID NO: 5928335 - DNA, 24 bp, Homo sapiens
gtgggatgttcagcactgtccctt

SEQ ID NO: 5928336 - DNA, 15 bp, Homo sapiens
gtgggattcagagaa

SEQ ID NO: 5928337 - DNA, 14 bp, Homo sapiens
gtgggatttgtaaa

SEQ ID NO: 5928338 - DNA, 18 bp, Homo sapiens
gtgggatttttcagaaaa

SEQ ID NO: 5928339 - DNA, 16 bp, Homo sapiens
gtgggcaaaagagtgt

SEQ ID NO: 5928340 - DNA, 13 bp, Homo sapiens
gtgggcaaaggca

SEQ ID NO: 5928341 - DNA, 16 bp, Homo sapiens
gtgggcaaaggcaggg

SEQ ID NO: 5928342 - DNA, 20 bp, Homo sapiens
gtgggcaaagtcctcctttc

SEQ ID NO: 5928343 - DNA, 21 bp, Homo sapiens
gtgggcaattgttacaagtgt

SEQ ID NO: 5928344 - DNA, 21 bp, Homo sapiens
gtgggcacgctgtgggcaggt

SEQ ID NO: 5928345 - DNA, 17 bp, Homo sapiens
gtgggcactaagggtgg

SEQ ID NO: 5928346 - DNA, 18 bp, Homo sapiens
gtgggcactaagggtgga

SEQ ID NO: 5928347 - DNA, 12 bp, Homo sapiens
gtgggcagagga

SEQ ID NO: 5928348 - DNA, 13 bp, Homo sapiens
gtgggcagaggaa

SEQ ID NO: 5928349 - DNA, 16 bp, Homo sapiens
gtgggcagcaccctcc

SEQ ID NO: 5928350 - DNA, 17 bp, Homo sapiens
gtgggcagcaccctccc

SEQ ID NO: 5928351 - DNA, 16 bp, Homo sapiens
gtgggcagcagcatcc

SEQ ID NO: 5928352 - DNA, 19 bp, Homo sapiens
gtgggcagcagcatcccag

SEQ ID NO: 5928353 - DNA, 23 bp, Homo sapiens
gtgggcagcctatgggggctctc

SEQ ID NO: 5928354 - DNA, 15 bp, Homo sapiens
gtgggcagctgagga

SEQ ID NO: 5928355 - DNA, 12 bp, Homo sapiens
gtgggcagctgg

SEQ ID NO: 5928356 - DNA, 15 bp, Homo sapiens
gtgggcagctggctc

SEQ ID NO: 5928357 - DNA, 13 bp, Homo sapiens
gtgggcaggaaaa

SEQ ID NO: 5928358 - DNA, 20 bp, Homo sapiens
gtgggcaggatctcaagcca

SEQ ID NO: 5928359 - DNA, 21 bp, Homo sapiens
gtgggcaggatctcaagccag

SEQ ID NO: 5928360 - DNA, 22 bp, Homo sapiens
gtgggcaggatctcaagccagc

SEQ ID NO: 5928361 - DNA, 19 bp, Homo sapiens
gtgggcagggaggggctgg

SEQ ID NO: 5928362 - DNA, 13 bp, Homo sapiens
gtgggcagggctg

SEQ ID NO: 5928363 - DNA, 21 bp, Homo sapiens
gtgggcaggtggccgcccctg

SEQ ID NO: 5928364 - DNA, 21 bp, Homo sapiens
gtgggcagtcaccacccagcc

SEQ ID NO: 5928365 - DNA, 22 bp, Homo sapiens
gtgggcagtcaccacccagccc

SEQ ID NO: 5928366 - DNA, 20 bp, Homo sapiens
gtgggcatgagctgctgtgc

SEQ ID NO: 5928367 - DNA, 19 bp, Homo sapiens
gtgggcatgccaccctcac

SEQ ID NO: 5928368 - DNA, 12 bp, Homo sapiens
gtgggcatggcc

SEQ ID NO: 5928369 - DNA, 20 bp, Homo sapiens
gtgggcattgatggggaagg

SEQ ID NO: 5928370 - DNA, 21 bp, Homo sapiens
gtgggccacacccaggaaggg

SEQ ID NO: 5928371 - DNA, 22 bp, Homo sapiens
gtgggccaccgtgcctggctga

SEQ ID NO: 5928372 - DNA, 15 bp, Homo sapiens
gtgggccagcccctc

SEQ ID NO: 5928373 - DNA, 22 bp, Homo sapiens
gtgggccagccgattcctccag

SEQ ID NO: 5928374 - DNA, 13 bp, Homo sapiens
gtgggccaggagc

SEQ ID NO: 5928375 - DNA, 19 bp, Homo sapiens
gtgggccaggagctcagcc

SEQ ID NO: 5928376 - DNA, 13 bp, Homo sapiens
gtgggccagggct

SEQ ID NO: 5928377 - DNA, 18 bp, Homo sapiens
gtgggccagtcctggttg

SEQ ID NO: 5928378 - DNA, 17 bp, Homo sapiens
gtgggccagtgtgggaa

SEQ ID NO: 5928379 - DNA, 21 bp, Homo sapiens
gtgggcccaggaccagctggg

SEQ ID NO: 5928380 - DNA, 23 bp, Homo sapiens
gtgggcccaggaccagctggggc

SEQ ID NO: 5928381 - DNA, 13 bp, Homo sapiens
gtgggcccaggga

SEQ ID NO: 5928382 - DNA, 13 bp, Homo sapiens
gtgggccccacag

SEQ ID NO: 5928383 - DNA, 14 bp, Homo sapiens
gtgggccccaccct

SEQ ID NO: 5928384 - DNA, 17 bp, Homo sapiens
gtgggccccagccgtgg

SEQ ID NO: 5928385 - DNA, 17 bp, Homo sapiens
gtgggccccgggctgga

SEQ ID NO: 5928386 - DNA, 20 bp, Homo sapiens
gtgggccccgggctggagaa

SEQ ID NO: 5928387 - DNA, 18 bp, Homo sapiens
gtgggccccttagcaatg

SEQ ID NO: 5928388 - DNA, 23 bp, Homo sapiens
gtgggcccggagtaatcaggcag

SEQ ID NO: 5928389 - DNA, 13 bp, Homo sapiens
gtgggccctaccc

SEQ ID NO: 5928390 - DNA, 21 bp, Homo sapiens
gtgggccctaccctcctgctg

SEQ ID NO: 5928391 - DNA, 22 bp, Homo sapiens
gtgggccctaccctcctgctga

SEQ ID NO: 5928392 - DNA, 14 bp, Homo sapiens
gtgggccctgcagg

SEQ ID NO: 5928393 - DNA, 15 bp, Homo sapiens
gtgggccctgcaggc

SEQ ID NO: 5928394 - DNA, 18 bp, Homo sapiens
gtgggccctgcaggctgc

SEQ ID NO: 5928395 - DNA, 20 bp, Homo sapiens
gtgggccctgcaggctgcag

SEQ ID NO: 5928396 - DNA, 12 bp, Homo sapiens
gtgggccctgcc

SEQ ID NO: 5928397 - DNA, 20 bp, Homo sapiens
gtgggccctgcccggggagc

SEQ ID NO: 5928398 - DNA, 16 bp, Homo sapiens
gtgggccggccccagg

SEQ ID NO: 5928399 - DNA, 16 bp, Homo sapiens
gtgggccgggaggcag

SEQ ID NO: 5928400 - DNA, 16 bp, Homo sapiens
gtgggcctcacctgcc

SEQ ID NO: 5928401 - DNA, 20 bp, Homo sapiens
gtgggcctcctctgtccagg

SEQ ID NO: 5928402 - DNA, 23 bp, Homo sapiens
gtgggcctcctctgtccagggcc

SEQ ID NO: 5928403 - DNA, 13 bp, Homo sapiens
gtgggcctggcca

SEQ ID NO: 5928404 - DNA, 15 bp, Homo sapiens
gtggtctgcaggcag

SEQ ID NO: 5928405 - DNA, 13 bp, Homo sapiens
gtggtctgccaat

SEQ ID NO: 5928406 - DNA, 21 bp, Homo sapiens
gtggtctgccaatctgtacaa

SEQ ID NO: 5928407 - DNA, 22 bp, Homo sapiens
gtggtctgctcgggcccaggcc

SEQ ID NO: 5928408 - DNA, 13 bp, Homo sapiens
gtggtctgttggc

SEQ ID NO: 5928409 - DNA, 17 bp, Homo sapiens
gtggtctgttggcaggc

SEQ ID NO: 5928410 - DNA, 19 bp, Homo sapiens
gtggtctgttggcaggctg

SEQ ID NO: 5928411 - DNA, 20 bp, Homo sapiens
gtggtctgttggcaggctgg

SEQ ID NO: 5928412 - DNA, 22 bp, Homo sapiens
gtggtctgttggcaggctggcc

SEQ ID NO: 5928413 - DNA, 23 bp, Homo sapiens
gtggtctgttggcaggctggcca

SEQ ID NO: 5928414 - DNA, 17 bp, Homo sapiens
gtggtcttcaagcctgg

SEQ ID NO: 5928415 - DNA, 19 bp, Homo sapiens
gtggtcttcaagcctggcc

SEQ ID NO: 5928416 - DNA, 12 bp, Homo sapiens
gtggtcttcctt

SEQ ID NO: 5928417 - DNA, 17 bp, Homo sapiens
gtggtcttggagaggag

SEQ ID NO: 5928418 - DNA, 16 bp, Homo sapiens
gtggtcttgtggttgt

SEQ ID NO: 5928419 - DNA, 15 bp, Homo sapiens
gtggtctttgaataa

SEQ ID NO: 5928420 - DNA, 18 bp, Homo sapiens
gtggtctttgaataaagt

SEQ ID NO: 5928421 - DNA, 19 bp, Homo sapiens
gtggtctttgaataaagtc

SEQ ID NO: 5928422 - DNA, 15 bp, Homo sapiens
gtggtctttgctgct

SEQ ID NO: 5928423 - DNA, 21 bp, Homo sapiens
gtggtgaacagaacctcccaa

SEQ ID NO: 5928424 - DNA, 17 bp, Homo sapiens
gtggtgaagtgtggctg

SEQ ID NO: 5928425 - DNA, 20 bp, Homo sapiens
gtggtgaagtgtggctggtg

SEQ ID NO: 5928426 - DNA, 19 bp, Homo sapiens
gtggtgaatgtgtgagaaa

SEQ ID NO: 5928427 - DNA, 17 bp, Homo sapiens
gtggtgacacctccccc

SEQ ID NO: 5928428 - DNA, 19 bp, Homo sapiens
gtggtgacatttcccaagt

SEQ ID NO: 5928429 - DNA, 16 bp, Homo sapiens
gtggtgaccccaggag

SEQ ID NO: 5928430 - DNA, 19 bp, Homo sapiens
gtggtgactgaacgaggga

SEQ ID NO: 5928431 - DNA, 22 bp, Homo sapiens
gtggtgacttctgctgctggcc

SEQ ID NO: 5928432 - DNA, 21 bp, Homo sapiens
gtggtgagaggcatccagtat

SEQ ID NO: 5928433 - DNA, 15 bp, Homo sapiens
gtggtgagggagaac

SEQ ID NO: 5928434 - DNA, 14 bp, Homo sapiens
gtggtgaggggctt

SEQ ID NO: 5928435 - DNA, 17 bp, Homo sapiens
gtggtgaggggctttct

SEQ ID NO: 5928436 - DNA, 15 bp, Homo sapiens
gtggtgagtggaagg

SEQ ID NO: 5928437 - DNA, 19 bp, Homo sapiens
gtggtgagtggaagggagg

SEQ ID NO: 5928438 - DNA, 15 bp, Homo sapiens
gtggtgcagccccag

SEQ ID NO: 5928439 - DNA, 16 bp, Homo sapiens
gtggtgcagccccagg

SEQ ID NO: 5928440 - DNA, 18 bp, Homo sapiens
gtggtgcagccccaggac

SEQ ID NO: 5928441 - DNA, 21 bp, Homo sapiens
gtggtgcagccccaggaccaa

SEQ ID NO: 5928442 - DNA, 17 bp, Homo sapiens
gtggtgcagccttcccc

SEQ ID NO: 5928443 - DNA, 14 bp, Homo sapiens
gtggtgccagaggt

SEQ ID NO: 5928444 - DNA, 12 bp, Homo sapiens
gtggtgcctgca

SEQ ID NO: 5928445 - DNA, 21 bp, Homo sapiens
gtggtgcctgcacacagagtg

SEQ ID NO: 5928446 - DNA, 19 bp, Homo sapiens
gtggtgcgatctgggttca

SEQ ID NO: 5928447 - DNA, 23 bp, Homo sapiens
gtggtgcgtttataattggctta

SEQ ID NO: 5928448 - DNA, 22 bp, Homo sapiens
gtggtggaaacttttcttaaaa

SEQ ID NO: 5928449 - DNA, 18 bp, Homo sapiens
gtggtggaagaggggaca

SEQ ID NO: 5928450 - DNA, 19 bp, Homo sapiens
gtggtggaagaggggacag

SEQ ID NO: 5928451 - DNA, 15 bp, Homo sapiens
gtggtggaagggtag

SEQ ID NO: 5928452 - DNA, 12 bp, Homo sapiens
gtggtggagcca

SEQ ID NO: 5928453 - DNA, 14 bp, Homo sapiens
gtggtggagccagg

SEQ ID NO: 5928454 - DNA, 15 bp, Homo sapiens
gtggtggagggggct

SEQ ID NO: 5928455 - DNA, 17 bp, Homo sapiens
gtggtggcagggcctag

SEQ ID NO: 5928456 - DNA, 18 bp, Homo sapiens
gtggtggcccacgcctgt

SEQ ID NO: 5928457 - DNA, 22 bp, Homo sapiens
gtggtggccgtcacgctttcat

SEQ ID NO: 5928458 - DNA, 21 bp, Homo sapiens
gtggtggcctatttcagctgc

SEQ ID NO: 5928459 - DNA, 13 bp, Homo sapiens
gtggtggcctcag

SEQ ID NO: 5928460 - DNA, 17 bp, Homo sapiens
gtggtggcctgtgaggg

SEQ ID NO: 5928461 - DNA, 19 bp, Homo sapiens
gtggtggcgttatggcagc

SEQ ID NO: 5928462 - DNA, 18 bp, Homo sapiens
gtggtggctcacgcctgt

SEQ ID NO: 5928463 - DNA, 18 bp, Homo sapiens
gtggtggctcatgcctgt

SEQ ID NO: 5928464 - DNA, 12 bp, Homo sapiens
gtggtggctgct

SEQ ID NO: 5928465 - DNA, 15 bp, Homo sapiens
gtggtggctgtctct

SEQ ID NO: 5928466 - DNA, 18 bp, Homo sapiens
gtggtgggacagggaccc

SEQ ID NO: 5928467 - DNA, 23 bp, Homo sapiens
gtggtgggatccacgctgggcct

SEQ ID NO: 5928468 - DNA, 21 bp, Homo sapiens
gtggtgggcattctctctcca

SEQ ID NO: 5928469 - DNA, 15 bp, Homo sapiens
gtggtgggccctgag

SEQ ID NO: 5928470 - DNA, 14 bp, Homo sapiens
gtggtggggacagg

SEQ ID NO: 5928471 - DNA, 15 bp, Homo sapiens
gtggtggggctgccg

SEQ ID NO: 5928472 - DNA, 22 bp, Homo sapiens
gtggtgggttctttggaaggag

SEQ ID NO: 5928473 - DNA, 17 bp, Homo sapiens
gtggtggtattctgtca

SEQ ID NO: 5928474 - DNA, 16 bp, Homo sapiens
gtggtggtccctgggt

SEQ ID NO: 5928475 - DNA, 15 bp, Homo sapiens
gtggtggtgaagggg

SEQ ID NO: 5928476 - DNA, 16 bp, Homo sapiens
gtggtggtggtgaagg

SEQ ID NO: 5928477 - DNA, 18 bp, Homo sapiens
gtggtggttcattccaca

SEQ ID NO: 5928478 - DNA, 22 bp, Homo sapiens
gtggtggttcctttgcaccctg

SEQ ID NO: 5928479 - DNA, 20 bp, Homo sapiens
gtggtggttttctgttcttt

SEQ ID NO: 5928480 - DNA, 16 bp, Homo sapiens
gtggtgtaaagctggc

SEQ ID NO: 5928481 - DNA, 12 bp, Homo sapiens
gtggtgtaattt

SEQ ID NO: 5928482 - DNA, 12 bp, Homo sapiens
gtggtgtatttg

SEQ ID NO: 5928483 - DNA, 15 bp, Homo sapiens
gtggtgtcagaccct

SEQ ID NO: 5928484 - DNA, 20 bp, Homo sapiens
gtggtgtcccctatcctccc

SEQ ID NO: 5928485 - DNA, 14 bp, Homo sapiens
gtggtgtcctctgt

SEQ ID NO: 5928486 - DNA, 14 bp, Homo sapiens
gtggtgtcctgaag

SEQ ID NO: 5928487 - DNA, 20 bp, Homo sapiens
gtggtgtcctgaagctgctg

SEQ ID NO: 5928488 - DNA, 17 bp, Homo sapiens
gtggtgtccttctcctc

SEQ ID NO: 5928489 - DNA, 17 bp, Homo sapiens
gtggtgtcgtctgtgaa

SEQ ID NO: 5928490 - DNA, 21 bp, Homo sapiens
gtggtgtgaaacacacaatgt

SEQ ID NO: 5928491 - DNA, 18 bp, Homo sapiens
gtggtgtgaccatgttca

SEQ ID NO: 5928492 - DNA, 21 bp, Homo sapiens
gtggtgtgaccatgttcatta

SEQ ID NO: 5928493 - DNA, 15 bp, Homo sapiens
gtggtgtgaggcccc

SEQ ID NO: 5928494 - DNA, 14 bp, Homo sapiens
gtggtgtgcagtgg

SEQ ID NO: 5928495 - DNA, 22 bp, Homo sapiens
gtggtgtggagaagccacaggc

SEQ ID NO: 5928496 - DNA, 23 bp, Homo sapiens
gtggtgtgtccccctctgtccag

SEQ ID NO: 5928497 - DNA, 18 bp, Homo sapiens
gtggtgtgtccctggaca

SEQ ID NO: 5928498 - DNA, 20 bp, Homo sapiens
gtggtgtgtccctggacaca

SEQ ID NO: 5928499 - DNA, 22 bp, Homo sapiens
gtggtgtgtccctggacacagc

SEQ ID NO: 5928500 - DNA, 13 bp, Homo sapiens
gtggtgttacatt

SEQ ID NO: 5928501 - DNA, 15 bp, Homo sapiens
gtggtgttcctgaag

SEQ ID NO: 5928502 - DNA, 20 bp, Homo sapiens
gtggtgtttcctgcaggcca

SEQ ID NO: 5928503 - DNA, 21 bp, Homo sapiens
gtggtgtttgtaggctgtggg

SEQ ID NO: 5928504 - DNA, 14 bp, Homo sapiens
gtggttaagaatgt

SEQ ID NO: 5928505 - DNA, 18 bp, Homo sapiens
gtggttaaggccagggcc

SEQ ID NO: 5928506 - DNA, 13 bp, Homo sapiens
gtggttacacagt

SEQ ID NO: 5928507 - DNA, 21 bp, Homo sapiens
gtggttagaatcttgttttgt

SEQ ID NO: 5928508 - DNA, 21 bp, Homo sapiens
gtggttattggactccaggcc

SEQ ID NO: 5928509 - DNA, 22 bp, Homo sapiens
gtggttatttctcaacaaagca

SEQ ID NO: 5928510 - DNA, 19 bp, Homo sapiens
gtggttcaagcacactgga

SEQ ID NO: 5928511 - DNA, 16 bp, Homo sapiens
gtggttcactttggtc

SEQ ID NO: 5928512 - DNA, 20 bp, Homo sapiens
gtggttcagagactggcagc

SEQ ID NO: 5928513 - DNA, 20 bp, Homo sapiens
gtggttcagtgccttcctct

SEQ ID NO: 5928514 - DNA, 22 bp, Homo sapiens
gtggttcatccatcatctgctg

SEQ ID NO: 5928515 - DNA, 22 bp, Homo sapiens
gtggttccaagaaagatccacc

SEQ ID NO: 5928516 - DNA, 18 bp, Homo sapiens
gtggttccccaccgaagt

SEQ ID NO: 5928517 - DNA, 13 bp, Homo sapiens
gtggttcctctgc

SEQ ID NO: 5928518 - DNA, 16 bp, Homo sapiens
gtggttcctctgctca

SEQ ID NO: 5928519 - DNA, 19 bp, Homo sapiens
gtggttctattttactttg

SEQ ID NO: 5928520 - DNA, 23 bp, Homo sapiens
gtggttctattttactttgtact

SEQ ID NO: 5928521 - DNA, 15 bp, Homo sapiens
gtggttctcatttgg

SEQ ID NO: 5928522 - DNA, 19 bp, Homo sapiens
gtggttcttaaatgtttat

SEQ ID NO: 5928523 - DNA, 24 bp, Homo sapiens
gtggttcttaaatgtttatactgt

SEQ ID NO: 5928524 - DNA, 21 bp, Homo sapiens
gtggttgaggctaagttggga

SEQ ID NO: 5928525 - DNA, 12 bp, Homo sapiens
gtggttgcatgt

SEQ ID NO: 5928526 - DNA, 12 bp, Homo sapiens
gtggttggaaaa

SEQ ID NO: 5928527 - DNA, 17 bp, Homo sapiens
gtggttggaaaactttt

SEQ ID NO: 5928528 - DNA, 13 bp, Homo sapiens
gtggttggaggcc

SEQ ID NO: 5928529 - DNA, 20 bp, Homo sapiens
gtggttggggccctgccctg

SEQ ID NO: 5928530 - DNA, 18 bp, Homo sapiens
gtggttgggtgtgggcag

SEQ ID NO: 5928531 - DNA, 13 bp, Homo sapiens
gtggttgtgcctt

SEQ ID NO: 5928532 - DNA, 14 bp, Homo sapiens
gtggttgtgccttt

SEQ ID NO: 5928533 - DNA, 16 bp, Homo sapiens
gtggttgtggatggga

SEQ ID NO: 5928534 - DNA, 18 bp, Homo sapiens
gtggtttaggctatttgt

SEQ ID NO: 5928535 - DNA, 18 bp, Homo sapiens
gtggtttagtgtaaaaat

SEQ ID NO: 5928536 - DNA, 19 bp, Homo sapiens
gtggtttagtgtaaaaatg

SEQ ID NO: 5928537 - DNA, 15 bp, Homo sapiens
gtggtttatgattaa

SEQ ID NO: 5928538 - DNA, 23 bp, Homo sapiens
gtggtttcaaagtaaaggcctcc

SEQ ID NO: 5928539 - DNA, 16 bp, Homo sapiens
gtggtttcagaaaggg

SEQ ID NO: 5928540 - DNA, 14 bp, Homo sapiens
gtggtttcatgtta

SEQ ID NO: 5928541 - DNA, 14 bp, Homo sapiens
gtggtttccctgcc

SEQ ID NO: 5928542 - DNA, 17 bp, Homo sapiens
gtggtttccctgcccct

SEQ ID NO: 5928543 - DNA, 16 bp, Homo sapiens
gtggtttcggaaaaaa

SEQ ID NO: 5928544 - DNA, 20 bp, Homo sapiens
gtggtttctacggtgacagt

SEQ ID NO: 5928545 - DNA, 21 bp, Homo sapiens
gtggtttctacttcccctggg

SEQ ID NO: 5928546 - DNA, 13 bp, Homo sapiens
gtggtttgacagc

SEQ ID NO: 5928547 - DNA, 16 bp, Homo sapiens
gtggtttgattgttta

SEQ ID NO: 5928548 - DNA, 17 bp, Homo sapiens
gtggtttgattgtttac

SEQ ID NO: 5928549 - DNA, 14 bp, Homo sapiens
gtggtttgcagatg

SEQ ID NO: 5928550 - DNA, 14 bp, Homo sapiens
gtggtttgccatgt

SEQ ID NO: 5928551 - DNA, 16 bp, Homo sapiens
gtggtttgcttgctct

SEQ ID NO: 5928552 - DNA, 21 bp, Homo sapiens
gtggtttggttcctctctggt

SEQ ID NO: 5928553 - DNA, 14 bp, Homo sapiens
gtggtttggtttta

SEQ ID NO: 5928554 - DNA, 15 bp, Homo sapiens
gtggtttgtgagcct

SEQ ID NO: 5928555 - DNA, 23 bp, Homo sapiens
gtggtttgttatcagtacaattc

SEQ ID NO: 5928556 - DNA, 23 bp, Homo sapiens
gtggttttagattttctggttct

SEQ ID NO: 5928557 - DNA, 17 bp, Homo sapiens
gtggttttcagagcagg

SEQ ID NO: 5928558 - DNA, 17 bp, Homo sapiens
gtggttttgggaaaaat

SEQ ID NO: 5928559 - DNA, 17 bp, Homo sapiens
gtggtttttcagctccc

SEQ ID NO: 5928560 - DNA, 16 bp, Homo sapiens
gtggtttttgagccat

SEQ ID NO: 5928561 - DNA, 16 bp, Homo sapiens
gtggttttttccccct

SEQ ID NO: 5928562 - DNA, 15 bp, Homo sapiens
gtgtaaaaaaaccac

SEQ ID NO: 5928563 - DNA, 14 bp, Homo sapiens
gtgtaaaaaatgtc

SEQ ID NO: 5928564 - DNA, 23 bp, Homo sapiens
gtgtaaaaagcctccttgtgcaa

SEQ ID NO: 5928565 - DNA, 15 bp, Homo sapiens
gtgtaaaaatgagaa

SEQ ID NO: 5928566 - DNA, 13 bp, Homo sapiens
gtgtaaaatgagt

SEQ ID NO: 5928567 - DNA, 20 bp, Homo sapiens
gtgtaaaattaatgtaataa

SEQ ID NO: 5928568 - DNA, 21 bp, Homo sapiens
gtgtaaaattaatgtaataaa

SEQ ID NO: 5928569 - DNA, 22 bp, Homo sapiens
gtgtaaaattaatgtaataaag

SEQ ID NO: 5928570 - DNA, 16 bp, Homo sapiens
gtgtaaaattggatta

SEQ ID NO: 5928571 - DNA, 21 bp, Homo sapiens
gtgtaaaattggattattact

SEQ ID NO: 5928572 - DNA, 15 bp, Homo sapiens
gtgtaaacacatcta

SEQ ID NO: 5928573 - DNA, 16 bp, Homo sapiens
gtgtaaacttgtacat

SEQ ID NO: 5928574 - DNA, 17 bp, Homo sapiens
gtgtaaagatttataca

SEQ ID NO: 5928575 - DNA, 12 bp, Homo sapiens
gtgtaaagcatt

SEQ ID NO: 5928576 - DNA, 12 bp, Homo sapiens
gtgtaaagctgg

SEQ ID NO: 5928577 - DNA, 14 bp, Homo sapiens
gtgtaaagctggcc

SEQ ID NO: 5928578 - DNA, 16 bp, Homo sapiens
gtgtaaagttagtcta

SEQ ID NO: 5928579 - DNA, 13 bp, Homo sapiens
gtgtaaataattt

SEQ ID NO: 5928580 - DNA, 19 bp, Homo sapiens
gtgtaaataatttgcactg

SEQ ID NO: 5928581 - DNA, 21 bp, Homo sapiens
gtgtaaatacaattttgtttc

SEQ ID NO: 5928582 - DNA, 17 bp, Homo sapiens
gtgtatgcacatgaact

SEQ ID NO: 5928583 - DNA, 16 bp, Homo sapiens
gtgtatgcactgctca

SEQ ID NO: 5928584 - DNA, 12 bp, Homo sapiens
gtgtatgcatac

SEQ ID NO: 5928585 - DNA, 23 bp, Homo sapiens
gtgtatgcgaaaaggtttttagg

SEQ ID NO: 5928586 - DNA, 18 bp, Homo sapiens
gtgtatggaagacaaata

SEQ ID NO: 5928587 - DNA, 19 bp, Homo sapiens
gtgtatggcgttggtttgt

SEQ ID NO: 5928588 - DNA, 15 bp, Homo sapiens
gtgtatgggggaagg

SEQ ID NO: 5928589 - DNA, 15 bp, Homo sapiens
gtgtatgggtagcac

SEQ ID NO: 5928590 - DNA, 17 bp, Homo sapiens
gtgtatgtatacacaca

SEQ ID NO: 5928591 - DNA, 18 bp, Homo sapiens
gtgtatgtgcgtgtgtgc

SEQ ID NO: 5928592 - DNA, 13 bp, Homo sapiens
gtgtatgtggttt

SEQ ID NO: 5928593 - DNA, 18 bp, Homo sapiens
gtgtatgtttcttagccc

SEQ ID NO: 5928594 - DNA, 22 bp, Homo sapiens
gtgtatgtttgcacacttgtgt

SEQ ID NO: 5928595 - DNA, 16 bp, Homo sapiens
gtgtattaaaaaaaac

SEQ ID NO: 5928596 - DNA, 16 bp, Homo sapiens
gtgtattaacatgcaa

SEQ ID NO: 5928597 - DNA, 19 bp, Homo sapiens
gtgtattaacatgcaataa

SEQ ID NO: 5928598 - DNA, 20 bp, Homo sapiens
gtgtattatggttcaccagg

SEQ ID NO: 5928599 - DNA, 19 bp, Homo sapiens
gtgtattctagttttgtca

SEQ ID NO: 5928600 - DNA, 22 bp, Homo sapiens
gtgtattgagtcttaactgtat

SEQ ID NO: 5928601 - DNA, 17 bp, Homo sapiens
gtgtattgatgcaatat

SEQ ID NO: 5928602 - DNA, 17 bp, Homo sapiens
gtgtattgtaatgtata

SEQ ID NO: 5928603 - DNA, 21 bp, Homo sapiens
gtgtatttaaaaaaaagaaac

SEQ ID NO: 5928604 - DNA, 16 bp, Homo sapiens
gtgtatttattacatt

SEQ ID NO: 5928605 - DNA, 18 bp, Homo sapiens
gtgtatttatttaaaact

SEQ ID NO: 5928606 - DNA, 21 bp, Homo sapiens
gtgtatttattttcctcccca

SEQ ID NO: 5928607 - DNA, 22 bp, Homo sapiens
gtgtatttattttcctccccag

SEQ ID NO: 5928608 - DNA, 13 bp, Homo sapiens
gtgtatttcagtt

SEQ ID NO: 5928609 - DNA, 12 bp, Homo sapiens
gtgtatttctaa

SEQ ID NO: 5928610 - DNA, 22 bp, Homo sapiens
gtgtatttctattttgcagcag

SEQ ID NO: 5928611 - DNA, 23 bp, Homo sapiens
gtgtatttctattttgcagcagt

SEQ ID NO: 5928612 - DNA, 19 bp, Homo sapiens
gtgtatttggaaataaagt

SEQ ID NO: 5928613 - DNA, 19 bp, Homo sapiens
gtgtatttgtattaataaa

SEQ ID NO: 5928614 - DNA, 21 bp, Homo sapiens
gtgtatttgtattaataaagc

SEQ ID NO: 5928615 - DNA, 23 bp, Homo sapiens
gtgtatttgtattaataaagcat

SEQ ID NO: 5928616 - DNA, 19 bp, Homo sapiens
gtgtattttaaaatagagg

SEQ ID NO: 5928617 - DNA, 16 bp, Homo sapiens
gtgtattttattcagt

SEQ ID NO: 5928618 - DNA, 17 bp, Homo sapiens
gtgtattttcctggatt

SEQ ID NO: 5928619 - DNA, 16 bp, Homo sapiens
gtgtatttttgtaatt

SEQ ID NO: 5928620 - DNA, 19 bp, Homo sapiens
gtgtatttttgtaattcct

SEQ ID NO: 5928621 - DNA, 21 bp, Homo sapiens
gtgtatttttgtaattcctct

SEQ ID NO: 5928622 - DNA, 19 bp, Homo sapiens
gtgtatttttgtttaatca

SEQ ID NO: 5928623 - DNA, 12 bp, Homo sapiens
gtgtcaaagaga

SEQ ID NO: 5928624 - DNA, 14 bp, Homo sapiens
gtgtcaaccagaca

SEQ ID NO: 5928625 - DNA, 15 bp, Homo sapiens
gtgtcaaccagacag

SEQ ID NO: 5928626 - DNA, 19 bp, Homo sapiens
gtgtcaaccagacagaggg

SEQ ID NO: 5928627 - DNA, 19 bp, Homo sapiens
gtgtcaactctttgttatt

SEQ ID NO: 5928628 - DNA, 15 bp, Homo sapiens
gtgtcaacttcaaca

SEQ ID NO: 5928629 - DNA, 16 bp, Homo sapiens
gtgtcaactttcattt

SEQ ID NO: 5928630 - DNA, 16 bp, Homo sapiens
gtgtcaagctgctctg

SEQ ID NO: 5928631 - DNA, 16 bp, Homo sapiens
gtgtcaaggggcccta

SEQ ID NO: 5928632 - DNA, 14 bp, Homo sapiens
gtgtcaagtcctga

SEQ ID NO: 5928633 - DNA, 14 bp, Homo sapiens
gtgtcaagtggcaa

SEQ ID NO: 5928634 - DNA, 18 bp, Homo sapiens
gtgtcacaaagctaaata

SEQ ID NO: 5928635 - DNA, 14 bp, Homo sapiens
gtgtcacactctgt

SEQ ID NO: 5928636 - DNA, 18 bp, Homo sapiens
gtgtcacactgagctggg

SEQ ID NO: 5928637 - DNA, 14 bp, Homo sapiens
gtgtcacagaggca

SEQ ID NO: 5928638 - DNA, 16 bp, Homo sapiens
gtgtcacagaggcagt

SEQ ID NO: 5928639 - DNA, 10 bp, Homo sapiens
gtgtcacagt

SEQ ID NO: 5928640 - DNA, 16 bp, Homo sapiens
gtgtcaccaggcccag

SEQ ID NO: 5928641 - DNA, 13 bp, Homo sapiens
gtgtcaccatcat

SEQ ID NO: 5928642 - DNA, 17 bp, Homo sapiens
gtgtcaccatcatttct

SEQ ID NO: 5928643 - DNA, 19 bp, Homo sapiens
gtgtcacccaaaccggcag

SEQ ID NO: 5928644 - DNA, 17 bp, Homo sapiens
gtgtcaccccagagcca

SEQ ID NO: 5928645 - DNA, 15 bp, Homo sapiens
gtgtcaccctgcaga

SEQ ID NO: 5928646 - DNA, 17 bp, Homo sapiens
gtgtcaccctgcagagc

SEQ ID NO: 5928647 - DNA, 12 bp, Homo sapiens
gtgtcacctcct

SEQ ID NO: 5928648 - DNA, 15 bp, Homo sapiens
gtgtcacctccttcc

SEQ ID NO: 5928649 - DNA, 17 bp, Homo sapiens
gtgtcacctccttcccc

SEQ ID NO: 5928650 - DNA, 21 bp, Homo sapiens
gtgtcacctccttccccagct

SEQ ID NO: 5928651 - DNA, 22 bp, Homo sapiens
gtgtcacctctctcagagcatc

SEQ ID NO: 5928652 - DNA, 14 bp, Homo sapiens
gtgtcacctgtgct

SEQ ID NO: 5928653 - DNA, 18 bp, Homo sapiens
gtgtcaccttttcttgcc

SEQ ID NO: 5928654 - DNA, 13 bp, Homo sapiens
gtgtcacgcaggc

SEQ ID NO: 5928655 - DNA, 17 bp, Homo sapiens
gtgtcacggccaggcag

SEQ ID NO: 5928656 - DNA, 18 bp, Homo sapiens
gtgtcacggccaggcaga

SEQ ID NO: 5928657 - DNA, 14 bp, Homo sapiens
gtgtcacgtgaccc

SEQ ID NO: 5928658 - DNA, 15 bp, Homo sapiens
gtgtcacgtgaccct

SEQ ID NO: 5928659 - DNA, 16 bp, Homo sapiens
gtgtcacgtgaccctg

SEQ ID NO: 5928660 - DNA, 23 bp, Homo sapiens
gtgtcactactcacagtctcttt

SEQ ID NO: 5928661 - DNA, 21 bp, Homo sapiens
gtgtcactcaaggcggtgctt

SEQ ID NO: 5928662 - DNA, 23 bp, Homo sapiens
gtgtcactccataaaaagaaagc

SEQ ID NO: 5928663 - DNA, 14 bp, Homo sapiens
gtgtcactctgcct

SEQ ID NO: 5928664 - DNA, 14 bp, Homo sapiens
gtgtcactggctgc

SEQ ID NO: 5928665 - DNA, 15 bp, Homo sapiens
gtgtcactggctgcc

SEQ ID NO: 5928666 - DNA, 17 bp, Homo sapiens
gtgtcactggctgcctc

SEQ ID NO: 5928667 - DNA, 18 bp, Homo sapiens
gtgtcactggctgcctcc

SEQ ID NO: 5928668 - DNA, 19 bp, Homo sapiens
gtgtcactggctgcctcca

SEQ ID NO: 5928669 - DNA, 18 bp, Homo sapiens
gtgtcactgtccctcctg

SEQ ID NO: 5928670 - DNA, 19 bp, Homo sapiens
gtgtcacttactgtttctg

SEQ ID NO: 5928671 - DNA, 15 bp, Homo sapiens
gtgtcacttttttcc

SEQ ID NO: 5928672 - DNA, 15 bp, Homo sapiens
gtgtcagagcccagg

SEQ ID NO: 5928673 - DNA, 16 bp, Homo sapiens
gtgtcagagcctacct

SEQ ID NO: 5928674 - DNA, 13 bp, Homo sapiens
gtgtcagagtcat

SEQ ID NO: 5928675 - DNA, 12 bp, Homo sapiens
gtgtcagccatt

SEQ ID NO: 5928676 - DNA, 14 bp, Homo sapiens
gtgtcagctctgtt

SEQ ID NO: 5928677 - DNA, 14 bp, Homo sapiens
gtgtcagctgaggc

SEQ ID NO: 5928678 - DNA, 14 bp, Homo sapiens
gtgtcaggcaggtt

SEQ ID NO: 5928679 - DNA, 22 bp, Homo sapiens
gtgtcaggcccccagtgggacc

SEQ ID NO: 5928680 - DNA, 12 bp, Homo sapiens
gtgtcaggccct

SEQ ID NO: 5928681 - DNA, 16 bp, Homo sapiens
gtgtcaggccctctgc

SEQ ID NO: 5928682 - DNA, 19 bp, Homo sapiens
gtgtcaggccctctgcctg

SEQ ID NO: 5928683 - DNA, 20 bp, Homo sapiens
gtgtcaggccctctgcctgc

SEQ ID NO: 5928684 - DNA, 22 bp, Homo sapiens
gtgtcaggccctctgcctgcac

SEQ ID NO: 5928685 - DNA, 23 bp, Homo sapiens
gtgtcaggccctctgcctgcact

SEQ ID NO: 5928686 - DNA, 14 bp, Homo sapiens
gtgtcaggctgctg

SEQ ID NO: 5928687 - DNA, 19 bp, Homo sapiens
gtgtcaggtggggcagctt

SEQ ID NO: 5928688 - DNA, 20 bp, Homo sapiens
gtgtcagtggggctctctga

SEQ ID NO: 5928689 - DNA, 20 bp, Homo sapiens
gtgtcagttcaactttcaga

SEQ ID NO: 5928690 - DNA, 19 bp, Homo sapiens
gtgtcagtttatgttttgg

SEQ ID NO: 5928691 - DNA, 16 bp, Homo sapiens
gtgtcagtttttcctc

SEQ ID NO: 5928692 - DNA, 23 bp, Homo sapiens
gtgtcataaacagatgaataaac

SEQ ID NO: 5928693 - DNA, 13 bp, Homo sapiens
gtgtcataaactt

SEQ ID NO: 5928694 - DNA, 18 bp, Homo sapiens
gtgtcataccaggccgcc

SEQ ID NO: 5928695 - DNA, 15 bp, Homo sapiens
gtgtcatagacttgg

SEQ ID NO: 5928696 - DNA, 21 bp, Homo sapiens
gtgtcatataaactcatttat

SEQ ID NO: 5928697 - DNA, 23 bp, Homo sapiens
gtgtcatatatggggggccaaca

SEQ ID NO: 5928698 - DNA, 17 bp, Homo sapiens
gtgtcatcaatttgtaa

SEQ ID NO: 5928699 - DNA, 16 bp, Homo sapiens
gtgtcatctgtcagct

SEQ ID NO: 5928700 - DNA, 17 bp, Homo sapiens
gtgtcatgaagaatgtt

SEQ ID NO: 5928701 - DNA, 18 bp, Homo sapiens
gtgtcatggactgttgcc

SEQ ID NO: 5928702 - DNA, 18 bp, Homo sapiens
gtgtcatggatagatttt

SEQ ID NO: 5928703 - DNA, 12 bp, Homo sapiens
gtgtcatggctg

SEQ ID NO: 5928704 - DNA, 13 bp, Homo sapiens
gtgtcatggctga

SEQ ID NO: 5928705 - DNA, 15 bp, Homo sapiens
gtgtcatgttctgtg

SEQ ID NO: 5928706 - DNA, 18 bp, Homo sapiens
gtgtcattattccatctt

SEQ ID NO: 5928707 - DNA, 15 bp, Homo sapiens
gtgtcatttagtaag

SEQ ID NO: 5928708 - DNA, 23 bp, Homo sapiens
gtgtcatttctatattcctccag

SEQ ID NO: 5928709 - DNA, 21 bp, Homo sapiens
gtgtcattttattttttccct

SEQ ID NO: 5928710 - DNA, 21 bp, Homo sapiens
gtgtcattttctgttatacac

SEQ ID NO: 5928711 - DNA, 22 bp, Homo sapiens
gtgtcattttcttgatgtcact

SEQ ID NO: 5928712 - DNA, 15 bp, Homo sapiens
gtgtcatttttcctt

SEQ ID NO: 5928713 - DNA, 17 bp, Homo sapiens
gtgtccaaaaccgccag

SEQ ID NO: 5928714 - DNA, 20 bp, Homo sapiens
gtgtccaaaaccgccagctc

SEQ ID NO: 5928715 - DNA, 16 bp, Homo sapiens
gtgtccaactccagta

SEQ ID NO: 5928716 - DNA, 12 bp, Homo sapiens
gtgtccaccccc

SEQ ID NO: 5928717 - DNA, 22 bp, Homo sapiens
gtgtccagaccattgtcttcca

SEQ ID NO: 5928718 - DNA, 21 bp, Homo sapiens
gtgtccagagacatgggcctc

SEQ ID NO: 5928719 - DNA, 22 bp, Homo sapiens
gtgtccagagacatgggcctcc

SEQ ID NO: 5928720 - DNA, 12 bp, Homo sapiens
gtgtccagcaca

SEQ ID NO: 5928721 - DNA, 19 bp, Homo sapiens
gtgtccagcattgaagaga

SEQ ID NO: 5928722 - DNA, 13 bp, Homo sapiens
gtgtccagcttcc

SEQ ID NO: 5928723 - DNA, 19 bp, Homo sapiens
gtgtccagcttccaaagcc

SEQ ID NO: 5928724 - DNA, 15 bp, Homo sapiens
gtgtccaggctctgg

SEQ ID NO: 5928725 - DNA, 22 bp, Homo sapiens
gtgtccaggctctgggcacagt

SEQ ID NO: 5928726 - DNA, 13 bp, Homo sapiens
gtgtccagggtcc

SEQ ID NO: 5928727 - DNA, 19 bp, Homo sapiens
gtgtccataaataaagttt

SEQ ID NO: 5928728 - DNA, 17 bp, Homo sapiens
gtgtccatagatataaa

SEQ ID NO: 5928729 - DNA, 19 bp, Homo sapiens
gtgtccatcccagcggctg

SEQ ID NO: 5928730 - DNA, 19 bp, Homo sapiens
gtgtccatgcgctcagggc

SEQ ID NO: 5928731 - DNA, 20 bp, Homo sapiens
gtgtccatgcgctcagggcc

SEQ ID NO: 5928732 - DNA, 22 bp, Homo sapiens
gtgtccatgtgtatgcgtgtcc

SEQ ID NO: 5928733 - DNA, 16 bp, Homo sapiens
gtgtccattgacatgt

SEQ ID NO: 5928734 - DNA, 20 bp, Homo sapiens
gtgtccattgacatgtacag

SEQ ID NO: 5928735 - DNA, 21 bp, Homo sapiens
gtgtccattgacatgtacaga

SEQ ID NO: 5928736 - DNA, 14 bp, Homo sapiens
gtgtccatttcaag

SEQ ID NO: 5928737 - DNA, 21 bp, Homo sapiens
gtgtccattttgtgaagccct

SEQ ID NO: 5928738 - DNA, 20 bp, Homo sapiens
gtgtcccaaaatcccctcag

SEQ ID NO: 5928739 - DNA, 15 bp, Homo sapiens
gtgtcccaaggagct

SEQ ID NO: 5928740 - DNA, 22 bp, Homo sapiens
gtgtcccagaagatgactgagg

SEQ ID NO: 5928741 - DNA, 19 bp, Homo sapiens
gtgtcccagcaccacacca

SEQ ID NO: 5928742 - DNA, 17 bp, Homo sapiens
gtgtcccagccacgcag

SEQ ID NO: 5928743 - DNA, 13 bp, Homo sapiens
gtgtcccaggcag

SEQ ID NO: 5928744 - DNA, 16 bp, Homo sapiens
gtgtcccagtcccagc

SEQ ID NO: 5928745 - DNA, 21 bp, Homo sapiens
gtgtcccagtcccagcctctg

SEQ ID NO: 5928746 - DNA, 22 bp, Homo sapiens
gtgtcccagtcccagcctctgg

SEQ ID NO: 5928747 - DNA, 13 bp, Homo sapiens
gtgtcccagtgaa

SEQ ID NO: 5928748 - DNA, 17 bp, Homo sapiens
gtgtcccagtgtctggc

SEQ ID NO: 5928749 - DNA, 19 bp, Homo sapiens
gtgtcccagtgtctggccc

SEQ ID NO: 5928750 - DNA, 20 bp, Homo sapiens
gtgtcccagtgtctggccca

SEQ ID NO: 5928751 - DNA, 21 bp, Homo sapiens
gtgtcccatgacccacccctg

SEQ ID NO: 5928752 - DNA, 23 bp, Homo sapiens
gtgtcccatgacccacccctgtg

SEQ ID NO: 5928753 - DNA, 19 bp, Homo sapiens
gtgtcccattggtgttgtc

SEQ ID NO: 5928754 - DNA, 11 bp, Homo sapiens
gtgtccccacc

SEQ ID NO: 5928755 - DNA, 12 bp, Homo sapiens
gtgtccccacca

SEQ ID NO: 5928756 - DNA, 20 bp, Homo sapiens
gtgtccccaccatctgctgt

SEQ ID NO: 5928757 - DNA, 15 bp, Homo sapiens
gtgtccccagcccac

SEQ ID NO: 5928758 - DNA, 21 bp, Homo sapiens
gtgtccccagcctacctctcc

SEQ ID NO: 5928759 - DNA, 22 bp, Homo sapiens
gtgtccccagcctacctctcca

SEQ ID NO: 5928760 - DNA, 15 bp, Homo sapiens
gtgtgaactgggcac

SEQ ID NO: 5928761 - DNA, 13 bp, Homo sapiens
gtgtgaagaaatg

SEQ ID NO: 5928762 - DNA, 17 bp, Homo sapiens
gtgtgaagacactgtgc

SEQ ID NO: 5928763 - DNA, 19 bp, Homo sapiens
gtgtgaagacactgtgcag

SEQ ID NO: 5928764 - DNA, 23 bp, Homo sapiens
gtgtgaagccgccagttcatctt

SEQ ID NO: 5928765 - DNA, 18 bp, Homo sapiens
gtgtgaaggtcctgctat

SEQ ID NO: 5928766 - DNA, 11 bp, Homo sapiens
gtgtgaagtta

SEQ ID NO: 5928767 - DNA, 13 bp, Homo sapiens
gtgtgaagttaga

SEQ ID NO: 5928768 - DNA, 21 bp, Homo sapiens
gtgtgaagttagaattccttc

SEQ ID NO: 5928769 - DNA, 16 bp, Homo sapiens
gtgtgaagtttggaga

SEQ ID NO: 5928770 - DNA, 17 bp, Homo sapiens
gtgtgaagtttggagat

SEQ ID NO: 5928771 - DNA, 21 bp, Homo sapiens
gtgtgaatcggcgacggagca

SEQ ID NO: 5928772 - DNA, 15 bp, Homo sapiens
gtgtgaatgaacact

SEQ ID NO: 5928773 - DNA, 15 bp, Homo sapiens
gtgtgaatgtgggca

SEQ ID NO: 5928774 - DNA, 17 bp, Homo sapiens
gtgtgaatttgccagag

SEQ ID NO: 5928775 - DNA, 22 bp, Homo sapiens
gtgtgacaaggattgctactgt

SEQ ID NO: 5928776 - DNA, 21 bp, Homo sapiens
gtgtgacaccaccactgtgtc

SEQ ID NO: 5928777 - DNA, 22 bp, Homo sapiens
gtgtgacaccaccactgtgtcc

SEQ ID NO: 5928778 - DNA, 18 bp, Homo sapiens
gtgtgacagggccagtgg

SEQ ID NO: 5928779 - DNA, 15 bp, Homo sapiens
gtgtgacatcagtgg

SEQ ID NO: 5928780 - DNA, 19 bp, Homo sapiens
gtgtgacattgggacaaca

SEQ ID NO: 5928781 - DNA, 16 bp, Homo sapiens
gtgtgaccatgttcat

SEQ ID NO: 5928782 - DNA, 17 bp, Homo sapiens
gtgtgacccctcctggg

SEQ ID NO: 5928783 - DNA, 12 bp, Homo sapiens
gtgtgaccctga

SEQ ID NO: 5928784 - DNA, 15 bp, Homo sapiens
gtgtgacctgagggc

SEQ ID NO: 5928785 - DNA, 17 bp, Homo sapiens
gtgtgacgggggttggg

SEQ ID NO: 5928786 - DNA, 14 bp, Homo sapiens
gtgtgactaactat

SEQ ID NO: 5928787 - DNA, 19 bp, Homo sapiens
gtgtgactaactatgcaat

SEQ ID NO: 5928788 - DNA, 15 bp, Homo sapiens
gtgtgactccttatc

SEQ ID NO: 5928789 - DNA, 20 bp, Homo sapiens
gtgtgactccttatctcttt

SEQ ID NO: 5928790 - DNA, 21 bp, Homo sapiens
gtgtgactccttatctctttc

SEQ ID NO: 5928791 - DNA, 19 bp, Homo sapiens
gtgtgactcgggagctgca

SEQ ID NO: 5928792 - DNA, 23 bp, Homo sapiens
gtgtgactctcttggattattta

SEQ ID NO: 5928793 - DNA, 17 bp, Homo sapiens
gtgtgactggcaagagg

SEQ ID NO: 5928794 - DNA, 16 bp, Homo sapiens
gtgtgactttcaggct

SEQ ID NO: 5928795 - DNA, 12 bp, Homo sapiens
gtgtgagactgg

SEQ ID NO: 5928796 - DNA, 18 bp, Homo sapiens
gtgtgagacttaaaacat

SEQ ID NO: 5928797 - DNA, 15 bp, Homo sapiens
gtgtgagagagactg

SEQ ID NO: 5928798 - DNA, 15 bp, Homo sapiens
gtgtgagatcctctt

SEQ ID NO: 5928799 - DNA, 22 bp, Homo sapiens
gtgtgagcagggcttgctcctg

SEQ ID NO: 5928800 - DNA, 14 bp, Homo sapiens
gtgtgagcagggtg

SEQ ID NO: 5928801 - DNA, 13 bp, Homo sapiens
gtgtgagccaccg

SEQ ID NO: 5928802 - DNA, 15 bp, Homo sapiens
gtgtgagcgccttgg

SEQ ID NO: 5928803 - DNA, 17 bp, Homo sapiens
gtgtgagcgcttctgca

SEQ ID NO: 5928804 - DNA, 21 bp, Homo sapiens
gtgtgagcgtggccttgggag

SEQ ID NO: 5928805 - DNA, 13 bp, Homo sapiens
gtgtgaggcagga

SEQ ID NO: 5928806 - DNA, 13 bp, Homo sapiens
gtgtgaggccaca

SEQ ID NO: 5928807 - DNA, 14 bp, Homo sapiens
gtgtgaggccaggg

SEQ ID NO: 5928808 - DNA, 17 bp, Homo sapiens
gtgtgaggcccccggag

SEQ ID NO: 5928809 - DNA, 15 bp, Homo sapiens
gtgtgaggctgtgtc

SEQ ID NO: 5928810 - DNA, 14 bp, Homo sapiens
gtgtgagggcaaac

SEQ ID NO: 5928811 - DNA, 12 bp, Homo sapiens
gtgtgagggcag

SEQ ID NO: 5928812 - DNA, 13 bp, Homo sapiens
gtgtgagggcagc

SEQ ID NO: 5928813 - DNA, 18 bp, Homo sapiens
gtgtgagtcaccaagccc

SEQ ID NO: 5928814 - DNA, 22 bp, Homo sapiens
gtgtgagtcacttctacgcata

SEQ ID NO: 5928815 - DNA, 19 bp, Homo sapiens
gtgtgagtggcagccatgc

SEQ ID NO: 5928816 - DNA, 17 bp, Homo sapiens
gtgtgagtgggaggaga

SEQ ID NO: 5928817 - DNA, 13 bp, Homo sapiens
gtgtgagtgtatg

SEQ ID NO: 5928818 - DNA, 13 bp, Homo sapiens
gtgtgagtgtgac

SEQ ID NO: 5928819 - DNA, 15 bp, Homo sapiens
gtgtgagtgtgacag

SEQ ID NO: 5928820 - DNA, 23 bp, Homo sapiens
gtgtgagtgtgacgggggttggg

SEQ ID NO: 5928821 - DNA, 14 bp, Homo sapiens
gtgtgagtgtgtgt

SEQ ID NO: 5928822 - DNA, 15 bp, Homo sapiens
gtgtgatatttcaga

SEQ ID NO: 5928823 - DNA, 17 bp, Homo sapiens
gtgtgatatttcagaaa

SEQ ID NO: 5928824 - DNA, 14 bp, Homo sapiens
gtgtgatccagccc

SEQ ID NO: 5928825 - DNA, 21 bp, Homo sapiens
gtgtgatcttaatatatttga

SEQ ID NO: 5928826 - DNA, 13 bp, Homo sapiens
gtgtgatgcagga

SEQ ID NO: 5928827 - DNA, 14 bp, Homo sapiens
gtgtgatgctgaca

SEQ ID NO: 5928828 - DNA, 16 bp, Homo sapiens
gtgtgattgaatctga

SEQ ID NO: 5928829 - DNA, 23 bp, Homo sapiens
gtgtgattgacagctttgctgct

SEQ ID NO: 5928830 - DNA, 22 bp, Homo sapiens
gtgtgattggcttaaatccagt

SEQ ID NO: 5928831 - DNA, 20 bp, Homo sapiens
gtgtgatttgtgaaataaaa

SEQ ID NO: 5928832 - DNA, 15 bp, Homo sapiens
gtgtgcaacagacaa

SEQ ID NO: 5928833 - DNA, 22 bp, Homo sapiens
gtgtgcaactaactgactctgt

SEQ ID NO: 5928834 - DNA, 23 bp, Homo sapiens
gtgtgcaactaactgactctgtt

SEQ ID NO: 5928835 - DNA, 17 bp, Homo sapiens
gtgtgcaactggccagc

SEQ ID NO: 5928836 - DNA, 16 bp, Homo sapiens
gtgtgcaagtatgtga

SEQ ID NO: 5928837 - DNA, 16 bp, Homo sapiens
gtgtgcaagtgtgtgc

SEQ ID NO: 5928838 - DNA, 14 bp, Homo sapiens
gtgtgcacagaaaa

SEQ ID NO: 5928839 - DNA, 16 bp, Homo sapiens
gtgtgcacgcctgcag

SEQ ID NO: 5928840 - DNA, 22 bp, Homo sapiens
gtgtgcacgcctgcaggctgga

SEQ ID NO: 5928841 - DNA, 17 bp, Homo sapiens
gtgtgcactaaggggcc

SEQ ID NO: 5928842 - DNA, 13 bp, Homo sapiens
gtgtgcagacagc

SEQ ID NO: 5928843 - DNA, 23 bp, Homo sapiens
gtgtgcagacagccatgcgtggc

SEQ ID NO: 5928844 - DNA, 14 bp, Homo sapiens
gtgtgcagactgat

SEQ ID NO: 5928845 - DNA, 13 bp, Homo sapiens
gtgtgcagagtat

SEQ ID NO: 5928846 - DNA, 22 bp, Homo sapiens
gtgtgcagatcatccgtctgtg

SEQ ID NO: 5928847 - DNA, 12 bp, Homo sapiens
gtgtgcaggagc

SEQ ID NO: 5928848 - DNA, 17 bp, Homo sapiens
gtgtgcaggagcctccc

SEQ ID NO: 5928849 - DNA, 18 bp, Homo sapiens
gtgtgcaggagcctccct

SEQ ID NO: 5928850 - DNA, 19 bp, Homo sapiens
gtgtgcaggagcctccctg

SEQ ID NO: 5928851 - DNA, 18 bp, Homo sapiens
gtgtgcaggctgtctcat

SEQ ID NO: 5928852 - DNA, 18 bp, Homo sapiens
gtgtgcagtggagctggc

SEQ ID NO: 5928853 - DNA, 21 bp, Homo sapiens
gtgtgcatattgtacactttt

SEQ ID NO: 5928854 - DNA, 14 bp, Homo sapiens
gtgtgcatgtatgt

SEQ ID NO: 5928855 - DNA, 15 bp, Homo sapiens
gtgtgcatgtatgtg

SEQ ID NO: 5928856 - DNA, 11 bp, Homo sapiens
gtgtgcatgtg

SEQ ID NO: 5928857 - DNA, 14 bp, Homo sapiens
gtgtgcatgtgccg

SEQ ID NO: 5928858 - DNA, 16 bp, Homo sapiens
gtgtgcatgtgtgtat

SEQ ID NO: 5928859 - DNA, 17 bp, Homo sapiens
gtgtgcatgtgtgtata

SEQ ID NO: 5928860 - DNA, 19 bp, Homo sapiens
gtgtgcatgtgtgtgtctg

SEQ ID NO: 5928861 - DNA, 17 bp, Homo sapiens
gtgtgccaagccctggc

SEQ ID NO: 5928862 - DNA, 19 bp, Homo sapiens
gtgtgccaagccctggccc

SEQ ID NO: 5928863 - DNA, 15 bp, Homo sapiens
gtgtgccacaggctg

SEQ ID NO: 5928864 - DNA, 18 bp, Homo sapiens
gtgtgccaccctctgcag

SEQ ID NO: 5928865 - DNA, 20 bp, Homo sapiens
gtgtgccaccctctgcaggg

SEQ ID NO: 5928866 - DNA, 21 bp, Homo sapiens
gtgtgccatagagtttaacac

SEQ ID NO: 5928867 - DNA, 14 bp, Homo sapiens
gtgtgcccaagtgg

SEQ ID NO: 5928868 - DNA, 17 bp, Homo sapiens
gtgtgcccaagtgggca

SEQ ID NO: 5928869 - DNA, 21 bp, Homo sapiens
gtgtgcccaagtgggcagtca

SEQ ID NO: 5928870 - DNA, 15 bp, Homo sapiens
gtgtgcccaccagcg

SEQ ID NO: 5928871 - DNA, 16 bp, Homo sapiens
gtgtgcccaccagcgg

SEQ ID NO: 5928872 - DNA, 20 bp, Homo sapiens
gtgtgcccagcacctggagg

SEQ ID NO: 5928873 - DNA, 12 bp, Homo sapiens
gtgtgccccact

SEQ ID NO: 5928874 - DNA, 15 bp, Homo sapiens
gtgtgccccactcca

SEQ ID NO: 5928875 - DNA, 17 bp, Homo sapiens
gtgtgccccccatcctg

SEQ ID NO: 5928876 - DNA, 16 bp, Homo sapiens
gtgtgcccccttcaag

SEQ ID NO: 5928877 - DNA, 17 bp, Homo sapiens
gtgtgccctagggctca

SEQ ID NO: 5928878 - DNA, 20 bp, Homo sapiens
gtgtgccctagggctcagag

SEQ ID NO: 5928879 - DNA, 21 bp, Homo sapiens
gtgtgccctagggctcagagg

SEQ ID NO: 5928880 - DNA, 13 bp, Homo sapiens
gtgtgccctctgg

SEQ ID NO: 5928881 - DNA, 11 bp, Homo sapiens
gtgtgccctgg

SEQ ID NO: 5928882 - DNA, 13 bp, Homo sapiens
gtgtgccctggct

SEQ ID NO: 5928883 - DNA, 14 bp, Homo sapiens
gtgtgccctggctc

SEQ ID NO: 5928884 - DNA, 16 bp, Homo sapiens
gtgtgccctggctccc

SEQ ID NO: 5928885 - DNA, 23 bp, Homo sapiens
gtgtgccctggctcccaagggag

SEQ ID NO: 5928886 - DNA, 14 bp, Homo sapiens
gtgtgccctgggcc

SEQ ID NO: 5928887 - DNA, 15 bp, Homo sapiens
gtgtgccctgggcca

SEQ ID NO: 5928888 - DNA, 16 bp, Homo sapiens
gtgtgccctgggccag

SEQ ID NO: 5928889 - DNA, 14 bp, Homo sapiens
gtgtgccctgtgtg

SEQ ID NO: 5928890 - DNA, 12 bp, Homo sapiens
gtgtgcctcctg

SEQ ID NO: 5928891 - DNA, 13 bp, Homo sapiens
gtgtgcctcctgt

SEQ ID NO: 5928892 - DNA, 14 bp, Homo sapiens
gtgtgcctcctgtg

SEQ ID NO: 5928893 - DNA, 11 bp, Homo sapiens
gtgtgcctcta

SEQ ID NO: 5928894 - DNA, 18 bp, Homo sapiens
gtgtgcctctctctccca

SEQ ID NO: 5928895 - DNA, 19 bp, Homo sapiens
gtgtgcctgactgcccagc

SEQ ID NO: 5928896 - DNA, 14 bp, Homo sapiens
gtgtgcctggcctc

SEQ ID NO: 5928897 - DNA, 16 bp, Homo sapiens
gtgtgcctgggggagt

SEQ ID NO: 5928898 - DNA, 16 bp, Homo sapiens
gtgtgcctggttaata

SEQ ID NO: 5928899 - DNA, 13 bp, Homo sapiens
gtgtgcctgtctg

SEQ ID NO: 5928900 - DNA, 22 bp, Homo sapiens
gtgtgcctgtctgttacactgg

SEQ ID NO: 5928901 - DNA, 16 bp, Homo sapiens
gtgtgcctgtgctcct

SEQ ID NO: 5928902 - DNA, 23 bp, Homo sapiens
gtgtgccttccagatcctctctg

SEQ ID NO: 5928903 - DNA, 17 bp, Homo sapiens
gtgtgccttctgccaac

SEQ ID NO: 5928904 - DNA, 16 bp, Homo sapiens
gtgtgcgcctgagtga

SEQ ID NO: 5928905 - DNA, 17 bp, Homo sapiens
gtgtgcgctgcctggcc

SEQ ID NO: 5928906 - DNA, 19 bp, Homo sapiens
gtgtgcgctgcctggccag

SEQ ID NO: 5928907 - DNA, 17 bp, Homo sapiens
gtgtgcggaggcaggag

SEQ ID NO: 5928908 - DNA, 18 bp, Homo sapiens
gtgtgcggagtctcctct

SEQ ID NO: 5928909 - DNA, 19 bp, Homo sapiens
gtgtgcggagtctcctctc

SEQ ID NO: 5928910 - DNA, 14 bp, Homo sapiens
gtgtgcgtgcgtgt

SEQ ID NO: 5928911 - DNA, 17 bp, Homo sapiens
gtgtgcgtggcgtggcc

SEQ ID NO: 5928912 - DNA, 15 bp, Homo sapiens
gtgtgctaaaaatga

SEQ ID NO: 5928913 - DNA, 12 bp, Homo sapiens
gtgtgctacaga

SEQ ID NO: 5928914 - DNA, 18 bp, Homo sapiens
gtgtgctactaacagatt

SEQ ID NO: 5928915 - DNA, 16 bp, Homo sapiens
gtgtgctccaggcttc

SEQ ID NO: 5928916 - DNA, 23 bp, Homo sapiens
gtgtgctccaggcttcctgccct

SEQ ID NO: 5928917 - DNA, 21 bp, Homo sapiens
gtgtgctctccattctgctcc

SEQ ID NO: 5928918 - DNA, 22 bp, Homo sapiens
gtgtgctctccattctgctcct

SEQ ID NO: 5928919 - DNA, 23 bp, Homo sapiens
gtgtgctctccattctgctcctt

SEQ ID NO: 5928920 - DNA, 23 bp, Homo sapiens
gtgtgctctccccggcaggcctg

SEQ ID NO: 5928921 - DNA, 15 bp, Homo sapiens
gtgtgctctgatcat

SEQ ID NO: 5928922 - DNA, 22 bp, Homo sapiens
gtgtgctctgatcatccactgt

SEQ ID NO: 5928923 - DNA, 15 bp, Homo sapiens
gtgtgctctgcttca

SEQ ID NO: 5928924 - DNA, 21 bp, Homo sapiens
gtgtgctcttatccccagctg

SEQ ID NO: 5928925 - DNA, 13 bp, Homo sapiens
gtgtgctcttctt

SEQ ID NO: 5928926 - DNA, 20 bp, Homo sapiens
gtgtgctgacaacttagctc

SEQ ID NO: 5928927 - DNA, 16 bp, Homo sapiens
gtgtgctgacttttta

SEQ ID NO: 5928928 - DNA, 17 bp, Homo sapiens
gtgtgctgatgggcgta

SEQ ID NO: 5928929 - DNA, 18 bp, Homo sapiens
gtgtgctgatgtttcctg

SEQ ID NO: 5928930 - DNA, 12 bp, Homo sapiens
gtgtgctgctgc

SEQ ID NO: 5928931 - DNA, 14 bp, Homo sapiens
gtgtgctgctgctg

SEQ ID NO: 5928932 - DNA, 14 bp, Homo sapiens
gtgtgctggcttcc

SEQ ID NO: 5928933 - DNA, 23 bp, Homo sapiens
gtgtgctgtatggcccaggcagc

SEQ ID NO: 5928934 - DNA, 17 bp, Homo sapiens
gtgtgctgttgtttaaa

SEQ ID NO: 5928935 - DNA, 15 bp, Homo sapiens
gtgtgctgtttgaaa

SEQ ID NO: 5928936 - DNA, 17 bp, Homo sapiens
gtgtgctgtttgaaaat

SEQ ID NO: 5928937 - DNA, 15 bp, Homo sapiens
gtgtgcttatgtttt

SEQ ID NO: 5928938 - DNA, 18 bp, Homo sapiens
gtgtgcttgaatgtgagt

SEQ ID NO: 5928939 - DNA, 13 bp, Homo sapiens
gtgtgctttataa

SEQ ID NO: 5928940 - DNA, 22 bp, Homo sapiens
gtgttctcctgctgctccctca

SEQ ID NO: 5928941 - DNA, 23 bp, Homo sapiens
gtgttctcctgctgctccctcag

SEQ ID NO: 5928942 - DNA, 14 bp, Homo sapiens
gtgttctctcttat

SEQ ID NO: 5928943 - DNA, 18 bp, Homo sapiens
gtgttctctttaatgctg

SEQ ID NO: 5928944 - DNA, 13 bp, Homo sapiens
gtgttctgagccc

SEQ ID NO: 5928945 - DNA, 21 bp, Homo sapiens
gtgttctgagcccccacctgc

SEQ ID NO: 5928946 - DNA, 16 bp, Homo sapiens
gtgttctgagctgtat

SEQ ID NO: 5928947 - DNA, 13 bp, Homo sapiens
gtgttctgctcct

SEQ ID NO: 5928948 - DNA, 16 bp, Homo sapiens
gtgttctgctcctgct

SEQ ID NO: 5928949 - DNA, 17 bp, Homo sapiens
gtgttctgctcctgctt

SEQ ID NO: 5928950 - DNA, 22 bp, Homo sapiens
gtgttctgctcctgcttttctg

SEQ ID NO: 5928951 - DNA, 23 bp, Homo sapiens
gtgttctgctcctgcttttctgt

SEQ ID NO: 5928952 - DNA, 18 bp, Homo sapiens
gtgttctggcctctggcc

SEQ ID NO: 5928953 - DNA, 22 bp, Homo sapiens
gtgttctggcctctggcctggg

SEQ ID NO: 5928954 - DNA, 11 bp, Homo sapiens
gtgttctgggc

SEQ ID NO: 5928955 - DNA, 23 bp, Homo sapiens
gtgttctgtgaatagcagtggca

SEQ ID NO: 5928956 - DNA, 14 bp, Homo sapiens
gtgttctgttcact

SEQ ID NO: 5928957 - DNA, 14 bp, Homo sapiens
gtgttctgttgaag

SEQ ID NO: 5928958 - DNA, 18 bp, Homo sapiens
gtgttctgtttgaaacta

SEQ ID NO: 5928959 - DNA, 15 bp, Homo sapiens
gtgttctgttttctc

SEQ ID NO: 5928960 - DNA, 13 bp, Homo sapiens
gtgttctgttttg

SEQ ID NO: 5928961 - DNA, 15 bp, Homo sapiens
gtgttctgttttgtt

SEQ ID NO: 5928962 - DNA, 16 bp, Homo sapiens
gtgttcttaaaatatt

SEQ ID NO: 5928963 - DNA, 16 bp, Homo sapiens
gtgttcttcaagccag

SEQ ID NO: 5928964 - DNA, 18 bp, Homo sapiens
gtgttcttcaagccagct

SEQ ID NO: 5928965 - DNA, 14 bp, Homo sapiens
gtgttcttcagtgt

SEQ ID NO: 5928966 - DNA, 16 bp, Homo sapiens
gtgttcttctcaagga

SEQ ID NO: 5928967 - DNA, 13 bp, Homo sapiens
gtgttctttcccc

SEQ ID NO: 5928968 - DNA, 21 bp, Homo sapiens
gtgttctttccccaggggcat

SEQ ID NO: 5928969 - DNA, 12 bp, Homo sapiens
gtgttcttttct

SEQ ID NO: 5928970 - DNA, 21 bp, Homo sapiens
gtgttcttttctcctttacca

SEQ ID NO: 5928971 - DNA, 21 bp, Homo sapiens
gtgttgaaacggatgatttct

SEQ ID NO: 5928972 - DNA, 16 bp, Homo sapiens
gtgttgaaatggcatt

SEQ ID NO: 5928973 - DNA, 18 bp, Homo sapiens
gtgttgaacacaattgat

SEQ ID NO: 5928974 - DNA, 14 bp, Homo sapiens
gtgttgaccggctg

SEQ ID NO: 5928975 - DNA, 12 bp, Homo sapiens
gtgttgaggagg

SEQ ID NO: 5928976 - DNA, 13 bp, Homo sapiens
gtgttgaggaggg

SEQ ID NO: 5928977 - DNA, 14 bp, Homo sapiens
gtgttgaggttttt

SEQ ID NO: 5928978 - DNA, 14 bp, Homo sapiens
gtgttgatactgtt

SEQ ID NO: 5928979 - DNA, 15 bp, Homo sapiens
gtgttgatactgttg

SEQ ID NO: 5928980 - DNA, 16 bp, Homo sapiens
gtgttgatactgttgc

SEQ ID NO: 5928981 - DNA, 20 bp, Homo sapiens
gtgttgatactgttgcacgt

SEQ ID NO: 5928982 - DNA, 12 bp, Homo sapiens
gtgttgatctta

SEQ ID NO: 5928983 - DNA, 18 bp, Homo sapiens
gtgttgatttgagaaatt

SEQ ID NO: 5928984 - DNA, 22 bp, Homo sapiens
gtgttgcaaatcactctgcaat

SEQ ID NO: 5928985 - DNA, 21 bp, Homo sapiens
gtgttgcaaattattctagtc

SEQ ID NO: 5928986 - DNA, 21 bp, Homo sapiens
gtgttgcagccgcagagaaat

SEQ ID NO: 5928987 - DNA, 17 bp, Homo sapiens
gtgttgcagctgtcacc

SEQ ID NO: 5928988 - DNA, 19 bp, Homo sapiens
gtgttgccaaatatgtcct

SEQ ID NO: 5928989 - DNA, 15 bp, Homo sapiens
gtgttgccaggcagg

SEQ ID NO: 5928990 - DNA, 23 bp, Homo sapiens
gtgttgccaggcaggcacctggg

SEQ ID NO: 5928991 - DNA, 19 bp, Homo sapiens
gtgttgccatttctctgct

SEQ ID NO: 5928992 - DNA, 17 bp, Homo sapiens
gtgttgcccaggctggt

SEQ ID NO: 5928993 - DNA, 20 bp, Homo sapiens
gtgttgcccaggctggtctc

SEQ ID NO: 5928994 - DNA, 14 bp, Homo sapiens
gtgttgctcagctc

SEQ ID NO: 5928995 - DNA, 13 bp, Homo sapiens
gtgttgctgtggc

SEQ ID NO: 5928996 - DNA, 13 bp, Homo sapiens
gtgttgctgttta

SEQ ID NO: 5928997 - DNA, 21 bp, Homo sapiens
gtgttgcttcaaactgagaca

SEQ ID NO: 5928998 - DNA, 16 bp, Homo sapiens
gtgttggaaactgtaa

SEQ ID NO: 5928999 - DNA, 20 bp, Homo sapiens
gtgttggaggggcaggcctt

SEQ ID NO: 5929000 - DNA, 16 bp, Homo sapiens
gtgttggcaaacgaga

SEQ ID NO: 5929001 - DNA, 21 bp, Homo sapiens
gtgttggctctgctggtcact

SEQ ID NO: 5929002 - DNA, 16 bp, Homo sapiens
gtgttgggaattgcat

SEQ ID NO: 5929003 - DNA, 15 bp, Homo sapiens
gtgttgggacctgct

SEQ ID NO: 5929004 - DNA, 16 bp, Homo sapiens
gtgttggggctggggg

SEQ ID NO: 5929005 - DNA, 23 bp, Homo sapiens
gtgttggtctttctaatgtagct

SEQ ID NO: 5929006 - DNA, 24 bp, Homo sapiens
gtgttggtctttctaatgtagcta

SEQ ID NO: 5929007 - DNA, 22 bp, Homo sapiens
gtgttggttttgactggatatt

SEQ ID NO: 5929008 - DNA, 14 bp, Homo sapiens
gtgttgtattaaca

SEQ ID NO: 5929009 - DNA, 18 bp, Homo sapiens
gtgttgtattaacaaaag

SEQ ID NO: 5929010 - DNA, 19 bp, Homo sapiens
gtgttgtcccatctgccct

SEQ ID NO: 5929011 - DNA, 23 bp, Homo sapiens
gtgttgtcccatctgccctccct

SEQ ID NO: 5929012 - DNA, 20 bp, Homo sapiens
gtgttgtccctactttctct

SEQ ID NO: 5929013 - DNA, 18 bp, Homo sapiens
gtgttgtccttttgtctt

SEQ ID NO: 5929014 - DNA, 12 bp, Homo sapiens
gtgttgtctcta

SEQ ID NO: 5929015 - DNA, 20 bp, Homo sapiens
gtgttgtgaaactgtaaatt

SEQ ID NO: 5929016 - DNA, 20 bp, Homo sapiens
gtgttgtgggcttcctgctg

SEQ ID NO: 5929017 - DNA, 19 bp, Homo sapiens
gtgttgtgtccattttgca

SEQ ID NO: 5929018 - DNA, 13 bp, Homo sapiens
gtgttgtgttcct

SEQ ID NO: 5929019 - DNA, 14 bp, Homo sapiens
gtgttgtgttcctg

SEQ ID NO: 5929020 - DNA, 15 bp, Homo sapiens
gtgttgtgttcttta

SEQ ID NO: 5929021 - DNA, 21 bp, Homo sapiens
gtgttgttgcttcttgtgaag

SEQ ID NO: 5929022 - DNA, 20 bp, Homo sapiens
gtgttgttgttgctgctgtt

SEQ ID NO: 5929023 - DNA, 15 bp, Homo sapiens
gtgttgttttctctg

SEQ ID NO: 5929024 - DNA, 12 bp, Homo sapiens
gtgtttaaaaaa

SEQ ID NO: 5929025 - DNA, 22 bp, Homo sapiens
gtgtttaaaaattgaaaaaagt

SEQ ID NO: 5929026 - DNA, 14 bp, Homo sapiens
gtgtttaaagtcaa

SEQ ID NO: 5929027 - DNA, 21 bp, Homo sapiens
gtgtttaaagttcaacatgtt

SEQ ID NO: 5929028 - DNA, 14 bp, Homo sapiens
gtgtttaaataaag

SEQ ID NO: 5929029 - DNA, 16 bp, Homo sapiens
gtgtttaaataaagta

SEQ ID NO: 5929030 - DNA, 14 bp, Homo sapiens
gtgtttaacattca

SEQ ID NO: 5929031 - DNA, 15 bp, Homo sapiens
gtgtttaacattcac

SEQ ID NO: 5929032 - DNA, 19 bp, Homo sapiens
gtgtttaacattcacagcc

SEQ ID NO: 5929033 - DNA, 19 bp, Homo sapiens
gtgtttaactgctgcaggg

SEQ ID NO: 5929034 - DNA, 14 bp, Homo sapiens
gtgtttaactggca

SEQ ID NO: 5929035 - DNA, 17 bp, Homo sapiens
gtgtttaattgtataaa

SEQ ID NO: 5929036 - DNA, 16 bp, Homo sapiens
gtgtttaatttcttca

SEQ ID NO: 5929037 - DNA, 17 bp, Homo sapiens
gtgtttaatttcttcaa

SEQ ID NO: 5929038 - DNA, 12 bp, Homo sapiens
gtgtttacagac

SEQ ID NO: 5929039 - DNA, 14 bp, Homo sapiens
gtgtttacagagat

SEQ ID NO: 5929040 - DNA, 14 bp, Homo sapiens
gtgtttacatttta

SEQ ID NO: 5929041 - DNA, 20 bp, Homo sapiens
gtgtttacttcctgcagtga

SEQ ID NO: 5929042 - DNA, 20 bp, Homo sapiens
gtgtttactttttggctgga

SEQ ID NO: 5929043 - DNA, 19 bp, Homo sapiens
gtgtttaggatcatctctg

SEQ ID NO: 5929044 - DNA, 15 bp, Homo sapiens
gtgtttatcctttca

SEQ ID NO: 5929045 - DNA, 22 bp, Homo sapiens
gtgtttatggccaatctattct

SEQ ID NO: 5929046 - DNA, 19 bp, Homo sapiens
gtgtttattcatccagcag

SEQ ID NO: 5929047 - DNA, 13 bp, Homo sapiens
gtgtttattgcaa

SEQ ID NO: 5929048 - DNA, 13 bp, Homo sapiens
gtgtttatttata

SEQ ID NO: 5929049 - DNA, 21 bp, Homo sapiens
gtgtttcacagtttgaaataa

SEQ ID NO: 5929050 - DNA, 17 bp, Homo sapiens
gtgtttcaggacagctg

SEQ ID NO: 5929051 - DNA, 18 bp, Homo sapiens
gtgtttcatgttctgtgt

SEQ ID NO: 5929052 - DNA, 21 bp, Homo sapiens
gtgtttcattacttgaatgta

SEQ ID NO: 5929053 - DNA, 18 bp, Homo sapiens
gtgtttccacagcctgca

SEQ ID NO: 5929054 - DNA, 13 bp, Homo sapiens
gtgtttccagtga

SEQ ID NO: 5929055 - DNA, 16 bp, Homo sapiens
gtgtttccctctgtgt

SEQ ID NO: 5929056 - DNA, 17 bp, Homo sapiens
gtgtttcctcatctatg

SEQ ID NO: 5929057 - DNA, 23 bp, Homo sapiens
gtgtttcctggcactgcttccag

SEQ ID NO: 5929058 - DNA, 19 bp, Homo sapiens
gtgtttcgcgggtaactgg

SEQ ID NO: 5929059 - DNA, 15 bp, Homo sapiens
gtgtttcgggccagg

SEQ ID NO: 5929060 - DNA, 13 bp, Homo sapiens
gtgtttctatctc

SEQ ID NO: 5929061 - DNA, 18 bp, Homo sapiens
gtgtttctatctctttct

SEQ ID NO: 5929062 - DNA, 17 bp, Homo sapiens
gtgtttctattgacttc

SEQ ID NO: 5929063 - DNA, 14 bp, Homo sapiens
gtgtttctcaaaag

SEQ ID NO: 5929064 - DNA, 15 bp, Homo sapiens
gtgtttctcaaaaga

SEQ ID NO: 5929065 - DNA, 13 bp, Homo sapiens
gtgtttctccctc

SEQ ID NO: 5929066 - DNA, 21 bp, Homo sapiens
gtgtttctccctctcactgtc

SEQ ID NO: 5929067 - DNA, 13 bp, Homo sapiens
gtgtttctctaag

SEQ ID NO: 5929068 - DNA, 14 bp, Homo sapiens
gtgtttctgaatgt

SEQ ID NO: 5929069 - DNA, 12 bp, Homo sapiens
gtgtttctggag

SEQ ID NO: 5929070 - DNA, 23 bp, Homo sapiens
gtgtttctggagtgattctagag

SEQ ID NO: 5929071 - DNA, 15 bp, Homo sapiens
gtgtttctgtaacaa

SEQ ID NO: 5929072 - DNA, 15 bp, Homo sapiens
gtgtttctgtgctcc

SEQ ID NO: 5929073 - DNA, 16 bp, Homo sapiens
gtgtttctgtgctcca

SEQ ID NO: 5929074 - DNA, 14 bp, Homo sapiens
gtgtttcttgcctc

SEQ ID NO: 5929075 - DNA, 14 bp, Homo sapiens
gtgtttcttgcttt

SEQ ID NO: 5929076 - DNA, 12 bp, Homo sapiens
gtgtttgaaaac

SEQ ID NO: 5929077 - DNA, 21 bp, Homo sapiens
gtgtttgaaaactgacatcag

SEQ ID NO: 5929078 - DNA, 12 bp, Homo sapiens
gtgtttgaagca

SEQ ID NO: 5929079 - DNA, 16 bp, Homo sapiens
gtgtttgaagtctgct

SEQ ID NO: 5929080 - DNA, 15 bp, Homo sapiens
gtgtttgagtttctg

SEQ ID NO: 5929081 - DNA, 13 bp, Homo sapiens
gtgtttgattcca

SEQ ID NO: 5929082 - DNA, 13 bp, Homo sapiens
gtgtttgattggc

SEQ ID NO: 5929083 - DNA, 22 bp, Homo sapiens
gtgtttgcacgttatggtgttt

SEQ ID NO: 5929084 - DNA, 15 bp, Homo sapiens
gtgtttgcagctgtg

SEQ ID NO: 5929085 - DNA, 18 bp, Homo sapiens
gtgtttgcagctgtgaga

SEQ ID NO: 5929086 - DNA, 15 bp, Homo sapiens
gtgtttgcattgtct

SEQ ID NO: 5929087 - DNA, 15 bp, Homo sapiens
gtgtttgcttaaaat

SEQ ID NO: 5929088 - DNA, 19 bp, Homo sapiens
gtgtttgcttaaacaaagt

SEQ ID NO: 5929089 - DNA, 11 bp, Homo sapiens
gtgtttgcttg

SEQ ID NO: 5929090 - DNA, 23 bp, Homo sapiens
gtgtttgcttggaaattccttgc

SEQ ID NO: 5929091 - DNA, 17 bp, Homo sapiens
gtgtttggaggctgctg

SEQ ID NO: 5929092 - DNA, 19 bp, Homo sapiens
gtgtttggaggctgctgcc

SEQ ID NO: 5929093 - DNA, 20 bp, Homo sapiens
gtgtttggcaggagaatcaa

SEQ ID NO: 5929094 - DNA, 16 bp, Homo sapiens
gtgtttggtttacatt

SEQ ID NO: 5929095 - DNA, 14 bp, Homo sapiens
gtgtttgtatgtct

SEQ ID NO: 5929096 - DNA, 16 bp, Homo sapiens
gtgtttgtcctgggtt

SEQ ID NO: 5929097 - DNA, 16 bp, Homo sapiens
gtgtttgtgagcatgg

SEQ ID NO: 5929098 - DNA, 23 bp, Homo sapiens
gtgtttgttcataataaaagtga

SEQ ID NO: 5929099 - DNA, 12 bp, Homo sapiens
gtgttttaacac

SEQ ID NO: 5929100 - DNA, 18 bp, Homo sapiens
gtgttttaataaacgttt

SEQ ID NO: 5929101 - DNA, 22 bp, Homo sapiens
gtgttttaattccaatatgatg

SEQ ID NO: 5929102 - DNA, 14 bp, Homo sapiens
gtgttttaatttaa

SEQ ID NO: 5929103 - DNA, 14 bp, Homo sapiens
gtgttttactgtca

SEQ ID NO: 5929104 - DNA, 20 bp, Homo sapiens
gtgttttactgtcagattaa

SEQ ID NO: 5929105 - DNA, 14 bp, Homo sapiens
gtgttttattcact

SEQ ID NO: 5929106 - DNA, 23 bp, Homo sapiens
gtgttttcaagcacaacccacca

SEQ ID NO: 5929107 - DNA, 21 bp, Homo sapiens
gtgttttcaaggaagaaaacg

SEQ ID NO: 5929108 - DNA, 12 bp, Homo sapiens
gtgttttcagag

SEQ ID NO: 5929109 - DNA, 13 bp, Homo sapiens
gtgttttcataat

SEQ ID NO: 5929110 - DNA, 14 bp, Homo sapiens
gtgttttcataata

SEQ ID NO: 5929111 - DNA, 15 bp, Homo sapiens
gtgttttcataataa

SEQ ID NO: 5929112 - DNA, 19 bp, Homo sapiens
gtgttttcatcatttcagc

SEQ ID NO: 5929113 - DNA, 13 bp, Homo sapiens
gtgttttctgaat

SEQ ID NO: 5929114 - DNA, 18 bp, Homo sapiens
gtgttttctgaataacat

SEQ ID NO: 5929115 - DNA, 13 bp, Homo sapiens
gtgttttctgtag

SEQ ID NO: 5929116 - DNA, 23 bp, Homo sapiens
gtgttttctgtagactctaagat

SEQ ID NO: 5929117 - DNA, 16 bp, Homo sapiens
gtgttttctgtgtaac

SEQ ID NO: 5929118 - DNA, 19 bp, Homo sapiens
gtgttttcttgtaaatgtt

SEQ ID NO: 5929119 - DNA, 12 bp, Homo sapiens
gtgttttgctgt

SEQ ID NO: 5929120 - DNA, 16 bp, Homo sapiens
gttacctttgctgtca

SEQ ID NO: 5929121 - DNA, 16 bp, Homo sapiens
gttacgtgaagaaata

SEQ ID NO: 5929122 - DNA, 23 bp, Homo sapiens
gttacgtgaagaaataaatgaaa

SEQ ID NO: 5929123 - DNA, 16 bp, Homo sapiens
gttactaactaaactc

SEQ ID NO: 5929124 - DNA, 17 bp, Homo sapiens
gttactaactaaactct

SEQ ID NO: 5929125 - DNA, 16 bp, Homo sapiens
gttactaagatgaaat

SEQ ID NO: 5929126 - DNA, 21 bp, Homo sapiens
gttactaatatatctgtaaca

SEQ ID NO: 5929127 - DNA, 23 bp, Homo sapiens
gttactaattggcctctttaaga

SEQ ID NO: 5929128 - DNA, 15 bp, Homo sapiens
gttactacctcctct

SEQ ID NO: 5929129 - DNA, 13 bp, Homo sapiens
gttactagcctct

SEQ ID NO: 5929130 - DNA, 22 bp, Homo sapiens
gttactatagtggtgagatgga

SEQ ID NO: 5929131 - DNA, 13 bp, Homo sapiens
gttactatatgcc

SEQ ID NO: 5929132 - DNA, 21 bp, Homo sapiens
gttactatttttatattctat

SEQ ID NO: 5929133 - DNA, 12 bp, Homo sapiens
gttactcagccc

SEQ ID NO: 5929134 - DNA, 13 bp, Homo sapiens
gttactcagccct

SEQ ID NO: 5929135 - DNA, 14 bp, Homo sapiens
gttactcagccctg

SEQ ID NO: 5929136 - DNA, 15 bp, Homo sapiens
gttactcagccctgg

SEQ ID NO: 5929137 - DNA, 22 bp, Homo sapiens
gttactcagggctcctcccagc

SEQ ID NO: 5929138 - DNA, 15 bp, Homo sapiens
gttactcagggttca

SEQ ID NO: 5929139 - DNA, 20 bp, Homo sapiens
gttactcagggttcatctgt

SEQ ID NO: 5929140 - DNA, 23 bp, Homo sapiens
gttactcagggttcatctgtcca

SEQ ID NO: 5929141 - DNA, 19 bp, Homo sapiens
gttactcagtgttagagaa

SEQ ID NO: 5929142 - DNA, 20 bp, Homo sapiens
gttactcagtgttagagaaa

SEQ ID NO: 5929143 - DNA, 19 bp, Homo sapiens
gttactcatcgggcccagg

SEQ ID NO: 5929144 - DNA, 21 bp, Homo sapiens
gttactcatctttatcctaaa

SEQ ID NO: 5929145 - DNA, 16 bp, Homo sapiens
gttactcattttatca

SEQ ID NO: 5929146 - DNA, 16 bp, Homo sapiens
gttactccagtgccaa

SEQ ID NO: 5929147 - DNA, 22 bp, Homo sapiens
gttactccagtgccaacaatcc

SEQ ID NO: 5929148 - DNA, 19 bp, Homo sapiens
gttactccctacactgatg

SEQ ID NO: 5929149 - DNA, 20 bp, Homo sapiens
gttactccctgttttagttt

SEQ ID NO: 5929150 - DNA, 21 bp, Homo sapiens
gttactctcttccacatgtta

SEQ ID NO: 5929151 - DNA, 21 bp, Homo sapiens
gttactctcttgcaccaaatt

SEQ ID NO: 5929152 - DNA, 11 bp, Homo sapiens
gttactctgaa

SEQ ID NO: 5929153 - DNA, 14 bp, Homo sapiens
gttactctggttct

SEQ ID NO: 5929154 - DNA, 16 bp, Homo sapiens
gttactcttaatttta

SEQ ID NO: 5929155 - DNA, 23 bp, Homo sapiens
gttactcttcagttaagcctttg

SEQ ID NO: 5929156 - DNA, 17 bp, Homo sapiens
gttactgaaatgagcct

SEQ ID NO: 5929157 - DNA, 21 bp, Homo sapiens
gttactgaagttatctgtgtt

SEQ ID NO: 5929158 - DNA, 15 bp, Homo sapiens
gttactgagatgttt

SEQ ID NO: 5929159 - DNA, 14 bp, Homo sapiens
gttactgattctcc

SEQ ID NO: 5929160 - DNA, 22 bp, Homo sapiens
gttactgcctaggagttaatga

SEQ ID NO: 5929161 - DNA, 14 bp, Homo sapiens
gttactgccttaat

SEQ ID NO: 5929162 - DNA, 17 bp, Homo sapiens
gttactgcttctctttg

SEQ ID NO: 5929163 - DNA, 14 bp, Homo sapiens
gttactgctttgca

SEQ ID NO: 5929164 - DNA, 14 bp, Homo sapiens
gttactgggccctg

SEQ ID NO: 5929165 - DNA, 17 bp, Homo sapiens
gttactgggtaggttct

SEQ ID NO: 5929166 - DNA, 18 bp, Homo sapiens
gttactggtgatgttgaa

SEQ ID NO: 5929167 - DNA, 13 bp, Homo sapiens
gttactgtaattc

SEQ ID NO: 5929168 - DNA, 21 bp, Homo sapiens
gttactgtatactgaaggtct

SEQ ID NO: 5929169 - DNA, 12 bp, Homo sapiens
gttactgtattt

SEQ ID NO: 5929170 - DNA, 18 bp, Homo sapiens
gttactgtatttttcaga

SEQ ID NO: 5929171 - DNA, 21 bp, Homo sapiens
gttactgtcctgttttctaat

SEQ ID NO: 5929172 - DNA, 19 bp, Homo sapiens
gttactgtgccatgtgttt

SEQ ID NO: 5929173 - DNA, 13 bp, Homo sapiens
gttactgtgtaat

SEQ ID NO: 5929174 - DNA, 12 bp, Homo sapiens
gttactgtgtga

SEQ ID NO: 5929175 - DNA, 18 bp, Homo sapiens
gttactgttaaccattta

SEQ ID NO: 5929176 - DNA, 16 bp, Homo sapiens
gttactgttatagagg

SEQ ID NO: 5929177 - DNA, 10 bp, Homo sapiens
gttactgttc

SEQ ID NO: 5929178 - DNA, 11 bp, Homo sapiens
gttactgttct

SEQ ID NO: 5929179 - DNA, 18 bp, Homo sapiens
gttactgttcttgctgct

SEQ ID NO: 5929180 - DNA, 16 bp, Homo sapiens
gttactgttgtgacct

SEQ ID NO: 5929181 - DNA, 14 bp, Homo sapiens
gttacttaagattc

SEQ ID NO: 5929182 - DNA, 23 bp, Homo sapiens
gttacttcactttaattctcatg

SEQ ID NO: 5929183 - DNA, 12 bp, Homo sapiens
gttacttccctt

SEQ ID NO: 5929184 - DNA, 13 bp, Homo sapiens
gttacttccttat

SEQ ID NO: 5929185 - DNA, 12 bp, Homo sapiens
gttacttccttc

SEQ ID NO: 5929186 - DNA, 18 bp, Homo sapiens
gttacttctcccctgggt

SEQ ID NO: 5929187 - DNA, 15 bp, Homo sapiens
gttacttctctgagt

SEQ ID NO: 5929188 - DNA, 14 bp, Homo sapiens
gttacttctgaggt

SEQ ID NO: 5929189 - DNA, 14 bp, Homo sapiens
gttacttgctttga

SEQ ID NO: 5929190 - DNA, 17 bp, Homo sapiens
gttacttgtctgaggcc

SEQ ID NO: 5929191 - DNA, 18 bp, Homo sapiens
gttacttgtctgaggcct

SEQ ID NO: 5929192 - DNA, 19 bp, Homo sapiens
gttacttgtctgaggcctc

SEQ ID NO: 5929193 - DNA, 23 bp, Homo sapiens
gttacttgtctgaggcctcatcc

SEQ ID NO: 5929194 - DNA, 19 bp, Homo sapiens
gttactttaaaaatcagtt

SEQ ID NO: 5929195 - DNA, 20 bp, Homo sapiens
gttactttatttgaataaca

SEQ ID NO: 5929196 - DNA, 21 bp, Homo sapiens
gttactttctttcagatgttt

SEQ ID NO: 5929197 - DNA, 14 bp, Homo sapiens
gttactttgtaatt

SEQ ID NO: 5929198 - DNA, 19 bp, Homo sapiens
gttactttgtaatttttgg

SEQ ID NO: 5929199 - DNA, 13 bp, Homo sapiens
gttactttttagt

SEQ ID NO: 5929200 - DNA, 20 bp, Homo sapiens
gttactttttagtcttttac

SEQ ID NO: 5929201 - DNA, 15 bp, Homo sapiens
gttagaaaatgactt

SEQ ID NO: 5929202 - DNA, 19 bp, Homo sapiens
gttagaaaattcagctcct

SEQ ID NO: 5929203 - DNA, 15 bp, Homo sapiens
gttagaaacattttg

SEQ ID NO: 5929204 - DNA, 15 bp, Homo sapiens
gttagaaatgcaaat

SEQ ID NO: 5929205 - DNA, 13 bp, Homo sapiens
gttagaacactat

SEQ ID NO: 5929206 - DNA, 16 bp, Homo sapiens
gttagaactgattaca

SEQ ID NO: 5929207 - DNA, 17 bp, Homo sapiens
gttagaactgattacat

SEQ ID NO: 5929208 - DNA, 18 bp, Homo sapiens
gttagaagaagaggaaga

SEQ ID NO: 5929209 - DNA, 19 bp, Homo sapiens
gttagaagaggtggcccca

SEQ ID NO: 5929210 - DNA, 20 bp, Homo sapiens
gttagaataataaatattta

SEQ ID NO: 5929211 - DNA, 17 bp, Homo sapiens
gttagaatcaaatactc

SEQ ID NO: 5929212 - DNA, 18 bp, Homo sapiens
gttagaatctattttcta

SEQ ID NO: 5929213 - DNA, 19 bp, Homo sapiens
gttagaatctattttctat

SEQ ID NO: 5929214 - DNA, 15 bp, Homo sapiens
gttagaatgaggagg

SEQ ID NO: 5929215 - DNA, 15 bp, Homo sapiens
gttagaatgtaaggt

SEQ ID NO: 5929216 - DNA, 18 bp, Homo sapiens
gttagaattgatttccaa

SEQ ID NO: 5929217 - DNA, 13 bp, Homo sapiens
gttagacagccaa

SEQ ID NO: 5929218 - DNA, 18 bp, Homo sapiens
gttagactcttacttttt

SEQ ID NO: 5929219 - DNA, 22 bp, Homo sapiens
gttagactgacttgtttgtctt

SEQ ID NO: 5929220 - DNA, 17 bp, Homo sapiens
gttagactgccagctct

SEQ ID NO: 5929221 - DNA, 23 bp, Homo sapiens
gttagactgttgggacagccatt

SEQ ID NO: 5929222 - DNA, 13 bp, Homo sapiens
gttagacttgctc

SEQ ID NO: 5929223 - DNA, 18 bp, Homo sapiens
gttagacttgctccctct

SEQ ID NO: 5929224 - DNA, 21 bp, Homo sapiens
gttagacttgtgtgcatggaa

SEQ ID NO: 5929225 - DNA, 20 bp, Homo sapiens
gttagagaactaaactagtt

SEQ ID NO: 5929226 - DNA, 20 bp, Homo sapiens
gttagagaatatatttttga

SEQ ID NO: 5929227 - DNA, 20 bp, Homo sapiens
gttagagagggaccatgtgt

SEQ ID NO: 5929228 - DNA, 18 bp, Homo sapiens
gttagagaggtagcgagc

SEQ ID NO: 5929229 - DNA, 21 bp, Homo sapiens
gttagagaggtagcgagctgc

SEQ ID NO: 5929230 - DNA, 13 bp, Homo sapiens
gttagagatgcct

SEQ ID NO: 5929231 - DNA, 17 bp, Homo sapiens
gttagagccaagctgca

SEQ ID NO: 5929232 - DNA, 18 bp, Homo sapiens
gttagagccaagctgcac

SEQ ID NO: 5929233 - DNA, 19 bp, Homo sapiens
gttagagccaagctgcaca

SEQ ID NO: 5929234 - DNA, 17 bp, Homo sapiens
gttagaggaaaaatatt

SEQ ID NO: 5929235 - DNA, 23 bp, Homo sapiens
gttagaggaaaagactcctcctg

SEQ ID NO: 5929236 - DNA, 22 bp, Homo sapiens
gttagaggttttaaagtgatta

SEQ ID NO: 5929237 - DNA, 15 bp, Homo sapiens
gttagataaaaataa

SEQ ID NO: 5929238 - DNA, 12 bp, Homo sapiens
gttagatctagt

SEQ ID NO: 5929239 - DNA, 14 bp, Homo sapiens
gttagatgctacta

SEQ ID NO: 5929240 - DNA, 11 bp, Homo sapiens
gttagatgctg

SEQ ID NO: 5929241 - DNA, 16 bp, Homo sapiens
gttagatgcttagtgt

SEQ ID NO: 5929242 - DNA, 12 bp, Homo sapiens
gttagatgtttg

SEQ ID NO: 5929243 - DNA, 16 bp, Homo sapiens
gttagattaagaaata

SEQ ID NO: 5929244 - DNA, 23 bp, Homo sapiens
gttagattcctcttgcctctctc

SEQ ID NO: 5929245 - DNA, 11 bp, Homo sapiens
gttagcaaaga

SEQ ID NO: 5929246 - DNA, 13 bp, Homo sapiens
gttagcaagagag

SEQ ID NO: 5929247 - DNA, 14 bp, Homo sapiens
gttagcaatattta

SEQ ID NO: 5929248 - DNA, 15 bp, Homo sapiens
gttagcactgatagt

SEQ ID NO: 5929249 - DNA, 18 bp, Homo sapiens
gttagcactgatagtcct

SEQ ID NO: 5929250 - DNA, 14 bp, Homo sapiens
gttagcactgttga

SEQ ID NO: 5929251 - DNA, 16 bp, Homo sapiens
gttagcactgttgatg

SEQ ID NO: 5929252 - DNA, 21 bp, Homo sapiens
gttagcactgttgatgtatct

SEQ ID NO: 5929253 - DNA, 13 bp, Homo sapiens
gttagcagagtct

SEQ ID NO: 5929254 - DNA, 15 bp, Homo sapiens
gttagcagagtctgt

SEQ ID NO: 5929255 - DNA, 18 bp, Homo sapiens
gttagcagagtctgtctc

SEQ ID NO: 5929256 - DNA, 21 bp, Homo sapiens
gttagcagagtctgtctcttg

SEQ ID NO: 5929257 - DNA, 23 bp, Homo sapiens
gttagcagcagtgagcttctatt

SEQ ID NO: 5929258 - DNA, 21 bp, Homo sapiens
gttagcatgcgcgctgtgggc

SEQ ID NO: 5929259 - DNA, 22 bp, Homo sapiens
gttagcatgcgcgctgtgggca

SEQ ID NO: 5929260 - DNA, 19 bp, Homo sapiens
gttagcatgtatgaatgta

SEQ ID NO: 5929261 - DNA, 20 bp, Homo sapiens
gttagcatgtgtgactttca

SEQ ID NO: 5929262 - DNA, 16 bp, Homo sapiens
gttagcattattgcca

SEQ ID NO: 5929263 - DNA, 21 bp, Homo sapiens
gttagcatttaccaacatgta

SEQ ID NO: 5929264 - DNA, 20 bp, Homo sapiens
gttagcccaatggagaaatg

SEQ ID NO: 5929265 - DNA, 22 bp, Homo sapiens
gttagcccaatggagaaatgaa

SEQ ID NO: 5929266 - DNA, 22 bp, Homo sapiens
gttagccccagggatcactggc

SEQ ID NO: 5929267 - DNA, 13 bp, Homo sapiens
gttagcccggcca

SEQ ID NO: 5929268 - DNA, 13 bp, Homo sapiens
gttagccctcagt

SEQ ID NO: 5929269 - DNA, 20 bp, Homo sapiens
gttagccctcagtcagttcc

SEQ ID NO: 5929270 - DNA, 14 bp, Homo sapiens
gttagcctgcaccg

SEQ ID NO: 5929271 - DNA, 17 bp, Homo sapiens
gttagcgtccatttctt

SEQ ID NO: 5929272 - DNA, 11 bp, Homo sapiens
gttagctcaga

SEQ ID NO: 5929273 - DNA, 13 bp, Homo sapiens
gttagctcagagg

SEQ ID NO: 5929274 - DNA, 18 bp, Homo sapiens
gttagctccctgtggggc

SEQ ID NO: 5929275 - DNA, 20 bp, Homo sapiens
gttagctcctgtggccccac

SEQ ID NO: 5929276 - DNA, 17 bp, Homo sapiens
gttagctgaagaattga

SEQ ID NO: 5929277 - DNA, 16 bp, Homo sapiens
gttagctgacagtcag

SEQ ID NO: 5929278 - DNA, 20 bp, Homo sapiens
gttagctggacatgctttgg

SEQ ID NO: 5929279 - DNA, 11 bp, Homo sapiens
gttagctggag

SEQ ID NO: 5929280 - DNA, 22 bp, Homo sapiens
gttagctgtcacatacaacttt

SEQ ID NO: 5929281 - DNA, 19 bp, Homo sapiens
gttagctttttaaaacatt

SEQ ID NO: 5929282 - DNA, 14 bp, Homo sapiens
gttaggaaataaaa

SEQ ID NO: 5929283 - DNA, 18 bp, Homo sapiens
gttaggaaataaaacctt

SEQ ID NO: 5929284 - DNA, 19 bp, Homo sapiens
gttaggaaataaaaccttt

SEQ ID NO: 5929285 - DNA, 15 bp, Homo sapiens
gttaggaacccggca

SEQ ID NO: 5929286 - DNA, 18 bp, Homo sapiens
gttaggaataacactgca

SEQ ID NO: 5929287 - DNA, 15 bp, Homo sapiens
gttaggaatgagaag

SEQ ID NO: 5929288 - DNA, 13 bp, Homo sapiens
gttaggaggtcct

SEQ ID NO: 5929289 - DNA, 20 bp, Homo sapiens
gttaggagtgggtgacaaga

SEQ ID NO: 5929290 - DNA, 21 bp, Homo sapiens
gttaggagtggttctcatttg

SEQ ID NO: 5929291 - DNA, 15 bp, Homo sapiens
gttaggagttcgaga

SEQ ID NO: 5929292 - DNA, 17 bp, Homo sapiens
gttaggatgctcagttg

SEQ ID NO: 5929293 - DNA, 15 bp, Homo sapiens
gttaggatggcagga

SEQ ID NO: 5929294 - DNA, 23 bp, Homo sapiens
gttaggatttaacagtcatttaa

SEQ ID NO: 5929295 - DNA, 14 bp, Homo sapiens
gttaggcagcaagc

SEQ ID NO: 5929296 - DNA, 22 bp, Homo sapiens
gttaggccaaagacaaatagta

SEQ ID NO: 5929297 - DNA, 21 bp, Homo sapiens
gttaggcccgggcccctggca

SEQ ID NO: 5929298 - DNA, 13 bp, Homo sapiens
gttaggcctggca

SEQ ID NO: 5929299 - DNA, 16 bp, Homo sapiens
gttatggtgatgactt

SEQ ID NO: 5929300 - DNA, 17 bp, Homo sapiens
gttatggtgatgactta

SEQ ID NO: 5929301 - DNA, 21 bp, Homo sapiens
gttatgtaaaaggccaaacct

SEQ ID NO: 5929302 - DNA, 17 bp, Homo sapiens
gttatgtaagtttctaa

SEQ ID NO: 5929303 - DNA, 11 bp, Homo sapiens
gttatgtacaa

SEQ ID NO: 5929304 - DNA, 22 bp, Homo sapiens
gttatgtaccatatgatctgtt

SEQ ID NO: 5929305 - DNA, 22 bp, Homo sapiens
gttatgtactagtgttctgttt

SEQ ID NO: 5929306 - DNA, 13 bp, Homo sapiens
gttatgtactgta

SEQ ID NO: 5929307 - DNA, 15 bp, Homo sapiens
gttatgtactgtact

SEQ ID NO: 5929308 - DNA, 17 bp, Homo sapiens
gttatgtactgtactaa

SEQ ID NO: 5929309 - DNA, 11 bp, Homo sapiens
gttatgtatga

SEQ ID NO: 5929310 - DNA, 16 bp, Homo sapiens
gttatgtattcctatg

SEQ ID NO: 5929311 - DNA, 22 bp, Homo sapiens
gttatgtcagcagctctgagac

SEQ ID NO: 5929312 - DNA, 18 bp, Homo sapiens
gttatgtctgtttaagaa

SEQ ID NO: 5929313 - DNA, 18 bp, Homo sapiens
gttatgtgggtggcttct

SEQ ID NO: 5929314 - DNA, 18 bp, Homo sapiens
gttatgtgtatgtgccat

SEQ ID NO: 5929315 - DNA, 11 bp, Homo sapiens
gttatgtgtct

SEQ ID NO: 5929316 - DNA, 16 bp, Homo sapiens
gttatgttcatttttc

SEQ ID NO: 5929317 - DNA, 20 bp, Homo sapiens
gttatgttcccagcagtggg

SEQ ID NO: 5929318 - DNA, 13 bp, Homo sapiens
gttatgttgtaat

SEQ ID NO: 5929319 - DNA, 19 bp, Homo sapiens
gttatgtttaaaaaaacat

SEQ ID NO: 5929320 - DNA, 22 bp, Homo sapiens
gttatgtttgcactttgtatat

SEQ ID NO: 5929321 - DNA, 13 bp, Homo sapiens
gttattaaatgta

SEQ ID NO: 5929322 - DNA, 21 bp, Homo sapiens
gttattaacctcttaaacatg

SEQ ID NO: 5929323 - DNA, 21 bp, Homo sapiens
gttattaactttaatgttttt

SEQ ID NO: 5929324 - DNA, 14 bp, Homo sapiens
gttattaatattgt

SEQ ID NO: 5929325 - DNA, 16 bp, Homo sapiens
gttattaatgtttctt

SEQ ID NO: 5929326 - DNA, 22 bp, Homo sapiens
gttattaattaaagaaaattaa

SEQ ID NO: 5929327 - DNA, 23 bp, Homo sapiens
gttattaattaaagaaaattaat

SEQ ID NO: 5929328 - DNA, 15 bp, Homo sapiens
gttattaatttgtaa

SEQ ID NO: 5929329 - DNA, 13 bp, Homo sapiens
gttattacatcct

SEQ ID NO: 5929330 - DNA, 13 bp, Homo sapiens
gttattacctctc

SEQ ID NO: 5929331 - DNA, 14 bp, Homo sapiens
gttattagaactta

SEQ ID NO: 5929332 - DNA, 13 bp, Homo sapiens
gttattataaatg

SEQ ID NO: 5929333 - DNA, 14 bp, Homo sapiens
gttattataaatgt

SEQ ID NO: 5929334 - DNA, 15 bp, Homo sapiens
gttattataaatgtt

SEQ ID NO: 5929335 - DNA, 17 bp, Homo sapiens
gttattataaatgttag

SEQ ID NO: 5929336 - DNA, 20 bp, Homo sapiens
gttattatatttacaaatgg

SEQ ID NO: 5929337 - DNA, 15 bp, Homo sapiens
gttattatatttgac

SEQ ID NO: 5929338 - DNA, 15 bp, Homo sapiens
gttattatgaaggaa

SEQ ID NO: 5929339 - DNA, 19 bp, Homo sapiens
gttattatgaaggaatttg

SEQ ID NO: 5929340 - DNA, 18 bp, Homo sapiens
gttattatgattagcttt

SEQ ID NO: 5929341 - DNA, 20 bp, Homo sapiens
gttattatgtagctgaaaca

SEQ ID NO: 5929342 - DNA, 14 bp, Homo sapiens
gttattattcttga

SEQ ID NO: 5929343 - DNA, 16 bp, Homo sapiens
gttattattgctgttt

SEQ ID NO: 5929344 - DNA, 23 bp, Homo sapiens
gttattattggcttgcactttgt

SEQ ID NO: 5929345 - DNA, 15 bp, Homo sapiens
gttattcaaatttga

SEQ ID NO: 5929346 - DNA, 18 bp, Homo sapiens
gttattcacaacctcacc

SEQ ID NO: 5929347 - DNA, 22 bp, Homo sapiens
gttattcactctcccagaggct

SEQ ID NO: 5929348 - DNA, 15 bp, Homo sapiens
gttattcagaaatat

SEQ ID NO: 5929349 - DNA, 14 bp, Homo sapiens
gttattcataaaga

SEQ ID NO: 5929350 - DNA, 23 bp, Homo sapiens
gttattcataaagagaaaatgat

SEQ ID NO: 5929351 - DNA, 23 bp, Homo sapiens
gttattcattctgtgatcattta

SEQ ID NO: 5929352 - DNA, 17 bp, Homo sapiens
gttattccatcaataaa

SEQ ID NO: 5929353 - DNA, 18 bp, Homo sapiens
gttattccttgatcattt

SEQ ID NO: 5929354 - DNA, 13 bp, Homo sapiens
gttattctcttca

SEQ ID NO: 5929355 - DNA, 17 bp, Homo sapiens
gttattcttggtactgt

SEQ ID NO: 5929356 - DNA, 16 bp, Homo sapiens
gttattcttgttatac

SEQ ID NO: 5929357 - DNA, 14 bp, Homo sapiens
gttattgaagtgtt

SEQ ID NO: 5929358 - DNA, 21 bp, Homo sapiens
gttattgataagttcatacat

SEQ ID NO: 5929359 - DNA, 16 bp, Homo sapiens
gttattgatttttgta

SEQ ID NO: 5929360 - DNA, 17 bp, Homo sapiens
gttattgcaataaagta

SEQ ID NO: 5929361 - DNA, 21 bp, Homo sapiens
gttattgctgcataaatttgt

SEQ ID NO: 5929362 - DNA, 19 bp, Homo sapiens
gttattggactccaggcct

SEQ ID NO: 5929363 - DNA, 14 bp, Homo sapiens
gttattgtgaatga

SEQ ID NO: 5929364 - DNA, 16 bp, Homo sapiens
gttattgtgttaaaac

SEQ ID NO: 5929365 - DNA, 12 bp, Homo sapiens
gttattgttgaa

SEQ ID NO: 5929366 - DNA, 16 bp, Homo sapiens
gttattgttttgttaa

SEQ ID NO: 5929367 - DNA, 15 bp, Homo sapiens
gttatttaaagaaga

SEQ ID NO: 5929368 - DNA, 15 bp, Homo sapiens
gttatttaaatgagt

SEQ ID NO: 5929369 - DNA, 23 bp, Homo sapiens
gttatttaacagctgaattatct

SEQ ID NO: 5929370 - DNA, 13 bp, Homo sapiens
gttatttaagcat

SEQ ID NO: 5929371 - DNA, 21 bp, Homo sapiens
gttatttaatagctgtgatca

SEQ ID NO: 5929372 - DNA, 15 bp, Homo sapiens
gttatttaattgaaa

SEQ ID NO: 5929373 - DNA, 18 bp, Homo sapiens
gttatttacactggtcta

SEQ ID NO: 5929374 - DNA, 14 bp, Homo sapiens
gttatttactttta

SEQ ID NO: 5929375 - DNA, 14 bp, Homo sapiens
gttatttataatca

SEQ ID NO: 5929376 - DNA, 20 bp, Homo sapiens
gttatttataatcacttttt

SEQ ID NO: 5929377 - DNA, 20 bp, Homo sapiens
gttatttatacaagattgaa

SEQ ID NO: 5929378 - DNA, 15 bp, Homo sapiens
gttatttattcttta

SEQ ID NO: 5929379 - DNA, 15 bp, Homo sapiens
gttatttatttccaa

SEQ ID NO: 5929380 - DNA, 16 bp, Homo sapiens
gttatttatttccaaa

SEQ ID NO: 5929381 - DNA, 18 bp, Homo sapiens
gttatttccccagccaca

SEQ ID NO: 5929382 - DNA, 14 bp, Homo sapiens
gttatttctaaacc

SEQ ID NO: 5929383 - DNA, 15 bp, Homo sapiens
gttatttctgcaaac

SEQ ID NO: 5929384 - DNA, 13 bp, Homo sapiens
gttatttctgtag

SEQ ID NO: 5929385 - DNA, 14 bp, Homo sapiens
gttatttcttacag

SEQ ID NO: 5929386 - DNA, 16 bp, Homo sapiens
gttatttgcacactgc

SEQ ID NO: 5929387 - DNA, 22 bp, Homo sapiens
gttatttggaccactccaggct

SEQ ID NO: 5929388 - DNA, 18 bp, Homo sapiens
gttatttggtattaaact

SEQ ID NO: 5929389 - DNA, 14 bp, Homo sapiens
gttatttgtacagt

SEQ ID NO: 5929390 - DNA, 16 bp, Homo sapiens
gttatttgttcattat

SEQ ID NO: 5929391 - DNA, 18 bp, Homo sapiens
gttattttaataccttta

SEQ ID NO: 5929392 - DNA, 15 bp, Homo sapiens
gttattttacttttt

SEQ ID NO: 5929393 - DNA, 16 bp, Homo sapiens
gttattttactttttg

SEQ ID NO: 5929394 - DNA, 18 bp, Homo sapiens
gttattttaggagacagt

SEQ ID NO: 5929395 - DNA, 13 bp, Homo sapiens
gttattttagttt

SEQ ID NO: 5929396 - DNA, 19 bp, Homo sapiens
gttattttagtttctgttc

SEQ ID NO: 5929397 - DNA, 15 bp, Homo sapiens
gttattttataatca

SEQ ID NO: 5929398 - DNA, 13 bp, Homo sapiens
gttattttatagg

SEQ ID NO: 5929399 - DNA, 16 bp, Homo sapiens
gttattttatatttga

SEQ ID NO: 5929400 - DNA, 17 bp, Homo sapiens
gttattttatatttgag

SEQ ID NO: 5929401 - DNA, 13 bp, Homo sapiens
gttattttccagg

SEQ ID NO: 5929402 - DNA, 12 bp, Homo sapiens
gttattttctac

SEQ ID NO: 5929403 - DNA, 14 bp, Homo sapiens
gttattttcttgtt

SEQ ID NO: 5929404 - DNA, 17 bp, Homo sapiens
gttattttcttgtttaa

SEQ ID NO: 5929405 - DNA, 16 bp, Homo sapiens
gttattttgctttggt

SEQ ID NO: 5929406 - DNA, 17 bp, Homo sapiens
gttattttggatatatt

SEQ ID NO: 5929407 - DNA, 19 bp, Homo sapiens
gttattttggatatattat

SEQ ID NO: 5929408 - DNA, 16 bp, Homo sapiens
gttattttgtacattt

SEQ ID NO: 5929409 - DNA, 17 bp, Homo sapiens
gttattttgtttttcct

SEQ ID NO: 5929410 - DNA, 13 bp, Homo sapiens
gttatttttacag

SEQ ID NO: 5929411 - DNA, 19 bp, Homo sapiens
gttatttttataagaaaac

SEQ ID NO: 5929412 - DNA, 17 bp, Homo sapiens
gttatttttatacagta

SEQ ID NO: 5929413 - DNA, 17 bp, Homo sapiens
gttatttttattaaatg

SEQ ID NO: 5929414 - DNA, 18 bp, Homo sapiens
gttatttttcaaggaagg

SEQ ID NO: 5929415 - DNA, 14 bp, Homo sapiens
gttatttttctctt

SEQ ID NO: 5929416 - DNA, 21 bp, Homo sapiens
gttatttttctcttgtaccat

SEQ ID NO: 5929417 - DNA, 17 bp, Homo sapiens
gttatttttgtccctgc

SEQ ID NO: 5929418 - DNA, 21 bp, Homo sapiens
gttatttttgtccctgctcct

SEQ ID NO: 5929419 - DNA, 15 bp, Homo sapiens
gttatttttttctaa

SEQ ID NO: 5929420 - DNA, 13 bp, Homo sapiens
gttcaaaacattc

SEQ ID NO: 5929421 - DNA, 17 bp, Homo sapiens
gttcaaaacattccaag

SEQ ID NO: 5929422 - DNA, 14 bp, Homo sapiens
gttcaaaatgtctg

SEQ ID NO: 5929423 - DNA, 19 bp, Homo sapiens
gttcaaaatgttaataaag

SEQ ID NO: 5929424 - DNA, 14 bp, Homo sapiens
gttcaaaattctaa

SEQ ID NO: 5929425 - DNA, 15 bp, Homo sapiens
gttcaaacatttacc

SEQ ID NO: 5929426 - DNA, 18 bp, Homo sapiens
gttcaaagaacccccctc

SEQ ID NO: 5929427 - DNA, 23 bp, Homo sapiens
gttcaaagatacaagaaaaagta

SEQ ID NO: 5929428 - DNA, 21 bp, Homo sapiens
gttcaaagatattttgctttg

SEQ ID NO: 5929429 - DNA, 22 bp, Homo sapiens
gttcaaagatattttgctttgt

SEQ ID NO: 5929430 - DNA, 14 bp, Homo sapiens
gttcaaagctgcct

SEQ ID NO: 5929431 - DNA, 11 bp, Homo sapiens
gttcaaagtac

SEQ ID NO: 5929432 - DNA, 15 bp, Homo sapiens
gttcaaagtgtatat

SEQ ID NO: 5929433 - DNA, 18 bp, Homo sapiens
gttcaaagtgtatattta

SEQ ID NO: 5929434 - DNA, 23 bp, Homo sapiens
gttcaaagtgtatatttattcat

SEQ ID NO: 5929435 - DNA, 20 bp, Homo sapiens
gttcaaattctcttcttttt

SEQ ID NO: 5929436 - DNA, 22 bp, Homo sapiens
gttcaacaaagaaacaaagatg

SEQ ID NO: 5929437 - DNA, 21 bp, Homo sapiens
gttcaacaagagtaaatattg

SEQ ID NO: 5929438 - DNA, 16 bp, Homo sapiens
gttcaactttcagaag

SEQ ID NO: 5929439 - DNA, 21 bp, Homo sapiens
gttcaagcaatcctcctgcct

SEQ ID NO: 5929440 - DNA, 17 bp, Homo sapiens
gttcaagccattctgcc

SEQ ID NO: 5929441 - DNA, 19 bp, Homo sapiens
gttcaagccattctgcctc

SEQ ID NO: 5929442 - DNA, 14 bp, Homo sapiens
gttcaagccttcca

SEQ ID NO: 5929443 - DNA, 20 bp, Homo sapiens
gttcaagcgattctcctgcc

SEQ ID NO: 5929444 - DNA, 21 bp, Homo sapiens
gttcaagcgattctcctgcct

SEQ ID NO: 5929445 - DNA, 22 bp, Homo sapiens
gttcaagcgattctcctgcctc

SEQ ID NO: 5929446 - DNA, 18 bp, Homo sapiens
gttcaagcgattctcttg

SEQ ID NO: 5929447 - DNA, 18 bp, Homo sapiens
gttcaaggaatcattgtt

SEQ ID NO: 5929448 - DNA, 21 bp, Homo sapiens
gttcaaggtcactgtttcctg

SEQ ID NO: 5929449 - DNA, 17 bp, Homo sapiens
gttcaagtatctaactc

SEQ ID NO: 5929450 - DNA, 18 bp, Homo sapiens
gttcaataataaatattt

SEQ ID NO: 5929451 - DNA, 21 bp, Homo sapiens
gttcaatataagcttttcttt

SEQ ID NO: 5929452 - DNA, 21 bp, Homo sapiens
gttcaatatcagctttgataa

SEQ ID NO: 5929453 - DNA, 19 bp, Homo sapiens
gttcaatatgagtctcaat

SEQ ID NO: 5929454 - DNA, 12 bp, Homo sapiens
gttcaatatttt

SEQ ID NO: 5929455 - DNA, 18 bp, Homo sapiens
gttcaatctcccgctgct

SEQ ID NO: 5929456 - DNA, 10 bp, Homo sapiens
gttcaatgat

SEQ ID NO: 5929457 - DNA, 19 bp, Homo sapiens
gttcaatgatctaggttta

SEQ ID NO: 5929458 - DNA, 22 bp, Homo sapiens
gttcaatgcctcacgagatttg

SEQ ID NO: 5929459 - DNA, 21 bp, Homo sapiens
gttcaatgctacaaaatgtgt

SEQ ID NO: 5929460 - DNA, 17 bp, Homo sapiens
gttcaatggctgctgaa

SEQ ID NO: 5929461 - DNA, 17 bp, Homo sapiens
gttcaatggttctgaaa

SEQ ID NO: 5929462 - DNA, 20 bp, Homo sapiens
gttcaattatctttatcata

SEQ ID NO: 5929463 - DNA, 17 bp, Homo sapiens
gttcaattatttccccc

SEQ ID NO: 5929464 - DNA, 18 bp, Homo sapiens
gttcaattggacaattat

SEQ ID NO: 5929465 - DNA, 16 bp, Homo sapiens
gttcaatttcagaaac

SEQ ID NO: 5929466 - DNA, 22 bp, Homo sapiens
gttcaatttgttagttcctgta

SEQ ID NO: 5929467 - DNA, 20 bp, Homo sapiens
gttcaattttttttaatcta

SEQ ID NO: 5929468 - DNA, 20 bp, Homo sapiens
gttcacaaactacctctgga

SEQ ID NO: 5929469 - DNA, 20 bp, Homo sapiens
gttcacaaactgtgaaaata

SEQ ID NO: 5929470 - DNA, 14 bp, Homo sapiens
gttcacaacctagg

SEQ ID NO: 5929471 - DNA, 17 bp, Homo sapiens
gttcacaaggtacccca

SEQ ID NO: 5929472 - DNA, 15 bp, Homo sapiens
gttcacacagcccag

SEQ ID NO: 5929473 - DNA, 20 bp, Homo sapiens
gttcacaccattctcctgcc

SEQ ID NO: 5929474 - DNA, 17 bp, Homo sapiens
gttcacaccctgcaagg

SEQ ID NO: 5929475 - DNA, 14 bp, Homo sapiens
gttcacagaaaaag

SEQ ID NO: 5929476 - DNA, 13 bp, Homo sapiens
gttcacagacata

SEQ ID NO: 5929477 - DNA, 17 bp, Homo sapiens
gttcacagcttttcttg

SEQ ID NO: 5929478 - DNA, 21 bp, Homo sapiens
gttcatgcagacaaagccctg

SEQ ID NO: 5929479 - DNA, 18 bp, Homo sapiens
gttcatgccattctgcct

SEQ ID NO: 5929480 - DNA, 22 bp, Homo sapiens
gttcatggaacgcgttgaaatt

SEQ ID NO: 5929481 - DNA, 18 bp, Homo sapiens
gttcatggattacttctc

SEQ ID NO: 5929482 - DNA, 21 bp, Homo sapiens
gttcatggtgaaggtttttgt

SEQ ID NO: 5929483 - DNA, 16 bp, Homo sapiens
gttcatggtgatcagt

SEQ ID NO: 5929484 - DNA, 12 bp, Homo sapiens
gttcatgtagag

SEQ ID NO: 5929485 - DNA, 19 bp, Homo sapiens
gttcatgtagagaaaagca

SEQ ID NO: 5929486 - DNA, 19 bp, Homo sapiens
gttcatgtctaagaactct

SEQ ID NO: 5929487 - DNA, 15 bp, Homo sapiens
gttcatgtctctgat

SEQ ID NO: 5929488 - DNA, 22 bp, Homo sapiens
gttcatgtctgaaacagagaac

SEQ ID NO: 5929489 - DNA, 10 bp, Homo sapiens
gttcatgttt

SEQ ID NO: 5929490 - DNA, 24 bp, Homo sapiens
gttcatgtttgcttcataaatgaa

SEQ ID NO: 5929491 - DNA, 20 bp, Homo sapiens
gttcatgtttggtgcataga

SEQ ID NO: 5929492 - DNA, 17 bp, Homo sapiens
gttcatgttttgctaat

SEQ ID NO: 5929493 - DNA, 18 bp, Homo sapiens
gttcatgtttttgtttta

SEQ ID NO: 5929494 - DNA, 10 bp, Homo sapiens
gttcattaaa

SEQ ID NO: 5929495 - DNA, 18 bp, Homo sapiens
gttcattaaacgtcattc

SEQ ID NO: 5929496 - DNA, 19 bp, Homo sapiens
gttcattagaaatatttta

SEQ ID NO: 5929497 - DNA, 19 bp, Homo sapiens
gttcattcaaaatgtccag

SEQ ID NO: 5929498 - DNA, 17 bp, Homo sapiens
gttcattcatactcaaa

SEQ ID NO: 5929499 - DNA, 18 bp, Homo sapiens
gttcattcatactcaaag

SEQ ID NO: 5929500 - DNA, 22 bp, Homo sapiens
gttcattcatactcaaagaggc

SEQ ID NO: 5929501 - DNA, 17 bp, Homo sapiens
gttcattcatattacaa

SEQ ID NO: 5929502 - DNA, 14 bp, Homo sapiens
gttcattccacagg

SEQ ID NO: 5929503 - DNA, 16 bp, Homo sapiens
gttcattccacaggac

SEQ ID NO: 5929504 - DNA, 23 bp, Homo sapiens
gttcattctcccgcttcctggcc

SEQ ID NO: 5929505 - DNA, 18 bp, Homo sapiens
gttcattctgcattgaga

SEQ ID NO: 5929506 - DNA, 15 bp, Homo sapiens
gttcattctgtgacc

SEQ ID NO: 5929507 - DNA, 15 bp, Homo sapiens
gttcattcttcagat

SEQ ID NO: 5929508 - DNA, 21 bp, Homo sapiens
gttcattgatgggatttttgt

SEQ ID NO: 5929509 - DNA, 18 bp, Homo sapiens
gttcattgcaattaaact

SEQ ID NO: 5929510 - DNA, 16 bp, Homo sapiens
gttcattgcctttcca

SEQ ID NO: 5929511 - DNA, 13 bp, Homo sapiens
gttcattgtaaat

SEQ ID NO: 5929512 - DNA, 14 bp, Homo sapiens
gttcattgtaatgt

SEQ ID NO: 5929513 - DNA, 20 bp, Homo sapiens
gttcattgtaatgttactga

SEQ ID NO: 5929514 - DNA, 21 bp, Homo sapiens
gttcattgtaatgttactgat

SEQ ID NO: 5929515 - DNA, 23 bp, Homo sapiens
gttcattgtaatgttactgatca

SEQ ID NO: 5929516 - DNA, 12 bp, Homo sapiens
gttcatttcatt

SEQ ID NO: 5929517 - DNA, 12 bp, Homo sapiens
gttcatttccta

SEQ ID NO: 5929518 - DNA, 13 bp, Homo sapiens
gttcatttcctca

SEQ ID NO: 5929519 - DNA, 18 bp, Homo sapiens
gttcatttctaaatttat

SEQ ID NO: 5929520 - DNA, 12 bp, Homo sapiens
gttcatttctgt

SEQ ID NO: 5929521 - DNA, 16 bp, Homo sapiens
gttcatttctgtctcc

SEQ ID NO: 5929522 - DNA, 12 bp, Homo sapiens
gttcatttgaaa

SEQ ID NO: 5929523 - DNA, 18 bp, Homo sapiens
gttcatttgtgtgctcat

SEQ ID NO: 5929524 - DNA, 15 bp, Homo sapiens
gttcatttgtttgtt

SEQ ID NO: 5929525 - DNA, 16 bp, Homo sapiens
gttcattttaaatgaa

SEQ ID NO: 5929526 - DNA, 12 bp, Homo sapiens
gttcattttaag

SEQ ID NO: 5929527 - DNA, 18 bp, Homo sapiens
gttcattttagtgactgt

SEQ ID NO: 5929528 - DNA, 13 bp, Homo sapiens
gttcattttgaaa

SEQ ID NO: 5929529 - DNA, 19 bp, Homo sapiens
gttcattttgaaaatatgt

SEQ ID NO: 5929530 - DNA, 13 bp, Homo sapiens
gttcattttgagt

SEQ ID NO: 5929531 - DNA, 13 bp, Homo sapiens
gttcattttgtca

SEQ ID NO: 5929532 - DNA, 22 bp, Homo sapiens
gttcatttttaaagcctggctt

SEQ ID NO: 5929533 - DNA, 19 bp, Homo sapiens
gttcatttttatcccttcc

SEQ ID NO: 5929534 - DNA, 13 bp, Homo sapiens
gttcatttttcaa

SEQ ID NO: 5929535 - DNA, 19 bp, Homo sapiens
gttccaaaagccaatggct

SEQ ID NO: 5929536 - DNA, 18 bp, Homo sapiens
gttccaaacagacaaaac

SEQ ID NO: 5929537 - DNA, 17 bp, Homo sapiens
gttccaaacatgaggtt

SEQ ID NO: 5929538 - DNA, 18 bp, Homo sapiens
gttccaaaccctcctggg

SEQ ID NO: 5929539 - DNA, 17 bp, Homo sapiens
gttccaaagtcacagga

SEQ ID NO: 5929540 - DNA, 19 bp, Homo sapiens
gttccaaatgaatgttgtc

SEQ ID NO: 5929541 - DNA, 23 bp, Homo sapiens
gttccaaatgtgtataattttaa

SEQ ID NO: 5929542 - DNA, 14 bp, Homo sapiens
gttccaaattcagt

SEQ ID NO: 5929543 - DNA, 17 bp, Homo sapiens
gttccaaatttgcttta

SEQ ID NO: 5929544 - DNA, 15 bp, Homo sapiens
gttccaacctcctgc

SEQ ID NO: 5929545 - DNA, 14 bp, Homo sapiens
gttccaagagtcta

SEQ ID NO: 5929546 - DNA, 18 bp, Homo sapiens
gttccaagagtctaaaga

SEQ ID NO: 5929547 - DNA, 18 bp, Homo sapiens
gttccaagtctttgctat

SEQ ID NO: 5929548 - DNA, 19 bp, Homo sapiens
gttccaagtgtgtgtgcaa

SEQ ID NO: 5929549 - DNA, 16 bp, Homo sapiens
gttccaatcctggctc

SEQ ID NO: 5929550 - DNA, 14 bp, Homo sapiens
gttccaatgaaata

SEQ ID NO: 5929551 - DNA, 21 bp, Homo sapiens
gttccacacccaatgctgctc

SEQ ID NO: 5929552 - DNA, 20 bp, Homo sapiens
gttccacagagtaagacatt

SEQ ID NO: 5929553 - DNA, 22 bp, Homo sapiens
gttccacagtgactgggccctg

SEQ ID NO: 5929554 - DNA, 14 bp, Homo sapiens
gttccacagttgcc

SEQ ID NO: 5929555 - DNA, 16 bp, Homo sapiens
gttccacagttgccac

SEQ ID NO: 5929556 - DNA, 15 bp, Homo sapiens
gttccaccccaagag

SEQ ID NO: 5929557 - DNA, 21 bp, Homo sapiens
gttccaccccaagagaactcg

SEQ ID NO: 5929558 - DNA, 15 bp, Homo sapiens
gttccacctgccaca

SEQ ID NO: 5929559 - DNA, 20 bp, Homo sapiens
gttccacctggggcttccct

SEQ ID NO: 5929560 - DNA, 16 bp, Homo sapiens
gttccacgtggggtgg

SEQ ID NO: 5929561 - DNA, 15 bp, Homo sapiens
gttccactcagcttg

SEQ ID NO: 5929562 - DNA, 13 bp, Homo sapiens
gttccactgagac

SEQ ID NO: 5929563 - DNA, 14 bp, Homo sapiens
gttccactggagaa

SEQ ID NO: 5929564 - DNA, 23 bp, Homo sapiens
gttccactggagaattgaaaagg

SEQ ID NO: 5929565 - DNA, 18 bp, Homo sapiens
gttccacttatagcctct

SEQ ID NO: 5929566 - DNA, 22 bp, Homo sapiens
gttccacttccaggtctgcctg

SEQ ID NO: 5929567 - DNA, 15 bp, Homo sapiens
gttccacttgtttgc

SEQ ID NO: 5929568 - DNA, 20 bp, Homo sapiens
gttccacttgtttgcactgt

SEQ ID NO: 5929569 - DNA, 22 bp, Homo sapiens
gttccacttgtttgcactgtgt

SEQ ID NO: 5929570 - DNA, 17 bp, Homo sapiens
gttccagaacagccctc

SEQ ID NO: 5929571 - DNA, 24 bp, Homo sapiens
gttccagaacagccctcggcctcc

SEQ ID NO: 5929572 - DNA, 18 bp, Homo sapiens
gttccagaacgtctctca

SEQ ID NO: 5929573 - DNA, 21 bp, Homo sapiens
gttccagaacgtctctcacct

SEQ ID NO: 5929574 - DNA, 17 bp, Homo sapiens
gttccagaagtgtgact

SEQ ID NO: 5929575 - DNA, 11 bp, Homo sapiens
gttccagacag

SEQ ID NO: 5929576 - DNA, 12 bp, Homo sapiens
gttccagacaga

SEQ ID NO: 5929577 - DNA, 22 bp, Homo sapiens
gttccagactcaggttccagaa

SEQ ID NO: 5929578 - DNA, 11 bp, Homo sapiens
gttccagaggc

SEQ ID NO: 5929579 - DNA, 19 bp, Homo sapiens
gttccagaggtattcctct

SEQ ID NO: 5929580 - DNA, 22 bp, Homo sapiens
gttccagattcctatgatggat

SEQ ID NO: 5929581 - DNA, 20 bp, Homo sapiens
gttccagcaattctcctgcc

SEQ ID NO: 5929582 - DNA, 21 bp, Homo sapiens
gttccagcagatgccacataa

SEQ ID NO: 5929583 - DNA, 20 bp, Homo sapiens
gttccagcagcagaatggaa

SEQ ID NO: 5929584 - DNA, 14 bp, Homo sapiens
gttccagcctgcca

SEQ ID NO: 5929585 - DNA, 18 bp, Homo sapiens
gttccagccttctctcaa

SEQ ID NO: 5929586 - DNA, 12 bp, Homo sapiens
gttccagctctt

SEQ ID NO: 5929587 - DNA, 16 bp, Homo sapiens
gttccagctctttgaa

SEQ ID NO: 5929588 - DNA, 16 bp, Homo sapiens
gttccagctgttgtga

SEQ ID NO: 5929589 - DNA, 18 bp, Homo sapiens
gttccaggccctccagtg

SEQ ID NO: 5929590 - DNA, 21 bp, Homo sapiens
gttccaggcctgatcttgcct

SEQ ID NO: 5929591 - DNA, 23 bp, Homo sapiens
gttccaggcctgatcttgcctgt

SEQ ID NO: 5929592 - DNA, 17 bp, Homo sapiens
gttccagggtccctctg

SEQ ID NO: 5929593 - DNA, 12 bp, Homo sapiens
gttccagtgctg

SEQ ID NO: 5929594 - DNA, 16 bp, Homo sapiens
gttccagtgtctgtct

SEQ ID NO: 5929595 - DNA, 15 bp, Homo sapiens
gttccagtttcagag

SEQ ID NO: 5929596 - DNA, 15 bp, Homo sapiens
gttccagtttctcct

SEQ ID NO: 5929597 - DNA, 18 bp, Homo sapiens
gttccagtttctccttga

SEQ ID NO: 5929598 - DNA, 13 bp, Homo sapiens
gttccatccacca

SEQ ID NO: 5929599 - DNA, 15 bp, Homo sapiens
gttccatccaccacc

SEQ ID NO: 5929600 - DNA, 19 bp, Homo sapiens
gttccatgcagccttgggg

SEQ ID NO: 5929601 - DNA, 17 bp, Homo sapiens
gttccatgcctgagggt

SEQ ID NO: 5929602 - DNA, 22 bp, Homo sapiens
gttccattatgaaaatcttatt

SEQ ID NO: 5929603 - DNA, 21 bp, Homo sapiens
gttccattgaagccgactctg

SEQ ID NO: 5929604 - DNA, 23 bp, Homo sapiens
gttccattgaagccgactctggc

SEQ ID NO: 5929605 - DNA, 18 bp, Homo sapiens
gttccatttcagttcagt

SEQ ID NO: 5929606 - DNA, 19 bp, Homo sapiens
gttcccaaaacaatggtgt

SEQ ID NO: 5929607 - DNA, 22 bp, Homo sapiens
gttcccaagaaaggaaaccttt

SEQ ID NO: 5929608 - DNA, 21 bp, Homo sapiens
gttcccaagagcatcatgcct

SEQ ID NO: 5929609 - DNA, 14 bp, Homo sapiens
gttcccaagcaaag

SEQ ID NO: 5929610 - DNA, 19 bp, Homo sapiens
gttcccaagctcagaggcg

SEQ ID NO: 5929611 - DNA, 12 bp, Homo sapiens
gttcccaaggac

SEQ ID NO: 5929612 - DNA, 23 bp, Homo sapiens
gttcccaaggacatgagtctgta

SEQ ID NO: 5929613 - DNA, 18 bp, Homo sapiens
gttcccaatatcatgtga

SEQ ID NO: 5929614 - DNA, 17 bp, Homo sapiens
gttcccacaagcctgcc

SEQ ID NO: 5929615 - DNA, 19 bp, Homo sapiens
gttcccacaagcctgcctc

SEQ ID NO: 5929616 - DNA, 16 bp, Homo sapiens
gttcccactcccggcc

SEQ ID NO: 5929617 - DNA, 11 bp, Homo sapiens
gttcccagccc

SEQ ID NO: 5929618 - DNA, 13 bp, Homo sapiens
gttcccagcccct

SEQ ID NO: 5929619 - DNA, 18 bp, Homo sapiens
gttcccagcccctcctcc

SEQ ID NO: 5929620 - DNA, 22 bp, Homo sapiens
gttcccagcccctcctccctca

SEQ ID NO: 5929621 - DNA, 23 bp, Homo sapiens
gttcccaggctgcccccaacact

SEQ ID NO: 5929622 - DNA, 15 bp, Homo sapiens
gttcccagtagttat

SEQ ID NO: 5929623 - DNA, 19 bp, Homo sapiens
gttcccatggtgtatgtgg

SEQ ID NO: 5929624 - DNA, 17 bp, Homo sapiens
gttcccatgtagccccc

SEQ ID NO: 5929625 - DNA, 22 bp, Homo sapiens
gttcccattattatttctgttc

SEQ ID NO: 5929626 - DNA, 15 bp, Homo sapiens
gttccccaagacatt

SEQ ID NO: 5929627 - DNA, 20 bp, Homo sapiens
gttccccacacagggcactg

SEQ ID NO: 5929628 - DNA, 22 bp, Homo sapiens
gttccccacacagggcactgac

SEQ ID NO: 5929629 - DNA, 13 bp, Homo sapiens
gttccccacaggt

SEQ ID NO: 5929630 - DNA, 14 bp, Homo sapiens
gttccccacaggtc

SEQ ID NO: 5929631 - DNA, 23 bp, Homo sapiens
gttccccaccgctgagaggctgc

SEQ ID NO: 5929632 - DNA, 13 bp, Homo sapiens
gttccccactgga

SEQ ID NO: 5929633 - DNA, 21 bp, Homo sapiens
gttccccagagagcaggcagg

SEQ ID NO: 5929634 - DNA, 12 bp, Homo sapiens
gttccccaggag

SEQ ID NO: 5929635 - DNA, 14 bp, Homo sapiens
gttccccagttcag

SEQ ID NO: 5929636 - DNA, 22 bp, Homo sapiens
gttccccatccctgtcattttt

SEQ ID NO: 5929637 - DNA, 19 bp, Homo sapiens
gttccccatctgggtcctt

SEQ ID NO: 5929638 - DNA, 14 bp, Homo sapiens
gttccccatgcaga

SEQ ID NO: 5929639 - DNA, 22 bp, Homo sapiens
gttcccccaaccatcttcactg

SEQ ID NO: 5929640 - DNA, 14 bp, Homo sapiens
gttcccccagacag

SEQ ID NO: 5929641 - DNA, 14 bp, Homo sapiens
gttcccccagccct

SEQ ID NO: 5929642 - DNA, 19 bp, Homo sapiens
gttcccccaggaccctgag

SEQ ID NO: 5929643 - DNA, 23 bp, Homo sapiens
gttcccccaggggtgagccccgc

SEQ ID NO: 5929644 - DNA, 16 bp, Homo sapiens
gttccccgctgaccct

SEQ ID NO: 5929645 - DNA, 20 bp, Homo sapiens
gttccccgctttttcactcc

SEQ ID NO: 5929646 - DNA, 20 bp, Homo sapiens
gttcccctagtaagtgcctt

SEQ ID NO: 5929647 - DNA, 17 bp, Homo sapiens
gttcccctcacccaaaa

SEQ ID NO: 5929648 - DNA, 13 bp, Homo sapiens
gttcccctcactg

SEQ ID NO: 5929649 - DNA, 13 bp, Homo sapiens
gttcccctccccc

SEQ ID NO: 5929650 - DNA, 16 bp, Homo sapiens
gttcccctctcccttc

SEQ ID NO: 5929651 - DNA, 18 bp, Homo sapiens
gttcccctcttgtctccc

SEQ ID NO: 5929652 - DNA, 24 bp, Homo sapiens
gttcccctggaagcagtgcccagg

SEQ ID NO: 5929653 - DNA, 23 bp, Homo sapiens
gttcccctgtcctgtgaatggaa

SEQ ID NO: 5929654 - DNA, 17 bp, Homo sapiens
gttcccctgttcactct

SEQ ID NO: 5929655 - DNA, 18 bp, Homo sapiens
gttcccctgttcactcta

SEQ ID NO: 5929656 - DNA, 21 bp, Homo sapiens
gttcggctctagggcctcagt

SEQ ID NO: 5929657 - DNA, 17 bp, Homo sapiens
gttcgggggagcagaga

SEQ ID NO: 5929658 - DNA, 21 bp, Homo sapiens
gttcgggggagcagagagagc

SEQ ID NO: 5929659 - DNA, 13 bp, Homo sapiens
gttcgttctgttt

SEQ ID NO: 5929660 - DNA, 17 bp, Homo sapiens
gttcgttggggacatga

SEQ ID NO: 5929661 - DNA, 22 bp, Homo sapiens
gttcgtttccatcatgtctgta

SEQ ID NO: 5929662 - DNA, 15 bp, Homo sapiens
gttctaaaaagatgt

SEQ ID NO: 5929663 - DNA, 14 bp, Homo sapiens
gttctaaagatgga

SEQ ID NO: 5929664 - DNA, 23 bp, Homo sapiens
gttctaaagatggaaaaaccacc

SEQ ID NO: 5929665 - DNA, 15 bp, Homo sapiens
gttctaaagttctaa

SEQ ID NO: 5929666 - DNA, 16 bp, Homo sapiens
gttctaaagttctaag

SEQ ID NO: 5929667 - DNA, 15 bp, Homo sapiens
gttctaaatattgct

SEQ ID NO: 5929668 - DNA, 16 bp, Homo sapiens
gttctaaatattgctt

SEQ ID NO: 5929669 - DNA, 19 bp, Homo sapiens
gttctaaatattgcttcaa

SEQ ID NO: 5929670 - DNA, 22 bp, Homo sapiens
gttctaaatattgcttcaattt

SEQ ID NO: 5929671 - DNA, 15 bp, Homo sapiens
gttctaacacatttc

SEQ ID NO: 5929672 - DNA, 20 bp, Homo sapiens
gttctaacagatcagaacat

SEQ ID NO: 5929673 - DNA, 15 bp, Homo sapiens
gttctaacagcatct

SEQ ID NO: 5929674 - DNA, 22 bp, Homo sapiens
gttctaacagtgaagttttact

SEQ ID NO: 5929675 - DNA, 13 bp, Homo sapiens
gttctaacttatt

SEQ ID NO: 5929676 - DNA, 12 bp, Homo sapiens
gttctaacttct

SEQ ID NO: 5929677 - DNA, 17 bp, Homo sapiens
gttctaagactcaaatg

SEQ ID NO: 5929678 - DNA, 14 bp, Homo sapiens
gttctaagattctg

SEQ ID NO: 5929679 - DNA, 20 bp, Homo sapiens
gttctaaggcctaggattct

SEQ ID NO: 5929680 - DNA, 23 bp, Homo sapiens
gttctaaggcctaggattctaaa

SEQ ID NO: 5929681 - DNA, 11 bp, Homo sapiens
gttctaaggct

SEQ ID NO: 5929682 - DNA, 12 bp, Homo sapiens
gttctaaggctc

SEQ ID NO: 5929683 - DNA, 13 bp, Homo sapiens
gttctaaggctca

SEQ ID NO: 5929684 - DNA, 14 bp, Homo sapiens
gttctaaggctctg

SEQ ID NO: 5929685 - DNA, 16 bp, Homo sapiens
gttctaagtttctaag

SEQ ID NO: 5929686 - DNA, 17 bp, Homo sapiens
gttctaagtttctaaga

SEQ ID NO: 5929687 - DNA, 21 bp, Homo sapiens
gttctaagtttctaagattct

SEQ ID NO: 5929688 - DNA, 17 bp, Homo sapiens
gttctaataatttctaa

SEQ ID NO: 5929689 - DNA, 18 bp, Homo sapiens
gttctaatatttttagct

SEQ ID NO: 5929690 - DNA, 21 bp, Homo sapiens
gttctacaggaaatacagaga

SEQ ID NO: 5929691 - DNA, 20 bp, Homo sapiens
gttctacagtcgtaaaagag

SEQ ID NO: 5929692 - DNA, 22 bp, Homo sapiens
gttctaccaattatagatcaaa

SEQ ID NO: 5929693 - DNA, 17 bp, Homo sapiens
gttctaccaggcaaatt

SEQ ID NO: 5929694 - DNA, 21 bp, Homo sapiens
gttctacctcaggcagctcaa

SEQ ID NO: 5929695 - DNA, 14 bp, Homo sapiens
gttctagaaaaaca

SEQ ID NO: 5929696 - DNA, 18 bp, Homo sapiens
gttctagaaaaacaggca

SEQ ID NO: 5929697 - DNA, 21 bp, Homo sapiens
gttctagaaccacttcctgct

SEQ ID NO: 5929698 - DNA, 12 bp, Homo sapiens
gttctagaagga

SEQ ID NO: 5929699 - DNA, 21 bp, Homo sapiens
gttctagacatggaggttcta

SEQ ID NO: 5929700 - DNA, 18 bp, Homo sapiens
gttctagacctctggtta

SEQ ID NO: 5929701 - DNA, 17 bp, Homo sapiens
gttctagacgcccctcc

SEQ ID NO: 5929702 - DNA, 19 bp, Homo sapiens
gttctagacgcccctccca

SEQ ID NO: 5929703 - DNA, 15 bp, Homo sapiens
gttctagacttcccc

SEQ ID NO: 5929704 - DNA, 16 bp, Homo sapiens
gttctagacttcccca

SEQ ID NO: 5929705 - DNA, 23 bp, Homo sapiens
gttctagagaagaggctggtgct

SEQ ID NO: 5929706 - DNA, 12 bp, Homo sapiens
gttctaggaaaa

SEQ ID NO: 5929707 - DNA, 13 bp, Homo sapiens
gttctaggaaaat

SEQ ID NO: 5929708 - DNA, 22 bp, Homo sapiens
gttctaggcactgtagttctaa

SEQ ID NO: 5929709 - DNA, 21 bp, Homo sapiens
gttctaggcatacttttcaaa

SEQ ID NO: 5929710 - DNA, 20 bp, Homo sapiens
gttctaggcctttcctctgc

SEQ ID NO: 5929711 - DNA, 19 bp, Homo sapiens
gttctaggtcctggcttct

SEQ ID NO: 5929712 - DNA, 16 bp, Homo sapiens
gttctaggtttcaaag

SEQ ID NO: 5929713 - DNA, 22 bp, Homo sapiens
gttctaggtttcaaagatgctg

SEQ ID NO: 5929714 - DNA, 14 bp, Homo sapiens
gttctagtctcctt

SEQ ID NO: 5929715 - DNA, 21 bp, Homo sapiens
gttctagtctcctttgcactg

SEQ ID NO: 5929716 - DNA, 15 bp, Homo sapiens
gttctagtgaaactg

SEQ ID NO: 5929717 - DNA, 17 bp, Homo sapiens
gttctagtgttttcaat

SEQ ID NO: 5929718 - DNA, 15 bp, Homo sapiens
gttctagtttgcatt

SEQ ID NO: 5929719 - DNA, 15 bp, Homo sapiens
gttctagttttcagt

SEQ ID NO: 5929720 - DNA, 19 bp, Homo sapiens
gttctataaacaggcttgg

SEQ ID NO: 5929721 - DNA, 16 bp, Homo sapiens
gttctataaatgaatg

SEQ ID NO: 5929722 - DNA, 21 bp, Homo sapiens
gttctataagaataaggcttt

SEQ ID NO: 5929723 - DNA, 18 bp, Homo sapiens
gttctataagtgaggaag

SEQ ID NO: 5929724 - DNA, 18 bp, Homo sapiens
gttctataataagttttg

SEQ ID NO: 5929725 - DNA, 16 bp, Homo sapiens
gttctatagagcctgg

SEQ ID NO: 5929726 - DNA, 19 bp, Homo sapiens
gttctatataaggaggaaa

SEQ ID NO: 5929727 - DNA, 21 bp, Homo sapiens
gttctatataaggaggaaaac

SEQ ID NO: 5929728 - DNA, 17 bp, Homo sapiens
gttctatataatttttc

SEQ ID NO: 5929729 - DNA, 20 bp, Homo sapiens
gttctatatgaatgctattt

SEQ ID NO: 5929730 - DNA, 15 bp, Homo sapiens
gttctatatgcattt

SEQ ID NO: 5929731 - DNA, 16 bp, Homo sapiens
gttctatattgtgcca

SEQ ID NO: 5929732 - DNA, 16 bp, Homo sapiens
gttctatatttactgt

SEQ ID NO: 5929733 - DNA, 22 bp, Homo sapiens
gttctatcagtgacttctgaat

SEQ ID NO: 5929734 - DNA, 19 bp, Homo sapiens
gttctatcagttatccttt

SEQ ID NO: 5929735 - DNA, 22 bp, Homo sapiens
gttctatccaaacatgtattta

SEQ ID NO: 5929736 - DNA, 21 bp, Homo sapiens
gttctatcccacccaacagct

SEQ ID NO: 5929737 - DNA, 21 bp, Homo sapiens
gttctatccccaagctggcca

SEQ ID NO: 5929738 - DNA, 20 bp, Homo sapiens
gttctatccttttgcctgca

SEQ ID NO: 5929739 - DNA, 18 bp, Homo sapiens
gttctatgaagagtatta

SEQ ID NO: 5929740 - DNA, 23 bp, Homo sapiens
gttctatgaatatggaaaggcca

SEQ ID NO: 5929741 - DNA, 23 bp, Homo sapiens
gttctatgctaaactgtgaaaaa

SEQ ID NO: 5929742 - DNA, 13 bp, Homo sapiens
gttctatgcttcc

SEQ ID NO: 5929743 - DNA, 15 bp, Homo sapiens
gttctatgcttcctc

SEQ ID NO: 5929744 - DNA, 21 bp, Homo sapiens
gttctatgcttcctcgtgcca

SEQ ID NO: 5929745 - DNA, 22 bp, Homo sapiens
gttctatgcttcctcgtgccaa

SEQ ID NO: 5929746 - DNA, 21 bp, Homo sapiens
gttctatggagactttgctgt

SEQ ID NO: 5929747 - DNA, 17 bp, Homo sapiens
gttctatggttatgaaa

SEQ ID NO: 5929748 - DNA, 23 bp, Homo sapiens
gttctatttaagtgtactaatta

SEQ ID NO: 5929749 - DNA, 18 bp, Homo sapiens
gttctatttggaatttat

SEQ ID NO: 5929750 - DNA, 15 bp, Homo sapiens
gttctattttactgt

SEQ ID NO: 5929751 - DNA, 15 bp, Homo sapiens
gttctattttacttt

SEQ ID NO: 5929752 - DNA, 20 bp, Homo sapiens
gttctattttattaattttc

SEQ ID NO: 5929753 - DNA, 17 bp, Homo sapiens
gttctatttttcaatca

SEQ ID NO: 5929754 - DNA, 20 bp, Homo sapiens
gttctcaaaccctgtttacg

SEQ ID NO: 5929755 - DNA, 22 bp, Homo sapiens
gttctcaaacggtacacagact

SEQ ID NO: 5929756 - DNA, 14 bp, Homo sapiens
gttctcaaatgcta

SEQ ID NO: 5929757 - DNA, 16 bp, Homo sapiens
gttctcaacatactgt

SEQ ID NO: 5929758 - DNA, 21 bp, Homo sapiens
gttctcaacatactgtaatca

SEQ ID NO: 5929759 - DNA, 23 bp, Homo sapiens
gttctcaatgtgaaaaatgtgtc

SEQ ID NO: 5929760 - DNA, 15 bp, Homo sapiens
gttctcaatttcatt

SEQ ID NO: 5929761 - DNA, 16 bp, Homo sapiens
gttctcacacccaccg

SEQ ID NO: 5929762 - DNA, 15 bp, Homo sapiens
gttctcacagtgaca

SEQ ID NO: 5929763 - DNA, 20 bp, Homo sapiens
gttctcacagtgtggggcag

SEQ ID NO: 5929764 - DNA, 15 bp, Homo sapiens
gttctcagaaccatt

SEQ ID NO: 5929765 - DNA, 23 bp, Homo sapiens
gttctcagaactgttggctgctc

SEQ ID NO: 5929766 - DNA, 18 bp, Homo sapiens
gttctcagactctttctt

SEQ ID NO: 5929767 - DNA, 11 bp, Homo sapiens
gttctcagagc

SEQ ID NO: 5929768 - DNA, 16 bp, Homo sapiens
gttctcagagccaagt

SEQ ID NO: 5929769 - DNA, 20 bp, Homo sapiens
gttctcagagctccacagaa

SEQ ID NO: 5929770 - DNA, 17 bp, Homo sapiens
gttctcagcaagtgtac

SEQ ID NO: 5929771 - DNA, 13 bp, Homo sapiens
gttctcagctccc

SEQ ID NO: 5929772 - DNA, 15 bp, Homo sapiens
gttctcagctccccc

SEQ ID NO: 5929773 - DNA, 13 bp, Homo sapiens
gttctcagggctc

SEQ ID NO: 5929774 - DNA, 17 bp, Homo sapiens
gttctcaggtgttgcca

SEQ ID NO: 5929775 - DNA, 19 bp, Homo sapiens
gttctcaggttcactcatt

SEQ ID NO: 5929776 - DNA, 16 bp, Homo sapiens
gttctcatccacagag

SEQ ID NO: 5929777 - DNA, 21 bp, Homo sapiens
gttctcatccacagaggccag

SEQ ID NO: 5929778 - DNA, 24 bp, Homo sapiens
gttctcatcccagtctgatattca

SEQ ID NO: 5929779 - DNA, 14 bp, Homo sapiens
gttctcatgaagca

SEQ ID NO: 5929780 - DNA, 16 bp, Homo sapiens
gttctcatgaaggaga

SEQ ID NO: 5929781 - DNA, 14 bp, Homo sapiens
gttctcatgactcc

SEQ ID NO: 5929782 - DNA, 19 bp, Homo sapiens
gttctcatgggtggcactc

SEQ ID NO: 5929783 - DNA, 20 bp, Homo sapiens
gttctcatgtttgtgcatgt

SEQ ID NO: 5929784 - DNA, 19 bp, Homo sapiens
gttctcattcctgttcttt

SEQ ID NO: 5929785 - DNA, 21 bp, Homo sapiens
gttctcattcctgttctttct

SEQ ID NO: 5929786 - DNA, 12 bp, Homo sapiens
gttctcatttct

SEQ ID NO: 5929787 - DNA, 23 bp, Homo sapiens
gttctcatttggtctgccagaat

SEQ ID NO: 5929788 - DNA, 21 bp, Homo sapiens
gttctccaacatcacagccca

SEQ ID NO: 5929789 - DNA, 22 bp, Homo sapiens
gttctccaacatcacagcccag

SEQ ID NO: 5929790 - DNA, 19 bp, Homo sapiens
gttctccagaatgtaagaa

SEQ ID NO: 5929791 - DNA, 16 bp, Homo sapiens
gttctccagcccacac

SEQ ID NO: 5929792 - DNA, 20 bp, Homo sapiens
gttctccagcccacacccct

SEQ ID NO: 5929793 - DNA, 21 bp, Homo sapiens
gttctccagcccacacccctc

SEQ ID NO: 5929794 - DNA, 21 bp, Homo sapiens
gttctccaggcttcacagtct

SEQ ID NO: 5929795 - DNA, 18 bp, Homo sapiens
gttctccaggtgattctg

SEQ ID NO: 5929796 - DNA, 15 bp, Homo sapiens
gttctcccaaagatt

SEQ ID NO: 5929797 - DNA, 15 bp, Homo sapiens
gttctcccaccagcc

SEQ ID NO: 5929798 - DNA, 23 bp, Homo sapiens
gttctcccagcactgcctcctgt

SEQ ID NO: 5929799 - DNA, 15 bp, Homo sapiens
gttctcccagggagt

SEQ ID NO: 5929800 - DNA, 19 bp, Homo sapiens
gttctcccagggagtgagc

SEQ ID NO: 5929801 - DNA, 12 bp, Homo sapiens
gttctcccatga

SEQ ID NO: 5929802 - DNA, 16 bp, Homo sapiens
gttctccctgggaggc

SEQ ID NO: 5929803 - DNA, 16 bp, Homo sapiens
gttctccctttctctc

SEQ ID NO: 5929804 - DNA, 18 bp, Homo sapiens
gttctccctttctctctc

SEQ ID NO: 5929805 - DNA, 20 bp, Homo sapiens
gttctccctttctctctcct

SEQ ID NO: 5929806 - DNA, 21 bp, Homo sapiens
gttctccctttctctctcctc

SEQ ID NO: 5929807 - DNA, 19 bp, Homo sapiens
gttctccgggtgtggcctc

SEQ ID NO: 5929808 - DNA, 22 bp, Homo sapiens
gttctccgggtgtggcctcagc

SEQ ID NO: 5929809 - DNA, 18 bp, Homo sapiens
gttctccgttagctcctg

SEQ ID NO: 5929810 - DNA, 19 bp, Homo sapiens
gttctcctaatgctctgaa

SEQ ID NO: 5929811 - DNA, 17 bp, Homo sapiens
gttctcctctcccctct

SEQ ID NO: 5929812 - DNA, 20 bp, Homo sapiens
gttctcctgaatattttttg

SEQ ID NO: 5929813 - DNA, 13 bp, Homo sapiens
gttctccttttcc

SEQ ID NO: 5929814 - DNA, 18 bp, Homo sapiens
gttctccttttcctctct

SEQ ID NO: 5929815 - DNA, 22 bp, Homo sapiens
gttctccttttcctctctcccg

SEQ ID NO: 5929816 - DNA, 21 bp, Homo sapiens
gttctccttttgaacttgtca

SEQ ID NO: 5929817 - DNA, 16 bp, Homo sapiens
gttctcgaactcctga

SEQ ID NO: 5929818 - DNA, 21 bp, Homo sapiens
gttctcgaactcctgacctca

SEQ ID NO: 5929819 - DNA, 21 bp, Homo sapiens
gttctcgttgccctaattcat

SEQ ID NO: 5929820 - DNA, 22 bp, Homo sapiens
gttctctaagttccactgagct

SEQ ID NO: 5929821 - DNA, 20 bp, Homo sapiens
gttctctaatatgtaaaatt

SEQ ID NO: 5929822 - DNA, 22 bp, Homo sapiens
gttctctacctaatatgttctg

SEQ ID NO: 5929823 - DNA, 16 bp, Homo sapiens
gttctctagttttcca

SEQ ID NO: 5929824 - DNA, 20 bp, Homo sapiens
gttctctcatcggaggccca

SEQ ID NO: 5929825 - DNA, 16 bp, Homo sapiens
gttctctctgaatgct

SEQ ID NO: 5929826 - DNA, 18 bp, Homo sapiens
gttctctgatgcagaaat

SEQ ID NO: 5929827 - DNA, 18 bp, Homo sapiens
gttctctgccctccaaga

SEQ ID NO: 5929828 - DNA, 13 bp, Homo sapiens
gttctctgccttt

SEQ ID NO: 5929829 - DNA, 15 bp, Homo sapiens
gttctctgctgtcct

SEQ ID NO: 5929830 - DNA, 23 bp, Homo sapiens
gttctctgcttttccattctggg

SEQ ID NO: 5929831 - DNA, 23 bp, Homo sapiens
gttgaattttttttaacattcct

SEQ ID NO: 5929832 - DNA, 18 bp, Homo sapiens
gttgacaacctagaatgt

SEQ ID NO: 5929833 - DNA, 15 bp, Homo sapiens
gttgacaactgtgac

SEQ ID NO: 5929834 - DNA, 21 bp, Homo sapiens
gttgacaattctgcatgtact

SEQ ID NO: 5929835 - DNA, 19 bp, Homo sapiens
gttgacaggtacttggagg

SEQ ID NO: 5929836 - DNA, 15 bp, Homo sapiens
gttgacagtgaaaca

SEQ ID NO: 5929837 - DNA, 16 bp, Homo sapiens
gttgacagtgaaacaa

SEQ ID NO: 5929838 - DNA, 17 bp, Homo sapiens
gttgacagttctgaaga

SEQ ID NO: 5929839 - DNA, 22 bp, Homo sapiens
gttgacataccttttatttttt

SEQ ID NO: 5929840 - DNA, 17 bp, Homo sapiens
gttgacatagcctttgt

SEQ ID NO: 5929841 - DNA, 18 bp, Homo sapiens
gttgacatatttaatgtt

SEQ ID NO: 5929842 - DNA, 19 bp, Homo sapiens
gttgacatcactggcatgg

SEQ ID NO: 5929843 - DNA, 12 bp, Homo sapiens
gttgacatttgt

SEQ ID NO: 5929844 - DNA, 13 bp, Homo sapiens
gttgaccactcca

SEQ ID NO: 5929845 - DNA, 14 bp, Homo sapiens
gttgacccctttcc

SEQ ID NO: 5929846 - DNA, 17 bp, Homo sapiens
gttgacccctttccccc

SEQ ID NO: 5929847 - DNA, 20 bp, Homo sapiens
gttgaccctattttttgaca

SEQ ID NO: 5929848 - DNA, 17 bp, Homo sapiens
gttgacctaccctggac

SEQ ID NO: 5929849 - DNA, 22 bp, Homo sapiens
gttgacctttgaggtctaaaca

SEQ ID NO: 5929850 - DNA, 18 bp, Homo sapiens
gttgacgggctgtccgtg

SEQ ID NO: 5929851 - DNA, 13 bp, Homo sapiens
gttgacgtgacca

SEQ ID NO: 5929852 - DNA, 22 bp, Homo sapiens
gttgacgtgaccaattgccctg

SEQ ID NO: 5929853 - DNA, 16 bp, Homo sapiens
gttgactggcatccat

SEQ ID NO: 5929854 - DNA, 15 bp, Homo sapiens
gttgactttagggac

SEQ ID NO: 5929855 - DNA, 18 bp, Homo sapiens
gttgactttagggactca

SEQ ID NO: 5929856 - DNA, 13 bp, Homo sapiens
gttgactttctcc

SEQ ID NO: 5929857 - DNA, 12 bp, Homo sapiens
gttgagaaatga

SEQ ID NO: 5929858 - DNA, 16 bp, Homo sapiens
gttgagaagcgttttt

SEQ ID NO: 5929859 - DNA, 19 bp, Homo sapiens
gttgagaatcccaaatttg

SEQ ID NO: 5929860 - DNA, 13 bp, Homo sapiens
gttgagacgcctt

SEQ ID NO: 5929861 - DNA, 21 bp, Homo sapiens
gttgagagggggatgcccctg

SEQ ID NO: 5929862 - DNA, 17 bp, Homo sapiens
gttgagagtgtgaccaa

SEQ ID NO: 5929863 - DNA, 18 bp, Homo sapiens
gttgagatgtgctttgct

SEQ ID NO: 5929864 - DNA, 22 bp, Homo sapiens
gttgagatgttgtgtggcaatg

SEQ ID NO: 5929865 - DNA, 19 bp, Homo sapiens
gttgagattacgctgcctt

SEQ ID NO: 5929866 - DNA, 19 bp, Homo sapiens
gttgagatttttaagaact

SEQ ID NO: 5929867 - DNA, 19 bp, Homo sapiens
gttgagcagggatcctggt

SEQ ID NO: 5929868 - DNA, 16 bp, Homo sapiens
gttgagcatctgtccc

SEQ ID NO: 5929869 - DNA, 19 bp, Homo sapiens
gttgagcatgacagcctgc

SEQ ID NO: 5929870 - DNA, 16 bp, Homo sapiens
gttgagccagcagaca

SEQ ID NO: 5929871 - DNA, 10 bp, Homo sapiens
gttgagcccc

SEQ ID NO: 5929872 - DNA, 15 bp, Homo sapiens
gttgagccccaagtc

SEQ ID NO: 5929873 - DNA, 17 bp, Homo sapiens
gttgagccccagtcctg

SEQ ID NO: 5929874 - DNA, 15 bp, Homo sapiens
gttgagcccctggag

SEQ ID NO: 5929875 - DNA, 22 bp, Homo sapiens
gttgagccttcaggccagctgg

SEQ ID NO: 5929876 - DNA, 12 bp, Homo sapiens
gttgagctatga

SEQ ID NO: 5929877 - DNA, 16 bp, Homo sapiens
gttgagctatgatatg

SEQ ID NO: 5929878 - DNA, 13 bp, Homo sapiens
gttgagctcaggt

SEQ ID NO: 5929879 - DNA, 13 bp, Homo sapiens
gttgagctgtttt

SEQ ID NO: 5929880 - DNA, 21 bp, Homo sapiens
gttgaggaaaagactgtgggt

SEQ ID NO: 5929881 - DNA, 20 bp, Homo sapiens
gttgaggaaagcacagaggc

SEQ ID NO: 5929882 - DNA, 17 bp, Homo sapiens
gttgaggaactgtacag

SEQ ID NO: 5929883 - DNA, 16 bp, Homo sapiens
gttgaggaggggagca

SEQ ID NO: 5929884 - DNA, 16 bp, Homo sapiens
gttgaggatgcactgg

SEQ ID NO: 5929885 - DNA, 19 bp, Homo sapiens
gttgaggatgcactggcct

SEQ ID NO: 5929886 - DNA, 14 bp, Homo sapiens
gttgaggccactgt

SEQ ID NO: 5929887 - DNA, 21 bp, Homo sapiens
gttgaggccactgtgttcctt

SEQ ID NO: 5929888 - DNA, 20 bp, Homo sapiens
gttgaggccgaggataaaga

SEQ ID NO: 5929889 - DNA, 20 bp, Homo sapiens
gttgaggcggtttcctgaat

SEQ ID NO: 5929890 - DNA, 16 bp, Homo sapiens
gttgaggctaaaacaa

SEQ ID NO: 5929891 - DNA, 17 bp, Homo sapiens
gttgagggaaagagctt

SEQ ID NO: 5929892 - DNA, 11 bp, Homo sapiens
gttgaggggag

SEQ ID NO: 5929893 - DNA, 16 bp, Homo sapiens
gttgaggggcctggag

SEQ ID NO: 5929894 - DNA, 21 bp, Homo sapiens
gttgaggtccagccctggctg

SEQ ID NO: 5929895 - DNA, 22 bp, Homo sapiens
gttgaggtccagccctggctga

SEQ ID NO: 5929896 - DNA, 23 bp, Homo sapiens
gttgaggtggaagccctccttcc

SEQ ID NO: 5929897 - DNA, 13 bp, Homo sapiens
gttgagtatttgc

SEQ ID NO: 5929898 - DNA, 13 bp, Homo sapiens
gttgagtgcactg

SEQ ID NO: 5929899 - DNA, 15 bp, Homo sapiens
gttgagtttcttcta

SEQ ID NO: 5929900 - DNA, 23 bp, Homo sapiens
gttgagtttcttctaaagaggaa

SEQ ID NO: 5929901 - DNA, 13 bp, Homo sapiens
gttgagtttgctg

SEQ ID NO: 5929902 - DNA, 23 bp, Homo sapiens
gttgataaaccaaaaacatttga

SEQ ID NO: 5929903 - DNA, 14 bp, Homo sapiens
gttgataactttgc

SEQ ID NO: 5929904 - DNA, 15 bp, Homo sapiens
gttgataactttgct

SEQ ID NO: 5929905 - DNA, 20 bp, Homo sapiens
gttgataatagtaatggttc

SEQ ID NO: 5929906 - DNA, 19 bp, Homo sapiens
gttgatacgtgtgtgaagt

SEQ ID NO: 5929907 - DNA, 17 bp, Homo sapiens
gttgatactgttgcacg

SEQ ID NO: 5929908 - DNA, 23 bp, Homo sapiens
gttgatagcaagtgaatttttct

SEQ ID NO: 5929909 - DNA, 19 bp, Homo sapiens
gttgatagcacagaccctg

SEQ ID NO: 5929910 - DNA, 15 bp, Homo sapiens
gttgatagtttacaa

SEQ ID NO: 5929911 - DNA, 20 bp, Homo sapiens
gttgatataaaactctgggt

SEQ ID NO: 5929912 - DNA, 16 bp, Homo sapiens
gttgatatattctttc

SEQ ID NO: 5929913 - DNA, 22 bp, Homo sapiens
gttgatatattctttccatgca

SEQ ID NO: 5929914 - DNA, 15 bp, Homo sapiens
gttgatatttaaaag

SEQ ID NO: 5929915 - DNA, 20 bp, Homo sapiens
gttgatatttcgaaagctgc

SEQ ID NO: 5929916 - DNA, 14 bp, Homo sapiens
gttgatcagatctg

SEQ ID NO: 5929917 - DNA, 16 bp, Homo sapiens
gttgatcataattaaa

SEQ ID NO: 5929918 - DNA, 15 bp, Homo sapiens
gttgatccatccagc

SEQ ID NO: 5929919 - DNA, 14 bp, Homo sapiens
gttgatctcctggt

SEQ ID NO: 5929920 - DNA, 23 bp, Homo sapiens
gttgatctgcatatttctgtata

SEQ ID NO: 5929921 - DNA, 15 bp, Homo sapiens
gttgatctggaaccc

SEQ ID NO: 5929922 - DNA, 17 bp, Homo sapiens
gttgatctggaacccag

SEQ ID NO: 5929923 - DNA, 19 bp, Homo sapiens
gttgatctggaacccagac

SEQ ID NO: 5929924 - DNA, 13 bp, Homo sapiens
gttgatgaaattc

SEQ ID NO: 5929925 - DNA, 14 bp, Homo sapiens
gttgatgaccaatc

SEQ ID NO: 5929926 - DNA, 12 bp, Homo sapiens
gttgatgcatgt

SEQ ID NO: 5929927 - DNA, 14 bp, Homo sapiens
gttgatggaaaata

SEQ ID NO: 5929928 - DNA, 15 bp, Homo sapiens
gttgatggaaaataa

SEQ ID NO: 5929929 - DNA, 21 bp, Homo sapiens
gttgatgggatgattgaagaa

SEQ ID NO: 5929930 - DNA, 19 bp, Homo sapiens
gttgatgtatggtatcttt

SEQ ID NO: 5929931 - DNA, 17 bp, Homo sapiens
gttgatgtgtctttttt

SEQ ID NO: 5929932 - DNA, 12 bp, Homo sapiens
gttgattaaggc

SEQ ID NO: 5929933 - DNA, 13 bp, Homo sapiens
gttgattaaggca

SEQ ID NO: 5929934 - DNA, 16 bp, Homo sapiens
gttgattacagtgcag

SEQ ID NO: 5929935 - DNA, 13 bp, Homo sapiens
gttgattatcttc

SEQ ID NO: 5929936 - DNA, 20 bp, Homo sapiens
gttgattcatattgcatcat

SEQ ID NO: 5929937 - DNA, 15 bp, Homo sapiens
gttgattcccagcat

SEQ ID NO: 5929938 - DNA, 20 bp, Homo sapiens
gttgattccttgagtttcat

SEQ ID NO: 5929939 - DNA, 12 bp, Homo sapiens
gttgattgctaa

SEQ ID NO: 5929940 - DNA, 15 bp, Homo sapiens
gttgattgctaaatg

SEQ ID NO: 5929941 - DNA, 18 bp, Homo sapiens
gttgattgctaaatgtaa

SEQ ID NO: 5929942 - DNA, 14 bp, Homo sapiens
gttgattgtttaag

SEQ ID NO: 5929943 - DNA, 14 bp, Homo sapiens
gttgatttcttctt

SEQ ID NO: 5929944 - DNA, 17 bp, Homo sapiens
gttgatttttactgtgt

SEQ ID NO: 5929945 - DNA, 12 bp, Homo sapiens
gttgcaaagcta

SEQ ID NO: 5929946 - DNA, 23 bp, Homo sapiens
gttgcaaaggtaggttgaaggga

SEQ ID NO: 5929947 - DNA, 14 bp, Homo sapiens
gttgcaactttgta

SEQ ID NO: 5929948 - DNA, 16 bp, Homo sapiens
gttgcaactttgtata

SEQ ID NO: 5929949 - DNA, 13 bp, Homo sapiens
gttgcaagactcg

SEQ ID NO: 5929950 - DNA, 18 bp, Homo sapiens
gttgcaagatgtgaatta

SEQ ID NO: 5929951 - DNA, 17 bp, Homo sapiens
gttgcaagtactgctgt

SEQ ID NO: 5929952 - DNA, 12 bp, Homo sapiens
gttgcaataaaa

SEQ ID NO: 5929953 - DNA, 15 bp, Homo sapiens
gttgcaataaaatag

SEQ ID NO: 5929954 - DNA, 23 bp, Homo sapiens
gttgcaataaaatagtattgaaa

SEQ ID NO: 5929955 - DNA, 18 bp, Homo sapiens
gttgcaatgatcagactt

SEQ ID NO: 5929956 - DNA, 23 bp, Homo sapiens
gttgcaattcataactaatgaat

SEQ ID NO: 5929957 - DNA, 13 bp, Homo sapiens
gttgcaattgttt

SEQ ID NO: 5929958 - DNA, 19 bp, Homo sapiens
gttgcaattgtttaagaat

SEQ ID NO: 5929959 - DNA, 19 bp, Homo sapiens
gttgcacagtccctcctgt

SEQ ID NO: 5929960 - DNA, 16 bp, Homo sapiens
gttgcacatcattcat

SEQ ID NO: 5929961 - DNA, 18 bp, Homo sapiens
gttgcaccaattaagtgt

SEQ ID NO: 5929962 - DNA, 16 bp, Homo sapiens
gttgcaccatctgctt

SEQ ID NO: 5929963 - DNA, 13 bp, Homo sapiens
gttgcacccagcc

SEQ ID NO: 5929964 - DNA, 11 bp, Homo sapiens
gttgcaccctt

SEQ ID NO: 5929965 - DNA, 17 bp, Homo sapiens
gttgcacgtgtgttttt

SEQ ID NO: 5929966 - DNA, 17 bp, Homo sapiens
gttgcactaactgctgg

SEQ ID NO: 5929967 - DNA, 17 bp, Homo sapiens
gttgcactcaagttgtt

SEQ ID NO: 5929968 - DNA, 20 bp, Homo sapiens
gttgcactcaagttgtttaa

SEQ ID NO: 5929969 - DNA, 15 bp, Homo sapiens
gttgcactgaacagg

SEQ ID NO: 5929970 - DNA, 16 bp, Homo sapiens
gttgcactgaagtttg

SEQ ID NO: 5929971 - DNA, 21 bp, Homo sapiens
gttgcactgaagtttgataaa

SEQ ID NO: 5929972 - DNA, 16 bp, Homo sapiens
gttgcactgccccctg

SEQ ID NO: 5929973 - DNA, 15 bp, Homo sapiens
gttgcactgtttgca

SEQ ID NO: 5929974 - DNA, 21 bp, Homo sapiens
gttgcactttagacatttttg

SEQ ID NO: 5929975 - DNA, 15 bp, Homo sapiens
gttgcacttttgaat

SEQ ID NO: 5929976 - DNA, 14 bp, Homo sapiens
gttgcagaaaatga

SEQ ID NO: 5929977 - DNA, 22 bp, Homo sapiens
gttgcagactggtgttaatgag

SEQ ID NO: 5929978 - DNA, 21 bp, Homo sapiens
gttgcagagaagcatcctcca

SEQ ID NO: 5929979 - DNA, 22 bp, Homo sapiens
gttgcagatctttttgtgaaat

SEQ ID NO: 5929980 - DNA, 17 bp, Homo sapiens
gttgcagatgaaatgtt

SEQ ID NO: 5929981 - DNA, 16 bp, Homo sapiens
gttgcagatgtattga

SEQ ID NO: 5929982 - DNA, 15 bp, Homo sapiens
gttgcagcccaagga

SEQ ID NO: 5929983 - DNA, 23 bp, Homo sapiens
gttgcagccctgctgctgcctgc

SEQ ID NO: 5929984 - DNA, 11 bp, Homo sapiens
gttgcagcctg

SEQ ID NO: 5929985 - DNA, 12 bp, Homo sapiens
gttgcagctgct

SEQ ID NO: 5929986 - DNA, 20 bp, Homo sapiens
gttgcagctgttttgttgac

SEQ ID NO: 5929987 - DNA, 12 bp, Homo sapiens
gttgcaggcagt

SEQ ID NO: 5929988 - DNA, 19 bp, Homo sapiens
gttgcaggcagtgtcttaa

SEQ ID NO: 5929989 - DNA, 17 bp, Homo sapiens
gttgcaggtgtccgggg

SEQ ID NO: 5929990 - DNA, 15 bp, Homo sapiens
gttgcagtctcagaa

SEQ ID NO: 5929991 - DNA, 17 bp, Homo sapiens
gttgcagtctcagaaag

SEQ ID NO: 5929992 - DNA, 18 bp, Homo sapiens
gttgcagtgagcagggtg

SEQ ID NO: 5929993 - DNA, 20 bp, Homo sapiens
gttgcagtgagcagggtggg

SEQ ID NO: 5929994 - DNA, 16 bp, Homo sapiens
gttgcagtgagctgag

SEQ ID NO: 5929995 - DNA, 20 bp, Homo sapiens
gttgcataaacaatccaaat

SEQ ID NO: 5929996 - DNA, 19 bp, Homo sapiens
gttgcatactgagccaagt

SEQ ID NO: 5929997 - DNA, 16 bp, Homo sapiens
gttgcatagcagtata

SEQ ID NO: 5929998 - DNA, 18 bp, Homo sapiens
gttgcatagcagtatatg

SEQ ID NO: 5929999 - DNA, 22 bp, Homo sapiens
gttgcatatagttaaactgaga

SEQ ID NO: 5930000 - DNA, 14 bp, Homo sapiens
gttgcatcagaaat

SEQ ID NO: 5930001 - DNA, 14 bp, Homo sapiens
gttgcatgaaattt

SEQ ID NO: 5930002 - DNA, 16 bp, Homo sapiens
gttgcatgataaacat

SEQ ID NO: 5930003 - DNA, 20 bp, Homo sapiens
gttgcattaaaaatgcatat

SEQ ID NO: 5930004 - DNA, 22 bp, Homo sapiens
gttgcattacgataaacattaa

SEQ ID NO: 5930005 - DNA, 18 bp, Homo sapiens
gttgcattagtaactttg

SEQ ID NO: 5930006 - DNA, 18 bp, Homo sapiens
gttgccaaattgctgcat

SEQ ID NO: 5930007 - DNA, 19 bp, Homo sapiens
gttgccaaattgctgcata

SEQ ID NO: 5930008 - DNA, 22 bp, Homo sapiens
gttgccaagaactgaaaacata

SEQ ID NO: 5930009 - DNA, 15 bp, Homo sapiens
gttgccaagacaaat

SEQ ID NO: 5930010 - DNA, 15 bp, Homo sapiens
gttggacagctgctt

SEQ ID NO: 5930011 - DNA, 16 bp, Homo sapiens
gttggacagctgcttg

SEQ ID NO: 5930012 - DNA, 15 bp, Homo sapiens
gttggacccgctctg

SEQ ID NO: 5930013 - DNA, 23 bp, Homo sapiens
gttggacgggatgacctccagaa

SEQ ID NO: 5930014 - DNA, 14 bp, Homo sapiens
gttggactaaatgc

SEQ ID NO: 5930015 - DNA, 15 bp, Homo sapiens
gttggactaaatgcc

SEQ ID NO: 5930016 - DNA, 23 bp, Homo sapiens
gttggactaaatgcctagttttt

SEQ ID NO: 5930017 - DNA, 14 bp, Homo sapiens
gttggactgtggcc

SEQ ID NO: 5930018 - DNA, 14 bp, Homo sapiens
gttggacttcagtc

SEQ ID NO: 5930019 - DNA, 19 bp, Homo sapiens
gttggagaaaatgaagaaa

SEQ ID NO: 5930020 - DNA, 14 bp, Homo sapiens
gttggagagcagca

SEQ ID NO: 5930021 - DNA, 15 bp, Homo sapiens
gttggagagccctgg

SEQ ID NO: 5930022 - DNA, 21 bp, Homo sapiens
gttggagatgacagaaatatg

SEQ ID NO: 5930023 - DNA, 17 bp, Homo sapiens
gttggagcagcaggcct

SEQ ID NO: 5930024 - DNA, 23 bp, Homo sapiens
gttggagcagcaggcctctggga

SEQ ID NO: 5930025 - DNA, 13 bp, Homo sapiens
gttggagcagggg

SEQ ID NO: 5930026 - DNA, 18 bp, Homo sapiens
gttggagccactctgttc

SEQ ID NO: 5930027 - DNA, 19 bp, Homo sapiens
gttggagcctgcagggtgg

SEQ ID NO: 5930028 - DNA, 18 bp, Homo sapiens
gttggagctcattctgtc

SEQ ID NO: 5930029 - DNA, 17 bp, Homo sapiens
gttggagctccagcctg

SEQ ID NO: 5930030 - DNA, 16 bp, Homo sapiens
gttggaggagagagcc

SEQ ID NO: 5930031 - DNA, 18 bp, Homo sapiens
gttggagggaaagccagc

SEQ ID NO: 5930032 - DNA, 22 bp, Homo sapiens
gttggagggaaagccagcctgg

SEQ ID NO: 5930033 - DNA, 16 bp, Homo sapiens
gttggagggaaccacc

SEQ ID NO: 5930034 - DNA, 20 bp, Homo sapiens
gttggagggaaccaccagcg

SEQ ID NO: 5930035 - DNA, 18 bp, Homo sapiens
gttggagtactatattta

SEQ ID NO: 5930036 - DNA, 15 bp, Homo sapiens
gttggagtgcagtgg

SEQ ID NO: 5930037 - DNA, 19 bp, Homo sapiens
gttggatccgtttgaccaa

SEQ ID NO: 5930038 - DNA, 21 bp, Homo sapiens
gttggatccgtttgaccaatt

SEQ ID NO: 5930039 - DNA, 14 bp, Homo sapiens
gttggatgggaaga

SEQ ID NO: 5930040 - DNA, 23 bp, Homo sapiens
gttggatgggaagatggtagcag

SEQ ID NO: 5930041 - DNA, 15 bp, Homo sapiens
gttggatgggagtgg

SEQ ID NO: 5930042 - DNA, 18 bp, Homo sapiens
gttggatgggagtgggca

SEQ ID NO: 5930043 - DNA, 14 bp, Homo sapiens
gttggatgtagcat

SEQ ID NO: 5930044 - DNA, 15 bp, Homo sapiens
gttggattccatgct

SEQ ID NO: 5930045 - DNA, 17 bp, Homo sapiens
gttggattccatgctaa

SEQ ID NO: 5930046 - DNA, 21 bp, Homo sapiens
gttggcaaacgagactttctc

SEQ ID NO: 5930047 - DNA, 19 bp, Homo sapiens
gttggcaagctgcaggttt

SEQ ID NO: 5930048 - DNA, 15 bp, Homo sapiens
gttggcaccccagct

SEQ ID NO: 5930049 - DNA, 16 bp, Homo sapiens
gttggcacctgcacac

SEQ ID NO: 5930050 - DNA, 14 bp, Homo sapiens
gttggcacttatag

SEQ ID NO: 5930051 - DNA, 22 bp, Homo sapiens
gttggcagcgcctcgccccagc

SEQ ID NO: 5930052 - DNA, 15 bp, Homo sapiens
gttggcaggagctcc

SEQ ID NO: 5930053 - DNA, 14 bp, Homo sapiens
gttggcaggcccac

SEQ ID NO: 5930054 - DNA, 15 bp, Homo sapiens
gttggcaggcccact

SEQ ID NO: 5930055 - DNA, 16 bp, Homo sapiens
gttggcagtgagtgag

SEQ ID NO: 5930056 - DNA, 23 bp, Homo sapiens
gttggcagtgagtgagcctggct

SEQ ID NO: 5930057 - DNA, 13 bp, Homo sapiens
gttggcagtttcc

SEQ ID NO: 5930058 - DNA, 16 bp, Homo sapiens
gttggccaagcagaaa

SEQ ID NO: 5930059 - DNA, 23 bp, Homo sapiens
gttggccagaaaaccctggtaag

SEQ ID NO: 5930060 - DNA, 13 bp, Homo sapiens
gttggccaggctg

SEQ ID NO: 5930061 - DNA, 17 bp, Homo sapiens
gttggccaggctggtct

SEQ ID NO: 5930062 - DNA, 14 bp, Homo sapiens
gttggccagtgtga

SEQ ID NO: 5930063 - DNA, 23 bp, Homo sapiens
gttggccatatttacctcagcct

SEQ ID NO: 5930064 - DNA, 22 bp, Homo sapiens
gttggcccttccagtgggatta

SEQ ID NO: 5930065 - DNA, 17 bp, Homo sapiens
gttggcccttctgccct

SEQ ID NO: 5930066 - DNA, 16 bp, Homo sapiens
gttggccggctggccg

SEQ ID NO: 5930067 - DNA, 20 bp, Homo sapiens
gttggccgtggtccagctct

SEQ ID NO: 5930068 - DNA, 14 bp, Homo sapiens
gttggcctcagcag

SEQ ID NO: 5930069 - DNA, 21 bp, Homo sapiens
gttggcctcagggccaggaag

SEQ ID NO: 5930070 - DNA, 15 bp, Homo sapiens
gttggcctccagtcc

SEQ ID NO: 5930071 - DNA, 14 bp, Homo sapiens
gttggcctctgccc

SEQ ID NO: 5930072 - DNA, 15 bp, Homo sapiens
gttggcctctgcccc

SEQ ID NO: 5930073 - DNA, 13 bp, Homo sapiens
gttggcctgtgct

SEQ ID NO: 5930074 - DNA, 18 bp, Homo sapiens
gttggcctgtgcttggag

SEQ ID NO: 5930075 - DNA, 22 bp, Homo sapiens
gttggcgtaggctacagagaag

SEQ ID NO: 5930076 - DNA, 14 bp, Homo sapiens
gttggcgtgtccca

SEQ ID NO: 5930077 - DNA, 15 bp, Homo sapiens
gttggcgtgtcccag

SEQ ID NO: 5930078 - DNA, 21 bp, Homo sapiens
gttggctaagaagaaatgcaa

SEQ ID NO: 5930079 - DNA, 18 bp, Homo sapiens
gttggctagtctgtgcct

SEQ ID NO: 5930080 - DNA, 14 bp, Homo sapiens
gttggctcaggcag

SEQ ID NO: 5930081 - DNA, 22 bp, Homo sapiens
gttggctctgccagtcctgtcc

SEQ ID NO: 5930082 - DNA, 20 bp, Homo sapiens
gttggctgacttccacacct

SEQ ID NO: 5930083 - DNA, 19 bp, Homo sapiens
gttggctgattggaaaata

SEQ ID NO: 5930084 - DNA, 12 bp, Homo sapiens
gttggctgctcc

SEQ ID NO: 5930085 - DNA, 14 bp, Homo sapiens
gttggctggatgaa

SEQ ID NO: 5930086 - DNA, 12 bp, Homo sapiens
gttggctggcct

SEQ ID NO: 5930087 - DNA, 17 bp, Homo sapiens
gttggctgggaactcac

SEQ ID NO: 5930088 - DNA, 14 bp, Homo sapiens
gttggctgggccca

SEQ ID NO: 5930089 - DNA, 23 bp, Homo sapiens
gttggctgggggcctcagtgcca

SEQ ID NO: 5930090 - DNA, 12 bp, Homo sapiens
gttggctggggt

SEQ ID NO: 5930091 - DNA, 12 bp, Homo sapiens
gttggctgggta

SEQ ID NO: 5930092 - DNA, 13 bp, Homo sapiens
gttggctgtgctg

SEQ ID NO: 5930093 - DNA, 21 bp, Homo sapiens
gttggctgtgttcgggggagc

SEQ ID NO: 5930094 - DNA, 15 bp, Homo sapiens
gttggcttctccctg

SEQ ID NO: 5930095 - DNA, 19 bp, Homo sapiens
gttggcttctccctgggga

SEQ ID NO: 5930096 - DNA, 13 bp, Homo sapiens
gttggcttctgtt

SEQ ID NO: 5930097 - DNA, 17 bp, Homo sapiens
gttggcttgctgatggc

SEQ ID NO: 5930098 - DNA, 16 bp, Homo sapiens
gttggctttcataaat

SEQ ID NO: 5930099 - DNA, 16 bp, Homo sapiens
gttggctttgcagctg

SEQ ID NO: 5930100 - DNA, 20 bp, Homo sapiens
gttgggaaaagcccacaggc

SEQ ID NO: 5930101 - DNA, 21 bp, Homo sapiens
gttgggaaaagcccacaggcc

SEQ ID NO: 5930102 - DNA, 18 bp, Homo sapiens
gttgggaaggcacctgct

SEQ ID NO: 5930103 - DNA, 17 bp, Homo sapiens
gttgggaaggggtcctg

SEQ ID NO: 5930104 - DNA, 21 bp, Homo sapiens
gttgggaaggggtcctgcagg

SEQ ID NO: 5930105 - DNA, 22 bp, Homo sapiens
gttgggaaggggtcctgcaggg

SEQ ID NO: 5930106 - DNA, 23 bp, Homo sapiens
gttgggaatgaggaaaattctta

SEQ ID NO: 5930107 - DNA, 17 bp, Homo sapiens
gttgggaatgaggcttg

SEQ ID NO: 5930108 - DNA, 18 bp, Homo sapiens
gttgggactacaggcgtg

SEQ ID NO: 5930109 - DNA, 20 bp, Homo sapiens
gttgggagagggcgcaggcc

SEQ ID NO: 5930110 - DNA, 23 bp, Homo sapiens
gttgggagagggcgcaggccgtg

SEQ ID NO: 5930111 - DNA, 16 bp, Homo sapiens
gttgggagcactggag

SEQ ID NO: 5930112 - DNA, 13 bp, Homo sapiens
gttgggagctgat

SEQ ID NO: 5930113 - DNA, 14 bp, Homo sapiens
gttgggaggattct

SEQ ID NO: 5930114 - DNA, 18 bp, Homo sapiens
gttgggatcgcattgcat

SEQ ID NO: 5930115 - DNA, 16 bp, Homo sapiens
gttgggattcctgacc

SEQ ID NO: 5930116 - DNA, 23 bp, Homo sapiens
gttgggattcctgacccaggccg

SEQ ID NO: 5930117 - DNA, 14 bp, Homo sapiens
gttgggcagccaga

SEQ ID NO: 5930118 - DNA, 12 bp, Homo sapiens
gttgggcatgtg

SEQ ID NO: 5930119 - DNA, 15 bp, Homo sapiens
gttgggccaggagcc

SEQ ID NO: 5930120 - DNA, 15 bp, Homo sapiens
gttgggcccagatct

SEQ ID NO: 5930121 - DNA, 18 bp, Homo sapiens
gttgggcccctgaggagc

SEQ ID NO: 5930122 - DNA, 19 bp, Homo sapiens
gttgggcccctgaggagct

SEQ ID NO: 5930123 - DNA, 13 bp, Homo sapiens
gttgggctggtgt

SEQ ID NO: 5930124 - DNA, 14 bp, Homo sapiens
gttgggctgtgcct

SEQ ID NO: 5930125 - DNA, 17 bp, Homo sapiens
gttgggctgtgcctggg

SEQ ID NO: 5930126 - DNA, 18 bp, Homo sapiens
gttggggaagggcctgcc

SEQ ID NO: 5930127 - DNA, 17 bp, Homo sapiens
gttggggcaaagcctcc

SEQ ID NO: 5930128 - DNA, 16 bp, Homo sapiens
gttggggccctcttgc

SEQ ID NO: 5930129 - DNA, 18 bp, Homo sapiens
gttggggccctcttgcca

SEQ ID NO: 5930130 - DNA, 11 bp, Homo sapiens
gttggggctgc

SEQ ID NO: 5930131 - DNA, 21 bp, Homo sapiens
gttgggggaggggagactttg

SEQ ID NO: 5930132 - DNA, 17 bp, Homo sapiens
gttgggggcagattggg

SEQ ID NO: 5930133 - DNA, 20 bp, Homo sapiens
gttgggggccagcacagctg

SEQ ID NO: 5930134 - DNA, 19 bp, Homo sapiens
gttgggggggaccctgcct

SEQ ID NO: 5930135 - DNA, 17 bp, Homo sapiens
gttggggggtgggagag

SEQ ID NO: 5930136 - DNA, 14 bp, Homo sapiens
gttgggggtcagtg

SEQ ID NO: 5930137 - DNA, 22 bp, Homo sapiens
gttgggggtcagtgctgcctgt

SEQ ID NO: 5930138 - DNA, 15 bp, Homo sapiens
gttggggtgacagtc

SEQ ID NO: 5930139 - DNA, 15 bp, Homo sapiens
gttggggtgggaggg

SEQ ID NO: 5930140 - DNA, 12 bp, Homo sapiens
gttggggtgggg

SEQ ID NO: 5930141 - DNA, 17 bp, Homo sapiens
gttggggtggggcagga

SEQ ID NO: 5930142 - DNA, 23 bp, Homo sapiens
gttggggtgggtataaaagatgg

SEQ ID NO: 5930143 - DNA, 19 bp, Homo sapiens
gttgggtagatgggtgggg

SEQ ID NO: 5930144 - DNA, 23 bp, Homo sapiens
gttgggtagggtgttctggcttt

SEQ ID NO: 5930145 - DNA, 17 bp, Homo sapiens
gttgggtcaaggacagg

SEQ ID NO: 5930146 - DNA, 15 bp, Homo sapiens
gttgggtcccttgct

SEQ ID NO: 5930147 - DNA, 16 bp, Homo sapiens
gttgggtcccttgctg

SEQ ID NO: 5930148 - DNA, 15 bp, Homo sapiens
gttgggttcatctga

SEQ ID NO: 5930149 - DNA, 19 bp, Homo sapiens
gttgggttccagacagagt

SEQ ID NO: 5930150 - DNA, 18 bp, Homo sapiens
gttgggtttgctcatgta

SEQ ID NO: 5930151 - DNA, 17 bp, Homo sapiens
gttggtagcaattggca

SEQ ID NO: 5930152 - DNA, 17 bp, Homo sapiens
gttggtatctcaggtct

SEQ ID NO: 5930153 - DNA, 15 bp, Homo sapiens
gttggtatttactgc

SEQ ID NO: 5930154 - DNA, 14 bp, Homo sapiens
gttggtcaggctgg

SEQ ID NO: 5930155 - DNA, 20 bp, Homo sapiens
gttggtcatctctcctgtgt

SEQ ID NO: 5930156 - DNA, 14 bp, Homo sapiens
gttggtccactgtg

SEQ ID NO: 5930157 - DNA, 13 bp, Homo sapiens
gttggtcccaagt

SEQ ID NO: 5930158 - DNA, 18 bp, Homo sapiens
gttggtcccccttccatg

SEQ ID NO: 5930159 - DNA, 16 bp, Homo sapiens
gttggtcggtgggttg

SEQ ID NO: 5930160 - DNA, 13 bp, Homo sapiens
gttggtctgcctt

SEQ ID NO: 5930161 - DNA, 16 bp, Homo sapiens
gttggtctgtactgat

SEQ ID NO: 5930162 - DNA, 13 bp, Homo sapiens
gttggtctgtgta

SEQ ID NO: 5930163 - DNA, 20 bp, Homo sapiens
gttggtctttgtctgcaggt

SEQ ID NO: 5930164 - DNA, 15 bp, Homo sapiens
gttggtgacttgtct

SEQ ID NO: 5930165 - DNA, 19 bp, Homo sapiens
gttggtgacttgtctgcct

SEQ ID NO: 5930166 - DNA, 20 bp, Homo sapiens
gttggtgacttgtctgcctc

SEQ ID NO: 5930167 - DNA, 18 bp, Homo sapiens
gttggtgcaattaactct

SEQ ID NO: 5930168 - DNA, 17 bp, Homo sapiens
gttggtgcacagcacaa

SEQ ID NO: 5930169 - DNA, 12 bp, Homo sapiens
gttggtgctgat

SEQ ID NO: 5930170 - DNA, 15 bp, Homo sapiens
gttggtgctgatgga

SEQ ID NO: 5930171 - DNA, 16 bp, Homo sapiens
gttggtgctgatggag

SEQ ID NO: 5930172 - DNA, 18 bp, Homo sapiens
gttggtgggctggcccag

SEQ ID NO: 5930173 - DNA, 18 bp, Homo sapiens
gttggtggggccaggcca

SEQ ID NO: 5930174 - DNA, 22 bp, Homo sapiens
gttggtggggggtccagtctgt

SEQ ID NO: 5930175 - DNA, 16 bp, Homo sapiens
gttggtggtgcagccc

SEQ ID NO: 5930176 - DNA, 15 bp, Homo sapiens
gttggtgtgtttttg

SEQ ID NO: 5930177 - DNA, 20 bp, Homo sapiens
gttggttaaataaacttttt

SEQ ID NO: 5930178 - DNA, 18 bp, Homo sapiens
gttggttatttgtgttat

SEQ ID NO: 5930179 - DNA, 14 bp, Homo sapiens
gttggttggttttc

SEQ ID NO: 5930180 - DNA, 16 bp, Homo sapiens
gttggttgtgtctttt

SEQ ID NO: 5930181 - DNA, 14 bp, Homo sapiens
gttggtttactttc

SEQ ID NO: 5930182 - DNA, 19 bp, Homo sapiens
gttggtttagctttggaaa

SEQ ID NO: 5930183 - DNA, 16 bp, Homo sapiens
gttggtttcccctgca

SEQ ID NO: 5930184 - DNA, 22 bp, Homo sapiens
gttggttttatactatattaac

SEQ ID NO: 5930185 - DNA, 13 bp, Homo sapiens
gttgtaaaaagaa

SEQ ID NO: 5930186 - DNA, 22 bp, Homo sapiens
gttgtaaaatatagctgtacaa

SEQ ID NO: 5930187 - DNA, 23 bp, Homo sapiens
gttgtaaacaacgtgtatagtgc

SEQ ID NO: 5930188 - DNA, 16 bp, Homo sapiens
gttgtaaaccaagtga

SEQ ID NO: 5930189 - DNA, 14 bp, Homo sapiens
gtttcaagaaaatc

SEQ ID NO: 5930190 - DNA, 20 bp, Homo sapiens
gtttcaagaaaatctttgtt

SEQ ID NO: 5930191 - DNA, 18 bp, Homo sapiens
gtttcaaggcactctaga

SEQ ID NO: 5930192 - DNA, 19 bp, Homo sapiens
gtttcaaggcactctagat

SEQ ID NO: 5930193 - DNA, 19 bp, Homo sapiens
gtttcaagttattcaaatt

SEQ ID NO: 5930194 - DNA, 20 bp, Homo sapiens
gtttcaagttattcaaattt

SEQ ID NO: 5930195 - DNA, 22 bp, Homo sapiens
gtttcaataaagtttgtacact

SEQ ID NO: 5930196 - DNA, 14 bp, Homo sapiens
gtttcaatcactgt

SEQ ID NO: 5930197 - DNA, 22 bp, Homo sapiens
gtttcaatgcatacaataaaag

SEQ ID NO: 5930198 - DNA, 19 bp, Homo sapiens
gtttcaatgtgattctaat

SEQ ID NO: 5930199 - DNA, 15 bp, Homo sapiens
gtttcaattcagtgc

SEQ ID NO: 5930200 - DNA, 14 bp, Homo sapiens
gtttcaatttactt

SEQ ID NO: 5930201 - DNA, 22 bp, Homo sapiens
gtttcaatttactttttaaaca

SEQ ID NO: 5930202 - DNA, 21 bp, Homo sapiens
gtttcacaggtcaataaactt

SEQ ID NO: 5930203 - DNA, 15 bp, Homo sapiens
gtttcacatatttgt

SEQ ID NO: 5930204 - DNA, 17 bp, Homo sapiens
gtttcaccactcctctc

SEQ ID NO: 5930205 - DNA, 16 bp, Homo sapiens
gtttcacccttaaccc

SEQ ID NO: 5930206 - DNA, 22 bp, Homo sapiens
gtttcacccttaacccaaggag

SEQ ID NO: 5930207 - DNA, 14 bp, Homo sapiens
gtttcaccttccct

SEQ ID NO: 5930208 - DNA, 17 bp, Homo sapiens
gtttcacgtaaatattc

SEQ ID NO: 5930209 - DNA, 20 bp, Homo sapiens
gtttcactatgattttctat

SEQ ID NO: 5930210 - DNA, 21 bp, Homo sapiens
gtttcactatgattttctatt

SEQ ID NO: 5930211 - DNA, 17 bp, Homo sapiens
gtttcactcctgcttct

SEQ ID NO: 5930212 - DNA, 19 bp, Homo sapiens
gtttcactgtactgcatgt

SEQ ID NO: 5930213 - DNA, 21 bp, Homo sapiens
gtttcagaaagggcagcccct

SEQ ID NO: 5930214 - DNA, 23 bp, Homo sapiens
gtttcagaaagggcagcccctcc

SEQ ID NO: 5930215 - DNA, 16 bp, Homo sapiens
gtttcagaataaaatt

SEQ ID NO: 5930216 - DNA, 22 bp, Homo sapiens
gtttcagacagggtctgaagga

SEQ ID NO: 5930217 - DNA, 21 bp, Homo sapiens
gtttcagagacaacttcccaa

SEQ ID NO: 5930218 - DNA, 18 bp, Homo sapiens
gtttcagagatggacaga

SEQ ID NO: 5930219 - DNA, 19 bp, Homo sapiens
gtttcagagatggacagag

SEQ ID NO: 5930220 - DNA, 18 bp, Homo sapiens
gtttcagataaatcatgg

SEQ ID NO: 5930221 - DNA, 21 bp, Homo sapiens
gtttcagataaatcatgggca

SEQ ID NO: 5930222 - DNA, 21 bp, Homo sapiens
gtttcagatatatatcatatt

SEQ ID NO: 5930223 - DNA, 14 bp, Homo sapiens
gtttcagatgaggt

SEQ ID NO: 5930224 - DNA, 22 bp, Homo sapiens
gtttcagatgtgcaataatttg

SEQ ID NO: 5930225 - DNA, 21 bp, Homo sapiens
gtttcagattttttaaaattt

SEQ ID NO: 5930226 - DNA, 23 bp, Homo sapiens
gtttcagcactagccaaacctca

SEQ ID NO: 5930227 - DNA, 14 bp, Homo sapiens
gtttcagcattccc

SEQ ID NO: 5930228 - DNA, 23 bp, Homo sapiens
gtttcagctaagggaagacattt

SEQ ID NO: 5930229 - DNA, 14 bp, Homo sapiens
gtttcagctgcagt

SEQ ID NO: 5930230 - DNA, 18 bp, Homo sapiens
gtttcagctttcttcagc

SEQ ID NO: 5930231 - DNA, 12 bp, Homo sapiens
gtttcaggaagt

SEQ ID NO: 5930232 - DNA, 19 bp, Homo sapiens
gtttcaggatacatgtgcc

SEQ ID NO: 5930233 - DNA, 20 bp, Homo sapiens
gtttcaggcaaggcagctcc

SEQ ID NO: 5930234 - DNA, 23 bp, Homo sapiens
gtttcagggggcctttaaagact

SEQ ID NO: 5930235 - DNA, 16 bp, Homo sapiens
gtttcaggtgacatgt

SEQ ID NO: 5930236 - DNA, 16 bp, Homo sapiens
gtttcagtaataaaac

SEQ ID NO: 5930237 - DNA, 17 bp, Homo sapiens
gtttcagtaatagctga

SEQ ID NO: 5930238 - DNA, 16 bp, Homo sapiens
gtttcagtagctcctt

SEQ ID NO: 5930239 - DNA, 20 bp, Homo sapiens
gtttcagtagctccttggtt

SEQ ID NO: 5930240 - DNA, 18 bp, Homo sapiens
gtttcagttctgtgtaca

SEQ ID NO: 5930241 - DNA, 12 bp, Homo sapiens
gtttcagtttga

SEQ ID NO: 5930242 - DNA, 21 bp, Homo sapiens
gtttcagtttgttggaaagta

SEQ ID NO: 5930243 - DNA, 22 bp, Homo sapiens
gtttcataatgcagaagtattc

SEQ ID NO: 5930244 - DNA, 18 bp, Homo sapiens
gtttcatactctagattt

SEQ ID NO: 5930245 - DNA, 16 bp, Homo sapiens
gtttcatagttttcta

SEQ ID NO: 5930246 - DNA, 14 bp, Homo sapiens
gtttcatatctggt

SEQ ID NO: 5930247 - DNA, 13 bp, Homo sapiens
gtttcatatttct

SEQ ID NO: 5930248 - DNA, 22 bp, Homo sapiens
gtttcatatttttcatagctaa

SEQ ID NO: 5930249 - DNA, 15 bp, Homo sapiens
gtttcatcaggacca

SEQ ID NO: 5930250 - DNA, 14 bp, Homo sapiens
gtttcatccttccc

SEQ ID NO: 5930251 - DNA, 15 bp, Homo sapiens
gtttcatccttccca

SEQ ID NO: 5930252 - DNA, 17 bp, Homo sapiens
gtttcatccttcccact

SEQ ID NO: 5930253 - DNA, 14 bp, Homo sapiens
gtttcatctcagct

SEQ ID NO: 5930254 - DNA, 15 bp, Homo sapiens
gtttcatctcagctt

SEQ ID NO: 5930255 - DNA, 14 bp, Homo sapiens
gtttcatgagccca

SEQ ID NO: 5930256 - DNA, 15 bp, Homo sapiens
gtttcatgagcccaa

SEQ ID NO: 5930257 - DNA, 17 bp, Homo sapiens
gtttcatgtaaagaaaa

SEQ ID NO: 5930258 - DNA, 23 bp, Homo sapiens
gtttcatgtagccagcagaactg

SEQ ID NO: 5930259 - DNA, 21 bp, Homo sapiens
gtttcatgttatgcctgttgc

SEQ ID NO: 5930260 - DNA, 18 bp, Homo sapiens
gtttcatgttttgtgact

SEQ ID NO: 5930261 - DNA, 19 bp, Homo sapiens
gtttcattctcctgcctgt

SEQ ID NO: 5930262 - DNA, 14 bp, Homo sapiens
gtttcattgccttc

SEQ ID NO: 5930263 - DNA, 20 bp, Homo sapiens
gtttcattgcgaatcttttt

SEQ ID NO: 5930264 - DNA, 21 bp, Homo sapiens
gtttcatttagtcatgtgacc

SEQ ID NO: 5930265 - DNA, 14 bp, Homo sapiens
gtttccaaagtgca

SEQ ID NO: 5930266 - DNA, 15 bp, Homo sapiens
gtttccaaagtgcat

SEQ ID NO: 5930267 - DNA, 20 bp, Homo sapiens
gtttccaaagtgcatgtcac

SEQ ID NO: 5930268 - DNA, 20 bp, Homo sapiens
gtttccaaatccctttcatg

SEQ ID NO: 5930269 - DNA, 14 bp, Homo sapiens
gtttccaagcaaat

SEQ ID NO: 5930270 - DNA, 17 bp, Homo sapiens
gtttccaagcctgggcc

SEQ ID NO: 5930271 - DNA, 14 bp, Homo sapiens
gtttccaaggagct

SEQ ID NO: 5930272 - DNA, 15 bp, Homo sapiens
gtttccaatcaacag

SEQ ID NO: 5930273 - DNA, 23 bp, Homo sapiens
gtttccaatgtttagcaaataca

SEQ ID NO: 5930274 - DNA, 21 bp, Homo sapiens
gtttccaattatttgacttta

SEQ ID NO: 5930275 - DNA, 19 bp, Homo sapiens
gtttccacacaggcccatg

SEQ ID NO: 5930276 - DNA, 20 bp, Homo sapiens
gtttccacttgtgggcttca

SEQ ID NO: 5930277 - DNA, 14 bp, Homo sapiens
gtttccagaaaata

SEQ ID NO: 5930278 - DNA, 17 bp, Homo sapiens
gtttccagaaaatataa

SEQ ID NO: 5930279 - DNA, 19 bp, Homo sapiens
gtttccagaaaatataaat

SEQ ID NO: 5930280 - DNA, 17 bp, Homo sapiens
gtttccagaaattcttc

SEQ ID NO: 5930281 - DNA, 19 bp, Homo sapiens
gtttccagacttccttgag

SEQ ID NO: 5930282 - DNA, 13 bp, Homo sapiens
gtttccagcattc

SEQ ID NO: 5930283 - DNA, 16 bp, Homo sapiens
gtttccagcattccca

SEQ ID NO: 5930284 - DNA, 13 bp, Homo sapiens
gtttccagctgcc

SEQ ID NO: 5930285 - DNA, 14 bp, Homo sapiens
gtttccagctgcca

SEQ ID NO: 5930286 - DNA, 16 bp, Homo sapiens
gtttccagcttgcatt

SEQ ID NO: 5930287 - DNA, 12 bp, Homo sapiens
gtttccaggaag

SEQ ID NO: 5930288 - DNA, 13 bp, Homo sapiens
gtttccaggaaga

SEQ ID NO: 5930289 - DNA, 18 bp, Homo sapiens
gtttccaggcatgaccct

SEQ ID NO: 5930290 - DNA, 19 bp, Homo sapiens
gtttccaggcatgaccctg

SEQ ID NO: 5930291 - DNA, 22 bp, Homo sapiens
gtttccaggcatgaccctggag

SEQ ID NO: 5930292 - DNA, 14 bp, Homo sapiens
gtttccatagttta

SEQ ID NO: 5930293 - DNA, 22 bp, Homo sapiens
gtttccatcctttgcatttctc

SEQ ID NO: 5930294 - DNA, 22 bp, Homo sapiens
gtttccatttctcaatcagtgc

SEQ ID NO: 5930295 - DNA, 13 bp, Homo sapiens
gtttccatttgga

SEQ ID NO: 5930296 - DNA, 23 bp, Homo sapiens
gtttccatttggattttaaacaa

SEQ ID NO: 5930297 - DNA, 22 bp, Homo sapiens
gtttcccaaaacaatctattta

SEQ ID NO: 5930298 - DNA, 16 bp, Homo sapiens
gtttcccaaattccct

SEQ ID NO: 5930299 - DNA, 14 bp, Homo sapiens
gtttcccaggccca

SEQ ID NO: 5930300 - DNA, 17 bp, Homo sapiens
gtttcccagtgagcctc

SEQ ID NO: 5930301 - DNA, 23 bp, Homo sapiens
gtttccccaataaagccttttaa

SEQ ID NO: 5930302 - DNA, 15 bp, Homo sapiens
gtttccccaccagtg

SEQ ID NO: 5930303 - DNA, 17 bp, Homo sapiens
gtttccccaccagtgaa

SEQ ID NO: 5930304 - DNA, 20 bp, Homo sapiens
gtttccccaccagtgaatga

SEQ ID NO: 5930305 - DNA, 21 bp, Homo sapiens
gtttccccactaataaagtgc

SEQ ID NO: 5930306 - DNA, 19 bp, Homo sapiens
gtttccccagggaaggaaa

SEQ ID NO: 5930307 - DNA, 19 bp, Homo sapiens
gtttcccccacagttttaa

SEQ ID NO: 5930308 - DNA, 13 bp, Homo sapiens
gtttcccccactc

SEQ ID NO: 5930309 - DNA, 13 bp, Homo sapiens
gtttcccctctgg

SEQ ID NO: 5930310 - DNA, 22 bp, Homo sapiens
gtttcccggtgacacatccatt

SEQ ID NO: 5930311 - DNA, 19 bp, Homo sapiens
gtttcccggttcaggacca

SEQ ID NO: 5930312 - DNA, 21 bp, Homo sapiens
gtttcccggttcaggaccact

SEQ ID NO: 5930313 - DNA, 20 bp, Homo sapiens
gtttccctactaacatccca

SEQ ID NO: 5930314 - DNA, 23 bp, Homo sapiens
gtttccctcaaatgcgcgtgtgc

SEQ ID NO: 5930315 - DNA, 18 bp, Homo sapiens
gtttccctcccaacagag

SEQ ID NO: 5930316 - DNA, 16 bp, Homo sapiens
gtttccctcctctgca

SEQ ID NO: 5930317 - DNA, 15 bp, Homo sapiens
gtttccctctccttc

SEQ ID NO: 5930318 - DNA, 15 bp, Homo sapiens
gtttccctctgtgtt

SEQ ID NO: 5930319 - DNA, 15 bp, Homo sapiens
gtttccctgcccctg

SEQ ID NO: 5930320 - DNA, 18 bp, Homo sapiens
gtttccctgcccctgtcc

SEQ ID NO: 5930321 - DNA, 17 bp, Homo sapiens
gtttccctgctggccaa

SEQ ID NO: 5930322 - DNA, 14 bp, Homo sapiens
gtttccctggtgcc

SEQ ID NO: 5930323 - DNA, 14 bp, Homo sapiens
gtttcccttcctcg

SEQ ID NO: 5930324 - DNA, 16 bp, Homo sapiens
gtttccctttagctaa

SEQ ID NO: 5930325 - DNA, 17 bp, Homo sapiens
gtttccgaatctctttc

SEQ ID NO: 5930326 - DNA, 14 bp, Homo sapiens
gtttccgcggcggc

SEQ ID NO: 5930327 - DNA, 15 bp, Homo sapiens
gtttccgtagcagtt

SEQ ID NO: 5930328 - DNA, 16 bp, Homo sapiens
gtttccgtagcagttt

SEQ ID NO: 5930329 - DNA, 13 bp, Homo sapiens
gtttccgtgcgtg

SEQ ID NO: 5930330 - DNA, 22 bp, Homo sapiens
gtttccgtggcaaccctcagct

SEQ ID NO: 5930331 - DNA, 16 bp, Homo sapiens
gtttcctaaaagttca

SEQ ID NO: 5930332 - DNA, 22 bp, Homo sapiens
gtttcctaaaatatctgggtgg

SEQ ID NO: 5930333 - DNA, 21 bp, Homo sapiens
gtttcctaaatccaaccattt

SEQ ID NO: 5930334 - DNA, 22 bp, Homo sapiens
gtttcctcatctatggttctaa

SEQ ID NO: 5930335 - DNA, 13 bp, Homo sapiens
gtttcctcatttt

SEQ ID NO: 5930336 - DNA, 20 bp, Homo sapiens
gtttcctcctcccaacagtt

SEQ ID NO: 5930337 - DNA, 18 bp, Homo sapiens
gtttcctctagttctttg

SEQ ID NO: 5930338 - DNA, 13 bp, Homo sapiens
gtttcctctgttc

SEQ ID NO: 5930339 - DNA, 20 bp, Homo sapiens
gtttcctctgttcaaagctg

SEQ ID NO: 5930340 - DNA, 23 bp, Homo sapiens
gtttcctctgttcaaagctgcct

SEQ ID NO: 5930341 - DNA, 17 bp, Homo sapiens
gtttcctgagccacctt

SEQ ID NO: 5930342 - DNA, 12 bp, Homo sapiens
gtttcctgcagg

SEQ ID NO: 5930343 - DNA, 14 bp, Homo sapiens
gtttcctgctccag

SEQ ID NO: 5930344 - DNA, 11 bp, Homo sapiens
gtttcctggca

SEQ ID NO: 5930345 - DNA, 20 bp, Homo sapiens
gtttcctggcactgcttcca

SEQ ID NO: 5930346 - DNA, 16 bp, Homo sapiens
gtttcctgtggaaata

SEQ ID NO: 5930347 - DNA, 20 bp, Homo sapiens
gtttcctgtggaaatatgca

SEQ ID NO: 5930348 - DNA, 16 bp, Homo sapiens
gtttcctgtgtctcca

SEQ ID NO: 5930349 - DNA, 20 bp, Homo sapiens
gtttccttattgaaaaatca

SEQ ID NO: 5930350 - DNA, 13 bp, Homo sapiens
gtttccttccctc

SEQ ID NO: 5930351 - DNA, 21 bp, Homo sapiens
gtttccttgaggggagccagg

SEQ ID NO: 5930352 - DNA, 19 bp, Homo sapiens
gtttccttgggagttgtca

SEQ ID NO: 5930353 - DNA, 17 bp, Homo sapiens
gtttcctttcatttact

SEQ ID NO: 5930354 - DNA, 12 bp, Homo sapiens
gtttcctttctc

SEQ ID NO: 5930355 - DNA, 23 bp, Homo sapiens
gtttccttttctgtctctctctt

SEQ ID NO: 5930356 - DNA, 14 bp, Homo sapiens
gtttccttttggaa

SEQ ID NO: 5930357 - DNA, 14 bp, Homo sapiens
gtttccttttttcc

SEQ ID NO: 5930358 - DNA, 17 bp, Homo sapiens
gtttcgaagtcattaaa

SEQ ID NO: 5930359 - DNA, 21 bp, Homo sapiens
gtttcgactggtccagctctg

SEQ ID NO: 5930360 - DNA, 18 bp, Homo sapiens
gtttcgacttatttctta

SEQ ID NO: 5930361 - DNA, 17 bp, Homo sapiens
gtttcgagtaaacttga

SEQ ID NO: 5930362 - DNA, 20 bp, Homo sapiens
gtttcgagtaaacttgaaaa

SEQ ID NO: 5930363 - DNA, 15 bp, Homo sapiens
gtttcgatatttatt

SEQ ID NO: 5930364 - DNA, 21 bp, Homo sapiens
gtttcgatatttattgatgtt

SEQ ID NO: 5930365 - DNA, 22 bp, Homo sapiens
gtttcggaaaaaaaaaaagaaa

SEQ ID NO: 5930366 - DNA, 13 bp, Homo sapiens
gtttcgtcatgtt

SEQ ID NO: 5930367 - DNA, 21 bp, Homo sapiens
gtttcgtcatgttggccaggc

SEQ ID NO: 5930368 - DNA, 22 bp, Homo sapiens
gtttcgttaagcagtacatctt

SEQ ID NO: 5930369 - DNA, 16 bp, Homo sapiens
gtttcgtttctgtata

SEQ ID NO: 5930370 - DNA, 14 bp, Homo sapiens
gtttctaaagctgc

SEQ ID NO: 5930371 - DNA, 16 bp, Homo sapiens
gtttctaaagctgcca

SEQ ID NO: 5930372 - DNA, 20 bp, Homo sapiens
gtttctaaagctgccagccg

SEQ ID NO: 5930373 - DNA, 19 bp, Homo sapiens
gtttctaaaggctaccttt

SEQ ID NO: 5930374 - DNA, 18 bp, Homo sapiens
gtttctaagaaaatgtag

SEQ ID NO: 5930375 - DNA, 17 bp, Homo sapiens
gtttctaagaatttaga

SEQ ID NO: 5930376 - DNA, 14 bp, Homo sapiens
gtttctaagattct

SEQ ID NO: 5930377 - DNA, 11 bp, Homo sapiens
gtttctaaggt

SEQ ID NO: 5930378 - DNA, 21 bp, Homo sapiens
gtttctaaggtaacaagatga

SEQ ID NO: 5930379 - DNA, 22 bp, Homo sapiens
gtttctaagtctgttattgttt

SEQ ID NO: 5930380 - DNA, 23 bp, Homo sapiens
gtttctaccggagagagaatgta

SEQ ID NO: 5930381 - DNA, 14 bp, Homo sapiens
gtttctacttcccc

SEQ ID NO: 5930382 - DNA, 19 bp, Homo sapiens
gtttctacttcccctggga

SEQ ID NO: 5930383 - DNA, 23 bp, Homo sapiens
gtttctagaattttatatcattg

SEQ ID NO: 5930384 - DNA, 16 bp, Homo sapiens
gtttctagactataaa

SEQ ID NO: 5930385 - DNA, 20 bp, Homo sapiens
gtttctagctctcacagaca

SEQ ID NO: 5930386 - DNA, 15 bp, Homo sapiens
gtttctataaatgac

SEQ ID NO: 5930387 - DNA, 23 bp, Homo sapiens
gtttctatacaaatataaatctt

SEQ ID NO: 5930388 - DNA, 22 bp, Homo sapiens
gtttctatgacacatgcaaggt

SEQ ID NO: 5930389 - DNA, 20 bp, Homo sapiens
gtttctatgagtggaaaaag

SEQ ID NO: 5930390 - DNA, 21 bp, Homo sapiens
gtttctatggattcacttcta

SEQ ID NO: 5930391 - DNA, 20 bp, Homo sapiens
gtttctatgtccaaacctgg

SEQ ID NO: 5930392 - DNA, 19 bp, Homo sapiens
gtttctatgtgtagggcgg

SEQ ID NO: 5930393 - DNA, 16 bp, Homo sapiens
gtttctattctgtcag

SEQ ID NO: 5930394 - DNA, 17 bp, Homo sapiens
gtttctatttagacact

SEQ ID NO: 5930395 - DNA, 23 bp, Homo sapiens
gtttctatttagttatttaagaa

SEQ ID NO: 5930396 - DNA, 13 bp, Homo sapiens
gtttctattttct

SEQ ID NO: 5930397 - DNA, 17 bp, Homo sapiens
gtttctcaaaagaggtt

SEQ ID NO: 5930398 - DNA, 21 bp, Homo sapiens
gtttctcaaaagaggttactt

SEQ ID NO: 5930399 - DNA, 14 bp, Homo sapiens
gtttctcaaagaaa

SEQ ID NO: 5930400 - DNA, 16 bp, Homo sapiens
gtttctcaaatctgct

SEQ ID NO: 5930401 - DNA, 14 bp, Homo sapiens
gtttctcaaatctt

SEQ ID NO: 5930402 - DNA, 21 bp, Homo sapiens
gtttctcaagtttaaagtcat

SEQ ID NO: 5930403 - DNA, 18 bp, Homo sapiens
gtttctcacattgctgta

SEQ ID NO: 5930404 - DNA, 18 bp, Homo sapiens
gtttctcagactggtctc

SEQ ID NO: 5930405 - DNA, 19 bp, Homo sapiens
gtttctcagctcccatttc

SEQ ID NO: 5930406 - DNA, 21 bp, Homo sapiens
gtttctcagggtcactgtcct

SEQ ID NO: 5930407 - DNA, 17 bp, Homo sapiens
gtttctcattaaactct

SEQ ID NO: 5930408 - DNA, 17 bp, Homo sapiens
gtttctcattttaaaca

SEQ ID NO: 5930409 - DNA, 19 bp, Homo sapiens
gtttctccccacaccctgg

SEQ ID NO: 5930410 - DNA, 17 bp, Homo sapiens
gtttctcccccatgttc

SEQ ID NO: 5930411 - DNA, 22 bp, Homo sapiens
gtttctccccctgggctctgcc

SEQ ID NO: 5930412 - DNA, 18 bp, Homo sapiens
gtttctcctgagctagga

SEQ ID NO: 5930413 - DNA, 19 bp, Homo sapiens
gtttctccttttcctatcc

SEQ ID NO: 5930414 - DNA, 22 bp, Homo sapiens
gtttctcggcaccagtgcctca

SEQ ID NO: 5930415 - DNA, 16 bp, Homo sapiens
gtttctctataaagta

SEQ ID NO: 5930416 - DNA, 21 bp, Homo sapiens
gtttctctcccaacgctgaag

SEQ ID NO: 5930417 - DNA, 19 bp, Homo sapiens
gtttctctgagctttgtta

SEQ ID NO: 5930418 - DNA, 17 bp, Homo sapiens
gtttctctgcctccagg

SEQ ID NO: 5930419 - DNA, 21 bp, Homo sapiens
gtttctctgccttcttccagg

SEQ ID NO: 5930420 - DNA, 13 bp, Homo sapiens
gtttctctgctgt

SEQ ID NO: 5930421 - DNA, 17 bp, Homo sapiens
gtttctctgctgtcaac

SEQ ID NO: 5930422 - DNA, 15 bp, Homo sapiens
gtttctctgctgttg

SEQ ID NO: 5930423 - DNA, 14 bp, Homo sapiens
gtttctctgtggct

SEQ ID NO: 5930424 - DNA, 13 bp, Homo sapiens
gtttctcttctcc

SEQ ID NO: 5930425 - DNA, 21 bp, Homo sapiens
gtttctcttctccccttccat

SEQ ID NO: 5930426 - DNA, 18 bp, Homo sapiens
gtttctcttgagctggcc

SEQ ID NO: 5930427 - DNA, 21 bp, Homo sapiens
gtttctctttccttggctccc

SEQ ID NO: 5930428 - DNA, 19 bp, Homo sapiens
gtttctgaaaattccagaa

SEQ ID NO: 5930429 - DNA, 15 bp, Homo sapiens
gtttctgaagtactt

SEQ ID NO: 5930430 - DNA, 18 bp, Homo sapiens
gtttctgacacaagatcc

SEQ ID NO: 5930431 - DNA, 21 bp, Homo sapiens
gtttctgacccaagaggtggg

SEQ ID NO: 5930432 - DNA, 13 bp, Homo sapiens
gtttctgagaaaa

SEQ ID NO: 5930433 - DNA, 17 bp, Homo sapiens
gtttctgagaaaagaac

SEQ ID NO: 5930434 - DNA, 13 bp, Homo sapiens
gtttctgagacca

SEQ ID NO: 5930435 - DNA, 13 bp, Homo sapiens
gtttctgagctaa

SEQ ID NO: 5930436 - DNA, 22 bp, Homo sapiens
gtttctgcagcccttgggcagt

SEQ ID NO: 5930437 - DNA, 14 bp, Homo sapiens
gtttctgcagtagt

SEQ ID NO: 5930438 - DNA, 22 bp, Homo sapiens
gtttctgcagtagtctctgtgc

SEQ ID NO: 5930439 - DNA, 15 bp, Homo sapiens
gtttctgcagtattc

SEQ ID NO: 5930440 - DNA, 18 bp, Homo sapiens
gtttctgcagtattctgt

SEQ ID NO: 5930441 - DNA, 20 bp, Homo sapiens
gtttctgcccagccctctgt

SEQ ID NO: 5930442 - DNA, 22 bp, Homo sapiens
gtttctgcccagccctctgtgg

SEQ ID NO: 5930443 - DNA, 22 bp, Homo sapiens
gtttctgccctgccagctgcag

SEQ ID NO: 5930444 - DNA, 13 bp, Homo sapiens
gtttctgcctggg

SEQ ID NO: 5930445 - DNA, 13 bp, Homo sapiens
gtttctgcgtgct

SEQ ID NO: 5930446 - DNA, 14 bp, Homo sapiens
gtttctgcgtgctt

SEQ ID NO: 5930447 - DNA, 16 bp, Homo sapiens
gtttctggaagactgc

SEQ ID NO: 5930448 - DNA, 13 bp, Homo sapiens
gtttctggacatt

SEQ ID NO: 5930449 - DNA, 14 bp, Homo sapiens
gtttctggatttca

SEQ ID NO: 5930450 - DNA, 18 bp, Homo sapiens
gtttctgggtccctgctc

SEQ ID NO: 5930451 - DNA, 16 bp, Homo sapiens
gtttctgggtcctgaa

SEQ ID NO: 5930452 - DNA, 19 bp, Homo sapiens
gtttctgggtcctgaagaa

SEQ ID NO: 5930453 - DNA, 18 bp, Homo sapiens
gtttctggtggtctgttg

SEQ ID NO: 5930454 - DNA, 10 bp, Homo sapiens
gtttctgtac

SEQ ID NO: 5930455 - DNA, 15 bp, Homo sapiens
gtttctgtacttttt

SEQ ID NO: 5930456 - DNA, 20 bp, Homo sapiens
gtttctgtactttttggcat

SEQ ID NO: 5930457 - DNA, 21 bp, Homo sapiens
gtttctgtcaagctggtgcta

SEQ ID NO: 5930458 - DNA, 20 bp, Homo sapiens
gtttctgtctgaattattct

SEQ ID NO: 5930459 - DNA, 18 bp, Homo sapiens
gtttctgtgaaattctca

SEQ ID NO: 5930460 - DNA, 13 bp, Homo sapiens
gtttctgtgcatg

SEQ ID NO: 5930461 - DNA, 15 bp, Homo sapiens
gtttctgtgtgtccg

SEQ ID NO: 5930462 - DNA, 14 bp, Homo sapiens
gtttctgttattaa

SEQ ID NO: 5930463 - DNA, 12 bp, Homo sapiens
gtttctgttcca

SEQ ID NO: 5930464 - DNA, 15 bp, Homo sapiens
gtttctgttccaaat

SEQ ID NO: 5930465 - DNA, 11 bp, Homo sapiens
gtttctgttct

SEQ ID NO: 5930466 - DNA, 12 bp, Homo sapiens
gtttctgttctg

SEQ ID NO: 5930467 - DNA, 13 bp, Homo sapiens
gtttctgttctgc

SEQ ID NO: 5930468 - DNA, 17 bp, Homo sapiens
gtttctgttctgtggaa

SEQ ID NO: 5930469 - DNA, 14 bp, Homo sapiens
gtttctgttggata

SEQ ID NO: 5930470 - DNA, 17 bp, Homo sapiens
gtttctgtttgattctt

SEQ ID NO: 5930471 - DNA, 16 bp, Homo sapiens
gtttcttaatttggaa

SEQ ID NO: 5930472 - DNA, 14 bp, Homo sapiens
gtttcttagctgca

SEQ ID NO: 5930473 - DNA, 13 bp, Homo sapiens
gtttcttagcttt

SEQ ID NO: 5930474 - DNA, 15 bp, Homo sapiens
gtttcttatagattt

SEQ ID NO: 5930475 - DNA, 14 bp, Homo sapiens
gtttcttattctct

SEQ ID NO: 5930476 - DNA, 15 bp, Homo sapiens
gtttcttcacttctt

SEQ ID NO: 5930477 - DNA, 12 bp, Homo sapiens
gtttcttcattt

SEQ ID NO: 5930478 - DNA, 13 bp, Homo sapiens
gtttcttccccaa

SEQ ID NO: 5930479 - DNA, 11 bp, Homo sapiens
gtttcttcctg

SEQ ID NO: 5930480 - DNA, 18 bp, Homo sapiens
gtttcttcctgccagcag

SEQ ID NO: 5930481 - DNA, 14 bp, Homo sapiens
gtttcttcctttct

SEQ ID NO: 5930482 - DNA, 21 bp, Homo sapiens
gtttcttctaaagaggaagcc

SEQ ID NO: 5930483 - DNA, 11 bp, Homo sapiens
gtttcttctct

SEQ ID NO: 5930484 - DNA, 22 bp, Homo sapiens
gtttcttctcttggtgaaataa

SEQ ID NO: 5930485 - DNA, 20 bp, Homo sapiens
gtttcttctgcgcctcaggc

SEQ ID NO: 5930486 - DNA, 23 bp, Homo sapiens
gtttcttcttcatgcttttgctt

SEQ ID NO: 5930487 - DNA, 14 bp, Homo sapiens
gtttcttctttcta

SEQ ID NO: 5930488 - DNA, 16 bp, Homo sapiens
gtttcttcttttcctt

SEQ ID NO: 5930489 - DNA, 15 bp, Homo sapiens
gtttcttgacaagct

SEQ ID NO: 5930490 - DNA, 14 bp, Homo sapiens
gtttcttgatgctc

SEQ ID NO: 5930491 - DNA, 11 bp, Homo sapiens
gtttcttgcaa

SEQ ID NO: 5930492 - DNA, 17 bp, Homo sapiens
gtttcttgcaagcatgc

SEQ ID NO: 5930493 - DNA, 24 bp, Homo sapiens
gtttcttgcactgaatatataaac

SEQ ID NO: 5930494 - DNA, 13 bp, Homo sapiens
gtttcttgcctca

SEQ ID NO: 5930495 - DNA, 23 bp, Homo sapiens
gtttcttgcctcatttttttcct

SEQ ID NO: 5930496 - DNA, 19 bp, Homo sapiens
gtttcttgccttttgttaa

SEQ ID NO: 5930497 - DNA, 20 bp, Homo sapiens
gtttcttgccttttgttaat

SEQ ID NO: 5930498 - DNA, 22 bp, Homo sapiens
gtttcttgctctctctccctgc

SEQ ID NO: 5930499 - DNA, 19 bp, Homo sapiens
gtttcttgcttgtacctct

SEQ ID NO: 5930500 - DNA, 14 bp, Homo sapiens
gtttcttgggaaaa

SEQ ID NO: 5930501 - DNA, 15 bp, Homo sapiens
gtttcttgggaaaat

SEQ ID NO: 5930502 - DNA, 13 bp, Homo sapiens
gtttcttggtaaa

SEQ ID NO: 5930503 - DNA, 14 bp, Homo sapiens
gtttcttgtgtaga

SEQ ID NO: 5930504 - DNA, 17 bp, Homo sapiens
gtttcttgtgtagattt

SEQ ID NO: 5930505 - DNA, 21 bp, Homo sapiens
gtttctttaaccttgtataaa

SEQ ID NO: 5930506 - DNA, 19 bp, Homo sapiens
gtttctttattttgtgtaa

SEQ ID NO: 5930507 - DNA, 17 bp, Homo sapiens
gtttctttcagatcatt

SEQ ID NO: 5930508 - DNA, 19 bp, Homo sapiens
gtttctttcctgccttctt

SEQ ID NO: 5930509 - DNA, 20 bp, Homo sapiens
gtttctttctctgaggacaa

SEQ ID NO: 5930510 - DNA, 15 bp, Homo sapiens
gtttctttctgttat

SEQ ID NO: 5930511 - DNA, 12 bp, Homo sapiens
gtttctttcttt

SEQ ID NO: 5930512 - DNA, 18 bp, Homo sapiens
gtttctttgaattttcat

SEQ ID NO: 5930513 - DNA, 21 bp, Homo sapiens
gtttctttgagggttccatgg

SEQ ID NO: 5930514 - DNA, 18 bp, Homo sapiens
gtttctttgtaatgaaaa

SEQ ID NO: 5930515 - DNA, 19 bp, Homo sapiens
gtttctttgtaatgaaaac

SEQ ID NO: 5930516 - DNA, 21 bp, Homo sapiens
gtttctttgtggtctgtgtca

SEQ ID NO: 5930517 - DNA, 20 bp, Homo sapiens
gtttcttttaatgtgaggaa

SEQ ID NO: 5930518 - DNA, 23 bp, Homo sapiens
gtttcttttcacattaggctgtt

SEQ ID NO: 5930519 - DNA, 18 bp, Homo sapiens
gtttcttttgtgttccta

SEQ ID NO: 5930520 - DNA, 18 bp, Homo sapiens
gtttcttttgtttggtaa

SEQ ID NO: 5930521 - DNA, 23 bp, Homo sapiens
gtttctttttacagcattgtctt

SEQ ID NO: 5930522 - DNA, 12 bp, Homo sapiens
gtttgaaaactg

SEQ ID NO: 5930523 - DNA, 13 bp, Homo sapiens
gtttgaaaatagt

SEQ ID NO: 5930524 - DNA, 13 bp, Homo sapiens
gtttgaaaatatt

SEQ ID NO: 5930525 - DNA, 21 bp, Homo sapiens
gtttgaaaattagagatcatg

SEQ ID NO: 5930526 - DNA, 15 bp, Homo sapiens
gtttgaaacaaagaa

SEQ ID NO: 5930527 - DNA, 17 bp, Homo sapiens
gtttgaaacaaagaagg

SEQ ID NO: 5930528 - DNA, 18 bp, Homo sapiens
gtttgaaacactcgtgtg

SEQ ID NO: 5930529 - DNA, 16 bp, Homo sapiens
gtttgaaagtaaaaac

SEQ ID NO: 5930530 - DNA, 18 bp, Homo sapiens
gtttgaaagtgaataaac

SEQ ID NO: 5930531 - DNA, 19 bp, Homo sapiens
gtttgaaagtgaataaact

SEQ ID NO: 5930532 - DNA, 18 bp, Homo sapiens
gtttgaaagttgtacatg

SEQ ID NO: 5930533 - DNA, 22 bp, Homo sapiens
gtttgaaagttgtacatgataa

SEQ ID NO: 5930534 - DNA, 22 bp, Homo sapiens
gtttgaaatagttcaaactgca

SEQ ID NO: 5930535 - DNA, 23 bp, Homo sapiens
gtttgaaatagttcaaactgcag

SEQ ID NO: 5930536 - DNA, 22 bp, Homo sapiens
gtttgaaatatggaactgtaat

SEQ ID NO: 5930537 - DNA, 12 bp, Homo sapiens
gtttgaaatgtc

SEQ ID NO: 5930538 - DNA, 14 bp, Homo sapiens
gtttgaaatgttta

SEQ ID NO: 5930539 - DNA, 16 bp, Homo sapiens
gtttgaaattctgaat

SEQ ID NO: 5930540 - DNA, 20 bp, Homo sapiens
gtttgaacagatatgttttt

SEQ ID NO: 5930541 - DNA, 17 bp, Homo sapiens
gtttgaactcacacttt

SEQ ID NO: 5930542 - DNA, 21 bp, Homo sapiens
gtttgaagacacagcctcccc

SEQ ID NO: 5930543 - DNA, 23 bp, Homo sapiens
gtttgaagacacagcctcccccg

SEQ ID NO: 5930544 - DNA, 23 bp, Homo sapiens
gttttaattccaagtgtttctgt

SEQ ID NO: 5930545 - DNA, 23 bp, Homo sapiens
gttttaattccaatatgatgact

SEQ ID NO: 5930546 - DNA, 13 bp, Homo sapiens
gttttaattccat

SEQ ID NO: 5930547 - DNA, 14 bp, Homo sapiens
gttttaattccatg

SEQ ID NO: 5930548 - DNA, 22 bp, Homo sapiens
gttttaattccatgtcagataa

SEQ ID NO: 5930549 - DNA, 16 bp, Homo sapiens
gttttaattgaaggaa

SEQ ID NO: 5930550 - DNA, 17 bp, Homo sapiens
gttttaattgaaggaaa

SEQ ID NO: 5930551 - DNA, 21 bp, Homo sapiens
gttttaatttaaacacctcct

SEQ ID NO: 5930552 - DNA, 22 bp, Homo sapiens
gttttacaaatttaattttgca

SEQ ID NO: 5930553 - DNA, 20 bp, Homo sapiens
gttttacaagttggagtcac

SEQ ID NO: 5930554 - DNA, 11 bp, Homo sapiens
gttttacaata

SEQ ID NO: 5930555 - DNA, 23 bp, Homo sapiens
gttttacaataaaatcttgaaaa

SEQ ID NO: 5930556 - DNA, 21 bp, Homo sapiens
gttttacaatgatttgtaaag

SEQ ID NO: 5930557 - DNA, 22 bp, Homo sapiens
gttttacagatttattcctttg

SEQ ID NO: 5930558 - DNA, 20 bp, Homo sapiens
gttttacattacaaatttct

SEQ ID NO: 5930559 - DNA, 21 bp, Homo sapiens
gttttacattgttgagctatt

SEQ ID NO: 5930560 - DNA, 13 bp, Homo sapiens
gttttacatttta

SEQ ID NO: 5930561 - DNA, 13 bp, Homo sapiens
gttttaccagctc

SEQ ID NO: 5930562 - DNA, 16 bp, Homo sapiens
gttttaccccagctcc

SEQ ID NO: 5930563 - DNA, 19 bp, Homo sapiens
gttttacgtgcaaacaacc

SEQ ID NO: 5930564 - DNA, 21 bp, Homo sapiens
gttttactcctttttattcat

SEQ ID NO: 5930565 - DNA, 18 bp, Homo sapiens
gttttactgatatggttc

SEQ ID NO: 5930566 - DNA, 13 bp, Homo sapiens
gttttactgcctg

SEQ ID NO: 5930567 - DNA, 14 bp, Homo sapiens
gttttactgcctgt

SEQ ID NO: 5930568 - DNA, 19 bp, Homo sapiens
gttttactgtcagattaaa

SEQ ID NO: 5930569 - DNA, 15 bp, Homo sapiens
gttttactgtctatt

SEQ ID NO: 5930570 - DNA, 14 bp, Homo sapiens
gttttactgtgaaa

SEQ ID NO: 5930571 - DNA, 17 bp, Homo sapiens
gttttactgttttaatt

SEQ ID NO: 5930572 - DNA, 20 bp, Homo sapiens
gttttactgttttaattgta

SEQ ID NO: 5930573 - DNA, 15 bp, Homo sapiens
gttttacttacaaaa

SEQ ID NO: 5930574 - DNA, 18 bp, Homo sapiens
gttttactttgtttttat

SEQ ID NO: 5930575 - DNA, 21 bp, Homo sapiens
gttttacttttaaactgtgta

SEQ ID NO: 5930576 - DNA, 12 bp, Homo sapiens
gttttacttttt

SEQ ID NO: 5930577 - DNA, 20 bp, Homo sapiens
gttttacttttttaacatgt

SEQ ID NO: 5930578 - DNA, 21 bp, Homo sapiens
gttttagaataaggaggagga

SEQ ID NO: 5930579 - DNA, 22 bp, Homo sapiens
gttttagacaaatactcatgtg

SEQ ID NO: 5930580 - DNA, 20 bp, Homo sapiens
gttttagagataaatattta

SEQ ID NO: 5930581 - DNA, 18 bp, Homo sapiens
gttttagaggcattgtta

SEQ ID NO: 5930582 - DNA, 12 bp, Homo sapiens
gttttagatgtt

SEQ ID NO: 5930583 - DNA, 18 bp, Homo sapiens
gttttagattattttatc

SEQ ID NO: 5930584 - DNA, 19 bp, Homo sapiens
gttttagattattttatct

SEQ ID NO: 5930585 - DNA, 20 bp, Homo sapiens
gttttagattttctggttct

SEQ ID NO: 5930586 - DNA, 15 bp, Homo sapiens
gttttagcagcactt

SEQ ID NO: 5930587 - DNA, 20 bp, Homo sapiens
gttttaggaaacttgtagaa

SEQ ID NO: 5930588 - DNA, 14 bp, Homo sapiens
gttttaggatactt

SEQ ID NO: 5930589 - DNA, 18 bp, Homo sapiens
gttttaggatacttaaca

SEQ ID NO: 5930590 - DNA, 20 bp, Homo sapiens
gttttaggatacttaacaaa

SEQ ID NO: 5930591 - DNA, 23 bp, Homo sapiens
gttttagggagtggttcctgtgg

SEQ ID NO: 5930592 - DNA, 16 bp, Homo sapiens
gttttaggttctaaag

SEQ ID NO: 5930593 - DNA, 13 bp, Homo sapiens
gttttagtgtctg

SEQ ID NO: 5930594 - DNA, 15 bp, Homo sapiens
gttttagttggtgct

SEQ ID NO: 5930595 - DNA, 13 bp, Homo sapiens
gttttagtttaaa

SEQ ID NO: 5930596 - DNA, 13 bp, Homo sapiens
gttttagtttctg

SEQ ID NO: 5930597 - DNA, 23 bp, Homo sapiens
gttttataaaccacttgagccta

SEQ ID NO: 5930598 - DNA, 21 bp, Homo sapiens
gttttataaggtctgacatca

SEQ ID NO: 5930599 - DNA, 16 bp, Homo sapiens
gttttataatgaaccc

SEQ ID NO: 5930600 - DNA, 22 bp, Homo sapiens
gttttataattttgtgaagcaa

SEQ ID NO: 5930601 - DNA, 14 bp, Homo sapiens
gttttatacaaaga

SEQ ID NO: 5930602 - DNA, 15 bp, Homo sapiens
gttttatacataaac

SEQ ID NO: 5930603 - DNA, 16 bp, Homo sapiens
gttttatacccttttt

SEQ ID NO: 5930604 - DNA, 19 bp, Homo sapiens
gttttataccctttttcat

SEQ ID NO: 5930605 - DNA, 18 bp, Homo sapiens
gttttatactgtacttaa

SEQ ID NO: 5930606 - DNA, 21 bp, Homo sapiens
gttttatagaaaacctgactt

SEQ ID NO: 5930607 - DNA, 15 bp, Homo sapiens
gttttatagcccggt

SEQ ID NO: 5930608 - DNA, 18 bp, Homo sapiens
gttttatagcctggactg

SEQ ID NO: 5930609 - DNA, 16 bp, Homo sapiens
gttttataggcagctg

SEQ ID NO: 5930610 - DNA, 13 bp, Homo sapiens
gttttatatacct

SEQ ID NO: 5930611 - DNA, 12 bp, Homo sapiens
gttttatatatt

SEQ ID NO: 5930612 - DNA, 19 bp, Homo sapiens
gttttatatattatatgga

SEQ ID NO: 5930613 - DNA, 15 bp, Homo sapiens
gttttatatattatg

SEQ ID NO: 5930614 - DNA, 14 bp, Homo sapiens
gttttatatcaaat

SEQ ID NO: 5930615 - DNA, 11 bp, Homo sapiens
gttttatcaag

SEQ ID NO: 5930616 - DNA, 18 bp, Homo sapiens
gttttatcacatgtatgt

SEQ ID NO: 5930617 - DNA, 22 bp, Homo sapiens
gttttatcacatgtatgttttg

SEQ ID NO: 5930618 - DNA, 22 bp, Homo sapiens
gttttatcatgacatgttatat

SEQ ID NO: 5930619 - DNA, 18 bp, Homo sapiens
gttttatcctccctttgg

SEQ ID NO: 5930620 - DNA, 17 bp, Homo sapiens
gttttatctctgtctac

SEQ ID NO: 5930621 - DNA, 22 bp, Homo sapiens
gttttatctgggtacaaataaa

SEQ ID NO: 5930622 - DNA, 17 bp, Homo sapiens
gttttatcttaaactgt

SEQ ID NO: 5930623 - DNA, 16 bp, Homo sapiens
gttttatgaaaccaac

SEQ ID NO: 5930624 - DNA, 18 bp, Homo sapiens
gttttatgagacttccta

SEQ ID NO: 5930625 - DNA, 16 bp, Homo sapiens
gttttatgcatgtaat

SEQ ID NO: 5930626 - DNA, 17 bp, Homo sapiens
gttttatggcatgattt

SEQ ID NO: 5930627 - DNA, 20 bp, Homo sapiens
gttttatggttacttcttct

SEQ ID NO: 5930628 - DNA, 19 bp, Homo sapiens
gttttatgtcatactctgt

SEQ ID NO: 5930629 - DNA, 17 bp, Homo sapiens
gttttatgtgaatgtgg

SEQ ID NO: 5930630 - DNA, 13 bp, Homo sapiens
gttttattacaaa

SEQ ID NO: 5930631 - DNA, 15 bp, Homo sapiens
gttttattactctca

SEQ ID NO: 5930632 - DNA, 23 bp, Homo sapiens
gttttattattatcgctttatgt

SEQ ID NO: 5930633 - DNA, 22 bp, Homo sapiens
gttttattcacttgtgtttgta

SEQ ID NO: 5930634 - DNA, 18 bp, Homo sapiens
gttttattctttgagaag

SEQ ID NO: 5930635 - DNA, 22 bp, Homo sapiens
gttttattgatgtgaaattaaa

SEQ ID NO: 5930636 - DNA, 21 bp, Homo sapiens
gttttattggggaattaaata

SEQ ID NO: 5930637 - DNA, 22 bp, Homo sapiens
gttttattgtccttcagagctc

SEQ ID NO: 5930638 - DNA, 16 bp, Homo sapiens
gttttatttaaatgct

SEQ ID NO: 5930639 - DNA, 18 bp, Homo sapiens
gttttatttaaatgcttt

SEQ ID NO: 5930640 - DNA, 22 bp, Homo sapiens
gttttatttaactgtgcagtga

SEQ ID NO: 5930641 - DNA, 19 bp, Homo sapiens
gttttatttacttctgtat

SEQ ID NO: 5930642 - DNA, 17 bp, Homo sapiens
gttttatttatatttat

SEQ ID NO: 5930643 - DNA, 18 bp, Homo sapiens
gttttatttatatttatt

SEQ ID NO: 5930644 - DNA, 14 bp, Homo sapiens
gttttattttatgt

SEQ ID NO: 5930645 - DNA, 21 bp, Homo sapiens
gttttattttcaaatctggtc

SEQ ID NO: 5930646 - DNA, 15 bp, Homo sapiens
gttttattttctaaa

SEQ ID NO: 5930647 - DNA, 23 bp, Homo sapiens
gttttattttggaattggtgtat

SEQ ID NO: 5930648 - DNA, 17 bp, Homo sapiens
gttttatttttaagaaa

SEQ ID NO: 5930649 - DNA, 15 bp, Homo sapiens
gttttcaaaaaaaca

SEQ ID NO: 5930650 - DNA, 15 bp, Homo sapiens
gttttcaaaacacat

SEQ ID NO: 5930651 - DNA, 16 bp, Homo sapiens
gttttcaaaacacata

SEQ ID NO: 5930652 - DNA, 17 bp, Homo sapiens
gttttcaaaataaaaat

SEQ ID NO: 5930653 - DNA, 16 bp, Homo sapiens
gttttcaaaatacttc

SEQ ID NO: 5930654 - DNA, 10 bp, Homo sapiens
gttttcaaag

SEQ ID NO: 5930655 - DNA, 14 bp, Homo sapiens
gttttcaaatggag

SEQ ID NO: 5930656 - DNA, 19 bp, Homo sapiens
gttttcaacaagcctgaaa

SEQ ID NO: 5930657 - DNA, 12 bp, Homo sapiens
gttttcaacagt

SEQ ID NO: 5930658 - DNA, 16 bp, Homo sapiens
gttttcaacctagaaa

SEQ ID NO: 5930659 - DNA, 15 bp, Homo sapiens
gttttcaagtcaaat

SEQ ID NO: 5930660 - DNA, 14 bp, Homo sapiens
gttttcaagttgca

SEQ ID NO: 5930661 - DNA, 19 bp, Homo sapiens
gttttcaatgaattaagaa

SEQ ID NO: 5930662 - DNA, 14 bp, Homo sapiens
gttttcaatgtgaa

SEQ ID NO: 5930663 - DNA, 20 bp, Homo sapiens
gttttcaatgttttcttttc

SEQ ID NO: 5930664 - DNA, 14 bp, Homo sapiens
gttttcacactgct

SEQ ID NO: 5930665 - DNA, 22 bp, Homo sapiens
gttttcacataaatgcagccca

SEQ ID NO: 5930666 - DNA, 17 bp, Homo sapiens
gttttcaccatctttct

SEQ ID NO: 5930667 - DNA, 18 bp, Homo sapiens
gttttcaccatctttcta

SEQ ID NO: 5930668 - DNA, 11 bp, Homo sapiens
gttttcactct

SEQ ID NO: 5930669 - DNA, 13 bp, Homo sapiens
gttttcacttcct

SEQ ID NO: 5930670 - DNA, 19 bp, Homo sapiens
gttttcagaaaaagaaatg

SEQ ID NO: 5930671 - DNA, 16 bp, Homo sapiens
gttttcagaagaaata

SEQ ID NO: 5930672 - DNA, 18 bp, Homo sapiens
gttttcagacctttgtct

SEQ ID NO: 5930673 - DNA, 23 bp, Homo sapiens
gttttcagattgtaaaggtaggt

SEQ ID NO: 5930674 - DNA, 21 bp, Homo sapiens
gttttcaggttttgtttttag

SEQ ID NO: 5930675 - DNA, 22 bp, Homo sapiens
gttttcagtcaagttccgtctc

SEQ ID NO: 5930676 - DNA, 16 bp, Homo sapiens
gttttcagtttgtata

SEQ ID NO: 5930677 - DNA, 16 bp, Homo sapiens
gttttcataacttgct

SEQ ID NO: 5930678 - DNA, 23 bp, Homo sapiens
gttttcataacttgctgaatttc

SEQ ID NO: 5930679 - DNA, 17 bp, Homo sapiens
gttttcatcctggcctc

SEQ ID NO: 5930680 - DNA, 21 bp, Homo sapiens
gttttcatgacagaatataca

SEQ ID NO: 5930681 - DNA, 21 bp, Homo sapiens
gttttcatggacagctgagca

SEQ ID NO: 5930682 - DNA, 21 bp, Homo sapiens
gttttcatggtgaaaatgtac

SEQ ID NO: 5930683 - DNA, 16 bp, Homo sapiens
gttttcattatctcaa

SEQ ID NO: 5930684 - DNA, 17 bp, Homo sapiens
gttttcattatgttcat

SEQ ID NO: 5930685 - DNA, 21 bp, Homo sapiens
gttttcattatgttcatgtaa

SEQ ID NO: 5930686 - DNA, 17 bp, Homo sapiens
gttttcattattttccc

SEQ ID NO: 5930687 - DNA, 22 bp, Homo sapiens
gttttcatttactctaaaaact

SEQ ID NO: 5930688 - DNA, 15 bp, Homo sapiens
gttttcattttactg

SEQ ID NO: 5930689 - DNA, 14 bp, Homo sapiens
gttttccaaaagta

SEQ ID NO: 5930690 - DNA, 13 bp, Homo sapiens
gttttccaagccc

SEQ ID NO: 5930691 - DNA, 14 bp, Homo sapiens
gttttccaagccct

SEQ ID NO: 5930692 - DNA, 14 bp, Homo sapiens
gttttccactgtgc

SEQ ID NO: 5930693 - DNA, 17 bp, Homo sapiens
gttttccaggtgtagct

SEQ ID NO: 5930694 - DNA, 16 bp, Homo sapiens
gttttccagtattgaa

SEQ ID NO: 5930695 - DNA, 15 bp, Homo sapiens
gttttccatgaaaac

SEQ ID NO: 5930696 - DNA, 20 bp, Homo sapiens
gttttccatgagtcccctgt

SEQ ID NO: 5930697 - DNA, 19 bp, Homo sapiens
gttttccatgatttagcaa

SEQ ID NO: 5930698 - DNA, 22 bp, Homo sapiens
gttttccatgatttagcaagca

SEQ ID NO: 5930699 - DNA, 13 bp, Homo sapiens
gttttcccacttt

SEQ ID NO: 5930700 - DNA, 21 bp, Homo sapiens
gttttccccaaaccataaaac

SEQ ID NO: 5930701 - DNA, 20 bp, Homo sapiens
gttttccccaattatcctcc

SEQ ID NO: 5930702 - DNA, 16 bp, Homo sapiens
gttttccccacattct

SEQ ID NO: 5930703 - DNA, 23 bp, Homo sapiens
gttttcccccagcaacgcccctc

SEQ ID NO: 5930704 - DNA, 15 bp, Homo sapiens
gttttccctgaagtt

SEQ ID NO: 5930705 - DNA, 16 bp, Homo sapiens
gttttcccttgcctta

SEQ ID NO: 5930706 - DNA, 22 bp, Homo sapiens
gttttcctataatataataaat

SEQ ID NO: 5930707 - DNA, 15 bp, Homo sapiens
gttttcctcagctct

SEQ ID NO: 5930708 - DNA, 17 bp, Homo sapiens
gttttcctcagctctag

SEQ ID NO: 5930709 - DNA, 23 bp, Homo sapiens
gttttcctcatcctttccctctc

SEQ ID NO: 5930710 - DNA, 13 bp, Homo sapiens
gttttcctccctt

SEQ ID NO: 5930711 - DNA, 15 bp, Homo sapiens
gttttcctcccttct

SEQ ID NO: 5930712 - DNA, 22 bp, Homo sapiens
gttttcctcccttctgctactg

SEQ ID NO: 5930713 - DNA, 21 bp, Homo sapiens
gttttcctcctgattctctta

SEQ ID NO: 5930714 - DNA, 20 bp, Homo sapiens
gttttcctctatacatctct

SEQ ID NO: 5930715 - DNA, 22 bp, Homo sapiens
gttttcctctatacatctctcc

SEQ ID NO: 5930716 - DNA, 24 bp, Homo sapiens
gttttcctctatacatctctcccc

SEQ ID NO: 5930717 - DNA, 13 bp, Homo sapiens
gttttcctgaaat

SEQ ID NO: 5930718 - DNA, 13 bp, Homo sapiens
gttttccttctgt

SEQ ID NO: 5930719 - DNA, 15 bp, Homo sapiens
gttttccttgctatt

SEQ ID NO: 5930720 - DNA, 16 bp, Homo sapiens
gttttcctttctcacc

SEQ ID NO: 5930721 - DNA, 21 bp, Homo sapiens
gtttttttaaaaaaagctaaa

SEQ ID NO: 5930722 - DNA, 15 bp, Homo sapiens
gtttttttaaatatt

SEQ ID NO: 5930723 - DNA, 20 bp, Homo sapiens
gtttttttagggtttctgat

SEQ ID NO: 5930724 - DNA, 14 bp, Homo sapiens
gtttttttatttct

SEQ ID NO: 5930725 - DNA, 16 bp, Homo sapiens
gtttttttcctgtttc

SEQ ID NO: 5930726 - DNA, 13 bp, Homo sapiens
gtttttttccttt

SEQ ID NO: 5930727 - DNA, 16 bp, Homo sapiens
gtttttttctttggct

SEQ ID NO: 5930728 - DNA, 18 bp, Homo sapiens
gtttttttctttggctgc

SEQ ID NO: 5930729 - DNA, 23 bp, Homo sapiens
gtttttttcttttttaattgaaa

SEQ ID NO: 5930730 - DNA, 12 bp, Homo sapiens
gtttttttgaga

SEQ ID NO: 5930731 - DNA, 20 bp, Homo sapiens
gtttttttggtcactccagt

SEQ ID NO: 5930732 - DNA, 21 bp, Homo sapiens
gtttttttggtgctataacat

SEQ ID NO: 5930733 - DNA, 17 bp, Homo sapiens
gtttttttgttattaaa

SEQ ID NO: 5930734 - DNA, 15 bp, Homo sapiens
gtttttttgttcata

SEQ ID NO: 5930735 - DNA, 13 bp, Homo sapiens
gttttttttaaaa

SEQ ID NO: 5930736 - DNA, 18 bp, Homo sapiens
gttttttttaaataaaag

SEQ ID NO: 5930737 - DNA, 17 bp, Homo sapiens
gttttttttaatgtgaa

SEQ ID NO: 5930738 - DNA, 13 bp, Homo sapiens
gttttttttctaa

SEQ ID NO: 5930739 - DNA, 20 bp, Homo sapiens
gttttttttgactaaagcta

SEQ ID NO: 5930740 - DNA, 14 bp, Homo sapiens
gttttttttgcagg

SEQ ID NO: 5930741 - DNA, 20 bp, Homo sapiens
gtttttttttatacactgta

SEQ ID NO: 5930742 - DNA, 19 bp, Homo sapiens
gtttttttttcctgtcctt

SEQ ID NO: 5930743 - DNA, 20 bp, Homo sapiens
gtttttttttcctgtccttc

SEQ ID NO: 5930744 - DNA, 19 bp, Homo sapiens
gttttttttttaagtgcaa

SEQ ID NO: 5930745 - DNA, 21 bp, Homo sapiens
gttttttttttcttgtctata

SEQ ID NO: 5930746 - DNA, 18 bp, Homo sapiens
gttttttttttgaaagtc

SEQ ID NO: 5930747 - DNA, 14 bp, Homo sapiens
gttttttttttgtt

SEQ ID NO: 5930748 - DNA, 16 bp, Homo sapiens
gttttttttttgtttg

SEQ ID NO: 5930749 - DNA, 22 bp, Homo sapiens
gtttttttttttaaaaaaagaa

SEQ ID NO: 5930750 - DNA, 23 bp, Homo sapiens
gtttttttttttaaaaaaagaaa

SEQ ID NO: 5930751 - DNA, 21 bp, Homo sapiens
gtttttttttttttaaataat

SEQ ID NO: 5930752 - DNA, 19 bp, Homo sapiens
gttttttttttttttttgg

SEQ ID NO: 5930753 - DNA, 21 bp, Homo sapiens
gttttttttttttttttggct

SEQ ID NO: 5930754 - DNA, 20 bp, Homo sapiens
taaaaaaaaaaaaaagcttt

SEQ ID NO: 5930755 - DNA, 17 bp, Homo sapiens
taaaaaaaaaaaagtta

SEQ ID NO: 5930756 - DNA, 18 bp, Homo sapiens
taaaaaaaaaaacaaagc

SEQ ID NO: 5930757 - DNA, 15 bp, Homo sapiens
taaaaaaaaaaatga

SEQ ID NO: 5930758 - DNA, 16 bp, Homo sapiens
taaaaaaaaaagtcac

SEQ ID NO: 5930759 - DNA, 20 bp, Homo sapiens
taaaaaaaaaatcagtgttt

SEQ ID NO: 5930760 - DNA, 18 bp, Homo sapiens
taaaaaaaaaattgggga

SEQ ID NO: 5930761 - DNA, 14 bp, Homo sapiens
taaaaaaaaagaat

SEQ ID NO: 5930762 - DNA, 22 bp, Homo sapiens
taaaaaaaaaggcatattgctt

SEQ ID NO: 5930763 - DNA, 15 bp, Homo sapiens
taaaaaaaaagttgg

SEQ ID NO: 5930764 - DNA, 16 bp, Homo sapiens
taaaaaaaaatcttgt

SEQ ID NO: 5930765 - DNA, 16 bp, Homo sapiens
taaaaaaaaatgcctt

SEQ ID NO: 5930766 - DNA, 18 bp, Homo sapiens
taaaaaaaaatgcctttg

SEQ ID NO: 5930767 - DNA, 18 bp, Homo sapiens
taaaaaaaacaaaaagaa

SEQ ID NO: 5930768 - DNA, 19 bp, Homo sapiens
taaaaaaaacaaaaagaac

SEQ ID NO: 5930769 - DNA, 22 bp, Homo sapiens
taaaaaaaacaaaaagaacaaa

SEQ ID NO: 5930770 - DNA, 14 bp, Homo sapiens
taaaaaaaagaaaa

SEQ ID NO: 5930771 - DNA, 15 bp, Homo sapiens
taaaaaaaagaaaaa

SEQ ID NO: 5930772 - DNA, 14 bp, Homo sapiens
taaaaaaaagaaac

SEQ ID NO: 5930773 - DNA, 17 bp, Homo sapiens
taaaaaaaagaaacttt

SEQ ID NO: 5930774 - DNA, 13 bp, Homo sapiens
taaaaaaaagaag

SEQ ID NO: 5930775 - DNA, 15 bp, Homo sapiens
taaaaaaaagaagag

SEQ ID NO: 5930776 - DNA, 21 bp, Homo sapiens
taaaaaaaatattctgtcatt

SEQ ID NO: 5930777 - DNA, 18 bp, Homo sapiens
taaaaaaaatccttgtga

SEQ ID NO: 5930778 - DNA, 22 bp, Homo sapiens
taaaaaaaatccttgtgactta

SEQ ID NO: 5930779 - DNA, 13 bp, Homo sapiens
taaaaaaaatgtg

SEQ ID NO: 5930780 - DNA, 18 bp, Homo sapiens
taaaaaaaatgtgaaatt

SEQ ID NO: 5930781 - DNA, 19 bp, Homo sapiens
taaaaaaaatgtgaaattt

SEQ ID NO: 5930782 - DNA, 15 bp, Homo sapiens
taaaaaaaatttgtg

SEQ ID NO: 5930783 - DNA, 11 bp, Homo sapiens
taaaaaaacaa

SEQ ID NO: 5930784 - DNA, 17 bp, Homo sapiens
taaaaaaacaaatgtta

SEQ ID NO: 5930785 - DNA, 21 bp, Homo sapiens
taaaaaaacaatcatttgctt

SEQ ID NO: 5930786 - DNA, 15 bp, Homo sapiens
taaaaaaacacaaaa

SEQ ID NO: 5930787 - DNA, 10 bp, Homo sapiens
taaaaaaaga

SEQ ID NO: 5930788 - DNA, 17 bp, Homo sapiens
taaaaaaagaagagaaa

SEQ ID NO: 5930789 - DNA, 12 bp, Homo sapiens
taaaaaaagcaa

SEQ ID NO: 5930790 - DNA, 13 bp, Homo sapiens
taaaaaaagcaaa

SEQ ID NO: 5930791 - DNA, 16 bp, Homo sapiens
taaaaaaagctaaatt

SEQ ID NO: 5930792 - DNA, 20 bp, Homo sapiens
taaaaaaagctaaattacat

SEQ ID NO: 5930793 - DNA, 14 bp, Homo sapiens
taaaaaaaggaaaa

SEQ ID NO: 5930794 - DNA, 18 bp, Homo sapiens
taaaaaaaggcattgttt

SEQ ID NO: 5930795 - DNA, 13 bp, Homo sapiens
taaaaaaagtgca

SEQ ID NO: 5930796 - DNA, 17 bp, Homo sapiens
taaaaaaagtgcatgat

SEQ ID NO: 5930797 - DNA, 17 bp, Homo sapiens
taaaaaaataaaacatt

SEQ ID NO: 5930798 - DNA, 15 bp, Homo sapiens
taaaaaaataaaata

SEQ ID NO: 5930799 - DNA, 22 bp, Homo sapiens
taaaaaaataagaagaatgctt

SEQ ID NO: 5930800 - DNA, 15 bp, Homo sapiens
taaaaaaataatata

SEQ ID NO: 5930801 - DNA, 13 bp, Homo sapiens
taaaaaaattggt

SEQ ID NO: 5930802 - DNA, 12 bp, Homo sapiens
taaaaaaatttg

SEQ ID NO: 5930803 - DNA, 16 bp, Homo sapiens
taaaaaaatttttgac

SEQ ID NO: 5930804 - DNA, 11 bp, Homo sapiens
taaaaaacaaa

SEQ ID NO: 5930805 - DNA, 13 bp, Homo sapiens
taaaaaacaagaa

SEQ ID NO: 5930806 - DNA, 17 bp, Homo sapiens
taaaaaacaattaactg

SEQ ID NO: 5930807 - DNA, 18 bp, Homo sapiens
taaaaaacactaaacatt

SEQ ID NO: 5930808 - DNA, 23 bp, Homo sapiens
taaaaaacatgtggttacacagt

SEQ ID NO: 5930809 - DNA, 17 bp, Homo sapiens
taaaaaactaaaaacta

SEQ ID NO: 5930810 - DNA, 21 bp, Homo sapiens
taaaaaactatctttttgctt

SEQ ID NO: 5930811 - DNA, 20 bp, Homo sapiens
taaaaaactgctgactgttt

SEQ ID NO: 5930812 - DNA, 16 bp, Homo sapiens
taaaaaactgtataag

SEQ ID NO: 5930813 - DNA, 21 bp, Homo sapiens
taaaaaactttctactcattt

SEQ ID NO: 5930814 - DNA, 12 bp, Homo sapiens
taaaaaagaaaa

SEQ ID NO: 5930815 - DNA, 16 bp, Homo sapiens
taaaaaagaaaacatt

SEQ ID NO: 5930816 - DNA, 12 bp, Homo sapiens
taaaaaagaaga

SEQ ID NO: 5930817 - DNA, 14 bp, Homo sapiens
taaaaaagaagcac

SEQ ID NO: 5930818 - DNA, 20 bp, Homo sapiens
taaaaaagaagcactttgat

SEQ ID NO: 5930819 - DNA, 18 bp, Homo sapiens
taaaaaagactgaacatg

SEQ ID NO: 5930820 - DNA, 15 bp, Homo sapiens
taaaaaagagttttc

SEQ ID NO: 5930821 - DNA, 11 bp, Homo sapiens
taaaaaagata

SEQ ID NO: 5930822 - DNA, 13 bp, Homo sapiens
taaaaaagataaa

SEQ ID NO: 5930823 - DNA, 17 bp, Homo sapiens
taaaaaagataaacaca

SEQ ID NO: 5930824 - DNA, 19 bp, Homo sapiens
taaaaaagatatattaaaa

SEQ ID NO: 5930825 - DNA, 21 bp, Homo sapiens
taaaaaagatggatttgacac

SEQ ID NO: 5930826 - DNA, 13 bp, Homo sapiens
taaaaaagattct

SEQ ID NO: 5930827 - DNA, 15 bp, Homo sapiens
taaaaaagattctac

SEQ ID NO: 5930828 - DNA, 12 bp, Homo sapiens
taaaaaagattt

SEQ ID NO: 5930829 - DNA, 13 bp, Homo sapiens
taaaaaagcaaaa

SEQ ID NO: 5930830 - DNA, 14 bp, Homo sapiens
taaaaaagccttcc

SEQ ID NO: 5930831 - DNA, 20 bp, Homo sapiens
taaaaaagcttaaaactttg

SEQ ID NO: 5930832 - DNA, 13 bp, Homo sapiens
taaaaaagtctct

SEQ ID NO: 5930833 - DNA, 17 bp, Homo sapiens
taaaaaagtctctattt

SEQ ID NO: 5930834 - DNA, 20 bp, Homo sapiens
taaaaaagtctctatttaaa

SEQ ID NO: 5930835 - DNA, 15 bp, Homo sapiens
taaaaaagtgttctg

SEQ ID NO: 5930836 - DNA, 18 bp, Homo sapiens
taaaaaagtgttctgtgt

SEQ ID NO: 5930837 - DNA, 17 bp, Homo sapiens
taaaaaagttaaatgtg

SEQ ID NO: 5930838 - DNA, 18 bp, Homo sapiens
taaaaaagttaaatgtgt

SEQ ID NO: 5930839 - DNA, 20 bp, Homo sapiens
taaaaaagttattatgtagc

SEQ ID NO: 5930840 - DNA, 17 bp, Homo sapiens
taaaaaagtttaaaatg

SEQ ID NO: 5930841 - DNA, 13 bp, Homo sapiens
taaaaaataaaaa

SEQ ID NO: 5930842 - DNA, 14 bp, Homo sapiens
taaaaaataaataa

SEQ ID NO: 5930843 - DNA, 20 bp, Homo sapiens
taaaaaataaataaaatgga

SEQ ID NO: 5930844 - DNA, 15 bp, Homo sapiens
taaaaaataaatata

SEQ ID NO: 5930845 - DNA, 13 bp, Homo sapiens
taaaaaataacat

SEQ ID NO: 5930846 - DNA, 22 bp, Homo sapiens
taaaaaataacatattcttgct

SEQ ID NO: 5930847 - DNA, 14 bp, Homo sapiens
taaaaaataactgt

SEQ ID NO: 5930848 - DNA, 21 bp, Homo sapiens
taaaaaataactgtgcactat

SEQ ID NO: 5930849 - DNA, 13 bp, Homo sapiens
taaaaaataagta

SEQ ID NO: 5930850 - DNA, 19 bp, Homo sapiens
taaaaaataataatacaag

SEQ ID NO: 5930851 - DNA, 17 bp, Homo sapiens
taaaaaataatctattt

SEQ ID NO: 5930852 - DNA, 22 bp, Homo sapiens
taaaaaatacaccacgaatttg

SEQ ID NO: 5930853 - DNA, 20 bp, Homo sapiens
taaaaaatacagtattattt

SEQ ID NO: 5930854 - DNA, 18 bp, Homo sapiens
taaaaaataccattgaaa

SEQ ID NO: 5930855 - DNA, 20 bp, Homo sapiens
taaaaaataccattgaaatc

SEQ ID NO: 5930856 - DNA, 19 bp, Homo sapiens
taaaaaatatatgtaatat

SEQ ID NO: 5930857 - DNA, 15 bp, Homo sapiens
taaaaaatattttaa

SEQ ID NO: 5930858 - DNA, 18 bp, Homo sapiens
taaaaaatattttaagaa

SEQ ID NO: 5930859 - DNA, 18 bp, Homo sapiens
taaaaaatattttctctg

SEQ ID NO: 5930860 - DNA, 18 bp, Homo sapiens
taaaaaatcaatcaatgg

SEQ ID NO: 5930861 - DNA, 16 bp, Homo sapiens
taaaaaatcagaacaa

SEQ ID NO: 5930862 - DNA, 14 bp, Homo sapiens
taaaaaatctgaag

SEQ ID NO: 5930863 - DNA, 17 bp, Homo sapiens
taaaaaatctgaagagg

SEQ ID NO: 5930864 - DNA, 15 bp, Homo sapiens
taaaaaatgaaaata

SEQ ID NO: 5930865 - DNA, 14 bp, Homo sapiens
taaaaaatgacaaa

SEQ ID NO: 5930866 - DNA, 15 bp, Homo sapiens
taaaaaatggaaaga

SEQ ID NO: 5930867 - DNA, 19 bp, Homo sapiens
taaaaaatggttcagaatt

SEQ ID NO: 5930868 - DNA, 13 bp, Homo sapiens
taaaaaatgtaaa

SEQ ID NO: 5930869 - DNA, 15 bp, Homo sapiens
taaaaaatgtatgct

SEQ ID NO: 5930870 - DNA, 21 bp, Homo sapiens
taaaaaatgtctatagagaaa

SEQ ID NO: 5930871 - DNA, 13 bp, Homo sapiens
taaaaaatgtctc

SEQ ID NO: 5930872 - DNA, 16 bp, Homo sapiens
taaaaaatgtcttctt

SEQ ID NO: 5930873 - DNA, 14 bp, Homo sapiens
taaaaaatgtgaaa

SEQ ID NO: 5930874 - DNA, 11 bp, Homo sapiens
taaaaaattaa

SEQ ID NO: 5930875 - DNA, 18 bp, Homo sapiens
taaaaaattaaaaatgaa

SEQ ID NO: 5930876 - DNA, 16 bp, Homo sapiens
taaaaaattagtttgt

SEQ ID NO: 5930877 - DNA, 16 bp, Homo sapiens
taaaaaattatggaat

SEQ ID NO: 5930878 - DNA, 17 bp, Homo sapiens
taaaaaattatggaata

SEQ ID NO: 5930879 - DNA, 24 bp, Homo sapiens
taaaaaattatggaatatcatctg

SEQ ID NO: 5930880 - DNA, 19 bp, Homo sapiens
taaaaaattcaaaccaatt

SEQ ID NO: 5930881 - DNA, 19 bp, Homo sapiens
taaaaaattcacataataa

SEQ ID NO: 5930882 - DNA, 14 bp, Homo sapiens
taaaaaatttatta

SEQ ID NO: 5930883 - DNA, 14 bp, Homo sapiens
taaaaaattttaaa

SEQ ID NO: 5930884 - DNA, 15 bp, Homo sapiens
taaaaaattttgtaa

SEQ ID NO: 5930885 - DNA, 17 bp, Homo sapiens
taaaaaattttgtaatt

SEQ ID NO: 5930886 - DNA, 23 bp, Homo sapiens
taaaaacaaaaacatcccaagat

SEQ ID NO: 5930887 - DNA, 15 bp, Homo sapiens
taaaaacaaaaggca

SEQ ID NO: 5930888 - DNA, 13 bp, Homo sapiens
taaaaacaacttt

SEQ ID NO: 5930889 - DNA, 18 bp, Homo sapiens
taaaaacaactttatacc

SEQ ID NO: 5930890 - DNA, 19 bp, Homo sapiens
taaaaacaactttcacttc

SEQ ID NO: 5930891 - DNA, 20 bp, Homo sapiens
taaaaacacaaaaaaaattt

SEQ ID NO: 5930892 - DNA, 21 bp, Homo sapiens
taaaaacacaccttaaaacat

SEQ ID NO: 5930893 - DNA, 21 bp, Homo sapiens
taaaaacactacctcttttga

SEQ ID NO: 5930894 - DNA, 17 bp, Homo sapiens
taaaaacagattctgat

SEQ ID NO: 5930895 - DNA, 16 bp, Homo sapiens
taaaaacagcattgct

SEQ ID NO: 5930896 - DNA, 13 bp, Homo sapiens
taaaaacaggaaa

SEQ ID NO: 5930897 - DNA, 14 bp, Homo sapiens
taaaaacaggaaaa

SEQ ID NO: 5930898 - DNA, 15 bp, Homo sapiens
taaaaacaggcagct

SEQ ID NO: 5930899 - DNA, 15 bp, Homo sapiens
taaaaacataaaata

SEQ ID NO: 5930900 - DNA, 15 bp, Homo sapiens
taaaaacatgaccac

SEQ ID NO: 5930901 - DNA, 20 bp, Homo sapiens
taaaaatccccaaaaaagcg

SEQ ID NO: 5930902 - DNA, 18 bp, Homo sapiens
taaaaatccctcttcctc

SEQ ID NO: 5930903 - DNA, 16 bp, Homo sapiens
taaaaatccttttgaa

SEQ ID NO: 5930904 - DNA, 19 bp, Homo sapiens
taaaaatctcaaatttcta

SEQ ID NO: 5930905 - DNA, 14 bp, Homo sapiens
taaaaatctgccac

SEQ ID NO: 5930906 - DNA, 16 bp, Homo sapiens
taaaaatctttcagaa

SEQ ID NO: 5930907 - DNA, 13 bp, Homo sapiens
taaaaatgaaaaa

SEQ ID NO: 5930908 - DNA, 16 bp, Homo sapiens
taaaaatgaaagtgac

SEQ ID NO: 5930909 - DNA, 22 bp, Homo sapiens
taaaaatgaaagtgactttaaa

SEQ ID NO: 5930910 - DNA, 14 bp, Homo sapiens
taaaaatgaaatta

SEQ ID NO: 5930911 - DNA, 18 bp, Homo sapiens
taaaaatgaaattattta

SEQ ID NO: 5930912 - DNA, 11 bp, Homo sapiens
taaaaatgaag

SEQ ID NO: 5930913 - DNA, 18 bp, Homo sapiens
taaaaatgaattgggaac

SEQ ID NO: 5930914 - DNA, 16 bp, Homo sapiens
taaaaatgagactttt

SEQ ID NO: 5930915 - DNA, 21 bp, Homo sapiens
taaaaatgagactttttcagt

SEQ ID NO: 5930916 - DNA, 15 bp, Homo sapiens
taaaaatgaggtact

SEQ ID NO: 5930917 - DNA, 22 bp, Homo sapiens
taaaaatgaggtactctcctgg

SEQ ID NO: 5930918 - DNA, 19 bp, Homo sapiens
taaaaatgatgataatcat

SEQ ID NO: 5930919 - DNA, 11 bp, Homo sapiens
taaaaatgcaa

SEQ ID NO: 5930920 - DNA, 13 bp, Homo sapiens
taaaaatgcattt

SEQ ID NO: 5930921 - DNA, 14 bp, Homo sapiens
taaaaatgcattta

SEQ ID NO: 5930922 - DNA, 18 bp, Homo sapiens
taaaaatgcatttaagtt

SEQ ID NO: 5930923 - DNA, 11 bp, Homo sapiens
taaaaatgcca

SEQ ID NO: 5930924 - DNA, 14 bp, Homo sapiens
taaaaatgctgctc

SEQ ID NO: 5930925 - DNA, 23 bp, Homo sapiens
taaaaatggaaaaataaacacta

SEQ ID NO: 5930926 - DNA, 17 bp, Homo sapiens
taaaaatggcaaatgca

SEQ ID NO: 5930927 - DNA, 22 bp, Homo sapiens
taaaaatggctcaagtagaaaa

SEQ ID NO: 5930928 - DNA, 19 bp, Homo sapiens
taaaaatgggacttctttt

SEQ ID NO: 5930929 - DNA, 23 bp, Homo sapiens
taaaaatgggacttcttttcaca

SEQ ID NO: 5930930 - DNA, 20 bp, Homo sapiens
taaaaatgggtgttattttt

SEQ ID NO: 5930931 - DNA, 12 bp, Homo sapiens
taaaaatggtgg

SEQ ID NO: 5930932 - DNA, 21 bp, Homo sapiens
taaaaatgtaaatattctata

SEQ ID NO: 5930933 - DNA, 20 bp, Homo sapiens
taaaaatgtaggctttcatg

SEQ ID NO: 5930934 - DNA, 22 bp, Homo sapiens
taaaaatgtatcccattggcta

SEQ ID NO: 5930935 - DNA, 16 bp, Homo sapiens
taaaaatgtcagaaaa

SEQ ID NO: 5930936 - DNA, 13 bp, Homo sapiens
taaaaatgtctta

SEQ ID NO: 5930937 - DNA, 16 bp, Homo sapiens
taaaaatgtctttcat

SEQ ID NO: 5930938 - DNA, 16 bp, Homo sapiens
taaaaatgttctcaaa

SEQ ID NO: 5930939 - DNA, 17 bp, Homo sapiens
taaaaatgttcttacac

SEQ ID NO: 5930940 - DNA, 15 bp, Homo sapiens
taaaaattaaaacct

SEQ ID NO: 5930941 - DNA, 17 bp, Homo sapiens
taaaaattaaagcagca

SEQ ID NO: 5930942 - DNA, 19 bp, Homo sapiens
taaaaattaaagcagcaaa

SEQ ID NO: 5930943 - DNA, 15 bp, Homo sapiens
taaaaattaaatatt

SEQ ID NO: 5930944 - DNA, 15 bp, Homo sapiens
taaaaattaatagtt

SEQ ID NO: 5930945 - DNA, 21 bp, Homo sapiens
taaaaattaatagttttatct

SEQ ID NO: 5930946 - DNA, 16 bp, Homo sapiens
taaaaattaattcttt

SEQ ID NO: 5930947 - DNA, 17 bp, Homo sapiens
taaaaattactgtgtta

SEQ ID NO: 5930948 - DNA, 19 bp, Homo sapiens
taaaaattagaacttgaat

SEQ ID NO: 5930949 - DNA, 13 bp, Homo sapiens
taaaaattagcat

SEQ ID NO: 5930950 - DNA, 14 bp, Homo sapiens
taaaaattatcaaa

SEQ ID NO: 5930951 - DNA, 18 bp, Homo sapiens
taaaaattatctttaaaa

SEQ ID NO: 5930952 - DNA, 14 bp, Homo sapiens
taaaaattccacca

SEQ ID NO: 5930953 - DNA, 14 bp, Homo sapiens
taaaaattccagaa

SEQ ID NO: 5930954 - DNA, 19 bp, Homo sapiens
taaaaattccagaatgaag

SEQ ID NO: 5930955 - DNA, 21 bp, Homo sapiens
taaaaattctagattaccatg

SEQ ID NO: 5930956 - DNA, 17 bp, Homo sapiens
taaaaattctagtctgt

SEQ ID NO: 5930957 - DNA, 15 bp, Homo sapiens
taaaaattgaaaaat

SEQ ID NO: 5930958 - DNA, 14 bp, Homo sapiens
taaaaattgataga

SEQ ID NO: 5930959 - DNA, 22 bp, Homo sapiens
taaaaattgccattggacagtt

SEQ ID NO: 5930960 - DNA, 17 bp, Homo sapiens
taaaaattggcatttta

SEQ ID NO: 5930961 - DNA, 14 bp, Homo sapiens
taaaaattgtctct

SEQ ID NO: 5930962 - DNA, 18 bp, Homo sapiens
taaaaattgtcttcatgt

SEQ ID NO: 5930963 - DNA, 19 bp, Homo sapiens
taaaaattgtcttcatgta

SEQ ID NO: 5930964 - DNA, 21 bp, Homo sapiens
taaaaattgttataattagag

SEQ ID NO: 5930965 - DNA, 23 bp, Homo sapiens
taaaaattgtttcaaaataaaaa

SEQ ID NO: 5930966 - DNA, 15 bp, Homo sapiens
taaaaattgtttctt

SEQ ID NO: 5930967 - DNA, 17 bp, Homo sapiens
taaaaattgtttcttga

SEQ ID NO: 5930968 - DNA, 22 bp, Homo sapiens
taaaaattgtttcttgacaagc

SEQ ID NO: 5930969 - DNA, 22 bp, Homo sapiens
taaaaatttatacaccagcaat

SEQ ID NO: 5930970 - DNA, 18 bp, Homo sapiens
taaaaatttttaaaatac

SEQ ID NO: 5930971 - DNA, 21 bp, Homo sapiens
taaaaatttttacaaaactgc

SEQ ID NO: 5930972 - DNA, 13 bp, Homo sapiens
taaaacaaaaaac

SEQ ID NO: 5930973 - DNA, 21 bp, Homo sapiens
taaaacaaaacaaaacaacat

SEQ ID NO: 5930974 - DNA, 20 bp, Homo sapiens
taaaacaaaaccaagccttg

SEQ ID NO: 5930975 - DNA, 21 bp, Homo sapiens
taaaacaaaaccaagccttgg

SEQ ID NO: 5930976 - DNA, 13 bp, Homo sapiens
taaaacaaaagag

SEQ ID NO: 5930977 - DNA, 20 bp, Homo sapiens
taaaacaaaagcattttgct

SEQ ID NO: 5930978 - DNA, 17 bp, Homo sapiens
taaaacaaaatctgaac

SEQ ID NO: 5930979 - DNA, 23 bp, Homo sapiens
taaaacaaaatctgaactctcaa

SEQ ID NO: 5930980 - DNA, 14 bp, Homo sapiens
taaaacaaaatgtt

SEQ ID NO: 5930981 - DNA, 14 bp, Homo sapiens
taaaacaaaatttg

SEQ ID NO: 5930982 - DNA, 15 bp, Homo sapiens
taaaacaaaatttga

SEQ ID NO: 5930983 - DNA, 23 bp, Homo sapiens
taaaacaaagccatgccaataaa

SEQ ID NO: 5930984 - DNA, 15 bp, Homo sapiens
taaaacaaagggaaa

SEQ ID NO: 5930985 - DNA, 16 bp, Homo sapiens
taaaacaaataaatat

SEQ ID NO: 5930986 - DNA, 17 bp, Homo sapiens
taaaacaaataaatatg

SEQ ID NO: 5930987 - DNA, 19 bp, Homo sapiens
taaaacaaatatacatttt

SEQ ID NO: 5930988 - DNA, 16 bp, Homo sapiens
taaaacaaatgaaatt

SEQ ID NO: 5930989 - DNA, 16 bp, Homo sapiens
taaaacaacaacaaaa

SEQ ID NO: 5930990 - DNA, 16 bp, Homo sapiens
taaaacaacagatgta

SEQ ID NO: 5930991 - DNA, 13 bp, Homo sapiens
taaaacaaccagt

SEQ ID NO: 5930992 - DNA, 17 bp, Homo sapiens
taaaacaagaaagtttc

SEQ ID NO: 5930993 - DNA, 17 bp, Homo sapiens
taaaacaagagaccact

SEQ ID NO: 5930994 - DNA, 12 bp, Homo sapiens
taaaacaagctg

SEQ ID NO: 5930995 - DNA, 20 bp, Homo sapiens
taaaacaagctgatagtgtt

SEQ ID NO: 5930996 - DNA, 23 bp, Homo sapiens
taaaacaataaaattttttttca

SEQ ID NO: 5930997 - DNA, 15 bp, Homo sapiens
taaaacaatccttac

SEQ ID NO: 5930998 - DNA, 23 bp, Homo sapiens
taaaacaatgaaggaaaacctca

SEQ ID NO: 5930999 - DNA, 19 bp, Homo sapiens
taaaacaatgaagtgtttt

SEQ ID NO: 5931000 - DNA, 23 bp, Homo sapiens
taaaacaatgaagtgttttacaa

SEQ ID NO: 5931001 - DNA, 13 bp, Homo sapiens
taaaacaatgaat

SEQ ID NO: 5931002 - DNA, 18 bp, Homo sapiens
taaaacaatgacttttaa

SEQ ID NO: 5931003 - DNA, 13 bp, Homo sapiens
taaaacaatgcca

SEQ ID NO: 5931004 - DNA, 17 bp, Homo sapiens
taaaacaatgccatgaa

SEQ ID NO: 5931005 - DNA, 21 bp, Homo sapiens
taaaacaatgccatgaacaaa

SEQ ID NO: 5931006 - DNA, 23 bp, Homo sapiens
taaaacaatgccatgaacaaatt

SEQ ID NO: 5931007 - DNA, 16 bp, Homo sapiens
taaaacaatgtcaagg

SEQ ID NO: 5931008 - DNA, 19 bp, Homo sapiens
taaaacaatgtttttcata

SEQ ID NO: 5931009 - DNA, 21 bp, Homo sapiens
taaaacaatgtttttcatact

SEQ ID NO: 5931010 - DNA, 22 bp, Homo sapiens
taaaacacaagactgtcattag

SEQ ID NO: 5931011 - DNA, 21 bp, Homo sapiens
taaaacacacctaagagaaaa

SEQ ID NO: 5931012 - DNA, 13 bp, Homo sapiens
taaaacacagagg

SEQ ID NO: 5931013 - DNA, 13 bp, Homo sapiens
taaaacacagctt

SEQ ID NO: 5931014 - DNA, 19 bp, Homo sapiens
taaaacacatacaaaagaa

SEQ ID NO: 5931015 - DNA, 14 bp, Homo sapiens
taaaacacatgata

SEQ ID NO: 5931016 - DNA, 22 bp, Homo sapiens
taaaacaccatcattaagaata

SEQ ID NO: 5931017 - DNA, 21 bp, Homo sapiens
taaaacacccttgaaaatata

SEQ ID NO: 5931018 - DNA, 10 bp, Homo sapiens
taaaacacta

SEQ ID NO: 5931019 - DNA, 15 bp, Homo sapiens
taaaacactcatccc

SEQ ID NO: 5931020 - DNA, 23 bp, Homo sapiens
taaaacacttattccctcatcct

SEQ ID NO: 5931021 - DNA, 18 bp, Homo sapiens
taaaacacttctgtcctg

SEQ ID NO: 5931022 - DNA, 16 bp, Homo sapiens
taaaacagaaaaggtt

SEQ ID NO: 5931023 - DNA, 14 bp, Homo sapiens
taaaacagaagcaa

SEQ ID NO: 5931024 - DNA, 16 bp, Homo sapiens
taaaacagaagcaaat

SEQ ID NO: 5931025 - DNA, 18 bp, Homo sapiens
taaaacagacaataattt

SEQ ID NO: 5931026 - DNA, 15 bp, Homo sapiens
taaaacagacactgg

SEQ ID NO: 5931027 - DNA, 19 bp, Homo sapiens
taaaacagacactggcatg

SEQ ID NO: 5931028 - DNA, 19 bp, Homo sapiens
taaaacagagtaatcttgt

SEQ ID NO: 5931029 - DNA, 19 bp, Homo sapiens
taaaacagatttgttcatt

SEQ ID NO: 5931030 - DNA, 16 bp, Homo sapiens
taaaacagcattagat

SEQ ID NO: 5931031 - DNA, 17 bp, Homo sapiens
taaaacagcattagata

SEQ ID NO: 5931032 - DNA, 12 bp, Homo sapiens
taaaacagctat

SEQ ID NO: 5931033 - DNA, 21 bp, Homo sapiens
taaaacaggtagaattatcta

SEQ ID NO: 5931034 - DNA, 22 bp, Homo sapiens
taaaacaggtagaattatctaa

SEQ ID NO: 5931035 - DNA, 21 bp, Homo sapiens
taaaacaggttataacagtgt

SEQ ID NO: 5931036 - DNA, 13 bp, Homo sapiens
taaaacagtatct

SEQ ID NO: 5931037 - DNA, 14 bp, Homo sapiens
taaaacagtattta

SEQ ID NO: 5931038 - DNA, 17 bp, Homo sapiens
taaaacagtatttattt

SEQ ID NO: 5931039 - DNA, 13 bp, Homo sapiens
taaaacagtcatc

SEQ ID NO: 5931040 - DNA, 12 bp, Homo sapiens
taaaacagtggt

SEQ ID NO: 5931041 - DNA, 21 bp, Homo sapiens
taaaacagtggttgttttttc

SEQ ID NO: 5931042 - DNA, 22 bp, Homo sapiens
taaaacagtgtatttggaaaat

SEQ ID NO: 5931043 - DNA, 16 bp, Homo sapiens
taaaacagtgtttcca

SEQ ID NO: 5931044 - DNA, 16 bp, Homo sapiens
taaaacataatagaat

SEQ ID NO: 5931045 - DNA, 21 bp, Homo sapiens
taaaacataatagaatttcct

SEQ ID NO: 5931046 - DNA, 16 bp, Homo sapiens
taaaacatagactgaa

SEQ ID NO: 5931047 - DNA, 18 bp, Homo sapiens
taaaacatatttcatttt

SEQ ID NO: 5931048 - DNA, 22 bp, Homo sapiens
taaaacatcactatcaatttta

SEQ ID NO: 5931049 - DNA, 17 bp, Homo sapiens
taaaacatcattactat

SEQ ID NO: 5931050 - DNA, 15 bp, Homo sapiens
taaaacatcattcct

SEQ ID NO: 5931051 - DNA, 16 bp, Homo sapiens
taaaacatcattcctt

SEQ ID NO: 5931052 - DNA, 20 bp, Homo sapiens
taaaacatggcaataaatgg

SEQ ID NO: 5931053 - DNA, 21 bp, Homo sapiens
taaaacatggtgcctatatct

SEQ ID NO: 5931054 - DNA, 22 bp, Homo sapiens
taaaacatggtgcctatatctg

SEQ ID NO: 5931055 - DNA, 16 bp, Homo sapiens
taaaacattaaaatat

SEQ ID NO: 5931056 - DNA, 13 bp, Homo sapiens
taaaacattaaga

SEQ ID NO: 5931057 - DNA, 19 bp, Homo sapiens
taaaacattacttatttaa

SEQ ID NO: 5931058 - DNA, 20 bp, Homo sapiens
taaaacattacttatttaac

SEQ ID NO: 5931059 - DNA, 21 bp, Homo sapiens
taaaacattagaagaaaacat

SEQ ID NO: 5931060 - DNA, 20 bp, Homo sapiens
taaaacattatagattttca

SEQ ID NO: 5931061 - DNA, 11 bp, Homo sapiens
taaaacattcc

SEQ ID NO: 5931062 - DNA, 16 bp, Homo sapiens
taaaacattggattat

SEQ ID NO: 5931063 - DNA, 20 bp, Homo sapiens
taaaacattggattatcctg

SEQ ID NO: 5931064 - DNA, 16 bp, Homo sapiens
taaaacatttcatgta

SEQ ID NO: 5931065 - DNA, 18 bp, Homo sapiens
taaaacattttaaatgga

SEQ ID NO: 5931066 - DNA, 19 bp, Homo sapiens
taaaacattttatttcttt

SEQ ID NO: 5931067 - DNA, 17 bp, Homo sapiens
taaaaccaaacatgctt

SEQ ID NO: 5931068 - DNA, 13 bp, Homo sapiens
taaaaccaaaggt

SEQ ID NO: 5931069 - DNA, 17 bp, Homo sapiens
taaaaccacagaacagt

SEQ ID NO: 5931070 - DNA, 18 bp, Homo sapiens
taaaaccacagctgggca

SEQ ID NO: 5931071 - DNA, 21 bp, Homo sapiens
taaaaccacagctgggcaggg

SEQ ID NO: 5931072 - DNA, 16 bp, Homo sapiens
taaaaccagaaagagg

SEQ ID NO: 5931073 - DNA, 12 bp, Homo sapiens
taaaaccaggct

SEQ ID NO: 5931074 - DNA, 16 bp, Homo sapiens
taaaaccagttttgct

SEQ ID NO: 5931075 - DNA, 19 bp, Homo sapiens
taaaaccatcctgtttgaa

SEQ ID NO: 5931076 - DNA, 15 bp, Homo sapiens
taaaaccatgcagct

SEQ ID NO: 5931077 - DNA, 16 bp, Homo sapiens
taaaaccatgcagctt

SEQ ID NO: 5931078 - DNA, 19 bp, Homo sapiens
taaaaccatgcagcttcat

SEQ ID NO: 5931079 - DNA, 17 bp, Homo sapiens
taaaatagcaaaagaag

SEQ ID NO: 5931080 - DNA, 21 bp, Homo sapiens
taaaatagcaaaagaagaagt

SEQ ID NO: 5931081 - DNA, 14 bp, Homo sapiens
taaaatagcaataa

SEQ ID NO: 5931082 - DNA, 17 bp, Homo sapiens
taaaatagcatactgtg

SEQ ID NO: 5931083 - DNA, 21 bp, Homo sapiens
taaaatagccacttaccttca

SEQ ID NO: 5931084 - DNA, 22 bp, Homo sapiens
taaaatagcggtacaagttctg

SEQ ID NO: 5931085 - DNA, 20 bp, Homo sapiens
taaaatagcgttcttgtaat

SEQ ID NO: 5931086 - DNA, 16 bp, Homo sapiens
taaaataggcatatta

SEQ ID NO: 5931087 - DNA, 19 bp, Homo sapiens
taaaataggggagcctgtg

SEQ ID NO: 5931088 - DNA, 15 bp, Homo sapiens
taaaatagtattgaa

SEQ ID NO: 5931089 - DNA, 18 bp, Homo sapiens
taaaatagtcatgattct

SEQ ID NO: 5931090 - DNA, 14 bp, Homo sapiens
taaaatagtctcat

SEQ ID NO: 5931091 - DNA, 22 bp, Homo sapiens
taaaatagtttaaaaatattcc

SEQ ID NO: 5931092 - DNA, 13 bp, Homo sapiens
taaaatagttttc

SEQ ID NO: 5931093 - DNA, 14 bp, Homo sapiens
taaaatagttttct

SEQ ID NO: 5931094 - DNA, 16 bp, Homo sapiens
taaaatagttttctaa

SEQ ID NO: 5931095 - DNA, 17 bp, Homo sapiens
taaaatagttttctaaa

SEQ ID NO: 5931096 - DNA, 23 bp, Homo sapiens
taaaatagttttgctttgttgaa

SEQ ID NO: 5931097 - DNA, 14 bp, Homo sapiens
taaaatataaacaa

SEQ ID NO: 5931098 - DNA, 19 bp, Homo sapiens
taaaatataaattaagact

SEQ ID NO: 5931099 - DNA, 18 bp, Homo sapiens
taaaatatacaaacatgt

SEQ ID NO: 5931100 - DNA, 20 bp, Homo sapiens
taaaatatacaaacatgtgg

SEQ ID NO: 5931101 - DNA, 20 bp, Homo sapiens
taaaatatagagacaggaca

SEQ ID NO: 5931102 - DNA, 20 bp, Homo sapiens
taaaatatataatatactaa

SEQ ID NO: 5931103 - DNA, 17 bp, Homo sapiens
taaaatatatagtgaaa

SEQ ID NO: 5931104 - DNA, 19 bp, Homo sapiens
taaaatatatatgttgatt

SEQ ID NO: 5931105 - DNA, 13 bp, Homo sapiens
taaaatatatgta

SEQ ID NO: 5931106 - DNA, 14 bp, Homo sapiens
taaaatatatgttc

SEQ ID NO: 5931107 - DNA, 22 bp, Homo sapiens
taaaatatattgctgcatttta

SEQ ID NO: 5931108 - DNA, 22 bp, Homo sapiens
taaaatatatttatgataacta

SEQ ID NO: 5931109 - DNA, 20 bp, Homo sapiens
taaaatatcataaagcattt

SEQ ID NO: 5931110 - DNA, 14 bp, Homo sapiens
taaaatatcattca

SEQ ID NO: 5931111 - DNA, 15 bp, Homo sapiens
taaaatatcattcag

SEQ ID NO: 5931112 - DNA, 15 bp, Homo sapiens
taaaatatcctcagg

SEQ ID NO: 5931113 - DNA, 15 bp, Homo sapiens
taaaatatctacctg

SEQ ID NO: 5931114 - DNA, 13 bp, Homo sapiens
taaaatatctata

SEQ ID NO: 5931115 - DNA, 18 bp, Homo sapiens
taaaatatctatttgaat

SEQ ID NO: 5931116 - DNA, 23 bp, Homo sapiens
taaaatatgcactaagtctcttt

SEQ ID NO: 5931117 - DNA, 23 bp, Homo sapiens
taaaatatgtccagaagagtcaa

SEQ ID NO: 5931118 - DNA, 17 bp, Homo sapiens
taaaatatgtgaagttt

SEQ ID NO: 5931119 - DNA, 19 bp, Homo sapiens
taaaatatgtgaagttttc

SEQ ID NO: 5931120 - DNA, 23 bp, Homo sapiens
taaaatattaacatattatttca

SEQ ID NO: 5931121 - DNA, 18 bp, Homo sapiens
taaaatattaatacagat

SEQ ID NO: 5931122 - DNA, 16 bp, Homo sapiens
taaaatattattgaac

SEQ ID NO: 5931123 - DNA, 13 bp, Homo sapiens
taaaatattcact

SEQ ID NO: 5931124 - DNA, 23 bp, Homo sapiens
taaaatattcatatattatcaaa

SEQ ID NO: 5931125 - DNA, 23 bp, Homo sapiens
taaaatattgtgtaagaatcact

SEQ ID NO: 5931126 - DNA, 16 bp, Homo sapiens
taaaatatttaacttt

SEQ ID NO: 5931127 - DNA, 17 bp, Homo sapiens
taaaatatttaactttt

SEQ ID NO: 5931128 - DNA, 12 bp, Homo sapiens
taaaatatttat

SEQ ID NO: 5931129 - DNA, 20 bp, Homo sapiens
taaaatatttataaatgaag

SEQ ID NO: 5931130 - DNA, 14 bp, Homo sapiens
taaaatatttatga

SEQ ID NO: 5931131 - DNA, 22 bp, Homo sapiens
taaaatatttgaatgaaaacat

SEQ ID NO: 5931132 - DNA, 13 bp, Homo sapiens
taaaatatttgcc

SEQ ID NO: 5931133 - DNA, 15 bp, Homo sapiens
taaaatattttccaa

SEQ ID NO: 5931134 - DNA, 14 bp, Homo sapiens
taaaatattttctg

SEQ ID NO: 5931135 - DNA, 16 bp, Homo sapiens
taaaatattttctgtg

SEQ ID NO: 5931136 - DNA, 18 bp, Homo sapiens
taaaatattttctgtgtg

SEQ ID NO: 5931137 - DNA, 19 bp, Homo sapiens
taaaatattttctgtgtgt

SEQ ID NO: 5931138 - DNA, 21 bp, Homo sapiens
taaaatattttctgtgtgttc

SEQ ID NO: 5931139 - DNA, 24 bp, Homo sapiens
taaaatattttctgtgtgttcctg

SEQ ID NO: 5931140 - DNA, 14 bp, Homo sapiens
taaaatattttctt

SEQ ID NO: 5931141 - DNA, 12 bp, Homo sapiens
taaaatattttg

SEQ ID NO: 5931142 - DNA, 16 bp, Homo sapiens
taaaatattttgaatc

SEQ ID NO: 5931143 - DNA, 23 bp, Homo sapiens
taaaatattttgttaacttttgt

SEQ ID NO: 5931144 - DNA, 12 bp, Homo sapiens
taaaatcaactt

SEQ ID NO: 5931145 - DNA, 18 bp, Homo sapiens
taaaatcaacttaacatg

SEQ ID NO: 5931146 - DNA, 17 bp, Homo sapiens
taaaatcaagtgcacct

SEQ ID NO: 5931147 - DNA, 17 bp, Homo sapiens
taaaatcaagttttaag

SEQ ID NO: 5931148 - DNA, 23 bp, Homo sapiens
taaaatcacaaactcatccatta

SEQ ID NO: 5931149 - DNA, 19 bp, Homo sapiens
taaaatcacattttaagtg

SEQ ID NO: 5931150 - DNA, 16 bp, Homo sapiens
taaaatcactaacatt

SEQ ID NO: 5931151 - DNA, 18 bp, Homo sapiens
taaaatcactaacattat

SEQ ID NO: 5931152 - DNA, 13 bp, Homo sapiens
taaaatcactata

SEQ ID NO: 5931153 - DNA, 18 bp, Homo sapiens
taaaatcactctcagtgc

SEQ ID NO: 5931154 - DNA, 11 bp, Homo sapiens
taaaatcactt

SEQ ID NO: 5931155 - DNA, 13 bp, Homo sapiens
taaaatcagccaa

SEQ ID NO: 5931156 - DNA, 21 bp, Homo sapiens
taaaatcagccaattatgtta

SEQ ID NO: 5931157 - DNA, 23 bp, Homo sapiens
taaaatcagccaattatgttaaa

SEQ ID NO: 5931158 - DNA, 21 bp, Homo sapiens
taaaatcagtgtgcttgcctt

SEQ ID NO: 5931159 - DNA, 15 bp, Homo sapiens
taaaatcataacatt

SEQ ID NO: 5931160 - DNA, 21 bp, Homo sapiens
taaaatcataagtatttggaa

SEQ ID NO: 5931161 - DNA, 18 bp, Homo sapiens
taaaatcatgtacatttc

SEQ ID NO: 5931162 - DNA, 20 bp, Homo sapiens
taaaatcattcaatatctga

SEQ ID NO: 5931163 - DNA, 15 bp, Homo sapiens
taaaatcattgtcaa

SEQ ID NO: 5931164 - DNA, 19 bp, Homo sapiens
taaaatccacagctatatc

SEQ ID NO: 5931165 - DNA, 15 bp, Homo sapiens
taaaatccatacatt

SEQ ID NO: 5931166 - DNA, 19 bp, Homo sapiens
taaaatccatacatttgtg

SEQ ID NO: 5931167 - DNA, 14 bp, Homo sapiens
taaaatccatttta

SEQ ID NO: 5931168 - DNA, 15 bp, Homo sapiens
taaaatcccaccaga

SEQ ID NO: 5931169 - DNA, 19 bp, Homo sapiens
taaaatccccatgcctgtg

SEQ ID NO: 5931170 - DNA, 16 bp, Homo sapiens
taaaatctaaaatttc

SEQ ID NO: 5931171 - DNA, 17 bp, Homo sapiens
taaaatctactccaaat

SEQ ID NO: 5931172 - DNA, 22 bp, Homo sapiens
taaaatctataacataaagaat

SEQ ID NO: 5931173 - DNA, 16 bp, Homo sapiens
taaaatctattctgtg

SEQ ID NO: 5931174 - DNA, 19 bp, Homo sapiens
taaaatctattttgtctga

SEQ ID NO: 5931175 - DNA, 13 bp, Homo sapiens
taaaatctcaact

SEQ ID NO: 5931176 - DNA, 12 bp, Homo sapiens
taaaatctctga

SEQ ID NO: 5931177 - DNA, 15 bp, Homo sapiens
taaaatctcttgatt

SEQ ID NO: 5931178 - DNA, 16 bp, Homo sapiens
taaaatctcttgatta

SEQ ID NO: 5931179 - DNA, 18 bp, Homo sapiens
taaaatctcttgattata

SEQ ID NO: 5931180 - DNA, 22 bp, Homo sapiens
taaaatctgatatgtattgttt

SEQ ID NO: 5931181 - DNA, 20 bp, Homo sapiens
taaaatctggcaaagttata

SEQ ID NO: 5931182 - DNA, 14 bp, Homo sapiens
taaaatctgtcacg

SEQ ID NO: 5931183 - DNA, 18 bp, Homo sapiens
taaaatctgtttttctca

SEQ ID NO: 5931184 - DNA, 13 bp, Homo sapiens
taaaatcttaaac

SEQ ID NO: 5931185 - DNA, 15 bp, Homo sapiens
taaaatcttattaaa

SEQ ID NO: 5931186 - DNA, 17 bp, Homo sapiens
taaaatcttattaaagt

SEQ ID NO: 5931187 - DNA, 18 bp, Homo sapiens
taaaatcttattaaagtt

SEQ ID NO: 5931188 - DNA, 19 bp, Homo sapiens
taaaatcttattaaagttt

SEQ ID NO: 5931189 - DNA, 23 bp, Homo sapiens
taaaatcttattaaagtttcaaa

SEQ ID NO: 5931190 - DNA, 15 bp, Homo sapiens
taaaatcttcagctg

SEQ ID NO: 5931191 - DNA, 18 bp, Homo sapiens
taaaatcttcagctggtg

SEQ ID NO: 5931192 - DNA, 19 bp, Homo sapiens
taaaatcttgatagctaaa

SEQ ID NO: 5931193 - DNA, 14 bp, Homo sapiens
taaaatcttgcatg

SEQ ID NO: 5931194 - DNA, 13 bp, Homo sapiens
taaaatcttggaa

SEQ ID NO: 5931195 - DNA, 17 bp, Homo sapiens
taaaatcttggaagtac

SEQ ID NO: 5931196 - DNA, 24 bp, Homo sapiens
taaaatcttggaagtacatgaata

SEQ ID NO: 5931197 - DNA, 19 bp, Homo sapiens
taaaatcttggcacagaaa

SEQ ID NO: 5931198 - DNA, 15 bp, Homo sapiens
taaaatcttgtcatg

SEQ ID NO: 5931199 - DNA, 20 bp, Homo sapiens
taaaatcttgtcatgtgtat

SEQ ID NO: 5931200 - DNA, 23 bp, Homo sapiens
taaaatcttgtcatgtgtataaa

SEQ ID NO: 5931201 - DNA, 14 bp, Homo sapiens
taaaatctttccat

SEQ ID NO: 5931202 - DNA, 18 bp, Homo sapiens
taaaatctttccatctca

SEQ ID NO: 5931203 - DNA, 13 bp, Homo sapiens
taaaatctttctt

SEQ ID NO: 5931204 - DNA, 21 bp, Homo sapiens
taaaatctttctttcttagaa

SEQ ID NO: 5931205 - DNA, 15 bp, Homo sapiens
taaaatctttctttg

SEQ ID NO: 5931206 - DNA, 12 bp, Homo sapiens
taaaatgaaaga

SEQ ID NO: 5931207 - DNA, 14 bp, Homo sapiens
taaaatgaaagatt

SEQ ID NO: 5931208 - DNA, 14 bp, Homo sapiens
taaaatgaaatgca

SEQ ID NO: 5931209 - DNA, 16 bp, Homo sapiens
taaaatgaaatgcatt

SEQ ID NO: 5931210 - DNA, 13 bp, Homo sapiens
taaaatgaacatc

SEQ ID NO: 5931211 - DNA, 23 bp, Homo sapiens
taaaatgaacatctcttgaaacc

SEQ ID NO: 5931212 - DNA, 15 bp, Homo sapiens
taaaatgaacatttt

SEQ ID NO: 5931213 - DNA, 14 bp, Homo sapiens
taaaatgaagcaat

SEQ ID NO: 5931214 - DNA, 18 bp, Homo sapiens
taaaatgaagcaatttat

SEQ ID NO: 5931215 - DNA, 13 bp, Homo sapiens
taaaatgaataat

SEQ ID NO: 5931216 - DNA, 12 bp, Homo sapiens
taaaatgaattt

SEQ ID NO: 5931217 - DNA, 17 bp, Homo sapiens
taaaatgacaaagccat

SEQ ID NO: 5931218 - DNA, 12 bp, Homo sapiens
taaaatgacagc

SEQ ID NO: 5931219 - DNA, 15 bp, Homo sapiens
taaaatgactactta

SEQ ID NO: 5931220 - DNA, 20 bp, Homo sapiens
taaaatgactacttagcatc

SEQ ID NO: 5931221 - DNA, 18 bp, Homo sapiens
taaaatgagctacttctt

SEQ ID NO: 5931222 - DNA, 20 bp, Homo sapiens
taaaatgagctacttcttat

SEQ ID NO: 5931223 - DNA, 12 bp, Homo sapiens
taaaatgaggat

SEQ ID NO: 5931224 - DNA, 13 bp, Homo sapiens
taaaatgaggcag

SEQ ID NO: 5931225 - DNA, 19 bp, Homo sapiens
taaaatgagggacttccct

SEQ ID NO: 5931226 - DNA, 23 bp, Homo sapiens
taaaatgagtcacttacttcata

SEQ ID NO: 5931227 - DNA, 16 bp, Homo sapiens
taaaatgatgttatac

SEQ ID NO: 5931228 - DNA, 16 bp, Homo sapiens
taaaatgattgtagta

SEQ ID NO: 5931229 - DNA, 17 bp, Homo sapiens
taaaatgatttgtagtg

SEQ ID NO: 5931230 - DNA, 15 bp, Homo sapiens
taaaatgattttatc

SEQ ID NO: 5931231 - DNA, 19 bp, Homo sapiens
taaaatgcaaaaaatctta

SEQ ID NO: 5931232 - DNA, 15 bp, Homo sapiens
taaaatgcaaatgaa

SEQ ID NO: 5931233 - DNA, 17 bp, Homo sapiens
taaaatgcaaatgaatc

SEQ ID NO: 5931234 - DNA, 19 bp, Homo sapiens
taaaatgcaaatgaatcat

SEQ ID NO: 5931235 - DNA, 20 bp, Homo sapiens
taaaatgcaaatgaatcatt

SEQ ID NO: 5931236 - DNA, 21 bp, Homo sapiens
taaaatgcaaatgaatcattg

SEQ ID NO: 5931237 - DNA, 22 bp, Homo sapiens
taaaatgcaaatgaatcattgt

SEQ ID NO: 5931238 - DNA, 20 bp, Homo sapiens
taaaatgcaacatgtgtact

SEQ ID NO: 5931239 - DNA, 18 bp, Homo sapiens
taaaatgcaatatttgta

SEQ ID NO: 5931240 - DNA, 15 bp, Homo sapiens
taaaatgcaatgtaa

SEQ ID NO: 5931241 - DNA, 13 bp, Homo sapiens
taaaatgcactga

SEQ ID NO: 5931242 - DNA, 19 bp, Homo sapiens
taaaatgcagtccagaata

SEQ ID NO: 5931243 - DNA, 18 bp, Homo sapiens
taaaatgcatactgttga

SEQ ID NO: 5931244 - DNA, 15 bp, Homo sapiens
taaaatgcatatttc

SEQ ID NO: 5931245 - DNA, 19 bp, Homo sapiens
taaaatgcatgattttgta

SEQ ID NO: 5931246 - DNA, 16 bp, Homo sapiens
taaaatgcattgaaag

SEQ ID NO: 5931247 - DNA, 16 bp, Homo sapiens
taaaatgccatagttt

SEQ ID NO: 5931248 - DNA, 20 bp, Homo sapiens
taaaatgccatagtttgtga

SEQ ID NO: 5931249 - DNA, 18 bp, Homo sapiens
taaaatgcccatttcgaa

SEQ ID NO: 5931250 - DNA, 19 bp, Homo sapiens
taaaatgcccatttcgaag

SEQ ID NO: 5931251 - DNA, 21 bp, Homo sapiens
taaaatgcctcagtgtatttg

SEQ ID NO: 5931252 - DNA, 12 bp, Homo sapiens
taaaatgcgaaa

SEQ ID NO: 5931253 - DNA, 21 bp, Homo sapiens
taaaatgcgaaattattggtt

SEQ ID NO: 5931254 - DNA, 14 bp, Homo sapiens
taaaatgctaggtt

SEQ ID NO: 5931255 - DNA, 16 bp, Homo sapiens
taaaatgctaggttct

SEQ ID NO: 5931256 - DNA, 17 bp, Homo sapiens
taaaatgctaggttcta

SEQ ID NO: 5931257 - DNA, 12 bp, Homo sapiens
taaacatgtgtt

SEQ ID NO: 5931258 - DNA, 17 bp, Homo sapiens
taaacattaaaaatgga

SEQ ID NO: 5931259 - DNA, 17 bp, Homo sapiens
taaacattaaacactgt

SEQ ID NO: 5931260 - DNA, 20 bp, Homo sapiens
taaacattaaacactgtaat

SEQ ID NO: 5931261 - DNA, 15 bp, Homo sapiens
taaacattaaatgtc

SEQ ID NO: 5931262 - DNA, 21 bp, Homo sapiens
taaacattaaatgtcttatat

SEQ ID NO: 5931263 - DNA, 19 bp, Homo sapiens
taaacattaagtaaatgct

SEQ ID NO: 5931264 - DNA, 22 bp, Homo sapiens
taaacattaatagcagcctttc

SEQ ID NO: 5931265 - DNA, 14 bp, Homo sapiens
taaacattaatatt

SEQ ID NO: 5931266 - DNA, 19 bp, Homo sapiens
taaacattaatatttacca

SEQ ID NO: 5931267 - DNA, 16 bp, Homo sapiens
taaacattaattggag

SEQ ID NO: 5931268 - DNA, 22 bp, Homo sapiens
taaacattaattttgtgcattc

SEQ ID NO: 5931269 - DNA, 21 bp, Homo sapiens
taaacattacggtacagacat

SEQ ID NO: 5931270 - DNA, 19 bp, Homo sapiens
taaacattattaagtaact

SEQ ID NO: 5931271 - DNA, 20 bp, Homo sapiens
taaacattcctccagcctcc

SEQ ID NO: 5931272 - DNA, 20 bp, Homo sapiens
taaacattggtatatttcca

SEQ ID NO: 5931273 - DNA, 13 bp, Homo sapiens
taaacatttcctt

SEQ ID NO: 5931274 - DNA, 14 bp, Homo sapiens
taaacatttgccaa

SEQ ID NO: 5931275 - DNA, 24 bp, Homo sapiens
taaacatttgccaaaaattcatgc

SEQ ID NO: 5931276 - DNA, 23 bp, Homo sapiens
taaacatttgtaaaaatactgtt

SEQ ID NO: 5931277 - DNA, 10 bp, Homo sapiens
taaacatttt

SEQ ID NO: 5931278 - DNA, 15 bp, Homo sapiens
taaacattttattta

SEQ ID NO: 5931279 - DNA, 12 bp, Homo sapiens
taaacatttttt

SEQ ID NO: 5931280 - DNA, 17 bp, Homo sapiens
taaacattttttaagaa

SEQ ID NO: 5931281 - DNA, 18 bp, Homo sapiens
taaacattttttcttcaa

SEQ ID NO: 5931282 - DNA, 22 bp, Homo sapiens
taaacattttttttaaaaatta

SEQ ID NO: 5931283 - DNA, 15 bp, Homo sapiens
taaaccaaaaacatt

SEQ ID NO: 5931284 - DNA, 16 bp, Homo sapiens
taaaccaaaaacattt

SEQ ID NO: 5931285 - DNA, 16 bp, Homo sapiens
taaaccaaaaactgaa

SEQ ID NO: 5931286 - DNA, 14 bp, Homo sapiens
taaaccaaaaccaa

SEQ ID NO: 5931287 - DNA, 15 bp, Homo sapiens
taaaccaaacccagc

SEQ ID NO: 5931288 - DNA, 20 bp, Homo sapiens
taaaccaaacccagccactg

SEQ ID NO: 5931289 - DNA, 22 bp, Homo sapiens
taaaccaaatatgttaaagttt

SEQ ID NO: 5931290 - DNA, 20 bp, Homo sapiens
taaaccaactctaatattgc

SEQ ID NO: 5931291 - DNA, 21 bp, Homo sapiens
taaaccaagattatgtgactt

SEQ ID NO: 5931292 - DNA, 16 bp, Homo sapiens
taaaccaataaaacaa

SEQ ID NO: 5931293 - DNA, 12 bp, Homo sapiens
taaaccaatcat

SEQ ID NO: 5931294 - DNA, 17 bp, Homo sapiens
taaaccaatgaacgaag

SEQ ID NO: 5931295 - DNA, 15 bp, Homo sapiens
taaaccacaaaagtt

SEQ ID NO: 5931296 - DNA, 21 bp, Homo sapiens
taaaccacaaaagttgtttaa

SEQ ID NO: 5931297 - DNA, 22 bp, Homo sapiens
taaaccacacacacaaggtgct

SEQ ID NO: 5931298 - DNA, 14 bp, Homo sapiens
taaaccacataatt

SEQ ID NO: 5931299 - DNA, 20 bp, Homo sapiens
taaaccactaatgcttgcca

SEQ ID NO: 5931300 - DNA, 13 bp, Homo sapiens
taaaccactgaaa

SEQ ID NO: 5931301 - DNA, 22 bp, Homo sapiens
taaaccacttaaacgaagagtt

SEQ ID NO: 5931302 - DNA, 18 bp, Homo sapiens
taaaccacttctctgctg

SEQ ID NO: 5931303 - DNA, 20 bp, Homo sapiens
taaaccacttctctgctgcc

SEQ ID NO: 5931304 - DNA, 22 bp, Homo sapiens
taaaccagaaaaaataaatgtt

SEQ ID NO: 5931305 - DNA, 22 bp, Homo sapiens
taaaccagaaaggtgattccag

SEQ ID NO: 5931306 - DNA, 17 bp, Homo sapiens
taaaccagcagaaaagt

SEQ ID NO: 5931307 - DNA, 22 bp, Homo sapiens
taaaccagcagaaaagtgctta

SEQ ID NO: 5931308 - DNA, 16 bp, Homo sapiens
taaaccagggatgtct

SEQ ID NO: 5931309 - DNA, 13 bp, Homo sapiens
taaaccagtttaa

SEQ ID NO: 5931310 - DNA, 19 bp, Homo sapiens
taaaccagtttagatttca

SEQ ID NO: 5931311 - DNA, 18 bp, Homo sapiens
taaaccataaaaagctga

SEQ ID NO: 5931312 - DNA, 19 bp, Homo sapiens
taaaccataaaaagctgac

SEQ ID NO: 5931313 - DNA, 20 bp, Homo sapiens
taaaccataaaataaataat

SEQ ID NO: 5931314 - DNA, 22 bp, Homo sapiens
taaaccatggccaattcagttt

SEQ ID NO: 5931315 - DNA, 12 bp, Homo sapiens
taaaccattgga

SEQ ID NO: 5931316 - DNA, 19 bp, Homo sapiens
taaaccatttttgttactc

SEQ ID NO: 5931317 - DNA, 14 bp, Homo sapiens
taaacccaaaatat

SEQ ID NO: 5931318 - DNA, 15 bp, Homo sapiens
taaacccaaaatata

SEQ ID NO: 5931319 - DNA, 16 bp, Homo sapiens
taaacccaaaatatat

SEQ ID NO: 5931320 - DNA, 22 bp, Homo sapiens
taaacccacataaacacttctc

SEQ ID NO: 5931321 - DNA, 17 bp, Homo sapiens
taaacccagatggtttc

SEQ ID NO: 5931322 - DNA, 19 bp, Homo sapiens
taaacccaggaggcggagg

SEQ ID NO: 5931323 - DNA, 15 bp, Homo sapiens
taaacccatacaatg

SEQ ID NO: 5931324 - DNA, 17 bp, Homo sapiens
taaacccatacaatgta

SEQ ID NO: 5931325 - DNA, 23 bp, Homo sapiens
taaacccattttagtcacttttt

SEQ ID NO: 5931326 - DNA, 16 bp, Homo sapiens
taaacccctcagacag

SEQ ID NO: 5931327 - DNA, 17 bp, Homo sapiens
taaacccctgggtaact

SEQ ID NO: 5931328 - DNA, 16 bp, Homo sapiens
taaaccctcagagcct

SEQ ID NO: 5931329 - DNA, 14 bp, Homo sapiens
taaaccctctgtga

SEQ ID NO: 5931330 - DNA, 20 bp, Homo sapiens
taaaccctgccccacttctc

SEQ ID NO: 5931331 - DNA, 15 bp, Homo sapiens
taaaccgataatgca

SEQ ID NO: 5931332 - DNA, 16 bp, Homo sapiens
taaaccggatcctgtt

SEQ ID NO: 5931333 - DNA, 15 bp, Homo sapiens
taaacctaatattca

SEQ ID NO: 5931334 - DNA, 17 bp, Homo sapiens
taaacctaattgtggta

SEQ ID NO: 5931335 - DNA, 21 bp, Homo sapiens
taaacctaattgtggtagaaa

SEQ ID NO: 5931336 - DNA, 11 bp, Homo sapiens
taaacctacct

SEQ ID NO: 5931337 - DNA, 21 bp, Homo sapiens
taaacctaggacttccgagct

SEQ ID NO: 5931338 - DNA, 19 bp, Homo sapiens
taaacctagtaaaaccttg

SEQ ID NO: 5931339 - DNA, 23 bp, Homo sapiens
taaacctatctgtattggcagca

SEQ ID NO: 5931340 - DNA, 18 bp, Homo sapiens
taaacctcaaaatgtcta

SEQ ID NO: 5931341 - DNA, 15 bp, Homo sapiens
taaacctgaaatata

SEQ ID NO: 5931342 - DNA, 13 bp, Homo sapiens
taaacctgaagat

SEQ ID NO: 5931343 - DNA, 16 bp, Homo sapiens
taaacctggagatgat

SEQ ID NO: 5931344 - DNA, 15 bp, Homo sapiens
taaacctgtgcctcc

SEQ ID NO: 5931345 - DNA, 20 bp, Homo sapiens
taaacctgtgctttcatgtt

SEQ ID NO: 5931346 - DNA, 19 bp, Homo sapiens
taaacctgttcctgactgt

SEQ ID NO: 5931347 - DNA, 21 bp, Homo sapiens
taaacctgttcctgactgttc

SEQ ID NO: 5931348 - DNA, 14 bp, Homo sapiens
taaacctgttcttc

SEQ ID NO: 5931349 - DNA, 16 bp, Homo sapiens
taaaccttagtactga

SEQ ID NO: 5931350 - DNA, 13 bp, Homo sapiens
taaacctttaatg

SEQ ID NO: 5931351 - DNA, 23 bp, Homo sapiens
taaacctttccattttacgtttt

SEQ ID NO: 5931352 - DNA, 20 bp, Homo sapiens
taaacctttttcttgatctt

SEQ ID NO: 5931353 - DNA, 22 bp, Homo sapiens
taaacgaaacaaagacaattta

SEQ ID NO: 5931354 - DNA, 20 bp, Homo sapiens
taaacgatatatgtaaatat

SEQ ID NO: 5931355 - DNA, 23 bp, Homo sapiens
taaacgatatatgtaaatataca

SEQ ID NO: 5931356 - DNA, 15 bp, Homo sapiens
taaacgatgttgtga

SEQ ID NO: 5931357 - DNA, 22 bp, Homo sapiens
taaacgattagtgatgtcctta

SEQ ID NO: 5931358 - DNA, 16 bp, Homo sapiens
taaacgatttttaaaa

SEQ ID NO: 5931359 - DNA, 21 bp, Homo sapiens
taaacgatttttaaaatgtac

SEQ ID NO: 5931360 - DNA, 20 bp, Homo sapiens
taaacgcagaagagggggag

SEQ ID NO: 5931361 - DNA, 13 bp, Homo sapiens
taaacggattatt

SEQ ID NO: 5931362 - DNA, 19 bp, Homo sapiens
taaacggattattttttca

SEQ ID NO: 5931363 - DNA, 20 bp, Homo sapiens
taaacggattattttttcag

SEQ ID NO: 5931364 - DNA, 18 bp, Homo sapiens
taaacggcccaggccagg

SEQ ID NO: 5931365 - DNA, 16 bp, Homo sapiens
taaacggttcctggtg

SEQ ID NO: 5931366 - DNA, 17 bp, Homo sapiens
taaacgtcttaaatatt

SEQ ID NO: 5931367 - DNA, 15 bp, Homo sapiens
taaacgtctttttaa

SEQ ID NO: 5931368 - DNA, 23 bp, Homo sapiens
taaacgtgatttttaaattaaat

SEQ ID NO: 5931369 - DNA, 17 bp, Homo sapiens
taaacgtgcagactatg

SEQ ID NO: 5931370 - DNA, 13 bp, Homo sapiens
taaacgtggagaa

SEQ ID NO: 5931371 - DNA, 17 bp, Homo sapiens
taaacgtgtaaattgca

SEQ ID NO: 5931372 - DNA, 21 bp, Homo sapiens
taaacgtgtaaattgcacaga

SEQ ID NO: 5931373 - DNA, 22 bp, Homo sapiens
taaacgtgtatgtttttcagtt

SEQ ID NO: 5931374 - DNA, 18 bp, Homo sapiens
taaacgttaaaagtgtac

SEQ ID NO: 5931375 - DNA, 15 bp, Homo sapiens
taaacgtttcagtaa

SEQ ID NO: 5931376 - DNA, 22 bp, Homo sapiens
taaacgtttcagtaataaaaca

SEQ ID NO: 5931377 - DNA, 19 bp, Homo sapiens
taaactaaaaaaaaaaagg

SEQ ID NO: 5931378 - DNA, 20 bp, Homo sapiens
taaactaaaaaaaaaaaggc

SEQ ID NO: 5931379 - DNA, 14 bp, Homo sapiens
taaactaaaaacta

SEQ ID NO: 5931380 - DNA, 16 bp, Homo sapiens
taaactaaaaatttac

SEQ ID NO: 5931381 - DNA, 18 bp, Homo sapiens
taaactaaaatctgttac

SEQ ID NO: 5931382 - DNA, 13 bp, Homo sapiens
taaactaaagtat

SEQ ID NO: 5931383 - DNA, 17 bp, Homo sapiens
taaactaaagtatggta

SEQ ID NO: 5931384 - DNA, 21 bp, Homo sapiens
taaactaaagtgtgctttata

SEQ ID NO: 5931385 - DNA, 14 bp, Homo sapiens
taaactaaagttgt

SEQ ID NO: 5931386 - DNA, 13 bp, Homo sapiens
taaactaaatgtg

SEQ ID NO: 5931387 - DNA, 16 bp, Homo sapiens
taaactaaattactgt

SEQ ID NO: 5931388 - DNA, 18 bp, Homo sapiens
taaactaaccttttatca

SEQ ID NO: 5931389 - DNA, 15 bp, Homo sapiens
taaactaagagaaac

SEQ ID NO: 5931390 - DNA, 16 bp, Homo sapiens
taaactaataattgca

SEQ ID NO: 5931391 - DNA, 17 bp, Homo sapiens
taaactaataattgcag

SEQ ID NO: 5931392 - DNA, 17 bp, Homo sapiens
taaactaatgaacaaat

SEQ ID NO: 5931393 - DNA, 13 bp, Homo sapiens
taaactacaaaaa

SEQ ID NO: 5931394 - DNA, 22 bp, Homo sapiens
taaactacagaatattaaatat

SEQ ID NO: 5931395 - DNA, 23 bp, Homo sapiens
taaactacagaatattaaatatt

SEQ ID NO: 5931396 - DNA, 16 bp, Homo sapiens
taaactaccacctcag

SEQ ID NO: 5931397 - DNA, 20 bp, Homo sapiens
taaactacctcaaaacactt

SEQ ID NO: 5931398 - DNA, 17 bp, Homo sapiens
taaactactatttttct

SEQ ID NO: 5931399 - DNA, 18 bp, Homo sapiens
taaactactatttttctt

SEQ ID NO: 5931400 - DNA, 19 bp, Homo sapiens
taaactactatttttcttt

SEQ ID NO: 5931401 - DNA, 15 bp, Homo sapiens
taaactactctttga

SEQ ID NO: 5931402 - DNA, 22 bp, Homo sapiens
taaactactgttaggaacagca

SEQ ID NO: 5931403 - DNA, 18 bp, Homo sapiens
taaactactttgaataga

SEQ ID NO: 5931404 - DNA, 22 bp, Homo sapiens
taaactagatctcctatttttc

SEQ ID NO: 5931405 - DNA, 11 bp, Homo sapiens
taaactagatg

SEQ ID NO: 5931406 - DNA, 15 bp, Homo sapiens
taaactagatgacct

SEQ ID NO: 5931407 - DNA, 19 bp, Homo sapiens
taaactagcaatgcctgag

SEQ ID NO: 5931408 - DNA, 21 bp, Homo sapiens
taaactagcatatctgccttt

SEQ ID NO: 5931409 - DNA, 14 bp, Homo sapiens
taaactaggaaaat

SEQ ID NO: 5931410 - DNA, 17 bp, Homo sapiens
taaactaggaaaattgg

SEQ ID NO: 5931411 - DNA, 15 bp, Homo sapiens
taaactaggtaaaat

SEQ ID NO: 5931412 - DNA, 17 bp, Homo sapiens
taaactagtatgaaata

SEQ ID NO: 5931413 - DNA, 14 bp, Homo sapiens
taaactagtttcca

SEQ ID NO: 5931414 - DNA, 17 bp, Homo sapiens
taaactataaactactg

SEQ ID NO: 5931415 - DNA, 18 bp, Homo sapiens
taaactataaactactgt

SEQ ID NO: 5931416 - DNA, 15 bp, Homo sapiens
taaactataggtaat

SEQ ID NO: 5931417 - DNA, 17 bp, Homo sapiens
taaactatcagtttgtc

SEQ ID NO: 5931418 - DNA, 14 bp, Homo sapiens
taaactatctgtat

SEQ ID NO: 5931419 - DNA, 17 bp, Homo sapiens
taaactatctgtattta

SEQ ID NO: 5931420 - DNA, 20 bp, Homo sapiens
taaactatcttggtgaattt

SEQ ID NO: 5931421 - DNA, 14 bp, Homo sapiens
taaactatcttttt

SEQ ID NO: 5931422 - DNA, 20 bp, Homo sapiens
taaactatgttcctaacaaa

SEQ ID NO: 5931423 - DNA, 17 bp, Homo sapiens
taaactatttatatcac

SEQ ID NO: 5931424 - DNA, 20 bp, Homo sapiens
taaactcaaaacttaacata

SEQ ID NO: 5931425 - DNA, 14 bp, Homo sapiens
taaactcagatctg

SEQ ID NO: 5931426 - DNA, 18 bp, Homo sapiens
taaactcagatctgatca

SEQ ID NO: 5931427 - DNA, 19 bp, Homo sapiens
taaactcagatctgatcaa

SEQ ID NO: 5931428 - DNA, 19 bp, Homo sapiens
taaactcagggacagagcc

SEQ ID NO: 5931429 - DNA, 20 bp, Homo sapiens
taaactcagggacagagcca

SEQ ID NO: 5931430 - DNA, 13 bp, Homo sapiens
taaactcatattt

SEQ ID NO: 5931431 - DNA, 12 bp, Homo sapiens
taaactcatttc

SEQ ID NO: 5931432 - DNA, 19 bp, Homo sapiens
taaactccaggatttataa

SEQ ID NO: 5931433 - DNA, 20 bp, Homo sapiens
taaactccaggatttataaa

SEQ ID NO: 5931434 - DNA, 20 bp, Homo sapiens
taaagaaaggcagagattgg

SEQ ID NO: 5931435 - DNA, 21 bp, Homo sapiens
taaagaaagtcgaattaatag

SEQ ID NO: 5931436 - DNA, 22 bp, Homo sapiens
taaagaaagtgagtctgaattg

SEQ ID NO: 5931437 - DNA, 15 bp, Homo sapiens
taaagaaagtgtatt

SEQ ID NO: 5931438 - DNA, 23 bp, Homo sapiens
taaagaaagtgtatttggaaata

SEQ ID NO: 5931439 - DNA, 24 bp, Homo sapiens
taaagaaagtgtatttggaaataa

SEQ ID NO: 5931440 - DNA, 14 bp, Homo sapiens
taaagaaataattt

SEQ ID NO: 5931441 - DNA, 16 bp, Homo sapiens
taaagaaatagaacaa

SEQ ID NO: 5931442 - DNA, 13 bp, Homo sapiens
taaagaaatattt

SEQ ID NO: 5931443 - DNA, 23 bp, Homo sapiens
taaagaaatgaaaaaaaaaaaca

SEQ ID NO: 5931444 - DNA, 10 bp, Homo sapiens
taaagaaatt

SEQ ID NO: 5931445 - DNA, 17 bp, Homo sapiens
taaagaaatttactata

SEQ ID NO: 5931446 - DNA, 19 bp, Homo sapiens
taaagaaatttactatata

SEQ ID NO: 5931447 - DNA, 22 bp, Homo sapiens
taaagaaatttactatatatat

SEQ ID NO: 5931448 - DNA, 23 bp, Homo sapiens
taaagaacactgcagtgttattt

SEQ ID NO: 5931449 - DNA, 12 bp, Homo sapiens
taaagaacagaa

SEQ ID NO: 5931450 - DNA, 15 bp, Homo sapiens
taaagaacataaata

SEQ ID NO: 5931451 - DNA, 17 bp, Homo sapiens
taaagaactccttattt

SEQ ID NO: 5931452 - DNA, 19 bp, Homo sapiens
taaagaactgcacatgaag

SEQ ID NO: 5931453 - DNA, 20 bp, Homo sapiens
taaagaactgcacatgaaga

SEQ ID NO: 5931454 - DNA, 14 bp, Homo sapiens
taaagaacttaaat

SEQ ID NO: 5931455 - DNA, 13 bp, Homo sapiens
taaagaagaaaaa

SEQ ID NO: 5931456 - DNA, 23 bp, Homo sapiens
taaagaagaaaaaaaaaaattca

SEQ ID NO: 5931457 - DNA, 14 bp, Homo sapiens
taaagaagacacac

SEQ ID NO: 5931458 - DNA, 20 bp, Homo sapiens
taaagaagacctgagaatgt

SEQ ID NO: 5931459 - DNA, 18 bp, Homo sapiens
taaagaagaggagaaaaa

SEQ ID NO: 5931460 - DNA, 17 bp, Homo sapiens
taaagaagataaacaca

SEQ ID NO: 5931461 - DNA, 17 bp, Homo sapiens
taaagaagctactattt

SEQ ID NO: 5931462 - DNA, 20 bp, Homo sapiens
taaagaagggatattaagaa

SEQ ID NO: 5931463 - DNA, 20 bp, Homo sapiens
taaagaagggggctttcttt

SEQ ID NO: 5931464 - DNA, 21 bp, Homo sapiens
taaagaagtaaatttgtccaa

SEQ ID NO: 5931465 - DNA, 15 bp, Homo sapiens
taaagaagtattttt

SEQ ID NO: 5931466 - DNA, 17 bp, Homo sapiens
taaagaagtatttttag

SEQ ID NO: 5931467 - DNA, 15 bp, Homo sapiens
taaagaagtccatgt

SEQ ID NO: 5931468 - DNA, 23 bp, Homo sapiens
taaagaagtctcttaattctgat

SEQ ID NO: 5931469 - DNA, 15 bp, Homo sapiens
taaagaagtgcatga

SEQ ID NO: 5931470 - DNA, 13 bp, Homo sapiens
taaagaataaatg

SEQ ID NO: 5931471 - DNA, 17 bp, Homo sapiens
taaagaatacttgaact

SEQ ID NO: 5931472 - DNA, 23 bp, Homo sapiens
taaagaatagtgcctcagcgctg

SEQ ID NO: 5931473 - DNA, 11 bp, Homo sapiens
taaagaatcca

SEQ ID NO: 5931474 - DNA, 17 bp, Homo sapiens
taaagaatccaagacaa

SEQ ID NO: 5931475 - DNA, 15 bp, Homo sapiens
taaagaatgaaagta

SEQ ID NO: 5931476 - DNA, 15 bp, Homo sapiens
taaagaatgctgcaa

SEQ ID NO: 5931477 - DNA, 14 bp, Homo sapiens
taaagaattacttg

SEQ ID NO: 5931478 - DNA, 15 bp, Homo sapiens
taaagaattattttg

SEQ ID NO: 5931479 - DNA, 16 bp, Homo sapiens
taaagaattattttgt

SEQ ID NO: 5931480 - DNA, 14 bp, Homo sapiens
taaagaatttcttt

SEQ ID NO: 5931481 - DNA, 15 bp, Homo sapiens
taaagacaaagacaa

SEQ ID NO: 5931482 - DNA, 22 bp, Homo sapiens
taaagacaaagacaaattctgt

SEQ ID NO: 5931483 - DNA, 15 bp, Homo sapiens
taaagacaaattttg

SEQ ID NO: 5931484 - DNA, 16 bp, Homo sapiens
taaagacaacaaaaga

SEQ ID NO: 5931485 - DNA, 20 bp, Homo sapiens
taaagacaaccatatttagc

SEQ ID NO: 5931486 - DNA, 17 bp, Homo sapiens
taaagacaatcactgcc

SEQ ID NO: 5931487 - DNA, 18 bp, Homo sapiens
taaagacaatcactgcca

SEQ ID NO: 5931488 - DNA, 20 bp, Homo sapiens
taaagacaatcactgccaac

SEQ ID NO: 5931489 - DNA, 20 bp, Homo sapiens
taaagacactggcagagaga

SEQ ID NO: 5931490 - DNA, 22 bp, Homo sapiens
taaagacagaaaaaaataaaaa

SEQ ID NO: 5931491 - DNA, 15 bp, Homo sapiens
taaagacaggagaca

SEQ ID NO: 5931492 - DNA, 14 bp, Homo sapiens
taaagacagggtct

SEQ ID NO: 5931493 - DNA, 13 bp, Homo sapiens
taaagacatgaag

SEQ ID NO: 5931494 - DNA, 13 bp, Homo sapiens
taaagacatttaa

SEQ ID NO: 5931495 - DNA, 21 bp, Homo sapiens
taaagacatttaaaatagttt

SEQ ID NO: 5931496 - DNA, 20 bp, Homo sapiens
taaagaccaataaacttcct

SEQ ID NO: 5931497 - DNA, 18 bp, Homo sapiens
taaagaccatttagtcct

SEQ ID NO: 5931498 - DNA, 19 bp, Homo sapiens
taaagacccagggggagaa

SEQ ID NO: 5931499 - DNA, 22 bp, Homo sapiens
taaagaccgtacaaactcagat

SEQ ID NO: 5931500 - DNA, 19 bp, Homo sapiens
taaagacgtctctttttgg

SEQ ID NO: 5931501 - DNA, 21 bp, Homo sapiens
taaagacgtctctttttggta

SEQ ID NO: 5931502 - DNA, 21 bp, Homo sapiens
taaagactagagcaaaataat

SEQ ID NO: 5931503 - DNA, 15 bp, Homo sapiens
taaagactgagaccc

SEQ ID NO: 5931504 - DNA, 20 bp, Homo sapiens
taaagactggcttttattaa

SEQ ID NO: 5931505 - DNA, 19 bp, Homo sapiens
taaagactgtgctgagaag

SEQ ID NO: 5931506 - DNA, 21 bp, Homo sapiens
taaagactgtggaaatgccaa

SEQ ID NO: 5931507 - DNA, 13 bp, Homo sapiens
taaagacttaaga

SEQ ID NO: 5931508 - DNA, 16 bp, Homo sapiens
taaagacttcatgttc

SEQ ID NO: 5931509 - DNA, 16 bp, Homo sapiens
taaagacttgatgaat

SEQ ID NO: 5931510 - DNA, 22 bp, Homo sapiens
taaagacttgtatagcatgaaa

SEQ ID NO: 5931511 - DNA, 13 bp, Homo sapiens
taaagacttttat

SEQ ID NO: 5931512 - DNA, 20 bp, Homo sapiens
taaagacttttatgtgagat

SEQ ID NO: 5931513 - DNA, 14 bp, Homo sapiens
taaagagaaacttt

SEQ ID NO: 5931514 - DNA, 15 bp, Homo sapiens
taaagagaaccatgt

SEQ ID NO: 5931515 - DNA, 19 bp, Homo sapiens
taaagagacctacctcagg

SEQ ID NO: 5931516 - DNA, 20 bp, Homo sapiens
taaagagatacgaatttcta

SEQ ID NO: 5931517 - DNA, 18 bp, Homo sapiens
taaagagattcacacaca

SEQ ID NO: 5931518 - DNA, 21 bp, Homo sapiens
taaagagcaatcctggaagaa

SEQ ID NO: 5931519 - DNA, 22 bp, Homo sapiens
taaagagcaggatagctcttcc

SEQ ID NO: 5931520 - DNA, 23 bp, Homo sapiens
taaagagcaggatagctcttcct

SEQ ID NO: 5931521 - DNA, 16 bp, Homo sapiens
taaagagcccttgcct

SEQ ID NO: 5931522 - DNA, 10 bp, Homo sapiens
taaagagctc

SEQ ID NO: 5931523 - DNA, 22 bp, Homo sapiens
taaagaggaagccttgcccagc

SEQ ID NO: 5931524 - DNA, 20 bp, Homo sapiens
taaagaggagcctttccaga

SEQ ID NO: 5931525 - DNA, 21 bp, Homo sapiens
taaagaggcatcttttctaga

SEQ ID NO: 5931526 - DNA, 22 bp, Homo sapiens
taaagaggcatcttttctagag

SEQ ID NO: 5931527 - DNA, 19 bp, Homo sapiens
taaagaggcgtcttgtatt

SEQ ID NO: 5931528 - DNA, 19 bp, Homo sapiens
taaagaggcgttgctttca

SEQ ID NO: 5931529 - DNA, 20 bp, Homo sapiens
taaagaggctgaaagaggcc

SEQ ID NO: 5931530 - DNA, 18 bp, Homo sapiens
taaagaggcttccaagca

SEQ ID NO: 5931531 - DNA, 20 bp, Homo sapiens
taaagaggtggggtgaagct

SEQ ID NO: 5931532 - DNA, 19 bp, Homo sapiens
taaagagtacactcagcca

SEQ ID NO: 5931533 - DNA, 15 bp, Homo sapiens
taaagagtcctcctt

SEQ ID NO: 5931534 - DNA, 17 bp, Homo sapiens
taaagagtcctccttcc

SEQ ID NO: 5931535 - DNA, 19 bp, Homo sapiens
taaagagtcctccttccca

SEQ ID NO: 5931536 - DNA, 19 bp, Homo sapiens
taaagagtctagattcaaa

SEQ ID NO: 5931537 - DNA, 21 bp, Homo sapiens
taaagagtggagcaaatgctt

SEQ ID NO: 5931538 - DNA, 15 bp, Homo sapiens
taaagagtgtgttat

SEQ ID NO: 5931539 - DNA, 15 bp, Homo sapiens
taaagagttattcaa

SEQ ID NO: 5931540 - DNA, 20 bp, Homo sapiens
taaagagttgtgttgttctt

SEQ ID NO: 5931541 - DNA, 17 bp, Homo sapiens
taaagataaagccagaa

SEQ ID NO: 5931542 - DNA, 22 bp, Homo sapiens
taaagataatcgaagcaaaagt

SEQ ID NO: 5931543 - DNA, 14 bp, Homo sapiens
taaagataattgct

SEQ ID NO: 5931544 - DNA, 23 bp, Homo sapiens
taaagatacagaactctttcaaa

SEQ ID NO: 5931545 - DNA, 18 bp, Homo sapiens
taaagataccaaatagaa

SEQ ID NO: 5931546 - DNA, 20 bp, Homo sapiens
taaagatatggagaattgct

SEQ ID NO: 5931547 - DNA, 14 bp, Homo sapiens
taaagatatttcca

SEQ ID NO: 5931548 - DNA, 16 bp, Homo sapiens
taaagatatttttatt

SEQ ID NO: 5931549 - DNA, 19 bp, Homo sapiens
taaagatatttttattcaa

SEQ ID NO: 5931550 - DNA, 23 bp, Homo sapiens
taaagatatttttattcaaacta

SEQ ID NO: 5931551 - DNA, 14 bp, Homo sapiens
taaagatcacacat

SEQ ID NO: 5931552 - DNA, 23 bp, Homo sapiens
taaagatcatttataatactgtt

SEQ ID NO: 5931553 - DNA, 16 bp, Homo sapiens
taaagatctacatgaa

SEQ ID NO: 5931554 - DNA, 15 bp, Homo sapiens
taaagatctcaacat

SEQ ID NO: 5931555 - DNA, 17 bp, Homo sapiens
taaagatgaactctgaa

SEQ ID NO: 5931556 - DNA, 13 bp, Homo sapiens
taaagatgattga

SEQ ID NO: 5931557 - DNA, 22 bp, Homo sapiens
taaagatgccctaagtgttgaa

SEQ ID NO: 5931558 - DNA, 14 bp, Homo sapiens
taaagatgctgtcg

SEQ ID NO: 5931559 - DNA, 13 bp, Homo sapiens
taaagatggaaaa

SEQ ID NO: 5931560 - DNA, 21 bp, Homo sapiens
taaagatggagtttctaaggt

SEQ ID NO: 5931561 - DNA, 22 bp, Homo sapiens
taaagatggagtttctaaggtc

SEQ ID NO: 5931562 - DNA, 22 bp, Homo sapiens
taaagatggggaaactgagggc

SEQ ID NO: 5931563 - DNA, 16 bp, Homo sapiens
taaagatggttttgat

SEQ ID NO: 5931564 - DNA, 16 bp, Homo sapiens
taaagatgtagcaaac

SEQ ID NO: 5931565 - DNA, 15 bp, Homo sapiens
taaagatgtgaaaac

SEQ ID NO: 5931566 - DNA, 16 bp, Homo sapiens
taaagatgtgaaaact

SEQ ID NO: 5931567 - DNA, 12 bp, Homo sapiens
taaagattaaca

SEQ ID NO: 5931568 - DNA, 23 bp, Homo sapiens
taaagattagggaaaatggatat

SEQ ID NO: 5931569 - DNA, 19 bp, Homo sapiens
taaagattataatatgtgc

SEQ ID NO: 5931570 - DNA, 11 bp, Homo sapiens
taaagattatt

SEQ ID NO: 5931571 - DNA, 15 bp, Homo sapiens
taaagattattacct

SEQ ID NO: 5931572 - DNA, 20 bp, Homo sapiens
taaagattctatagttctag

SEQ ID NO: 5931573 - DNA, 21 bp, Homo sapiens
taaagattctatagttctaga

SEQ ID NO: 5931574 - DNA, 17 bp, Homo sapiens
taaagattctctttaaa

SEQ ID NO: 5931575 - DNA, 20 bp, Homo sapiens
taaagattctctttaaaaaa

SEQ ID NO: 5931576 - DNA, 19 bp, Homo sapiens
taaagattgctttatccag

SEQ ID NO: 5931577 - DNA, 23 bp, Homo sapiens
taaagatttatacagttgaaaac

SEQ ID NO: 5931578 - DNA, 15 bp, Homo sapiens
taaagatttatcaaa

SEQ ID NO: 5931579 - DNA, 22 bp, Homo sapiens
taaagatttatcaaatcagtca

SEQ ID NO: 5931580 - DNA, 20 bp, Homo sapiens
taaagatttatttagctatt

SEQ ID NO: 5931581 - DNA, 21 bp, Homo sapiens
taaagatttatttagctattt

SEQ ID NO: 5931582 - DNA, 12 bp, Homo sapiens
taaagatttctg

SEQ ID NO: 5931583 - DNA, 13 bp, Homo sapiens
taaagatttgctt

SEQ ID NO: 5931584 - DNA, 14 bp, Homo sapiens
taaagattttgatc

SEQ ID NO: 5931585 - DNA, 21 bp, Homo sapiens
taaagattttgatctcacatt

SEQ ID NO: 5931586 - DNA, 21 bp, Homo sapiens
taaagattttgttttgttgga

SEQ ID NO: 5931587 - DNA, 15 bp, Homo sapiens
taaagatttttgttt

SEQ ID NO: 5931588 - DNA, 20 bp, Homo sapiens
taaagattttttaataattt

SEQ ID NO: 5931589 - DNA, 21 bp, Homo sapiens
taaagcaaaaaatgaatgtct

SEQ ID NO: 5931590 - DNA, 11 bp, Homo sapiens
taaagcaaaat

SEQ ID NO: 5931591 - DNA, 12 bp, Homo sapiens
taaagcaaaata

SEQ ID NO: 5931592 - DNA, 13 bp, Homo sapiens
taaagcaaaatag

SEQ ID NO: 5931593 - DNA, 14 bp, Homo sapiens
taaagcaaaatagt

SEQ ID NO: 5931594 - DNA, 17 bp, Homo sapiens
taaagcaaaatagtatt

SEQ ID NO: 5931595 - DNA, 21 bp, Homo sapiens
taaagcaaaatagtattgctg

SEQ ID NO: 5931596 - DNA, 23 bp, Homo sapiens
taaagcaaaatagtattgctgaa

SEQ ID NO: 5931597 - DNA, 16 bp, Homo sapiens
taaagcaaaccagcct

SEQ ID NO: 5931598 - DNA, 18 bp, Homo sapiens
taaagcaaactatgattt

SEQ ID NO: 5931599 - DNA, 21 bp, Homo sapiens
taaagcaaactatgatttatt

SEQ ID NO: 5931600 - DNA, 20 bp, Homo sapiens
taaagcaaagcgctaagtaa

SEQ ID NO: 5931601 - DNA, 10 bp, Homo sapiens
taaagcaaat

SEQ ID NO: 5931602 - DNA, 18 bp, Homo sapiens
taaagcaacattttattt

SEQ ID NO: 5931603 - DNA, 19 bp, Homo sapiens
taaagcaagctcacttgct

SEQ ID NO: 5931604 - DNA, 22 bp, Homo sapiens
taaagcaaggcatacctgtcct

SEQ ID NO: 5931605 - DNA, 14 bp, Homo sapiens
taaagcaataagtt

SEQ ID NO: 5931606 - DNA, 16 bp, Homo sapiens
taaagcaataagttca

SEQ ID NO: 5931607 - DNA, 21 bp, Homo sapiens
taaagcaataagttcattaaa

SEQ ID NO: 5931608 - DNA, 23 bp, Homo sapiens
taaagcaataagttcattaaaca

SEQ ID NO: 5931609 - DNA, 23 bp, Homo sapiens
taaagcaataatggtcccatcca

SEQ ID NO: 5931610 - DNA, 16 bp, Homo sapiens
taaagggaccatctgc

SEQ ID NO: 5931611 - DNA, 17 bp, Homo sapiens
taaagggaccatctgct

SEQ ID NO: 5931612 - DNA, 20 bp, Homo sapiens
taaagggaccatctgctgca

SEQ ID NO: 5931613 - DNA, 20 bp, Homo sapiens
taaagggactacctctgtgc

SEQ ID NO: 5931614 - DNA, 21 bp, Homo sapiens
taaagggactacctctgtgcc

SEQ ID NO: 5931615 - DNA, 17 bp, Homo sapiens
taaagggataaagaaat

SEQ ID NO: 5931616 - DNA, 22 bp, Homo sapiens
taaagggatatttttttctatt

SEQ ID NO: 5931617 - DNA, 16 bp, Homo sapiens
taaagggatctgctta

SEQ ID NO: 5931618 - DNA, 20 bp, Homo sapiens
taaagggcaggtggttctaa

SEQ ID NO: 5931619 - DNA, 20 bp, Homo sapiens
taaagggcccaatgaattat

SEQ ID NO: 5931620 - DNA, 16 bp, Homo sapiens
taaagggcctgcctgg

SEQ ID NO: 5931621 - DNA, 22 bp, Homo sapiens
taaaggggagaaactgaaagtg

SEQ ID NO: 5931622 - DNA, 17 bp, Homo sapiens
taaaggggcctgcgcag

SEQ ID NO: 5931623 - DNA, 15 bp, Homo sapiens
taaaggggggagggg

SEQ ID NO: 5931624 - DNA, 18 bp, Homo sapiens
taaaggggtctgaaattt

SEQ ID NO: 5931625 - DNA, 16 bp, Homo sapiens
taaaggggttccaaat

SEQ ID NO: 5931626 - DNA, 18 bp, Homo sapiens
taaagggtatgagctgga

SEQ ID NO: 5931627 - DNA, 14 bp, Homo sapiens
taaagggtcaggcc

SEQ ID NO: 5931628 - DNA, 21 bp, Homo sapiens
taaagggttgaaaatgtgttt

SEQ ID NO: 5931629 - DNA, 21 bp, Homo sapiens
taaagggtttgagatgtacat

SEQ ID NO: 5931630 - DNA, 13 bp, Homo sapiens
taaaggtaaaatc

SEQ ID NO: 5931631 - DNA, 14 bp, Homo sapiens
taaaggtaaaatca

SEQ ID NO: 5931632 - DNA, 23 bp, Homo sapiens
taaaggtacactggtatttatat

SEQ ID NO: 5931633 - DNA, 20 bp, Homo sapiens
taaaggtaccaaacaaggaa

SEQ ID NO: 5931634 - DNA, 17 bp, Homo sapiens
taaaggtagagatgtgt

SEQ ID NO: 5931635 - DNA, 19 bp, Homo sapiens
taaaggtccacaggtctag

SEQ ID NO: 5931636 - DNA, 22 bp, Homo sapiens
taaaggtccacaggtctagact

SEQ ID NO: 5931637 - DNA, 20 bp, Homo sapiens
taaaggtcccatgctccacc

SEQ ID NO: 5931638 - DNA, 14 bp, Homo sapiens
taaaggtgatgaat

SEQ ID NO: 5931639 - DNA, 16 bp, Homo sapiens
taaaggtgatgaattt

SEQ ID NO: 5931640 - DNA, 23 bp, Homo sapiens
taaaggtgcagttgctcattgta

SEQ ID NO: 5931641 - DNA, 14 bp, Homo sapiens
taaaggtggaaaat

SEQ ID NO: 5931642 - DNA, 19 bp, Homo sapiens
taaaggtggccacaaattc

SEQ ID NO: 5931643 - DNA, 21 bp, Homo sapiens
taaaggtggtatgtgtgtgta

SEQ ID NO: 5931644 - DNA, 23 bp, Homo sapiens
taaaggtggtatgtgtgtgtatg

SEQ ID NO: 5931645 - DNA, 21 bp, Homo sapiens
taaaggtggtgaggcaataaa

SEQ ID NO: 5931646 - DNA, 16 bp, Homo sapiens
taaaggtggttttatt

SEQ ID NO: 5931647 - DNA, 17 bp, Homo sapiens
taaaggtgtcttcctcc

SEQ ID NO: 5931648 - DNA, 20 bp, Homo sapiens
taaaggttaccgatttcaaa

SEQ ID NO: 5931649 - DNA, 22 bp, Homo sapiens
taaaggttactgtttttatcct

SEQ ID NO: 5931650 - DNA, 14 bp, Homo sapiens
taaaggttatgaaa

SEQ ID NO: 5931651 - DNA, 18 bp, Homo sapiens
taaaggttatgaaacata

SEQ ID NO: 5931652 - DNA, 19 bp, Homo sapiens
taaaggttattttctcctg

SEQ ID NO: 5931653 - DNA, 15 bp, Homo sapiens
taaaggttcctttgt

SEQ ID NO: 5931654 - DNA, 20 bp, Homo sapiens
taaaggttgacaataaatgt

SEQ ID NO: 5931655 - DNA, 12 bp, Homo sapiens
taaaggttgtga

SEQ ID NO: 5931656 - DNA, 21 bp, Homo sapiens
taaaggtttatttttctgtta

SEQ ID NO: 5931657 - DNA, 21 bp, Homo sapiens
taaaggtttcactgttcatga

SEQ ID NO: 5931658 - DNA, 20 bp, Homo sapiens
taaaggtttcgttgcatggt

SEQ ID NO: 5931659 - DNA, 21 bp, Homo sapiens
taaagtaaaaacaaagaaatt

SEQ ID NO: 5931660 - DNA, 22 bp, Homo sapiens
taaagtaaaaacaaagaaatta

SEQ ID NO: 5931661 - DNA, 13 bp, Homo sapiens
taaagtaaaatat

SEQ ID NO: 5931662 - DNA, 14 bp, Homo sapiens
taaagtaaaatatg

SEQ ID NO: 5931663 - DNA, 18 bp, Homo sapiens
taaagtaaaatatgtcca

SEQ ID NO: 5931664 - DNA, 16 bp, Homo sapiens
taaagtaaacttgtgt

SEQ ID NO: 5931665 - DNA, 14 bp, Homo sapiens
taaagtaaagctaa

SEQ ID NO: 5931666 - DNA, 15 bp, Homo sapiens
taaagtaaagctaaa

SEQ ID NO: 5931667 - DNA, 13 bp, Homo sapiens
taaagtaaataca

SEQ ID NO: 5931668 - DNA, 14 bp, Homo sapiens
taaagtaactttat

SEQ ID NO: 5931669 - DNA, 13 bp, Homo sapiens
taaagtaataatg

SEQ ID NO: 5931670 - DNA, 13 bp, Homo sapiens
taaagtaattcat

SEQ ID NO: 5931671 - DNA, 21 bp, Homo sapiens
taaagtaatttctaaagcagt

SEQ ID NO: 5931672 - DNA, 22 bp, Homo sapiens
taaagtacaaatgaagaaagtc

SEQ ID NO: 5931673 - DNA, 16 bp, Homo sapiens
taaagtacagcctgga

SEQ ID NO: 5931674 - DNA, 18 bp, Homo sapiens
taaagtacagcctggacc

SEQ ID NO: 5931675 - DNA, 15 bp, Homo sapiens
taaagtacctgtagt

SEQ ID NO: 5931676 - DNA, 22 bp, Homo sapiens
taaagtacttgactacctactg

SEQ ID NO: 5931677 - DNA, 17 bp, Homo sapiens
taaagtactttcttata

SEQ ID NO: 5931678 - DNA, 19 bp, Homo sapiens
taaagtactttcttataaa

SEQ ID NO: 5931679 - DNA, 22 bp, Homo sapiens
taaagtactttcttataaattt

SEQ ID NO: 5931680 - DNA, 18 bp, Homo sapiens
taaagtagaagagggttt

SEQ ID NO: 5931681 - DNA, 18 bp, Homo sapiens
taaagtagcaaaacaaat

SEQ ID NO: 5931682 - DNA, 17 bp, Homo sapiens
taaagtagtcctgtgaa

SEQ ID NO: 5931683 - DNA, 15 bp, Homo sapiens
taaagtataatgttt

SEQ ID NO: 5931684 - DNA, 21 bp, Homo sapiens
taaagtatacaactgcctggg

SEQ ID NO: 5931685 - DNA, 17 bp, Homo sapiens
taaagtatactcttagg

SEQ ID NO: 5931686 - DNA, 16 bp, Homo sapiens
taaagtatagaaatat

SEQ ID NO: 5931687 - DNA, 20 bp, Homo sapiens
taaagtatagagagaagttc

SEQ ID NO: 5931688 - DNA, 17 bp, Homo sapiens
taaagtatatatttatt

SEQ ID NO: 5931689 - DNA, 18 bp, Homo sapiens
taaagtatatgtgcagtc

SEQ ID NO: 5931690 - DNA, 19 bp, Homo sapiens
taaagtatatgtgcagtct

SEQ ID NO: 5931691 - DNA, 16 bp, Homo sapiens
taaagtatattgaaag

SEQ ID NO: 5931692 - DNA, 17 bp, Homo sapiens
taaagtatattgaaagt

SEQ ID NO: 5931693 - DNA, 18 bp, Homo sapiens
taaagtatcacttttctg

SEQ ID NO: 5931694 - DNA, 15 bp, Homo sapiens
taaagtatcatgcat

SEQ ID NO: 5931695 - DNA, 17 bp, Homo sapiens
taaagtatcatgcattc

SEQ ID NO: 5931696 - DNA, 23 bp, Homo sapiens
taaagtatgacccacattacttt

SEQ ID NO: 5931697 - DNA, 19 bp, Homo sapiens
taaagtatgcatgcagtct

SEQ ID NO: 5931698 - DNA, 13 bp, Homo sapiens
taaagtatgtaaa

SEQ ID NO: 5931699 - DNA, 21 bp, Homo sapiens
taaagtatgtaaagtatgtaa

SEQ ID NO: 5931700 - DNA, 13 bp, Homo sapiens
taaagtatgtgaa

SEQ ID NO: 5931701 - DNA, 21 bp, Homo sapiens
taaagtatgtgagtagtctta

SEQ ID NO: 5931702 - DNA, 23 bp, Homo sapiens
taaagtatgtgagtagtcttatg

SEQ ID NO: 5931703 - DNA, 18 bp, Homo sapiens
taaagtatgtttttacat

SEQ ID NO: 5931704 - DNA, 15 bp, Homo sapiens
taaagtattccacct

SEQ ID NO: 5931705 - DNA, 21 bp, Homo sapiens
taaagtattccaccttaaatt

SEQ ID NO: 5931706 - DNA, 14 bp, Homo sapiens
taaagtattctcca

SEQ ID NO: 5931707 - DNA, 18 bp, Homo sapiens
taaagtattcttctcttc

SEQ ID NO: 5931708 - DNA, 17 bp, Homo sapiens
taaagtattggattttt

SEQ ID NO: 5931709 - DNA, 13 bp, Homo sapiens
taaagtatttata

SEQ ID NO: 5931710 - DNA, 19 bp, Homo sapiens
taaagtatttgggttttgt

SEQ ID NO: 5931711 - DNA, 13 bp, Homo sapiens
taaagtattttct

SEQ ID NO: 5931712 - DNA, 19 bp, Homo sapiens
taaagtcaacaaccatgcc

SEQ ID NO: 5931713 - DNA, 22 bp, Homo sapiens
taaagtcaacaaccatgccagg

SEQ ID NO: 5931714 - DNA, 19 bp, Homo sapiens
taaagtcacacatttctat

SEQ ID NO: 5931715 - DNA, 17 bp, Homo sapiens
taaagtcacatccctgt

SEQ ID NO: 5931716 - DNA, 15 bp, Homo sapiens
taaagtcagaagttt

SEQ ID NO: 5931717 - DNA, 19 bp, Homo sapiens
taaagtcaggacctggctt

SEQ ID NO: 5931718 - DNA, 13 bp, Homo sapiens
taaagtcaggggt

SEQ ID NO: 5931719 - DNA, 18 bp, Homo sapiens
taaagtcatcatgaactg

SEQ ID NO: 5931720 - DNA, 19 bp, Homo sapiens
taaagtccctatagtatat

SEQ ID NO: 5931721 - DNA, 23 bp, Homo sapiens
taaagtccctttataaagagtgc

SEQ ID NO: 5931722 - DNA, 19 bp, Homo sapiens
taaagtcgagcttttctaa

SEQ ID NO: 5931723 - DNA, 16 bp, Homo sapiens
taaagtctatggacag

SEQ ID NO: 5931724 - DNA, 22 bp, Homo sapiens
taaagtctcctggatttaaatt

SEQ ID NO: 5931725 - DNA, 14 bp, Homo sapiens
taaagtctgagtgg

SEQ ID NO: 5931726 - DNA, 19 bp, Homo sapiens
taaagtctgagtgggcggc

SEQ ID NO: 5931727 - DNA, 14 bp, Homo sapiens
taaagtctgtcatg

SEQ ID NO: 5931728 - DNA, 15 bp, Homo sapiens
taaagtctgtcatgc

SEQ ID NO: 5931729 - DNA, 14 bp, Homo sapiens
taaagtgaacagat

SEQ ID NO: 5931730 - DNA, 20 bp, Homo sapiens
taaagtgaacagattttatt

SEQ ID NO: 5931731 - DNA, 14 bp, Homo sapiens
taaagtgaaggaaa

SEQ ID NO: 5931732 - DNA, 15 bp, Homo sapiens
taaagtgaaggaaat

SEQ ID NO: 5931733 - DNA, 16 bp, Homo sapiens
taaagtgaaggaaata

SEQ ID NO: 5931734 - DNA, 20 bp, Homo sapiens
taaagtgaaggaaataaagg

SEQ ID NO: 5931735 - DNA, 13 bp, Homo sapiens
taaagtgaccagg

SEQ ID NO: 5931736 - DNA, 17 bp, Homo sapiens
taaagtgaccctgctct

SEQ ID NO: 5931737 - DNA, 21 bp, Homo sapiens
taaagtgaggccactgaagag

SEQ ID NO: 5931738 - DNA, 23 bp, Homo sapiens
taaagtgagtactgttaagaata

SEQ ID NO: 5931739 - DNA, 16 bp, Homo sapiens
taaagtgatatttccc

SEQ ID NO: 5931740 - DNA, 22 bp, Homo sapiens
taaagtgatcctaaatatgaca

SEQ ID NO: 5931741 - DNA, 15 bp, Homo sapiens
taaagtgatgtttgt

SEQ ID NO: 5931742 - DNA, 13 bp, Homo sapiens
taaagtgattcct

SEQ ID NO: 5931743 - DNA, 13 bp, Homo sapiens
taaagtgcaattg

SEQ ID NO: 5931744 - DNA, 18 bp, Homo sapiens
taaagtgcacacctttat

SEQ ID NO: 5931745 - DNA, 16 bp, Homo sapiens
taaagtgcctcggaca

SEQ ID NO: 5931746 - DNA, 22 bp, Homo sapiens
taaagtgccttcagccaagacc

SEQ ID NO: 5931747 - DNA, 16 bp, Homo sapiens
taaagtgctaaggttc

SEQ ID NO: 5931748 - DNA, 17 bp, Homo sapiens
taaagtgctaaggttct

SEQ ID NO: 5931749 - DNA, 20 bp, Homo sapiens
taaagtgctaaggttctaag

SEQ ID NO: 5931750 - DNA, 13 bp, Homo sapiens
taaagtgctctat

SEQ ID NO: 5931751 - DNA, 19 bp, Homo sapiens
taaagtgctctatttatta

SEQ ID NO: 5931752 - DNA, 16 bp, Homo sapiens
taaagtgctggaactt

SEQ ID NO: 5931753 - DNA, 24 bp, Homo sapiens
taaagtgctggaactttagtgaaa

SEQ ID NO: 5931754 - DNA, 14 bp, Homo sapiens
taaagtgctgttta

SEQ ID NO: 5931755 - DNA, 18 bp, Homo sapiens
taaagtgctgtttagatt

SEQ ID NO: 5931756 - DNA, 12 bp, Homo sapiens
taaagtgcttga

SEQ ID NO: 5931757 - DNA, 17 bp, Homo sapiens
taaagtgcttgcttttt

SEQ ID NO: 5931758 - DNA, 15 bp, Homo sapiens
taaagtgcttgtgta

SEQ ID NO: 5931759 - DNA, 16 bp, Homo sapiens
taaagtgctttcagaa

SEQ ID NO: 5931760 - DNA, 15 bp, Homo sapiens
taaagtggctttcaa

SEQ ID NO: 5931761 - DNA, 22 bp, Homo sapiens
taaagtgggttattctggagtt

SEQ ID NO: 5931762 - DNA, 16 bp, Homo sapiens
taaagtggtctgaact

SEQ ID NO: 5931763 - DNA, 19 bp, Homo sapiens
taaagtgtaacaattgtgt

SEQ ID NO: 5931764 - DNA, 13 bp, Homo sapiens
taaagtgtaacat

SEQ ID NO: 5931765 - DNA, 16 bp, Homo sapiens
taaagtgtaacatatg

SEQ ID NO: 5931766 - DNA, 17 bp, Homo sapiens
taaagtgtacttataaa

SEQ ID NO: 5931767 - DNA, 15 bp, Homo sapiens
taaagtgtagcaccc

SEQ ID NO: 5931768 - DNA, 14 bp, Homo sapiens
taaagtgtattttt

SEQ ID NO: 5931769 - DNA, 22 bp, Homo sapiens
taaagtgtatttttttactaat

SEQ ID NO: 5931770 - DNA, 23 bp, Homo sapiens
taaagtgtcatccaccagtgtgt

SEQ ID NO: 5931771 - DNA, 12 bp, Homo sapiens
taaagtgtctat

SEQ ID NO: 5931772 - DNA, 23 bp, Homo sapiens
taaagtgtctattagttttcttt

SEQ ID NO: 5931773 - DNA, 15 bp, Homo sapiens
taaagtgtgctttat

SEQ ID NO: 5931774 - DNA, 20 bp, Homo sapiens
taaagtgtgctttataaaaa

SEQ ID NO: 5931775 - DNA, 17 bp, Homo sapiens
taaagtgtgttgttgct

SEQ ID NO: 5931776 - DNA, 18 bp, Homo sapiens
taaagtgtgttgttgctt

SEQ ID NO: 5931777 - DNA, 13 bp, Homo sapiens
taaagtgttactt

SEQ ID NO: 5931778 - DNA, 17 bp, Homo sapiens
taaagtgttactttttg

SEQ ID NO: 5931779 - DNA, 20 bp, Homo sapiens
taaagtgttctgccagatct

SEQ ID NO: 5931780 - DNA, 13 bp, Homo sapiens
taaagtgtttagc

SEQ ID NO: 5931781 - DNA, 18 bp, Homo sapiens
taaagtgtttcagctaag

SEQ ID NO: 5931782 - DNA, 15 bp, Homo sapiens
taaagtgttttcaga

SEQ ID NO: 5931783 - DNA, 16 bp, Homo sapiens
taaagtgttttcagag

SEQ ID NO: 5931784 - DNA, 20 bp, Homo sapiens
taaagttaaaaataggcttt

SEQ ID NO: 5931785 - DNA, 15 bp, Homo sapiens
taaagttaattcatt

SEQ ID NO: 5931786 - DNA, 15 bp, Homo sapiens
taaagttacactttt

SEQ ID NO: 5931787 - DNA, 19 bp, Homo sapiens
taaatattcacacttgaac

SEQ ID NO: 5931788 - DNA, 16 bp, Homo sapiens
taaatattcatttgct

SEQ ID NO: 5931789 - DNA, 15 bp, Homo sapiens
taaatattctatatg

SEQ ID NO: 5931790 - DNA, 19 bp, Homo sapiens
taaatattctatatgaatt

SEQ ID NO: 5931791 - DNA, 12 bp, Homo sapiens
taaatattcttg

SEQ ID NO: 5931792 - DNA, 13 bp, Homo sapiens
taaatattcttgt

SEQ ID NO: 5931793 - DNA, 17 bp, Homo sapiens
taaatattgctaaaagc

SEQ ID NO: 5931794 - DNA, 19 bp, Homo sapiens
taaatattgctaaaagcat

SEQ ID NO: 5931795 - DNA, 20 bp, Homo sapiens
taaatattgctaaaagcatg

SEQ ID NO: 5931796 - DNA, 22 bp, Homo sapiens
taaatattgctgtctgaaaaag

SEQ ID NO: 5931797 - DNA, 23 bp, Homo sapiens
taaatattgggattggggggaaa

SEQ ID NO: 5931798 - DNA, 23 bp, Homo sapiens
taaatattggttgggatgacttg

SEQ ID NO: 5931799 - DNA, 15 bp, Homo sapiens
taaatattgtatttt

SEQ ID NO: 5931800 - DNA, 19 bp, Homo sapiens
taaatattgtattttagat

SEQ ID NO: 5931801 - DNA, 23 bp, Homo sapiens
taaatattgtattttagatatat

SEQ ID NO: 5931802 - DNA, 20 bp, Homo sapiens
taaatattgttttgcattgt

SEQ ID NO: 5931803 - DNA, 10 bp, Homo sapiens
taaatattta

SEQ ID NO: 5931804 - DNA, 18 bp, Homo sapiens
taaatatttacatatgaa

SEQ ID NO: 5931805 - DNA, 16 bp, Homo sapiens
taaatatttactcttt

SEQ ID NO: 5931806 - DNA, 11 bp, Homo sapiens
taaatatttat

SEQ ID NO: 5931807 - DNA, 14 bp, Homo sapiens
taaatatttatgct

SEQ ID NO: 5931808 - DNA, 16 bp, Homo sapiens
taaatatttatgtaga

SEQ ID NO: 5931809 - DNA, 17 bp, Homo sapiens
taaatatttatttatgt

SEQ ID NO: 5931810 - DNA, 12 bp, Homo sapiens
taaatatttcat

SEQ ID NO: 5931811 - DNA, 16 bp, Homo sapiens
taaatatttcataaat

SEQ ID NO: 5931812 - DNA, 19 bp, Homo sapiens
taaatatttcataaattaa

SEQ ID NO: 5931813 - DNA, 13 bp, Homo sapiens
taaatatttcatg

SEQ ID NO: 5931814 - DNA, 13 bp, Homo sapiens
taaatatttgaaa

SEQ ID NO: 5931815 - DNA, 23 bp, Homo sapiens
taaatatttgactttagtgaaag

SEQ ID NO: 5931816 - DNA, 15 bp, Homo sapiens
taaatattttaaaga

SEQ ID NO: 5931817 - DNA, 15 bp, Homo sapiens
taaatattttacagt

SEQ ID NO: 5931818 - DNA, 16 bp, Homo sapiens
taaatattttaggaaa

SEQ ID NO: 5931819 - DNA, 17 bp, Homo sapiens
taaatattttaggaaac

SEQ ID NO: 5931820 - DNA, 18 bp, Homo sapiens
taaatattttaggaaact

SEQ ID NO: 5931821 - DNA, 14 bp, Homo sapiens
taaatattttgcta

SEQ ID NO: 5931822 - DNA, 15 bp, Homo sapiens
taaatattttgctaa

SEQ ID NO: 5931823 - DNA, 17 bp, Homo sapiens
taaatattttgctaact

SEQ ID NO: 5931824 - DNA, 22 bp, Homo sapiens
taaatattttttcttttctatt

SEQ ID NO: 5931825 - DNA, 18 bp, Homo sapiens
taaatatttttttaacct

SEQ ID NO: 5931826 - DNA, 16 bp, Homo sapiens
taaatcaaaagctgct

SEQ ID NO: 5931827 - DNA, 19 bp, Homo sapiens
taaatcaaaagctgcttga

SEQ ID NO: 5931828 - DNA, 22 bp, Homo sapiens
taaatcaagagtgaacatgtac

SEQ ID NO: 5931829 - DNA, 12 bp, Homo sapiens
taaatcaatcag

SEQ ID NO: 5931830 - DNA, 14 bp, Homo sapiens
taaatcaatcttat

SEQ ID NO: 5931831 - DNA, 16 bp, Homo sapiens
taaatcaatcttatta

SEQ ID NO: 5931832 - DNA, 18 bp, Homo sapiens
taaatcacactcaaactt

SEQ ID NO: 5931833 - DNA, 12 bp, Homo sapiens
taaatcacagat

SEQ ID NO: 5931834 - DNA, 17 bp, Homo sapiens
taaatcacagatgcata

SEQ ID NO: 5931835 - DNA, 23 bp, Homo sapiens
taaatcacagatgcatatagaca

SEQ ID NO: 5931836 - DNA, 18 bp, Homo sapiens
taaatcacgctttttgaa

SEQ ID NO: 5931837 - DNA, 17 bp, Homo sapiens
taaatcacttcattgtt

SEQ ID NO: 5931838 - DNA, 15 bp, Homo sapiens
taaatcacttgtaaa

SEQ ID NO: 5931839 - DNA, 18 bp, Homo sapiens
taaatcacttgtaaataa

SEQ ID NO: 5931840 - DNA, 23 bp, Homo sapiens
taaatcacttgtaaataaataga

SEQ ID NO: 5931841 - DNA, 13 bp, Homo sapiens
taaatcagaaata

SEQ ID NO: 5931842 - DNA, 17 bp, Homo sapiens
taaatcagaataaatta

SEQ ID NO: 5931843 - DNA, 22 bp, Homo sapiens
taaatcagatgttttggtcaag

SEQ ID NO: 5931844 - DNA, 22 bp, Homo sapiens
taaatcagtcaagctgttgaag

SEQ ID NO: 5931845 - DNA, 11 bp, Homo sapiens
taaatcagtgg

SEQ ID NO: 5931846 - DNA, 15 bp, Homo sapiens
taaatcataaagtca

SEQ ID NO: 5931847 - DNA, 16 bp, Homo sapiens
taaatcataaagtcag

SEQ ID NO: 5931848 - DNA, 14 bp, Homo sapiens
taaatcataatcat

SEQ ID NO: 5931849 - DNA, 20 bp, Homo sapiens
taaatcatattagtattaat

SEQ ID NO: 5931850 - DNA, 19 bp, Homo sapiens
taaatcatattgatgaaaa

SEQ ID NO: 5931851 - DNA, 16 bp, Homo sapiens
taaatcatcctcatgt

SEQ ID NO: 5931852 - DNA, 16 bp, Homo sapiens
taaatcatgtatgtta

SEQ ID NO: 5931853 - DNA, 19 bp, Homo sapiens
taaatcatgtatgttatga

SEQ ID NO: 5931854 - DNA, 15 bp, Homo sapiens
taaatcatgtggcct

SEQ ID NO: 5931855 - DNA, 13 bp, Homo sapiens
taaatcatgttgt

SEQ ID NO: 5931856 - DNA, 14 bp, Homo sapiens
taaatcattaatac

SEQ ID NO: 5931857 - DNA, 15 bp, Homo sapiens
taaatcatttcagta

SEQ ID NO: 5931858 - DNA, 21 bp, Homo sapiens
taaatcatttggttaaatcat

SEQ ID NO: 5931859 - DNA, 17 bp, Homo sapiens
taaatcattttaggaaa

SEQ ID NO: 5931860 - DNA, 19 bp, Homo sapiens
taaatcattttaggaaagg

SEQ ID NO: 5931861 - DNA, 20 bp, Homo sapiens
taaatcattttaggaaagga

SEQ ID NO: 5931862 - DNA, 21 bp, Homo sapiens
taaatcattttaggaaaggat

SEQ ID NO: 5931863 - DNA, 15 bp, Homo sapiens
taaatcattttatgt

SEQ ID NO: 5931864 - DNA, 17 bp, Homo sapiens
taaatcattttcattaa

SEQ ID NO: 5931865 - DNA, 12 bp, Homo sapiens
taaatccaaaga

SEQ ID NO: 5931866 - DNA, 13 bp, Homo sapiens
taaatccaaagaa

SEQ ID NO: 5931867 - DNA, 14 bp, Homo sapiens
taaatccaaagtaa

SEQ ID NO: 5931868 - DNA, 14 bp, Homo sapiens
taaatccaataaaa

SEQ ID NO: 5931869 - DNA, 19 bp, Homo sapiens
taaatccaatatcatgtct

SEQ ID NO: 5931870 - DNA, 23 bp, Homo sapiens
taaatccaggctttatgtacaaa

SEQ ID NO: 5931871 - DNA, 20 bp, Homo sapiens
taaatccagtggggaaaaaa

SEQ ID NO: 5931872 - DNA, 21 bp, Homo sapiens
taaatccatcactataataaa

SEQ ID NO: 5931873 - DNA, 14 bp, Homo sapiens
taaatccatttgga

SEQ ID NO: 5931874 - DNA, 15 bp, Homo sapiens
taaatccattttcta

SEQ ID NO: 5931875 - DNA, 16 bp, Homo sapiens
taaatccattttctaa

SEQ ID NO: 5931876 - DNA, 17 bp, Homo sapiens
taaatccattttctaaa

SEQ ID NO: 5931877 - DNA, 20 bp, Homo sapiens
taaatccattttctaaactg

SEQ ID NO: 5931878 - DNA, 16 bp, Homo sapiens
taaatcccattattca

SEQ ID NO: 5931879 - DNA, 15 bp, Homo sapiens
taaatcccattcata

SEQ ID NO: 5931880 - DNA, 23 bp, Homo sapiens
taaatcccatttctaaaaaccac

SEQ ID NO: 5931881 - DNA, 23 bp, Homo sapiens
taaatccgacttgaatattcctg

SEQ ID NO: 5931882 - DNA, 12 bp, Homo sapiens
taaatcctccag

SEQ ID NO: 5931883 - DNA, 15 bp, Homo sapiens
taaatcctctattga

SEQ ID NO: 5931884 - DNA, 14 bp, Homo sapiens
taaatcctgaagag

SEQ ID NO: 5931885 - DNA, 14 bp, Homo sapiens
taaatcctgttgaa

SEQ ID NO: 5931886 - DNA, 15 bp, Homo sapiens
taaatcctgttgaaa

SEQ ID NO: 5931887 - DNA, 16 bp, Homo sapiens
taaatcctgttgaaaa

SEQ ID NO: 5931888 - DNA, 17 bp, Homo sapiens
taaatcctgttgaaaag

SEQ ID NO: 5931889 - DNA, 14 bp, Homo sapiens
taaatccttcgtcc

SEQ ID NO: 5931890 - DNA, 19 bp, Homo sapiens
taaatccttgggagtcatt

SEQ ID NO: 5931891 - DNA, 23 bp, Homo sapiens
taaatccttgggagtcattacca

SEQ ID NO: 5931892 - DNA, 17 bp, Homo sapiens
taaatcctttactgtta

SEQ ID NO: 5931893 - DNA, 17 bp, Homo sapiens
taaatcctttttcttta

SEQ ID NO: 5931894 - DNA, 20 bp, Homo sapiens
taaatcgatccatgttttgt

SEQ ID NO: 5931895 - DNA, 19 bp, Homo sapiens
taaatcgcttttgataatc

SEQ ID NO: 5931896 - DNA, 16 bp, Homo sapiens
taaatcgggaaggatg

SEQ ID NO: 5931897 - DNA, 19 bp, Homo sapiens
taaatcgtaacaagcaata

SEQ ID NO: 5931898 - DNA, 19 bp, Homo sapiens
taaatcgtactacagaaat

SEQ ID NO: 5931899 - DNA, 16 bp, Homo sapiens
taaatctaaacaaaaa

SEQ ID NO: 5931900 - DNA, 14 bp, Homo sapiens
taaatctaaatcta

SEQ ID NO: 5931901 - DNA, 17 bp, Homo sapiens
taaatctacaaactttt

SEQ ID NO: 5931902 - DNA, 15 bp, Homo sapiens
taaatctacacacgg

SEQ ID NO: 5931903 - DNA, 19 bp, Homo sapiens
taaatctactcttaaatat

SEQ ID NO: 5931904 - DNA, 16 bp, Homo sapiens
taaatctagagtttat

SEQ ID NO: 5931905 - DNA, 23 bp, Homo sapiens
taaatctagagtttatacagtgt

SEQ ID NO: 5931906 - DNA, 19 bp, Homo sapiens
taaatctaggatgtgatga

SEQ ID NO: 5931907 - DNA, 15 bp, Homo sapiens
taaatctagtttact

SEQ ID NO: 5931908 - DNA, 19 bp, Homo sapiens
taaatctatgaagtatata

SEQ ID NO: 5931909 - DNA, 20 bp, Homo sapiens
taaatctatgaagtatataa

SEQ ID NO: 5931910 - DNA, 14 bp, Homo sapiens
taaatctccaaaat

SEQ ID NO: 5931911 - DNA, 21 bp, Homo sapiens
taaatctccaaaataaaactt

SEQ ID NO: 5931912 - DNA, 22 bp, Homo sapiens
taaatctccagcttactataaa

SEQ ID NO: 5931913 - DNA, 16 bp, Homo sapiens
taaatctcctattttt

SEQ ID NO: 5931914 - DNA, 17 bp, Homo sapiens
taaatctcctatttttt

SEQ ID NO: 5931915 - DNA, 22 bp, Homo sapiens
taaatctctatctctttatata

SEQ ID NO: 5931916 - DNA, 15 bp, Homo sapiens
taaatctcttaaact

SEQ ID NO: 5931917 - DNA, 13 bp, Homo sapiens
taaatctgaagaa

SEQ ID NO: 5931918 - DNA, 20 bp, Homo sapiens
taaatctgaagaaagttatt

SEQ ID NO: 5931919 - DNA, 21 bp, Homo sapiens
taaatctgaattttaaaacat

SEQ ID NO: 5931920 - DNA, 15 bp, Homo sapiens
taaatctgacccagt

SEQ ID NO: 5931921 - DNA, 17 bp, Homo sapiens
taaatctgacccagtgc

SEQ ID NO: 5931922 - DNA, 23 bp, Homo sapiens
taaatctgagaggtaagaagtaa

SEQ ID NO: 5931923 - DNA, 15 bp, Homo sapiens
taaatctgattaatc

SEQ ID NO: 5931924 - DNA, 22 bp, Homo sapiens
taaatctggggaagaggtttta

SEQ ID NO: 5931925 - DNA, 18 bp, Homo sapiens
taaatctgtaagctcttt

SEQ ID NO: 5931926 - DNA, 12 bp, Homo sapiens
taaatctgtact

SEQ ID NO: 5931927 - DNA, 17 bp, Homo sapiens
taaatctgtactttttt

SEQ ID NO: 5931928 - DNA, 19 bp, Homo sapiens
taaatctgtacttttttca

SEQ ID NO: 5931929 - DNA, 20 bp, Homo sapiens
taaatctgtacttttttcaa

SEQ ID NO: 5931930 - DNA, 14 bp, Homo sapiens
taaatctgtctgat

SEQ ID NO: 5931931 - DNA, 22 bp, Homo sapiens
taaatctgtgaacttgaaattt

SEQ ID NO: 5931932 - DNA, 14 bp, Homo sapiens
taaatctgtgatga

SEQ ID NO: 5931933 - DNA, 20 bp, Homo sapiens
taaatctgttgccaagctgg

SEQ ID NO: 5931934 - DNA, 13 bp, Homo sapiens
taaatcttaaaca

SEQ ID NO: 5931935 - DNA, 19 bp, Homo sapiens
taaatcttaatacttgaac

SEQ ID NO: 5931936 - DNA, 17 bp, Homo sapiens
taaatcttaatgttcct

SEQ ID NO: 5931937 - DNA, 19 bp, Homo sapiens
taaatcttaatgttcctca

SEQ ID NO: 5931938 - DNA, 19 bp, Homo sapiens
taaatcttccaatttcctt

SEQ ID NO: 5931939 - DNA, 16 bp, Homo sapiens
taaatcttccttgtga

SEQ ID NO: 5931940 - DNA, 18 bp, Homo sapiens
taaatcttccttgtgagg

SEQ ID NO: 5931941 - DNA, 19 bp, Homo sapiens
taaatcttccttgtgagga

SEQ ID NO: 5931942 - DNA, 16 bp, Homo sapiens
taaatctttcttcaaa

SEQ ID NO: 5931943 - DNA, 14 bp, Homo sapiens
taaatctttgtgaa

SEQ ID NO: 5931944 - DNA, 18 bp, Homo sapiens
taaatctttgttaaaata

SEQ ID NO: 5931945 - DNA, 20 bp, Homo sapiens
taaatctttgttaaaatata

SEQ ID NO: 5931946 - DNA, 21 bp, Homo sapiens
taaatctttgttaaaatatag

SEQ ID NO: 5931947 - DNA, 14 bp, Homo sapiens
taaatcttttacaa

SEQ ID NO: 5931948 - DNA, 14 bp, Homo sapiens
taaatgaaaaacac

SEQ ID NO: 5931949 - DNA, 15 bp, Homo sapiens
taaatgaaaaacaca

SEQ ID NO: 5931950 - DNA, 15 bp, Homo sapiens
taaatgaaaagagaa

SEQ ID NO: 5931951 - DNA, 18 bp, Homo sapiens
taaatgaaaatgtaactt

SEQ ID NO: 5931952 - DNA, 14 bp, Homo sapiens
taaatgaaacaagt

SEQ ID NO: 5931953 - DNA, 13 bp, Homo sapiens
taaatgaaagaaa

SEQ ID NO: 5931954 - DNA, 14 bp, Homo sapiens
taaatgaaagctat

SEQ ID NO: 5931955 - DNA, 12 bp, Homo sapiens
taaatgaaatac

SEQ ID NO: 5931956 - DNA, 14 bp, Homo sapiens
taaatgaaatactt

SEQ ID NO: 5931957 - DNA, 14 bp, Homo sapiens
taaatgaaattgta

SEQ ID NO: 5931958 - DNA, 17 bp, Homo sapiens
taaatgaaatttgcaaa

SEQ ID NO: 5931959 - DNA, 18 bp, Homo sapiens
taaatgaaatttgcaaaa

SEQ ID NO: 5931960 - DNA, 17 bp, Homo sapiens
taaatgaacaagagaag

SEQ ID NO: 5931961 - DNA, 18 bp, Homo sapiens
taaatgaacacatggcag

SEQ ID NO: 5931962 - DNA, 15 bp, Homo sapiens
taaatgaacatttaa

SEQ ID NO: 5931963 - DNA, 15 bp, Homo sapiens
taaatgaactgattt

SEQ ID NO: 5931964 - DNA, 16 bp, Homo sapiens
taaatgaactgatttt

SEQ ID NO: 5931965 - DNA, 14 bp, Homo sapiens
taaatgaagattac

SEQ ID NO: 5931966 - DNA, 16 bp, Homo sapiens
taaatgaagcagcttt

SEQ ID NO: 5931967 - DNA, 17 bp, Homo sapiens
taaatgaagcagcttta

SEQ ID NO: 5931968 - DNA, 22 bp, Homo sapiens
taaatgaagcagctttaaacaa

SEQ ID NO: 5931969 - DNA, 20 bp, Homo sapiens
taaatgaagggtcatttctc

SEQ ID NO: 5931970 - DNA, 18 bp, Homo sapiens
taaatgaagtttatacag

SEQ ID NO: 5931971 - DNA, 20 bp, Homo sapiens
taaatgaagtttatacagta

SEQ ID NO: 5931972 - DNA, 15 bp, Homo sapiens
taaatgaatattttg

SEQ ID NO: 5931973 - DNA, 21 bp, Homo sapiens
taaatgaatcgcaagttaact

SEQ ID NO: 5931974 - DNA, 16 bp, Homo sapiens
taaatgaatctggtgt

SEQ ID NO: 5931975 - DNA, 16 bp, Homo sapiens
taaatgaatcttactc

SEQ ID NO: 5931976 - DNA, 15 bp, Homo sapiens
taaatgaatgcttct

SEQ ID NO: 5931977 - DNA, 20 bp, Homo sapiens
taaatgaattaaatattgaa

SEQ ID NO: 5931978 - DNA, 15 bp, Homo sapiens
taaatgacaaagtgt

SEQ ID NO: 5931979 - DNA, 16 bp, Homo sapiens
taaatgacaaagtgtt

SEQ ID NO: 5931980 - DNA, 15 bp, Homo sapiens
taaatgacacccaga

SEQ ID NO: 5931981 - DNA, 13 bp, Homo sapiens
taaatgacactca

SEQ ID NO: 5931982 - DNA, 16 bp, Homo sapiens
taaatgacagtaatat

SEQ ID NO: 5931983 - DNA, 14 bp, Homo sapiens
taaatgaccaaaga

SEQ ID NO: 5931984 - DNA, 19 bp, Homo sapiens
taaatgaccaagaaaaaga

SEQ ID NO: 5931985 - DNA, 13 bp, Homo sapiens
taaatgaccagtt

SEQ ID NO: 5931986 - DNA, 14 bp, Homo sapiens
taaatgaccagttt

SEQ ID NO: 5931987 - DNA, 16 bp, Homo sapiens
taaatgacctcagcaa

SEQ ID NO: 5931988 - DNA, 16 bp, Homo sapiens
taaatgactcttccct

SEQ ID NO: 5931989 - DNA, 14 bp, Homo sapiens
taaatgactgaagt

SEQ ID NO: 5931990 - DNA, 20 bp, Homo sapiens
taaatgacttgattgtactt

SEQ ID NO: 5931991 - DNA, 15 bp, Homo sapiens
taaatgacttgcaga

SEQ ID NO: 5931992 - DNA, 22 bp, Homo sapiens
taaatgacttgcagatgaaaaa

SEQ ID NO: 5931993 - DNA, 15 bp, Homo sapiens
taaatgactttcata

SEQ ID NO: 5931994 - DNA, 13 bp, Homo sapiens
taaatgacttttc

SEQ ID NO: 5931995 - DNA, 16 bp, Homo sapiens
taaatgacttttctta

SEQ ID NO: 5931996 - DNA, 19 bp, Homo sapiens
taaatgagaagtacttggt

SEQ ID NO: 5931997 - DNA, 17 bp, Homo sapiens
taaatgagacacataca

SEQ ID NO: 5931998 - DNA, 19 bp, Homo sapiens
taaatgagacccctttaaa

SEQ ID NO: 5931999 - DNA, 22 bp, Homo sapiens
taaatgagcaaatatcatactg

SEQ ID NO: 5932000 - DNA, 14 bp, Homo sapiens
taaatgagctcctg

SEQ ID NO: 5932001 - DNA, 16 bp, Homo sapiens
taaatgagctcctgcg

SEQ ID NO: 5932002 - DNA, 18 bp, Homo sapiens
taaatgagcttaatgtct

SEQ ID NO: 5932003 - DNA, 20 bp, Homo sapiens
taaatgagggtttctgatct

SEQ ID NO: 5932004 - DNA, 23 bp, Homo sapiens
taaatgatatctatattctaaag

SEQ ID NO: 5932005 - DNA, 11 bp, Homo sapiens
taaatgatatt

SEQ ID NO: 5932006 - DNA, 17 bp, Homo sapiens
taaatgatatttaggtt

SEQ ID NO: 5932007 - DNA, 21 bp, Homo sapiens
taaatgatatttaggtttttg

SEQ ID NO: 5932008 - DNA, 21 bp, Homo sapiens
taaatgatgtggtgcctgagg

SEQ ID NO: 5932009 - DNA, 23 bp, Homo sapiens
taaatgatgtgttggtttacagg

SEQ ID NO: 5932010 - DNA, 15 bp, Homo sapiens
taaatgattccaaat

SEQ ID NO: 5932011 - DNA, 16 bp, Homo sapiens
taaatgattccaaata

SEQ ID NO: 5932012 - DNA, 16 bp, Homo sapiens
taaatgattttatgtt

SEQ ID NO: 5932013 - DNA, 17 bp, Homo sapiens
taaatgcaaacactgtg

SEQ ID NO: 5932014 - DNA, 19 bp, Homo sapiens
taaatgcaaccagaattgt

SEQ ID NO: 5932015 - DNA, 11 bp, Homo sapiens
taaatgcaata

SEQ ID NO: 5932016 - DNA, 12 bp, Homo sapiens
taaatgcaataa

SEQ ID NO: 5932017 - DNA, 15 bp, Homo sapiens
taaatgcaatatgta

SEQ ID NO: 5932018 - DNA, 19 bp, Homo sapiens
taaatgcaatattaatgcc

SEQ ID NO: 5932019 - DNA, 20 bp, Homo sapiens
taaatgcaatttaaaattat

SEQ ID NO: 5932020 - DNA, 15 bp, Homo sapiens
taaatgcactgtaat

SEQ ID NO: 5932021 - DNA, 17 bp, Homo sapiens
taaatgcagttacaaat

SEQ ID NO: 5932022 - DNA, 17 bp, Homo sapiens
taaatgcagttttaaga

SEQ ID NO: 5932023 - DNA, 10 bp, Homo sapiens
taaatgcata

SEQ ID NO: 5932024 - DNA, 21 bp, Homo sapiens
taaatgcatatcctgagccat

SEQ ID NO: 5932025 - DNA, 15 bp, Homo sapiens
taaatgcatgatttt

SEQ ID NO: 5932026 - DNA, 21 bp, Homo sapiens
taaatgcatgattttatacat

SEQ ID NO: 5932027 - DNA, 22 bp, Homo sapiens
taaatgcatgtcttaaatgctc

SEQ ID NO: 5932028 - DNA, 16 bp, Homo sapiens
taaatgccaaaatgta

SEQ ID NO: 5932029 - DNA, 19 bp, Homo sapiens
taaatgccaaaatgtactt

SEQ ID NO: 5932030 - DNA, 18 bp, Homo sapiens
taaatgccaactggtcac

SEQ ID NO: 5932031 - DNA, 12 bp, Homo sapiens
taaatgccagag

SEQ ID NO: 5932032 - DNA, 16 bp, Homo sapiens
taaatgccagagccaa

SEQ ID NO: 5932033 - DNA, 15 bp, Homo sapiens
taaatgccatagaaa

SEQ ID NO: 5932034 - DNA, 16 bp, Homo sapiens
taaatgccatcaataa

SEQ ID NO: 5932035 - DNA, 21 bp, Homo sapiens
taaatgcccagcacaattcat

SEQ ID NO: 5932036 - DNA, 15 bp, Homo sapiens
taaatgccctctctg

SEQ ID NO: 5932037 - DNA, 16 bp, Homo sapiens
taaatgccctctctga

SEQ ID NO: 5932038 - DNA, 19 bp, Homo sapiens
taaatgccctttgatgttt

SEQ ID NO: 5932039 - DNA, 14 bp, Homo sapiens
taaatgcctaataa

SEQ ID NO: 5932040 - DNA, 14 bp, Homo sapiens
taaatgcctagttt

SEQ ID NO: 5932041 - DNA, 17 bp, Homo sapiens
taaatgccttgcttgta

SEQ ID NO: 5932042 - DNA, 16 bp, Homo sapiens
taaatgccttggtttg

SEQ ID NO: 5932043 - DNA, 17 bp, Homo sapiens
taaatgccttgtataaa

SEQ ID NO: 5932044 - DNA, 18 bp, Homo sapiens
taaatgccttgtataaaa

SEQ ID NO: 5932045 - DNA, 15 bp, Homo sapiens
taaatgctacctctg

SEQ ID NO: 5932046 - DNA, 14 bp, Homo sapiens
taaatgctatggaa

SEQ ID NO: 5932047 - DNA, 22 bp, Homo sapiens
taaatgctatggaaatacattt

SEQ ID NO: 5932048 - DNA, 13 bp, Homo sapiens
taaatgctattat

SEQ ID NO: 5932049 - DNA, 16 bp, Homo sapiens
taaatgctcatacaca

SEQ ID NO: 5932050 - DNA, 17 bp, Homo sapiens
taaatgctcattttctg

SEQ ID NO: 5932051 - DNA, 19 bp, Homo sapiens
taaatgctcattttcttta

SEQ ID NO: 5932052 - DNA, 14 bp, Homo sapiens
taaatgctccagca

SEQ ID NO: 5932053 - DNA, 17 bp, Homo sapiens
taaatgctcctagagta

SEQ ID NO: 5932054 - DNA, 17 bp, Homo sapiens
taaatgctcgtgtgatt

SEQ ID NO: 5932055 - DNA, 15 bp, Homo sapiens
taaatgctctatttt

SEQ ID NO: 5932056 - DNA, 22 bp, Homo sapiens
taaatgctctctcatcttgttc

SEQ ID NO: 5932057 - DNA, 13 bp, Homo sapiens
taaatgctgaaat

SEQ ID NO: 5932058 - DNA, 23 bp, Homo sapiens
taaatgctgattatttagagcca

SEQ ID NO: 5932059 - DNA, 14 bp, Homo sapiens
taaatgctgctttg

SEQ ID NO: 5932060 - DNA, 15 bp, Homo sapiens
taaatgctgctttgg

SEQ ID NO: 5932061 - DNA, 17 bp, Homo sapiens
taaatgctgtaaatatt

SEQ ID NO: 5932062 - DNA, 22 bp, Homo sapiens
taaatgctgtgtacaacaatgc

SEQ ID NO: 5932063 - DNA, 15 bp, Homo sapiens
taaatgcttaaattt

SEQ ID NO: 5932064 - DNA, 16 bp, Homo sapiens
taaatgcttaaatttc

SEQ ID NO: 5932065 - DNA, 12 bp, Homo sapiens
taaatgctttaa

SEQ ID NO: 5932066 - DNA, 15 bp, Homo sapiens
taaatgctttaaata

SEQ ID NO: 5932067 - DNA, 14 bp, Homo sapiens
taaatgcttttaaa

SEQ ID NO: 5932068 - DNA, 12 bp, Homo sapiens
taaatgcttttt

SEQ ID NO: 5932069 - DNA, 19 bp, Homo sapiens
taaatggaaacaccactgc

SEQ ID NO: 5932070 - DNA, 11 bp, Homo sapiens
taaatggaaat

SEQ ID NO: 5932071 - DNA, 16 bp, Homo sapiens
taaatggaaccactct

SEQ ID NO: 5932072 - DNA, 17 bp, Homo sapiens
taaatggaattattttg

SEQ ID NO: 5932073 - DNA, 22 bp, Homo sapiens
taaatggaattcgtgttatgaa

SEQ ID NO: 5932074 - DNA, 19 bp, Homo sapiens
taaatggcacctgtatacc

SEQ ID NO: 5932075 - DNA, 17 bp, Homo sapiens
taaatggcagtatttca

SEQ ID NO: 5932076 - DNA, 15 bp, Homo sapiens
taaatggcattgaca

SEQ ID NO: 5932077 - DNA, 19 bp, Homo sapiens
taaatggcctctctccact

SEQ ID NO: 5932078 - DNA, 11 bp, Homo sapiens
taaatggctgc

SEQ ID NO: 5932079 - DNA, 16 bp, Homo sapiens
taaatggcttgatttt

SEQ ID NO: 5932080 - DNA, 16 bp, Homo sapiens
taaatgggaacattta

SEQ ID NO: 5932081 - DNA, 17 bp, Homo sapiens
taaatgggaacatttat

SEQ ID NO: 5932082 - DNA, 23 bp, Homo sapiens
taaatgggaacatttattttatg

SEQ ID NO: 5932083 - DNA, 18 bp, Homo sapiens
taaatgggagcaacatat

SEQ ID NO: 5932084 - DNA, 22 bp, Homo sapiens
taaatgggagcaacatatcagt

SEQ ID NO: 5932085 - DNA, 11 bp, Homo sapiens
taaatgggcac

SEQ ID NO: 5932086 - DNA, 19 bp, Homo sapiens
taaatgggcagtgcctcct

SEQ ID NO: 5932087 - DNA, 20 bp, Homo sapiens
taaatgggcagtgcctcctg

SEQ ID NO: 5932088 - DNA, 18 bp, Homo sapiens
taaatggggagacaaagg

SEQ ID NO: 5932089 - DNA, 17 bp, Homo sapiens
taaatggggctcacaaa

SEQ ID NO: 5932090 - DNA, 17 bp, Homo sapiens
taaatgggtgaaaaatg

SEQ ID NO: 5932091 - DNA, 19 bp, Homo sapiens
taaatgggtgtatataatt

SEQ ID NO: 5932092 - DNA, 18 bp, Homo sapiens
taaatggtgagaattaaa

SEQ ID NO: 5932093 - DNA, 23 bp, Homo sapiens
taaatggtgagaattaaaataaa

SEQ ID NO: 5932094 - DNA, 19 bp, Homo sapiens
taaatggtgatttcttgct

SEQ ID NO: 5932095 - DNA, 22 bp, Homo sapiens
taaatggtgggaaccctcccca

SEQ ID NO: 5932096 - DNA, 23 bp, Homo sapiens
taaatggtgggaaccctccccaa

SEQ ID NO: 5932097 - DNA, 16 bp, Homo sapiens
taaatggtgtacataa

SEQ ID NO: 5932098 - DNA, 17 bp, Homo sapiens
taaatggtgtacataat

SEQ ID NO: 5932099 - DNA, 14 bp, Homo sapiens
taaatggtgttaca

SEQ ID NO: 5932100 - DNA, 20 bp, Homo sapiens
taaatggttaaattttacat

SEQ ID NO: 5932101 - DNA, 22 bp, Homo sapiens
taaatggtttggtgctttttat

SEQ ID NO: 5932102 - DNA, 15 bp, Homo sapiens
taaatggttttcaac

SEQ ID NO: 5932103 - DNA, 16 bp, Homo sapiens
taaatggtttttaaat

SEQ ID NO: 5932104 - DNA, 15 bp, Homo sapiens
taaatgtaaactcag

SEQ ID NO: 5932105 - DNA, 13 bp, Homo sapiens
taaatgtaaagat

SEQ ID NO: 5932106 - DNA, 12 bp, Homo sapiens
taaatgtaaagt

SEQ ID NO: 5932107 - DNA, 17 bp, Homo sapiens
taaatgtaacagtctga

SEQ ID NO: 5932108 - DNA, 14 bp, Homo sapiens
taaatgtaacttat

SEQ ID NO: 5932109 - DNA, 15 bp, Homo sapiens
taaatgtaacttatt

SEQ ID NO: 5932110 - DNA, 21 bp, Homo sapiens
taaatgtacagacatatttaa

SEQ ID NO: 5932111 - DNA, 22 bp, Homo sapiens
taaatgtacatttccaaatgaa

SEQ ID NO: 5932112 - DNA, 21 bp, Homo sapiens
taaatgtacccctctcagtct

SEQ ID NO: 5932113 - DNA, 17 bp, Homo sapiens
taaatgtagacagatat

SEQ ID NO: 5932114 - DNA, 17 bp, Homo sapiens
taaatgtagagttttta

SEQ ID NO: 5932115 - DNA, 15 bp, Homo sapiens
taaatgtataaatat

SEQ ID NO: 5932116 - DNA, 22 bp, Homo sapiens
taaatgtataaatatacagtat

SEQ ID NO: 5932117 - DNA, 13 bp, Homo sapiens
taaatgtatacta

SEQ ID NO: 5932118 - DNA, 12 bp, Homo sapiens
taaatgtatctg

SEQ ID NO: 5932119 - DNA, 17 bp, Homo sapiens
taaatgtatttaattaa

SEQ ID NO: 5932120 - DNA, 13 bp, Homo sapiens
taaatgtatttta

SEQ ID NO: 5932121 - DNA, 17 bp, Homo sapiens
taaatgtcactttttga

SEQ ID NO: 5932122 - DNA, 21 bp, Homo sapiens
taaatgtcactttttgaggca

SEQ ID NO: 5932123 - DNA, 17 bp, Homo sapiens
taaatgtcagttgaaaa

SEQ ID NO: 5932124 - DNA, 23 bp, Homo sapiens
taaatgtccacttaaaatacatg

SEQ ID NO: 5932125 - DNA, 20 bp, Homo sapiens
taaatgtcccaaataaattt

SEQ ID NO: 5932126 - DNA, 22 bp, Homo sapiens
taaatgtcccaaataaatttat

SEQ ID NO: 5932127 - DNA, 14 bp, Homo sapiens
taaatgtccctaat

SEQ ID NO: 5932128 - DNA, 16 bp, Homo sapiens
taaatgtctaatgtat

SEQ ID NO: 5932129 - DNA, 20 bp, Homo sapiens
taaatgtctagttgtaacac

SEQ ID NO: 5932130 - DNA, 22 bp, Homo sapiens
taaatgtctctttaatgtcaca

SEQ ID NO: 5932131 - DNA, 13 bp, Homo sapiens
taaatgtctgcac

SEQ ID NO: 5932132 - DNA, 19 bp, Homo sapiens
taaatgtctgcactgagga

SEQ ID NO: 5932133 - DNA, 22 bp, Homo sapiens
taaatgtctgcactgaggattt

SEQ ID NO: 5932134 - DNA, 12 bp, Homo sapiens
taaatgtctgtt

SEQ ID NO: 5932135 - DNA, 14 bp, Homo sapiens
taaatgtcttatat

SEQ ID NO: 5932136 - DNA, 22 bp, Homo sapiens
taaatgtcttcatgttgatgtg

SEQ ID NO: 5932137 - DNA, 23 bp, Homo sapiens
taaatgtcttcatgttgatgtgt

SEQ ID NO: 5932138 - DNA, 13 bp, Homo sapiens
taaatgtctttgt

SEQ ID NO: 5932139 - DNA, 16 bp, Homo sapiens
taaatgtctttgtaag

SEQ ID NO: 5932140 - DNA, 23 bp, Homo sapiens
taaatgtcttttttttaatgtgc

SEQ ID NO: 5932141 - DNA, 16 bp, Homo sapiens
taaatgtgaaattttt

SEQ ID NO: 5932142 - DNA, 22 bp, Homo sapiens
taaatgtgaattactaacttct

SEQ ID NO: 5932143 - DNA, 23 bp, Homo sapiens
taaatgtgagtatttctgttcct

SEQ ID NO: 5932144 - DNA, 19 bp, Homo sapiens
taaatgtgatgaatactgt

SEQ ID NO: 5932145 - DNA, 21 bp, Homo sapiens
taaattttttgacctatttta

SEQ ID NO: 5932146 - DNA, 22 bp, Homo sapiens
taaattttttttggtcaaattt

SEQ ID NO: 5932147 - DNA, 16 bp, Homo sapiens
taacaaaaaagagaaa

SEQ ID NO: 5932148 - DNA, 13 bp, Homo sapiens
taacaaaaaataa

SEQ ID NO: 5932149 - DNA, 17 bp, Homo sapiens
taacaaaaaataaattt

SEQ ID NO: 5932150 - DNA, 16 bp, Homo sapiens
taacaaaaaatgtaat

SEQ ID NO: 5932151 - DNA, 18 bp, Homo sapiens
taacaaaaactacacata

SEQ ID NO: 5932152 - DNA, 14 bp, Homo sapiens
taacaaaacaagaa

SEQ ID NO: 5932153 - DNA, 16 bp, Homo sapiens
taacaaaactgtgcca

SEQ ID NO: 5932154 - DNA, 12 bp, Homo sapiens
taacaaaagatg

SEQ ID NO: 5932155 - DNA, 15 bp, Homo sapiens
taacaaaagatgaaa

SEQ ID NO: 5932156 - DNA, 21 bp, Homo sapiens
taacaaaataaggttatatga

SEQ ID NO: 5932157 - DNA, 13 bp, Homo sapiens
taacaaaatcaca

SEQ ID NO: 5932158 - DNA, 20 bp, Homo sapiens
taacaaaatcacttccatag

SEQ ID NO: 5932159 - DNA, 20 bp, Homo sapiens
taacaaaatgtatgtctggt

SEQ ID NO: 5932160 - DNA, 15 bp, Homo sapiens
taacaaaatttgaat

SEQ ID NO: 5932161 - DNA, 23 bp, Homo sapiens
taacaaaatttgaataataaatc

SEQ ID NO: 5932162 - DNA, 13 bp, Homo sapiens
taacaaacaaaat

SEQ ID NO: 5932163 - DNA, 13 bp, Homo sapiens
taacaaacaaatt

SEQ ID NO: 5932164 - DNA, 21 bp, Homo sapiens
taacaaacatcactctgctgc

SEQ ID NO: 5932165 - DNA, 20 bp, Homo sapiens
taacaaaccaacatctttgc

SEQ ID NO: 5932166 - DNA, 15 bp, Homo sapiens
taacaaaccatctgg

SEQ ID NO: 5932167 - DNA, 18 bp, Homo sapiens
taacaaaccatctggtgc

SEQ ID NO: 5932168 - DNA, 20 bp, Homo sapiens
taacaaaccctcgtttctga

SEQ ID NO: 5932169 - DNA, 21 bp, Homo sapiens
taacaaaccctcgtttctgat

SEQ ID NO: 5932170 - DNA, 14 bp, Homo sapiens
taacaaactaaaaa

SEQ ID NO: 5932171 - DNA, 20 bp, Homo sapiens
taacaaactacatgtaatcc

SEQ ID NO: 5932172 - DNA, 22 bp, Homo sapiens
taacaaagaacctaacatttat

SEQ ID NO: 5932173 - DNA, 19 bp, Homo sapiens
taacaaagaagtgtattta

SEQ ID NO: 5932174 - DNA, 13 bp, Homo sapiens
taacaaagacaaa

SEQ ID NO: 5932175 - DNA, 12 bp, Homo sapiens
taacaaagatat

SEQ ID NO: 5932176 - DNA, 14 bp, Homo sapiens
taacaaagatatct

SEQ ID NO: 5932177 - DNA, 20 bp, Homo sapiens
taacaaagcacataactgga

SEQ ID NO: 5932178 - DNA, 19 bp, Homo sapiens
taacaaaggaatgagaata

SEQ ID NO: 5932179 - DNA, 15 bp, Homo sapiens
taacaaaggatactt

SEQ ID NO: 5932180 - DNA, 18 bp, Homo sapiens
taacaaaggatacttatt

SEQ ID NO: 5932181 - DNA, 19 bp, Homo sapiens
taacaaaggatacttattt

SEQ ID NO: 5932182 - DNA, 14 bp, Homo sapiens
taacaaaggcaaga

SEQ ID NO: 5932183 - DNA, 14 bp, Homo sapiens
taacaaaggcagct

SEQ ID NO: 5932184 - DNA, 23 bp, Homo sapiens
taacaaaggcagctgtgtctgag

SEQ ID NO: 5932185 - DNA, 20 bp, Homo sapiens
taacaaagtgtcactccata

SEQ ID NO: 5932186 - DNA, 23 bp, Homo sapiens
taacaaagttactggctctttgt

SEQ ID NO: 5932187 - DNA, 18 bp, Homo sapiens
taacaaataacaactttt

SEQ ID NO: 5932188 - DNA, 20 bp, Homo sapiens
taacaaataacctataaagt

SEQ ID NO: 5932189 - DNA, 13 bp, Homo sapiens
taacaaatacatt

SEQ ID NO: 5932190 - DNA, 17 bp, Homo sapiens
taacaaatatgctaatt

SEQ ID NO: 5932191 - DNA, 23 bp, Homo sapiens
taacaaatatggctagttttcaa

SEQ ID NO: 5932192 - DNA, 21 bp, Homo sapiens
taacaaatctaaaaaagcact

SEQ ID NO: 5932193 - DNA, 20 bp, Homo sapiens
taacaaatgccaaattaaaa

SEQ ID NO: 5932194 - DNA, 21 bp, Homo sapiens
taacaaatgctttattattta

SEQ ID NO: 5932195 - DNA, 14 bp, Homo sapiens
taacaaatgtaaaa

SEQ ID NO: 5932196 - DNA, 16 bp, Homo sapiens
taacaaatgttttcat

SEQ ID NO: 5932197 - DNA, 12 bp, Homo sapiens
taacaaattatt

SEQ ID NO: 5932198 - DNA, 14 bp, Homo sapiens
taacaaattatttt

SEQ ID NO: 5932199 - DNA, 13 bp, Homo sapiens
taacaaattctga

SEQ ID NO: 5932200 - DNA, 20 bp, Homo sapiens
taacaaatttctttgtttaa

SEQ ID NO: 5932201 - DNA, 11 bp, Homo sapiens
taacaacaatg

SEQ ID NO: 5932202 - DNA, 14 bp, Homo sapiens
taacaacaattatt

SEQ ID NO: 5932203 - DNA, 20 bp, Homo sapiens
taacaacatataaaactgtt

SEQ ID NO: 5932204 - DNA, 20 bp, Homo sapiens
taacaacatgtttccagcat

SEQ ID NO: 5932205 - DNA, 15 bp, Homo sapiens
taacaaccaaagact

SEQ ID NO: 5932206 - DNA, 17 bp, Homo sapiens
taacaaccaacttgttg

SEQ ID NO: 5932207 - DNA, 20 bp, Homo sapiens
taacaaccctgttgagtatt

SEQ ID NO: 5932208 - DNA, 15 bp, Homo sapiens
taacaactaacttgt

SEQ ID NO: 5932209 - DNA, 16 bp, Homo sapiens
taacaactatgatttg

SEQ ID NO: 5932210 - DNA, 21 bp, Homo sapiens
taacaactatgatttggaaaa

SEQ ID NO: 5932211 - DNA, 22 bp, Homo sapiens
taacaactgagatgttaaaata

SEQ ID NO: 5932212 - DNA, 16 bp, Homo sapiens
taacaactgctgggaa

SEQ ID NO: 5932213 - DNA, 14 bp, Homo sapiens
taacaactgtgaat

SEQ ID NO: 5932214 - DNA, 19 bp, Homo sapiens
taacaactgtgaatatgag

SEQ ID NO: 5932215 - DNA, 16 bp, Homo sapiens
taacaactttcagtgg

SEQ ID NO: 5932216 - DNA, 15 bp, Homo sapiens
taacaagaaaatcaa

SEQ ID NO: 5932217 - DNA, 18 bp, Homo sapiens
taacaagaaactcacccc

SEQ ID NO: 5932218 - DNA, 15 bp, Homo sapiens
taacaagaagatgaa

SEQ ID NO: 5932219 - DNA, 16 bp, Homo sapiens
taacaagaagatgaat

SEQ ID NO: 5932220 - DNA, 15 bp, Homo sapiens
taacaagaagcccag

SEQ ID NO: 5932221 - DNA, 20 bp, Homo sapiens
taacaagagtgattcttgct

SEQ ID NO: 5932222 - DNA, 20 bp, Homo sapiens
taacaagatatttatatgtt

SEQ ID NO: 5932223 - DNA, 18 bp, Homo sapiens
taacaagatctttcagga

SEQ ID NO: 5932224 - DNA, 19 bp, Homo sapiens
taacaagatgtttcatttt

SEQ ID NO: 5932225 - DNA, 15 bp, Homo sapiens
taacaagatttgtaa

SEQ ID NO: 5932226 - DNA, 16 bp, Homo sapiens
taacaagatttgtaat

SEQ ID NO: 5932227 - DNA, 20 bp, Homo sapiens
taacaagatttgtaattaca

SEQ ID NO: 5932228 - DNA, 18 bp, Homo sapiens
taacaagccaaacattct

SEQ ID NO: 5932229 - DNA, 17 bp, Homo sapiens
taacaagctcccaggcc

SEQ ID NO: 5932230 - DNA, 11 bp, Homo sapiens
taacaaggaat

SEQ ID NO: 5932231 - DNA, 18 bp, Homo sapiens
taacaaggaatgcctgtg

SEQ ID NO: 5932232 - DNA, 20 bp, Homo sapiens
taacaaggaatgcctgtgcc

SEQ ID NO: 5932233 - DNA, 15 bp, Homo sapiens
taacaaggagatttc

SEQ ID NO: 5932234 - DNA, 18 bp, Homo sapiens
taacaaggagatttctta

SEQ ID NO: 5932235 - DNA, 21 bp, Homo sapiens
taacaaggagctcaccctgcc

SEQ ID NO: 5932236 - DNA, 19 bp, Homo sapiens
taacaaggtgtcttttcca

SEQ ID NO: 5932237 - DNA, 14 bp, Homo sapiens
taacaaggttcttc

SEQ ID NO: 5932238 - DNA, 13 bp, Homo sapiens
taacaagtataaa

SEQ ID NO: 5932239 - DNA, 16 bp, Homo sapiens
taacaagtcatttcaa

SEQ ID NO: 5932240 - DNA, 23 bp, Homo sapiens
taacaataaagcattttgcaaac

SEQ ID NO: 5932241 - DNA, 14 bp, Homo sapiens
taacaataataaaa

SEQ ID NO: 5932242 - DNA, 19 bp, Homo sapiens
taacaataatatttcaagt

SEQ ID NO: 5932243 - DNA, 20 bp, Homo sapiens
taacaataatatttcaagtg

SEQ ID NO: 5932244 - DNA, 23 bp, Homo sapiens
taacaataatatttcaagtgcct

SEQ ID NO: 5932245 - DNA, 14 bp, Homo sapiens
taacaatacaaatg

SEQ ID NO: 5932246 - DNA, 16 bp, Homo sapiens
taacaatatatagaat

SEQ ID NO: 5932247 - DNA, 20 bp, Homo sapiens
taacaatcaggtaagatcat

SEQ ID NO: 5932248 - DNA, 21 bp, Homo sapiens
taacaatcaggtaagatcata

SEQ ID NO: 5932249 - DNA, 23 bp, Homo sapiens
taacaatctatggcttatttcta

SEQ ID NO: 5932250 - DNA, 19 bp, Homo sapiens
taacaatgacaagatgttc

SEQ ID NO: 5932251 - DNA, 22 bp, Homo sapiens
taacaatgatatatggataatg

SEQ ID NO: 5932252 - DNA, 15 bp, Homo sapiens
taacaatgcaacttt

SEQ ID NO: 5932253 - DNA, 20 bp, Homo sapiens
taacaatgcatgctttggaa

SEQ ID NO: 5932254 - DNA, 17 bp, Homo sapiens
taacaatgcctattgta

SEQ ID NO: 5932255 - DNA, 13 bp, Homo sapiens
taacaatgccttg

SEQ ID NO: 5932256 - DNA, 17 bp, Homo sapiens
taacaatgccttgttgt

SEQ ID NO: 5932257 - DNA, 17 bp, Homo sapiens
taacaatgctgtatttt

SEQ ID NO: 5932258 - DNA, 20 bp, Homo sapiens
taacaatggcaggttttaca

SEQ ID NO: 5932259 - DNA, 15 bp, Homo sapiens
taacaatgtaataaa

SEQ ID NO: 5932260 - DNA, 22 bp, Homo sapiens
taacaatgtatgtgaaagtgta

SEQ ID NO: 5932261 - DNA, 14 bp, Homo sapiens
taacaatgtatttt

SEQ ID NO: 5932262 - DNA, 16 bp, Homo sapiens
taacaatgtattttaa

SEQ ID NO: 5932263 - DNA, 22 bp, Homo sapiens
taacaatgtctcatgatgtaaa

SEQ ID NO: 5932264 - DNA, 23 bp, Homo sapiens
taacaatgttaaggaaactctta

SEQ ID NO: 5932265 - DNA, 23 bp, Homo sapiens
taacaatgttttttatacttcaa

SEQ ID NO: 5932266 - DNA, 17 bp, Homo sapiens
taacaattaaaatctca

SEQ ID NO: 5932267 - DNA, 16 bp, Homo sapiens
taacaattaggcagac

SEQ ID NO: 5932268 - DNA, 20 bp, Homo sapiens
taacaattaggcagactctt

SEQ ID NO: 5932269 - DNA, 13 bp, Homo sapiens
taacaattgtctt

SEQ ID NO: 5932270 - DNA, 15 bp, Homo sapiens
taacaattgtgaagt

SEQ ID NO: 5932271 - DNA, 18 bp, Homo sapiens
taacaattgtgtagcctt

SEQ ID NO: 5932272 - DNA, 23 bp, Homo sapiens
taacaattgtgtagcctttttgt

SEQ ID NO: 5932273 - DNA, 14 bp, Homo sapiens
taacaatttctgtc

SEQ ID NO: 5932274 - DNA, 14 bp, Homo sapiens
taacacaaaggaag

SEQ ID NO: 5932275 - DNA, 16 bp, Homo sapiens
taacacaacaaaaatg

SEQ ID NO: 5932276 - DNA, 18 bp, Homo sapiens
taacacaagtcctgtgaa

SEQ ID NO: 5932277 - DNA, 23 bp, Homo sapiens
taacacaattttcactttttctg

SEQ ID NO: 5932278 - DNA, 15 bp, Homo sapiens
taacacacagctccc

SEQ ID NO: 5932279 - DNA, 20 bp, Homo sapiens
taacacactaccgaatgtgt

SEQ ID NO: 5932280 - DNA, 12 bp, Homo sapiens
taacacactgaa

SEQ ID NO: 5932281 - DNA, 17 bp, Homo sapiens
taacacagcatgtgtat

SEQ ID NO: 5932282 - DNA, 15 bp, Homo sapiens
taacacagccttcct

SEQ ID NO: 5932283 - DNA, 15 bp, Homo sapiens
taacacagtaaaata

SEQ ID NO: 5932284 - DNA, 19 bp, Homo sapiens
taacacagtacctaagact

SEQ ID NO: 5932285 - DNA, 19 bp, Homo sapiens
taacacagtgccttcaata

SEQ ID NO: 5932286 - DNA, 14 bp, Homo sapiens
taacacataaacaa

SEQ ID NO: 5932287 - DNA, 17 bp, Homo sapiens
taacacataaagtaaat

SEQ ID NO: 5932288 - DNA, 22 bp, Homo sapiens
taacacatggcttcctaaatgg

SEQ ID NO: 5932289 - DNA, 14 bp, Homo sapiens
taacacatgtcctt

SEQ ID NO: 5932290 - DNA, 11 bp, Homo sapiens
taacacattat

SEQ ID NO: 5932291 - DNA, 23 bp, Homo sapiens
taacacattctttataaaatgta

SEQ ID NO: 5932292 - DNA, 12 bp, Homo sapiens
taacacatttcg

SEQ ID NO: 5932293 - DNA, 14 bp, Homo sapiens
taacacattttgta

SEQ ID NO: 5932294 - DNA, 17 bp, Homo sapiens
taacacattttgtataa

SEQ ID NO: 5932295 - DNA, 17 bp, Homo sapiens
taacacatttttaaagt

SEQ ID NO: 5932296 - DNA, 21 bp, Homo sapiens
taacacatttttttgcatgca

SEQ ID NO: 5932297 - DNA, 15 bp, Homo sapiens
taacaccaaacttca

SEQ ID NO: 5932298 - DNA, 16 bp, Homo sapiens
taacaccaacactgta

SEQ ID NO: 5932299 - DNA, 18 bp, Homo sapiens
taacaccaatcccagggc

SEQ ID NO: 5932300 - DNA, 17 bp, Homo sapiens
taacaccacactgacca

SEQ ID NO: 5932301 - DNA, 21 bp, Homo sapiens
taacaccaggtttatggaaaa

SEQ ID NO: 5932302 - DNA, 15 bp, Homo sapiens
taacacccaaaagaa

SEQ ID NO: 5932303 - DNA, 13 bp, Homo sapiens
taacacccttcct

SEQ ID NO: 5932304 - DNA, 21 bp, Homo sapiens
taacaccgtcccagggctctg

SEQ ID NO: 5932305 - DNA, 16 bp, Homo sapiens
taacaccttggactgt

SEQ ID NO: 5932306 - DNA, 12 bp, Homo sapiens
taacactaataa

SEQ ID NO: 5932307 - DNA, 13 bp, Homo sapiens
taacactaatata

SEQ ID NO: 5932308 - DNA, 23 bp, Homo sapiens
taacactaatatatttaaaaata

SEQ ID NO: 5932309 - DNA, 22 bp, Homo sapiens
taacactacacttctccttatc

SEQ ID NO: 5932310 - DNA, 19 bp, Homo sapiens
taacactagtagctgtttt

SEQ ID NO: 5932311 - DNA, 17 bp, Homo sapiens
taacactattacagtat

SEQ ID NO: 5932312 - DNA, 15 bp, Homo sapiens
taacactcatttcca

SEQ ID NO: 5932313 - DNA, 21 bp, Homo sapiens
taacactcgactctgctgctc

SEQ ID NO: 5932314 - DNA, 15 bp, Homo sapiens
taacactgcaagaag

SEQ ID NO: 5932315 - DNA, 13 bp, Homo sapiens
taacactggcccc

SEQ ID NO: 5932316 - DNA, 17 bp, Homo sapiens
taacactggttaaatta

SEQ ID NO: 5932317 - DNA, 16 bp, Homo sapiens
taacactgtgatttat

SEQ ID NO: 5932318 - DNA, 16 bp, Homo sapiens
taacactgtgtacacc

SEQ ID NO: 5932319 - DNA, 14 bp, Homo sapiens
taacacttaaattt

SEQ ID NO: 5932320 - DNA, 20 bp, Homo sapiens
taacacttctgtatgcatca

SEQ ID NO: 5932321 - DNA, 22 bp, Homo sapiens
taacacttcttacgcaatgctt

SEQ ID NO: 5932322 - DNA, 21 bp, Homo sapiens
taacactttaaaaccagttac

SEQ ID NO: 5932323 - DNA, 15 bp, Homo sapiens
taacctactagacaa

SEQ ID NO: 5932324 - DNA, 16 bp, Homo sapiens
taacctactagacaat

SEQ ID NO: 5932325 - DNA, 22 bp, Homo sapiens
taacctagttaaagaaaggaaa

SEQ ID NO: 5932326 - DNA, 14 bp, Homo sapiens
taacctataaagtg

SEQ ID NO: 5932327 - DNA, 20 bp, Homo sapiens
taacctataagcatgacata

SEQ ID NO: 5932328 - DNA, 20 bp, Homo sapiens
taacctatatgatttatagt

SEQ ID NO: 5932329 - DNA, 20 bp, Homo sapiens
taacctatgatattttctgt

SEQ ID NO: 5932330 - DNA, 16 bp, Homo sapiens
taacctatttccacat

SEQ ID NO: 5932331 - DNA, 15 bp, Homo sapiens
taacctcactgcctc

SEQ ID NO: 5932332 - DNA, 18 bp, Homo sapiens
taacctcagagtatcttt

SEQ ID NO: 5932333 - DNA, 23 bp, Homo sapiens
taacctcagcatttactttgttt

SEQ ID NO: 5932334 - DNA, 16 bp, Homo sapiens
taacctcagctctggg

SEQ ID NO: 5932335 - DNA, 22 bp, Homo sapiens
taacctcagtatttatgtaatt

SEQ ID NO: 5932336 - DNA, 14 bp, Homo sapiens
taacctcatcttct

SEQ ID NO: 5932337 - DNA, 19 bp, Homo sapiens
taacctccacagtagcatt

SEQ ID NO: 5932338 - DNA, 20 bp, Homo sapiens
taacctccctcaacaaggta

SEQ ID NO: 5932339 - DNA, 14 bp, Homo sapiens
taacctcgccctct

SEQ ID NO: 5932340 - DNA, 16 bp, Homo sapiens
taacctcgccctctcc

SEQ ID NO: 5932341 - DNA, 16 bp, Homo sapiens
taacctcgggcctgct

SEQ ID NO: 5932342 - DNA, 21 bp, Homo sapiens
taacctcgggtgatccaccca

SEQ ID NO: 5932343 - DNA, 14 bp, Homo sapiens
taacctctaaccct

SEQ ID NO: 5932344 - DNA, 14 bp, Homo sapiens
taacctctgcacta

SEQ ID NO: 5932345 - DNA, 14 bp, Homo sapiens
taacctctggccct

SEQ ID NO: 5932346 - DNA, 16 bp, Homo sapiens
taacctctggcccttg

SEQ ID NO: 5932347 - DNA, 18 bp, Homo sapiens
taacctctggcccttgga

SEQ ID NO: 5932348 - DNA, 17 bp, Homo sapiens
taacctcttcagaggcc

SEQ ID NO: 5932349 - DNA, 17 bp, Homo sapiens
taacctcttttctgcat

SEQ ID NO: 5932350 - DNA, 20 bp, Homo sapiens
taacctctttttaaggacac

SEQ ID NO: 5932351 - DNA, 21 bp, Homo sapiens
taacctctttttaaggacact

SEQ ID NO: 5932352 - DNA, 15 bp, Homo sapiens
taacctgacatcacc

SEQ ID NO: 5932353 - DNA, 16 bp, Homo sapiens
taacctgcacaggctt

SEQ ID NO: 5932354 - DNA, 17 bp, Homo sapiens
taacctgcacaggcttg

SEQ ID NO: 5932355 - DNA, 14 bp, Homo sapiens
taacctgcatgcag

SEQ ID NO: 5932356 - DNA, 16 bp, Homo sapiens
taacctgcatgcagca

SEQ ID NO: 5932357 - DNA, 22 bp, Homo sapiens
taacctggattttttaaatcat

SEQ ID NO: 5932358 - DNA, 13 bp, Homo sapiens
taacctggcttat

SEQ ID NO: 5932359 - DNA, 18 bp, Homo sapiens
taacctgggaccaacctg

SEQ ID NO: 5932360 - DNA, 18 bp, Homo sapiens
taacctgggcattgttga

SEQ ID NO: 5932361 - DNA, 19 bp, Homo sapiens
taacctgggttgttgcaga

SEQ ID NO: 5932362 - DNA, 13 bp, Homo sapiens
taacctgtgtctg

SEQ ID NO: 5932363 - DNA, 17 bp, Homo sapiens
taaccttaaatacactg

SEQ ID NO: 5932364 - DNA, 19 bp, Homo sapiens
taaccttaaccttaaaatt

SEQ ID NO: 5932365 - DNA, 20 bp, Homo sapiens
taaccttaaccttaaaattg

SEQ ID NO: 5932366 - DNA, 13 bp, Homo sapiens
taaccttagagct

SEQ ID NO: 5932367 - DNA, 15 bp, Homo sapiens
taaccttatatttac

SEQ ID NO: 5932368 - DNA, 17 bp, Homo sapiens
taaccttatcataaatt

SEQ ID NO: 5932369 - DNA, 17 bp, Homo sapiens
taaccttccaagactga

SEQ ID NO: 5932370 - DNA, 16 bp, Homo sapiens
taaccttgcctggtac

SEQ ID NO: 5932371 - DNA, 19 bp, Homo sapiens
taaccttgcctggtacagt

SEQ ID NO: 5932372 - DNA, 14 bp, Homo sapiens
taacctttaaaaat

SEQ ID NO: 5932373 - DNA, 20 bp, Homo sapiens
taacctttaaaaatgtataa

SEQ ID NO: 5932374 - DNA, 14 bp, Homo sapiens
taacctttcaggaa

SEQ ID NO: 5932375 - DNA, 18 bp, Homo sapiens
taacctttgctgtagtgt

SEQ ID NO: 5932376 - DNA, 16 bp, Homo sapiens
taacctttttgtaaat

SEQ ID NO: 5932377 - DNA, 17 bp, Homo sapiens
taacctttttgtaaata

SEQ ID NO: 5932378 - DNA, 20 bp, Homo sapiens
taacctttttgtaaatactg

SEQ ID NO: 5932379 - DNA, 15 bp, Homo sapiens
taacgaacccctaga

SEQ ID NO: 5932380 - DNA, 16 bp, Homo sapiens
taacgaacgttttaaa

SEQ ID NO: 5932381 - DNA, 21 bp, Homo sapiens
taacgactacaaaataaaact

SEQ ID NO: 5932382 - DNA, 14 bp, Homo sapiens
taacgacttcaggg

SEQ ID NO: 5932383 - DNA, 23 bp, Homo sapiens
taacgacttcagggcagggctct

SEQ ID NO: 5932384 - DNA, 21 bp, Homo sapiens
taacgcaaaaatagctcttgc

SEQ ID NO: 5932385 - DNA, 14 bp, Homo sapiens
taacgcaaccaagt

SEQ ID NO: 5932386 - DNA, 16 bp, Homo sapiens
taacgcaggagagaga

SEQ ID NO: 5932387 - DNA, 23 bp, Homo sapiens
taacgcaggagagagagagagaa

SEQ ID NO: 5932388 - DNA, 17 bp, Homo sapiens
taacgccctatttttgc

SEQ ID NO: 5932389 - DNA, 12 bp, Homo sapiens
taacgcctgagc

SEQ ID NO: 5932390 - DNA, 15 bp, Homo sapiens
taacgctaaaggtgt

SEQ ID NO: 5932391 - DNA, 20 bp, Homo sapiens
taacgctctatctggttttg

SEQ ID NO: 5932392 - DNA, 14 bp, Homo sapiens
taacggatcagaaa

SEQ ID NO: 5932393 - DNA, 13 bp, Homo sapiens
taacggctccagg

SEQ ID NO: 5932394 - DNA, 18 bp, Homo sapiens
taacggctccaggatttt

SEQ ID NO: 5932395 - DNA, 14 bp, Homo sapiens
taacggctctccag

SEQ ID NO: 5932396 - DNA, 14 bp, Homo sapiens
taacgggaggctgg

SEQ ID NO: 5932397 - DNA, 17 bp, Homo sapiens
taacgggaggctgggca

SEQ ID NO: 5932398 - DNA, 23 bp, Homo sapiens
taacggtctgttctgtttcaagg

SEQ ID NO: 5932399 - DNA, 20 bp, Homo sapiens
taacggttaagaaagcactt

SEQ ID NO: 5932400 - DNA, 20 bp, Homo sapiens
taacggtttaattctgtctt

SEQ ID NO: 5932401 - DNA, 17 bp, Homo sapiens
taacgtataaaagcctg

SEQ ID NO: 5932402 - DNA, 14 bp, Homo sapiens
taacgtattttgat

SEQ ID NO: 5932403 - DNA, 15 bp, Homo sapiens
taacgtattttgatg

SEQ ID NO: 5932404 - DNA, 19 bp, Homo sapiens
taacgtcacccaaaagcac

SEQ ID NO: 5932405 - DNA, 16 bp, Homo sapiens
taacgtcatctcaggg

SEQ ID NO: 5932406 - DNA, 18 bp, Homo sapiens
taacgtccactagcttac

SEQ ID NO: 5932407 - DNA, 20 bp, Homo sapiens
taacgtccactagcttactg

SEQ ID NO: 5932408 - DNA, 21 bp, Homo sapiens
taacgtggcttgtagaatttt

SEQ ID NO: 5932409 - DNA, 22 bp, Homo sapiens
taacgtgtgctgtgtttgctcc

SEQ ID NO: 5932410 - DNA, 22 bp, Homo sapiens
taacgttataaagccttctaaa

SEQ ID NO: 5932411 - DNA, 16 bp, Homo sapiens
taacgttgagcccctg

SEQ ID NO: 5932412 - DNA, 14 bp, Homo sapiens
taacgttgctgtgg

SEQ ID NO: 5932413 - DNA, 18 bp, Homo sapiens
taacgttgctgtgggaac

SEQ ID NO: 5932414 - DNA, 17 bp, Homo sapiens
taacgtttaagccaaaa

SEQ ID NO: 5932415 - DNA, 18 bp, Homo sapiens
taacgtttctcattaaaa

SEQ ID NO: 5932416 - DNA, 16 bp, Homo sapiens
taacgttttccttgtg

SEQ ID NO: 5932417 - DNA, 20 bp, Homo sapiens
taacgttttctactttgaaa

SEQ ID NO: 5932418 - DNA, 18 bp, Homo sapiens
taacgttttcttaaatgt

SEQ ID NO: 5932419 - DNA, 20 bp, Homo sapiens
taacgttttttcttctttta

SEQ ID NO: 5932420 - DNA, 14 bp, Homo sapiens
taactaaaaggtat

SEQ ID NO: 5932421 - DNA, 15 bp, Homo sapiens
taactaaaaggtatg

SEQ ID NO: 5932422 - DNA, 12 bp, Homo sapiens
taactaaaataa

SEQ ID NO: 5932423 - DNA, 14 bp, Homo sapiens
taactaaaatgtat

SEQ ID NO: 5932424 - DNA, 23 bp, Homo sapiens
taactaaaatgtatctaagaata

SEQ ID NO: 5932425 - DNA, 19 bp, Homo sapiens
taactaaaattaagtatat

SEQ ID NO: 5932426 - DNA, 13 bp, Homo sapiens
taactaaaattct

SEQ ID NO: 5932427 - DNA, 14 bp, Homo sapiens
taactaaaattctg

SEQ ID NO: 5932428 - DNA, 20 bp, Homo sapiens
taactaaactaacaagatta

SEQ ID NO: 5932429 - DNA, 19 bp, Homo sapiens
taactaaagaagaggagaa

SEQ ID NO: 5932430 - DNA, 20 bp, Homo sapiens
taactaaagaagaggagaaa

SEQ ID NO: 5932431 - DNA, 22 bp, Homo sapiens
taactaaagaagaggagaaaaa

SEQ ID NO: 5932432 - DNA, 14 bp, Homo sapiens
taactaaatgctca

SEQ ID NO: 5932433 - DNA, 14 bp, Homo sapiens
taactaaattaaca

SEQ ID NO: 5932434 - DNA, 16 bp, Homo sapiens
taactaaatttgatac

SEQ ID NO: 5932435 - DNA, 22 bp, Homo sapiens
taactaaatttgtctttcaagt

SEQ ID NO: 5932436 - DNA, 19 bp, Homo sapiens
taactaacaaacagattct

SEQ ID NO: 5932437 - DNA, 19 bp, Homo sapiens
taactaaccacattttagg

SEQ ID NO: 5932438 - DNA, 15 bp, Homo sapiens
taactaactgcttca

SEQ ID NO: 5932439 - DNA, 19 bp, Homo sapiens
taactaactgcttcatctc

SEQ ID NO: 5932440 - DNA, 15 bp, Homo sapiens
taactaactggcagg

SEQ ID NO: 5932441 - DNA, 18 bp, Homo sapiens
taactaagcacattatgt

SEQ ID NO: 5932442 - DNA, 23 bp, Homo sapiens
taactaatatgggcattgtagtt

SEQ ID NO: 5932443 - DNA, 22 bp, Homo sapiens
taactaatatttgtctgtgtgc

SEQ ID NO: 5932444 - DNA, 23 bp, Homo sapiens
taactaatctattgggttcatta

SEQ ID NO: 5932445 - DNA, 16 bp, Homo sapiens
taactaatgaattgaa

SEQ ID NO: 5932446 - DNA, 18 bp, Homo sapiens
taactaatgaattgaaat

SEQ ID NO: 5932447 - DNA, 19 bp, Homo sapiens
taactaatgaattgaaatt

SEQ ID NO: 5932448 - DNA, 19 bp, Homo sapiens
taactaatgctaagaaatg

SEQ ID NO: 5932449 - DNA, 22 bp, Homo sapiens
taactaatgtaaatattgctgt

SEQ ID NO: 5932450 - DNA, 13 bp, Homo sapiens
taactaattctgt

SEQ ID NO: 5932451 - DNA, 16 bp, Homo sapiens
taactaatttaaacca

SEQ ID NO: 5932452 - DNA, 17 bp, Homo sapiens
taactaatttaaaccag

SEQ ID NO: 5932453 - DNA, 14 bp, Homo sapiens
taactaatttgtgg

SEQ ID NO: 5932454 - DNA, 22 bp, Homo sapiens
taactacaaaggtttaaatgaa

SEQ ID NO: 5932455 - DNA, 15 bp, Homo sapiens
taactacaaatgatc

SEQ ID NO: 5932456 - DNA, 18 bp, Homo sapiens
taactacatattgaatag

SEQ ID NO: 5932457 - DNA, 20 bp, Homo sapiens
taactacatgaacacaaatg

SEQ ID NO: 5932458 - DNA, 12 bp, Homo sapiens
taactacattta

SEQ ID NO: 5932459 - DNA, 20 bp, Homo sapiens
taactaccctctcaaatgga

SEQ ID NO: 5932460 - DNA, 15 bp, Homo sapiens
taactactagttttt

SEQ ID NO: 5932461 - DNA, 17 bp, Homo sapiens
taactactccggagaca

SEQ ID NO: 5932462 - DNA, 19 bp, Homo sapiens
taactactgctaatgttga

SEQ ID NO: 5932463 - DNA, 13 bp, Homo sapiens
taactactgtaga

SEQ ID NO: 5932464 - DNA, 20 bp, Homo sapiens
taactactgtagaactgatt

SEQ ID NO: 5932465 - DNA, 15 bp, Homo sapiens
taactactgtgttcc

SEQ ID NO: 5932466 - DNA, 16 bp, Homo sapiens
taactactgtgttcct

SEQ ID NO: 5932467 - DNA, 15 bp, Homo sapiens
taactactttactaa

SEQ ID NO: 5932468 - DNA, 13 bp, Homo sapiens
taactactttata

SEQ ID NO: 5932469 - DNA, 23 bp, Homo sapiens
taactactttataactaacatgt

SEQ ID NO: 5932470 - DNA, 15 bp, Homo sapiens
taactagaattagta

SEQ ID NO: 5932471 - DNA, 17 bp, Homo sapiens
taactagaattagtatg

SEQ ID NO: 5932472 - DNA, 21 bp, Homo sapiens
taactagacaccaaagttcta

SEQ ID NO: 5932473 - DNA, 19 bp, Homo sapiens
taactagacatctgctgtt

SEQ ID NO: 5932474 - DNA, 21 bp, Homo sapiens
taactagagcagccctggagt

SEQ ID NO: 5932475 - DNA, 17 bp, Homo sapiens
taactagagtatgtgta

SEQ ID NO: 5932476 - DNA, 20 bp, Homo sapiens
taactagagtatgtgtatgt

SEQ ID NO: 5932477 - DNA, 21 bp, Homo sapiens
taactagagtatgtgtatgta

SEQ ID NO: 5932478 - DNA, 17 bp, Homo sapiens
taactagatctcctgta

SEQ ID NO: 5932479 - DNA, 15 bp, Homo sapiens
taactagcaccaggg

SEQ ID NO: 5932480 - DNA, 14 bp, Homo sapiens
taactaggagactg

SEQ ID NO: 5932481 - DNA, 16 bp, Homo sapiens
taactaggatatgtat

SEQ ID NO: 5932482 - DNA, 13 bp, Homo sapiens
taactagtggctc

SEQ ID NO: 5932483 - DNA, 19 bp, Homo sapiens
taactagtgtttctgcaga

SEQ ID NO: 5932484 - DNA, 17 bp, Homo sapiens
taactagtttaattaac

SEQ ID NO: 5932485 - DNA, 16 bp, Homo sapiens
taactataacaaaaaa

SEQ ID NO: 5932486 - DNA, 18 bp, Homo sapiens
taactataagatacaata

SEQ ID NO: 5932487 - DNA, 15 bp, Homo sapiens
taactataaggtgcc

SEQ ID NO: 5932488 - DNA, 15 bp, Homo sapiens
taactatataaatga

SEQ ID NO: 5932489 - DNA, 18 bp, Homo sapiens
taactatataagacatta

SEQ ID NO: 5932490 - DNA, 16 bp, Homo sapiens
taactatcaatattta

SEQ ID NO: 5932491 - DNA, 16 bp, Homo sapiens
taactatcactggttt

SEQ ID NO: 5932492 - DNA, 16 bp, Homo sapiens
taactatcaggcagaa

SEQ ID NO: 5932493 - DNA, 12 bp, Homo sapiens
taactatctcac

SEQ ID NO: 5932494 - DNA, 13 bp, Homo sapiens
taactatctcact

SEQ ID NO: 5932495 - DNA, 15 bp, Homo sapiens
taactatcttctcta

SEQ ID NO: 5932496 - DNA, 21 bp, Homo sapiens
taactatctttttgaaagcaa

SEQ ID NO: 5932497 - DNA, 14 bp, Homo sapiens
taactatgacagat

SEQ ID NO: 5932498 - DNA, 23 bp, Homo sapiens
taactatgacagatatatttaag

SEQ ID NO: 5932499 - DNA, 20 bp, Homo sapiens
taactatgattccaattact

SEQ ID NO: 5932500 - DNA, 13 bp, Homo sapiens
taactatgcaata

SEQ ID NO: 5932501 - DNA, 16 bp, Homo sapiens
taactatggtaaataa

SEQ ID NO: 5932502 - DNA, 23 bp, Homo sapiens
taactatggtaaataactgtgac

SEQ ID NO: 5932503 - DNA, 18 bp, Homo sapiens
taactatgtacaatattt

SEQ ID NO: 5932504 - DNA, 13 bp, Homo sapiens
taactatgtgatg

SEQ ID NO: 5932505 - DNA, 18 bp, Homo sapiens
taactatgtggctgaaaa

SEQ ID NO: 5932506 - DNA, 18 bp, Homo sapiens
taactattaacctttttt

SEQ ID NO: 5932507 - DNA, 22 bp, Homo sapiens
taactattacagtgttggagaa

SEQ ID NO: 5932508 - DNA, 14 bp, Homo sapiens
taactattgaattg

SEQ ID NO: 5932509 - DNA, 16 bp, Homo sapiens
taactattgcatttat

SEQ ID NO: 5932510 - DNA, 17 bp, Homo sapiens
taactattgcccaggtt

SEQ ID NO: 5932511 - DNA, 17 bp, Homo sapiens
taactattgggtgaata

SEQ ID NO: 5932512 - DNA, 18 bp, Homo sapiens
taactattgggtgaatat

SEQ ID NO: 5932513 - DNA, 15 bp, Homo sapiens
taactatttagagaa

SEQ ID NO: 5932514 - DNA, 18 bp, Homo sapiens
taactattttattttttg

SEQ ID NO: 5932515 - DNA, 13 bp, Homo sapiens
taactatttttgt

SEQ ID NO: 5932516 - DNA, 14 bp, Homo sapiens
taactatttttgta

SEQ ID NO: 5932517 - DNA, 14 bp, Homo sapiens
taactcaaaagttg

SEQ ID NO: 5932518 - DNA, 21 bp, Homo sapiens
taactcaaagacttcctctgg

SEQ ID NO: 5932519 - DNA, 18 bp, Homo sapiens
taactcaaatacacattt

SEQ ID NO: 5932520 - DNA, 22 bp, Homo sapiens
taactcaaattcaatgcttcta

SEQ ID NO: 5932521 - DNA, 23 bp, Homo sapiens
taactcaaggataccttcttatt

SEQ ID NO: 5932522 - DNA, 13 bp, Homo sapiens
taactcacattct

SEQ ID NO: 5932523 - DNA, 18 bp, Homo sapiens
taactcaccagatttact

SEQ ID NO: 5932524 - DNA, 16 bp, Homo sapiens
taactcaccagcccca

SEQ ID NO: 5932525 - DNA, 12 bp, Homo sapiens
taactcaccgtg

SEQ ID NO: 5932526 - DNA, 15 bp, Homo sapiens
taactcaggactcca

SEQ ID NO: 5932527 - DNA, 16 bp, Homo sapiens
taactcaggactccag

SEQ ID NO: 5932528 - DNA, 17 bp, Homo sapiens
taactcaggactccagc

SEQ ID NO: 5932529 - DNA, 20 bp, Homo sapiens
taactcaggactccagccca

SEQ ID NO: 5932530 - DNA, 15 bp, Homo sapiens
taactcatctgtcac

SEQ ID NO: 5932531 - DNA, 14 bp, Homo sapiens
taactcatggcagg

SEQ ID NO: 5932532 - DNA, 22 bp, Homo sapiens
taactcatggcaggcatctgta

SEQ ID NO: 5932533 - DNA, 22 bp, Homo sapiens
taactccaccaacccatcagaa

SEQ ID NO: 5932534 - DNA, 21 bp, Homo sapiens
taactccagtctcctgacatt

SEQ ID NO: 5932535 - DNA, 13 bp, Homo sapiens
taactcccactcc

SEQ ID NO: 5932536 - DNA, 15 bp, Homo sapiens
taactccccacccca

SEQ ID NO: 5932537 - DNA, 19 bp, Homo sapiens
taactcccctgtttcaatc

SEQ ID NO: 5932538 - DNA, 16 bp, Homo sapiens
taactccctagttacc

SEQ ID NO: 5932539 - DNA, 20 bp, Homo sapiens
taactccctagttacccacc

SEQ ID NO: 5932540 - DNA, 11 bp, Homo sapiens
taactccctcc

SEQ ID NO: 5932541 - DNA, 14 bp, Homo sapiens
taactccctccacc

SEQ ID NO: 5932542 - DNA, 14 bp, Homo sapiens
taactcccttttta

SEQ ID NO: 5932543 - DNA, 22 bp, Homo sapiens
taactccctttttacactttat

SEQ ID NO: 5932544 - DNA, 16 bp, Homo sapiens
taactccgtttccaaa

SEQ ID NO: 5932545 - DNA, 22 bp, Homo sapiens
taactcctccatccatgtgttc

SEQ ID NO: 5932546 - DNA, 12 bp, Homo sapiens
taactcctccca

SEQ ID NO: 5932547 - DNA, 18 bp, Homo sapiens
taactcctcccagggttt

SEQ ID NO: 5932548 - DNA, 17 bp, Homo sapiens
taactcctgagaaatgt

SEQ ID NO: 5932549 - DNA, 14 bp, Homo sapiens
taactcctgtccct

SEQ ID NO: 5932550 - DNA, 19 bp, Homo sapiens
taactcctgtcccttttcc

SEQ ID NO: 5932551 - DNA, 15 bp, Homo sapiens
taactccttacagaa

SEQ ID NO: 5932552 - DNA, 16 bp, Homo sapiens
taactctaaaagatcc

SEQ ID NO: 5932553 - DNA, 18 bp, Homo sapiens
taactctaaaagatcctt

SEQ ID NO: 5932554 - DNA, 15 bp, Homo sapiens
taactctaaccctgt

SEQ ID NO: 5932555 - DNA, 18 bp, Homo sapiens
taactctaaccctgtgga

SEQ ID NO: 5932556 - DNA, 20 bp, Homo sapiens
taactctaaccctgtggaag

SEQ ID NO: 5932557 - DNA, 16 bp, Homo sapiens
taactctattaatgag

SEQ ID NO: 5932558 - DNA, 19 bp, Homo sapiens
taactctcaagctaagtaa

SEQ ID NO: 5932559 - DNA, 22 bp, Homo sapiens
taactctctttccttgagctgt

SEQ ID NO: 5932560 - DNA, 13 bp, Homo sapiens
taactctgagagc

SEQ ID NO: 5932561 - DNA, 15 bp, Homo sapiens
taactctgatgtaaa

SEQ ID NO: 5932562 - DNA, 12 bp, Homo sapiens
taactctgattt

SEQ ID NO: 5932563 - DNA, 20 bp, Homo sapiens
taactctgcaaaggcctggg

SEQ ID NO: 5932564 - DNA, 15 bp, Homo sapiens
taactctgcaggaaa

SEQ ID NO: 5932565 - DNA, 16 bp, Homo sapiens
taactctgcaggaaat

SEQ ID NO: 5932566 - DNA, 13 bp, Homo sapiens
taactctgcatag

SEQ ID NO: 5932567 - DNA, 20 bp, Homo sapiens
taactctgcatagacaaagg

SEQ ID NO: 5932568 - DNA, 19 bp, Homo sapiens
taactctgcccaccctcct

SEQ ID NO: 5932569 - DNA, 17 bp, Homo sapiens
taactctgctgaatgta

SEQ ID NO: 5932570 - DNA, 10 bp, Homo sapiens
taactctggc

SEQ ID NO: 5932571 - DNA, 12 bp, Homo sapiens
taactctggcac

SEQ ID NO: 5932572 - DNA, 19 bp, Homo sapiens
taactctgtaaaagtgtct

SEQ ID NO: 5932573 - DNA, 16 bp, Homo sapiens
taactctgtataatag

SEQ ID NO: 5932574 - DNA, 18 bp, Homo sapiens
taactctgtataatagag

SEQ ID NO: 5932575 - DNA, 22 bp, Homo sapiens
taactcttctttcatttcttct

SEQ ID NO: 5932576 - DNA, 12 bp, Homo sapiens
taactctttgga

SEQ ID NO: 5932577 - DNA, 13 bp, Homo sapiens
taactctttggat

SEQ ID NO: 5932578 - DNA, 18 bp, Homo sapiens
taactcttttctattttg

SEQ ID NO: 5932579 - DNA, 13 bp, Homo sapiens
taactcttttgga

SEQ ID NO: 5932580 - DNA, 13 bp, Homo sapiens
taactgaaaatgt

SEQ ID NO: 5932581 - DNA, 16 bp, Homo sapiens
taactgaaaatgtaaa

SEQ ID NO: 5932582 - DNA, 20 bp, Homo sapiens
taactgaaaattatttaaac

SEQ ID NO: 5932583 - DNA, 21 bp, Homo sapiens
taactgaaagctgaatccttc

SEQ ID NO: 5932584 - DNA, 13 bp, Homo sapiens
taactgaaccaaa

SEQ ID NO: 5932585 - DNA, 14 bp, Homo sapiens
taactgaaccaaat

SEQ ID NO: 5932586 - DNA, 18 bp, Homo sapiens
taactgaaccaaattgca

SEQ ID NO: 5932587 - DNA, 14 bp, Homo sapiens
taactgaactgttt

SEQ ID NO: 5932588 - DNA, 15 bp, Homo sapiens
taactgaactgtttg

SEQ ID NO: 5932589 - DNA, 17 bp, Homo sapiens
taactgaagaaagagaa

SEQ ID NO: 5932590 - DNA, 21 bp, Homo sapiens
taactgaagaaagagaagtca

SEQ ID NO: 5932591 - DNA, 19 bp, Homo sapiens
taactgaagatgttgagaa

SEQ ID NO: 5932592 - DNA, 22 bp, Homo sapiens
taactgaagcaaataccaaagc

SEQ ID NO: 5932593 - DNA, 23 bp, Homo sapiens
taactgaagcataaacatcacat

SEQ ID NO: 5932594 - DNA, 14 bp, Homo sapiens
taactgaaggagaa

SEQ ID NO: 5932595 - DNA, 15 bp, Homo sapiens
taactgaaggagaag

SEQ ID NO: 5932596 - DNA, 19 bp, Homo sapiens
taactgaataaaaaataaa

SEQ ID NO: 5932597 - DNA, 16 bp, Homo sapiens
taactgaataccactc

SEQ ID NO: 5932598 - DNA, 21 bp, Homo sapiens
taactgaataccactctgtaa

SEQ ID NO: 5932599 - DNA, 22 bp, Homo sapiens
taactgaataccactctgtaat

SEQ ID NO: 5932600 - DNA, 16 bp, Homo sapiens
taactgacaaatcaag

SEQ ID NO: 5932601 - DNA, 17 bp, Homo sapiens
taactgaccctcccttc

SEQ ID NO: 5932602 - DNA, 22 bp, Homo sapiens
taactgactattcttgatgtaa

SEQ ID NO: 5932603 - DNA, 17 bp, Homo sapiens
taactgactctgttatt

SEQ ID NO: 5932604 - DNA, 15 bp, Homo sapiens
taactgaggagctag

SEQ ID NO: 5932605 - DNA, 20 bp, Homo sapiens
taactgagggctgatcttta

SEQ ID NO: 5932606 - DNA, 16 bp, Homo sapiens
taactgatgaaggatt

SEQ ID NO: 5932607 - DNA, 23 bp, Homo sapiens
taactgattagtaagtcttgcct

SEQ ID NO: 5932608 - DNA, 21 bp, Homo sapiens
taactgatttccatccaaacc

SEQ ID NO: 5932609 - DNA, 16 bp, Homo sapiens
taactgatttctatgg

SEQ ID NO: 5932610 - DNA, 16 bp, Homo sapiens
taactgcacctgggca

SEQ ID NO: 5932611 - DNA, 19 bp, Homo sapiens
taactgcacctgggcagct

SEQ ID NO: 5932612 - DNA, 15 bp, Homo sapiens
taactgcagaaaaaa

SEQ ID NO: 5932613 - DNA, 11 bp, Homo sapiens
taactgcatta

SEQ ID NO: 5932614 - DNA, 17 bp, Homo sapiens
taactgcattagaaacc

SEQ ID NO: 5932615 - DNA, 14 bp, Homo sapiens
taactgcattctat

SEQ ID NO: 5932616 - DNA, 16 bp, Homo sapiens
taactgcattctataa

SEQ ID NO: 5932617 - DNA, 17 bp, Homo sapiens
taactgcattttgtagc

SEQ ID NO: 5932618 - DNA, 16 bp, Homo sapiens
taactgcatttttaga

SEQ ID NO: 5932619 - DNA, 17 bp, Homo sapiens
taactgccaaaacaaga

SEQ ID NO: 5932620 - DNA, 11 bp, Homo sapiens
taactgccagg

SEQ ID NO: 5932621 - DNA, 12 bp, Homo sapiens
taactgccatgt

SEQ ID NO: 5932622 - DNA, 22 bp, Homo sapiens
taactgccatgtaggctaagaa

SEQ ID NO: 5932623 - DNA, 18 bp, Homo sapiens
taactgccattttttgtc

SEQ ID NO: 5932624 - DNA, 22 bp, Homo sapiens
taactgccattttttgtctgtg

SEQ ID NO: 5932625 - DNA, 21 bp, Homo sapiens
taactgcccaaagcagcactt

SEQ ID NO: 5932626 - DNA, 17 bp, Homo sapiens
taactgcccagcggaca

SEQ ID NO: 5932627 - DNA, 11 bp, Homo sapiens
taactgccctt

SEQ ID NO: 5932628 - DNA, 23 bp, Homo sapiens
taactgcccttttaaatggcatg

SEQ ID NO: 5932629 - DNA, 16 bp, Homo sapiens
taactgcctaaaatgt

SEQ ID NO: 5932630 - DNA, 16 bp, Homo sapiens
taactgcctagaaaca

SEQ ID NO: 5932631 - DNA, 22 bp, Homo sapiens
taactgccttgaacctgtgagt

SEQ ID NO: 5932632 - DNA, 20 bp, Homo sapiens
taactgctcagagctttaaa

SEQ ID NO: 5932633 - DNA, 21 bp, Homo sapiens
taactgctcagagctttaaaa

SEQ ID NO: 5932634 - DNA, 15 bp, Homo sapiens
taactgctccaaatt

SEQ ID NO: 5932635 - DNA, 23 bp, Homo sapiens
taactgctcttgggcaatattct

SEQ ID NO: 5932636 - DNA, 15 bp, Homo sapiens
taactgctgagccac

SEQ ID NO: 5932637 - DNA, 16 bp, Homo sapiens
taactgctgagccact

SEQ ID NO: 5932638 - DNA, 13 bp, Homo sapiens
taactgctgattt

SEQ ID NO: 5932639 - DNA, 15 bp, Homo sapiens
taactgctgattttg

SEQ ID NO: 5932640 - DNA, 14 bp, Homo sapiens
taactgctgcaggg

SEQ ID NO: 5932641 - DNA, 17 bp, Homo sapiens
taactgctttctgttcc

SEQ ID NO: 5932642 - DNA, 20 bp, Homo sapiens
taactgctttctgttccaaa

SEQ ID NO: 5932643 - DNA, 12 bp, Homo sapiens
taactgcttttg

SEQ ID NO: 5932644 - DNA, 18 bp, Homo sapiens
taactgcttttgcccata

SEQ ID NO: 5932645 - DNA, 15 bp, Homo sapiens
taactggacatgaag

SEQ ID NO: 5932646 - DNA, 15 bp, Homo sapiens
taactggagctccga

SEQ ID NO: 5932647 - DNA, 21 bp, Homo sapiens
taactggcatgtcatttgcac

SEQ ID NO: 5932648 - DNA, 16 bp, Homo sapiens
taactggccagccata

SEQ ID NO: 5932649 - DNA, 14 bp, Homo sapiens
taactggcccagaa

SEQ ID NO: 5932650 - DNA, 16 bp, Homo sapiens
taactggcccagaagc

SEQ ID NO: 5932651 - DNA, 12 bp, Homo sapiens
taactggcccca

SEQ ID NO: 5932652 - DNA, 14 bp, Homo sapiens
taactggctgctcc

SEQ ID NO: 5932653 - DNA, 11 bp, Homo sapiens
taactggctgt

SEQ ID NO: 5932654 - DNA, 18 bp, Homo sapiens
taactggcttcattttag

SEQ ID NO: 5932655 - DNA, 21 bp, Homo sapiens
taactggggtattaacttttt

SEQ ID NO: 5932656 - DNA, 22 bp, Homo sapiens
taactgggtacccaaaacacat

SEQ ID NO: 5932657 - DNA, 14 bp, Homo sapiens
taactgggttaaat

SEQ ID NO: 5932658 - DNA, 16 bp, Homo sapiens
taactgggttaaatat

SEQ ID NO: 5932659 - DNA, 18 bp, Homo sapiens
taactggtgatatatctc

SEQ ID NO: 5932660 - DNA, 22 bp, Homo sapiens
taactggtgcactttgtaaatt

SEQ ID NO: 5932661 - DNA, 21 bp, Homo sapiens
taactggtttgactctgtcca

SEQ ID NO: 5932662 - DNA, 12 bp, Homo sapiens
taactgtaaact

SEQ ID NO: 5932663 - DNA, 13 bp, Homo sapiens
taactgtaaactt

SEQ ID NO: 5932664 - DNA, 13 bp, Homo sapiens
taactgtaaatca

SEQ ID NO: 5932665 - DNA, 22 bp, Homo sapiens
taactgtaaatcacttgtaaat

SEQ ID NO: 5932666 - DNA, 23 bp, Homo sapiens
taactgtaaatcacttgtaaata

SEQ ID NO: 5932667 - DNA, 14 bp, Homo sapiens
taactgtaaatcat

SEQ ID NO: 5932668 - DNA, 18 bp, Homo sapiens
taactgtaaatgtgacat

SEQ ID NO: 5932669 - DNA, 19 bp, Homo sapiens
taactgtaattatttgaat

SEQ ID NO: 5932670 - DNA, 14 bp, Homo sapiens
taactgtactgaag

SEQ ID NO: 5932671 - DNA, 14 bp, Homo sapiens
taactgtactgaat

SEQ ID NO: 5932672 - DNA, 16 bp, Homo sapiens
taactgtatatttgta

SEQ ID NO: 5932673 - DNA, 19 bp, Homo sapiens
taactgtatatttgtatga

SEQ ID NO: 5932674 - DNA, 20 bp, Homo sapiens
taactgtatatttgtatgat

SEQ ID NO: 5932675 - DNA, 16 bp, Homo sapiens
taactgtatttcagta

SEQ ID NO: 5932676 - DNA, 12 bp, Homo sapiens
taactgtatttg

SEQ ID NO: 5932677 - DNA, 22 bp, Homo sapiens
taactgtatttgaaataagaat

SEQ ID NO: 5932678 - DNA, 18 bp, Homo sapiens
taactgtattttctttca

SEQ ID NO: 5932679 - DNA, 19 bp, Homo sapiens
taactgtattttctttcac

SEQ ID NO: 5932680 - DNA, 21 bp, Homo sapiens
taactgtcaggctgaaaacaa

SEQ ID NO: 5932681 - DNA, 16 bp, Homo sapiens
taagaatgagcctgtc

SEQ ID NO: 5932682 - DNA, 13 bp, Homo sapiens
taagaatgatctg

SEQ ID NO: 5932683 - DNA, 23 bp, Homo sapiens
taagaatgcagattcctgggcct

SEQ ID NO: 5932684 - DNA, 14 bp, Homo sapiens
taagaatgcattat

SEQ ID NO: 5932685 - DNA, 21 bp, Homo sapiens
taagaatgctggttttcctaa

SEQ ID NO: 5932686 - DNA, 13 bp, Homo sapiens
taagaatgtcctt

SEQ ID NO: 5932687 - DNA, 12 bp, Homo sapiens
taagaattattt

SEQ ID NO: 5932688 - DNA, 10 bp, Homo sapiens
taagaattca

SEQ ID NO: 5932689 - DNA, 22 bp, Homo sapiens
taagaattcaaactggggcctc

SEQ ID NO: 5932690 - DNA, 12 bp, Homo sapiens
taagaattcagt

SEQ ID NO: 5932691 - DNA, 19 bp, Homo sapiens
taagaattcccagatagtc

SEQ ID NO: 5932692 - DNA, 22 bp, Homo sapiens
taagaattgaattggaaagact

SEQ ID NO: 5932693 - DNA, 13 bp, Homo sapiens
taagaattgacca

SEQ ID NO: 5932694 - DNA, 16 bp, Homo sapiens
taagaattgagtaatg

SEQ ID NO: 5932695 - DNA, 21 bp, Homo sapiens
taagaattgagtaatggtgta

SEQ ID NO: 5932696 - DNA, 23 bp, Homo sapiens
taagaattgtctctgggctgagg

SEQ ID NO: 5932697 - DNA, 13 bp, Homo sapiens
taagaattgttta

SEQ ID NO: 5932698 - DNA, 20 bp, Homo sapiens
taagaattgtttttgaattt

SEQ ID NO: 5932699 - DNA, 17 bp, Homo sapiens
taagaatttcactgtct

SEQ ID NO: 5932700 - DNA, 20 bp, Homo sapiens
taagaatttcactgtctttt

SEQ ID NO: 5932701 - DNA, 21 bp, Homo sapiens
taagaatttcactgtctttta

SEQ ID NO: 5932702 - DNA, 22 bp, Homo sapiens
taagaatttcactgtcttttaa

SEQ ID NO: 5932703 - DNA, 23 bp, Homo sapiens
taagaatttgaggtctacattct

SEQ ID NO: 5932704 - DNA, 20 bp, Homo sapiens
taagaatttgtttaaattag

SEQ ID NO: 5932705 - DNA, 17 bp, Homo sapiens
taagaattttaaatatt

SEQ ID NO: 5932706 - DNA, 14 bp, Homo sapiens
taagaattttgctt

SEQ ID NO: 5932707 - DNA, 19 bp, Homo sapiens
taagaattttgttttactt

SEQ ID NO: 5932708 - DNA, 19 bp, Homo sapiens
taagaatttttcagcactt

SEQ ID NO: 5932709 - DNA, 23 bp, Homo sapiens
taagacaaaaagctacttattgt

SEQ ID NO: 5932710 - DNA, 13 bp, Homo sapiens
taagacaaacact

SEQ ID NO: 5932711 - DNA, 16 bp, Homo sapiens
taagacaaacactgcc

SEQ ID NO: 5932712 - DNA, 13 bp, Homo sapiens
taagacaaatatg

SEQ ID NO: 5932713 - DNA, 14 bp, Homo sapiens
taagacaaatggga

SEQ ID NO: 5932714 - DNA, 15 bp, Homo sapiens
taagacaaatgggac

SEQ ID NO: 5932715 - DNA, 17 bp, Homo sapiens
taagacaaatgggactg

SEQ ID NO: 5932716 - DNA, 20 bp, Homo sapiens
taagacaaatgggactgatg

SEQ ID NO: 5932717 - DNA, 17 bp, Homo sapiens
taagacaacaggcattt

SEQ ID NO: 5932718 - DNA, 18 bp, Homo sapiens
taagacaagaacattctc

SEQ ID NO: 5932719 - DNA, 19 bp, Homo sapiens
taagacaagaatatgttca

SEQ ID NO: 5932720 - DNA, 14 bp, Homo sapiens
taagacaagctgta

SEQ ID NO: 5932721 - DNA, 16 bp, Homo sapiens
taagacaatagtattt

SEQ ID NO: 5932722 - DNA, 23 bp, Homo sapiens
taagacacaaatgcatgaacaag

SEQ ID NO: 5932723 - DNA, 15 bp, Homo sapiens
taagacacacagcct

SEQ ID NO: 5932724 - DNA, 17 bp, Homo sapiens
taagacacacagccttt

SEQ ID NO: 5932725 - DNA, 18 bp, Homo sapiens
taagacacacagcctttc

SEQ ID NO: 5932726 - DNA, 22 bp, Homo sapiens
taagacacacagcctttctgta

SEQ ID NO: 5932727 - DNA, 22 bp, Homo sapiens
taagacacactccccacttcac

SEQ ID NO: 5932728 - DNA, 17 bp, Homo sapiens
taagacacgtgcaacag

SEQ ID NO: 5932729 - DNA, 13 bp, Homo sapiens
taagacacttaga

SEQ ID NO: 5932730 - DNA, 14 bp, Homo sapiens
taagacacttccgt

SEQ ID NO: 5932731 - DNA, 21 bp, Homo sapiens
taagacagagaaacagacaga

SEQ ID NO: 5932732 - DNA, 16 bp, Homo sapiens
taagacagagaaggtt

SEQ ID NO: 5932733 - DNA, 17 bp, Homo sapiens
taagacagagtatcctg

SEQ ID NO: 5932734 - DNA, 11 bp, Homo sapiens
taagacagcat

SEQ ID NO: 5932735 - DNA, 14 bp, Homo sapiens
taagacagcatgtg

SEQ ID NO: 5932736 - DNA, 18 bp, Homo sapiens
taagacagtgccctgaga

SEQ ID NO: 5932737 - DNA, 13 bp, Homo sapiens
taagacataaaca

SEQ ID NO: 5932738 - DNA, 15 bp, Homo sapiens
taagacataaacaaa

SEQ ID NO: 5932739 - DNA, 21 bp, Homo sapiens
taagacataaacaaagacatt

SEQ ID NO: 5932740 - DNA, 16 bp, Homo sapiens
taagacataacgtttt

SEQ ID NO: 5932741 - DNA, 21 bp, Homo sapiens
taagacataacgtttttcctt

SEQ ID NO: 5932742 - DNA, 16 bp, Homo sapiens
taagacatatctctaa

SEQ ID NO: 5932743 - DNA, 15 bp, Homo sapiens
taagacatctcaaat

SEQ ID NO: 5932744 - DNA, 16 bp, Homo sapiens
taagacatgatttcct

SEQ ID NO: 5932745 - DNA, 19 bp, Homo sapiens
taagacatgcttacttttt

SEQ ID NO: 5932746 - DNA, 20 bp, Homo sapiens
taagacatgcttacttttta

SEQ ID NO: 5932747 - DNA, 23 bp, Homo sapiens
taagacatgcttactttttaatt

SEQ ID NO: 5932748 - DNA, 17 bp, Homo sapiens
taagacatttgtttgct

SEQ ID NO: 5932749 - DNA, 20 bp, Homo sapiens
taagacatttttcattcatg

SEQ ID NO: 5932750 - DNA, 19 bp, Homo sapiens
taagaccacctcaaattta

SEQ ID NO: 5932751 - DNA, 16 bp, Homo sapiens
taagaccaccttccct

SEQ ID NO: 5932752 - DNA, 16 bp, Homo sapiens
taagaccggaagctcc

SEQ ID NO: 5932753 - DNA, 19 bp, Homo sapiens
taagaccgtgtcccaagga

SEQ ID NO: 5932754 - DNA, 21 bp, Homo sapiens
taagaccgtgtcccaaggagc

SEQ ID NO: 5932755 - DNA, 17 bp, Homo sapiens
taagacctactgttcta

SEQ ID NO: 5932756 - DNA, 18 bp, Homo sapiens
taagacctactgttctaa

SEQ ID NO: 5932757 - DNA, 20 bp, Homo sapiens
taagacctactgttctaaag

SEQ ID NO: 5932758 - DNA, 13 bp, Homo sapiens
taagacctctgag

SEQ ID NO: 5932759 - DNA, 11 bp, Homo sapiens
taagacctggc

SEQ ID NO: 5932760 - DNA, 20 bp, Homo sapiens
taagacggatttatttttcc

SEQ ID NO: 5932761 - DNA, 19 bp, Homo sapiens
taagacgtatgtaacatga

SEQ ID NO: 5932762 - DNA, 18 bp, Homo sapiens
taagactaaatctgtaag

SEQ ID NO: 5932763 - DNA, 20 bp, Homo sapiens
taagactaacaaaggcagct

SEQ ID NO: 5932764 - DNA, 23 bp, Homo sapiens
taagactaacaaaggcagctgtg

SEQ ID NO: 5932765 - DNA, 15 bp, Homo sapiens
taagactaactcaag

SEQ ID NO: 5932766 - DNA, 13 bp, Homo sapiens
taagactactaag

SEQ ID NO: 5932767 - DNA, 19 bp, Homo sapiens
taagactcaaatgttctaa

SEQ ID NO: 5932768 - DNA, 20 bp, Homo sapiens
taagactcccgccccgggct

SEQ ID NO: 5932769 - DNA, 22 bp, Homo sapiens
taagactcccgccccgggctgg

SEQ ID NO: 5932770 - DNA, 16 bp, Homo sapiens
taagactctcacactc

SEQ ID NO: 5932771 - DNA, 22 bp, Homo sapiens
taagactctgtgtggctgtgca

SEQ ID NO: 5932772 - DNA, 14 bp, Homo sapiens
taagactgaatgtt

SEQ ID NO: 5932773 - DNA, 19 bp, Homo sapiens
taagactgaatgttttatt

SEQ ID NO: 5932774 - DNA, 15 bp, Homo sapiens
taagactgtgtctgt

SEQ ID NO: 5932775 - DNA, 19 bp, Homo sapiens
taagactgtgtctgtattg

SEQ ID NO: 5932776 - DNA, 17 bp, Homo sapiens
taagacttactctaaga

SEQ ID NO: 5932777 - DNA, 21 bp, Homo sapiens
taagacttcagtcctggtctg

SEQ ID NO: 5932778 - DNA, 21 bp, Homo sapiens
taagacttcctctaccaccac

SEQ ID NO: 5932779 - DNA, 18 bp, Homo sapiens
taagacttctctgtcctc

SEQ ID NO: 5932780 - DNA, 13 bp, Homo sapiens
taagactttactt

SEQ ID NO: 5932781 - DNA, 14 bp, Homo sapiens
taagacttttctct

SEQ ID NO: 5932782 - DNA, 18 bp, Homo sapiens
taagacttttctttcctt

SEQ ID NO: 5932783 - DNA, 12 bp, Homo sapiens
taagactttttt

SEQ ID NO: 5932784 - DNA, 15 bp, Homo sapiens
taagagaaaagagag

SEQ ID NO: 5932785 - DNA, 20 bp, Homo sapiens
taagagaaaagagagaaaca

SEQ ID NO: 5932786 - DNA, 20 bp, Homo sapiens
taagagaaaattgcactaaa

SEQ ID NO: 5932787 - DNA, 17 bp, Homo sapiens
taagagaaacctgccaa

SEQ ID NO: 5932788 - DNA, 18 bp, Homo sapiens
taagagaaaccttgcaaa

SEQ ID NO: 5932789 - DNA, 22 bp, Homo sapiens
taagagaaaccttgcaaactct

SEQ ID NO: 5932790 - DNA, 15 bp, Homo sapiens
taagagaaactttat

SEQ ID NO: 5932791 - DNA, 22 bp, Homo sapiens
taagagaaactttatacattag

SEQ ID NO: 5932792 - DNA, 12 bp, Homo sapiens
taagagaaagag

SEQ ID NO: 5932793 - DNA, 13 bp, Homo sapiens
taagagaaatgga

SEQ ID NO: 5932794 - DNA, 13 bp, Homo sapiens
taagagaaatggt

SEQ ID NO: 5932795 - DNA, 14 bp, Homo sapiens
taagagaaatggta

SEQ ID NO: 5932796 - DNA, 20 bp, Homo sapiens
taagagaacaaagagtgaaa

SEQ ID NO: 5932797 - DNA, 18 bp, Homo sapiens
taagagaagctactttgt

SEQ ID NO: 5932798 - DNA, 14 bp, Homo sapiens
taagagaagtagaa

SEQ ID NO: 5932799 - DNA, 18 bp, Homo sapiens
taagagaagtagaaatca

SEQ ID NO: 5932800 - DNA, 18 bp, Homo sapiens
taagagaagtctcattcg

SEQ ID NO: 5932801 - DNA, 23 bp, Homo sapiens
taagagaatgttatagtgaatta

SEQ ID NO: 5932802 - DNA, 15 bp, Homo sapiens
taagagaatgttcct

SEQ ID NO: 5932803 - DNA, 19 bp, Homo sapiens
taagagaattagacaaatt

SEQ ID NO: 5932804 - DNA, 22 bp, Homo sapiens
taagagaattatatatttctaa

SEQ ID NO: 5932805 - DNA, 22 bp, Homo sapiens
taagagaattctaagattgtac

SEQ ID NO: 5932806 - DNA, 12 bp, Homo sapiens
taagagacaaag

SEQ ID NO: 5932807 - DNA, 20 bp, Homo sapiens
taagagacagaatgtatctg

SEQ ID NO: 5932808 - DNA, 15 bp, Homo sapiens
taagagacagacact

SEQ ID NO: 5932809 - DNA, 13 bp, Homo sapiens
taagagacagtca

SEQ ID NO: 5932810 - DNA, 18 bp, Homo sapiens
taagagacagttctctgt

SEQ ID NO: 5932811 - DNA, 23 bp, Homo sapiens
taagagactcactggttttactt

SEQ ID NO: 5932812 - DNA, 14 bp, Homo sapiens
taagagactcagcc

SEQ ID NO: 5932813 - DNA, 18 bp, Homo sapiens
taagagactcagcctgca

SEQ ID NO: 5932814 - DNA, 14 bp, Homo sapiens
taagagagagagcc

SEQ ID NO: 5932815 - DNA, 14 bp, Homo sapiens
taagagagatgaga

SEQ ID NO: 5932816 - DNA, 18 bp, Homo sapiens
taagagagatgagaaagc

SEQ ID NO: 5932817 - DNA, 19 bp, Homo sapiens
taagagatacttgatgcca

SEQ ID NO: 5932818 - DNA, 20 bp, Homo sapiens
taagagatatgctcattatt

SEQ ID NO: 5932819 - DNA, 14 bp, Homo sapiens
taagagattctgat

SEQ ID NO: 5932820 - DNA, 15 bp, Homo sapiens
taagagatttatctt

SEQ ID NO: 5932821 - DNA, 18 bp, Homo sapiens
taagagatttatctttat

SEQ ID NO: 5932822 - DNA, 19 bp, Homo sapiens
taagagcaaaaagtgtaat

SEQ ID NO: 5932823 - DNA, 20 bp, Homo sapiens
taagagcaaaagaatggcag

SEQ ID NO: 5932824 - DNA, 22 bp, Homo sapiens
taagagcaaaagaatggcagaa

SEQ ID NO: 5932825 - DNA, 19 bp, Homo sapiens
taagagcagtcacaacaga

SEQ ID NO: 5932826 - DNA, 22 bp, Homo sapiens
taagagccatataagtttgaag

SEQ ID NO: 5932827 - DNA, 14 bp, Homo sapiens
taagagcctctgga

SEQ ID NO: 5932828 - DNA, 12 bp, Homo sapiens
taagagctatac

SEQ ID NO: 5932829 - DNA, 21 bp, Homo sapiens
taagagctattttagaaagct

SEQ ID NO: 5932830 - DNA, 14 bp, Homo sapiens
taagagctcaggat

SEQ ID NO: 5932831 - DNA, 19 bp, Homo sapiens
taagagctctaagtacctt

SEQ ID NO: 5932832 - DNA, 16 bp, Homo sapiens
taagagcttgctccag

SEQ ID NO: 5932833 - DNA, 19 bp, Homo sapiens
taagagctttacaaaaaga

SEQ ID NO: 5932834 - DNA, 21 bp, Homo sapiens
taagagctttatatattgatt

SEQ ID NO: 5932835 - DNA, 19 bp, Homo sapiens
taagaggaaactagtgttt

SEQ ID NO: 5932836 - DNA, 19 bp, Homo sapiens
taagaggaaagtacatttt

SEQ ID NO: 5932837 - DNA, 13 bp, Homo sapiens
taagaggagcaga

SEQ ID NO: 5932838 - DNA, 18 bp, Homo sapiens
taagaggagcagagggca

SEQ ID NO: 5932839 - DNA, 21 bp, Homo sapiens
taagaggagcagagggcaggg

SEQ ID NO: 5932840 - DNA, 22 bp, Homo sapiens
taagaggagtaggccctggttc

SEQ ID NO: 5932841 - DNA, 16 bp, Homo sapiens
taagaggatgagcaga

SEQ ID NO: 5932842 - DNA, 19 bp, Homo sapiens
taagaggattcaacacctt

SEQ ID NO: 5932843 - DNA, 22 bp, Homo sapiens
taagaggattcaacacctttgt

SEQ ID NO: 5932844 - DNA, 15 bp, Homo sapiens
taagaggcagggtct

SEQ ID NO: 5932845 - DNA, 18 bp, Homo sapiens
taagaggcgacttcctct

SEQ ID NO: 5932846 - DNA, 16 bp, Homo sapiens
taagaggctgccctcc

SEQ ID NO: 5932847 - DNA, 18 bp, Homo sapiens
taagaggctttggcccaa

SEQ ID NO: 5932848 - DNA, 22 bp, Homo sapiens
taagagggaaactctggagagc

SEQ ID NO: 5932849 - DNA, 16 bp, Homo sapiens
taagagggcatataca

SEQ ID NO: 5932850 - DNA, 17 bp, Homo sapiens
taagagggcatatacag

SEQ ID NO: 5932851 - DNA, 16 bp, Homo sapiens
taagagggctttttaa

SEQ ID NO: 5932852 - DNA, 14 bp, Homo sapiens
taagagtactggga

SEQ ID NO: 5932853 - DNA, 22 bp, Homo sapiens
taagagtatgtgccaggaaact

SEQ ID NO: 5932854 - DNA, 18 bp, Homo sapiens
taagagtccaagaatcca

SEQ ID NO: 5932855 - DNA, 17 bp, Homo sapiens
taagagtctccttctct

SEQ ID NO: 5932856 - DNA, 19 bp, Homo sapiens
taagagtctccttctcttc

SEQ ID NO: 5932857 - DNA, 18 bp, Homo sapiens
taagagtgaaaattgtct

SEQ ID NO: 5932858 - DNA, 19 bp, Homo sapiens
taagcttttaagaaaaaca

SEQ ID NO: 5932859 - DNA, 20 bp, Homo sapiens
taagcttttcttttctttgt

SEQ ID NO: 5932860 - DNA, 13 bp, Homo sapiens
taagctttttgga

SEQ ID NO: 5932861 - DNA, 20 bp, Homo sapiens
taaggaaaaataaaagtgct

SEQ ID NO: 5932862 - DNA, 14 bp, Homo sapiens
taaggaaaagagaa

SEQ ID NO: 5932863 - DNA, 11 bp, Homo sapiens
taaggaaacaa

SEQ ID NO: 5932864 - DNA, 20 bp, Homo sapiens
taaggaaacacttctattta

SEQ ID NO: 5932865 - DNA, 20 bp, Homo sapiens
taaggaaactgctttatttt

SEQ ID NO: 5932866 - DNA, 22 bp, Homo sapiens
taaggaaactgctttattttta

SEQ ID NO: 5932867 - DNA, 12 bp, Homo sapiens
taaggaaactgg

SEQ ID NO: 5932868 - DNA, 19 bp, Homo sapiens
taaggaaactgggttcctg

SEQ ID NO: 5932869 - DNA, 16 bp, Homo sapiens
taaggaaactttattt

SEQ ID NO: 5932870 - DNA, 17 bp, Homo sapiens
taaggaaactttttaat

SEQ ID NO: 5932871 - DNA, 19 bp, Homo sapiens
taaggaaatcaacttgctt

SEQ ID NO: 5932872 - DNA, 17 bp, Homo sapiens
taaggaaatccagcccc

SEQ ID NO: 5932873 - DNA, 18 bp, Homo sapiens
taaggaaatccagcccca

SEQ ID NO: 5932874 - DNA, 23 bp, Homo sapiens
taaggaaatccagccccatagaa

SEQ ID NO: 5932875 - DNA, 14 bp, Homo sapiens
taaggaacaatgcc

SEQ ID NO: 5932876 - DNA, 15 bp, Homo sapiens
taaggaacatgtact

SEQ ID NO: 5932877 - DNA, 14 bp, Homo sapiens
taaggaagaaaaat

SEQ ID NO: 5932878 - DNA, 13 bp, Homo sapiens
taaggaagacaat

SEQ ID NO: 5932879 - DNA, 14 bp, Homo sapiens
taaggaagagagaa

SEQ ID NO: 5932880 - DNA, 15 bp, Homo sapiens
taaggaagatatcta

SEQ ID NO: 5932881 - DNA, 23 bp, Homo sapiens
taaggaagccagtcaccttctgg

SEQ ID NO: 5932882 - DNA, 14 bp, Homo sapiens
taaggaatatggga

SEQ ID NO: 5932883 - DNA, 19 bp, Homo sapiens
taaggaatgtagctggttt

SEQ ID NO: 5932884 - DNA, 17 bp, Homo sapiens
taaggaattgaagatag

SEQ ID NO: 5932885 - DNA, 23 bp, Homo sapiens
taaggaattgacttcagcagggg

SEQ ID NO: 5932886 - DNA, 16 bp, Homo sapiens
taaggaatttcctccc

SEQ ID NO: 5932887 - DNA, 20 bp, Homo sapiens
taaggaattttgtctcactt

SEQ ID NO: 5932888 - DNA, 12 bp, Homo sapiens
taaggacaaatt

SEQ ID NO: 5932889 - DNA, 20 bp, Homo sapiens
taaggacaaattagcatgca

SEQ ID NO: 5932890 - DNA, 15 bp, Homo sapiens
taaggacagcagctg

SEQ ID NO: 5932891 - DNA, 19 bp, Homo sapiens
taaggacagtgttcaaatt

SEQ ID NO: 5932892 - DNA, 21 bp, Homo sapiens
taaggacccaaatttccctgg

SEQ ID NO: 5932893 - DNA, 15 bp, Homo sapiens
taaggacctgaaatt

SEQ ID NO: 5932894 - DNA, 16 bp, Homo sapiens
taaggactacagaatt

SEQ ID NO: 5932895 - DNA, 10 bp, Homo sapiens
taaggactgc

SEQ ID NO: 5932896 - DNA, 21 bp, Homo sapiens
taaggactgcatggtaattta

SEQ ID NO: 5932897 - DNA, 18 bp, Homo sapiens
taaggacttagctggcca

SEQ ID NO: 5932898 - DNA, 15 bp, Homo sapiens
taaggacttctttaa

SEQ ID NO: 5932899 - DNA, 16 bp, Homo sapiens
taaggacttctttaat

SEQ ID NO: 5932900 - DNA, 13 bp, Homo sapiens
taaggacttgtta

SEQ ID NO: 5932901 - DNA, 12 bp, Homo sapiens
taaggactttgg

SEQ ID NO: 5932902 - DNA, 21 bp, Homo sapiens
taaggactttttgatggaatt

SEQ ID NO: 5932903 - DNA, 15 bp, Homo sapiens
taaggagaaatagct

SEQ ID NO: 5932904 - DNA, 19 bp, Homo sapiens
taaggagaaatctatagaa

SEQ ID NO: 5932905 - DNA, 13 bp, Homo sapiens
taaggagaaatga

SEQ ID NO: 5932906 - DNA, 11 bp, Homo sapiens
taaggagaaga

SEQ ID NO: 5932907 - DNA, 20 bp, Homo sapiens
taaggagaatcatgtttctt

SEQ ID NO: 5932908 - DNA, 22 bp, Homo sapiens
taaggagaatcatgtttctttg

SEQ ID NO: 5932909 - DNA, 16 bp, Homo sapiens
taaggagactgaggct

SEQ ID NO: 5932910 - DNA, 15 bp, Homo sapiens
taaggagacttctgt

SEQ ID NO: 5932911 - DNA, 20 bp, Homo sapiens
taaggagcatgattttaaga

SEQ ID NO: 5932912 - DNA, 12 bp, Homo sapiens
taaggagctggg

SEQ ID NO: 5932913 - DNA, 13 bp, Homo sapiens
taaggaggaaaac

SEQ ID NO: 5932914 - DNA, 21 bp, Homo sapiens
taaggagggaaggtggaccag

SEQ ID NO: 5932915 - DNA, 15 bp, Homo sapiens
taaggagggacaaga

SEQ ID NO: 5932916 - DNA, 16 bp, Homo sapiens
taaggagggacaagaa

SEQ ID NO: 5932917 - DNA, 13 bp, Homo sapiens
taaggagggagaa

SEQ ID NO: 5932918 - DNA, 15 bp, Homo sapiens
taaggagggagaaag

SEQ ID NO: 5932919 - DNA, 19 bp, Homo sapiens
taaggagggagaaaggaga

SEQ ID NO: 5932920 - DNA, 20 bp, Homo sapiens
taaggagggagaaaggagaa

SEQ ID NO: 5932921 - DNA, 19 bp, Homo sapiens
taaggaggtagctcccagc

SEQ ID NO: 5932922 - DNA, 16 bp, Homo sapiens
taaggaggtttgtata

SEQ ID NO: 5932923 - DNA, 19 bp, Homo sapiens
taaggagtaatctgtgtac

SEQ ID NO: 5932924 - DNA, 20 bp, Homo sapiens
taaggagtaatctgtgtaca

SEQ ID NO: 5932925 - DNA, 22 bp, Homo sapiens
taaggagttagaaccacagcag

SEQ ID NO: 5932926 - DNA, 16 bp, Homo sapiens
taaggatacaggctgg

SEQ ID NO: 5932927 - DNA, 21 bp, Homo sapiens
taaggatacaggctggaaagt

SEQ ID NO: 5932928 - DNA, 17 bp, Homo sapiens
taaggatactttacatg

SEQ ID NO: 5932929 - DNA, 16 bp, Homo sapiens
taaggatagcctttgt

SEQ ID NO: 5932930 - DNA, 18 bp, Homo sapiens
taaggatagcctttgtag

SEQ ID NO: 5932931 - DNA, 15 bp, Homo sapiens
taaggatagggaaag

SEQ ID NO: 5932932 - DNA, 17 bp, Homo sapiens
taaggatccggaaagaa

SEQ ID NO: 5932933 - DNA, 18 bp, Homo sapiens
taaggatccggaaagaag

SEQ ID NO: 5932934 - DNA, 13 bp, Homo sapiens
taaggatcttttg

SEQ ID NO: 5932935 - DNA, 16 bp, Homo sapiens
taaggatcttttgtaa

SEQ ID NO: 5932936 - DNA, 13 bp, Homo sapiens
taaggatgacttt

SEQ ID NO: 5932937 - DNA, 23 bp, Homo sapiens
taaggatgcttgtacataatgcg

SEQ ID NO: 5932938 - DNA, 21 bp, Homo sapiens
taaggatggaaaggtgacagt

SEQ ID NO: 5932939 - DNA, 19 bp, Homo sapiens
taaggatggagccagctct

SEQ ID NO: 5932940 - DNA, 20 bp, Homo sapiens
taaggatggggttatgaacc

SEQ ID NO: 5932941 - DNA, 17 bp, Homo sapiens
taaggatgtcacagggc

SEQ ID NO: 5932942 - DNA, 16 bp, Homo sapiens
taaggatgttctagca

SEQ ID NO: 5932943 - DNA, 16 bp, Homo sapiens
taaggattctgcagaa

SEQ ID NO: 5932944 - DNA, 21 bp, Homo sapiens
taaggatttattctcagaaca

SEQ ID NO: 5932945 - DNA, 22 bp, Homo sapiens
taaggattttatgagttcttgt

SEQ ID NO: 5932946 - DNA, 19 bp, Homo sapiens
taaggattttatgctttaa

SEQ ID NO: 5932947 - DNA, 20 bp, Homo sapiens
taaggattttatgctttaaa

SEQ ID NO: 5932948 - DNA, 22 bp, Homo sapiens
taaggattttatgctttaaaca

SEQ ID NO: 5932949 - DNA, 22 bp, Homo sapiens
taaggattttggactgagattt

SEQ ID NO: 5932950 - DNA, 17 bp, Homo sapiens
taaggcaaatcaggtaa

SEQ ID NO: 5932951 - DNA, 20 bp, Homo sapiens
taaggcaacaaaagaagccc

SEQ ID NO: 5932952 - DNA, 14 bp, Homo sapiens
taaggcaacattcc

SEQ ID NO: 5932953 - DNA, 15 bp, Homo sapiens
taaggcaatcatggt

SEQ ID NO: 5932954 - DNA, 22 bp, Homo sapiens
taaggcagacccagtatgaaat

SEQ ID NO: 5932955 - DNA, 21 bp, Homo sapiens
taaggcagattttacagagcg

SEQ ID NO: 5932956 - DNA, 17 bp, Homo sapiens
taaggcaggtgggcaga

SEQ ID NO: 5932957 - DNA, 15 bp, Homo sapiens
taaggcatgaaggat

SEQ ID NO: 5932958 - DNA, 21 bp, Homo sapiens
taaggcatgcgaaatgttctc

SEQ ID NO: 5932959 - DNA, 24 bp, Homo sapiens
taaggcatgctcccagcatttgtc

SEQ ID NO: 5932960 - DNA, 12 bp, Homo sapiens
taaggcattcca

SEQ ID NO: 5932961 - DNA, 18 bp, Homo sapiens
taaggcattgagggctct

SEQ ID NO: 5932962 - DNA, 14 bp, Homo sapiens
taaggccaaggcct

SEQ ID NO: 5932963 - DNA, 22 bp, Homo sapiens
taaggccaagtacactgagagc

SEQ ID NO: 5932964 - DNA, 18 bp, Homo sapiens
taaggccaatgggctaga

SEQ ID NO: 5932965 - DNA, 21 bp, Homo sapiens
taaggccactgttttaaaaga

SEQ ID NO: 5932966 - DNA, 16 bp, Homo sapiens
taaggccagaggccca

SEQ ID NO: 5932967 - DNA, 14 bp, Homo sapiens
taaggccagctaga

SEQ ID NO: 5932968 - DNA, 23 bp, Homo sapiens
taaggccccctctcaggagccat

SEQ ID NO: 5932969 - DNA, 20 bp, Homo sapiens
taaggccgaagaagggtcct

SEQ ID NO: 5932970 - DNA, 18 bp, Homo sapiens
taaggccgagcccacacc

SEQ ID NO: 5932971 - DNA, 17 bp, Homo sapiens
taaggcctactatacat

SEQ ID NO: 5932972 - DNA, 15 bp, Homo sapiens
taaggcctctggact

SEQ ID NO: 5932973 - DNA, 16 bp, Homo sapiens
taaggcctgtgggggg

SEQ ID NO: 5932974 - DNA, 21 bp, Homo sapiens
taaggccttttatgtaatttc

SEQ ID NO: 5932975 - DNA, 23 bp, Homo sapiens
taaggccttttatgtaatttctt

SEQ ID NO: 5932976 - DNA, 20 bp, Homo sapiens
taaggcgtggagctgcctga

SEQ ID NO: 5932977 - DNA, 16 bp, Homo sapiens
taaggctaaatgtaaa

SEQ ID NO: 5932978 - DNA, 20 bp, Homo sapiens
taaggctaaggatagggaaa

SEQ ID NO: 5932979 - DNA, 17 bp, Homo sapiens
taaggctccttcatgtg

SEQ ID NO: 5932980 - DNA, 22 bp, Homo sapiens
taaggctctgagagtctagatt

SEQ ID NO: 5932981 - DNA, 24 bp, Homo sapiens
taaggctctgagagtctagattct

SEQ ID NO: 5932982 - DNA, 18 bp, Homo sapiens
taaggctctgtgccttgg

SEQ ID NO: 5932983 - DNA, 16 bp, Homo sapiens
taaggctgaggctgcc

SEQ ID NO: 5932984 - DNA, 20 bp, Homo sapiens
taaggctgagggctgccagc

SEQ ID NO: 5932985 - DNA, 21 bp, Homo sapiens
taaggctgagggctgccagca

SEQ ID NO: 5932986 - DNA, 12 bp, Homo sapiens
taaggctgctgg

SEQ ID NO: 5932987 - DNA, 19 bp, Homo sapiens
taaggctgctggcttcagg

SEQ ID NO: 5932988 - DNA, 10 bp, Homo sapiens
taaggctgta

SEQ ID NO: 5932989 - DNA, 17 bp, Homo sapiens
taaggctgtacatagtc

SEQ ID NO: 5932990 - DNA, 13 bp, Homo sapiens
taaggctgtgtaa

SEQ ID NO: 5932991 - DNA, 18 bp, Homo sapiens
taaggcttaggtgccagg

SEQ ID NO: 5932992 - DNA, 14 bp, Homo sapiens
taaggcttcaattt

SEQ ID NO: 5932993 - DNA, 22 bp, Homo sapiens
taaggctttgattagttttctt

SEQ ID NO: 5932994 - DNA, 20 bp, Homo sapiens
taagggaaaaatcaagtatt

SEQ ID NO: 5932995 - DNA, 17 bp, Homo sapiens
taagggaacaagttgag

SEQ ID NO: 5932996 - DNA, 13 bp, Homo sapiens
taagggaagaatt

SEQ ID NO: 5932997 - DNA, 18 bp, Homo sapiens
taagggaataagccatga

SEQ ID NO: 5932998 - DNA, 23 bp, Homo sapiens
taagggaccttcagggagagctg

SEQ ID NO: 5932999 - DNA, 18 bp, Homo sapiens
taagggacgggggtggga

SEQ ID NO: 5933000 - DNA, 19 bp, Homo sapiens
taagggactccagaagcag

SEQ ID NO: 5933001 - DNA, 20 bp, Homo sapiens
taagggactccagaagcagc

SEQ ID NO: 5933002 - DNA, 22 bp, Homo sapiens
taagggactccagaagcagcag

SEQ ID NO: 5933003 - DNA, 16 bp, Homo sapiens
taagggactgatgttt

SEQ ID NO: 5933004 - DNA, 17 bp, Homo sapiens
taagggactgatgtttg

SEQ ID NO: 5933005 - DNA, 22 bp, Homo sapiens
taagggactgatgtttgtgcag

SEQ ID NO: 5933006 - DNA, 19 bp, Homo sapiens
taagggacttaacttgttt

SEQ ID NO: 5933007 - DNA, 21 bp, Homo sapiens
taagggagagctgagccagtt

SEQ ID NO: 5933008 - DNA, 22 bp, Homo sapiens
taagggaggaggagcttctggg

SEQ ID NO: 5933009 - DNA, 22 bp, Homo sapiens
taagggagtggcctcatttcac

SEQ ID NO: 5933010 - DNA, 22 bp, Homo sapiens
taagggagtgtttgtgtctgac

SEQ ID NO: 5933011 - DNA, 17 bp, Homo sapiens
taagggatccagagacc

SEQ ID NO: 5933012 - DNA, 22 bp, Homo sapiens
taagggcaaggagtttattaca

SEQ ID NO: 5933013 - DNA, 14 bp, Homo sapiens
taagggcacacaca

SEQ ID NO: 5933014 - DNA, 11 bp, Homo sapiens
taagggcagag

SEQ ID NO: 5933015 - DNA, 13 bp, Homo sapiens
taagggcagagtc

SEQ ID NO: 5933016 - DNA, 15 bp, Homo sapiens
taagggcaggaagac

SEQ ID NO: 5933017 - DNA, 20 bp, Homo sapiens
taagggcagtgcccatgtgt

SEQ ID NO: 5933018 - DNA, 23 bp, Homo sapiens
taagggcagtgcccatgtgtaca

SEQ ID NO: 5933019 - DNA, 15 bp, Homo sapiens
taagggcatttttat

SEQ ID NO: 5933020 - DNA, 16 bp, Homo sapiens
taagggccgccggacc

SEQ ID NO: 5933021 - DNA, 21 bp, Homo sapiens
taagggccggggatggatctt

SEQ ID NO: 5933022 - DNA, 18 bp, Homo sapiens
taagggctttaaataaaa

SEQ ID NO: 5933023 - DNA, 20 bp, Homo sapiens
taaggggaagaatgaaagct

SEQ ID NO: 5933024 - DNA, 18 bp, Homo sapiens
taaggggaattaacaatt

SEQ ID NO: 5933025 - DNA, 18 bp, Homo sapiens
taaggggaggctgctttc

SEQ ID NO: 5933026 - DNA, 17 bp, Homo sapiens
taaggggcacctgggaa

SEQ ID NO: 5933027 - DNA, 17 bp, Homo sapiens
taaggggcagctcctga

SEQ ID NO: 5933028 - DNA, 22 bp, Homo sapiens
taaggggcagctcctgaccaaa

SEQ ID NO: 5933029 - DNA, 23 bp, Homo sapiens
taaggggcagctcctgaccaaag

SEQ ID NO: 5933030 - DNA, 13 bp, Homo sapiens
taaggggcaggaa

SEQ ID NO: 5933031 - DNA, 20 bp, Homo sapiens
taaggggccttgctctgagc

SEQ ID NO: 5933032 - DNA, 19 bp, Homo sapiens
taagggggtagaagtagtt

SEQ ID NO: 5933033 - DNA, 18 bp, Homo sapiens
taagggggtgaccatgca

SEQ ID NO: 5933034 - DNA, 19 bp, Homo sapiens
taagtttccttccagccca

SEQ ID NO: 5933035 - DNA, 12 bp, Homo sapiens
taagtttccttt

SEQ ID NO: 5933036 - DNA, 15 bp, Homo sapiens
taagtttctaagaat

SEQ ID NO: 5933037 - DNA, 23 bp, Homo sapiens
taagtttctcagctcccatttct

SEQ ID NO: 5933038 - DNA, 18 bp, Homo sapiens
taagtttgaaggaaacag

SEQ ID NO: 5933039 - DNA, 13 bp, Homo sapiens
taagtttgcactc

SEQ ID NO: 5933040 - DNA, 20 bp, Homo sapiens
taagtttgcatatcagtcat

SEQ ID NO: 5933041 - DNA, 17 bp, Homo sapiens
taagtttgtctacacta

SEQ ID NO: 5933042 - DNA, 20 bp, Homo sapiens
taagtttgtctacactaaaa

SEQ ID NO: 5933043 - DNA, 13 bp, Homo sapiens
taagtttgtgtaa

SEQ ID NO: 5933044 - DNA, 17 bp, Homo sapiens
taagttttatttaactt

SEQ ID NO: 5933045 - DNA, 11 bp, Homo sapiens
taagttttctc

SEQ ID NO: 5933046 - DNA, 17 bp, Homo sapiens
taagttttcttgtttct

SEQ ID NO: 5933047 - DNA, 12 bp, Homo sapiens
taagttttgaca

SEQ ID NO: 5933048 - DNA, 18 bp, Homo sapiens
taagttttgtgtgtatat

SEQ ID NO: 5933049 - DNA, 21 bp, Homo sapiens
taagtttttattcaaagcagc

SEQ ID NO: 5933050 - DNA, 22 bp, Homo sapiens
taagtttttattcaaagcagct

SEQ ID NO: 5933051 - DNA, 23 bp, Homo sapiens
taagtttttctctttttcagaca

SEQ ID NO: 5933052 - DNA, 17 bp, Homo sapiens
taagtttttctttaata

SEQ ID NO: 5933053 - DNA, 16 bp, Homo sapiens
taataaaaaaagaaag

SEQ ID NO: 5933054 - DNA, 19 bp, Homo sapiens
taataaaaaaagaaagcat

SEQ ID NO: 5933055 - DNA, 14 bp, Homo sapiens
taataaaaaatgga

SEQ ID NO: 5933056 - DNA, 21 bp, Homo sapiens
taataaaaaatggaaagaatc

SEQ ID NO: 5933057 - DNA, 15 bp, Homo sapiens
taataaaaagaaaga

SEQ ID NO: 5933058 - DNA, 16 bp, Homo sapiens
taataaaaagaaagat

SEQ ID NO: 5933059 - DNA, 23 bp, Homo sapiens
taataaaaagccaccacacactg

SEQ ID NO: 5933060 - DNA, 23 bp, Homo sapiens
taataaaaagctttttcctcctg

SEQ ID NO: 5933061 - DNA, 15 bp, Homo sapiens
taataaaaaggaaat

SEQ ID NO: 5933062 - DNA, 13 bp, Homo sapiens
taataaaaaggtt

SEQ ID NO: 5933063 - DNA, 14 bp, Homo sapiens
taataaaaatgaca

SEQ ID NO: 5933064 - DNA, 21 bp, Homo sapiens
taataaaaatgacagactgaa

SEQ ID NO: 5933065 - DNA, 18 bp, Homo sapiens
taataaaaatttattatt

SEQ ID NO: 5933066 - DNA, 19 bp, Homo sapiens
taataaaacaatactcaaa

SEQ ID NO: 5933067 - DNA, 13 bp, Homo sapiens
taataaaacatct

SEQ ID NO: 5933068 - DNA, 15 bp, Homo sapiens
taataaaacattagt

SEQ ID NO: 5933069 - DNA, 12 bp, Homo sapiens
taataaaaccaa

SEQ ID NO: 5933070 - DNA, 22 bp, Homo sapiens
taataaaacccagcatgtacaa

SEQ ID NO: 5933071 - DNA, 16 bp, Homo sapiens
taataaaactctgcac

SEQ ID NO: 5933072 - DNA, 11 bp, Homo sapiens
taataaaactg

SEQ ID NO: 5933073 - DNA, 12 bp, Homo sapiens
taataaaactga

SEQ ID NO: 5933074 - DNA, 13 bp, Homo sapiens
taataaaactgat

SEQ ID NO: 5933075 - DNA, 21 bp, Homo sapiens
taataaaactgcacagtgctg

SEQ ID NO: 5933076 - DNA, 14 bp, Homo sapiens
taataaaactgtgc

SEQ ID NO: 5933077 - DNA, 12 bp, Homo sapiens
taataaaagaaa

SEQ ID NO: 5933078 - DNA, 21 bp, Homo sapiens
taataaaagatttacattcca

SEQ ID NO: 5933079 - DNA, 14 bp, Homo sapiens
taataaaaggaaaa

SEQ ID NO: 5933080 - DNA, 17 bp, Homo sapiens
taataaaagtacatgtt

SEQ ID NO: 5933081 - DNA, 19 bp, Homo sapiens
taataaaagtactgaagac

SEQ ID NO: 5933082 - DNA, 20 bp, Homo sapiens
taataaaagtactgaagacc

SEQ ID NO: 5933083 - DNA, 15 bp, Homo sapiens
taataaaagtcagag

SEQ ID NO: 5933084 - DNA, 13 bp, Homo sapiens
taataaaagtgaa

SEQ ID NO: 5933085 - DNA, 19 bp, Homo sapiens
taataaaagttattacctt

SEQ ID NO: 5933086 - DNA, 16 bp, Homo sapiens
taataaaataattatg

SEQ ID NO: 5933087 - DNA, 18 bp, Homo sapiens
taataaaataattctaaa

SEQ ID NO: 5933088 - DNA, 16 bp, Homo sapiens
taataaaatacatact

SEQ ID NO: 5933089 - DNA, 14 bp, Homo sapiens
taataaaatacttt

SEQ ID NO: 5933090 - DNA, 19 bp, Homo sapiens
taataaaatactttttgtg

SEQ ID NO: 5933091 - DNA, 20 bp, Homo sapiens
taataaaatattttctgtgt

SEQ ID NO: 5933092 - DNA, 22 bp, Homo sapiens
taataaaatattttctgtgtgt

SEQ ID NO: 5933093 - DNA, 13 bp, Homo sapiens
taataaaatgcaa

SEQ ID NO: 5933094 - DNA, 14 bp, Homo sapiens
taataaaatgcaaa

SEQ ID NO: 5933095 - DNA, 19 bp, Homo sapiens
taataaaatgcaaatgaat

SEQ ID NO: 5933096 - DNA, 22 bp, Homo sapiens
taataaaatgcaaatgaatcat

SEQ ID NO: 5933097 - DNA, 13 bp, Homo sapiens
taataaaatggct

SEQ ID NO: 5933098 - DNA, 13 bp, Homo sapiens
taataaaatgtga

SEQ ID NO: 5933099 - DNA, 19 bp, Homo sapiens
taataaaattcattccatt

SEQ ID NO: 5933100 - DNA, 20 bp, Homo sapiens
taataaaattcattccattt

SEQ ID NO: 5933101 - DNA, 18 bp, Homo sapiens
taataaacactcttgaaa

SEQ ID NO: 5933102 - DNA, 15 bp, Homo sapiens
taataaacataatga

SEQ ID NO: 5933103 - DNA, 22 bp, Homo sapiens
taataaacatccttcaagaact

SEQ ID NO: 5933104 - DNA, 20 bp, Homo sapiens
taataaacgagatgtttgcc

SEQ ID NO: 5933105 - DNA, 18 bp, Homo sapiens
taataaacgatgttgtga

SEQ ID NO: 5933106 - DNA, 12 bp, Homo sapiens
taataaactcat

SEQ ID NO: 5933107 - DNA, 20 bp, Homo sapiens
taataaactcttaagagaac

SEQ ID NO: 5933108 - DNA, 12 bp, Homo sapiens
taataaactgca

SEQ ID NO: 5933109 - DNA, 12 bp, Homo sapiens
taataaactgta

SEQ ID NO: 5933110 - DNA, 16 bp, Homo sapiens
taataaactgtattaa

SEQ ID NO: 5933111 - DNA, 21 bp, Homo sapiens
taataaactgtattaaatctt

SEQ ID NO: 5933112 - DNA, 15 bp, Homo sapiens
taataaactgtgttt

SEQ ID NO: 5933113 - DNA, 13 bp, Homo sapiens
taataaactgttt

SEQ ID NO: 5933114 - DNA, 17 bp, Homo sapiens
taataaacttagaataa

SEQ ID NO: 5933115 - DNA, 23 bp, Homo sapiens
taataaacttagaataaaattgt

SEQ ID NO: 5933116 - DNA, 16 bp, Homo sapiens
taataaactttatttt

SEQ ID NO: 5933117 - DNA, 18 bp, Homo sapiens
taataaactttgtgctga

SEQ ID NO: 5933118 - DNA, 17 bp, Homo sapiens
taataaagaaatattta

SEQ ID NO: 5933119 - DNA, 16 bp, Homo sapiens
taataaagaagctact

SEQ ID NO: 5933120 - DNA, 15 bp, Homo sapiens
taataaagagaaata

SEQ ID NO: 5933121 - DNA, 17 bp, Homo sapiens
taataaagatgctcttt

SEQ ID NO: 5933122 - DNA, 16 bp, Homo sapiens
taataaagatgtgaaa

SEQ ID NO: 5933123 - DNA, 13 bp, Homo sapiens
taataaagcattc

SEQ ID NO: 5933124 - DNA, 14 bp, Homo sapiens
taataaagcattct

SEQ ID NO: 5933125 - DNA, 17 bp, Homo sapiens
taataaagcgaaaaact

SEQ ID NO: 5933126 - DNA, 20 bp, Homo sapiens
taataaagcgaaaaactcaa

SEQ ID NO: 5933127 - DNA, 12 bp, Homo sapiens
taataaagcttt

SEQ ID NO: 5933128 - DNA, 20 bp, Homo sapiens
taataaagctttataaactt

SEQ ID NO: 5933129 - DNA, 20 bp, Homo sapiens
taataaaggactgtaatctt

SEQ ID NO: 5933130 - DNA, 18 bp, Homo sapiens
taataaaggccacaggag

SEQ ID NO: 5933131 - DNA, 11 bp, Homo sapiens
taataaaggct

SEQ ID NO: 5933132 - DNA, 13 bp, Homo sapiens
taataaaggctga

SEQ ID NO: 5933133 - DNA, 22 bp, Homo sapiens
taataaaggtcacataaacttt

SEQ ID NO: 5933134 - DNA, 14 bp, Homo sapiens
taataaaggttcta

SEQ ID NO: 5933135 - DNA, 17 bp, Homo sapiens
taataaaggttctatga

SEQ ID NO: 5933136 - DNA, 16 bp, Homo sapiens
taataaagtagcaaaa

SEQ ID NO: 5933137 - DNA, 18 bp, Homo sapiens
taataaagtagcaaaaca

SEQ ID NO: 5933138 - DNA, 23 bp, Homo sapiens
taataaagtagcaaaacaaattc

SEQ ID NO: 5933139 - DNA, 14 bp, Homo sapiens
taataaagtagtta

SEQ ID NO: 5933140 - DNA, 14 bp, Homo sapiens
taataaagtatata

SEQ ID NO: 5933141 - DNA, 14 bp, Homo sapiens
taataaagtatgaa

SEQ ID NO: 5933142 - DNA, 23 bp, Homo sapiens
taataaagtatgaatatttcatt

SEQ ID NO: 5933143 - DNA, 12 bp, Homo sapiens
taataaagtatt

SEQ ID NO: 5933144 - DNA, 13 bp, Homo sapiens
taataaagtattc

SEQ ID NO: 5933145 - DNA, 15 bp, Homo sapiens
taataaagtattcca

SEQ ID NO: 5933146 - DNA, 17 bp, Homo sapiens
taataaagtattttctt

SEQ ID NO: 5933147 - DNA, 20 bp, Homo sapiens
taataaagtcatttgtgaaa

SEQ ID NO: 5933148 - DNA, 21 bp, Homo sapiens
taataaagtctgtctgcactg

SEQ ID NO: 5933149 - DNA, 16 bp, Homo sapiens
taataaagtgttacgt

SEQ ID NO: 5933150 - DNA, 16 bp, Homo sapiens
taataaagtgttttca

SEQ ID NO: 5933151 - DNA, 17 bp, Homo sapiens
taataaagttgttttat

SEQ ID NO: 5933152 - DNA, 14 bp, Homo sapiens
taataaatacacaa

SEQ ID NO: 5933153 - DNA, 16 bp, Homo sapiens
taataaatacatacgg

SEQ ID NO: 5933154 - DNA, 15 bp, Homo sapiens
taataaatagagcaa

SEQ ID NO: 5933155 - DNA, 15 bp, Homo sapiens
taataaatagttctt

SEQ ID NO: 5933156 - DNA, 15 bp, Homo sapiens
taataaatataattt

SEQ ID NO: 5933157 - DNA, 13 bp, Homo sapiens
taataaatatgtt

SEQ ID NO: 5933158 - DNA, 20 bp, Homo sapiens
taataaatatgtttcacaca

SEQ ID NO: 5933159 - DNA, 13 bp, Homo sapiens
taataaatattga

SEQ ID NO: 5933160 - DNA, 23 bp, Homo sapiens
taataaatattgtattttagata

SEQ ID NO: 5933161 - DNA, 16 bp, Homo sapiens
taataaatatttatgt

SEQ ID NO: 5933162 - DNA, 14 bp, Homo sapiens
taataaatcaaaat

SEQ ID NO: 5933163 - DNA, 14 bp, Homo sapiens
taataaatcacaca

SEQ ID NO: 5933164 - DNA, 23 bp, Homo sapiens
taataaatctgagcctaaatcta

SEQ ID NO: 5933165 - DNA, 17 bp, Homo sapiens
taataaatgaccagttt

SEQ ID NO: 5933166 - DNA, 14 bp, Homo sapiens
taataaatgaggaa

SEQ ID NO: 5933167 - DNA, 18 bp, Homo sapiens
taataaatgcatagagca

SEQ ID NO: 5933168 - DNA, 18 bp, Homo sapiens
taataaatgccctcttct

SEQ ID NO: 5933169 - DNA, 14 bp, Homo sapiens
taataaatgggaaa

SEQ ID NO: 5933170 - DNA, 17 bp, Homo sapiens
taataaatgggaaatgt

SEQ ID NO: 5933171 - DNA, 19 bp, Homo sapiens
taataaatgtacattaatt

SEQ ID NO: 5933172 - DNA, 23 bp, Homo sapiens
taataaatgtgactcagcatcac

SEQ ID NO: 5933173 - DNA, 18 bp, Homo sapiens
taataaatgttatttaag

SEQ ID NO: 5933174 - DNA, 17 bp, Homo sapiens
taataaattaagtacag

SEQ ID NO: 5933175 - DNA, 19 bp, Homo sapiens
taataaattgaaattgtga

SEQ ID NO: 5933176 - DNA, 13 bp, Homo sapiens
taataaattgctt

SEQ ID NO: 5933177 - DNA, 14 bp, Homo sapiens
taataaattgctta

SEQ ID NO: 5933178 - DNA, 14 bp, Homo sapiens
taataaatttaagt

SEQ ID NO: 5933179 - DNA, 23 bp, Homo sapiens
taataaatttactcacagcactt

SEQ ID NO: 5933180 - DNA, 14 bp, Homo sapiens
taataaattttcta

SEQ ID NO: 5933181 - DNA, 21 bp, Homo sapiens
taataacaacaacttaatgtg

SEQ ID NO: 5933182 - DNA, 18 bp, Homo sapiens
taataacaaggagatttc

SEQ ID NO: 5933183 - DNA, 14 bp, Homo sapiens
taataacagaaata

SEQ ID NO: 5933184 - DNA, 20 bp, Homo sapiens
taataacattaccttactgt

SEQ ID NO: 5933185 - DNA, 17 bp, Homo sapiens
taataacatttaattta

SEQ ID NO: 5933186 - DNA, 20 bp, Homo sapiens
taataacatttaatttagat

SEQ ID NO: 5933187 - DNA, 12 bp, Homo sapiens
taataacatttt

SEQ ID NO: 5933188 - DNA, 17 bp, Homo sapiens
taataacgtgaaactta

SEQ ID NO: 5933189 - DNA, 14 bp, Homo sapiens
taataactaaacca

SEQ ID NO: 5933190 - DNA, 14 bp, Homo sapiens
taataactgaactg

SEQ ID NO: 5933191 - DNA, 15 bp, Homo sapiens
taataactgaactgt

SEQ ID NO: 5933192 - DNA, 23 bp, Homo sapiens
taataactgatgagatacatttg

SEQ ID NO: 5933193 - DNA, 13 bp, Homo sapiens
taataactttatt

SEQ ID NO: 5933194 - DNA, 16 bp, Homo sapiens
taataactttattgca

SEQ ID NO: 5933195 - DNA, 21 bp, Homo sapiens
taataactttattgcatatag

SEQ ID NO: 5933196 - DNA, 14 bp, Homo sapiens
taataagaacagat

SEQ ID NO: 5933197 - DNA, 16 bp, Homo sapiens
taataagaacagatca

SEQ ID NO: 5933198 - DNA, 22 bp, Homo sapiens
taataagaacattaattatatg

SEQ ID NO: 5933199 - DNA, 17 bp, Homo sapiens
taataagaaggaaaaat

SEQ ID NO: 5933200 - DNA, 12 bp, Homo sapiens
taataagacata

SEQ ID NO: 5933201 - DNA, 17 bp, Homo sapiens
taataagacataacgtt

SEQ ID NO: 5933202 - DNA, 22 bp, Homo sapiens
taataagacataacgtttttcc

SEQ ID NO: 5933203 - DNA, 13 bp, Homo sapiens
taataagagtaaa

SEQ ID NO: 5933204 - DNA, 15 bp, Homo sapiens
taataagattagttg

SEQ ID NO: 5933205 - DNA, 14 bp, Homo sapiens
taataagcaaaaag

SEQ ID NO: 5933206 - DNA, 14 bp, Homo sapiens
taataagcacttgc

SEQ ID NO: 5933207 - DNA, 19 bp, Homo sapiens
taataagcatggtgtcagt

SEQ ID NO: 5933208 - DNA, 23 bp, Homo sapiens
taataagccaagggctaggctct

SEQ ID NO: 5933209 - DNA, 16 bp, Homo sapiens
taataagctagttgaa

SEQ ID NO: 5933210 - DNA, 21 bp, Homo sapiens
taataagctagttgaatactt

SEQ ID NO: 5933211 - DNA, 15 bp, Homo sapiens
taataagggaaaaat

SEQ ID NO: 5933212 - DNA, 16 bp, Homo sapiens
taataagggaaaaatc

SEQ ID NO: 5933213 - DNA, 15 bp, Homo sapiens
taataaggttgaaca

SEQ ID NO: 5933214 - DNA, 23 bp, Homo sapiens
taatagtacccaacctggtaatt

SEQ ID NO: 5933215 - DNA, 14 bp, Homo sapiens
taatagtatatcta

SEQ ID NO: 5933216 - DNA, 20 bp, Homo sapiens
taatagtatccagcacagat

SEQ ID NO: 5933217 - DNA, 21 bp, Homo sapiens
taatagtcttgcagaaaatga

SEQ ID NO: 5933218 - DNA, 19 bp, Homo sapiens
taatagtgccaagcaggcc

SEQ ID NO: 5933219 - DNA, 14 bp, Homo sapiens
taatagtgcttttt

SEQ ID NO: 5933220 - DNA, 13 bp, Homo sapiens
taatagtgttaat

SEQ ID NO: 5933221 - DNA, 15 bp, Homo sapiens
taatagtgttaatca

SEQ ID NO: 5933222 - DNA, 14 bp, Homo sapiens
taatagttattatt

SEQ ID NO: 5933223 - DNA, 20 bp, Homo sapiens
taatagttcagtagaattac

SEQ ID NO: 5933224 - DNA, 23 bp, Homo sapiens
taatagttcagtagaattaccat

SEQ ID NO: 5933225 - DNA, 12 bp, Homo sapiens
taatagttcctg

SEQ ID NO: 5933226 - DNA, 14 bp, Homo sapiens
taatagtttatctt

SEQ ID NO: 5933227 - DNA, 14 bp, Homo sapiens
taatagtttctaaa

SEQ ID NO: 5933228 - DNA, 19 bp, Homo sapiens
taatagtttctaaaccatg

SEQ ID NO: 5933229 - DNA, 13 bp, Homo sapiens
taatagtttgtct

SEQ ID NO: 5933230 - DNA, 15 bp, Homo sapiens
taatataaaaaattt

SEQ ID NO: 5933231 - DNA, 21 bp, Homo sapiens
taatataaaaagcttccatga

SEQ ID NO: 5933232 - DNA, 11 bp, Homo sapiens
taatataaaag

SEQ ID NO: 5933233 - DNA, 12 bp, Homo sapiens
taatataaaaga

SEQ ID NO: 5933234 - DNA, 21 bp, Homo sapiens
taatataaagtagtcctgtga

SEQ ID NO: 5933235 - DNA, 20 bp, Homo sapiens
taatataaagttttatatat

SEQ ID NO: 5933236 - DNA, 13 bp, Homo sapiens
taatataaatata

SEQ ID NO: 5933237 - DNA, 20 bp, Homo sapiens
taatataaatcgtaacctat

SEQ ID NO: 5933238 - DNA, 12 bp, Homo sapiens
taatataaatga

SEQ ID NO: 5933239 - DNA, 14 bp, Homo sapiens
taatataaatgaat

SEQ ID NO: 5933240 - DNA, 21 bp, Homo sapiens
taatataaatgaatgaaatat

SEQ ID NO: 5933241 - DNA, 12 bp, Homo sapiens
taatataaatgc

SEQ ID NO: 5933242 - DNA, 14 bp, Homo sapiens
taatataaatgcaa

SEQ ID NO: 5933243 - DNA, 14 bp, Homo sapiens
taatataaattcac

SEQ ID NO: 5933244 - DNA, 23 bp, Homo sapiens
taatataacaatatatgatatat

SEQ ID NO: 5933245 - DNA, 21 bp, Homo sapiens
taatataactgccttaaaact

SEQ ID NO: 5933246 - DNA, 23 bp, Homo sapiens
taatataactgccttaaaacttt

SEQ ID NO: 5933247 - DNA, 14 bp, Homo sapiens
taatataactgtct

SEQ ID NO: 5933248 - DNA, 15 bp, Homo sapiens
taatataacttgaaa

SEQ ID NO: 5933249 - DNA, 21 bp, Homo sapiens
taatataagtttctttagaaa

SEQ ID NO: 5933250 - DNA, 22 bp, Homo sapiens
taatataagtttctttgcttca

SEQ ID NO: 5933251 - DNA, 13 bp, Homo sapiens
taatataataaaa

SEQ ID NO: 5933252 - DNA, 18 bp, Homo sapiens
taatataatacacaaaat

SEQ ID NO: 5933253 - DNA, 21 bp, Homo sapiens
taatataatttaacagaagtt

SEQ ID NO: 5933254 - DNA, 20 bp, Homo sapiens
taatatacagtgtgtagttt

SEQ ID NO: 5933255 - DNA, 19 bp, Homo sapiens
taatataccccaaattgtg

SEQ ID NO: 5933256 - DNA, 16 bp, Homo sapiens
taatatactatattta

SEQ ID NO: 5933257 - DNA, 12 bp, Homo sapiens
taatatactcct

SEQ ID NO: 5933258 - DNA, 15 bp, Homo sapiens
taatatactccttaa

SEQ ID NO: 5933259 - DNA, 20 bp, Homo sapiens
taatatactccttaaaaatg

SEQ ID NO: 5933260 - DNA, 23 bp, Homo sapiens
taatatactccttaaaaatgtat

SEQ ID NO: 5933261 - DNA, 15 bp, Homo sapiens
taatatactgcatat

SEQ ID NO: 5933262 - DNA, 19 bp, Homo sapiens
taatatagaaaaaaacatt

SEQ ID NO: 5933263 - DNA, 16 bp, Homo sapiens
taatatagggtttgtt

SEQ ID NO: 5933264 - DNA, 23 bp, Homo sapiens
taatatagggtttgtttgctgct

SEQ ID NO: 5933265 - DNA, 16 bp, Homo sapiens
taatatagtagatttt

SEQ ID NO: 5933266 - DNA, 19 bp, Homo sapiens
taatatataaaagaaatat

SEQ ID NO: 5933267 - DNA, 14 bp, Homo sapiens
taatatataaacaa

SEQ ID NO: 5933268 - DNA, 17 bp, Homo sapiens
taatatatacaaacctt

SEQ ID NO: 5933269 - DNA, 10 bp, Homo sapiens
taatatatat

SEQ ID NO: 5933270 - DNA, 16 bp, Homo sapiens
taatatatatgaataa

SEQ ID NO: 5933271 - DNA, 16 bp, Homo sapiens
taatatatattatctt

SEQ ID NO: 5933272 - DNA, 21 bp, Homo sapiens
taatatatcaaatccaggact

SEQ ID NO: 5933273 - DNA, 13 bp, Homo sapiens
taatatatcaata

SEQ ID NO: 5933274 - DNA, 18 bp, Homo sapiens
taatatatcattatcttt

SEQ ID NO: 5933275 - DNA, 21 bp, Homo sapiens
taatatatcctgtttgtattt

SEQ ID NO: 5933276 - DNA, 15 bp, Homo sapiens
taatatatctgtaac

SEQ ID NO: 5933277 - DNA, 12 bp, Homo sapiens
taatatatggaa

SEQ ID NO: 5933278 - DNA, 21 bp, Homo sapiens
taatatatggacctagcttga

SEQ ID NO: 5933279 - DNA, 22 bp, Homo sapiens
taatatatgggggaaaattatt

SEQ ID NO: 5933280 - DNA, 23 bp, Homo sapiens
taatatatgggggaaaattattt

SEQ ID NO: 5933281 - DNA, 12 bp, Homo sapiens
taatatattaaa

SEQ ID NO: 5933282 - DNA, 15 bp, Homo sapiens
taatatattaaaatt

SEQ ID NO: 5933283 - DNA, 16 bp, Homo sapiens
taatatattaaaattc

SEQ ID NO: 5933284 - DNA, 21 bp, Homo sapiens
taatatattctgaagcaacat

SEQ ID NO: 5933285 - DNA, 14 bp, Homo sapiens
taatatattgaaca

SEQ ID NO: 5933286 - DNA, 14 bp, Homo sapiens
taatatattgtaca

SEQ ID NO: 5933287 - DNA, 16 bp, Homo sapiens
taatatattgtacaaa

SEQ ID NO: 5933288 - DNA, 19 bp, Homo sapiens
taatatatttaaagggaaa

SEQ ID NO: 5933289 - DNA, 14 bp, Homo sapiens
taatatatttcttc

SEQ ID NO: 5933290 - DNA, 20 bp, Homo sapiens
taatatatttgtgtatttaa

SEQ ID NO: 5933291 - DNA, 17 bp, Homo sapiens
taatatattttctgttt

SEQ ID NO: 5933292 - DNA, 17 bp, Homo sapiens
taatatcaaaagaaaat

SEQ ID NO: 5933293 - DNA, 16 bp, Homo sapiens
taatatcaaataaaat

SEQ ID NO: 5933294 - DNA, 14 bp, Homo sapiens
taatatcactcatt

SEQ ID NO: 5933295 - DNA, 17 bp, Homo sapiens
taatatcactcattaat

SEQ ID NO: 5933296 - DNA, 15 bp, Homo sapiens
taatatcacttaaat

SEQ ID NO: 5933297 - DNA, 17 bp, Homo sapiens
taatatcagttacagtg

SEQ ID NO: 5933298 - DNA, 23 bp, Homo sapiens
taatatcatcagtattgaagcat

SEQ ID NO: 5933299 - DNA, 15 bp, Homo sapiens
taatatcatttcata

SEQ ID NO: 5933300 - DNA, 15 bp, Homo sapiens
taatatcattttata

SEQ ID NO: 5933301 - DNA, 20 bp, Homo sapiens
taatatcattttatagaaaa

SEQ ID NO: 5933302 - DNA, 17 bp, Homo sapiens
taatatcattttattca

SEQ ID NO: 5933303 - DNA, 24 bp, Homo sapiens
taatatcattttattcacatatgt

SEQ ID NO: 5933304 - DNA, 19 bp, Homo sapiens
taatatccactgcaatact

SEQ ID NO: 5933305 - DNA, 20 bp, Homo sapiens
taatatccaggtcaacagaa

SEQ ID NO: 5933306 - DNA, 23 bp, Homo sapiens
taatatcccactgggagaaagga

SEQ ID NO: 5933307 - DNA, 12 bp, Homo sapiens
taatatcctaaa

SEQ ID NO: 5933308 - DNA, 14 bp, Homo sapiens
taatatcctaaaca

SEQ ID NO: 5933309 - DNA, 15 bp, Homo sapiens
taatatcctgtaata

SEQ ID NO: 5933310 - DNA, 16 bp, Homo sapiens
taatatcggggggtgg

SEQ ID NO: 5933311 - DNA, 15 bp, Homo sapiens
taatatctaaagtta

SEQ ID NO: 5933312 - DNA, 13 bp, Homo sapiens
taatatctgtgag

SEQ ID NO: 5933313 - DNA, 12 bp, Homo sapiens
taatatcttgaa

SEQ ID NO: 5933314 - DNA, 15 bp, Homo sapiens
taatatcttgaagaa

SEQ ID NO: 5933315 - DNA, 22 bp, Homo sapiens
taatatcttgctggattaatgt

SEQ ID NO: 5933316 - DNA, 21 bp, Homo sapiens
taatatctttaaatgatgtac

SEQ ID NO: 5933317 - DNA, 13 bp, Homo sapiens
taatatctttcag

SEQ ID NO: 5933318 - DNA, 19 bp, Homo sapiens
taatatctttctgcacaca

SEQ ID NO: 5933319 - DNA, 19 bp, Homo sapiens
taatatctttgtgataatt

SEQ ID NO: 5933320 - DNA, 21 bp, Homo sapiens
taatatctttgtgataattta

SEQ ID NO: 5933321 - DNA, 13 bp, Homo sapiens
taatatgaaagcc

SEQ ID NO: 5933322 - DNA, 15 bp, Homo sapiens
taatatgaaagccac

SEQ ID NO: 5933323 - DNA, 15 bp, Homo sapiens
taatatgaagccttt

SEQ ID NO: 5933324 - DNA, 13 bp, Homo sapiens
taatatgaatata

SEQ ID NO: 5933325 - DNA, 14 bp, Homo sapiens
taatatgacagata

SEQ ID NO: 5933326 - DNA, 17 bp, Homo sapiens
taatatgagaatgtatt

SEQ ID NO: 5933327 - DNA, 17 bp, Homo sapiens
taatatgatctgtggag

SEQ ID NO: 5933328 - DNA, 21 bp, Homo sapiens
taatatgattctagtacataa

SEQ ID NO: 5933329 - DNA, 22 bp, Homo sapiens
taatatgcaatcctacttctat

SEQ ID NO: 5933330 - DNA, 15 bp, Homo sapiens
taatatgcacacatt

SEQ ID NO: 5933331 - DNA, 16 bp, Homo sapiens
taatatgcacacattt

SEQ ID NO: 5933332 - DNA, 10 bp, Homo sapiens
taatatgcat

SEQ ID NO: 5933333 - DNA, 16 bp, Homo sapiens
taatatgctttttact

SEQ ID NO: 5933334 - DNA, 18 bp, Homo sapiens
taatatggctatgcttaa

SEQ ID NO: 5933335 - DNA, 20 bp, Homo sapiens
taatatgggcattgtagtta

SEQ ID NO: 5933336 - DNA, 16 bp, Homo sapiens
taatatggggatgcag

SEQ ID NO: 5933337 - DNA, 20 bp, Homo sapiens
taatatggtcaggaagcaag

SEQ ID NO: 5933338 - DNA, 15 bp, Homo sapiens
taatatgtacaaata

SEQ ID NO: 5933339 - DNA, 17 bp, Homo sapiens
taatatgtacaaataat

SEQ ID NO: 5933340 - DNA, 12 bp, Homo sapiens
taatatgtactt

SEQ ID NO: 5933341 - DNA, 18 bp, Homo sapiens
taatatgtacttttccat

SEQ ID NO: 5933342 - DNA, 11 bp, Homo sapiens
taatatgtatt

SEQ ID NO: 5933343 - DNA, 20 bp, Homo sapiens
taatatgtctgccacagaga

SEQ ID NO: 5933344 - DNA, 12 bp, Homo sapiens
taatatgtcttt

SEQ ID NO: 5933345 - DNA, 13 bp, Homo sapiens
taatatgtctttt

SEQ ID NO: 5933346 - DNA, 17 bp, Homo sapiens
taatatgtgagaggaca

SEQ ID NO: 5933347 - DNA, 19 bp, Homo sapiens
taatatgttcattaaattt

SEQ ID NO: 5933348 - DNA, 13 bp, Homo sapiens
taatatgttgact

SEQ ID NO: 5933349 - DNA, 18 bp, Homo sapiens
taatatgtttccttccct

SEQ ID NO: 5933350 - DNA, 14 bp, Homo sapiens
taatatgtttgagg

SEQ ID NO: 5933351 - DNA, 17 bp, Homo sapiens
taatatgtttgaggtta

SEQ ID NO: 5933352 - DNA, 17 bp, Homo sapiens
taatattaaaagtcaca

SEQ ID NO: 5933353 - DNA, 12 bp, Homo sapiens
taatattaaagc

SEQ ID NO: 5933354 - DNA, 16 bp, Homo sapiens
taatattaaatatatg

SEQ ID NO: 5933355 - DNA, 21 bp, Homo sapiens
taatattaactacagaaaaga

SEQ ID NO: 5933356 - DNA, 20 bp, Homo sapiens
taatattaaggaagacaatg

SEQ ID NO: 5933357 - DNA, 14 bp, Homo sapiens
taatattaatttat

SEQ ID NO: 5933358 - DNA, 19 bp, Homo sapiens
taatattaatttatatttg

SEQ ID NO: 5933359 - DNA, 14 bp, Homo sapiens
taatattacatttc

SEQ ID NO: 5933360 - DNA, 18 bp, Homo sapiens
taatattacatttcattt

SEQ ID NO: 5933361 - DNA, 19 bp, Homo sapiens
taatattacctaatgaaag

SEQ ID NO: 5933362 - DNA, 22 bp, Homo sapiens
taatattacctaatgaaagtga

SEQ ID NO: 5933363 - DNA, 15 bp, Homo sapiens
taatattattggggt

SEQ ID NO: 5933364 - DNA, 20 bp, Homo sapiens
taatattcagccagcttaaa

SEQ ID NO: 5933365 - DNA, 20 bp, Homo sapiens
taatattcagggtaaatagg

SEQ ID NO: 5933366 - DNA, 21 bp, Homo sapiens
taatattcagggtaaatagga

SEQ ID NO: 5933367 - DNA, 23 bp, Homo sapiens
taatattccagaagaacaacttt

SEQ ID NO: 5933368 - DNA, 17 bp, Homo sapiens
taatattctctgatgtt

SEQ ID NO: 5933369 - DNA, 14 bp, Homo sapiens
taatattctgctat

SEQ ID NO: 5933370 - DNA, 14 bp, Homo sapiens
taatattctttcaa

SEQ ID NO: 5933371 - DNA, 20 bp, Homo sapiens
taatattctttcaataacga

SEQ ID NO: 5933372 - DNA, 13 bp, Homo sapiens
taatattgaaaat

SEQ ID NO: 5933373 - DNA, 19 bp, Homo sapiens
taatattgaaaatgtcact

SEQ ID NO: 5933374 - DNA, 21 bp, Homo sapiens
taatattgatatgcttataca

SEQ ID NO: 5933375 - DNA, 22 bp, Homo sapiens
taatattgccttgatgtttcta

SEQ ID NO: 5933376 - DNA, 16 bp, Homo sapiens
taatattgcttcttgt

SEQ ID NO: 5933377 - DNA, 19 bp, Homo sapiens
taatattggtgctatttaa

SEQ ID NO: 5933378 - DNA, 14 bp, Homo sapiens
taatattgtattgc

SEQ ID NO: 5933379 - DNA, 12 bp, Homo sapiens
taatattgtgct

SEQ ID NO: 5933380 - DNA, 19 bp, Homo sapiens
taatattgtttttctttct

SEQ ID NO: 5933381 - DNA, 20 bp, Homo sapiens
taatattgtttttctttcta

SEQ ID NO: 5933382 - DNA, 15 bp, Homo sapiens
taatatttacaatgt

SEQ ID NO: 5933383 - DNA, 17 bp, Homo sapiens
taatatttaccaaagta

SEQ ID NO: 5933384 - DNA, 14 bp, Homo sapiens
taatatttactgtt

SEQ ID NO: 5933385 - DNA, 23 bp, Homo sapiens
taatatttagctgtaaactgaat

SEQ ID NO: 5933386 - DNA, 12 bp, Homo sapiens
taatatttaggc

SEQ ID NO: 5933387 - DNA, 21 bp, Homo sapiens
taatatttaggcatgagctct

SEQ ID NO: 5933388 - DNA, 13 bp, Homo sapiens
taatatttatgtt

SEQ ID NO: 5933389 - DNA, 13 bp, Homo sapiens
taatatttattaa

SEQ ID NO: 5933390 - DNA, 18 bp, Homo sapiens
taatatttattgaattat

SEQ ID NO: 5933391 - DNA, 18 bp, Homo sapiens
taatatttcaagtgccta

SEQ ID NO: 5933392 - DNA, 16 bp, Homo sapiens
taatatttctgtggaa

SEQ ID NO: 5933393 - DNA, 12 bp, Homo sapiens
taatatttctta

SEQ ID NO: 5933394 - DNA, 23 bp, Homo sapiens
taatgacaccacacttgttttct

SEQ ID NO: 5933395 - DNA, 17 bp, Homo sapiens
taatgacactgtttcct

SEQ ID NO: 5933396 - DNA, 15 bp, Homo sapiens
taatgacagagagtt

SEQ ID NO: 5933397 - DNA, 15 bp, Homo sapiens
taatgacagagccag

SEQ ID NO: 5933398 - DNA, 21 bp, Homo sapiens
taatgacagataaatccttaa

SEQ ID NO: 5933399 - DNA, 22 bp, Homo sapiens
taatgacagatgcaagttattt

SEQ ID NO: 5933400 - DNA, 14 bp, Homo sapiens
taatgacattcaat

SEQ ID NO: 5933401 - DNA, 19 bp, Homo sapiens
taatgacattcaataaagt

SEQ ID NO: 5933402 - DNA, 11 bp, Homo sapiens
taatgaccaac

SEQ ID NO: 5933403 - DNA, 23 bp, Homo sapiens
taatgaccaacctgtttctacct

SEQ ID NO: 5933404 - DNA, 20 bp, Homo sapiens
taatgaccatgaaagacttc

SEQ ID NO: 5933405 - DNA, 15 bp, Homo sapiens
taatgaccatgttat

SEQ ID NO: 5933406 - DNA, 16 bp, Homo sapiens
taatgacccggccccc

SEQ ID NO: 5933407 - DNA, 18 bp, Homo sapiens
taatgacgtattgtgaaa

SEQ ID NO: 5933408 - DNA, 19 bp, Homo sapiens
taatgactggtcttcctta

SEQ ID NO: 5933409 - DNA, 16 bp, Homo sapiens
taatgacttagaaact

SEQ ID NO: 5933410 - DNA, 19 bp, Homo sapiens
taatgacttgtacaaacag

SEQ ID NO: 5933411 - DNA, 14 bp, Homo sapiens
taatgacttttaaa

SEQ ID NO: 5933412 - DNA, 23 bp, Homo sapiens
taatgacttttaaaatttgtaga

SEQ ID NO: 5933413 - DNA, 20 bp, Homo sapiens
taatgacttttgaattacag

SEQ ID NO: 5933414 - DNA, 21 bp, Homo sapiens
taatgacttttgaattacaga

SEQ ID NO: 5933415 - DNA, 14 bp, Homo sapiens
taatgagaacattt

SEQ ID NO: 5933416 - DNA, 20 bp, Homo sapiens
taatgagaacttcaatcact

SEQ ID NO: 5933417 - DNA, 20 bp, Homo sapiens
taatgagaagagttttctca

SEQ ID NO: 5933418 - DNA, 23 bp, Homo sapiens
taatgagacttgagtctattttt

SEQ ID NO: 5933419 - DNA, 19 bp, Homo sapiens
taatgagagcaaatgcaaa

SEQ ID NO: 5933420 - DNA, 21 bp, Homo sapiens
taatgagagcaaatgcaaaaa

SEQ ID NO: 5933421 - DNA, 22 bp, Homo sapiens
taatgagatatatctttatact

SEQ ID NO: 5933422 - DNA, 17 bp, Homo sapiens
taatgagatatttgtat

SEQ ID NO: 5933423 - DNA, 22 bp, Homo sapiens
taatgagatgttattactgttt

SEQ ID NO: 5933424 - DNA, 21 bp, Homo sapiens
taatgagcaatatctgctaga

SEQ ID NO: 5933425 - DNA, 23 bp, Homo sapiens
taatgagcagatgagagtttctg

SEQ ID NO: 5933426 - DNA, 20 bp, Homo sapiens
taatgagccaataaagctca

SEQ ID NO: 5933427 - DNA, 22 bp, Homo sapiens
taatgagccatcactagaagaa

SEQ ID NO: 5933428 - DNA, 18 bp, Homo sapiens
taatgagctattaaaact

SEQ ID NO: 5933429 - DNA, 21 bp, Homo sapiens
taatgagctattaaaactcag

SEQ ID NO: 5933430 - DNA, 21 bp, Homo sapiens
taatgagctcctgctcattgt

SEQ ID NO: 5933431 - DNA, 23 bp, Homo sapiens
taatgaggtagctatagttgcag

SEQ ID NO: 5933432 - DNA, 17 bp, Homo sapiens
taatgaggtccctctag

SEQ ID NO: 5933433 - DNA, 11 bp, Homo sapiens
taatgagtaac

SEQ ID NO: 5933434 - DNA, 17 bp, Homo sapiens
taatgagtatatgtaac

SEQ ID NO: 5933435 - DNA, 16 bp, Homo sapiens
taatgagtcacaaaat

SEQ ID NO: 5933436 - DNA, 17 bp, Homo sapiens
taatgagtgcacctgcc

SEQ ID NO: 5933437 - DNA, 19 bp, Homo sapiens
taatgagttgctggaaaat

SEQ ID NO: 5933438 - DNA, 22 bp, Homo sapiens
taatgagttgctggaaaatcat

SEQ ID NO: 5933439 - DNA, 23 bp, Homo sapiens
taatgagttgctggaaaatcata

SEQ ID NO: 5933440 - DNA, 18 bp, Homo sapiens
taatgagttttacattac

SEQ ID NO: 5933441 - DNA, 17 bp, Homo sapiens
taatgataaaataaata

SEQ ID NO: 5933442 - DNA, 18 bp, Homo sapiens
taatgataaaataaataa

SEQ ID NO: 5933443 - DNA, 22 bp, Homo sapiens
taatgataaaatcccattgtat

SEQ ID NO: 5933444 - DNA, 12 bp, Homo sapiens
taatgataaact

SEQ ID NO: 5933445 - DNA, 21 bp, Homo sapiens
taatgataaactcagatctga

SEQ ID NO: 5933446 - DNA, 18 bp, Homo sapiens
taatgataactaaaatcc

SEQ ID NO: 5933447 - DNA, 16 bp, Homo sapiens
taatgataactggaaa

SEQ ID NO: 5933448 - DNA, 23 bp, Homo sapiens
taatgataactggaaacttcagc

SEQ ID NO: 5933449 - DNA, 15 bp, Homo sapiens
taatgataacttgtt

SEQ ID NO: 5933450 - DNA, 19 bp, Homo sapiens
taatgataagtaaatgcta

SEQ ID NO: 5933451 - DNA, 22 bp, Homo sapiens
taatgataatcccaccaccctt

SEQ ID NO: 5933452 - DNA, 19 bp, Homo sapiens
taatgatactgattatgaa

SEQ ID NO: 5933453 - DNA, 20 bp, Homo sapiens
taatgatactgattatgaaa

SEQ ID NO: 5933454 - DNA, 16 bp, Homo sapiens
taatgatactgtctaa

SEQ ID NO: 5933455 - DNA, 15 bp, Homo sapiens
taatgatactgtgtg

SEQ ID NO: 5933456 - DNA, 16 bp, Homo sapiens
taatgatcaaagtttt

SEQ ID NO: 5933457 - DNA, 20 bp, Homo sapiens
taatgatcgaaaaaataatt

SEQ ID NO: 5933458 - DNA, 22 bp, Homo sapiens
taatgatgacaaaaaatgtttt

SEQ ID NO: 5933459 - DNA, 23 bp, Homo sapiens
taatgatgagcatttagcacaat

SEQ ID NO: 5933460 - DNA, 22 bp, Homo sapiens
taatgatgaggatctgaaaact

SEQ ID NO: 5933461 - DNA, 18 bp, Homo sapiens
taatgatggatttaacag

SEQ ID NO: 5933462 - DNA, 17 bp, Homo sapiens
taatgatgtcgtttgaa

SEQ ID NO: 5933463 - DNA, 23 bp, Homo sapiens
taatgatgtcgtttgaatcacag

SEQ ID NO: 5933464 - DNA, 20 bp, Homo sapiens
taatgatgttatcttaacac

SEQ ID NO: 5933465 - DNA, 16 bp, Homo sapiens
taatgattaagggaca

SEQ ID NO: 5933466 - DNA, 22 bp, Homo sapiens
taatgattaagggacatttcta

SEQ ID NO: 5933467 - DNA, 23 bp, Homo sapiens
taatgattaagggacatttctat

SEQ ID NO: 5933468 - DNA, 19 bp, Homo sapiens
taatgattatataaaatac

SEQ ID NO: 5933469 - DNA, 17 bp, Homo sapiens
taatgattatatgacaa

SEQ ID NO: 5933470 - DNA, 19 bp, Homo sapiens
taatgattcaattaacata

SEQ ID NO: 5933471 - DNA, 18 bp, Homo sapiens
taatgattcttgtgtcat

SEQ ID NO: 5933472 - DNA, 16 bp, Homo sapiens
taatgatttcctctga

SEQ ID NO: 5933473 - DNA, 23 bp, Homo sapiens
taatgatttcttgataattgtgt

SEQ ID NO: 5933474 - DNA, 12 bp, Homo sapiens
taatgattttgg

SEQ ID NO: 5933475 - DNA, 13 bp, Homo sapiens
taatgcaaatgtc

SEQ ID NO: 5933476 - DNA, 14 bp, Homo sapiens
taatgcaaatgtca

SEQ ID NO: 5933477 - DNA, 22 bp, Homo sapiens
taatgcaaattaaaacatattt

SEQ ID NO: 5933478 - DNA, 14 bp, Homo sapiens
taatgcaacaatgt

SEQ ID NO: 5933479 - DNA, 19 bp, Homo sapiens
taatgcaagagaacatttt

SEQ ID NO: 5933480 - DNA, 23 bp, Homo sapiens
taatgcaagagaacattttactg

SEQ ID NO: 5933481 - DNA, 18 bp, Homo sapiens
taatgcaatgataaataa

SEQ ID NO: 5933482 - DNA, 14 bp, Homo sapiens
taatgcacaattta

SEQ ID NO: 5933483 - DNA, 15 bp, Homo sapiens
taatgcacaatttag

SEQ ID NO: 5933484 - DNA, 18 bp, Homo sapiens
taatgcacaatttagaaa

SEQ ID NO: 5933485 - DNA, 19 bp, Homo sapiens
taatgcacaatttagaaaa

SEQ ID NO: 5933486 - DNA, 13 bp, Homo sapiens
taatgcacatcct

SEQ ID NO: 5933487 - DNA, 21 bp, Homo sapiens
taatgcacatcctcattcact

SEQ ID NO: 5933488 - DNA, 22 bp, Homo sapiens
taatgcactctgggtctggcca

SEQ ID NO: 5933489 - DNA, 14 bp, Homo sapiens
taatgcactttcta

SEQ ID NO: 5933490 - DNA, 16 bp, Homo sapiens
taatgcagaagtattc

SEQ ID NO: 5933491 - DNA, 18 bp, Homo sapiens
taatgcagaagtattctt

SEQ ID NO: 5933492 - DNA, 16 bp, Homo sapiens
taatgcagacatttac

SEQ ID NO: 5933493 - DNA, 18 bp, Homo sapiens
taatgcagacatttacat

SEQ ID NO: 5933494 - DNA, 19 bp, Homo sapiens
taatgcagataaatacatt

SEQ ID NO: 5933495 - DNA, 21 bp, Homo sapiens
taatgcagtatggtacatttt

SEQ ID NO: 5933496 - DNA, 17 bp, Homo sapiens
taatgcagttgcttact

SEQ ID NO: 5933497 - DNA, 15 bp, Homo sapiens
taatgcatacagaaa

SEQ ID NO: 5933498 - DNA, 13 bp, Homo sapiens
taatgcatattta

SEQ ID NO: 5933499 - DNA, 19 bp, Homo sapiens
taatgcattaacttttgta

SEQ ID NO: 5933500 - DNA, 18 bp, Homo sapiens
taatgcattcttctctgt

SEQ ID NO: 5933501 - DNA, 19 bp, Homo sapiens
taatgcattcttctctgtt

SEQ ID NO: 5933502 - DNA, 17 bp, Homo sapiens
taatgcatttgagcatg

SEQ ID NO: 5933503 - DNA, 16 bp, Homo sapiens
taatgcattttgcact

SEQ ID NO: 5933504 - DNA, 19 bp, Homo sapiens
taatgccaatgaacatctc

SEQ ID NO: 5933505 - DNA, 19 bp, Homo sapiens
taatgccattttaaggaaa

SEQ ID NO: 5933506 - DNA, 21 bp, Homo sapiens
taatgcccagccagccacccc

SEQ ID NO: 5933507 - DNA, 18 bp, Homo sapiens
taatgcctcttcattctt

SEQ ID NO: 5933508 - DNA, 15 bp, Homo sapiens
taatgcctgcttttt

SEQ ID NO: 5933509 - DNA, 15 bp, Homo sapiens
taatgccttactctt

SEQ ID NO: 5933510 - DNA, 12 bp, Homo sapiens
taatgccttcca

SEQ ID NO: 5933511 - DNA, 14 bp, Homo sapiens
taatgcgattttat

SEQ ID NO: 5933512 - DNA, 15 bp, Homo sapiens
taatgcgattttatt

SEQ ID NO: 5933513 - DNA, 14 bp, Homo sapiens
taatgcgtgcatac

SEQ ID NO: 5933514 - DNA, 20 bp, Homo sapiens
taatgctaaagaaaaagtca

SEQ ID NO: 5933515 - DNA, 14 bp, Homo sapiens
taatgctaaatgta

SEQ ID NO: 5933516 - DNA, 22 bp, Homo sapiens
taatgctaaatgtgtaataatg

SEQ ID NO: 5933517 - DNA, 17 bp, Homo sapiens
taatgctacgtgtgatt

SEQ ID NO: 5933518 - DNA, 17 bp, Homo sapiens
taatgctatttgaacaa

SEQ ID NO: 5933519 - DNA, 22 bp, Homo sapiens
taatgctattttaaaaaatata

SEQ ID NO: 5933520 - DNA, 20 bp, Homo sapiens
taatgctcacctttatcacc

SEQ ID NO: 5933521 - DNA, 17 bp, Homo sapiens
taatgctcccatctcct

SEQ ID NO: 5933522 - DNA, 22 bp, Homo sapiens
taatgctctatgtttgtatttg

SEQ ID NO: 5933523 - DNA, 19 bp, Homo sapiens
taatgctcttcaaaataaa

SEQ ID NO: 5933524 - DNA, 20 bp, Homo sapiens
taatgctgcctcaggaccca

SEQ ID NO: 5933525 - DNA, 16 bp, Homo sapiens
taatgctgtaaaatat

SEQ ID NO: 5933526 - DNA, 15 bp, Homo sapiens
taatgctgtctttgt

SEQ ID NO: 5933527 - DNA, 18 bp, Homo sapiens
taatgctgtctttgtgga

SEQ ID NO: 5933528 - DNA, 17 bp, Homo sapiens
taatgctgttgcctcat

SEQ ID NO: 5933529 - DNA, 14 bp, Homo sapiens
taatgctgtttcta

SEQ ID NO: 5933530 - DNA, 15 bp, Homo sapiens
taatgctgtttctaa

SEQ ID NO: 5933531 - DNA, 16 bp, Homo sapiens
taatgctgtttctaag

SEQ ID NO: 5933532 - DNA, 18 bp, Homo sapiens
taatgcttaacataaact

SEQ ID NO: 5933533 - DNA, 22 bp, Homo sapiens
taatgcttaacataaacttgta

SEQ ID NO: 5933534 - DNA, 14 bp, Homo sapiens
taatgcttaagatt

SEQ ID NO: 5933535 - DNA, 16 bp, Homo sapiens
taatgcttaagatttg

SEQ ID NO: 5933536 - DNA, 21 bp, Homo sapiens
taatgcttacctaatttcatt

SEQ ID NO: 5933537 - DNA, 15 bp, Homo sapiens
taatgcttatgtgtt

SEQ ID NO: 5933538 - DNA, 14 bp, Homo sapiens
taatgcttcattca

SEQ ID NO: 5933539 - DNA, 23 bp, Homo sapiens
taatgcttccaatcttgctttgt

SEQ ID NO: 5933540 - DNA, 15 bp, Homo sapiens
taatgcttgatttag

SEQ ID NO: 5933541 - DNA, 14 bp, Homo sapiens
taatgcttgctttt

SEQ ID NO: 5933542 - DNA, 16 bp, Homo sapiens
taatgcttggaatggc

SEQ ID NO: 5933543 - DNA, 15 bp, Homo sapiens
taatgcttgtacagt

SEQ ID NO: 5933544 - DNA, 17 bp, Homo sapiens
taatgctttatgtttaa

SEQ ID NO: 5933545 - DNA, 15 bp, Homo sapiens
taatgctttggaaaa

SEQ ID NO: 5933546 - DNA, 16 bp, Homo sapiens
taatgcttttactaag

SEQ ID NO: 5933547 - DNA, 20 bp, Homo sapiens
taatgcttttctaattaata

SEQ ID NO: 5933548 - DNA, 19 bp, Homo sapiens
taatgctttttagaaagca

SEQ ID NO: 5933549 - DNA, 11 bp, Homo sapiens
taatggaaaaa

SEQ ID NO: 5933550 - DNA, 22 bp, Homo sapiens
taatggaaaaaaaaaaaagagg

SEQ ID NO: 5933551 - DNA, 21 bp, Homo sapiens
taatggaaaatgccatgaatt

SEQ ID NO: 5933552 - DNA, 18 bp, Homo sapiens
taatggaaacatttacaa

SEQ ID NO: 5933553 - DNA, 20 bp, Homo sapiens
taatggaaacatttacaata

SEQ ID NO: 5933554 - DNA, 14 bp, Homo sapiens
taatggaaaccaag

SEQ ID NO: 5933555 - DNA, 16 bp, Homo sapiens
taatggaaagcagcag

SEQ ID NO: 5933556 - DNA, 14 bp, Homo sapiens
taatggaagagaaa

SEQ ID NO: 5933557 - DNA, 17 bp, Homo sapiens
taatggaagagaaatct

SEQ ID NO: 5933558 - DNA, 19 bp, Homo sapiens
taatggaagtgtatttatt

SEQ ID NO: 5933559 - DNA, 13 bp, Homo sapiens
taatggacacttt

SEQ ID NO: 5933560 - DNA, 23 bp, Homo sapiens
taatggactcagctctgtctgct

SEQ ID NO: 5933561 - DNA, 20 bp, Homo sapiens
taatggagaacaagttgtta

SEQ ID NO: 5933562 - DNA, 13 bp, Homo sapiens
taatggagaagac

SEQ ID NO: 5933563 - DNA, 14 bp, Homo sapiens
taatggagaatcac

SEQ ID NO: 5933564 - DNA, 17 bp, Homo sapiens
taatggagaatcacttt

SEQ ID NO: 5933565 - DNA, 17 bp, Homo sapiens
taatggagcatcaagcc

SEQ ID NO: 5933566 - DNA, 12 bp, Homo sapiens
taatggaggcca

SEQ ID NO: 5933567 - DNA, 14 bp, Homo sapiens
taatggaggccaag

SEQ ID NO: 5933568 - DNA, 15 bp, Homo sapiens
taatggaggtcccag

SEQ ID NO: 5933569 - DNA, 17 bp, Homo sapiens
taatggaggtcccagcc

SEQ ID NO: 5933570 - DNA, 15 bp, Homo sapiens
taatgttaattcagc

SEQ ID NO: 5933571 - DNA, 17 bp, Homo sapiens
taatgttacatagtaaa

SEQ ID NO: 5933572 - DNA, 22 bp, Homo sapiens
taatgttagaattgatttccaa

SEQ ID NO: 5933573 - DNA, 13 bp, Homo sapiens
taatgttatttgg

SEQ ID NO: 5933574 - DNA, 17 bp, Homo sapiens
taatgttcatattttca

SEQ ID NO: 5933575 - DNA, 13 bp, Homo sapiens
taatgttcatttt

SEQ ID NO: 5933576 - DNA, 16 bp, Homo sapiens
taatgttcattttctc

SEQ ID NO: 5933577 - DNA, 13 bp, Homo sapiens
taatgttccagtt

SEQ ID NO: 5933578 - DNA, 19 bp, Homo sapiens
taatgttctaaattctata

SEQ ID NO: 5933579 - DNA, 18 bp, Homo sapiens
taatgttctatataattt

SEQ ID NO: 5933580 - DNA, 17 bp, Homo sapiens
taatgttgaaaaagaaa

SEQ ID NO: 5933581 - DNA, 16 bp, Homo sapiens
taatgttgaacaaaat

SEQ ID NO: 5933582 - DNA, 18 bp, Homo sapiens
taatgttgaacaaaataa

SEQ ID NO: 5933583 - DNA, 14 bp, Homo sapiens
taatgttgaatgta

SEQ ID NO: 5933584 - DNA, 19 bp, Homo sapiens
taatgttgaatgtattttg

SEQ ID NO: 5933585 - DNA, 21 bp, Homo sapiens
taatgttgatcagcaaattta

SEQ ID NO: 5933586 - DNA, 13 bp, Homo sapiens
taatgttgatttc

SEQ ID NO: 5933587 - DNA, 17 bp, Homo sapiens
taatgttgatttctagt

SEQ ID NO: 5933588 - DNA, 18 bp, Homo sapiens
taatgttgatttctagtt

SEQ ID NO: 5933589 - DNA, 16 bp, Homo sapiens
taatgttggtgtggag

SEQ ID NO: 5933590 - DNA, 17 bp, Homo sapiens
taatgttggtgtggagt

SEQ ID NO: 5933591 - DNA, 21 bp, Homo sapiens
taatgttgtatgtcttgttta

SEQ ID NO: 5933592 - DNA, 13 bp, Homo sapiens
taatgttgtgaat

SEQ ID NO: 5933593 - DNA, 16 bp, Homo sapiens
taatgttgtgaataat

SEQ ID NO: 5933594 - DNA, 19 bp, Homo sapiens
taatgttgtgaataattac

SEQ ID NO: 5933595 - DNA, 21 bp, Homo sapiens
taatgttgtgaataattacag

SEQ ID NO: 5933596 - DNA, 12 bp, Homo sapiens
taatgtttaaat

SEQ ID NO: 5933597 - DNA, 19 bp, Homo sapiens
taatgtttaaatcatgtat

SEQ ID NO: 5933598 - DNA, 14 bp, Homo sapiens
taatgtttactata

SEQ ID NO: 5933599 - DNA, 16 bp, Homo sapiens
taatgtttatacagag

SEQ ID NO: 5933600 - DNA, 15 bp, Homo sapiens
taatgtttatgagcc

SEQ ID NO: 5933601 - DNA, 16 bp, Homo sapiens
taatgtttatgagcca

SEQ ID NO: 5933602 - DNA, 18 bp, Homo sapiens
taatgtttatgagccaga

SEQ ID NO: 5933603 - DNA, 22 bp, Homo sapiens
taatgtttatgagccagacaaa

SEQ ID NO: 5933604 - DNA, 22 bp, Homo sapiens
taatgtttattaaatgcttcat

SEQ ID NO: 5933605 - DNA, 12 bp, Homo sapiens
taatgtttctga

SEQ ID NO: 5933606 - DNA, 15 bp, Homo sapiens
taatgtttgatttag

SEQ ID NO: 5933607 - DNA, 17 bp, Homo sapiens
taatgtttgatttagta

SEQ ID NO: 5933608 - DNA, 15 bp, Homo sapiens
taatgttttaactct

SEQ ID NO: 5933609 - DNA, 14 bp, Homo sapiens
taatgttttcaaaa

SEQ ID NO: 5933610 - DNA, 15 bp, Homo sapiens
taatgttttcattat

SEQ ID NO: 5933611 - DNA, 12 bp, Homo sapiens
taatgttttctg

SEQ ID NO: 5933612 - DNA, 13 bp, Homo sapiens
taatgttttcttt

SEQ ID NO: 5933613 - DNA, 19 bp, Homo sapiens
taatgttttctttgcaaag

SEQ ID NO: 5933614 - DNA, 21 bp, Homo sapiens
taatgttttctttgcaaagta

SEQ ID NO: 5933615 - DNA, 14 bp, Homo sapiens
taatgttttgtaca

SEQ ID NO: 5933616 - DNA, 15 bp, Homo sapiens
taatgttttgtacaa

SEQ ID NO: 5933617 - DNA, 14 bp, Homo sapiens
taatgttttgtata

SEQ ID NO: 5933618 - DNA, 16 bp, Homo sapiens
taatgtttttaaatat

SEQ ID NO: 5933619 - DNA, 15 bp, Homo sapiens
taatgttttttgaag

SEQ ID NO: 5933620 - DNA, 21 bp, Homo sapiens
taatgttttttgaagttctgg

SEQ ID NO: 5933621 - DNA, 22 bp, Homo sapiens
taatgttttttgccacagcttt

SEQ ID NO: 5933622 - DNA, 14 bp, Homo sapiens
taattaaaaaatag

SEQ ID NO: 5933623 - DNA, 18 bp, Homo sapiens
taattaaaaacagaaaat

SEQ ID NO: 5933624 - DNA, 22 bp, Homo sapiens
taattaaaaactagtagttctc

SEQ ID NO: 5933625 - DNA, 14 bp, Homo sapiens
taattaaaaactgt

SEQ ID NO: 5933626 - DNA, 15 bp, Homo sapiens
taattaaaaactgtg

SEQ ID NO: 5933627 - DNA, 19 bp, Homo sapiens
taattaaaaactttaaaga

SEQ ID NO: 5933628 - DNA, 22 bp, Homo sapiens
taattaaaaagaattcttccac

SEQ ID NO: 5933629 - DNA, 15 bp, Homo sapiens
taattaaaaagttaa

SEQ ID NO: 5933630 - DNA, 14 bp, Homo sapiens
taattaaaatctgg

SEQ ID NO: 5933631 - DNA, 18 bp, Homo sapiens
taattaaaatctggaaat

SEQ ID NO: 5933632 - DNA, 14 bp, Homo sapiens
taattaaaatgtgc

SEQ ID NO: 5933633 - DNA, 21 bp, Homo sapiens
taattaaaattggtaaaaata

SEQ ID NO: 5933634 - DNA, 18 bp, Homo sapiens
taattaaaattgtgcata

SEQ ID NO: 5933635 - DNA, 16 bp, Homo sapiens
taattaaaatttatct

SEQ ID NO: 5933636 - DNA, 17 bp, Homo sapiens
taattaaaatttatctt

SEQ ID NO: 5933637 - DNA, 18 bp, Homo sapiens
taattaaaatttatctta

SEQ ID NO: 5933638 - DNA, 21 bp, Homo sapiens
taattaaacaaattccttccc

SEQ ID NO: 5933639 - DNA, 15 bp, Homo sapiens
taattaaactgttaa

SEQ ID NO: 5933640 - DNA, 19 bp, Homo sapiens
taattaaagaaaattgcca

SEQ ID NO: 5933641 - DNA, 23 bp, Homo sapiens
taattaaagaaaattgccaaaat

SEQ ID NO: 5933642 - DNA, 14 bp, Homo sapiens
taattaaagcacac

SEQ ID NO: 5933643 - DNA, 18 bp, Homo sapiens
taattaaagcacactttt

SEQ ID NO: 5933644 - DNA, 22 bp, Homo sapiens
taattaaataaatcattaatac

SEQ ID NO: 5933645 - DNA, 15 bp, Homo sapiens
taattaaataataca

SEQ ID NO: 5933646 - DNA, 16 bp, Homo sapiens
taattaaatatatcac

SEQ ID NO: 5933647 - DNA, 16 bp, Homo sapiens
taattaaatatttctt

SEQ ID NO: 5933648 - DNA, 13 bp, Homo sapiens
taattaaatgtat

SEQ ID NO: 5933649 - DNA, 15 bp, Homo sapiens
taattaaatttaact

SEQ ID NO: 5933650 - DNA, 23 bp, Homo sapiens
taattaaattttgagttctacat

SEQ ID NO: 5933651 - DNA, 20 bp, Homo sapiens
taattaacatataatatatg

SEQ ID NO: 5933652 - DNA, 13 bp, Homo sapiens
taattaacatcaa

SEQ ID NO: 5933653 - DNA, 17 bp, Homo sapiens
taattaacatgttaaac

SEQ ID NO: 5933654 - DNA, 19 bp, Homo sapiens
taattaaccttactaatta

SEQ ID NO: 5933655 - DNA, 16 bp, Homo sapiens
taattaactgtaaact

SEQ ID NO: 5933656 - DNA, 17 bp, Homo sapiens
taattaacttaactgaa

SEQ ID NO: 5933657 - DNA, 21 bp, Homo sapiens
taattaacttaactgaagaaa

SEQ ID NO: 5933658 - DNA, 16 bp, Homo sapiens
taattaagaaaactat

SEQ ID NO: 5933659 - DNA, 19 bp, Homo sapiens
taattaagcagaaacagca

SEQ ID NO: 5933660 - DNA, 16 bp, Homo sapiens
taattaaggtacatca

SEQ ID NO: 5933661 - DNA, 20 bp, Homo sapiens
taattaaggtacatcattat

SEQ ID NO: 5933662 - DNA, 17 bp, Homo sapiens
taattaagtaaactaat

SEQ ID NO: 5933663 - DNA, 17 bp, Homo sapiens
taattaagtactatgta

SEQ ID NO: 5933664 - DNA, 20 bp, Homo sapiens
taattaagtactatgtatca

SEQ ID NO: 5933665 - DNA, 14 bp, Homo sapiens
taattaataaagaa

SEQ ID NO: 5933666 - DNA, 19 bp, Homo sapiens
taattaataaagaaaaaga

SEQ ID NO: 5933667 - DNA, 14 bp, Homo sapiens
taattaataacttt

SEQ ID NO: 5933668 - DNA, 15 bp, Homo sapiens
taattaataactttc

SEQ ID NO: 5933669 - DNA, 19 bp, Homo sapiens
taattaataatatgtacta

SEQ ID NO: 5933670 - DNA, 20 bp, Homo sapiens
taattaataatatgtactaa

SEQ ID NO: 5933671 - DNA, 16 bp, Homo sapiens
taattaatatgttcat

SEQ ID NO: 5933672 - DNA, 21 bp, Homo sapiens
taattaatcatgaatgtgtaa

SEQ ID NO: 5933673 - DNA, 15 bp, Homo sapiens
taattaatcctttaa

SEQ ID NO: 5933674 - DNA, 19 bp, Homo sapiens
taattaatcgaaatgaatt

SEQ ID NO: 5933675 - DNA, 22 bp, Homo sapiens
taattaatcgaaatgaatttat

SEQ ID NO: 5933676 - DNA, 17 bp, Homo sapiens
taattaatgaaatatct

SEQ ID NO: 5933677 - DNA, 13 bp, Homo sapiens
taattaatggctt

SEQ ID NO: 5933678 - DNA, 15 bp, Homo sapiens
taattaatgtacaca

SEQ ID NO: 5933679 - DNA, 14 bp, Homo sapiens
taattaatgtgtgt

SEQ ID NO: 5933680 - DNA, 13 bp, Homo sapiens
taattaattaaag

SEQ ID NO: 5933681 - DNA, 21 bp, Homo sapiens
taattaattgggccagctttt

SEQ ID NO: 5933682 - DNA, 13 bp, Homo sapiens
taattaatttcag

SEQ ID NO: 5933683 - DNA, 14 bp, Homo sapiens
taattaatttcagt

SEQ ID NO: 5933684 - DNA, 21 bp, Homo sapiens
taattaatttgattaacaaat

SEQ ID NO: 5933685 - DNA, 22 bp, Homo sapiens
taattaatttgattaacaaata

SEQ ID NO: 5933686 - DNA, 15 bp, Homo sapiens
taattaatttggagc

SEQ ID NO: 5933687 - DNA, 18 bp, Homo sapiens
taattacaaacaataaga

SEQ ID NO: 5933688 - DNA, 22 bp, Homo sapiens
taattacaaacaataagaacaa

SEQ ID NO: 5933689 - DNA, 15 bp, Homo sapiens
taattacagaagagt

SEQ ID NO: 5933690 - DNA, 23 bp, Homo sapiens
taattacagaatatacttagaaa

SEQ ID NO: 5933691 - DNA, 18 bp, Homo sapiens
taattacattaaaatgga

SEQ ID NO: 5933692 - DNA, 14 bp, Homo sapiens
taattacattccta

SEQ ID NO: 5933693 - DNA, 16 bp, Homo sapiens
taattacattcctaac

SEQ ID NO: 5933694 - DNA, 21 bp, Homo sapiens
taattacattcctaactagaa

SEQ ID NO: 5933695 - DNA, 17 bp, Homo sapiens
taattaccaacctgtta

SEQ ID NO: 5933696 - DNA, 15 bp, Homo sapiens
taattaccagttttc

SEQ ID NO: 5933697 - DNA, 16 bp, Homo sapiens
taattacctactctgg

SEQ ID NO: 5933698 - DNA, 17 bp, Homo sapiens
taattactgccttgaaa

SEQ ID NO: 5933699 - DNA, 21 bp, Homo sapiens
taattactgctataaataggt

SEQ ID NO: 5933700 - DNA, 13 bp, Homo sapiens
taattactggaat

SEQ ID NO: 5933701 - DNA, 17 bp, Homo sapiens
taattactgttttcttt

SEQ ID NO: 5933702 - DNA, 19 bp, Homo sapiens
taattactgttttcttttt

SEQ ID NO: 5933703 - DNA, 22 bp, Homo sapiens
taattactgttttcttttttct

SEQ ID NO: 5933704 - DNA, 13 bp, Homo sapiens
taattacttaaaa

SEQ ID NO: 5933705 - DNA, 20 bp, Homo sapiens
taattactttcagaatgttg

SEQ ID NO: 5933706 - DNA, 22 bp, Homo sapiens
taattacttttgaaccatgtat

SEQ ID NO: 5933707 - DNA, 17 bp, Homo sapiens
taattagaaaatatagt

SEQ ID NO: 5933708 - DNA, 15 bp, Homo sapiens
taattagaaacgtga

SEQ ID NO: 5933709 - DNA, 21 bp, Homo sapiens
taattagaaacgtgataaata

SEQ ID NO: 5933710 - DNA, 15 bp, Homo sapiens
taattagaaatcaac

SEQ ID NO: 5933711 - DNA, 14 bp, Homo sapiens
taattagaacaata

SEQ ID NO: 5933712 - DNA, 20 bp, Homo sapiens
taattagaacaatagctatt

SEQ ID NO: 5933713 - DNA, 23 bp, Homo sapiens
taattagagattgacttcagaaa

SEQ ID NO: 5933714 - DNA, 22 bp, Homo sapiens
taattagagcagatgacccctc

SEQ ID NO: 5933715 - DNA, 21 bp, Homo sapiens
taattagagttgtgatacaga

SEQ ID NO: 5933716 - DNA, 23 bp, Homo sapiens
taattagagttgtgatacagagt

SEQ ID NO: 5933717 - DNA, 14 bp, Homo sapiens
taattagatccatt

SEQ ID NO: 5933718 - DNA, 20 bp, Homo sapiens
taattagatccattaattta

SEQ ID NO: 5933719 - DNA, 19 bp, Homo sapiens
taattagattttcttgcag

SEQ ID NO: 5933720 - DNA, 21 bp, Homo sapiens
taattagcagtttagaatgga

SEQ ID NO: 5933721 - DNA, 13 bp, Homo sapiens
taattagctctgg

SEQ ID NO: 5933722 - DNA, 14 bp, Homo sapiens
taattagctctggg

SEQ ID NO: 5933723 - DNA, 18 bp, Homo sapiens
taattaggaattacttta

SEQ ID NO: 5933724 - DNA, 19 bp, Homo sapiens
taattaggaattactttat

SEQ ID NO: 5933725 - DNA, 21 bp, Homo sapiens
taattaggaattactttatta

SEQ ID NO: 5933726 - DNA, 20 bp, Homo sapiens
taattaggataactaaaatt

SEQ ID NO: 5933727 - DNA, 16 bp, Homo sapiens
taattaggatctatgc

SEQ ID NO: 5933728 - DNA, 17 bp, Homo sapiens
taattaggcaaggctat

SEQ ID NO: 5933729 - DNA, 22 bp, Homo sapiens
taattaggcaaggctatgtgat

SEQ ID NO: 5933730 - DNA, 22 bp, Homo sapiens
taattaggcagcctgctataaa

SEQ ID NO: 5933731 - DNA, 18 bp, Homo sapiens
taattaggggttgctaag

SEQ ID NO: 5933732 - DNA, 15 bp, Homo sapiens
taattagggtacatt

SEQ ID NO: 5933733 - DNA, 19 bp, Homo sapiens
taattagggtacatttata

SEQ ID NO: 5933734 - DNA, 16 bp, Homo sapiens
taattaggttaacatt

SEQ ID NO: 5933735 - DNA, 13 bp, Homo sapiens
taattagtaataa

SEQ ID NO: 5933736 - DNA, 21 bp, Homo sapiens
taattagtgccacttaatgta

SEQ ID NO: 5933737 - DNA, 20 bp, Homo sapiens
taattagtgctaagtgtgaa

SEQ ID NO: 5933738 - DNA, 24 bp, Homo sapiens
taattagttccagtttctccttga

SEQ ID NO: 5933739 - DNA, 15 bp, Homo sapiens
taattataaacagca

SEQ ID NO: 5933740 - DNA, 18 bp, Homo sapiens
taattataaacagcaggg

SEQ ID NO: 5933741 - DNA, 14 bp, Homo sapiens
taattataatgcaa

SEQ ID NO: 5933742 - DNA, 16 bp, Homo sapiens
taattataatgcaaat

SEQ ID NO: 5933743 - DNA, 23 bp, Homo sapiens
taattataccgctatcattccaa

SEQ ID NO: 5933744 - DNA, 14 bp, Homo sapiens
taattatatatact

SEQ ID NO: 5933745 - DNA, 21 bp, Homo sapiens
taattatatattttgttgttc

SEQ ID NO: 5933746 - DNA, 18 bp, Homo sapiens
taattatatgctatttct

SEQ ID NO: 5933747 - DNA, 16 bp, Homo sapiens
taattatatgttgtaa

SEQ ID NO: 5933748 - DNA, 22 bp, Homo sapiens
taattgcattcatcttgtgttt

SEQ ID NO: 5933749 - DNA, 20 bp, Homo sapiens
taattgcatttaaaaatata

SEQ ID NO: 5933750 - DNA, 17 bp, Homo sapiens
taattgcatttctgctc

SEQ ID NO: 5933751 - DNA, 17 bp, Homo sapiens
taattgcatttgctttt

SEQ ID NO: 5933752 - DNA, 18 bp, Homo sapiens
taattgccagcaaataaa

SEQ ID NO: 5933753 - DNA, 20 bp, Homo sapiens
taattgcctacaataaaaag

SEQ ID NO: 5933754 - DNA, 22 bp, Homo sapiens
taattgcctacaataaaaagaa

SEQ ID NO: 5933755 - DNA, 17 bp, Homo sapiens
taattgcctagaaatat

SEQ ID NO: 5933756 - DNA, 21 bp, Homo sapiens
taattgcgtagaggctacagg

SEQ ID NO: 5933757 - DNA, 17 bp, Homo sapiens
taattgctgttgaaagc

SEQ ID NO: 5933758 - DNA, 21 bp, Homo sapiens
taattgctgttgaaagcaaaa

SEQ ID NO: 5933759 - DNA, 15 bp, Homo sapiens
taattgcttacattt

SEQ ID NO: 5933760 - DNA, 21 bp, Homo sapiens
taattgcttacatttttacaa

SEQ ID NO: 5933761 - DNA, 20 bp, Homo sapiens
taattgctttaaatcttaag

SEQ ID NO: 5933762 - DNA, 15 bp, Homo sapiens
taattggaattctgg

SEQ ID NO: 5933763 - DNA, 19 bp, Homo sapiens
taattggagtgcagctaac

SEQ ID NO: 5933764 - DNA, 14 bp, Homo sapiens
taattggcagcaga

SEQ ID NO: 5933765 - DNA, 15 bp, Homo sapiens
taattggcagcagat

SEQ ID NO: 5933766 - DNA, 21 bp, Homo sapiens
taattggcccaagtcattgtt

SEQ ID NO: 5933767 - DNA, 17 bp, Homo sapiens
taattggctttgcagat

SEQ ID NO: 5933768 - DNA, 18 bp, Homo sapiens
taattgggaactgaaatc

SEQ ID NO: 5933769 - DNA, 24 bp, Homo sapiens
taattgggaactgaaatccttgag

SEQ ID NO: 5933770 - DNA, 12 bp, Homo sapiens
taattgggattt

SEQ ID NO: 5933771 - DNA, 20 bp, Homo sapiens
taattgggcactatttattt

SEQ ID NO: 5933772 - DNA, 18 bp, Homo sapiens
taattgggccagcttttc

SEQ ID NO: 5933773 - DNA, 23 bp, Homo sapiens
taattggtacttttaaaaacata

SEQ ID NO: 5933774 - DNA, 18 bp, Homo sapiens
taattggtccgatctttg

SEQ ID NO: 5933775 - DNA, 17 bp, Homo sapiens
taattggtgacaatgtc

SEQ ID NO: 5933776 - DNA, 16 bp, Homo sapiens
taattggtgctatttg

SEQ ID NO: 5933777 - DNA, 18 bp, Homo sapiens
taattggtgctatttgaa

SEQ ID NO: 5933778 - DNA, 21 bp, Homo sapiens
taattggtgctatttgaagaa

SEQ ID NO: 5933779 - DNA, 22 bp, Homo sapiens
taattggtgctatttgaagaaa

SEQ ID NO: 5933780 - DNA, 17 bp, Homo sapiens
taattggtttagttctt

SEQ ID NO: 5933781 - DNA, 14 bp, Homo sapiens
taattgtaaactgt

SEQ ID NO: 5933782 - DNA, 15 bp, Homo sapiens
taattgtaattccaa

SEQ ID NO: 5933783 - DNA, 20 bp, Homo sapiens
taattgtaattccaaaatcc

SEQ ID NO: 5933784 - DNA, 15 bp, Homo sapiens
taattgtaattgtct

SEQ ID NO: 5933785 - DNA, 11 bp, Homo sapiens
taattgtacaa

SEQ ID NO: 5933786 - DNA, 15 bp, Homo sapiens
taattgtacaaaatt

SEQ ID NO: 5933787 - DNA, 18 bp, Homo sapiens
taattgtactaaagccaa

SEQ ID NO: 5933788 - DNA, 20 bp, Homo sapiens
taattgtactgtgtttttaa

SEQ ID NO: 5933789 - DNA, 14 bp, Homo sapiens
taattgtactttga

SEQ ID NO: 5933790 - DNA, 16 bp, Homo sapiens
taattgtactttgaaa

SEQ ID NO: 5933791 - DNA, 21 bp, Homo sapiens
taattgtaggtcaatgaaata

SEQ ID NO: 5933792 - DNA, 17 bp, Homo sapiens
taattgtagttctgtgt

SEQ ID NO: 5933793 - DNA, 12 bp, Homo sapiens
taattgtataag

SEQ ID NO: 5933794 - DNA, 13 bp, Homo sapiens
taattgtataagt

SEQ ID NO: 5933795 - DNA, 23 bp, Homo sapiens
taattgtataagtcaagcacatg

SEQ ID NO: 5933796 - DNA, 24 bp, Homo sapiens
taattgtataagtcaagcacatgt

SEQ ID NO: 5933797 - DNA, 20 bp, Homo sapiens
taattgtatcgtatagctgt

SEQ ID NO: 5933798 - DNA, 23 bp, Homo sapiens
taattgtatcgtatagctgtatt

SEQ ID NO: 5933799 - DNA, 12 bp, Homo sapiens
taattgtatttt

SEQ ID NO: 5933800 - DNA, 19 bp, Homo sapiens
taattgtcaaaaaccagaa

SEQ ID NO: 5933801 - DNA, 16 bp, Homo sapiens
taattgtcatgacttt

SEQ ID NO: 5933802 - DNA, 16 bp, Homo sapiens
taattgtgaacagcca

SEQ ID NO: 5933803 - DNA, 20 bp, Homo sapiens
taattgtgaccaatacattt

SEQ ID NO: 5933804 - DNA, 22 bp, Homo sapiens
taattgtgaccaatacatttgt

SEQ ID NO: 5933805 - DNA, 14 bp, Homo sapiens
taattgtgagttaa

SEQ ID NO: 5933806 - DNA, 16 bp, Homo sapiens
taattgtgagttaatt

SEQ ID NO: 5933807 - DNA, 18 bp, Homo sapiens
taattgtgatatttgaca

SEQ ID NO: 5933808 - DNA, 22 bp, Homo sapiens
taattgtgattagacagaacac

SEQ ID NO: 5933809 - DNA, 14 bp, Homo sapiens
taattgtgccccta

SEQ ID NO: 5933810 - DNA, 13 bp, Homo sapiens
taattgtgtaaaa

SEQ ID NO: 5933811 - DNA, 19 bp, Homo sapiens
taattgtgtaaaaaatgga

SEQ ID NO: 5933812 - DNA, 21 bp, Homo sapiens
taattgtgtaaaaaatggaaa

SEQ ID NO: 5933813 - DNA, 14 bp, Homo sapiens
taattgtgtacaaa

SEQ ID NO: 5933814 - DNA, 23 bp, Homo sapiens
taattgtgtatatgttggtttaa

SEQ ID NO: 5933815 - DNA, 16 bp, Homo sapiens
taattgtgtcccctct

SEQ ID NO: 5933816 - DNA, 22 bp, Homo sapiens
taattgtgtgaacttggaagca

SEQ ID NO: 5933817 - DNA, 15 bp, Homo sapiens
taattgtgtgatatt

SEQ ID NO: 5933818 - DNA, 19 bp, Homo sapiens
taattgtgtgatatttcag

SEQ ID NO: 5933819 - DNA, 14 bp, Homo sapiens
taattgtgtggatt

SEQ ID NO: 5933820 - DNA, 20 bp, Homo sapiens
taattgtgtggattctttaa

SEQ ID NO: 5933821 - DNA, 13 bp, Homo sapiens
taattgtgtttat

SEQ ID NO: 5933822 - DNA, 18 bp, Homo sapiens
taattgtgtttatttttt

SEQ ID NO: 5933823 - DNA, 22 bp, Homo sapiens
taattgttcattttgagctgaa

SEQ ID NO: 5933824 - DNA, 12 bp, Homo sapiens
taattgttccag

SEQ ID NO: 5933825 - DNA, 14 bp, Homo sapiens
taattgttcctttt

SEQ ID NO: 5933826 - DNA, 17 bp, Homo sapiens
taattgttctcagaatc

SEQ ID NO: 5933827 - DNA, 20 bp, Homo sapiens
taattgttgaacaggtgttt

SEQ ID NO: 5933828 - DNA, 16 bp, Homo sapiens
taattgttgatatttt

SEQ ID NO: 5933829 - DNA, 17 bp, Homo sapiens
taattgttgttctgtta

SEQ ID NO: 5933830 - DNA, 21 bp, Homo sapiens
taattgttgttctgttaactg

SEQ ID NO: 5933831 - DNA, 15 bp, Homo sapiens
taattgttgtttctt

SEQ ID NO: 5933832 - DNA, 13 bp, Homo sapiens
taattgtttataa

SEQ ID NO: 5933833 - DNA, 12 bp, Homo sapiens
taattgtttcca

SEQ ID NO: 5933834 - DNA, 20 bp, Homo sapiens
taattgtttccaacttgtct

SEQ ID NO: 5933835 - DNA, 21 bp, Homo sapiens
taattgtttccaacttgtctg

SEQ ID NO: 5933836 - DNA, 13 bp, Homo sapiens
taattgttttatt

SEQ ID NO: 5933837 - DNA, 14 bp, Homo sapiens
taattgttttttaa

SEQ ID NO: 5933838 - DNA, 17 bp, Homo sapiens
taattgttttttaaagc

SEQ ID NO: 5933839 - DNA, 18 bp, Homo sapiens
taattgttttttaaagca

SEQ ID NO: 5933840 - DNA, 21 bp, Homo sapiens
taattgttttttatcttttct

SEQ ID NO: 5933841 - DNA, 15 bp, Homo sapiens
taatttaaaaaataa

SEQ ID NO: 5933842 - DNA, 17 bp, Homo sapiens
taatttaaacacctcct

SEQ ID NO: 5933843 - DNA, 14 bp, Homo sapiens
taatttaaacaggc

SEQ ID NO: 5933844 - DNA, 18 bp, Homo sapiens
taatttaaaccagcagaa

SEQ ID NO: 5933845 - DNA, 16 bp, Homo sapiens
taatttaaactgtgtt

SEQ ID NO: 5933846 - DNA, 17 bp, Homo sapiens
taatttaaagaaacact

SEQ ID NO: 5933847 - DNA, 19 bp, Homo sapiens
taatttaaagctgtttcta

SEQ ID NO: 5933848 - DNA, 11 bp, Homo sapiens
taatttaaagt

SEQ ID NO: 5933849 - DNA, 15 bp, Homo sapiens
taatttaaatagcat

SEQ ID NO: 5933850 - DNA, 13 bp, Homo sapiens
taatttaaatgaa

SEQ ID NO: 5933851 - DNA, 18 bp, Homo sapiens
taatttaaatgatttaaa

SEQ ID NO: 5933852 - DNA, 19 bp, Homo sapiens
taatttaacaaactaaaaa

SEQ ID NO: 5933853 - DNA, 19 bp, Homo sapiens
taatttaacaccctttaga

SEQ ID NO: 5933854 - DNA, 21 bp, Homo sapiens
taatttaacagaagttgtgaa

SEQ ID NO: 5933855 - DNA, 23 bp, Homo sapiens
taatttaacagaagttgtgaaac

SEQ ID NO: 5933856 - DNA, 16 bp, Homo sapiens
taatttaactaattta

SEQ ID NO: 5933857 - DNA, 19 bp, Homo sapiens
taatttaacttattgctag

SEQ ID NO: 5933858 - DNA, 23 bp, Homo sapiens
taatttaaggtctgtttgctgtt

SEQ ID NO: 5933859 - DNA, 21 bp, Homo sapiens
taatttaagtgacacagacat

SEQ ID NO: 5933860 - DNA, 20 bp, Homo sapiens
taatttaatattcctggcat

SEQ ID NO: 5933861 - DNA, 14 bp, Homo sapiens
taatttaatgaaaa

SEQ ID NO: 5933862 - DNA, 11 bp, Homo sapiens
taatttaatgg

SEQ ID NO: 5933863 - DNA, 16 bp, Homo sapiens
taatttaatgtaaata

SEQ ID NO: 5933864 - DNA, 21 bp, Homo sapiens
taatttaatgtaaataaaaca

SEQ ID NO: 5933865 - DNA, 14 bp, Homo sapiens
taatttaatgtatt

SEQ ID NO: 5933866 - DNA, 21 bp, Homo sapiens
taatttaattccccttccctt

SEQ ID NO: 5933867 - DNA, 16 bp, Homo sapiens
taatttacaagatatt

SEQ ID NO: 5933868 - DNA, 21 bp, Homo sapiens
taatttacctctcattagaaa

SEQ ID NO: 5933869 - DNA, 15 bp, Homo sapiens
taatttactgattcc

SEQ ID NO: 5933870 - DNA, 20 bp, Homo sapiens
taatttactggacaaagaat

SEQ ID NO: 5933871 - DNA, 22 bp, Homo sapiens
taatttacttaagtgttcattt

SEQ ID NO: 5933872 - DNA, 15 bp, Homo sapiens
taatttagaaaactt

SEQ ID NO: 5933873 - DNA, 17 bp, Homo sapiens
taatttagaaaacttta

SEQ ID NO: 5933874 - DNA, 17 bp, Homo sapiens
taatttagaaactgaaa

SEQ ID NO: 5933875 - DNA, 18 bp, Homo sapiens
taatttagaaactgaaaa

SEQ ID NO: 5933876 - DNA, 13 bp, Homo sapiens
taatttagaaata

SEQ ID NO: 5933877 - DNA, 14 bp, Homo sapiens
taatttagaaataa

SEQ ID NO: 5933878 - DNA, 14 bp, Homo sapiens
taatttagaatggt

SEQ ID NO: 5933879 - DNA, 22 bp, Homo sapiens
taatttagagataggaaactga

SEQ ID NO: 5933880 - DNA, 22 bp, Homo sapiens
taatttagcagtccatttttga

SEQ ID NO: 5933881 - DNA, 20 bp, Homo sapiens
taatttaggagttttgagaa

SEQ ID NO: 5933882 - DNA, 18 bp, Homo sapiens
taatttagggtactaaat

SEQ ID NO: 5933883 - DNA, 17 bp, Homo sapiens
taatttagtaaatgtta

SEQ ID NO: 5933884 - DNA, 20 bp, Homo sapiens
taatttagtaaatgttatct

SEQ ID NO: 5933885 - DNA, 16 bp, Homo sapiens
taatttagtgatctta

SEQ ID NO: 5933886 - DNA, 16 bp, Homo sapiens
taatttagtggattaa

SEQ ID NO: 5933887 - DNA, 14 bp, Homo sapiens
taatttagtgtata

SEQ ID NO: 5933888 - DNA, 15 bp, Homo sapiens
taatttagttattga

SEQ ID NO: 5933889 - DNA, 16 bp, Homo sapiens
taatttagttattgat

SEQ ID NO: 5933890 - DNA, 17 bp, Homo sapiens
taatttagttgtttcta

SEQ ID NO: 5933891 - DNA, 21 bp, Homo sapiens
taatttataaaagaataaaat

SEQ ID NO: 5933892 - DNA, 20 bp, Homo sapiens
taatttataagcattgccat

SEQ ID NO: 5933893 - DNA, 15 bp, Homo sapiens
taatttataatccac

SEQ ID NO: 5933894 - DNA, 20 bp, Homo sapiens
taatttataatgtatttgaa

SEQ ID NO: 5933895 - DNA, 21 bp, Homo sapiens
taatttataatgtatttgaaa

SEQ ID NO: 5933896 - DNA, 16 bp, Homo sapiens
taatttatacaaaata

SEQ ID NO: 5933897 - DNA, 17 bp, Homo sapiens
taatttatacaaaataa

SEQ ID NO: 5933898 - DNA, 16 bp, Homo sapiens
taatttatacaggtca

SEQ ID NO: 5933899 - DNA, 19 bp, Homo sapiens
taatttatactggcatgct

SEQ ID NO: 5933900 - DNA, 13 bp, Homo sapiens
taatttatacttt

SEQ ID NO: 5933901 - DNA, 20 bp, Homo sapiens
taatttatactttaaagtat

SEQ ID NO: 5933902 - DNA, 21 bp, Homo sapiens
taatttatagcaagatattga

SEQ ID NO: 5933903 - DNA, 20 bp, Homo sapiens
taatttataggcagatcttt

SEQ ID NO: 5933904 - DNA, 22 bp, Homo sapiens
taatttatagtaatgagtttaa

SEQ ID NO: 5933905 - DNA, 18 bp, Homo sapiens
taatttatagtttataca

SEQ ID NO: 5933906 - DNA, 14 bp, Homo sapiens
taatttatatctaa

SEQ ID NO: 5933907 - DNA, 15 bp, Homo sapiens
taatttatatgcatg

SEQ ID NO: 5933908 - DNA, 16 bp, Homo sapiens
taatttatattccatt

SEQ ID NO: 5933909 - DNA, 17 bp, Homo sapiens
taatttatatttgtctc

SEQ ID NO: 5933910 - DNA, 14 bp, Homo sapiens
taatttatcaaaaa

SEQ ID NO: 5933911 - DNA, 19 bp, Homo sapiens
taatttatcaaaaaacaag

SEQ ID NO: 5933912 - DNA, 20 bp, Homo sapiens
taatttatctaaattaaagc

SEQ ID NO: 5933913 - DNA, 21 bp, Homo sapiens
taatttatctaaattaaagcc

SEQ ID NO: 5933914 - DNA, 23 bp, Homo sapiens
taatttatcttgtctctgggctt

SEQ ID NO: 5933915 - DNA, 16 bp, Homo sapiens
taatttatgaagatag

SEQ ID NO: 5933916 - DNA, 20 bp, Homo sapiens
taatttatgagtttttgata

SEQ ID NO: 5933917 - DNA, 14 bp, Homo sapiens
taatttatgcagaa

SEQ ID NO: 5933918 - DNA, 17 bp, Homo sapiens
taatttatgtgaaagag

SEQ ID NO: 5933919 - DNA, 16 bp, Homo sapiens
taatttattaaattta

SEQ ID NO: 5933920 - DNA, 20 bp, Homo sapiens
taatttattaaatttattaa

SEQ ID NO: 5933921 - DNA, 13 bp, Homo sapiens
taatttattaatc

SEQ ID NO: 5933922 - DNA, 14 bp, Homo sapiens
taatttattattaa

SEQ ID NO: 5933923 - DNA, 18 bp, Homo sapiens
taatttattattgaaatt

SEQ ID NO: 5933924 - DNA, 11 bp, Homo sapiens
taatttattct

SEQ ID NO: 5933925 - DNA, 13 bp, Homo sapiens
tacaaatatattg

SEQ ID NO: 5933926 - DNA, 14 bp, Homo sapiens
tacaaatatattgt

SEQ ID NO: 5933927 - DNA, 19 bp, Homo sapiens
tacaaatatatttaattgt

SEQ ID NO: 5933928 - DNA, 18 bp, Homo sapiens
tacaaatattaagaaaat

SEQ ID NO: 5933929 - DNA, 19 bp, Homo sapiens
tacaaatcagaagtcatct

SEQ ID NO: 5933930 - DNA, 21 bp, Homo sapiens
tacaaatcagaagtcatcttg

SEQ ID NO: 5933931 - DNA, 15 bp, Homo sapiens
tacaaatcagtaatt

SEQ ID NO: 5933932 - DNA, 21 bp, Homo sapiens
tacaaatcctctgttttctct

SEQ ID NO: 5933933 - DNA, 17 bp, Homo sapiens
tacaaatctcactgtat

SEQ ID NO: 5933934 - DNA, 12 bp, Homo sapiens
tacaaatctgta

SEQ ID NO: 5933935 - DNA, 16 bp, Homo sapiens
tacaaatctgtataaa

SEQ ID NO: 5933936 - DNA, 18 bp, Homo sapiens
tacaaatctgtataaatg

SEQ ID NO: 5933937 - DNA, 19 bp, Homo sapiens
tacaaatctgtataaatgt

SEQ ID NO: 5933938 - DNA, 21 bp, Homo sapiens
tacaaatgaagaaagtcaaaa

SEQ ID NO: 5933939 - DNA, 18 bp, Homo sapiens
tacaaatgaagtatttca

SEQ ID NO: 5933940 - DNA, 22 bp, Homo sapiens
tacaaatgaagtatttcatgta

SEQ ID NO: 5933941 - DNA, 20 bp, Homo sapiens
tacaaatgattgcttttaaa

SEQ ID NO: 5933942 - DNA, 21 bp, Homo sapiens
tacaaatgattgcttttaaaa

SEQ ID NO: 5933943 - DNA, 18 bp, Homo sapiens
tacaaatgcatctttgat

SEQ ID NO: 5933944 - DNA, 21 bp, Homo sapiens
tacaaatgcatctttgatgtg

SEQ ID NO: 5933945 - DNA, 13 bp, Homo sapiens
tacaaatgcctta

SEQ ID NO: 5933946 - DNA, 21 bp, Homo sapiens
tacaaatgccttaaaatggaa

SEQ ID NO: 5933947 - DNA, 17 bp, Homo sapiens
tacaaatggtggaggat

SEQ ID NO: 5933948 - DNA, 21 bp, Homo sapiens
tacaaatgtaagcaaaggctc

SEQ ID NO: 5933949 - DNA, 13 bp, Homo sapiens
tacaaatgtattt

SEQ ID NO: 5933950 - DNA, 16 bp, Homo sapiens
tacaaatgtattttga

SEQ ID NO: 5933951 - DNA, 12 bp, Homo sapiens
tacaaatgtctt

SEQ ID NO: 5933952 - DNA, 12 bp, Homo sapiens
tacaaatgtgat

SEQ ID NO: 5933953 - DNA, 17 bp, Homo sapiens
tacaaatgttaaaatgt

SEQ ID NO: 5933954 - DNA, 18 bp, Homo sapiens
tacaaatgttaaaatgtg

SEQ ID NO: 5933955 - DNA, 19 bp, Homo sapiens
tacaaatgtttttcatcca

SEQ ID NO: 5933956 - DNA, 17 bp, Homo sapiens
tacaaattaatatttgt

SEQ ID NO: 5933957 - DNA, 14 bp, Homo sapiens
tacaaattagaaaa

SEQ ID NO: 5933958 - DNA, 16 bp, Homo sapiens
tacaaattcaaggaga

SEQ ID NO: 5933959 - DNA, 14 bp, Homo sapiens
tacaaattctactt

SEQ ID NO: 5933960 - DNA, 16 bp, Homo sapiens
tacaaattgcttgaaa

SEQ ID NO: 5933961 - DNA, 20 bp, Homo sapiens
tacaaattgtcgtttttatt

SEQ ID NO: 5933962 - DNA, 18 bp, Homo sapiens
tacaaattgtttttactg

SEQ ID NO: 5933963 - DNA, 21 bp, Homo sapiens
tacaaatttaattttgcagat

SEQ ID NO: 5933964 - DNA, 14 bp, Homo sapiens
tacaaatttatgca

SEQ ID NO: 5933965 - DNA, 19 bp, Homo sapiens
tacaaatttatgcatttca

SEQ ID NO: 5933966 - DNA, 20 bp, Homo sapiens
tacaaatttatgcatttcat

SEQ ID NO: 5933967 - DNA, 24 bp, Homo sapiens
tacaaatttggccttaagaactgt

SEQ ID NO: 5933968 - DNA, 16 bp, Homo sapiens
tacaaatttgttattt

SEQ ID NO: 5933969 - DNA, 14 bp, Homo sapiens
tacaaattttcact

SEQ ID NO: 5933970 - DNA, 17 bp, Homo sapiens
tacaaatttttactcag

SEQ ID NO: 5933971 - DNA, 17 bp, Homo sapiens
tacaaatttttcctgca

SEQ ID NO: 5933972 - DNA, 15 bp, Homo sapiens
tacaacaaaaatcac

SEQ ID NO: 5933973 - DNA, 16 bp, Homo sapiens
tacaacaaacactgtg

SEQ ID NO: 5933974 - DNA, 15 bp, Homo sapiens
tacaacaactatttt

SEQ ID NO: 5933975 - DNA, 16 bp, Homo sapiens
tacaacaatcccagca

SEQ ID NO: 5933976 - DNA, 15 bp, Homo sapiens
tacaacaatgctttg

SEQ ID NO: 5933977 - DNA, 15 bp, Homo sapiens
tacaacacaaagaga

SEQ ID NO: 5933978 - DNA, 19 bp, Homo sapiens
tacaacacagtagtgttct

SEQ ID NO: 5933979 - DNA, 20 bp, Homo sapiens
tacaacacatctaattaaat

SEQ ID NO: 5933980 - DNA, 21 bp, Homo sapiens
tacaacacattgaaactgtat

SEQ ID NO: 5933981 - DNA, 16 bp, Homo sapiens
tacaacaccaaaaaat

SEQ ID NO: 5933982 - DNA, 23 bp, Homo sapiens
tacaacagaaaccagaaaagcaa

SEQ ID NO: 5933983 - DNA, 19 bp, Homo sapiens
tacaacagaagttatattt

SEQ ID NO: 5933984 - DNA, 16 bp, Homo sapiens
tacaacagatttgtga

SEQ ID NO: 5933985 - DNA, 16 bp, Homo sapiens
tacaacaggattttca

SEQ ID NO: 5933986 - DNA, 23 bp, Homo sapiens
tacaacaggattttcaagttatt

SEQ ID NO: 5933987 - DNA, 21 bp, Homo sapiens
tacaacataatctagtttaca

SEQ ID NO: 5933988 - DNA, 19 bp, Homo sapiens
tacaacatcaccagtgcca

SEQ ID NO: 5933989 - DNA, 17 bp, Homo sapiens
tacaacattagaatatt

SEQ ID NO: 5933990 - DNA, 22 bp, Homo sapiens
tacaacatttatatattgtctg

SEQ ID NO: 5933991 - DNA, 17 bp, Homo sapiens
tacaaccaagctctctg

SEQ ID NO: 5933992 - DNA, 20 bp, Homo sapiens
tacaaccaagctctctgcat

SEQ ID NO: 5933993 - DNA, 22 bp, Homo sapiens
tacaaccagaaacaatgtgtct

SEQ ID NO: 5933994 - DNA, 14 bp, Homo sapiens
tacaaccagagccc

SEQ ID NO: 5933995 - DNA, 22 bp, Homo sapiens
tacaaccagagccccccacaat

SEQ ID NO: 5933996 - DNA, 18 bp, Homo sapiens
tacaaccatccctgccac

SEQ ID NO: 5933997 - DNA, 19 bp, Homo sapiens
tacaaccatccctgccaca

SEQ ID NO: 5933998 - DNA, 17 bp, Homo sapiens
tacaacctccctcttgt

SEQ ID NO: 5933999 - DNA, 15 bp, Homo sapiens
tacaacctccgcctc

SEQ ID NO: 5934000 - DNA, 22 bp, Homo sapiens
tacaacctgagccttttcttat

SEQ ID NO: 5934001 - DNA, 20 bp, Homo sapiens
tacaacgattgtatttgtga

SEQ ID NO: 5934002 - DNA, 22 bp, Homo sapiens
tacaacggagtcaaaaattaaa

SEQ ID NO: 5934003 - DNA, 15 bp, Homo sapiens
tacaactaaataaca

SEQ ID NO: 5934004 - DNA, 18 bp, Homo sapiens
tacaactaaataacacag

SEQ ID NO: 5934005 - DNA, 20 bp, Homo sapiens
tacaactaacgcaaccaagt

SEQ ID NO: 5934006 - DNA, 16 bp, Homo sapiens
tacaactccaacttct

SEQ ID NO: 5934007 - DNA, 23 bp, Homo sapiens
tacaactggagtttttttataca

SEQ ID NO: 5934008 - DNA, 17 bp, Homo sapiens
tacaacttaagttggtc

SEQ ID NO: 5934009 - DNA, 16 bp, Homo sapiens
tacaacttaatggaaa

SEQ ID NO: 5934010 - DNA, 15 bp, Homo sapiens
tacaacttcatataa

SEQ ID NO: 5934011 - DNA, 14 bp, Homo sapiens
tacaacttctgggc

SEQ ID NO: 5934012 - DNA, 14 bp, Homo sapiens
tacaactttaccat

SEQ ID NO: 5934013 - DNA, 17 bp, Homo sapiens
tacaagaaaaaatgaat

SEQ ID NO: 5934014 - DNA, 18 bp, Homo sapiens
tacaagaaaaagtagaaa

SEQ ID NO: 5934015 - DNA, 20 bp, Homo sapiens
tacaagaaaaagtagaaaaa

SEQ ID NO: 5934016 - DNA, 21 bp, Homo sapiens
tacaagaagcattttgtaagt

SEQ ID NO: 5934017 - DNA, 22 bp, Homo sapiens
tacaagaattgtccatgtgctt

SEQ ID NO: 5934018 - DNA, 18 bp, Homo sapiens
tacaagacaacattgtaa

SEQ ID NO: 5934019 - DNA, 16 bp, Homo sapiens
tacaagactgccatat

SEQ ID NO: 5934020 - DNA, 19 bp, Homo sapiens
tacaagactgtaaattcca

SEQ ID NO: 5934021 - DNA, 16 bp, Homo sapiens
tacaagagaagaaagt

SEQ ID NO: 5934022 - DNA, 17 bp, Homo sapiens
tacaagagagtgaaatt

SEQ ID NO: 5934023 - DNA, 14 bp, Homo sapiens
tacaagagatggga

SEQ ID NO: 5934024 - DNA, 16 bp, Homo sapiens
tacaagagcagcctgt

SEQ ID NO: 5934025 - DNA, 18 bp, Homo sapiens
tacaagagccatgtacca

SEQ ID NO: 5934026 - DNA, 17 bp, Homo sapiens
tacaagagggcaaagct

SEQ ID NO: 5934027 - DNA, 18 bp, Homo sapiens
tacaagagggcaaagctg

SEQ ID NO: 5934028 - DNA, 21 bp, Homo sapiens
tacaagagggcaaagctgatt

SEQ ID NO: 5934029 - DNA, 15 bp, Homo sapiens
tacaagagtctgtat

SEQ ID NO: 5934030 - DNA, 22 bp, Homo sapiens
tacaagagtggagagaagctct

SEQ ID NO: 5934031 - DNA, 15 bp, Homo sapiens
tacaagataagcttc

SEQ ID NO: 5934032 - DNA, 16 bp, Homo sapiens
tacaagatattatgta

SEQ ID NO: 5934033 - DNA, 17 bp, Homo sapiens
tacaagatattatgtat

SEQ ID NO: 5934034 - DNA, 21 bp, Homo sapiens
tacaagatattatgtataaaa

SEQ ID NO: 5934035 - DNA, 15 bp, Homo sapiens
tacaagatattgatg

SEQ ID NO: 5934036 - DNA, 12 bp, Homo sapiens
tacaagatccat

SEQ ID NO: 5934037 - DNA, 24 bp, Homo sapiens
tacaagatgaaggagaggcaacat

SEQ ID NO: 5934038 - DNA, 15 bp, Homo sapiens
tacaagatggcgacc

SEQ ID NO: 5934039 - DNA, 21 bp, Homo sapiens
tacaagattagaagctgaaaa

SEQ ID NO: 5934040 - DNA, 20 bp, Homo sapiens
tacaagattgaaaatcttgt

SEQ ID NO: 5934041 - DNA, 14 bp, Homo sapiens
tacaagattgtaag

SEQ ID NO: 5934042 - DNA, 14 bp, Homo sapiens
tacaagcaacagca

SEQ ID NO: 5934043 - DNA, 20 bp, Homo sapiens
tacaagcaagcaaaattatt

SEQ ID NO: 5934044 - DNA, 14 bp, Homo sapiens
tacaagcagttaat

SEQ ID NO: 5934045 - DNA, 18 bp, Homo sapiens
tacaagcatcatggatca

SEQ ID NO: 5934046 - DNA, 22 bp, Homo sapiens
tacaagcatcatggatcaacca

SEQ ID NO: 5934047 - DNA, 21 bp, Homo sapiens
tacaagcattctgtcttgaag

SEQ ID NO: 5934048 - DNA, 23 bp, Homo sapiens
tacaagccaaaagtccctccctg

SEQ ID NO: 5934049 - DNA, 22 bp, Homo sapiens
tacaagccaaagtggcatgttt

SEQ ID NO: 5934050 - DNA, 22 bp, Homo sapiens
tacaagccactaccttctgacc

SEQ ID NO: 5934051 - DNA, 19 bp, Homo sapiens
tacaagcccccccttccac

SEQ ID NO: 5934052 - DNA, 21 bp, Homo sapiens
tacaagcgtgagccactgcac

SEQ ID NO: 5934053 - DNA, 21 bp, Homo sapiens
tacaagctacagttgtccaga

SEQ ID NO: 5934054 - DNA, 15 bp, Homo sapiens
tacaagctatttttg

SEQ ID NO: 5934055 - DNA, 21 bp, Homo sapiens
tacaagctcttgtttctgttt

SEQ ID NO: 5934056 - DNA, 18 bp, Homo sapiens
tacaagctgggaacttct

SEQ ID NO: 5934057 - DNA, 16 bp, Homo sapiens
tacaagcttaaagctt

SEQ ID NO: 5934058 - DNA, 18 bp, Homo sapiens
tacaagcttttaactttt

SEQ ID NO: 5934059 - DNA, 17 bp, Homo sapiens
tacaaggaaggtggtgg

SEQ ID NO: 5934060 - DNA, 16 bp, Homo sapiens
tacaaggatcagaatg

SEQ ID NO: 5934061 - DNA, 15 bp, Homo sapiens
tacaaggcaagcatt

SEQ ID NO: 5934062 - DNA, 18 bp, Homo sapiens
tacaaggcaagcattttt

SEQ ID NO: 5934063 - DNA, 20 bp, Homo sapiens
tacaaggcaggcctttccta

SEQ ID NO: 5934064 - DNA, 22 bp, Homo sapiens
tacaaggcaggcctttcctaca

SEQ ID NO: 5934065 - DNA, 21 bp, Homo sapiens
tacaaggccccaaggtttaca

SEQ ID NO: 5934066 - DNA, 22 bp, Homo sapiens
tacaaggccccaaggtttacat

SEQ ID NO: 5934067 - DNA, 19 bp, Homo sapiens
tacaagggcataaagtaaa

SEQ ID NO: 5934068 - DNA, 22 bp, Homo sapiens
tacaaggggatccagtgtgtaa

SEQ ID NO: 5934069 - DNA, 18 bp, Homo sapiens
tacaagggtctagggaga

SEQ ID NO: 5934070 - DNA, 13 bp, Homo sapiens
tacaaggtatgta

SEQ ID NO: 5934071 - DNA, 20 bp, Homo sapiens
tacaaggtatttacacatac

SEQ ID NO: 5934072 - DNA, 19 bp, Homo sapiens
tacaaggtttggcaaaaaa

SEQ ID NO: 5934073 - DNA, 14 bp, Homo sapiens
tacaagtaaattct

SEQ ID NO: 5934074 - DNA, 16 bp, Homo sapiens
tacaagtaaattctgt

SEQ ID NO: 5934075 - DNA, 14 bp, Homo sapiens
tacaagtaatgtaa

SEQ ID NO: 5934076 - DNA, 18 bp, Homo sapiens
tacaagtactggtaagat

SEQ ID NO: 5934077 - DNA, 21 bp, Homo sapiens
tacaagtagttctgtatttga

SEQ ID NO: 5934078 - DNA, 15 bp, Homo sapiens
tacaagtataacagt

SEQ ID NO: 5934079 - DNA, 17 bp, Homo sapiens
tacaagtatatgtgaaa

SEQ ID NO: 5934080 - DNA, 14 bp, Homo sapiens
tacaagtattcagt

SEQ ID NO: 5934081 - DNA, 18 bp, Homo sapiens
tacaagtatttttaatta

SEQ ID NO: 5934082 - DNA, 16 bp, Homo sapiens
tacaagtcagtttcta

SEQ ID NO: 5934083 - DNA, 19 bp, Homo sapiens
tacaagtcatggtcacagt

SEQ ID NO: 5934084 - DNA, 20 bp, Homo sapiens
tacaagtgctcagttccaat

SEQ ID NO: 5934085 - DNA, 13 bp, Homo sapiens
tacaagtggctcc

SEQ ID NO: 5934086 - DNA, 19 bp, Homo sapiens
tacaagtggctccccacct

SEQ ID NO: 5934087 - DNA, 23 bp, Homo sapiens
tacaagtggtaatttttgtacat

SEQ ID NO: 5934088 - DNA, 17 bp, Homo sapiens
tacaagtggtgaccaaa

SEQ ID NO: 5934089 - DNA, 14 bp, Homo sapiens
tacaagtgtatatc

SEQ ID NO: 5934090 - DNA, 23 bp, Homo sapiens
tacaagtgttttagatgttacta

SEQ ID NO: 5934091 - DNA, 13 bp, Homo sapiens
tacaagttagaaa

SEQ ID NO: 5934092 - DNA, 15 bp, Homo sapiens
tacaagttagaaaac

SEQ ID NO: 5934093 - DNA, 16 bp, Homo sapiens
tacaagttctggcaag

SEQ ID NO: 5934094 - DNA, 14 bp, Homo sapiens
tacaagttgagtat

SEQ ID NO: 5934095 - DNA, 22 bp, Homo sapiens
tacaagttgctttgttacaata

SEQ ID NO: 5934096 - DNA, 15 bp, Homo sapiens
tacaagtttataagc

SEQ ID NO: 5934097 - DNA, 16 bp, Homo sapiens
tacaagtttatatata

SEQ ID NO: 5934098 - DNA, 13 bp, Homo sapiens
tacaagtttcaga

SEQ ID NO: 5934099 - DNA, 17 bp, Homo sapiens
tacaagtttcagacagg

SEQ ID NO: 5934100 - DNA, 15 bp, Homo sapiens
tacaagtttcagtaa

SEQ ID NO: 5934101 - DNA, 16 bp, Homo sapiens
tacacactcagccaca

SEQ ID NO: 5934102 - DNA, 15 bp, Homo sapiens
tacacactcaggcct

SEQ ID NO: 5934103 - DNA, 20 bp, Homo sapiens
tacacactcaggcctgtgcc

SEQ ID NO: 5934104 - DNA, 14 bp, Homo sapiens
tacacagaaacact

SEQ ID NO: 5934105 - DNA, 15 bp, Homo sapiens
tacacagaaacactg

SEQ ID NO: 5934106 - DNA, 18 bp, Homo sapiens
tacacagaaatgctgctg

SEQ ID NO: 5934107 - DNA, 20 bp, Homo sapiens
tacacagaaatgctgctggc

SEQ ID NO: 5934108 - DNA, 18 bp, Homo sapiens
tacacagaccctgcccac

SEQ ID NO: 5934109 - DNA, 20 bp, Homo sapiens
tacacagaccctgcccaccc

SEQ ID NO: 5934110 - DNA, 21 bp, Homo sapiens
tacacagaccctgcccacccc

SEQ ID NO: 5934111 - DNA, 14 bp, Homo sapiens
tacacagagaaggc

SEQ ID NO: 5934112 - DNA, 18 bp, Homo sapiens
tacacagagcaggactgc

SEQ ID NO: 5934113 - DNA, 22 bp, Homo sapiens
tacacagagggacttgagccag

SEQ ID NO: 5934114 - DNA, 21 bp, Homo sapiens
tacacagattctgccttgttt

SEQ ID NO: 5934115 - DNA, 20 bp, Homo sapiens
tacacagcacaccagccgct

SEQ ID NO: 5934116 - DNA, 14 bp, Homo sapiens
tacacagcctggac

SEQ ID NO: 5934117 - DNA, 12 bp, Homo sapiens
tacacaggcagg

SEQ ID NO: 5934118 - DNA, 16 bp, Homo sapiens
tacacaggtgagaaag

SEQ ID NO: 5934119 - DNA, 16 bp, Homo sapiens
tacacagtaattgtga

SEQ ID NO: 5934120 - DNA, 19 bp, Homo sapiens
tacacagtacttcctccca

SEQ ID NO: 5934121 - DNA, 23 bp, Homo sapiens
tacacagtactttattgtacaga

SEQ ID NO: 5934122 - DNA, 13 bp, Homo sapiens
tacacagtcagct

SEQ ID NO: 5934123 - DNA, 18 bp, Homo sapiens
tacacagtgagactgtac

SEQ ID NO: 5934124 - DNA, 19 bp, Homo sapiens
tacacagtgagactgtaca

SEQ ID NO: 5934125 - DNA, 20 bp, Homo sapiens
tacacagtgagactgtacat

SEQ ID NO: 5934126 - DNA, 23 bp, Homo sapiens
tacacagtgagactgtacataat

SEQ ID NO: 5934127 - DNA, 22 bp, Homo sapiens
tacacagtgggaactctgacaa

SEQ ID NO: 5934128 - DNA, 21 bp, Homo sapiens
tacacagttcacaaacagtaa

SEQ ID NO: 5934129 - DNA, 15 bp, Homo sapiens
tacacataacttctt

SEQ ID NO: 5934130 - DNA, 20 bp, Homo sapiens
tacacatacagaaagaagca

SEQ ID NO: 5934131 - DNA, 13 bp, Homo sapiens
tacacatacatat

SEQ ID NO: 5934132 - DNA, 15 bp, Homo sapiens
tacacatacatatat

SEQ ID NO: 5934133 - DNA, 17 bp, Homo sapiens
tacacatacatatatac

SEQ ID NO: 5934134 - DNA, 22 bp, Homo sapiens
tacacatagttctgtaataaaa

SEQ ID NO: 5934135 - DNA, 14 bp, Homo sapiens
tacacatataaaca

SEQ ID NO: 5934136 - DNA, 19 bp, Homo sapiens
tacacatataaacacagta

SEQ ID NO: 5934137 - DNA, 20 bp, Homo sapiens
tacacatataaacacagtaa

SEQ ID NO: 5934138 - DNA, 21 bp, Homo sapiens
tacacatataaacacagtaag

SEQ ID NO: 5934139 - DNA, 13 bp, Homo sapiens
tacacatatacct

SEQ ID NO: 5934140 - DNA, 21 bp, Homo sapiens
tacacatatacctataatgtg

SEQ ID NO: 5934141 - DNA, 18 bp, Homo sapiens
tacacatatctaaaaata

SEQ ID NO: 5934142 - DNA, 18 bp, Homo sapiens
tacacatatttgaagggt

SEQ ID NO: 5934143 - DNA, 14 bp, Homo sapiens
tacacatattttga

SEQ ID NO: 5934144 - DNA, 17 bp, Homo sapiens
tacacatcacacaagat

SEQ ID NO: 5934145 - DNA, 22 bp, Homo sapiens
tacacatcagccatcaactaaa

SEQ ID NO: 5934146 - DNA, 22 bp, Homo sapiens
tacacatctattctcaaagcta

SEQ ID NO: 5934147 - DNA, 14 bp, Homo sapiens
tacacatgaaaaca

SEQ ID NO: 5934148 - DNA, 16 bp, Homo sapiens
tacacatggagtgctt

SEQ ID NO: 5934149 - DNA, 15 bp, Homo sapiens
tacacatggatgcac

SEQ ID NO: 5934150 - DNA, 20 bp, Homo sapiens
tacacatgtaaaatatgtaa

SEQ ID NO: 5934151 - DNA, 23 bp, Homo sapiens
tacacatgtgttatctacctcaa

SEQ ID NO: 5934152 - DNA, 20 bp, Homo sapiens
tacacatgttgccttgcatt

SEQ ID NO: 5934153 - DNA, 17 bp, Homo sapiens
tacacattagaaatatt

SEQ ID NO: 5934154 - DNA, 13 bp, Homo sapiens
tacacattagatt

SEQ ID NO: 5934155 - DNA, 15 bp, Homo sapiens
tacacattagatttt

SEQ ID NO: 5934156 - DNA, 13 bp, Homo sapiens
tacacattatcac

SEQ ID NO: 5934157 - DNA, 20 bp, Homo sapiens
tacacattatcactgaaaaa

SEQ ID NO: 5934158 - DNA, 23 bp, Homo sapiens
tacacattattatgactagaagt

SEQ ID NO: 5934159 - DNA, 13 bp, Homo sapiens
tacacatttcact

SEQ ID NO: 5934160 - DNA, 22 bp, Homo sapiens
tacacatttcatctaatttaat

SEQ ID NO: 5934161 - DNA, 13 bp, Homo sapiens
tacacatttgtac

SEQ ID NO: 5934162 - DNA, 16 bp, Homo sapiens
tacacatttgtacaga

SEQ ID NO: 5934163 - DNA, 19 bp, Homo sapiens
tacacattttattttatta

SEQ ID NO: 5934164 - DNA, 21 bp, Homo sapiens
tacacattttattttattatg

SEQ ID NO: 5934165 - DNA, 22 bp, Homo sapiens
tacacattttcaaggactattt

SEQ ID NO: 5934166 - DNA, 16 bp, Homo sapiens
tacacattttgtaaat

SEQ ID NO: 5934167 - DNA, 19 bp, Homo sapiens
tacacattttgtaaatctg

SEQ ID NO: 5934168 - DNA, 23 bp, Homo sapiens
tacacattttgtaaatctgtact

SEQ ID NO: 5934169 - DNA, 15 bp, Homo sapiens
tacacatttttcaga

SEQ ID NO: 5934170 - DNA, 19 bp, Homo sapiens
tacacatttttcagatata

SEQ ID NO: 5934171 - DNA, 15 bp, Homo sapiens
tacaccaaacatttc

SEQ ID NO: 5934172 - DNA, 10 bp, Homo sapiens
tacaccaagt

SEQ ID NO: 5934173 - DNA, 14 bp, Homo sapiens
tacaccaatgaaaa

SEQ ID NO: 5934174 - DNA, 19 bp, Homo sapiens
tacaccaatgaaaacatgt

SEQ ID NO: 5934175 - DNA, 15 bp, Homo sapiens
tacaccacaagtatc

SEQ ID NO: 5934176 - DNA, 14 bp, Homo sapiens
tacaccacacacaa

SEQ ID NO: 5934177 - DNA, 16 bp, Homo sapiens
tacaccacacacaaca

SEQ ID NO: 5934178 - DNA, 18 bp, Homo sapiens
tacaccacacacaacagc

SEQ ID NO: 5934179 - DNA, 22 bp, Homo sapiens
tacaccacacacaacagccaac

SEQ ID NO: 5934180 - DNA, 24 bp, Homo sapiens
tacaccacactaaaacattgtcta

SEQ ID NO: 5934181 - DNA, 23 bp, Homo sapiens
tacaccactttcccacactgtga

SEQ ID NO: 5934182 - DNA, 19 bp, Homo sapiens
tacaccagagataatatga

SEQ ID NO: 5934183 - DNA, 19 bp, Homo sapiens
tacaccatgtttgagctca

SEQ ID NO: 5934184 - DNA, 14 bp, Homo sapiens
tacacccaaagagg

SEQ ID NO: 5934185 - DNA, 16 bp, Homo sapiens
tacacccaaatattgt

SEQ ID NO: 5934186 - DNA, 13 bp, Homo sapiens
tacacccacccac

SEQ ID NO: 5934187 - DNA, 14 bp, Homo sapiens
tacacccagacccc

SEQ ID NO: 5934188 - DNA, 20 bp, Homo sapiens
tacacccagaccccaggctg

SEQ ID NO: 5934189 - DNA, 12 bp, Homo sapiens
tacacccagcaa

SEQ ID NO: 5934190 - DNA, 14 bp, Homo sapiens
tacacccagcaata

SEQ ID NO: 5934191 - DNA, 18 bp, Homo sapiens
tacacccagttctgaata

SEQ ID NO: 5934192 - DNA, 15 bp, Homo sapiens
tacaccccttttcca

SEQ ID NO: 5934193 - DNA, 12 bp, Homo sapiens
tacaccctttcc

SEQ ID NO: 5934194 - DNA, 17 bp, Homo sapiens
tacaccgactagccagg

SEQ ID NO: 5934195 - DNA, 15 bp, Homo sapiens
tacaccgggcctgga

SEQ ID NO: 5934196 - DNA, 21 bp, Homo sapiens
tacaccgtgaggccaagatcc

SEQ ID NO: 5934197 - DNA, 16 bp, Homo sapiens
tacacctcagaaattg

SEQ ID NO: 5934198 - DNA, 23 bp, Homo sapiens
tacacctccactcagcactctgg

SEQ ID NO: 5934199 - DNA, 14 bp, Homo sapiens
tacacctccccctg

SEQ ID NO: 5934200 - DNA, 18 bp, Homo sapiens
tacacctccccctgcgcc

SEQ ID NO: 5934201 - DNA, 20 bp, Homo sapiens
tacacctcctttaagattta

SEQ ID NO: 5934202 - DNA, 24 bp, Homo sapiens
tacacctcgttagggaagagaaac

SEQ ID NO: 5934203 - DNA, 14 bp, Homo sapiens
tacacctctgggcc

SEQ ID NO: 5934204 - DNA, 18 bp, Homo sapiens
tacacctgaggctgaggc

SEQ ID NO: 5934205 - DNA, 21 bp, Homo sapiens
tacacctggaccatttgattg

SEQ ID NO: 5934206 - DNA, 22 bp, Homo sapiens
tacacctggctgaggttcctct

SEQ ID NO: 5934207 - DNA, 23 bp, Homo sapiens
tacacctggctgaggttcctctg

SEQ ID NO: 5934208 - DNA, 18 bp, Homo sapiens
tacacgaagaaatagaat

SEQ ID NO: 5934209 - DNA, 19 bp, Homo sapiens
tacacgaatagacatcaaa

SEQ ID NO: 5934210 - DNA, 21 bp, Homo sapiens
tacacgaccatttgataggga

SEQ ID NO: 5934211 - DNA, 21 bp, Homo sapiens
tacacgcatgatggagctgat

SEQ ID NO: 5934212 - DNA, 18 bp, Homo sapiens
tacacgggacagttgctg

SEQ ID NO: 5934213 - DNA, 22 bp, Homo sapiens
tacacggttcaaacctgtgaag

SEQ ID NO: 5934214 - DNA, 16 bp, Homo sapiens
tacacgtctggacccc

SEQ ID NO: 5934215 - DNA, 17 bp, Homo sapiens
tacacgtctggaccccg

SEQ ID NO: 5934216 - DNA, 17 bp, Homo sapiens
tacacgtgtcctgtagt

SEQ ID NO: 5934217 - DNA, 14 bp, Homo sapiens
tacacgtttatctt

SEQ ID NO: 5934218 - DNA, 15 bp, Homo sapiens
tacactaaaaggtga

SEQ ID NO: 5934219 - DNA, 14 bp, Homo sapiens
tacactaaaattta

SEQ ID NO: 5934220 - DNA, 16 bp, Homo sapiens
tacactaaatgatatt

SEQ ID NO: 5934221 - DNA, 15 bp, Homo sapiens
tacactaaattatta

SEQ ID NO: 5934222 - DNA, 19 bp, Homo sapiens
tacactaagagagaatgag

SEQ ID NO: 5934223 - DNA, 19 bp, Homo sapiens
tacactaatatatggacct

SEQ ID NO: 5934224 - DNA, 20 bp, Homo sapiens
tacactacgcactggacagc

SEQ ID NO: 5934225 - DNA, 14 bp, Homo sapiens
tacactagttgttt

SEQ ID NO: 5934226 - DNA, 17 bp, Homo sapiens
tacactatgataaagtt

SEQ ID NO: 5934227 - DNA, 19 bp, Homo sapiens
tacactatgataaagttgt

SEQ ID NO: 5934228 - DNA, 17 bp, Homo sapiens
tacactattgcattgtt

SEQ ID NO: 5934229 - DNA, 20 bp, Homo sapiens
tacactcaactaatttttgt

SEQ ID NO: 5934230 - DNA, 18 bp, Homo sapiens
tacactcagccactgtca

SEQ ID NO: 5934231 - DNA, 16 bp, Homo sapiens
tacactcattgaaatg

SEQ ID NO: 5934232 - DNA, 12 bp, Homo sapiens
tacactccagcc

SEQ ID NO: 5934233 - DNA, 19 bp, Homo sapiens
tacactcctctatcatgca

SEQ ID NO: 5934234 - DNA, 11 bp, Homo sapiens
tacactcctgc

SEQ ID NO: 5934235 - DNA, 12 bp, Homo sapiens
tacactcgaact

SEQ ID NO: 5934236 - DNA, 17 bp, Homo sapiens
tacactcgaactcggga

SEQ ID NO: 5934237 - DNA, 19 bp, Homo sapiens
tacactcgtatgatacttc

SEQ ID NO: 5934238 - DNA, 21 bp, Homo sapiens
tacactcgtccccctcctgcc

SEQ ID NO: 5934239 - DNA, 21 bp, Homo sapiens
tacactctcaaagcaaataat

SEQ ID NO: 5934240 - DNA, 18 bp, Homo sapiens
tacactctcctgggcccc

SEQ ID NO: 5934241 - DNA, 22 bp, Homo sapiens
tacactctcctgggcccctccc

SEQ ID NO: 5934242 - DNA, 18 bp, Homo sapiens
tacactctctgtacaaaa

SEQ ID NO: 5934243 - DNA, 21 bp, Homo sapiens
tacactctctgtacaaaaaca

SEQ ID NO: 5934244 - DNA, 23 bp, Homo sapiens
tacactctgctgtttgacacctc

SEQ ID NO: 5934245 - DNA, 20 bp, Homo sapiens
tacactgaaaggaaaaatgt

SEQ ID NO: 5934246 - DNA, 22 bp, Homo sapiens
tacactgaaaggaaaaatgtac

SEQ ID NO: 5934247 - DNA, 17 bp, Homo sapiens
tacactgaattgaatct

SEQ ID NO: 5934248 - DNA, 18 bp, Homo sapiens
tacactgaatttttatgt

SEQ ID NO: 5934249 - DNA, 23 bp, Homo sapiens
tacactgacacctttgcaggcat

SEQ ID NO: 5934250 - DNA, 15 bp, Homo sapiens
tacactgacttggtg

SEQ ID NO: 5934251 - DNA, 13 bp, Homo sapiens
tacactgaggact

SEQ ID NO: 5934252 - DNA, 15 bp, Homo sapiens
tacactgaggactgt

SEQ ID NO: 5934253 - DNA, 16 bp, Homo sapiens
tacactgaggagagat

SEQ ID NO: 5934254 - DNA, 15 bp, Homo sapiens
tacactgagtttcta

SEQ ID NO: 5934255 - DNA, 19 bp, Homo sapiens
tacactgcaatcatatgtg

SEQ ID NO: 5934256 - DNA, 13 bp, Homo sapiens
tacactgcacttt

SEQ ID NO: 5934257 - DNA, 14 bp, Homo sapiens
tacactgcactttg

SEQ ID NO: 5934258 - DNA, 16 bp, Homo sapiens
tacactgcactttgtt

SEQ ID NO: 5934259 - DNA, 13 bp, Homo sapiens
tacactgccagcc

SEQ ID NO: 5934260 - DNA, 13 bp, Homo sapiens
tacactgcctgta

SEQ ID NO: 5934261 - DNA, 18 bp, Homo sapiens
tacactgcctgtatactt

SEQ ID NO: 5934262 - DNA, 20 bp, Homo sapiens
tacactgcctgtatacttta

SEQ ID NO: 5934263 - DNA, 23 bp, Homo sapiens
tacactgcctgtatactttagta

SEQ ID NO: 5934264 - DNA, 20 bp, Homo sapiens
tacactgccttaccttcact

SEQ ID NO: 5934265 - DNA, 22 bp, Homo sapiens
tacactgccttaccttcactta

SEQ ID NO: 5934266 - DNA, 17 bp, Homo sapiens
tacactgcggaagccaa

SEQ ID NO: 5934267 - DNA, 20 bp, Homo sapiens
tacactgcggaagccaaagg

SEQ ID NO: 5934268 - DNA, 22 bp, Homo sapiens
tacactgcggaagccaaaggca

SEQ ID NO: 5934269 - DNA, 18 bp, Homo sapiens
tacactgctgtacccaga

SEQ ID NO: 5934270 - DNA, 19 bp, Homo sapiens
tacactggaggagagaaga

SEQ ID NO: 5934271 - DNA, 21 bp, Homo sapiens
tacactggaggagagaagaat

SEQ ID NO: 5934272 - DNA, 16 bp, Homo sapiens
tacactgggctgggtt

SEQ ID NO: 5934273 - DNA, 16 bp, Homo sapiens
tacactggtgtgtccc

SEQ ID NO: 5934274 - DNA, 20 bp, Homo sapiens
tacactggtgtgtccctctg

SEQ ID NO: 5934275 - DNA, 14 bp, Homo sapiens
tacactgtaagaaa

SEQ ID NO: 5934276 - DNA, 15 bp, Homo sapiens
tacactgtaagcttt

SEQ ID NO: 5934277 - DNA, 16 bp, Homo sapiens
tacagattttgatagc

SEQ ID NO: 5934278 - DNA, 18 bp, Homo sapiens
tacagattttgatagcaa

SEQ ID NO: 5934279 - DNA, 22 bp, Homo sapiens
tacagattttgatagcaaagcg

SEQ ID NO: 5934280 - DNA, 23 bp, Homo sapiens
tacagattttgatagcaaagcga

SEQ ID NO: 5934281 - DNA, 13 bp, Homo sapiens
tacagcaaaagat

SEQ ID NO: 5934282 - DNA, 19 bp, Homo sapiens
tacagcaacaatttatgaa

SEQ ID NO: 5934283 - DNA, 20 bp, Homo sapiens
tacagcaacaatttatgaat

SEQ ID NO: 5934284 - DNA, 18 bp, Homo sapiens
tacagcaacaggaatctc

SEQ ID NO: 5934285 - DNA, 23 bp, Homo sapiens
tacagcaacaggaatctcagaga

SEQ ID NO: 5934286 - DNA, 17 bp, Homo sapiens
tacagcaagatgtttct

SEQ ID NO: 5934287 - DNA, 22 bp, Homo sapiens
tacagcaaggagatttacaact

SEQ ID NO: 5934288 - DNA, 18 bp, Homo sapiens
tacagcacagaatgagta

SEQ ID NO: 5934289 - DNA, 22 bp, Homo sapiens
tacagcacatcttttttttgga

SEQ ID NO: 5934290 - DNA, 23 bp, Homo sapiens
tacagcactacttacttagagat

SEQ ID NO: 5934291 - DNA, 23 bp, Homo sapiens
tacagcactccaccttgggacct

SEQ ID NO: 5934292 - DNA, 15 bp, Homo sapiens
tacagcagcaagaaa

SEQ ID NO: 5934293 - DNA, 20 bp, Homo sapiens
tacagcagcaatattttgta

SEQ ID NO: 5934294 - DNA, 18 bp, Homo sapiens
tacagcagggtcttgctg

SEQ ID NO: 5934295 - DNA, 20 bp, Homo sapiens
tacagcagtagacattttaa

SEQ ID NO: 5934296 - DNA, 21 bp, Homo sapiens
tacagcatagggtccactttg

SEQ ID NO: 5934297 - DNA, 21 bp, Homo sapiens
tacagcatgagattgtacatt

SEQ ID NO: 5934298 - DNA, 16 bp, Homo sapiens
tacagcattacaaatt

SEQ ID NO: 5934299 - DNA, 10 bp, Homo sapiens
tacagcattg

SEQ ID NO: 5934300 - DNA, 13 bp, Homo sapiens
tacagcatttctt

SEQ ID NO: 5934301 - DNA, 19 bp, Homo sapiens
tacagcatttctttggaaa

SEQ ID NO: 5934302 - DNA, 20 bp, Homo sapiens
tacagccaagttgtgacagt

SEQ ID NO: 5934303 - DNA, 23 bp, Homo sapiens
tacagccaagttgtgacagtcac

SEQ ID NO: 5934304 - DNA, 14 bp, Homo sapiens
tacagccagaagcc

SEQ ID NO: 5934305 - DNA, 19 bp, Homo sapiens
tacagccccaaaccagggt

SEQ ID NO: 5934306 - DNA, 22 bp, Homo sapiens
tacagccctaagtggctgcctt

SEQ ID NO: 5934307 - DNA, 22 bp, Homo sapiens
tacagcccttggcttgtgttat

SEQ ID NO: 5934308 - DNA, 18 bp, Homo sapiens
tacagcctatagtaaatg

SEQ ID NO: 5934309 - DNA, 18 bp, Homo sapiens
tacagcctgaataaacca

SEQ ID NO: 5934310 - DNA, 22 bp, Homo sapiens
tacagcctgaataaaccaagac

SEQ ID NO: 5934311 - DNA, 14 bp, Homo sapiens
tacagcctgcacac

SEQ ID NO: 5934312 - DNA, 13 bp, Homo sapiens
tacagccttattt

SEQ ID NO: 5934313 - DNA, 23 bp, Homo sapiens
tacagccttattttgttggtgct

SEQ ID NO: 5934314 - DNA, 18 bp, Homo sapiens
tacagccttcactggaga

SEQ ID NO: 5934315 - DNA, 20 bp, Homo sapiens
tacagcgcggaggaggaggg

SEQ ID NO: 5934316 - DNA, 16 bp, Homo sapiens
tacagctaaggccttg

SEQ ID NO: 5934317 - DNA, 19 bp, Homo sapiens
tacagctactataaatata

SEQ ID NO: 5934318 - DNA, 14 bp, Homo sapiens
tacagctactttaa

SEQ ID NO: 5934319 - DNA, 18 bp, Homo sapiens
tacagctatatttgatta

SEQ ID NO: 5934320 - DNA, 23 bp, Homo sapiens
tacagctatatttgattatgtat

SEQ ID NO: 5934321 - DNA, 16 bp, Homo sapiens
tacagctatgaagtgc

SEQ ID NO: 5934322 - DNA, 18 bp, Homo sapiens
tacagctcattaaacttt

SEQ ID NO: 5934323 - DNA, 21 bp, Homo sapiens
tacagctcattaaactttttt

SEQ ID NO: 5934324 - DNA, 15 bp, Homo sapiens
tacagctccccaagt

SEQ ID NO: 5934325 - DNA, 18 bp, Homo sapiens
tacagctcccccagctcc

SEQ ID NO: 5934326 - DNA, 20 bp, Homo sapiens
tacagctcccccagctcccc

SEQ ID NO: 5934327 - DNA, 14 bp, Homo sapiens
tacagctcctttga

SEQ ID NO: 5934328 - DNA, 20 bp, Homo sapiens
tacagctcctttgaaaactc

SEQ ID NO: 5934329 - DNA, 20 bp, Homo sapiens
tacagctctcccctcccttg

SEQ ID NO: 5934330 - DNA, 16 bp, Homo sapiens
tacagctctcctccag

SEQ ID NO: 5934331 - DNA, 22 bp, Homo sapiens
tacagctctcctccagccctgg

SEQ ID NO: 5934332 - DNA, 13 bp, Homo sapiens
tacagctctgact

SEQ ID NO: 5934333 - DNA, 16 bp, Homo sapiens
tacagctctgtagttt

SEQ ID NO: 5934334 - DNA, 11 bp, Homo sapiens
tacagctgagt

SEQ ID NO: 5934335 - DNA, 14 bp, Homo sapiens
tacagctgcctgca

SEQ ID NO: 5934336 - DNA, 22 bp, Homo sapiens
tacagctgctttgagctacagg

SEQ ID NO: 5934337 - DNA, 23 bp, Homo sapiens
tacagctggctatctactaccag

SEQ ID NO: 5934338 - DNA, 10 bp, Homo sapiens
tacagctggg

SEQ ID NO: 5934339 - DNA, 21 bp, Homo sapiens
tacagctgggtggcactgcca

SEQ ID NO: 5934340 - DNA, 24 bp, Homo sapiens
tacagctgggtggcactgccatgc

SEQ ID NO: 5934341 - DNA, 15 bp, Homo sapiens
tacagctgtgctcca

SEQ ID NO: 5934342 - DNA, 15 bp, Homo sapiens
tacagcttatttttt

SEQ ID NO: 5934343 - DNA, 18 bp, Homo sapiens
tacagcttcattatctga

SEQ ID NO: 5934344 - DNA, 15 bp, Homo sapiens
tacagcttctggagc

SEQ ID NO: 5934345 - DNA, 23 bp, Homo sapiens
tacagcttgaccgtgaggccaga

SEQ ID NO: 5934346 - DNA, 23 bp, Homo sapiens
tacagcttgtttaacggcagtgt

SEQ ID NO: 5934347 - DNA, 21 bp, Homo sapiens
tacagctttacacacacagat

SEQ ID NO: 5934348 - DNA, 21 bp, Homo sapiens
tacagctttctgaccttcagc

SEQ ID NO: 5934349 - DNA, 23 bp, Homo sapiens
tacagctttctgaccttcagctc

SEQ ID NO: 5934350 - DNA, 23 bp, Homo sapiens
tacagctttcttgctcccttcag

SEQ ID NO: 5934351 - DNA, 15 bp, Homo sapiens
tacagctttgggtca

SEQ ID NO: 5934352 - DNA, 13 bp, Homo sapiens
tacagcttttatg

SEQ ID NO: 5934353 - DNA, 19 bp, Homo sapiens
tacagcttttatggatgat

SEQ ID NO: 5934354 - DNA, 21 bp, Homo sapiens
tacaggaaaaaaaattctgtt

SEQ ID NO: 5934355 - DNA, 22 bp, Homo sapiens
tacaggaaaaaaaattctgttg

SEQ ID NO: 5934356 - DNA, 13 bp, Homo sapiens
tacaggaaagatg

SEQ ID NO: 5934357 - DNA, 17 bp, Homo sapiens
tacaggaaagatgcatt

SEQ ID NO: 5934358 - DNA, 13 bp, Homo sapiens
tacaggaacagaa

SEQ ID NO: 5934359 - DNA, 19 bp, Homo sapiens
tacaggaacccagccagag

SEQ ID NO: 5934360 - DNA, 21 bp, Homo sapiens
tacaggaagcaccccatgcca

SEQ ID NO: 5934361 - DNA, 15 bp, Homo sapiens
tacaggaaggcttgc

SEQ ID NO: 5934362 - DNA, 18 bp, Homo sapiens
tacaggaaggtgcctggc

SEQ ID NO: 5934363 - DNA, 14 bp, Homo sapiens
tacaggaatgaaga

SEQ ID NO: 5934364 - DNA, 19 bp, Homo sapiens
tacaggacatgtactgaga

SEQ ID NO: 5934365 - DNA, 22 bp, Homo sapiens
tacaggacatgtactgagacaa

SEQ ID NO: 5934366 - DNA, 12 bp, Homo sapiens
tacaggactggg

SEQ ID NO: 5934367 - DNA, 14 bp, Homo sapiens
tacaggacttctct

SEQ ID NO: 5934368 - DNA, 17 bp, Homo sapiens
tacaggacttttaaatg

SEQ ID NO: 5934369 - DNA, 18 bp, Homo sapiens
tacaggacttttaaatgg

SEQ ID NO: 5934370 - DNA, 15 bp, Homo sapiens
tacaggagaggcagc

SEQ ID NO: 5934371 - DNA, 16 bp, Homo sapiens
tacaggagaggcagca

SEQ ID NO: 5934372 - DNA, 13 bp, Homo sapiens
tacaggagccagc

SEQ ID NO: 5934373 - DNA, 23 bp, Homo sapiens
tacaggagccagcctgcttccca

SEQ ID NO: 5934374 - DNA, 18 bp, Homo sapiens
tacaggaggttgtggatg

SEQ ID NO: 5934375 - DNA, 15 bp, Homo sapiens
tacaggagtgagcac

SEQ ID NO: 5934376 - DNA, 23 bp, Homo sapiens
tacaggatatcacctgaattatt

SEQ ID NO: 5934377 - DNA, 19 bp, Homo sapiens
tacaggatggtgggcagga

SEQ ID NO: 5934378 - DNA, 22 bp, Homo sapiens
tacaggcaaaacacgcaagggc

SEQ ID NO: 5934379 - DNA, 14 bp, Homo sapiens
tacaggcacaaaat

SEQ ID NO: 5934380 - DNA, 14 bp, Homo sapiens
tacaggcaccgaga

SEQ ID NO: 5934381 - DNA, 13 bp, Homo sapiens
tacaggcatgagc

SEQ ID NO: 5934382 - DNA, 18 bp, Homo sapiens
tacaggcctttcaggaag

SEQ ID NO: 5934383 - DNA, 18 bp, Homo sapiens
tacaggcgctccaggcca

SEQ ID NO: 5934384 - DNA, 15 bp, Homo sapiens
tacaggcgtgagcca

SEQ ID NO: 5934385 - DNA, 16 bp, Homo sapiens
tacaggcgtgagccac

SEQ ID NO: 5934386 - DNA, 16 bp, Homo sapiens
tacaggctaaaattag

SEQ ID NO: 5934387 - DNA, 15 bp, Homo sapiens
tacaggctcctgcca

SEQ ID NO: 5934388 - DNA, 19 bp, Homo sapiens
tacaggctgagacacagcc

SEQ ID NO: 5934389 - DNA, 12 bp, Homo sapiens
tacaggctggcg

SEQ ID NO: 5934390 - DNA, 21 bp, Homo sapiens
tacaggctggcgcagaacgaa

SEQ ID NO: 5934391 - DNA, 19 bp, Homo sapiens
tacagggaactgggaagat

SEQ ID NO: 5934392 - DNA, 23 bp, Homo sapiens
tacagggagaaaatccaggtcat

SEQ ID NO: 5934393 - DNA, 17 bp, Homo sapiens
tacagggagcctcctgc

SEQ ID NO: 5934394 - DNA, 16 bp, Homo sapiens
tacagggaggctcccg

SEQ ID NO: 5934395 - DNA, 23 bp, Homo sapiens
tacagggcaaaagggcagctgtg

SEQ ID NO: 5934396 - DNA, 17 bp, Homo sapiens
tacagggcaggagctgc

SEQ ID NO: 5934397 - DNA, 21 bp, Homo sapiens
tacaggggaatattttattca

SEQ ID NO: 5934398 - DNA, 22 bp, Homo sapiens
tacaggggaatattttattcaa

SEQ ID NO: 5934399 - DNA, 22 bp, Homo sapiens
tacaggggagaaggaaatgcag

SEQ ID NO: 5934400 - DNA, 15 bp, Homo sapiens
tacaggggaggctga

SEQ ID NO: 5934401 - DNA, 23 bp, Homo sapiens
tacaggggaggggcgcaccccac

SEQ ID NO: 5934402 - DNA, 20 bp, Homo sapiens
tacaggggcagtgcctttgt

SEQ ID NO: 5934403 - DNA, 11 bp, Homo sapiens
tacaggggcca

SEQ ID NO: 5934404 - DNA, 13 bp, Homo sapiens
tacaggggccaga

SEQ ID NO: 5934405 - DNA, 15 bp, Homo sapiens
tacaggggccagaag

SEQ ID NO: 5934406 - DNA, 15 bp, Homo sapiens
tacaggggccatgcc

SEQ ID NO: 5934407 - DNA, 21 bp, Homo sapiens
tacaggggggtcggaagcctg

SEQ ID NO: 5934408 - DNA, 20 bp, Homo sapiens
tacagggtaactgtgctgaa

SEQ ID NO: 5934409 - DNA, 24 bp, Homo sapiens
tacagggtaactgtgctgaatgct

SEQ ID NO: 5934410 - DNA, 18 bp, Homo sapiens
tacagggtctcttccttc

SEQ ID NO: 5934411 - DNA, 13 bp, Homo sapiens
tacagggttttta

SEQ ID NO: 5934412 - DNA, 20 bp, Homo sapiens
tacaggtaacattataaatg

SEQ ID NO: 5934413 - DNA, 20 bp, Homo sapiens
tacaggtagtgggctcacaa

SEQ ID NO: 5934414 - DNA, 19 bp, Homo sapiens
tacaggtatcaggcacagg

SEQ ID NO: 5934415 - DNA, 23 bp, Homo sapiens
tacaggtcatattaatatatttc

SEQ ID NO: 5934416 - DNA, 23 bp, Homo sapiens
tacaggtgggatatgctagaaaa

SEQ ID NO: 5934417 - DNA, 18 bp, Homo sapiens
tacaggtgtgagccacca

SEQ ID NO: 5934418 - DNA, 16 bp, Homo sapiens
tacaggtgtgagtcac

SEQ ID NO: 5934419 - DNA, 15 bp, Homo sapiens
tacaggttacaacag

SEQ ID NO: 5934420 - DNA, 20 bp, Homo sapiens
tacagtaaaattaagtgtgt

SEQ ID NO: 5934421 - DNA, 22 bp, Homo sapiens
tacagtaaagaggcttccaagc

SEQ ID NO: 5934422 - DNA, 11 bp, Homo sapiens
tacagtaaagt

SEQ ID NO: 5934423 - DNA, 13 bp, Homo sapiens
tacagtaaagttt

SEQ ID NO: 5934424 - DNA, 17 bp, Homo sapiens
tacagtaaataaattgt

SEQ ID NO: 5934425 - DNA, 18 bp, Homo sapiens
tacagtaaataaattgtt

SEQ ID NO: 5934426 - DNA, 17 bp, Homo sapiens
tacagtaaatacactgt

SEQ ID NO: 5934427 - DNA, 19 bp, Homo sapiens
tacagtaaatacactgtga

SEQ ID NO: 5934428 - DNA, 21 bp, Homo sapiens
tacagtaaatgttacttctga

SEQ ID NO: 5934429 - DNA, 22 bp, Homo sapiens
tacagtaactaattttgttgaa

SEQ ID NO: 5934430 - DNA, 23 bp, Homo sapiens
tacagtaactgagtgtggcggga

SEQ ID NO: 5934431 - DNA, 17 bp, Homo sapiens
tacagtaactttatgtg

SEQ ID NO: 5934432 - DNA, 23 bp, Homo sapiens
tacagtaactttatgtgtaaata

SEQ ID NO: 5934433 - DNA, 14 bp, Homo sapiens
tacagtaagctgct

SEQ ID NO: 5934434 - DNA, 21 bp, Homo sapiens
tacagtaagctgctctattgt

SEQ ID NO: 5934435 - DNA, 18 bp, Homo sapiens
tacagtaagtaaagtggt

SEQ ID NO: 5934436 - DNA, 20 bp, Homo sapiens
tacagtaatatgtttaatgt

SEQ ID NO: 5934437 - DNA, 21 bp, Homo sapiens
tacagtaatcccatttcccaa

SEQ ID NO: 5934438 - DNA, 13 bp, Homo sapiens
tacagtaatgaaa

SEQ ID NO: 5934439 - DNA, 15 bp, Homo sapiens
tacagtaatgtcata

SEQ ID NO: 5934440 - DNA, 19 bp, Homo sapiens
tacagtaccttgttgcaga

SEQ ID NO: 5934441 - DNA, 20 bp, Homo sapiens
tacagtaccttgttgcagat

SEQ ID NO: 5934442 - DNA, 16 bp, Homo sapiens
tacagtactatgtaaa

SEQ ID NO: 5934443 - DNA, 12 bp, Homo sapiens
tacagtactgac

SEQ ID NO: 5934444 - DNA, 21 bp, Homo sapiens
tacagtagattttccaaatgt

SEQ ID NO: 5934445 - DNA, 20 bp, Homo sapiens
tacagtagctgtggggagct

SEQ ID NO: 5934446 - DNA, 23 bp, Homo sapiens
tacagtagctgtggggagctggt

SEQ ID NO: 5934447 - DNA, 18 bp, Homo sapiens
tacagtagcttaaataaa

SEQ ID NO: 5934448 - DNA, 21 bp, Homo sapiens
tacagtagcttaaataaattc

SEQ ID NO: 5934449 - DNA, 22 bp, Homo sapiens
tacagtagcttaaataaattca

SEQ ID NO: 5934450 - DNA, 23 bp, Homo sapiens
tacagtagcttaaataaattcaa

SEQ ID NO: 5934451 - DNA, 17 bp, Homo sapiens
tacatgactgggcctcc

SEQ ID NO: 5934452 - DNA, 16 bp, Homo sapiens
tacatgactgtttctt

SEQ ID NO: 5934453 - DNA, 21 bp, Homo sapiens
tacatgactgtttcttttgta

SEQ ID NO: 5934454 - DNA, 15 bp, Homo sapiens
tacatgactttcttt

SEQ ID NO: 5934455 - DNA, 14 bp, Homo sapiens
tacatgagaaagat

SEQ ID NO: 5934456 - DNA, 17 bp, Homo sapiens
tacatgagaacagactg

SEQ ID NO: 5934457 - DNA, 23 bp, Homo sapiens
tacatgaggaactgtagatgatg

SEQ ID NO: 5934458 - DNA, 14 bp, Homo sapiens
tacatgaggactct

SEQ ID NO: 5934459 - DNA, 21 bp, Homo sapiens
tacatgaggactctattcttt

SEQ ID NO: 5934460 - DNA, 23 bp, Homo sapiens
tacatgaggactctattctttaa

SEQ ID NO: 5934461 - DNA, 21 bp, Homo sapiens
tacatgaggtactgagagtga

SEQ ID NO: 5934462 - DNA, 13 bp, Homo sapiens
tacatgagttcaa

SEQ ID NO: 5934463 - DNA, 16 bp, Homo sapiens
tacatgagttcaaata

SEQ ID NO: 5934464 - DNA, 16 bp, Homo sapiens
tacatgataagacatt

SEQ ID NO: 5934465 - DNA, 17 bp, Homo sapiens
tacatgataagacattt

SEQ ID NO: 5934466 - DNA, 21 bp, Homo sapiens
tacatgataagacattttgtt

SEQ ID NO: 5934467 - DNA, 15 bp, Homo sapiens
tacatgattcatttt

SEQ ID NO: 5934468 - DNA, 17 bp, Homo sapiens
tacatgatttaaagact

SEQ ID NO: 5934469 - DNA, 22 bp, Homo sapiens
tacatgatttaaagactacaat

SEQ ID NO: 5934470 - DNA, 15 bp, Homo sapiens
tacatgcacagtcat

SEQ ID NO: 5934471 - DNA, 18 bp, Homo sapiens
tacatgcagctatttcaa

SEQ ID NO: 5934472 - DNA, 17 bp, Homo sapiens
tacatgcatacaaagag

SEQ ID NO: 5934473 - DNA, 19 bp, Homo sapiens
tacatgcatacttcaaaag

SEQ ID NO: 5934474 - DNA, 21 bp, Homo sapiens
tacatgcatacttcaaaagta

SEQ ID NO: 5934475 - DNA, 14 bp, Homo sapiens
tacatgcatataat

SEQ ID NO: 5934476 - DNA, 20 bp, Homo sapiens
tacatgcatataatgaataa

SEQ ID NO: 5934477 - DNA, 15 bp, Homo sapiens
tacatgcatgagcac

SEQ ID NO: 5934478 - DNA, 16 bp, Homo sapiens
tacatgcatgagcacc

SEQ ID NO: 5934479 - DNA, 17 bp, Homo sapiens
tacatgcatgagcacct

SEQ ID NO: 5934480 - DNA, 17 bp, Homo sapiens
tacatgccacatcaaac

SEQ ID NO: 5934481 - DNA, 16 bp, Homo sapiens
tacatgcctaccaata

SEQ ID NO: 5934482 - DNA, 17 bp, Homo sapiens
tacatgctaagagaagt

SEQ ID NO: 5934483 - DNA, 18 bp, Homo sapiens
tacatgctaagagaagta

SEQ ID NO: 5934484 - DNA, 13 bp, Homo sapiens
tacatgctacttt

SEQ ID NO: 5934485 - DNA, 20 bp, Homo sapiens
tacatgctatgctgaagaca

SEQ ID NO: 5934486 - DNA, 12 bp, Homo sapiens
tacatgctgcta

SEQ ID NO: 5934487 - DNA, 22 bp, Homo sapiens
tacatgctggttacctgttcca

SEQ ID NO: 5934488 - DNA, 17 bp, Homo sapiens
tacatgcttagaggggt

SEQ ID NO: 5934489 - DNA, 12 bp, Homo sapiens
tacatgcttatt

SEQ ID NO: 5934490 - DNA, 23 bp, Homo sapiens
tacatgcttattccatgactgct

SEQ ID NO: 5934491 - DNA, 16 bp, Homo sapiens
tacatggaaaggattt

SEQ ID NO: 5934492 - DNA, 19 bp, Homo sapiens
tacatggaattttttgaat

SEQ ID NO: 5934493 - DNA, 21 bp, Homo sapiens
tacatggaattttttgaatat

SEQ ID NO: 5934494 - DNA, 16 bp, Homo sapiens
tacatggacagaattt

SEQ ID NO: 5934495 - DNA, 17 bp, Homo sapiens
tacatggacagaatttt

SEQ ID NO: 5934496 - DNA, 15 bp, Homo sapiens
tacatggagctcagg

SEQ ID NO: 5934497 - DNA, 16 bp, Homo sapiens
tacatggagctcaggt

SEQ ID NO: 5934498 - DNA, 21 bp, Homo sapiens
tacatggcaacgtgtgaactg

SEQ ID NO: 5934499 - DNA, 16 bp, Homo sapiens
tacatggccagtgtga

SEQ ID NO: 5934500 - DNA, 19 bp, Homo sapiens
tacatggcgccctgcctcc

SEQ ID NO: 5934501 - DNA, 22 bp, Homo sapiens
tacatggcgtaccgtacacaga

SEQ ID NO: 5934502 - DNA, 21 bp, Homo sapiens
tacatggctggagctagaatt

SEQ ID NO: 5934503 - DNA, 23 bp, Homo sapiens
tacatggctggagctagaatttg

SEQ ID NO: 5934504 - DNA, 14 bp, Homo sapiens
tacatgggaagttg

SEQ ID NO: 5934505 - DNA, 15 bp, Homo sapiens
tacatgggccagccc

SEQ ID NO: 5934506 - DNA, 16 bp, Homo sapiens
tacatgggccagccct

SEQ ID NO: 5934507 - DNA, 17 bp, Homo sapiens
tacatgggccagccctt

SEQ ID NO: 5934508 - DNA, 20 bp, Homo sapiens
tacatgggtgttttgatctc

SEQ ID NO: 5934509 - DNA, 14 bp, Homo sapiens
tacatggtagcagg

SEQ ID NO: 5934510 - DNA, 13 bp, Homo sapiens
tacatggtattgt

SEQ ID NO: 5934511 - DNA, 17 bp, Homo sapiens
tacatggtgctgggaga

SEQ ID NO: 5934512 - DNA, 20 bp, Homo sapiens
tacatgtaaaaatgtttcct

SEQ ID NO: 5934513 - DNA, 15 bp, Homo sapiens
tacatgtaaagctgt

SEQ ID NO: 5934514 - DNA, 22 bp, Homo sapiens
tacatgtaaagctgttaaaata

SEQ ID NO: 5934515 - DNA, 14 bp, Homo sapiens
tacatgtaatgaca

SEQ ID NO: 5934516 - DNA, 23 bp, Homo sapiens
tacatgtacatagtaaagtattt

SEQ ID NO: 5934517 - DNA, 18 bp, Homo sapiens
tacatgtacctatagaaa

SEQ ID NO: 5934518 - DNA, 22 bp, Homo sapiens
tacatgtagagatttgagtgca

SEQ ID NO: 5934519 - DNA, 16 bp, Homo sapiens
tacatgtataaagtga

SEQ ID NO: 5934520 - DNA, 21 bp, Homo sapiens
tacatgtataaagtgattgac

SEQ ID NO: 5934521 - DNA, 14 bp, Homo sapiens
tacatgtatagtga

SEQ ID NO: 5934522 - DNA, 14 bp, Homo sapiens
tacatgtatggtta

SEQ ID NO: 5934523 - DNA, 23 bp, Homo sapiens
tacatgtattaaattacatttgt

SEQ ID NO: 5934524 - DNA, 19 bp, Homo sapiens
tacatgtattgcacattgt

SEQ ID NO: 5934525 - DNA, 23 bp, Homo sapiens
tacatgtcatttgactgtctcac

SEQ ID NO: 5934526 - DNA, 21 bp, Homo sapiens
tacatgtgagatagttttcat

SEQ ID NO: 5934527 - DNA, 16 bp, Homo sapiens
tacatgtgatacattt

SEQ ID NO: 5934528 - DNA, 17 bp, Homo sapiens
tacatgtgatacatttt

SEQ ID NO: 5934529 - DNA, 18 bp, Homo sapiens
tacatgtgatacattttt

SEQ ID NO: 5934530 - DNA, 19 bp, Homo sapiens
tacatgtgatacatttttt

SEQ ID NO: 5934531 - DNA, 21 bp, Homo sapiens
tacatgtggaaaactcacaga

SEQ ID NO: 5934532 - DNA, 14 bp, Homo sapiens
tacatgtgtaaagg

SEQ ID NO: 5934533 - DNA, 16 bp, Homo sapiens
tacatgtgtaaaggtt

SEQ ID NO: 5934534 - DNA, 14 bp, Homo sapiens
tacatgtgtacata

SEQ ID NO: 5934535 - DNA, 19 bp, Homo sapiens
tacatgtgtacatatatgt

SEQ ID NO: 5934536 - DNA, 18 bp, Homo sapiens
tacatgtgtatattcctt

SEQ ID NO: 5934537 - DNA, 19 bp, Homo sapiens
tacatgtgtatattccttt

SEQ ID NO: 5934538 - DNA, 13 bp, Homo sapiens
tacatgtgtgtat

SEQ ID NO: 5934539 - DNA, 19 bp, Homo sapiens
tacatgtgtgtatatatgt

SEQ ID NO: 5934540 - DNA, 21 bp, Homo sapiens
tacatgtgtgtatatatgtgt

SEQ ID NO: 5934541 - DNA, 21 bp, Homo sapiens
tacatgtgtttattcatccag

SEQ ID NO: 5934542 - DNA, 19 bp, Homo sapiens
tacatgttattgttttcaa

SEQ ID NO: 5934543 - DNA, 15 bp, Homo sapiens
tacatgttcccaaaa

SEQ ID NO: 5934544 - DNA, 15 bp, Homo sapiens
tacatgttcctttgt

SEQ ID NO: 5934545 - DNA, 17 bp, Homo sapiens
tacatgttcctttgtaa

SEQ ID NO: 5934546 - DNA, 15 bp, Homo sapiens
tacatgttcttgtca

SEQ ID NO: 5934547 - DNA, 22 bp, Homo sapiens
tacatgttcttgtcataaaatg

SEQ ID NO: 5934548 - DNA, 23 bp, Homo sapiens
tacatgttcttgtcataaaatgc

SEQ ID NO: 5934549 - DNA, 12 bp, Homo sapiens
tacatgttcttt

SEQ ID NO: 5934550 - DNA, 14 bp, Homo sapiens
tacatgttgatact

SEQ ID NO: 5934551 - DNA, 17 bp, Homo sapiens
tacatgttggaaatgtg

SEQ ID NO: 5934552 - DNA, 18 bp, Homo sapiens
tacatgttggaaatgtgt

SEQ ID NO: 5934553 - DNA, 16 bp, Homo sapiens
tacatgttgtaaatgg

SEQ ID NO: 5934554 - DNA, 14 bp, Homo sapiens
tacatgttgtatta

SEQ ID NO: 5934555 - DNA, 15 bp, Homo sapiens
tacatgtttccatca

SEQ ID NO: 5934556 - DNA, 22 bp, Homo sapiens
tacatgtttgcacctttctagt

SEQ ID NO: 5934557 - DNA, 16 bp, Homo sapiens
tacattaaaaagcctt

SEQ ID NO: 5934558 - DNA, 21 bp, Homo sapiens
tacattaaaagctttagattg

SEQ ID NO: 5934559 - DNA, 17 bp, Homo sapiens
tacattaaaataactaa

SEQ ID NO: 5934560 - DNA, 21 bp, Homo sapiens
tacattaaaatagcacatgat

SEQ ID NO: 5934561 - DNA, 15 bp, Homo sapiens
tacattaaacaatga

SEQ ID NO: 5934562 - DNA, 14 bp, Homo sapiens
tacattaaacatga

SEQ ID NO: 5934563 - DNA, 20 bp, Homo sapiens
tacattaaataccagccagc

SEQ ID NO: 5934564 - DNA, 22 bp, Homo sapiens
tacattaacgacccactctgct

SEQ ID NO: 5934565 - DNA, 14 bp, Homo sapiens
tacattaacggtgc

SEQ ID NO: 5934566 - DNA, 15 bp, Homo sapiens
tacattaacttgaaa

SEQ ID NO: 5934567 - DNA, 22 bp, Homo sapiens
tacattaatgtcctcttgctgt

SEQ ID NO: 5934568 - DNA, 15 bp, Homo sapiens
tacattaatgttaat

SEQ ID NO: 5934569 - DNA, 18 bp, Homo sapiens
tacattacaaatttctgt

SEQ ID NO: 5934570 - DNA, 13 bp, Homo sapiens
tacattacagatt

SEQ ID NO: 5934571 - DNA, 15 bp, Homo sapiens
tacattacatgtaaa

SEQ ID NO: 5934572 - DNA, 16 bp, Homo sapiens
tacattagacacacat

SEQ ID NO: 5934573 - DNA, 21 bp, Homo sapiens
tacattagacacacatataca

SEQ ID NO: 5934574 - DNA, 19 bp, Homo sapiens
tacattagcagtttgcttt

SEQ ID NO: 5934575 - DNA, 20 bp, Homo sapiens
tacattagcagtttgctttg

SEQ ID NO: 5934576 - DNA, 14 bp, Homo sapiens
tacattagtaaatg

SEQ ID NO: 5934577 - DNA, 15 bp, Homo sapiens
tacattagtaaatgt

SEQ ID NO: 5934578 - DNA, 18 bp, Homo sapiens
tacattagtaaatgtctt

SEQ ID NO: 5934579 - DNA, 21 bp, Homo sapiens
tacattagtaaatgtctttgt

SEQ ID NO: 5934580 - DNA, 16 bp, Homo sapiens
tacattagtgagattt

SEQ ID NO: 5934581 - DNA, 18 bp, Homo sapiens
tacattataccgcagagt

SEQ ID NO: 5934582 - DNA, 13 bp, Homo sapiens
tacattatgcaaa

SEQ ID NO: 5934583 - DNA, 19 bp, Homo sapiens
tacattattaaacgatttc

SEQ ID NO: 5934584 - DNA, 21 bp, Homo sapiens
tacattattaatcattccatt

SEQ ID NO: 5934585 - DNA, 22 bp, Homo sapiens
tacattattaatcattccattt

SEQ ID NO: 5934586 - DNA, 16 bp, Homo sapiens
tacattattagaatat

SEQ ID NO: 5934587 - DNA, 15 bp, Homo sapiens
tacattatttctgta

SEQ ID NO: 5934588 - DNA, 17 bp, Homo sapiens
tacattatttctgtata

SEQ ID NO: 5934589 - DNA, 18 bp, Homo sapiens
tacattcaaattcttttt

SEQ ID NO: 5934590 - DNA, 15 bp, Homo sapiens
tacattcaaatttgt

SEQ ID NO: 5934591 - DNA, 17 bp, Homo sapiens
tacattcaaatttgtct

SEQ ID NO: 5934592 - DNA, 21 bp, Homo sapiens
tacattcaaatttgtctggtt

SEQ ID NO: 5934593 - DNA, 23 bp, Homo sapiens
tacattcaacttttctaagaaaa

SEQ ID NO: 5934594 - DNA, 15 bp, Homo sapiens
tacattcaatgttta

SEQ ID NO: 5934595 - DNA, 17 bp, Homo sapiens
tacattcatctggaggc

SEQ ID NO: 5934596 - DNA, 16 bp, Homo sapiens
tacattccaaagaaac

SEQ ID NO: 5934597 - DNA, 14 bp, Homo sapiens
tacattccaactcg

SEQ ID NO: 5934598 - DNA, 15 bp, Homo sapiens
tacattccaccctgt

SEQ ID NO: 5934599 - DNA, 20 bp, Homo sapiens
tacattccaccctgttactt

SEQ ID NO: 5934600 - DNA, 22 bp, Homo sapiens
tacattccagtagccagtatct

SEQ ID NO: 5934601 - DNA, 17 bp, Homo sapiens
tacattccccagagtgg

SEQ ID NO: 5934602 - DNA, 12 bp, Homo sapiens
tacattccctat

SEQ ID NO: 5934603 - DNA, 17 bp, Homo sapiens
tacattccctatcaaaa

SEQ ID NO: 5934604 - DNA, 18 bp, Homo sapiens
tacattccctatcaaaac

SEQ ID NO: 5934605 - DNA, 17 bp, Homo sapiens
tacattccctctcctgc

SEQ ID NO: 5934606 - DNA, 16 bp, Homo sapiens
tacattccctggcctg

SEQ ID NO: 5934607 - DNA, 17 bp, Homo sapiens
tacattcctaactagaa

SEQ ID NO: 5934608 - DNA, 21 bp, Homo sapiens
tacattcctaactagaattag

SEQ ID NO: 5934609 - DNA, 17 bp, Homo sapiens
tacattcctcagctgcc

SEQ ID NO: 5934610 - DNA, 13 bp, Homo sapiens
tacattcctgaga

SEQ ID NO: 5934611 - DNA, 22 bp, Homo sapiens
tacattcctgagattctgggaa

SEQ ID NO: 5934612 - DNA, 22 bp, Homo sapiens
tacattccttgataatgttgtg

SEQ ID NO: 5934613 - DNA, 22 bp, Homo sapiens
tacattcgaaggaacctgtgtt

SEQ ID NO: 5934614 - DNA, 22 bp, Homo sapiens
tacattctaatttgcattgtgt

SEQ ID NO: 5934615 - DNA, 15 bp, Homo sapiens
tacattctcagtttt

SEQ ID NO: 5934616 - DNA, 17 bp, Homo sapiens
tacattctcagtttttc

SEQ ID NO: 5934617 - DNA, 21 bp, Homo sapiens
tacattctcagtttttcttaa

SEQ ID NO: 5934618 - DNA, 17 bp, Homo sapiens
tacattctgctctgccc

SEQ ID NO: 5934619 - DNA, 20 bp, Homo sapiens
tacattctgctctgcccatg

SEQ ID NO: 5934620 - DNA, 23 bp, Homo sapiens
tacattctgctctgcccatgcct

SEQ ID NO: 5934621 - DNA, 19 bp, Homo sapiens
tacattcttccatcatcac

SEQ ID NO: 5934622 - DNA, 21 bp, Homo sapiens
tacattcttgctctgctcatc

SEQ ID NO: 5934623 - DNA, 15 bp, Homo sapiens
tacattctttgctag

SEQ ID NO: 5934624 - DNA, 21 bp, Homo sapiens
tacattctttttgctctaaaa

SEQ ID NO: 5934625 - DNA, 22 bp, Homo sapiens
tacattctttttgctctaaaat

SEQ ID NO: 5934626 - DNA, 12 bp, Homo sapiens
tacattgaaaac

SEQ ID NO: 5934627 - DNA, 22 bp, Homo sapiens
taccattattttacagtctctg

SEQ ID NO: 5934628 - DNA, 17 bp, Homo sapiens
taccattcacaataaaa

SEQ ID NO: 5934629 - DNA, 22 bp, Homo sapiens
taccattcagttaattcaatgt

SEQ ID NO: 5934630 - DNA, 19 bp, Homo sapiens
taccattccttcaaataaa

SEQ ID NO: 5934631 - DNA, 22 bp, Homo sapiens
taccattctattctccagacat

SEQ ID NO: 5934632 - DNA, 20 bp, Homo sapiens
taccattggaaatttcacgt

SEQ ID NO: 5934633 - DNA, 15 bp, Homo sapiens
taccattgtcactcg

SEQ ID NO: 5934634 - DNA, 17 bp, Homo sapiens
taccatttacatgtttt

SEQ ID NO: 5934635 - DNA, 15 bp, Homo sapiens
taccatttatacaaa

SEQ ID NO: 5934636 - DNA, 21 bp, Homo sapiens
taccatttcaaatatttacag

SEQ ID NO: 5934637 - DNA, 12 bp, Homo sapiens
taccatttcaat

SEQ ID NO: 5934638 - DNA, 15 bp, Homo sapiens
taccatttcagagag

SEQ ID NO: 5934639 - DNA, 13 bp, Homo sapiens
taccatttcagta

SEQ ID NO: 5934640 - DNA, 19 bp, Homo sapiens
taccatttccgtaattctt

SEQ ID NO: 5934641 - DNA, 22 bp, Homo sapiens
taccatttccgtaattcttatt

SEQ ID NO: 5934642 - DNA, 22 bp, Homo sapiens
taccatttgtaataaagtatat

SEQ ID NO: 5934643 - DNA, 23 bp, Homo sapiens
taccatttgtaataaagtatata

SEQ ID NO: 5934644 - DNA, 14 bp, Homo sapiens
taccatttgtgtct

SEQ ID NO: 5934645 - DNA, 19 bp, Homo sapiens
taccattttaacgctgcct

SEQ ID NO: 5934646 - DNA, 15 bp, Homo sapiens
taccattttctggtt

SEQ ID NO: 5934647 - DNA, 16 bp, Homo sapiens
taccattttgaaatat

SEQ ID NO: 5934648 - DNA, 22 bp, Homo sapiens
taccatttttttttaacactgt

SEQ ID NO: 5934649 - DNA, 23 bp, Homo sapiens
taccatttttttttaacactgtc

SEQ ID NO: 5934650 - DNA, 15 bp, Homo sapiens
tacccaaaacacatt

SEQ ID NO: 5934651 - DNA, 18 bp, Homo sapiens
tacccaaaacacattttc

SEQ ID NO: 5934652 - DNA, 20 bp, Homo sapiens
tacccaaaaccctgaagcca

SEQ ID NO: 5934653 - DNA, 17 bp, Homo sapiens
tacccaaaagagaaaaa

SEQ ID NO: 5934654 - DNA, 15 bp, Homo sapiens
tacccaaactgcttt

SEQ ID NO: 5934655 - DNA, 23 bp, Homo sapiens
tacccaaagcacatgcttagctt

SEQ ID NO: 5934656 - DNA, 11 bp, Homo sapiens
tacccaaagga

SEQ ID NO: 5934657 - DNA, 22 bp, Homo sapiens
tacccaaaggatactgtaacac

SEQ ID NO: 5934658 - DNA, 19 bp, Homo sapiens
tacccaaccaaagatgctt

SEQ ID NO: 5934659 - DNA, 23 bp, Homo sapiens
tacccaaccagggccccggggcc

SEQ ID NO: 5934660 - DNA, 19 bp, Homo sapiens
tacccaaccccagatgccc

SEQ ID NO: 5934661 - DNA, 12 bp, Homo sapiens
tacccaagcaaa

SEQ ID NO: 5934662 - DNA, 14 bp, Homo sapiens
tacccaagctgtgg

SEQ ID NO: 5934663 - DNA, 21 bp, Homo sapiens
tacccaaggatttttaaaact

SEQ ID NO: 5934664 - DNA, 22 bp, Homo sapiens
tacccaaggatttttaaaactc

SEQ ID NO: 5934665 - DNA, 22 bp, Homo sapiens
tacccaataggtaatttttcat

SEQ ID NO: 5934666 - DNA, 13 bp, Homo sapiens
tacccaatttccc

SEQ ID NO: 5934667 - DNA, 16 bp, Homo sapiens
tacccacaatctgagc

SEQ ID NO: 5934668 - DNA, 17 bp, Homo sapiens
tacccacaatctgagca

SEQ ID NO: 5934669 - DNA, 16 bp, Homo sapiens
tacccacacattccag

SEQ ID NO: 5934670 - DNA, 20 bp, Homo sapiens
tacccacacattccagggct

SEQ ID NO: 5934671 - DNA, 21 bp, Homo sapiens
tacccacaggtgaggggcagg

SEQ ID NO: 5934672 - DNA, 12 bp, Homo sapiens
tacccacccaga

SEQ ID NO: 5934673 - DNA, 19 bp, Homo sapiens
tacccaccccagcacagcc

SEQ ID NO: 5934674 - DNA, 17 bp, Homo sapiens
tacccacccgacctggc

SEQ ID NO: 5934675 - DNA, 20 bp, Homo sapiens
tacccacccgacctggctgc

SEQ ID NO: 5934676 - DNA, 22 bp, Homo sapiens
tacccaccctaatttgcccttc

SEQ ID NO: 5934677 - DNA, 19 bp, Homo sapiens
tacccacccttacttcctg

SEQ ID NO: 5934678 - DNA, 21 bp, Homo sapiens
tacccaccgatggagccccca

SEQ ID NO: 5934679 - DNA, 20 bp, Homo sapiens
tacccaccgggccactcctt

SEQ ID NO: 5934680 - DNA, 22 bp, Homo sapiens
tacccacctagaacactaactc

SEQ ID NO: 5934681 - DNA, 23 bp, Homo sapiens
tacccacctgagctttggacaca

SEQ ID NO: 5934682 - DNA, 21 bp, Homo sapiens
tacccacgttctcacacccac

SEQ ID NO: 5934683 - DNA, 17 bp, Homo sapiens
tacccactatgcacaga

SEQ ID NO: 5934684 - DNA, 12 bp, Homo sapiens
tacccactgcat

SEQ ID NO: 5934685 - DNA, 15 bp, Homo sapiens
tacccactgctctgg

SEQ ID NO: 5934686 - DNA, 15 bp, Homo sapiens
tacccacttccctgc

SEQ ID NO: 5934687 - DNA, 14 bp, Homo sapiens
tacccagaaagtta

SEQ ID NO: 5934688 - DNA, 16 bp, Homo sapiens
tacccagaaccttttt

SEQ ID NO: 5934689 - DNA, 22 bp, Homo sapiens
tacccagaatgtcagattcctt

SEQ ID NO: 5934690 - DNA, 20 bp, Homo sapiens
tacccagagaatatatacat

SEQ ID NO: 5934691 - DNA, 21 bp, Homo sapiens
tacccagagatatctatgaaa

SEQ ID NO: 5934692 - DNA, 15 bp, Homo sapiens
tacccagagccttct

SEQ ID NO: 5934693 - DNA, 20 bp, Homo sapiens
tacccagagccttctcctgc

SEQ ID NO: 5934694 - DNA, 22 bp, Homo sapiens
tacccagagccttctcctgcct

SEQ ID NO: 5934695 - DNA, 21 bp, Homo sapiens
tacccagatgttttatttatg

SEQ ID NO: 5934696 - DNA, 17 bp, Homo sapiens
tacccagattgtgtaca

SEQ ID NO: 5934697 - DNA, 14 bp, Homo sapiens
tacccagccacctt

SEQ ID NO: 5934698 - DNA, 16 bp, Homo sapiens
tacccagccatctgcc

SEQ ID NO: 5934699 - DNA, 19 bp, Homo sapiens
tacccagccatctgcccag

SEQ ID NO: 5934700 - DNA, 14 bp, Homo sapiens
tacccagcccatct

SEQ ID NO: 5934701 - DNA, 22 bp, Homo sapiens
tacccagcgtggcccaggccgg

SEQ ID NO: 5934702 - DNA, 20 bp, Homo sapiens
tacccaggctggagtgcagt

SEQ ID NO: 5934703 - DNA, 15 bp, Homo sapiens
tacccagggccagcc

SEQ ID NO: 5934704 - DNA, 16 bp, Homo sapiens
tacccagggcctgcag

SEQ ID NO: 5934705 - DNA, 17 bp, Homo sapiens
tacccagggctctgcag

SEQ ID NO: 5934706 - DNA, 15 bp, Homo sapiens
tacccaggtgggtcc

SEQ ID NO: 5934707 - DNA, 20 bp, Homo sapiens
tacccagtattactgctgct

SEQ ID NO: 5934708 - DNA, 22 bp, Homo sapiens
tacccagtttctaaactggaga

SEQ ID NO: 5934709 - DNA, 12 bp, Homo sapiens
tacccataaaca

SEQ ID NO: 5934710 - DNA, 20 bp, Homo sapiens
tacccataaacagcacacct

SEQ ID NO: 5934711 - DNA, 22 bp, Homo sapiens
tacccataaacagcacacctgt

SEQ ID NO: 5934712 - DNA, 23 bp, Homo sapiens
tacccataaacagcacacctgtg

SEQ ID NO: 5934713 - DNA, 16 bp, Homo sapiens
tacccatacaccccct

SEQ ID NO: 5934714 - DNA, 16 bp, Homo sapiens
tacccatagacatgaa

SEQ ID NO: 5934715 - DNA, 18 bp, Homo sapiens
tacccatagacatgaaag

SEQ ID NO: 5934716 - DNA, 15 bp, Homo sapiens
tacccatatcccctc

SEQ ID NO: 5934717 - DNA, 21 bp, Homo sapiens
tacccatccatcacccatctc

SEQ ID NO: 5934718 - DNA, 17 bp, Homo sapiens
tacccatccccgcagtg

SEQ ID NO: 5934719 - DNA, 19 bp, Homo sapiens
tacccatctaggaaagaaa

SEQ ID NO: 5934720 - DNA, 23 bp, Homo sapiens
tacccatcttgcttccaagacca

SEQ ID NO: 5934721 - DNA, 13 bp, Homo sapiens
tacccatgagcct

SEQ ID NO: 5934722 - DNA, 17 bp, Homo sapiens
tacccatgagcctgccc

SEQ ID NO: 5934723 - DNA, 14 bp, Homo sapiens
tacccatgcacagt

SEQ ID NO: 5934724 - DNA, 19 bp, Homo sapiens
tacccatgttacttctctg

SEQ ID NO: 5934725 - DNA, 20 bp, Homo sapiens
tacccatgttacttctctga

SEQ ID NO: 5934726 - DNA, 17 bp, Homo sapiens
tacccatgttgggaaaa

SEQ ID NO: 5934727 - DNA, 14 bp, Homo sapiens
tacccattcaacca

SEQ ID NO: 5934728 - DNA, 16 bp, Homo sapiens
tacccattctgttttc

SEQ ID NO: 5934729 - DNA, 18 bp, Homo sapiens
tacccattgttcccttcc

SEQ ID NO: 5934730 - DNA, 23 bp, Homo sapiens
tacccatttgaaagaatattagt

SEQ ID NO: 5934731 - DNA, 14 bp, Homo sapiens
taccccaaggccag

SEQ ID NO: 5934732 - DNA, 18 bp, Homo sapiens
taccccaatttcggattt

SEQ ID NO: 5934733 - DNA, 17 bp, Homo sapiens
taccccacaacacgcct

SEQ ID NO: 5934734 - DNA, 11 bp, Homo sapiens
taccccacaca

SEQ ID NO: 5934735 - DNA, 16 bp, Homo sapiens
taccccacaccagcct

SEQ ID NO: 5934736 - DNA, 18 bp, Homo sapiens
taccccacctcatgcctg

SEQ ID NO: 5934737 - DNA, 23 bp, Homo sapiens
taccccacctccctcaacctcat

SEQ ID NO: 5934738 - DNA, 16 bp, Homo sapiens
taccccacctgacctc

SEQ ID NO: 5934739 - DNA, 12 bp, Homo sapiens
taccccagccag

SEQ ID NO: 5934740 - DNA, 17 bp, Homo sapiens
taccccagccaggctcc

SEQ ID NO: 5934741 - DNA, 20 bp, Homo sapiens
taccccagcctacccttcct

SEQ ID NO: 5934742 - DNA, 16 bp, Homo sapiens
taccccagctctgctt

SEQ ID NO: 5934743 - DNA, 18 bp, Homo sapiens
taccccagctctgcttgc

SEQ ID NO: 5934744 - DNA, 19 bp, Homo sapiens
taccccaggatgcatgcag

SEQ ID NO: 5934745 - DNA, 16 bp, Homo sapiens
taccccagggccctgg

SEQ ID NO: 5934746 - DNA, 18 bp, Homo sapiens
taccccagggccctggcc

SEQ ID NO: 5934747 - DNA, 23 bp, Homo sapiens
taccccagttcatctctgctgaa

SEQ ID NO: 5934748 - DNA, 18 bp, Homo sapiens
taccccagttcctagcac

SEQ ID NO: 5934749 - DNA, 16 bp, Homo sapiens
taccccagttttttga

SEQ ID NO: 5934750 - DNA, 13 bp, Homo sapiens
taccccatacccc

SEQ ID NO: 5934751 - DNA, 19 bp, Homo sapiens
taccccataccccttattg

SEQ ID NO: 5934752 - DNA, 20 bp, Homo sapiens
taccccataccccttattgc

SEQ ID NO: 5934753 - DNA, 21 bp, Homo sapiens
taccccataccccttattgct

SEQ ID NO: 5934754 - DNA, 13 bp, Homo sapiens
taccccatatatt

SEQ ID NO: 5934755 - DNA, 17 bp, Homo sapiens
tacccccaacaccaccc

SEQ ID NO: 5934756 - DNA, 15 bp, Homo sapiens
tacccccaaccctca

SEQ ID NO: 5934757 - DNA, 12 bp, Homo sapiens
tacccccaacct

SEQ ID NO: 5934758 - DNA, 16 bp, Homo sapiens
tacccccaacctcatt

SEQ ID NO: 5934759 - DNA, 21 bp, Homo sapiens
tacccccaggtggaaggcaga

SEQ ID NO: 5934760 - DNA, 17 bp, Homo sapiens
taccccccaacccctga

SEQ ID NO: 5934761 - DNA, 15 bp, Homo sapiens
taccccccaccttgg

SEQ ID NO: 5934762 - DNA, 19 bp, Homo sapiens
taccccccctcctgctgcc

SEQ ID NO: 5934763 - DNA, 16 bp, Homo sapiens
tacccccgcccaggct

SEQ ID NO: 5934764 - DNA, 20 bp, Homo sapiens
tacccccgtggtctttgaat

SEQ ID NO: 5934765 - DNA, 16 bp, Homo sapiens
taccccctaagagcca

SEQ ID NO: 5934766 - DNA, 17 bp, Homo sapiens
taccccctcctctctgc

SEQ ID NO: 5934767 - DNA, 16 bp, Homo sapiens
taccccctccttcaga

SEQ ID NO: 5934768 - DNA, 19 bp, Homo sapiens
taccccctcttcaaagcag

SEQ ID NO: 5934769 - DNA, 23 bp, Homo sapiens
taccccctgcaaagcccagcttg

SEQ ID NO: 5934770 - DNA, 17 bp, Homo sapiens
tacccccttctgggcat

SEQ ID NO: 5934771 - DNA, 19 bp, Homo sapiens
tacccccttgtctgctgct

SEQ ID NO: 5934772 - DNA, 17 bp, Homo sapiens
taccccgcagacacctt

SEQ ID NO: 5934773 - DNA, 19 bp, Homo sapiens
taccccgggctgggcccct

SEQ ID NO: 5934774 - DNA, 18 bp, Homo sapiens
taccccgtccctttccct

SEQ ID NO: 5934775 - DNA, 22 bp, Homo sapiens
tacccctaaaaagattgccaat

SEQ ID NO: 5934776 - DNA, 19 bp, Homo sapiens
tacccctcaaactgcacat

SEQ ID NO: 5934777 - DNA, 10 bp, Homo sapiens
tacccctccc

SEQ ID NO: 5934778 - DNA, 14 bp, Homo sapiens
tacccctcccagct

SEQ ID NO: 5934779 - DNA, 22 bp, Homo sapiens
tacccctcccggccctgcctgc

SEQ ID NO: 5934780 - DNA, 23 bp, Homo sapiens
tacccctcccggccctgcctgct

SEQ ID NO: 5934781 - DNA, 18 bp, Homo sapiens
tacccctcgactcagcac

SEQ ID NO: 5934782 - DNA, 20 bp, Homo sapiens
tacccctcgactcagcacca

SEQ ID NO: 5934783 - DNA, 19 bp, Homo sapiens
tacccctgacttctgttta

SEQ ID NO: 5934784 - DNA, 13 bp, Homo sapiens
tacccctgatctg

SEQ ID NO: 5934785 - DNA, 14 bp, Homo sapiens
tacccctgcagctg

SEQ ID NO: 5934786 - DNA, 12 bp, Homo sapiens
tacccctggctg

SEQ ID NO: 5934787 - DNA, 13 bp, Homo sapiens
tacccctggctgt

SEQ ID NO: 5934788 - DNA, 18 bp, Homo sapiens
tacccctggctgtactgc

SEQ ID NO: 5934789 - DNA, 13 bp, Homo sapiens
tacccctgtcctg

SEQ ID NO: 5934790 - DNA, 18 bp, Homo sapiens
taccccttacttagcatg

SEQ ID NO: 5934791 - DNA, 14 bp, Homo sapiens
taccccttattgct

SEQ ID NO: 5934792 - DNA, 17 bp, Homo sapiens
taccccttattgctgcc

SEQ ID NO: 5934793 - DNA, 20 bp, Homo sapiens
taccccttattgctgccaaa

SEQ ID NO: 5934794 - DNA, 14 bp, Homo sapiens
taccccttcatgtc

SEQ ID NO: 5934795 - DNA, 14 bp, Homo sapiens
tacccctttcttct

SEQ ID NO: 5934796 - DNA, 21 bp, Homo sapiens
tacccgaaagcatcactgcct

SEQ ID NO: 5934797 - DNA, 23 bp, Homo sapiens
tacccgaaagcatcactgccttg

SEQ ID NO: 5934798 - DNA, 19 bp, Homo sapiens
tacccgagcccagctacat

SEQ ID NO: 5934799 - DNA, 21 bp, Homo sapiens
tacccgctacaattctgcaga

SEQ ID NO: 5934800 - DNA, 16 bp, Homo sapiens
tacccgctgtggccgg

SEQ ID NO: 5934801 - DNA, 22 bp, Homo sapiens
tacccggcccagagaccccttc

SEQ ID NO: 5934802 - DNA, 19 bp, Homo sapiens
tacccggtggcttctggca

SEQ ID NO: 5934803 - DNA, 18 bp, Homo sapiens
tacctcaattttcactgt

SEQ ID NO: 5934804 - DNA, 15 bp, Homo sapiens
tacctcactggggtc

SEQ ID NO: 5934805 - DNA, 14 bp, Homo sapiens
tacctcactgtcca

SEQ ID NO: 5934806 - DNA, 16 bp, Homo sapiens
tacctcagccctggcc

SEQ ID NO: 5934807 - DNA, 11 bp, Homo sapiens
tacctcagcct

SEQ ID NO: 5934808 - DNA, 15 bp, Homo sapiens
tacctcagcctgggc

SEQ ID NO: 5934809 - DNA, 21 bp, Homo sapiens
tacctcagcctgggcgctggt

SEQ ID NO: 5934810 - DNA, 14 bp, Homo sapiens
tacctcaggcagga

SEQ ID NO: 5934811 - DNA, 15 bp, Homo sapiens
tacctcaggcaggaa

SEQ ID NO: 5934812 - DNA, 18 bp, Homo sapiens
tacctcaggtgccaaccc

SEQ ID NO: 5934813 - DNA, 17 bp, Homo sapiens
tacctcaggtgtgcctg

SEQ ID NO: 5934814 - DNA, 12 bp, Homo sapiens
tacctcaggttg

SEQ ID NO: 5934815 - DNA, 14 bp, Homo sapiens
tacctcaggttgct

SEQ ID NO: 5934816 - DNA, 18 bp, Homo sapiens
tacctcagtgctcctgga

SEQ ID NO: 5934817 - DNA, 10 bp, Homo sapiens
tacctcagtt

SEQ ID NO: 5934818 - DNA, 17 bp, Homo sapiens
tacctcagttccacggt

SEQ ID NO: 5934819 - DNA, 17 bp, Homo sapiens
tacctcatcatccaccc

SEQ ID NO: 5934820 - DNA, 18 bp, Homo sapiens
tacctcatcatccacccg

SEQ ID NO: 5934821 - DNA, 16 bp, Homo sapiens
tacctcatctctgaaa

SEQ ID NO: 5934822 - DNA, 17 bp, Homo sapiens
tacctcatgccgctgtg

SEQ ID NO: 5934823 - DNA, 15 bp, Homo sapiens
tacctcatgggacag

SEQ ID NO: 5934824 - DNA, 12 bp, Homo sapiens
tacctcatgttt

SEQ ID NO: 5934825 - DNA, 17 bp, Homo sapiens
tacctcatgtttatgaa

SEQ ID NO: 5934826 - DNA, 23 bp, Homo sapiens
tacctcatttttcatactgaaaa

SEQ ID NO: 5934827 - DNA, 20 bp, Homo sapiens
tacctccaacagaactaaat

SEQ ID NO: 5934828 - DNA, 15 bp, Homo sapiens
tacctccaccctgca

SEQ ID NO: 5934829 - DNA, 22 bp, Homo sapiens
tacctccaccctgcattttcct

SEQ ID NO: 5934830 - DNA, 18 bp, Homo sapiens
tacctccagtcacactcc

SEQ ID NO: 5934831 - DNA, 22 bp, Homo sapiens
tacctccagtcacactccccgc

SEQ ID NO: 5934832 - DNA, 21 bp, Homo sapiens
tacctccatccatccttccaa

SEQ ID NO: 5934833 - DNA, 17 bp, Homo sapiens
tacctcccacactccca

SEQ ID NO: 5934834 - DNA, 13 bp, Homo sapiens
tacctcccacctt

SEQ ID NO: 5934835 - DNA, 22 bp, Homo sapiens
tacctcccctgccagggctcgg

SEQ ID NO: 5934836 - DNA, 14 bp, Homo sapiens
tacctccccttttc

SEQ ID NO: 5934837 - DNA, 23 bp, Homo sapiens
tacctccccttttctatgttgct

SEQ ID NO: 5934838 - DNA, 12 bp, Homo sapiens
tacctccctccc

SEQ ID NO: 5934839 - DNA, 14 bp, Homo sapiens
tacctccctccctc

SEQ ID NO: 5934840 - DNA, 15 bp, Homo sapiens
tacctccctccctct

SEQ ID NO: 5934841 - DNA, 14 bp, Homo sapiens
tacctccctcctca

SEQ ID NO: 5934842 - DNA, 16 bp, Homo sapiens
tacctccctcctcagg

SEQ ID NO: 5934843 - DNA, 15 bp, Homo sapiens
tacctcccttgcctt

SEQ ID NO: 5934844 - DNA, 23 bp, Homo sapiens
tacctcctcacttggctgtctga

SEQ ID NO: 5934845 - DNA, 13 bp, Homo sapiens
tacctcctcaggg

SEQ ID NO: 5934846 - DNA, 17 bp, Homo sapiens
tacctcctcagggatgg

SEQ ID NO: 5934847 - DNA, 23 bp, Homo sapiens
tacctcctcagggatggccgttg

SEQ ID NO: 5934848 - DNA, 11 bp, Homo sapiens
tacctcctcct

SEQ ID NO: 5934849 - DNA, 17 bp, Homo sapiens
tacctcctctcagtgtt

SEQ ID NO: 5934850 - DNA, 14 bp, Homo sapiens
tacctcctgtctct

SEQ ID NO: 5934851 - DNA, 15 bp, Homo sapiens
tacctcctgtctctg

SEQ ID NO: 5934852 - DNA, 21 bp, Homo sapiens
tacctcctgtctttacaaata

SEQ ID NO: 5934853 - DNA, 22 bp, Homo sapiens
tacctccttagctttccctgtg

SEQ ID NO: 5934854 - DNA, 13 bp, Homo sapiens
tacctccttgtgt

SEQ ID NO: 5934855 - DNA, 23 bp, Homo sapiens
tacctcgagtggcgagtccagac

SEQ ID NO: 5934856 - DNA, 13 bp, Homo sapiens
tacctcgcagtgt

SEQ ID NO: 5934857 - DNA, 20 bp, Homo sapiens
tacctcgttctgctcagagg

SEQ ID NO: 5934858 - DNA, 15 bp, Homo sapiens
tacctcgtttctaca

SEQ ID NO: 5934859 - DNA, 21 bp, Homo sapiens
tacctctaaatttccatatcc

SEQ ID NO: 5934860 - DNA, 22 bp, Homo sapiens
tacctctaacaccacactgacc

SEQ ID NO: 5934861 - DNA, 20 bp, Homo sapiens
tacctctaactgtgcaaagc

SEQ ID NO: 5934862 - DNA, 18 bp, Homo sapiens
tacctctaatagtataaa

SEQ ID NO: 5934863 - DNA, 21 bp, Homo sapiens
tacctctattttaattactgc

SEQ ID NO: 5934864 - DNA, 11 bp, Homo sapiens
tacctctctcc

SEQ ID NO: 5934865 - DNA, 12 bp, Homo sapiens
tacctctctctg

SEQ ID NO: 5934866 - DNA, 17 bp, Homo sapiens
tacctctctgggaccta

SEQ ID NO: 5934867 - DNA, 14 bp, Homo sapiens
tacctctctgtccc

SEQ ID NO: 5934868 - DNA, 15 bp, Homo sapiens
tacctctctgtccct

SEQ ID NO: 5934869 - DNA, 17 bp, Homo sapiens
tacctctcttatagaat

SEQ ID NO: 5934870 - DNA, 13 bp, Homo sapiens
tacctctctttct

SEQ ID NO: 5934871 - DNA, 21 bp, Homo sapiens
tacctctgacatcaagtgtaa

SEQ ID NO: 5934872 - DNA, 16 bp, Homo sapiens
tacctctgagaagaca

SEQ ID NO: 5934873 - DNA, 17 bp, Homo sapiens
tacctctgagaagacac

SEQ ID NO: 5934874 - DNA, 14 bp, Homo sapiens
tacctctgatacct

SEQ ID NO: 5934875 - DNA, 18 bp, Homo sapiens
tacctctgcataaatatt

SEQ ID NO: 5934876 - DNA, 13 bp, Homo sapiens
tacctctgctggg

SEQ ID NO: 5934877 - DNA, 16 bp, Homo sapiens
tacctctgctgggatg

SEQ ID NO: 5934878 - DNA, 18 bp, Homo sapiens
tacctctgtatagaaatc

SEQ ID NO: 5934879 - DNA, 19 bp, Homo sapiens
tacctctgtctgagacagg

SEQ ID NO: 5934880 - DNA, 14 bp, Homo sapiens
tacctctgtgtgct

SEQ ID NO: 5934881 - DNA, 16 bp, Homo sapiens
tacctcttagctgagt

SEQ ID NO: 5934882 - DNA, 14 bp, Homo sapiens
tacctcttattgca

SEQ ID NO: 5934883 - DNA, 17 bp, Homo sapiens
tacctcttattgcaaaa

SEQ ID NO: 5934884 - DNA, 23 bp, Homo sapiens
tacctcttccgttggaaagaaca

SEQ ID NO: 5934885 - DNA, 17 bp, Homo sapiens
tacctcttgaagaagaa

SEQ ID NO: 5934886 - DNA, 23 bp, Homo sapiens
tacctcttgagccttgaactttg

SEQ ID NO: 5934887 - DNA, 13 bp, Homo sapiens
tacctcttggctg

SEQ ID NO: 5934888 - DNA, 21 bp, Homo sapiens
tacctctttgtcagtctgggt

SEQ ID NO: 5934889 - DNA, 12 bp, Homo sapiens
tacctcttttgc

SEQ ID NO: 5934890 - DNA, 21 bp, Homo sapiens
tacctgaacacttattgcttt

SEQ ID NO: 5934891 - DNA, 18 bp, Homo sapiens
tacctgaacaggaatcct

SEQ ID NO: 5934892 - DNA, 21 bp, Homo sapiens
tacctgaaggcttcaatcatt

SEQ ID NO: 5934893 - DNA, 19 bp, Homo sapiens
tacctgaaggggttttctt

SEQ ID NO: 5934894 - DNA, 13 bp, Homo sapiens
tacctgacacaag

SEQ ID NO: 5934895 - DNA, 20 bp, Homo sapiens
tacctgacactcccttgggc

SEQ ID NO: 5934896 - DNA, 21 bp, Homo sapiens
tacctgacctaaattagataa

SEQ ID NO: 5934897 - DNA, 16 bp, Homo sapiens
tacctgacctcttgct

SEQ ID NO: 5934898 - DNA, 17 bp, Homo sapiens
tacctgacctcttgctg

SEQ ID NO: 5934899 - DNA, 13 bp, Homo sapiens
tacctgagaccag

SEQ ID NO: 5934900 - DNA, 17 bp, Homo sapiens
tacctgagactttcagt

SEQ ID NO: 5934901 - DNA, 23 bp, Homo sapiens
tacctgagatactgaagtgcagc

SEQ ID NO: 5934902 - DNA, 13 bp, Homo sapiens
tacctgaggggcc

SEQ ID NO: 5934903 - DNA, 15 bp, Homo sapiens
tacctgagggtctgt

SEQ ID NO: 5934904 - DNA, 16 bp, Homo sapiens
tacctgagttgaagag

SEQ ID NO: 5934905 - DNA, 17 bp, Homo sapiens
tacctgatcatggtcag

SEQ ID NO: 5934906 - DNA, 22 bp, Homo sapiens
tacctgattgatcacacagtgt

SEQ ID NO: 5934907 - DNA, 14 bp, Homo sapiens
tacctgattgtatt

SEQ ID NO: 5934908 - DNA, 18 bp, Homo sapiens
tacctgattttttttcct

SEQ ID NO: 5934909 - DNA, 19 bp, Homo sapiens
tacctgcaacacaacattt

SEQ ID NO: 5934910 - DNA, 22 bp, Homo sapiens
tacctgcaacacaacatttgtg

SEQ ID NO: 5934911 - DNA, 17 bp, Homo sapiens
tacctgcacgttcataa

SEQ ID NO: 5934912 - DNA, 23 bp, Homo sapiens
tacctgcacgttcataaccaaca

SEQ ID NO: 5934913 - DNA, 18 bp, Homo sapiens
tacctgcaggcggggctc

SEQ ID NO: 5934914 - DNA, 19 bp, Homo sapiens
tacctgcaggctccatgca

SEQ ID NO: 5934915 - DNA, 20 bp, Homo sapiens
tacctgcatgtgttgtacaa

SEQ ID NO: 5934916 - DNA, 21 bp, Homo sapiens
tacctgcatgtgttgtacaat

SEQ ID NO: 5934917 - DNA, 22 bp, Homo sapiens
tacctgccactcacacagccag

SEQ ID NO: 5934918 - DNA, 23 bp, Homo sapiens
tacctgccaggaagccagcaggc

SEQ ID NO: 5934919 - DNA, 19 bp, Homo sapiens
tacctgccctaagggactt

SEQ ID NO: 5934920 - DNA, 15 bp, Homo sapiens
tacctgccctggaac

SEQ ID NO: 5934921 - DNA, 15 bp, Homo sapiens
tacctgcctaaaata

SEQ ID NO: 5934922 - DNA, 23 bp, Homo sapiens
tacctgcctgggacagccactgg

SEQ ID NO: 5934923 - DNA, 20 bp, Homo sapiens
tacctgcctgttctccagat

SEQ ID NO: 5934924 - DNA, 15 bp, Homo sapiens
tacctgccttttaag

SEQ ID NO: 5934925 - DNA, 19 bp, Homo sapiens
tacctgccttttaagtttg

SEQ ID NO: 5934926 - DNA, 10 bp, Homo sapiens
tacctgctgc

SEQ ID NO: 5934927 - DNA, 14 bp, Homo sapiens
tacctgctgcttct

SEQ ID NO: 5934928 - DNA, 14 bp, Homo sapiens
tacctgctggacag

SEQ ID NO: 5934929 - DNA, 16 bp, Homo sapiens
tacctgctggacagcc

SEQ ID NO: 5934930 - DNA, 19 bp, Homo sapiens
tacctgctggacagcctcc

SEQ ID NO: 5934931 - DNA, 22 bp, Homo sapiens
tacctgcttgagctttctgtgc

SEQ ID NO: 5934932 - DNA, 10 bp, Homo sapiens
tacctggaaa

SEQ ID NO: 5934933 - DNA, 11 bp, Homo sapiens
tacctggaaaa

SEQ ID NO: 5934934 - DNA, 16 bp, Homo sapiens
tacctggacggtgcgc

SEQ ID NO: 5934935 - DNA, 19 bp, Homo sapiens
tacctggagcagaggaggg

SEQ ID NO: 5934936 - DNA, 23 bp, Homo sapiens
tacctggatataaattaattgtg

SEQ ID NO: 5934937 - DNA, 15 bp, Homo sapiens
tacctggcagacttg

SEQ ID NO: 5934938 - DNA, 16 bp, Homo sapiens
tacctggcagcaaact

SEQ ID NO: 5934939 - DNA, 18 bp, Homo sapiens
tacctggcagcaaactgc

SEQ ID NO: 5934940 - DNA, 13 bp, Homo sapiens
tacctggcctaga

SEQ ID NO: 5934941 - DNA, 20 bp, Homo sapiens
tacctggcttagcgttctgt

SEQ ID NO: 5934942 - DNA, 15 bp, Homo sapiens
tacctggctttttaa

SEQ ID NO: 5934943 - DNA, 14 bp, Homo sapiens
tacctgggaagggg

SEQ ID NO: 5934944 - DNA, 18 bp, Homo sapiens
tacctggggactcctcaa

SEQ ID NO: 5934945 - DNA, 18 bp, Homo sapiens
tacctggggacttgatgt

SEQ ID NO: 5934946 - DNA, 18 bp, Homo sapiens
tacctgggggcagaactc

SEQ ID NO: 5934947 - DNA, 20 bp, Homo sapiens
tacctgggtccccagccctt

SEQ ID NO: 5934948 - DNA, 21 bp, Homo sapiens
tacctgggtccttttcagaag

SEQ ID NO: 5934949 - DNA, 18 bp, Homo sapiens
tacctgggtgattacata

SEQ ID NO: 5934950 - DNA, 16 bp, Homo sapiens
tacctggtccccactg

SEQ ID NO: 5934951 - DNA, 18 bp, Homo sapiens
tacctggtccccactgct

SEQ ID NO: 5934952 - DNA, 22 bp, Homo sapiens
tacctggtgagtaacttagaaa

SEQ ID NO: 5934953 - DNA, 21 bp, Homo sapiens
tacctggtgctcgggaaggga

SEQ ID NO: 5934954 - DNA, 19 bp, Homo sapiens
tacctggttttcattattt

SEQ ID NO: 5934955 - DNA, 23 bp, Homo sapiens
tacctgtaatagcctcaccttcc

SEQ ID NO: 5934956 - DNA, 18 bp, Homo sapiens
tacctgtacacacacaga

SEQ ID NO: 5934957 - DNA, 18 bp, Homo sapiens
tacctgtagctttgggca

SEQ ID NO: 5934958 - DNA, 11 bp, Homo sapiens
tacctgtagga

SEQ ID NO: 5934959 - DNA, 16 bp, Homo sapiens
tacctgtagtgagaaa

SEQ ID NO: 5934960 - DNA, 20 bp, Homo sapiens
tacctgtatacagtgcagag

SEQ ID NO: 5934961 - DNA, 16 bp, Homo sapiens
tacctgtattgtctga

SEQ ID NO: 5934962 - DNA, 21 bp, Homo sapiens
tacctgtcacattgcattcta

SEQ ID NO: 5934963 - DNA, 17 bp, Homo sapiens
tacctgtcatctgggcc

SEQ ID NO: 5934964 - DNA, 18 bp, Homo sapiens
tacctgtcattttgcact

SEQ ID NO: 5934965 - DNA, 15 bp, Homo sapiens
tacctgtcctagcag

SEQ ID NO: 5934966 - DNA, 20 bp, Homo sapiens
tacctgtctaggaaggtgtg

SEQ ID NO: 5934967 - DNA, 18 bp, Homo sapiens
tacctgtctgctgccagc

SEQ ID NO: 5934968 - DNA, 13 bp, Homo sapiens
tacctgtgaaata

SEQ ID NO: 5934969 - DNA, 21 bp, Homo sapiens
tacctgtgaccctctttgctg

SEQ ID NO: 5934970 - DNA, 21 bp, Homo sapiens
tacctgtgagcatccttccca

SEQ ID NO: 5934971 - DNA, 18 bp, Homo sapiens
tacctgtggtgactgaac

SEQ ID NO: 5934972 - DNA, 19 bp, Homo sapiens
tacctgtggtttggtttta

SEQ ID NO: 5934973 - DNA, 18 bp, Homo sapiens
tacctgtgttcagattgt

SEQ ID NO: 5934974 - DNA, 17 bp, Homo sapiens
tacctgtgtttcttgcc

SEQ ID NO: 5934975 - DNA, 20 bp, Homo sapiens
tacctgtgtttttttctaaa

SEQ ID NO: 5934976 - DNA, 16 bp, Homo sapiens
tacctgttagctccct

SEQ ID NO: 5934977 - DNA, 13 bp, Homo sapiens
tacctgttcctcc

SEQ ID NO: 5934978 - DNA, 13 bp, Homo sapiens
tacctgttcctta

SEQ ID NO: 5934979 - DNA, 15 bp, Homo sapiens
taccttaaaatttga

SEQ ID NO: 5934980 - DNA, 20 bp, Homo sapiens
taccttaaaatttgaaacat

SEQ ID NO: 5934981 - DNA, 11 bp, Homo sapiens
tacggtacaga

SEQ ID NO: 5934982 - DNA, 17 bp, Homo sapiens
tacggtcatgatgtctg

SEQ ID NO: 5934983 - DNA, 19 bp, Homo sapiens
tacggtcatgatgtctgca

SEQ ID NO: 5934984 - DNA, 23 bp, Homo sapiens
tacggtctggtgtaaaagtagtg

SEQ ID NO: 5934985 - DNA, 14 bp, Homo sapiens
tacggtgatattgt

SEQ ID NO: 5934986 - DNA, 13 bp, Homo sapiens
tacggtgggggta

SEQ ID NO: 5934987 - DNA, 14 bp, Homo sapiens
tacgtaaaacattt

SEQ ID NO: 5934988 - DNA, 17 bp, Homo sapiens
tacgtaaagccttgttt

SEQ ID NO: 5934989 - DNA, 21 bp, Homo sapiens
tacgtaaaggtgcagttgctc

SEQ ID NO: 5934990 - DNA, 19 bp, Homo sapiens
tacgtaataaggttttaat

SEQ ID NO: 5934991 - DNA, 14 bp, Homo sapiens
tacgtacacatttt

SEQ ID NO: 5934992 - DNA, 15 bp, Homo sapiens
tacgtacacatttta

SEQ ID NO: 5934993 - DNA, 13 bp, Homo sapiens
tacgtagccacag

SEQ ID NO: 5934994 - DNA, 21 bp, Homo sapiens
tacgtagcctaaggctcctgt

SEQ ID NO: 5934995 - DNA, 15 bp, Homo sapiens
tacgtagctctctta

SEQ ID NO: 5934996 - DNA, 21 bp, Homo sapiens
tacgtataaaaagcaagaatt

SEQ ID NO: 5934997 - DNA, 13 bp, Homo sapiens
tacgtataaatat

SEQ ID NO: 5934998 - DNA, 20 bp, Homo sapiens
tacgtataaatatcagtatt

SEQ ID NO: 5934999 - DNA, 17 bp, Homo sapiens
tacgtataatgctttct

SEQ ID NO: 5935000 - DNA, 22 bp, Homo sapiens
tacgtatgtctggttctcaatt

SEQ ID NO: 5935001 - DNA, 18 bp, Homo sapiens
tacgtcaaacatgaagtg

SEQ ID NO: 5935002 - DNA, 21 bp, Homo sapiens
tacgtcaactgtatgtacata

SEQ ID NO: 5935003 - DNA, 16 bp, Homo sapiens
tacgtcccgctgctgt

SEQ ID NO: 5935004 - DNA, 15 bp, Homo sapiens
tacgtctgacaggca

SEQ ID NO: 5935005 - DNA, 13 bp, Homo sapiens
tacgtctgccagg

SEQ ID NO: 5935006 - DNA, 13 bp, Homo sapiens
tacgtctgggaga

SEQ ID NO: 5935007 - DNA, 21 bp, Homo sapiens
tacgtctgggagaaattgaca

SEQ ID NO: 5935008 - DNA, 19 bp, Homo sapiens
tacgtgaagaaataaatga

SEQ ID NO: 5935009 - DNA, 20 bp, Homo sapiens
tacgtgacctctgcaagaca

SEQ ID NO: 5935010 - DNA, 14 bp, Homo sapiens
tacgtgagccaggt

SEQ ID NO: 5935011 - DNA, 19 bp, Homo sapiens
tacgtgcaaacaacctgaa

SEQ ID NO: 5935012 - DNA, 22 bp, Homo sapiens
tacgtgcaaacaacctgaatct

SEQ ID NO: 5935013 - DNA, 20 bp, Homo sapiens
tacgtgcccatttcacacaa

SEQ ID NO: 5935014 - DNA, 14 bp, Homo sapiens
tacgtgggagaggc

SEQ ID NO: 5935015 - DNA, 19 bp, Homo sapiens
tacgtgggcattgtctttt

SEQ ID NO: 5935016 - DNA, 19 bp, Homo sapiens
tacgtgtaaaggaaaataa

SEQ ID NO: 5935017 - DNA, 15 bp, Homo sapiens
tacgtgtagctatat

SEQ ID NO: 5935018 - DNA, 18 bp, Homo sapiens
tacgtgtatgtttcttct

SEQ ID NO: 5935019 - DNA, 18 bp, Homo sapiens
tacgtgtgaaatctgtct

SEQ ID NO: 5935020 - DNA, 12 bp, Homo sapiens
tacgtgttcaaa

SEQ ID NO: 5935021 - DNA, 21 bp, Homo sapiens
tacgtgttcaaaaatttctgc

SEQ ID NO: 5935022 - DNA, 14 bp, Homo sapiens
tacgttaccaggca

SEQ ID NO: 5935023 - DNA, 15 bp, Homo sapiens
tacgttattgttgac

SEQ ID NO: 5935024 - DNA, 16 bp, Homo sapiens
tacgttattgttgact

SEQ ID NO: 5935025 - DNA, 15 bp, Homo sapiens
tacgttcctggcccc

SEQ ID NO: 5935026 - DNA, 20 bp, Homo sapiens
tacgttctccagcccacacc

SEQ ID NO: 5935027 - DNA, 19 bp, Homo sapiens
tacgttctgctatatttgt

SEQ ID NO: 5935028 - DNA, 16 bp, Homo sapiens
tacgttgtgcatttgg

SEQ ID NO: 5935029 - DNA, 14 bp, Homo sapiens
tacgttgtttctta

SEQ ID NO: 5935030 - DNA, 19 bp, Homo sapiens
tacgttgtttcttatagat

SEQ ID NO: 5935031 - DNA, 17 bp, Homo sapiens
tacgtttaaagtgcagt

SEQ ID NO: 5935032 - DNA, 21 bp, Homo sapiens
tacgtttaaagtgcagtcatt

SEQ ID NO: 5935033 - DNA, 22 bp, Homo sapiens
tacgtttccccaataaagcctt

SEQ ID NO: 5935034 - DNA, 15 bp, Homo sapiens
tacgtttctgtggag

SEQ ID NO: 5935035 - DNA, 11 bp, Homo sapiens
tacgtttcttt

SEQ ID NO: 5935036 - DNA, 23 bp, Homo sapiens
tacgtttctttaaccttgtataa

SEQ ID NO: 5935037 - DNA, 16 bp, Homo sapiens
tacgtttgaagtctga

SEQ ID NO: 5935038 - DNA, 22 bp, Homo sapiens
tacgtttgcaccgcctgccctc

SEQ ID NO: 5935039 - DNA, 21 bp, Homo sapiens
tacgtttgtgcagaatctcta

SEQ ID NO: 5935040 - DNA, 13 bp, Homo sapiens
tacgttttctgca

SEQ ID NO: 5935041 - DNA, 18 bp, Homo sapiens
tacgttttgcacattttg

SEQ ID NO: 5935042 - DNA, 16 bp, Homo sapiens
tacgttttgtgtatat

SEQ ID NO: 5935043 - DNA, 17 bp, Homo sapiens
tacgttttgtgtatatt

SEQ ID NO: 5935044 - DNA, 22 bp, Homo sapiens
tacgttttgtgtatatttgctt

SEQ ID NO: 5935045 - DNA, 14 bp, Homo sapiens
tacgtttttctggt

SEQ ID NO: 5935046 - DNA, 16 bp, Homo sapiens
tactaaaaaaaagatg

SEQ ID NO: 5935047 - DNA, 15 bp, Homo sapiens
tactaaaaagtataa

SEQ ID NO: 5935048 - DNA, 16 bp, Homo sapiens
tactaaaaagtataaa

SEQ ID NO: 5935049 - DNA, 18 bp, Homo sapiens
tactaaaaagtataaaat

SEQ ID NO: 5935050 - DNA, 14 bp, Homo sapiens
tactaaaaatacaa

SEQ ID NO: 5935051 - DNA, 18 bp, Homo sapiens
tactaaaaatacaaacaa

SEQ ID NO: 5935052 - DNA, 17 bp, Homo sapiens
tactaaaaatatgaaat

SEQ ID NO: 5935053 - DNA, 14 bp, Homo sapiens
tactaaaagaaact

SEQ ID NO: 5935054 - DNA, 21 bp, Homo sapiens
tactaaaagaaactatgatgt

SEQ ID NO: 5935055 - DNA, 17 bp, Homo sapiens
tactaaaagtttagaac

SEQ ID NO: 5935056 - DNA, 18 bp, Homo sapiens
tactaaaagtttagaact

SEQ ID NO: 5935057 - DNA, 12 bp, Homo sapiens
tactaaaatata

SEQ ID NO: 5935058 - DNA, 15 bp, Homo sapiens
tactaaaatggactg

SEQ ID NO: 5935059 - DNA, 17 bp, Homo sapiens
tactaaaatggactgtg

SEQ ID NO: 5935060 - DNA, 11 bp, Homo sapiens
tactaaaatta

SEQ ID NO: 5935061 - DNA, 19 bp, Homo sapiens
tactaaacagtaagatatc

SEQ ID NO: 5935062 - DNA, 17 bp, Homo sapiens
tactaaagcaaagcaaa

SEQ ID NO: 5935063 - DNA, 12 bp, Homo sapiens
tactaaagcagt

SEQ ID NO: 5935064 - DNA, 13 bp, Homo sapiens
tactaaagcagtg

SEQ ID NO: 5935065 - DNA, 14 bp, Homo sapiens
tactaaagccaaac

SEQ ID NO: 5935066 - DNA, 22 bp, Homo sapiens
tactaaatggtgttacattaaa

SEQ ID NO: 5935067 - DNA, 23 bp, Homo sapiens
tactaaatttaaatttaaagata

SEQ ID NO: 5935068 - DNA, 23 bp, Homo sapiens
tactaacagattataataaattg

SEQ ID NO: 5935069 - DNA, 16 bp, Homo sapiens
tactaacagtaactgc

SEQ ID NO: 5935070 - DNA, 16 bp, Homo sapiens
tactaacatcccaata

SEQ ID NO: 5935071 - DNA, 18 bp, Homo sapiens
tactaacatttatttgag

SEQ ID NO: 5935072 - DNA, 16 bp, Homo sapiens
tactaaccaccatttc

SEQ ID NO: 5935073 - DNA, 19 bp, Homo sapiens
tactaacccagtctttctt

SEQ ID NO: 5935074 - DNA, 12 bp, Homo sapiens
tactaacctccc

SEQ ID NO: 5935075 - DNA, 23 bp, Homo sapiens
tactaacctcccttaagcagcaa

SEQ ID NO: 5935076 - DNA, 18 bp, Homo sapiens
tactaaccttcatgcttt

SEQ ID NO: 5935077 - DNA, 12 bp, Homo sapiens
tactaacttcta

SEQ ID NO: 5935078 - DNA, 18 bp, Homo sapiens
tactaacttctaaaactg

SEQ ID NO: 5935079 - DNA, 13 bp, Homo sapiens
tactaactttcct

SEQ ID NO: 5935080 - DNA, 14 bp, Homo sapiens
tactaagaatgtcc

SEQ ID NO: 5935081 - DNA, 23 bp, Homo sapiens
tactaagacatagtctctaccta

SEQ ID NO: 5935082 - DNA, 15 bp, Homo sapiens
tactaagagatttgc

SEQ ID NO: 5935083 - DNA, 18 bp, Homo sapiens
tactaagagtaaagcaac

SEQ ID NO: 5935084 - DNA, 19 bp, Homo sapiens
tactaagatgaaattgcca

SEQ ID NO: 5935085 - DNA, 20 bp, Homo sapiens
tactaagatgaaattgccaa

SEQ ID NO: 5935086 - DNA, 15 bp, Homo sapiens
tactaagatgacatt

SEQ ID NO: 5935087 - DNA, 16 bp, Homo sapiens
tactaagccaggaggc

SEQ ID NO: 5935088 - DNA, 19 bp, Homo sapiens
tactaagccaggaggcttt

SEQ ID NO: 5935089 - DNA, 19 bp, Homo sapiens
tactaaggaagattactca

SEQ ID NO: 5935090 - DNA, 19 bp, Homo sapiens
tactaaggagaattaaact

SEQ ID NO: 5935091 - DNA, 22 bp, Homo sapiens
tactaaggatacaggctggaaa

SEQ ID NO: 5935092 - DNA, 15 bp, Homo sapiens
tactaaggctttcct

SEQ ID NO: 5935093 - DNA, 18 bp, Homo sapiens
tactaagggaacaatcca

SEQ ID NO: 5935094 - DNA, 22 bp, Homo sapiens
tactaagggaacaatccatgtg

SEQ ID NO: 5935095 - DNA, 23 bp, Homo sapiens
tactaaggtgactttctgaaact

SEQ ID NO: 5935096 - DNA, 22 bp, Homo sapiens
tactaagtaatctcacagcatt

SEQ ID NO: 5935097 - DNA, 17 bp, Homo sapiens
tactaagtgatgctgtg

SEQ ID NO: 5935098 - DNA, 13 bp, Homo sapiens
tactaagtttcct

SEQ ID NO: 5935099 - DNA, 14 bp, Homo sapiens
tactaagtttcctt

SEQ ID NO: 5935100 - DNA, 15 bp, Homo sapiens
tactaataaaaaggt

SEQ ID NO: 5935101 - DNA, 16 bp, Homo sapiens
tactaataaaaaggtt

SEQ ID NO: 5935102 - DNA, 17 bp, Homo sapiens
tactaataaaaaggttt

SEQ ID NO: 5935103 - DNA, 18 bp, Homo sapiens
tactaataaaaaggttta

SEQ ID NO: 5935104 - DNA, 15 bp, Homo sapiens
tactaataaaccagt

SEQ ID NO: 5935105 - DNA, 14 bp, Homo sapiens
tactaataaactaa

SEQ ID NO: 5935106 - DNA, 12 bp, Homo sapiens
tactaataaatt

SEQ ID NO: 5935107 - DNA, 14 bp, Homo sapiens
tactaataaattga

SEQ ID NO: 5935108 - DNA, 19 bp, Homo sapiens
tactaataatcttgtttct

SEQ ID NO: 5935109 - DNA, 20 bp, Homo sapiens
tactaatagacaatttatta

SEQ ID NO: 5935110 - DNA, 20 bp, Homo sapiens
tactaatagagtacttaata

SEQ ID NO: 5935111 - DNA, 19 bp, Homo sapiens
tactaatagcctaaaagat

SEQ ID NO: 5935112 - DNA, 16 bp, Homo sapiens
tactaatatatatttt

SEQ ID NO: 5935113 - DNA, 12 bp, Homo sapiens
tactaatatatc

SEQ ID NO: 5935114 - DNA, 13 bp, Homo sapiens
tactaatatatct

SEQ ID NO: 5935115 - DNA, 16 bp, Homo sapiens
tactaatatatctgta

SEQ ID NO: 5935116 - DNA, 19 bp, Homo sapiens
tactaatgaaatttacagt

SEQ ID NO: 5935117 - DNA, 23 bp, Homo sapiens
tactaatgatacttacaagtttc

SEQ ID NO: 5935118 - DNA, 15 bp, Homo sapiens
tactaatgatgagca

SEQ ID NO: 5935119 - DNA, 18 bp, Homo sapiens
tactaatgttatttctta

SEQ ID NO: 5935120 - DNA, 23 bp, Homo sapiens
tactaattaacatataatatatg

SEQ ID NO: 5935121 - DNA, 13 bp, Homo sapiens
tactaattccaca

SEQ ID NO: 5935122 - DNA, 16 bp, Homo sapiens
tactaattccacacct

SEQ ID NO: 5935123 - DNA, 18 bp, Homo sapiens
tactaattctatttctct

SEQ ID NO: 5935124 - DNA, 17 bp, Homo sapiens
tactaattttacacatt

SEQ ID NO: 5935125 - DNA, 23 bp, Homo sapiens
tactaattttccataagctattt

SEQ ID NO: 5935126 - DNA, 22 bp, Homo sapiens
tactaatttttagatattcatt

SEQ ID NO: 5935127 - DNA, 22 bp, Homo sapiens
tactaatttttgcttaacatta

SEQ ID NO: 5935128 - DNA, 13 bp, Homo sapiens
tactacaaaattt

SEQ ID NO: 5935129 - DNA, 16 bp, Homo sapiens
tactacaaatggatga

SEQ ID NO: 5935130 - DNA, 13 bp, Homo sapiens
tactacaatagtt

SEQ ID NO: 5935131 - DNA, 15 bp, Homo sapiens
tactacacattttta

SEQ ID NO: 5935132 - DNA, 20 bp, Homo sapiens
tactacactccatgtcaggt

SEQ ID NO: 5935133 - DNA, 20 bp, Homo sapiens
tactacactggtgtgtccct

SEQ ID NO: 5935134 - DNA, 21 bp, Homo sapiens
tactacagaaattaagatgtt

SEQ ID NO: 5935135 - DNA, 13 bp, Homo sapiens
tactacagagaag

SEQ ID NO: 5935136 - DNA, 20 bp, Homo sapiens
tactacagctatatttgatt

SEQ ID NO: 5935137 - DNA, 12 bp, Homo sapiens
tactacagtcct

SEQ ID NO: 5935138 - DNA, 17 bp, Homo sapiens
tactacagtcctcccat

SEQ ID NO: 5935139 - DNA, 22 bp, Homo sapiens
tactacagtcctcccatctcac

SEQ ID NO: 5935140 - DNA, 13 bp, Homo sapiens
tactacagtttgt

SEQ ID NO: 5935141 - DNA, 14 bp, Homo sapiens
tactacagtttgtt

SEQ ID NO: 5935142 - DNA, 12 bp, Homo sapiens
tactacatctgt

SEQ ID NO: 5935143 - DNA, 14 bp, Homo sapiens
tactaccacaagga

SEQ ID NO: 5935144 - DNA, 18 bp, Homo sapiens
tactaccagaagggcttc

SEQ ID NO: 5935145 - DNA, 14 bp, Homo sapiens
tactaccatagtga

SEQ ID NO: 5935146 - DNA, 18 bp, Homo sapiens
tactaccatagtgagcca

SEQ ID NO: 5935147 - DNA, 15 bp, Homo sapiens
tactacccagctctg

SEQ ID NO: 5935148 - DNA, 13 bp, Homo sapiens
tactaccctcacc

SEQ ID NO: 5935149 - DNA, 14 bp, Homo sapiens
tactacctagaagt

SEQ ID NO: 5935150 - DNA, 20 bp, Homo sapiens
tactaccttgaaaataagaa

SEQ ID NO: 5935151 - DNA, 18 bp, Homo sapiens
tactactagatgtcttta

SEQ ID NO: 5935152 - DNA, 14 bp, Homo sapiens
tactactattctgt

SEQ ID NO: 5935153 - DNA, 16 bp, Homo sapiens
tactactattctgtta

SEQ ID NO: 5935154 - DNA, 13 bp, Homo sapiens
tactactcctgta

SEQ ID NO: 5935155 - DNA, 13 bp, Homo sapiens
tactactctgcca

SEQ ID NO: 5935156 - DNA, 15 bp, Homo sapiens
tactactgaaacaga

SEQ ID NO: 5935157 - DNA, 16 bp, Homo sapiens
tactactgaccagaca

SEQ ID NO: 5935158 - DNA, 21 bp, Homo sapiens
tactactgattttaaaatgaa

SEQ ID NO: 5935159 - DNA, 12 bp, Homo sapiens
tactactgcaag

SEQ ID NO: 5935160 - DNA, 15 bp, Homo sapiens
tactactgctgcaaa

SEQ ID NO: 5935161 - DNA, 15 bp, Homo sapiens
tactcataagtaaaa

SEQ ID NO: 5935162 - DNA, 22 bp, Homo sapiens
tactcataagttggaccagagg

SEQ ID NO: 5935163 - DNA, 19 bp, Homo sapiens
tactcatatatatctatct

SEQ ID NO: 5935164 - DNA, 21 bp, Homo sapiens
tactcatatatatctatctta

SEQ ID NO: 5935165 - DNA, 21 bp, Homo sapiens
tactcatctttatcctaaaaa

SEQ ID NO: 5935166 - DNA, 15 bp, Homo sapiens
tactcatgaatgaaa

SEQ ID NO: 5935167 - DNA, 19 bp, Homo sapiens
tactcatgactgaagggaa

SEQ ID NO: 5935168 - DNA, 18 bp, Homo sapiens
tactcatgaggctgaggc

SEQ ID NO: 5935169 - DNA, 17 bp, Homo sapiens
tactcatgatcttgtga

SEQ ID NO: 5935170 - DNA, 16 bp, Homo sapiens
tactcattactgcaaa

SEQ ID NO: 5935171 - DNA, 17 bp, Homo sapiens
tactcattgaaatgtca

SEQ ID NO: 5935172 - DNA, 15 bp, Homo sapiens
tactcattgccccca

SEQ ID NO: 5935173 - DNA, 11 bp, Homo sapiens
tactcatttct

SEQ ID NO: 5935174 - DNA, 15 bp, Homo sapiens
tactcatttttcatt

SEQ ID NO: 5935175 - DNA, 16 bp, Homo sapiens
tactcatttttcatta

SEQ ID NO: 5935176 - DNA, 13 bp, Homo sapiens
tactccaaaaaga

SEQ ID NO: 5935177 - DNA, 16 bp, Homo sapiens
tactccaaaaagaaat

SEQ ID NO: 5935178 - DNA, 20 bp, Homo sapiens
tactccaaaaagacaagtgc

SEQ ID NO: 5935179 - DNA, 22 bp, Homo sapiens
tactccaaaacttcgtttaatg

SEQ ID NO: 5935180 - DNA, 19 bp, Homo sapiens
tactccaaagatgacttcc

SEQ ID NO: 5935181 - DNA, 21 bp, Homo sapiens
tactccaaagatgacttcccc

SEQ ID NO: 5935182 - DNA, 19 bp, Homo sapiens
tactccaaggtttataaag

SEQ ID NO: 5935183 - DNA, 22 bp, Homo sapiens
tactccaaggtttataaagcag

SEQ ID NO: 5935184 - DNA, 13 bp, Homo sapiens
tactccacactgc

SEQ ID NO: 5935185 - DNA, 21 bp, Homo sapiens
tactccactcccagcagctca

SEQ ID NO: 5935186 - DNA, 20 bp, Homo sapiens
tactccactgccctggcagc

SEQ ID NO: 5935187 - DNA, 14 bp, Homo sapiens
tactccagcaggta

SEQ ID NO: 5935188 - DNA, 22 bp, Homo sapiens
tactccagccccttcaattatt

SEQ ID NO: 5935189 - DNA, 15 bp, Homo sapiens
tactccagcctgggc

SEQ ID NO: 5935190 - DNA, 21 bp, Homo sapiens
tactccagcctgggcgacaga

SEQ ID NO: 5935191 - DNA, 18 bp, Homo sapiens
tactccaggcttccacac

SEQ ID NO: 5935192 - DNA, 19 bp, Homo sapiens
tactccagtggtgaagaaa

SEQ ID NO: 5935193 - DNA, 19 bp, Homo sapiens
tactccatggggtgggggt

SEQ ID NO: 5935194 - DNA, 13 bp, Homo sapiens
tactccatggttc

SEQ ID NO: 5935195 - DNA, 23 bp, Homo sapiens
tactcccagggcttacggccctg

SEQ ID NO: 5935196 - DNA, 13 bp, Homo sapiens
tactcccccacca

SEQ ID NO: 5935197 - DNA, 15 bp, Homo sapiens
tactcccccaccact

SEQ ID NO: 5935198 - DNA, 21 bp, Homo sapiens
tactcccccaccactcaggcc

SEQ ID NO: 5935199 - DNA, 15 bp, Homo sapiens
tactcccctccttga

SEQ ID NO: 5935200 - DNA, 14 bp, Homo sapiens
tactcccctggctg

SEQ ID NO: 5935201 - DNA, 16 bp, Homo sapiens
tactcccctttcttcc

SEQ ID NO: 5935202 - DNA, 17 bp, Homo sapiens
tactccctacactgatg

SEQ ID NO: 5935203 - DNA, 22 bp, Homo sapiens
tactccctcaaagcacacgtca

SEQ ID NO: 5935204 - DNA, 13 bp, Homo sapiens
tactccctccaat

SEQ ID NO: 5935205 - DNA, 16 bp, Homo sapiens
tactccctcttcactg

SEQ ID NO: 5935206 - DNA, 19 bp, Homo sapiens
tactccctgcagatgccac

SEQ ID NO: 5935207 - DNA, 17 bp, Homo sapiens
tactcccttcctggcct

SEQ ID NO: 5935208 - DNA, 20 bp, Homo sapiens
tactcccttctcgtgtttgc

SEQ ID NO: 5935209 - DNA, 15 bp, Homo sapiens
tactccctttaaaga

SEQ ID NO: 5935210 - DNA, 20 bp, Homo sapiens
tactccgtgaggctgctgcc

SEQ ID NO: 5935211 - DNA, 22 bp, Homo sapiens
tactccgtgaggctgctgccat

SEQ ID NO: 5935212 - DNA, 17 bp, Homo sapiens
tactccgttcctggcat

SEQ ID NO: 5935213 - DNA, 15 bp, Homo sapiens
tactcctagaagaac

SEQ ID NO: 5935214 - DNA, 21 bp, Homo sapiens
tactcctagaagaaccaaata

SEQ ID NO: 5935215 - DNA, 20 bp, Homo sapiens
tactcctatttttgtaaact

SEQ ID NO: 5935216 - DNA, 21 bp, Homo sapiens
tactcctatttttgtaaactg

SEQ ID NO: 5935217 - DNA, 14 bp, Homo sapiens
tactcctcacactt

SEQ ID NO: 5935218 - DNA, 24 bp, Homo sapiens
tactcctccccctcctccatgctg

SEQ ID NO: 5935219 - DNA, 13 bp, Homo sapiens
tactcctccctgg

SEQ ID NO: 5935220 - DNA, 14 bp, Homo sapiens
tactcctccctggg

SEQ ID NO: 5935221 - DNA, 21 bp, Homo sapiens
tactcctccctgggggcggga

SEQ ID NO: 5935222 - DNA, 13 bp, Homo sapiens
tactcctcctctt

SEQ ID NO: 5935223 - DNA, 15 bp, Homo sapiens
tactcctcctctttc

SEQ ID NO: 5935224 - DNA, 19 bp, Homo sapiens
tactcctcctctttctctc

SEQ ID NO: 5935225 - DNA, 23 bp, Homo sapiens
tactcctcctctttctctcccca

SEQ ID NO: 5935226 - DNA, 16 bp, Homo sapiens
tactcctcctgctcct

SEQ ID NO: 5935227 - DNA, 15 bp, Homo sapiens
tactcctgccaggga

SEQ ID NO: 5935228 - DNA, 18 bp, Homo sapiens
tactcctgcggctgcctg

SEQ ID NO: 5935229 - DNA, 9 bp, Homo sapiens
tactcctgg

SEQ ID NO: 5935230 - DNA, 22 bp, Homo sapiens
tactcctggctcaagccctgaa

SEQ ID NO: 5935231 - DNA, 23 bp, Homo sapiens
tactcctgggcacccttaatctt

SEQ ID NO: 5935232 - DNA, 12 bp, Homo sapiens
tactcctgggct

SEQ ID NO: 5935233 - DNA, 12 bp, Homo sapiens
tactcctgggtc

SEQ ID NO: 5935234 - DNA, 19 bp, Homo sapiens
tactcctgtaattcctacc

SEQ ID NO: 5935235 - DNA, 20 bp, Homo sapiens
tactcctgtcttctgctttg

SEQ ID NO: 5935236 - DNA, 19 bp, Homo sapiens
tactcctgtgctctggagg

SEQ ID NO: 5935237 - DNA, 11 bp, Homo sapiens
tactcctgtgg

SEQ ID NO: 5935238 - DNA, 12 bp, Homo sapiens
tactcctgtggg

SEQ ID NO: 5935239 - DNA, 18 bp, Homo sapiens
tactccttaaaaatgtat

SEQ ID NO: 5935240 - DNA, 21 bp, Homo sapiens
tactccttaaaaatgtatgtt

SEQ ID NO: 5935241 - DNA, 22 bp, Homo sapiens
tactccttaagaacacaaagcg

SEQ ID NO: 5935242 - DNA, 13 bp, Homo sapiens
tactccttctgtt

SEQ ID NO: 5935243 - DNA, 14 bp, Homo sapiens
tactccttgcttcc

SEQ ID NO: 5935244 - DNA, 15 bp, Homo sapiens
tactccttgcttcct

SEQ ID NO: 5935245 - DNA, 17 bp, Homo sapiens
tactccttgcttcctga

SEQ ID NO: 5935246 - DNA, 14 bp, Homo sapiens
tactcctttggaaa

SEQ ID NO: 5935247 - DNA, 17 bp, Homo sapiens
tactcctttttattcat

SEQ ID NO: 5935248 - DNA, 20 bp, Homo sapiens
tactcgatcaaaaccttcct

SEQ ID NO: 5935249 - DNA, 21 bp, Homo sapiens
tactcgatcaaaaccttcctt

SEQ ID NO: 5935250 - DNA, 21 bp, Homo sapiens
tactcgcacctcttggctttg

SEQ ID NO: 5935251 - DNA, 22 bp, Homo sapiens
tactcgggaggctgaggcacaa

SEQ ID NO: 5935252 - DNA, 22 bp, Homo sapiens
tactcgtgcattaaaatttctt

SEQ ID NO: 5935253 - DNA, 16 bp, Homo sapiens
tactctaaagaaaaat

SEQ ID NO: 5935254 - DNA, 13 bp, Homo sapiens
tactctaagatct

SEQ ID NO: 5935255 - DNA, 20 bp, Homo sapiens
tactctaagatcttagattc

SEQ ID NO: 5935256 - DNA, 16 bp, Homo sapiens
tactctaatcagtcct

SEQ ID NO: 5935257 - DNA, 15 bp, Homo sapiens
tactctaattctaac

SEQ ID NO: 5935258 - DNA, 15 bp, Homo sapiens
tactctacaaaatat

SEQ ID NO: 5935259 - DNA, 19 bp, Homo sapiens
tactctacaaaatatagct

SEQ ID NO: 5935260 - DNA, 21 bp, Homo sapiens
tactctaccatggttctgcct

SEQ ID NO: 5935261 - DNA, 14 bp, Homo sapiens
tactctagaacatg

SEQ ID NO: 5935262 - DNA, 14 bp, Homo sapiens
tactctagagaagt

SEQ ID NO: 5935263 - DNA, 14 bp, Homo sapiens
tactctagatacct

SEQ ID NO: 5935264 - DNA, 14 bp, Homo sapiens
tactctagatgaag

SEQ ID NO: 5935265 - DNA, 15 bp, Homo sapiens
tactctagattttgt

SEQ ID NO: 5935266 - DNA, 16 bp, Homo sapiens
tactctaggacttcaa

SEQ ID NO: 5935267 - DNA, 17 bp, Homo sapiens
tactctaggacttcaaa

SEQ ID NO: 5935268 - DNA, 13 bp, Homo sapiens
tactctagttctg

SEQ ID NO: 5935269 - DNA, 17 bp, Homo sapiens
tactctagttctgttgt

SEQ ID NO: 5935270 - DNA, 22 bp, Homo sapiens
tactctagttctgttgttttgt

SEQ ID NO: 5935271 - DNA, 23 bp, Homo sapiens
tactctatatacttttgcttggt

SEQ ID NO: 5935272 - DNA, 21 bp, Homo sapiens
tactctattgatacaatattg

SEQ ID NO: 5935273 - DNA, 14 bp, Homo sapiens
tactctcaatgcat

SEQ ID NO: 5935274 - DNA, 20 bp, Homo sapiens
tactctcaatgcattttcaa

SEQ ID NO: 5935275 - DNA, 15 bp, Homo sapiens
tactctcacatgtgg

SEQ ID NO: 5935276 - DNA, 14 bp, Homo sapiens
tactctcattcttt

SEQ ID NO: 5935277 - DNA, 13 bp, Homo sapiens
tactctccatatc

SEQ ID NO: 5935278 - DNA, 20 bp, Homo sapiens
tactctccccacgagggctg

SEQ ID NO: 5935279 - DNA, 14 bp, Homo sapiens
tactctcctagaga

SEQ ID NO: 5935280 - DNA, 16 bp, Homo sapiens
tactctcctcatctct

SEQ ID NO: 5935281 - DNA, 21 bp, Homo sapiens
tactctctctcttttccctcc

SEQ ID NO: 5935282 - DNA, 20 bp, Homo sapiens
tactctctgagtacattgtg

SEQ ID NO: 5935283 - DNA, 14 bp, Homo sapiens
tactctcttccctt

SEQ ID NO: 5935284 - DNA, 14 bp, Homo sapiens
tactctcttcttct

SEQ ID NO: 5935285 - DNA, 14 bp, Homo sapiens
tactctgaaaagca

SEQ ID NO: 5935286 - DNA, 14 bp, Homo sapiens
tactctgaaatgca

SEQ ID NO: 5935287 - DNA, 21 bp, Homo sapiens
tactctgaaattgtaactaaa

SEQ ID NO: 5935288 - DNA, 12 bp, Homo sapiens
tactctgaaggg

SEQ ID NO: 5935289 - DNA, 22 bp, Homo sapiens
tactctgaagggcatcatgcat

SEQ ID NO: 5935290 - DNA, 21 bp, Homo sapiens
tactctgacataaacccatct

SEQ ID NO: 5935291 - DNA, 11 bp, Homo sapiens
tactctgagcc

SEQ ID NO: 5935292 - DNA, 18 bp, Homo sapiens
tactctgagcccaggccg

SEQ ID NO: 5935293 - DNA, 17 bp, Homo sapiens
tactctgagtcctcatt

SEQ ID NO: 5935294 - DNA, 20 bp, Homo sapiens
tactctgccactttatttct

SEQ ID NO: 5935295 - DNA, 19 bp, Homo sapiens
tactctgcctgtcaagttt

SEQ ID NO: 5935296 - DNA, 18 bp, Homo sapiens
tactctgctccaaagtag

SEQ ID NO: 5935297 - DNA, 13 bp, Homo sapiens
tactctgctttat

SEQ ID NO: 5935298 - DNA, 21 bp, Homo sapiens
tactctggaatgtttttccct

SEQ ID NO: 5935299 - DNA, 22 bp, Homo sapiens
tactctggagcaacctactgtc

SEQ ID NO: 5935300 - DNA, 12 bp, Homo sapiens
tactctgggaac

SEQ ID NO: 5935301 - DNA, 21 bp, Homo sapiens
tactctggggtgctgcctgaa

SEQ ID NO: 5935302 - DNA, 21 bp, Homo sapiens
tactctggtggattgttctag

SEQ ID NO: 5935303 - DNA, 15 bp, Homo sapiens
tactctggttctttg

SEQ ID NO: 5935304 - DNA, 16 bp, Homo sapiens
tactctgtagtctcag

SEQ ID NO: 5935305 - DNA, 11 bp, Homo sapiens
tactctgtcca

SEQ ID NO: 5935306 - DNA, 16 bp, Homo sapiens
tactctgtccaggcca

SEQ ID NO: 5935307 - DNA, 19 bp, Homo sapiens
tactctgtccccccagcta

SEQ ID NO: 5935308 - DNA, 12 bp, Homo sapiens
tactctgtctcc

SEQ ID NO: 5935309 - DNA, 15 bp, Homo sapiens
tactctgtgccagag

SEQ ID NO: 5935310 - DNA, 16 bp, Homo sapiens
tactctgtgccagagc

SEQ ID NO: 5935311 - DNA, 19 bp, Homo sapiens
tactctgtgccagagcctg

SEQ ID NO: 5935312 - DNA, 20 bp, Homo sapiens
tactctgtgccagagcctgg

SEQ ID NO: 5935313 - DNA, 22 bp, Homo sapiens
tactctgtgccagagcctgggg

SEQ ID NO: 5935314 - DNA, 19 bp, Homo sapiens
tactctgtgtaatagaata

SEQ ID NO: 5935315 - DNA, 15 bp, Homo sapiens
tactctgtgtgtgta

SEQ ID NO: 5935316 - DNA, 16 bp, Homo sapiens
tactctgtgtttaaaa

SEQ ID NO: 5935317 - DNA, 19 bp, Homo sapiens
tactctgttccttcacatc

SEQ ID NO: 5935318 - DNA, 14 bp, Homo sapiens
tactctgttgcctc

SEQ ID NO: 5935319 - DNA, 18 bp, Homo sapiens
tactctgttgcctcctct

SEQ ID NO: 5935320 - DNA, 19 bp, Homo sapiens
tactctgttgcctcctctc

SEQ ID NO: 5935321 - DNA, 21 bp, Homo sapiens
tactcttaaatcatttggtta

SEQ ID NO: 5935322 - DNA, 15 bp, Homo sapiens
tactcttaagccatc

SEQ ID NO: 5935323 - DNA, 17 bp, Homo sapiens
tactcttaagccatctt

SEQ ID NO: 5935324 - DNA, 21 bp, Homo sapiens
tactcttaagtttctcagctc

SEQ ID NO: 5935325 - DNA, 21 bp, Homo sapiens
tactcttaatgatgttatctt

SEQ ID NO: 5935326 - DNA, 23 bp, Homo sapiens
tactcttacagagccttgagaga

SEQ ID NO: 5935327 - DNA, 13 bp, Homo sapiens
tactcttacatgt

SEQ ID NO: 5935328 - DNA, 11 bp, Homo sapiens
tactcttagga

SEQ ID NO: 5935329 - DNA, 18 bp, Homo sapiens
tactcttaggatatttga

SEQ ID NO: 5935330 - DNA, 20 bp, Homo sapiens
tactcttatatctatatttt

SEQ ID NO: 5935331 - DNA, 16 bp, Homo sapiens
tactcttccgatgttt

SEQ ID NO: 5935332 - DNA, 17 bp, Homo sapiens
tactcttcctctaacat

SEQ ID NO: 5935333 - DNA, 19 bp, Homo sapiens
tactcttcctctaacattt

SEQ ID NO: 5935334 - DNA, 13 bp, Homo sapiens
tactcttcctttc

SEQ ID NO: 5935335 - DNA, 15 bp, Homo sapiens
tactcttcctttcta

SEQ ID NO: 5935336 - DNA, 13 bp, Homo sapiens
tactcttctaaaa

SEQ ID NO: 5935337 - DNA, 14 bp, Homo sapiens
tactcttcttgaaa

SEQ ID NO: 5935338 - DNA, 18 bp, Homo sapiens
tactcttcttgaaatttt

SEQ ID NO: 5935339 - DNA, 16 bp, Homo sapiens
tactgtgcatctcctt

SEQ ID NO: 5935340 - DNA, 13 bp, Homo sapiens
tactgtgcctggt

SEQ ID NO: 5935341 - DNA, 19 bp, Homo sapiens
tactgtgctgattcaataa

SEQ ID NO: 5935342 - DNA, 15 bp, Homo sapiens
tactgtgctggagcc

SEQ ID NO: 5935343 - DNA, 16 bp, Homo sapiens
tactgtgctggagcca

SEQ ID NO: 5935344 - DNA, 17 bp, Homo sapiens
tactgtggcctgcagga

SEQ ID NO: 5935345 - DNA, 17 bp, Homo sapiens
tactgtgggcaatttag

SEQ ID NO: 5935346 - DNA, 18 bp, Homo sapiens
tactgtgggcaatttaga

SEQ ID NO: 5935347 - DNA, 13 bp, Homo sapiens
tactgtggggaga

SEQ ID NO: 5935348 - DNA, 14 bp, Homo sapiens
tactgtggggtgga

SEQ ID NO: 5935349 - DNA, 23 bp, Homo sapiens
tactgtgtaaatatatgtctgat

SEQ ID NO: 5935350 - DNA, 12 bp, Homo sapiens
tactgtgtactg

SEQ ID NO: 5935351 - DNA, 19 bp, Homo sapiens
tactgtgtagactcctgct

SEQ ID NO: 5935352 - DNA, 11 bp, Homo sapiens
tactgtgtatg

SEQ ID NO: 5935353 - DNA, 20 bp, Homo sapiens
tactgtgtatgttttatatc

SEQ ID NO: 5935354 - DNA, 23 bp, Homo sapiens
tactgtgtctttggtttgtgcta

SEQ ID NO: 5935355 - DNA, 23 bp, Homo sapiens
tactgtgtgtgagtgtgaatata

SEQ ID NO: 5935356 - DNA, 17 bp, Homo sapiens
tactgtgtgtgtgaatg

SEQ ID NO: 5935357 - DNA, 15 bp, Homo sapiens
tactgtgttatgcaa

SEQ ID NO: 5935358 - DNA, 12 bp, Homo sapiens
tactgtgttcct

SEQ ID NO: 5935359 - DNA, 14 bp, Homo sapiens
tactgtgttcctgg

SEQ ID NO: 5935360 - DNA, 19 bp, Homo sapiens
tactgtgttcctggcaata

SEQ ID NO: 5935361 - DNA, 17 bp, Homo sapiens
tactgttaaaactgtac

SEQ ID NO: 5935362 - DNA, 15 bp, Homo sapiens
tactgttaaccattt

SEQ ID NO: 5935363 - DNA, 17 bp, Homo sapiens
tactgttactctaaata

SEQ ID NO: 5935364 - DNA, 14 bp, Homo sapiens
tactgttacttgat

SEQ ID NO: 5935365 - DNA, 18 bp, Homo sapiens
tactgttaggaacagcag

SEQ ID NO: 5935366 - DNA, 20 bp, Homo sapiens
tactgttaggaacagcagtg

SEQ ID NO: 5935367 - DNA, 16 bp, Homo sapiens
tactgttatccatatt

SEQ ID NO: 5935368 - DNA, 12 bp, Homo sapiens
tactgttcatgg

SEQ ID NO: 5935369 - DNA, 16 bp, Homo sapiens
tactgttcctttcaga

SEQ ID NO: 5935370 - DNA, 19 bp, Homo sapiens
tactgttcctttcagatga

SEQ ID NO: 5935371 - DNA, 23 bp, Homo sapiens
tactgttcggaaggggttcctca

SEQ ID NO: 5935372 - DNA, 14 bp, Homo sapiens
tactgttctaaagc

SEQ ID NO: 5935373 - DNA, 18 bp, Homo sapiens
tactgttctaaagctctg

SEQ ID NO: 5935374 - DNA, 23 bp, Homo sapiens
tactgttctcaacatactgtaat

SEQ ID NO: 5935375 - DNA, 18 bp, Homo sapiens
tactgttctcttcttgaa

SEQ ID NO: 5935376 - DNA, 17 bp, Homo sapiens
tactgttctgtgtcttt

SEQ ID NO: 5935377 - DNA, 10 bp, Homo sapiens
tactgttctt

SEQ ID NO: 5935378 - DNA, 12 bp, Homo sapiens
tactgttcttgc

SEQ ID NO: 5935379 - DNA, 15 bp, Homo sapiens
tactgttcttgctgc

SEQ ID NO: 5935380 - DNA, 10 bp, Homo sapiens
tactgttgaa

SEQ ID NO: 5935381 - DNA, 19 bp, Homo sapiens
tactgttgagaaaaaagac

SEQ ID NO: 5935382 - DNA, 22 bp, Homo sapiens
tactgttgagaaaaaagaccct

SEQ ID NO: 5935383 - DNA, 20 bp, Homo sapiens
tactgttgataattcttatt

SEQ ID NO: 5935384 - DNA, 17 bp, Homo sapiens
tactgttgatacaaacc

SEQ ID NO: 5935385 - DNA, 20 bp, Homo sapiens
tactgttgatacaaaccact

SEQ ID NO: 5935386 - DNA, 17 bp, Homo sapiens
tactgttgcaaagcttc

SEQ ID NO: 5935387 - DNA, 23 bp, Homo sapiens
tactgttgcacaattttgataaa

SEQ ID NO: 5935388 - DNA, 13 bp, Homo sapiens
tactgttgcacgt

SEQ ID NO: 5935389 - DNA, 15 bp, Homo sapiens
tactgttgctttaat

SEQ ID NO: 5935390 - DNA, 22 bp, Homo sapiens
tactgttgtaagaattctgatt

SEQ ID NO: 5935391 - DNA, 17 bp, Homo sapiens
tactgtttacagtttag

SEQ ID NO: 5935392 - DNA, 14 bp, Homo sapiens
tactgtttcagtcc

SEQ ID NO: 5935393 - DNA, 14 bp, Homo sapiens
tactgtttcttgca

SEQ ID NO: 5935394 - DNA, 13 bp, Homo sapiens
tactgtttgaaaa

SEQ ID NO: 5935395 - DNA, 19 bp, Homo sapiens
tactgtttgcccattttca

SEQ ID NO: 5935396 - DNA, 12 bp, Homo sapiens
tactgtttgtaa

SEQ ID NO: 5935397 - DNA, 15 bp, Homo sapiens
tactgtttgtaatat

SEQ ID NO: 5935398 - DNA, 20 bp, Homo sapiens
tactgtttgtaatatacagt

SEQ ID NO: 5935399 - DNA, 19 bp, Homo sapiens
tactgtttgtcttctcccc

SEQ ID NO: 5935400 - DNA, 19 bp, Homo sapiens
tactgttttaattgtagtt

SEQ ID NO: 5935401 - DNA, 14 bp, Homo sapiens
tactgttttatgtt

SEQ ID NO: 5935402 - DNA, 17 bp, Homo sapiens
tactgttttatgttgat

SEQ ID NO: 5935403 - DNA, 16 bp, Homo sapiens
tactgttttctgggcc

SEQ ID NO: 5935404 - DNA, 16 bp, Homo sapiens
tactgttttgaggaat

SEQ ID NO: 5935405 - DNA, 14 bp, Homo sapiens
tactgttttgtgcg

SEQ ID NO: 5935406 - DNA, 21 bp, Homo sapiens
tactgttttgtgcggtgtgtc

SEQ ID NO: 5935407 - DNA, 15 bp, Homo sapiens
tactgtttttatcct

SEQ ID NO: 5935408 - DNA, 22 bp, Homo sapiens
tactgtttttgctattacatgt

SEQ ID NO: 5935409 - DNA, 23 bp, Homo sapiens
tacttaaaaaaaaaaaaaagctt

SEQ ID NO: 5935410 - DNA, 16 bp, Homo sapiens
tacttaaaaatatgtg

SEQ ID NO: 5935411 - DNA, 17 bp, Homo sapiens
tacttaaaaatatgtga

SEQ ID NO: 5935412 - DNA, 14 bp, Homo sapiens
tacttaaaatatct

SEQ ID NO: 5935413 - DNA, 17 bp, Homo sapiens
tacttaaacaaaaactt

SEQ ID NO: 5935414 - DNA, 18 bp, Homo sapiens
tacttaaacaaaaacttt

SEQ ID NO: 5935415 - DNA, 19 bp, Homo sapiens
tacttaaacaaaaactttc

SEQ ID NO: 5935416 - DNA, 16 bp, Homo sapiens
tacttaaacagctttt

SEQ ID NO: 5935417 - DNA, 15 bp, Homo sapiens
tacttaaacatcatt

SEQ ID NO: 5935418 - DNA, 13 bp, Homo sapiens
tacttaaagcttg

SEQ ID NO: 5935419 - DNA, 16 bp, Homo sapiens
tacttaaagttgattt

SEQ ID NO: 5935420 - DNA, 23 bp, Homo sapiens
tacttaaagttgattttgaactt

SEQ ID NO: 5935421 - DNA, 21 bp, Homo sapiens
tacttaaatagcatctgctct

SEQ ID NO: 5935422 - DNA, 17 bp, Homo sapiens
tacttaaatgaaagcat

SEQ ID NO: 5935423 - DNA, 12 bp, Homo sapiens
tacttaaatgag

SEQ ID NO: 5935424 - DNA, 23 bp, Homo sapiens
tacttaaatggtaataagcactg

SEQ ID NO: 5935425 - DNA, 17 bp, Homo sapiens
tacttaaatgttatgta

SEQ ID NO: 5935426 - DNA, 23 bp, Homo sapiens
tacttaaatttgaatctgagtga

SEQ ID NO: 5935427 - DNA, 15 bp, Homo sapiens
tacttaacaaataca

SEQ ID NO: 5935428 - DNA, 18 bp, Homo sapiens
tacttaacaaatacattc

SEQ ID NO: 5935429 - DNA, 19 bp, Homo sapiens
tacttaacaaatacattca

SEQ ID NO: 5935430 - DNA, 22 bp, Homo sapiens
tacttaacaaccaacttgttgt

SEQ ID NO: 5935431 - DNA, 13 bp, Homo sapiens
tacttaacatatc

SEQ ID NO: 5935432 - DNA, 16 bp, Homo sapiens
tacttaacatatctga

SEQ ID NO: 5935433 - DNA, 17 bp, Homo sapiens
tacttaactgtgtgaag

SEQ ID NO: 5935434 - DNA, 20 bp, Homo sapiens
tacttaactgtgtgaagaaa

SEQ ID NO: 5935435 - DNA, 15 bp, Homo sapiens
tacttaagagaaatg

SEQ ID NO: 5935436 - DNA, 18 bp, Homo sapiens
tacttaagagaaatggca

SEQ ID NO: 5935437 - DNA, 19 bp, Homo sapiens
tacttaagagaaatggcaa

SEQ ID NO: 5935438 - DNA, 16 bp, Homo sapiens
tacttaagattcagtt

SEQ ID NO: 5935439 - DNA, 17 bp, Homo sapiens
tacttaagattcagttt

SEQ ID NO: 5935440 - DNA, 21 bp, Homo sapiens
tacttaagctcccctgcctta

SEQ ID NO: 5935441 - DNA, 17 bp, Homo sapiens
tacttaagtgttcattt

SEQ ID NO: 5935442 - DNA, 12 bp, Homo sapiens
tacttaataaaa

SEQ ID NO: 5935443 - DNA, 15 bp, Homo sapiens
tacttaataaaacat

SEQ ID NO: 5935444 - DNA, 17 bp, Homo sapiens
tacttaatactgaattt

SEQ ID NO: 5935445 - DNA, 20 bp, Homo sapiens
tacttaatactgaatttctt

SEQ ID NO: 5935446 - DNA, 15 bp, Homo sapiens
tacttaatatactca

SEQ ID NO: 5935447 - DNA, 21 bp, Homo sapiens
tacttaatatactcagggatt

SEQ ID NO: 5935448 - DNA, 15 bp, Homo sapiens
tacttaatccaatgg

SEQ ID NO: 5935449 - DNA, 14 bp, Homo sapiens
tacttaatctaaga

SEQ ID NO: 5935450 - DNA, 18 bp, Homo sapiens
tacttaatgtaattcagg

SEQ ID NO: 5935451 - DNA, 18 bp, Homo sapiens
tacttaattgccagcaaa

SEQ ID NO: 5935452 - DNA, 18 bp, Homo sapiens
tacttaatttacttaagt

SEQ ID NO: 5935453 - DNA, 21 bp, Homo sapiens
tacttaatttacttaagtgtt

SEQ ID NO: 5935454 - DNA, 13 bp, Homo sapiens
tacttaatttctt

SEQ ID NO: 5935455 - DNA, 22 bp, Homo sapiens
tacttacaaactgcggtataca

SEQ ID NO: 5935456 - DNA, 22 bp, Homo sapiens
tacttacacacctgagaatgtg

SEQ ID NO: 5935457 - DNA, 13 bp, Homo sapiens
tacttacatagtt

SEQ ID NO: 5935458 - DNA, 17 bp, Homo sapiens
tacttacatatctgact

SEQ ID NO: 5935459 - DNA, 18 bp, Homo sapiens
tacttacatctttgttta

SEQ ID NO: 5935460 - DNA, 13 bp, Homo sapiens
tacttacatgggt

SEQ ID NO: 5935461 - DNA, 16 bp, Homo sapiens
tacttacatttccatt

SEQ ID NO: 5935462 - DNA, 17 bp, Homo sapiens
tacttacatttccattt

SEQ ID NO: 5935463 - DNA, 22 bp, Homo sapiens
tacttaccagtcaatgcattgt

SEQ ID NO: 5935464 - DNA, 22 bp, Homo sapiens
tacttacctaaacagatataaa

SEQ ID NO: 5935465 - DNA, 22 bp, Homo sapiens
tacttacctgttttctcctccc

SEQ ID NO: 5935466 - DNA, 15 bp, Homo sapiens
tacttacggttttaa

SEQ ID NO: 5935467 - DNA, 16 bp, Homo sapiens
tacttagaaagtaaga

SEQ ID NO: 5935468 - DNA, 16 bp, Homo sapiens
tacttagaatgccata

SEQ ID NO: 5935469 - DNA, 20 bp, Homo sapiens
tacttagaatgccataaaat

SEQ ID NO: 5935470 - DNA, 22 bp, Homo sapiens
tacttagaatgccataaaattg

SEQ ID NO: 5935471 - DNA, 21 bp, Homo sapiens
tacttagaccaaaagcaacat

SEQ ID NO: 5935472 - DNA, 18 bp, Homo sapiens
tacttagagtttctgttt

SEQ ID NO: 5935473 - DNA, 20 bp, Homo sapiens
tacttagagtttctgtttga

SEQ ID NO: 5935474 - DNA, 17 bp, Homo sapiens
tacttagcaaaaagtgg

SEQ ID NO: 5935475 - DNA, 18 bp, Homo sapiens
tacttagcaatgttatct

SEQ ID NO: 5935476 - DNA, 21 bp, Homo sapiens
tacttagcacttggcctgaga

SEQ ID NO: 5935477 - DNA, 15 bp, Homo sapiens
tacttagcatcctaa

SEQ ID NO: 5935478 - DNA, 20 bp, Homo sapiens
tacttagcatcctaagaaat

SEQ ID NO: 5935479 - DNA, 21 bp, Homo sapiens
tacttagcatcctaagaaata

SEQ ID NO: 5935480 - DNA, 21 bp, Homo sapiens
tacttagccagttcaaagtgt

SEQ ID NO: 5935481 - DNA, 14 bp, Homo sapiens
tacttagctggcca

SEQ ID NO: 5935482 - DNA, 15 bp, Homo sapiens
tacttagctggccaa

SEQ ID NO: 5935483 - DNA, 16 bp, Homo sapiens
tacttagcttatcaat

SEQ ID NO: 5935484 - DNA, 22 bp, Homo sapiens
tacttagcttatcaatttgtca

SEQ ID NO: 5935485 - DNA, 15 bp, Homo sapiens
tacttaggaaatact

SEQ ID NO: 5935486 - DNA, 16 bp, Homo sapiens
tacttaggttattttg

SEQ ID NO: 5935487 - DNA, 15 bp, Homo sapiens
tacttagtattgcaa

SEQ ID NO: 5935488 - DNA, 17 bp, Homo sapiens
tacttagtggtgtatat

SEQ ID NO: 5935489 - DNA, 13 bp, Homo sapiens
tacttatacacct

SEQ ID NO: 5935490 - DNA, 17 bp, Homo sapiens
tacttatataattgcca

SEQ ID NO: 5935491 - DNA, 16 bp, Homo sapiens
tacttatattttcgta

SEQ ID NO: 5935492 - DNA, 20 bp, Homo sapiens
tacttatattttcgtatgaa

SEQ ID NO: 5935493 - DNA, 22 bp, Homo sapiens
tacttatattttcgtatgaaaa

SEQ ID NO: 5935494 - DNA, 16 bp, Homo sapiens
tacttatcatttttgt

SEQ ID NO: 5935495 - DNA, 18 bp, Homo sapiens
tacttatcatttttgtat

SEQ ID NO: 5935496 - DNA, 23 bp, Homo sapiens
tacttatcatttttgtataaaaa

SEQ ID NO: 5935497 - DNA, 13 bp, Homo sapiens
tacttatccctgc

SEQ ID NO: 5935498 - DNA, 21 bp, Homo sapiens
tacttatccctgcccatttca

SEQ ID NO: 5935499 - DNA, 23 bp, Homo sapiens
tacttatccctgcccatttcata

SEQ ID NO: 5935500 - DNA, 18 bp, Homo sapiens
tacttatgcaagatattt

SEQ ID NO: 5935501 - DNA, 20 bp, Homo sapiens
tacttatgcacatttgtgca

SEQ ID NO: 5935502 - DNA, 18 bp, Homo sapiens
tacttattaaaaaatttg

SEQ ID NO: 5935503 - DNA, 21 bp, Homo sapiens
tacttattaagagcaaacttt

SEQ ID NO: 5935504 - DNA, 17 bp, Homo sapiens
tacttattacagtctta

SEQ ID NO: 5935505 - DNA, 21 bp, Homo sapiens
tacttattacagtcttattta

SEQ ID NO: 5935506 - DNA, 13 bp, Homo sapiens
tacttattcttcc

SEQ ID NO: 5935507 - DNA, 18 bp, Homo sapiens
tacttatttacctataaa

SEQ ID NO: 5935508 - DNA, 14 bp, Homo sapiens
tacttatttctcag

SEQ ID NO: 5935509 - DNA, 21 bp, Homo sapiens
tacttattttctgttcagatt

SEQ ID NO: 5935510 - DNA, 23 bp, Homo sapiens
tacttattttctgttcagattaa

SEQ ID NO: 5935511 - DNA, 20 bp, Homo sapiens
tacttatttttgacagtgtt

SEQ ID NO: 5935512 - DNA, 19 bp, Homo sapiens
tacttcaaagtgcctgggc

SEQ ID NO: 5935513 - DNA, 19 bp, Homo sapiens
tacttcaaatccttgaaga

SEQ ID NO: 5935514 - DNA, 12 bp, Homo sapiens
tacttcaaatgt

SEQ ID NO: 5935515 - DNA, 19 bp, Homo sapiens
tacttcacactgaactcag

SEQ ID NO: 5935516 - DNA, 21 bp, Homo sapiens
tacttcacccggctgggctcc

SEQ ID NO: 5935517 - DNA, 14 bp, Homo sapiens
tacttgttcatttc

SEQ ID NO: 5935518 - DNA, 15 bp, Homo sapiens
tacttgttctgtatt

SEQ ID NO: 5935519 - DNA, 17 bp, Homo sapiens
tacttgttgcctataag

SEQ ID NO: 5935520 - DNA, 14 bp, Homo sapiens
tacttgtttgctat

SEQ ID NO: 5935521 - DNA, 16 bp, Homo sapiens
tacttgtttgctatga

SEQ ID NO: 5935522 - DNA, 19 bp, Homo sapiens
tacttgtttttgtaaagaa

SEQ ID NO: 5935523 - DNA, 14 bp, Homo sapiens
tactttaaaaagga

SEQ ID NO: 5935524 - DNA, 18 bp, Homo sapiens
tactttaaaaatcagttt

SEQ ID NO: 5935525 - DNA, 14 bp, Homo sapiens
tactttaaacttgt

SEQ ID NO: 5935526 - DNA, 15 bp, Homo sapiens
tactttaaaggaaaa

SEQ ID NO: 5935527 - DNA, 20 bp, Homo sapiens
tactttaaaggaaaaaatgt

SEQ ID NO: 5935528 - DNA, 19 bp, Homo sapiens
tactttaaagtagtgatga

SEQ ID NO: 5935529 - DNA, 17 bp, Homo sapiens
tactttaaatgttctgt

SEQ ID NO: 5935530 - DNA, 12 bp, Homo sapiens
tactttaaatta

SEQ ID NO: 5935531 - DNA, 17 bp, Homo sapiens
tactttaaattatatga

SEQ ID NO: 5935532 - DNA, 21 bp, Homo sapiens
tactttaaattatatgatatg

SEQ ID NO: 5935533 - DNA, 14 bp, Homo sapiens
tactttaacagtct

SEQ ID NO: 5935534 - DNA, 14 bp, Homo sapiens
tactttaacatttt

SEQ ID NO: 5935535 - DNA, 15 bp, Homo sapiens
tactttaaccctttc

SEQ ID NO: 5935536 - DNA, 15 bp, Homo sapiens
tactttaacctccct

SEQ ID NO: 5935537 - DNA, 14 bp, Homo sapiens
tactttaagtgata

SEQ ID NO: 5935538 - DNA, 21 bp, Homo sapiens
tactttaatgattataatcat

SEQ ID NO: 5935539 - DNA, 22 bp, Homo sapiens
tactttaattactggaattctt

SEQ ID NO: 5935540 - DNA, 18 bp, Homo sapiens
tactttacacaattctta

SEQ ID NO: 5935541 - DNA, 15 bp, Homo sapiens
tactttaccaccccc

SEQ ID NO: 5935542 - DNA, 19 bp, Homo sapiens
tactttaccacccccacac

SEQ ID NO: 5935543 - DNA, 22 bp, Homo sapiens
tactttacctctctgtcatgtg

SEQ ID NO: 5935544 - DNA, 16 bp, Homo sapiens
tactttacttttgctg

SEQ ID NO: 5935545 - DNA, 17 bp, Homo sapiens
tactttacttttgctgt

SEQ ID NO: 5935546 - DNA, 14 bp, Homo sapiens
tactttagaagcac

SEQ ID NO: 5935547 - DNA, 21 bp, Homo sapiens
tactttagccatcataactca

SEQ ID NO: 5935548 - DNA, 19 bp, Homo sapiens
tactttatagaagaatgca

SEQ ID NO: 5935549 - DNA, 12 bp, Homo sapiens
tactttatatct

SEQ ID NO: 5935550 - DNA, 13 bp, Homo sapiens
tactttatatctt

SEQ ID NO: 5935551 - DNA, 18 bp, Homo sapiens
tactttatcactttttga

SEQ ID NO: 5935552 - DNA, 20 bp, Homo sapiens
tactttatctgtgaccacac

SEQ ID NO: 5935553 - DNA, 19 bp, Homo sapiens
tactttatgagcagcaaga

SEQ ID NO: 5935554 - DNA, 20 bp, Homo sapiens
tactttatgttactacatgc

SEQ ID NO: 5935555 - DNA, 17 bp, Homo sapiens
tactttattaacttacg

SEQ ID NO: 5935556 - DNA, 15 bp, Homo sapiens
tactttattataaaa

SEQ ID NO: 5935557 - DNA, 21 bp, Homo sapiens
tactttattgtacagactgtt

SEQ ID NO: 5935558 - DNA, 22 bp, Homo sapiens
tactttattgtacagactgttt

SEQ ID NO: 5935559 - DNA, 23 bp, Homo sapiens
tactttcaaaagagtagaaagct

SEQ ID NO: 5935560 - DNA, 12 bp, Homo sapiens
tactttcaaaat

SEQ ID NO: 5935561 - DNA, 18 bp, Homo sapiens
tactttcaaaatgaattt

SEQ ID NO: 5935562 - DNA, 12 bp, Homo sapiens
tactttcaagta

SEQ ID NO: 5935563 - DNA, 17 bp, Homo sapiens
tactttcaagtaatatt

SEQ ID NO: 5935564 - DNA, 20 bp, Homo sapiens
tactttcatcctgactctgc

SEQ ID NO: 5935565 - DNA, 17 bp, Homo sapiens
tactttcatcttaaact

SEQ ID NO: 5935566 - DNA, 18 bp, Homo sapiens
tactttcatcttaaacta

SEQ ID NO: 5935567 - DNA, 15 bp, Homo sapiens
tactttccaattctc

SEQ ID NO: 5935568 - DNA, 23 bp, Homo sapiens
tactttccacaaatctataaaga

SEQ ID NO: 5935569 - DNA, 22 bp, Homo sapiens
tactttccacttgattttgcaa

SEQ ID NO: 5935570 - DNA, 15 bp, Homo sapiens
tactttccatgtttt

SEQ ID NO: 5935571 - DNA, 18 bp, Homo sapiens
tactttccctaccctcta

SEQ ID NO: 5935572 - DNA, 14 bp, Homo sapiens
tactttccctctgg

SEQ ID NO: 5935573 - DNA, 15 bp, Homo sapiens
tactttccctctggg

SEQ ID NO: 5935574 - DNA, 22 bp, Homo sapiens
tactttcctgatgttgataata

SEQ ID NO: 5935575 - DNA, 18 bp, Homo sapiens
tactttcgaaatttcatt

SEQ ID NO: 5935576 - DNA, 17 bp, Homo sapiens
tactttcgtacattggc

SEQ ID NO: 5935577 - DNA, 23 bp, Homo sapiens
tactttcgttaatcttgctgctt

SEQ ID NO: 5935578 - DNA, 21 bp, Homo sapiens
tactttctatctcatctgtct

SEQ ID NO: 5935579 - DNA, 17 bp, Homo sapiens
tactttctatgtgacat

SEQ ID NO: 5935580 - DNA, 22 bp, Homo sapiens
tactttctatttttatgatgac

SEQ ID NO: 5935581 - DNA, 13 bp, Homo sapiens
tactttctcacat

SEQ ID NO: 5935582 - DNA, 15 bp, Homo sapiens
tactttctctctcct

SEQ ID NO: 5935583 - DNA, 18 bp, Homo sapiens
tactttctcttgtttaaa

SEQ ID NO: 5935584 - DNA, 13 bp, Homo sapiens
tactttctgaaaa

SEQ ID NO: 5935585 - DNA, 17 bp, Homo sapiens
tactttctgtactaaac

SEQ ID NO: 5935586 - DNA, 19 bp, Homo sapiens
tactttctgtactaaacat

SEQ ID NO: 5935587 - DNA, 17 bp, Homo sapiens
tactttcttcaggtaaa

SEQ ID NO: 5935588 - DNA, 12 bp, Homo sapiens
tactttgaaaac

SEQ ID NO: 5935589 - DNA, 17 bp, Homo sapiens
tactttgaaaacaattc

SEQ ID NO: 5935590 - DNA, 18 bp, Homo sapiens
tactttgaaaacaattca

SEQ ID NO: 5935591 - DNA, 22 bp, Homo sapiens
tactttgaaaacaccagctgta

SEQ ID NO: 5935592 - DNA, 11 bp, Homo sapiens
tactttgaaat

SEQ ID NO: 5935593 - DNA, 13 bp, Homo sapiens
tactttgaaatat

SEQ ID NO: 5935594 - DNA, 13 bp, Homo sapiens
tactttgaatgtg

SEQ ID NO: 5935595 - DNA, 22 bp, Homo sapiens
tactttgaatgtgtttcacagt

SEQ ID NO: 5935596 - DNA, 17 bp, Homo sapiens
tactttgacaaggaaaa

SEQ ID NO: 5935597 - DNA, 20 bp, Homo sapiens
tactttgacagtgtttttag

SEQ ID NO: 5935598 - DNA, 14 bp, Homo sapiens
tactttgacttttt

SEQ ID NO: 5935599 - DNA, 16 bp, Homo sapiens
tactttgagtaaactt

SEQ ID NO: 5935600 - DNA, 20 bp, Homo sapiens
tactttgattcacatgtttt

SEQ ID NO: 5935601 - DNA, 23 bp, Homo sapiens
tactttgattcacatgttttcaa

SEQ ID NO: 5935602 - DNA, 22 bp, Homo sapiens
tactttgcaatccaaataaaga

SEQ ID NO: 5935603 - DNA, 19 bp, Homo sapiens
tactttgcattttgtttca

SEQ ID NO: 5935604 - DNA, 14 bp, Homo sapiens
tactttgccatttt

SEQ ID NO: 5935605 - DNA, 19 bp, Homo sapiens
tactttgccttttgcaaac

SEQ ID NO: 5935606 - DNA, 20 bp, Homo sapiens
tactttgccttttgcaaact

SEQ ID NO: 5935607 - DNA, 13 bp, Homo sapiens
tactttgctatgt

SEQ ID NO: 5935608 - DNA, 19 bp, Homo sapiens
tactttgctctcttcttct

SEQ ID NO: 5935609 - DNA, 14 bp, Homo sapiens
tactttgcttcata

SEQ ID NO: 5935610 - DNA, 13 bp, Homo sapiens
tactttgcttccg

SEQ ID NO: 5935611 - DNA, 12 bp, Homo sapiens
tactttgcttct

SEQ ID NO: 5935612 - DNA, 12 bp, Homo sapiens
tactttgcttga

SEQ ID NO: 5935613 - DNA, 23 bp, Homo sapiens
tactttggaacactactcttaca

SEQ ID NO: 5935614 - DNA, 20 bp, Homo sapiens
tactttggaatacatttctc

SEQ ID NO: 5935615 - DNA, 20 bp, Homo sapiens
tactttggatgcaattaaaa

SEQ ID NO: 5935616 - DNA, 17 bp, Homo sapiens
tactttggcaatttcct

SEQ ID NO: 5935617 - DNA, 18 bp, Homo sapiens
tactttggtttctgtctg

SEQ ID NO: 5935618 - DNA, 11 bp, Homo sapiens
tactttgtaat

SEQ ID NO: 5935619 - DNA, 19 bp, Homo sapiens
tactttgtagactgtttca

SEQ ID NO: 5935620 - DNA, 20 bp, Homo sapiens
tactttgtagatgtattttc

SEQ ID NO: 5935621 - DNA, 16 bp, Homo sapiens
tactttgtatacaagt

SEQ ID NO: 5935622 - DNA, 12 bp, Homo sapiens
tactttgtattg

SEQ ID NO: 5935623 - DNA, 14 bp, Homo sapiens
tactttgtattgtc

SEQ ID NO: 5935624 - DNA, 16 bp, Homo sapiens
tactttgtattgtcct

SEQ ID NO: 5935625 - DNA, 16 bp, Homo sapiens
tactttgtatttgtat

SEQ ID NO: 5935626 - DNA, 19 bp, Homo sapiens
tactttgtctaagaaacat

SEQ ID NO: 5935627 - DNA, 16 bp, Homo sapiens
tactttgtctgaaaaa

SEQ ID NO: 5935628 - DNA, 22 bp, Homo sapiens
tactttgtctttctgcagaaaa

SEQ ID NO: 5935629 - DNA, 15 bp, Homo sapiens
tactttgtgcattct

SEQ ID NO: 5935630 - DNA, 11 bp, Homo sapiens
tactttgtgct

SEQ ID NO: 5935631 - DNA, 22 bp, Homo sapiens
tactttgtgctggggttatctg

SEQ ID NO: 5935632 - DNA, 19 bp, Homo sapiens
tactttgttaaaaacactg

SEQ ID NO: 5935633 - DNA, 19 bp, Homo sapiens
tactttgttaggattttca

SEQ ID NO: 5935634 - DNA, 14 bp, Homo sapiens
tactttgttctgct

SEQ ID NO: 5935635 - DNA, 13 bp, Homo sapiens
tactttgtttatt

SEQ ID NO: 5935636 - DNA, 22 bp, Homo sapiens
tactttgtttattgtaaaacag

SEQ ID NO: 5935637 - DNA, 16 bp, Homo sapiens
tactttgtttcttttg

SEQ ID NO: 5935638 - DNA, 15 bp, Homo sapiens
tacttttaaaaacat

SEQ ID NO: 5935639 - DNA, 18 bp, Homo sapiens
tacttttaaaaacataac

SEQ ID NO: 5935640 - DNA, 17 bp, Homo sapiens
tacttttaaaataaaat

SEQ ID NO: 5935641 - DNA, 15 bp, Homo sapiens
tacttttaaagaatt

SEQ ID NO: 5935642 - DNA, 19 bp, Homo sapiens
tacttttaaataaattatg

SEQ ID NO: 5935643 - DNA, 23 bp, Homo sapiens
tacttttaacgtatgtatttcat

SEQ ID NO: 5935644 - DNA, 18 bp, Homo sapiens
tacttttaccagtttctt

SEQ ID NO: 5935645 - DNA, 19 bp, Homo sapiens
tacttttagtagagacagt

SEQ ID NO: 5935646 - DNA, 19 bp, Homo sapiens
tacttttagttgactcaca

SEQ ID NO: 5935647 - DNA, 16 bp, Homo sapiens
tacttttataataaaa

SEQ ID NO: 5935648 - DNA, 22 bp, Homo sapiens
tacttttataataaaaggaaaa

SEQ ID NO: 5935649 - DNA, 16 bp, Homo sapiens
tacttttattaatatt

SEQ ID NO: 5935650 - DNA, 13 bp, Homo sapiens
tacttttattatt

SEQ ID NO: 5935651 - DNA, 19 bp, Homo sapiens
tacttttatttgcaacatt

SEQ ID NO: 5935652 - DNA, 17 bp, Homo sapiens
tacttttcacactgtct

SEQ ID NO: 5935653 - DNA, 19 bp, Homo sapiens
tacttttcatatttgcact

SEQ ID NO: 5935654 - DNA, 15 bp, Homo sapiens
tacttttccatttat

SEQ ID NO: 5935655 - DNA, 22 bp, Homo sapiens
tacttttcccctgttaaacagt

SEQ ID NO: 5935656 - DNA, 11 bp, Homo sapiens
tacttttcctt

SEQ ID NO: 5935657 - DNA, 16 bp, Homo sapiens
tacttttccttacctt

SEQ ID NO: 5935658 - DNA, 15 bp, Homo sapiens
tacttttccttgcat

SEQ ID NO: 5935659 - DNA, 16 bp, Homo sapiens
tacttttctaaaatct

SEQ ID NO: 5935660 - DNA, 19 bp, Homo sapiens
tacttttctaaaatctaaa

SEQ ID NO: 5935661 - DNA, 16 bp, Homo sapiens
tacttttctgcaatgt

SEQ ID NO: 5935662 - DNA, 19 bp, Homo sapiens
tacttttctggttccaaac

SEQ ID NO: 5935663 - DNA, 17 bp, Homo sapiens
tacttttctgtttagtt

SEQ ID NO: 5935664 - DNA, 21 bp, Homo sapiens
tacttttcttctattgcctct

SEQ ID NO: 5935665 - DNA, 22 bp, Homo sapiens
tacttttcttctattgcctctg

SEQ ID NO: 5935666 - DNA, 20 bp, Homo sapiens
tacttttgaaaaaggatcat

SEQ ID NO: 5935667 - DNA, 15 bp, Homo sapiens
tacttttgaaaatca

SEQ ID NO: 5935668 - DNA, 14 bp, Homo sapiens
tacttttgagtgtg

SEQ ID NO: 5935669 - DNA, 16 bp, Homo sapiens
tacttttgcaaactgt

SEQ ID NO: 5935670 - DNA, 20 bp, Homo sapiens
tacttttgcttttttattta

SEQ ID NO: 5935671 - DNA, 13 bp, Homo sapiens
tacttttggaatc

SEQ ID NO: 5935672 - DNA, 13 bp, Homo sapiens
tacttttggctcc

SEQ ID NO: 5935673 - DNA, 15 bp, Homo sapiens
tacttttggggagga

SEQ ID NO: 5935674 - DNA, 22 bp, Homo sapiens
tacttttggtggagacttggat

SEQ ID NO: 5935675 - DNA, 13 bp, Homo sapiens
tacttttgtaaat

SEQ ID NO: 5935676 - DNA, 17 bp, Homo sapiens
tacttttgtaccagtgt

SEQ ID NO: 5935677 - DNA, 15 bp, Homo sapiens
tactttttaaaaaac

SEQ ID NO: 5935678 - DNA, 17 bp, Homo sapiens
tactttttaaaaataac

SEQ ID NO: 5935679 - DNA, 18 bp, Homo sapiens
tactttttaaaaataact

SEQ ID NO: 5935680 - DNA, 20 bp, Homo sapiens
tactttttaaaatcttttct

SEQ ID NO: 5935681 - DNA, 16 bp, Homo sapiens
tactttttaaaatgtt

SEQ ID NO: 5935682 - DNA, 22 bp, Homo sapiens
tactttttaactggcttcattt

SEQ ID NO: 5935683 - DNA, 20 bp, Homo sapiens
tactttttatactccataca

SEQ ID NO: 5935684 - DNA, 14 bp, Homo sapiens
tactttttatatat

SEQ ID NO: 5935685 - DNA, 15 bp, Homo sapiens
tactttttatgtgct

SEQ ID NO: 5935686 - DNA, 21 bp, Homo sapiens
tactttttatgtgctatgcaa

SEQ ID NO: 5935687 - DNA, 20 bp, Homo sapiens
tactttttattcaattctgt

SEQ ID NO: 5935688 - DNA, 16 bp, Homo sapiens
tactttttatttctaa

SEQ ID NO: 5935689 - DNA, 13 bp, Homo sapiens
tactttttcagtt

SEQ ID NO: 5935690 - DNA, 19 bp, Homo sapiens
tactttttcagttgtttag

SEQ ID NO: 5935691 - DNA, 22 bp, Homo sapiens
tactttttcatgaaaatggagt

SEQ ID NO: 5935692 - DNA, 20 bp, Homo sapiens
tactttttcccatctggctt

SEQ ID NO: 5935693 - DNA, 11 bp, Homo sapiens
tactttttcct

SEQ ID NO: 5935694 - DNA, 16 bp, Homo sapiens
tactttttgtaaatgc

SEQ ID NO: 5935695 - DNA, 17 bp, Homo sapiens
tactttttgtaaatgct

SEQ ID NO: 5935696 - DNA, 14 bp, Homo sapiens
tagaaggagagccc

SEQ ID NO: 5935697 - DNA, 18 bp, Homo sapiens
tagaaggagattgtgggg

SEQ ID NO: 5935698 - DNA, 20 bp, Homo sapiens
tagaaggaggttctaatatt

SEQ ID NO: 5935699 - DNA, 17 bp, Homo sapiens
tagaaggcactgggaat

SEQ ID NO: 5935700 - DNA, 22 bp, Homo sapiens
tagaaggcgtgggggacaagaa

SEQ ID NO: 5935701 - DNA, 14 bp, Homo sapiens
tagaaggcttctct

SEQ ID NO: 5935702 - DNA, 17 bp, Homo sapiens
tagaagggaaagcccat

SEQ ID NO: 5935703 - DNA, 19 bp, Homo sapiens
tagaaggttctctcctccc

SEQ ID NO: 5935704 - DNA, 20 bp, Homo sapiens
tagaagtaggaagtgaaaat

SEQ ID NO: 5935705 - DNA, 19 bp, Homo sapiens
tagaagtataaagaattgt

SEQ ID NO: 5935706 - DNA, 23 bp, Homo sapiens
tagaagtcacattcctgaacagg

SEQ ID NO: 5935707 - DNA, 14 bp, Homo sapiens
tagaagtccacaga

SEQ ID NO: 5935708 - DNA, 18 bp, Homo sapiens
tagaagtccatgagttga

SEQ ID NO: 5935709 - DNA, 17 bp, Homo sapiens
tagaagtctccctgcac

SEQ ID NO: 5935710 - DNA, 16 bp, Homo sapiens
tagaagtctggaaaaa

SEQ ID NO: 5935711 - DNA, 22 bp, Homo sapiens
tagaagtctgtccaaatttaaa

SEQ ID NO: 5935712 - DNA, 21 bp, Homo sapiens
tagaagtcttaattgtgttta

SEQ ID NO: 5935713 - DNA, 16 bp, Homo sapiens
tagaagtcttagatgt

SEQ ID NO: 5935714 - DNA, 15 bp, Homo sapiens
tagaagtcttcatga

SEQ ID NO: 5935715 - DNA, 24 bp, Homo sapiens
tagaagtcttcatgaaatgctatg

SEQ ID NO: 5935716 - DNA, 19 bp, Homo sapiens
tagaagtgagtttgtaaat

SEQ ID NO: 5935717 - DNA, 18 bp, Homo sapiens
tagaagtgcatttctgaa

SEQ ID NO: 5935718 - DNA, 17 bp, Homo sapiens
tagaagtgccatctcaa

SEQ ID NO: 5935719 - DNA, 18 bp, Homo sapiens
tagaagtgccatctcaat

SEQ ID NO: 5935720 - DNA, 19 bp, Homo sapiens
tagaagtggaccaggacag

SEQ ID NO: 5935721 - DNA, 19 bp, Homo sapiens
tagaagtggtttgtagact

SEQ ID NO: 5935722 - DNA, 15 bp, Homo sapiens
tagaagtgtcatgtt

SEQ ID NO: 5935723 - DNA, 19 bp, Homo sapiens
tagaagtgttgtaaaagat

SEQ ID NO: 5935724 - DNA, 13 bp, Homo sapiens
tagaagtgtttta

SEQ ID NO: 5935725 - DNA, 15 bp, Homo sapiens
tagaagttaccaaat

SEQ ID NO: 5935726 - DNA, 16 bp, Homo sapiens
tagaagttactgaatg

SEQ ID NO: 5935727 - DNA, 18 bp, Homo sapiens
tagaagttgtttgtcatc

SEQ ID NO: 5935728 - DNA, 16 bp, Homo sapiens
tagaagtttcccttcc

SEQ ID NO: 5935729 - DNA, 23 bp, Homo sapiens
tagaagtttgtccatttgtaaaa

SEQ ID NO: 5935730 - DNA, 15 bp, Homo sapiens
tagaagttttaaatt

SEQ ID NO: 5935731 - DNA, 13 bp, Homo sapiens
tagaagtttttgt

SEQ ID NO: 5935732 - DNA, 22 bp, Homo sapiens
tagaagtttttgtactgtaaag

SEQ ID NO: 5935733 - DNA, 21 bp, Homo sapiens
tagaataaaagctataaagta

SEQ ID NO: 5935734 - DNA, 12 bp, Homo sapiens
tagaataaacct

SEQ ID NO: 5935735 - DNA, 15 bp, Homo sapiens
tagaataaagaaaaa

SEQ ID NO: 5935736 - DNA, 16 bp, Homo sapiens
tagaataaagaaaaac

SEQ ID NO: 5935737 - DNA, 19 bp, Homo sapiens
tagaataaaggcagttttc

SEQ ID NO: 5935738 - DNA, 18 bp, Homo sapiens
tagaataacaactgctgg

SEQ ID NO: 5935739 - DNA, 14 bp, Homo sapiens
tagaataaggagga

SEQ ID NO: 5935740 - DNA, 22 bp, Homo sapiens
tagaataaggaggaggagggag

SEQ ID NO: 5935741 - DNA, 19 bp, Homo sapiens
tagaataaggattctgaag

SEQ ID NO: 5935742 - DNA, 22 bp, Homo sapiens
tagaataagttatgggttttta

SEQ ID NO: 5935743 - DNA, 19 bp, Homo sapiens
tagaataagttggagaaat

SEQ ID NO: 5935744 - DNA, 16 bp, Homo sapiens
tagaataataaatatt

SEQ ID NO: 5935745 - DNA, 17 bp, Homo sapiens
tagaataataaatattt

SEQ ID NO: 5935746 - DNA, 13 bp, Homo sapiens
tagaataataata

SEQ ID NO: 5935747 - DNA, 21 bp, Homo sapiens
tagaataatgtgggaagaaac

SEQ ID NO: 5935748 - DNA, 11 bp, Homo sapiens
tagaataattc

SEQ ID NO: 5935749 - DNA, 12 bp, Homo sapiens
tagaataattct

SEQ ID NO: 5935750 - DNA, 14 bp, Homo sapiens
tagaataattcttt

SEQ ID NO: 5935751 - DNA, 23 bp, Homo sapiens
tagaatacagttttgagtagagt

SEQ ID NO: 5935752 - DNA, 19 bp, Homo sapiens
tagaatactaataaaatac

SEQ ID NO: 5935753 - DNA, 12 bp, Homo sapiens
tagaatactttt

SEQ ID NO: 5935754 - DNA, 12 bp, Homo sapiens
tagaatagcatg

SEQ ID NO: 5935755 - DNA, 15 bp, Homo sapiens
tagaatataattatc

SEQ ID NO: 5935756 - DNA, 20 bp, Homo sapiens
tagaatatagcatctttcat

SEQ ID NO: 5935757 - DNA, 23 bp, Homo sapiens
tagaatatagcatctttcatatg

SEQ ID NO: 5935758 - DNA, 15 bp, Homo sapiens
tagaatataggtctc

SEQ ID NO: 5935759 - DNA, 11 bp, Homo sapiens
tagaatatata

SEQ ID NO: 5935760 - DNA, 15 bp, Homo sapiens
tagaatatatttcct

SEQ ID NO: 5935761 - DNA, 17 bp, Homo sapiens
tagaatatcctatactg

SEQ ID NO: 5935762 - DNA, 18 bp, Homo sapiens
tagaatatcctatactgg

SEQ ID NO: 5935763 - DNA, 13 bp, Homo sapiens
tagaatatgcctt

SEQ ID NO: 5935764 - DNA, 17 bp, Homo sapiens
tagaatattcagacaaa

SEQ ID NO: 5935765 - DNA, 21 bp, Homo sapiens
tagaatattgtaactcacatg

SEQ ID NO: 5935766 - DNA, 15 bp, Homo sapiens
tagaatcaatcagta

SEQ ID NO: 5935767 - DNA, 16 bp, Homo sapiens
tagaatcaatttaagt

SEQ ID NO: 5935768 - DNA, 21 bp, Homo sapiens
tagaatcagaataaagttgta

SEQ ID NO: 5935769 - DNA, 14 bp, Homo sapiens
tagaatcagataca

SEQ ID NO: 5935770 - DNA, 19 bp, Homo sapiens
tagaatcagggtggagaag

SEQ ID NO: 5935771 - DNA, 15 bp, Homo sapiens
tagaatcatgtattt

SEQ ID NO: 5935772 - DNA, 15 bp, Homo sapiens
tagaatccaaacttg

SEQ ID NO: 5935773 - DNA, 20 bp, Homo sapiens
tagaatccacgtattcccct

SEQ ID NO: 5935774 - DNA, 23 bp, Homo sapiens
tagaatccagcaggtcacactgg

SEQ ID NO: 5935775 - DNA, 21 bp, Homo sapiens
tagaatcccagccccctgacc

SEQ ID NO: 5935776 - DNA, 16 bp, Homo sapiens
tagaatccctgtgtta

SEQ ID NO: 5935777 - DNA, 20 bp, Homo sapiens
tagaatccctgtgttaattt

SEQ ID NO: 5935778 - DNA, 15 bp, Homo sapiens
tagaatcgctttcct

SEQ ID NO: 5935779 - DNA, 17 bp, Homo sapiens
tagaatcgttggactca

SEQ ID NO: 5935780 - DNA, 15 bp, Homo sapiens
tagaatctattttct

SEQ ID NO: 5935781 - DNA, 17 bp, Homo sapiens
tagaatctattttctat

SEQ ID NO: 5935782 - DNA, 18 bp, Homo sapiens
tagaatctattttctatg

SEQ ID NO: 5935783 - DNA, 14 bp, Homo sapiens
tagaatctcagcac

SEQ ID NO: 5935784 - DNA, 20 bp, Homo sapiens
tagaatctcttcatgcttga

SEQ ID NO: 5935785 - DNA, 18 bp, Homo sapiens
tagaatctgcaattcaaa

SEQ ID NO: 5935786 - DNA, 13 bp, Homo sapiens
tagaatcttttaa

SEQ ID NO: 5935787 - DNA, 17 bp, Homo sapiens
tagaatgaaaactcatt

SEQ ID NO: 5935788 - DNA, 14 bp, Homo sapiens
tagaatgaaaagtt

SEQ ID NO: 5935789 - DNA, 18 bp, Homo sapiens
tagaatgaaccactgccc

SEQ ID NO: 5935790 - DNA, 19 bp, Homo sapiens
tagaatgaatttatcttta

SEQ ID NO: 5935791 - DNA, 16 bp, Homo sapiens
tagaatgaccttgtaa

SEQ ID NO: 5935792 - DNA, 19 bp, Homo sapiens
tagaatgaccttgtaatgt

SEQ ID NO: 5935793 - DNA, 13 bp, Homo sapiens
tagaatgagaaat

SEQ ID NO: 5935794 - DNA, 14 bp, Homo sapiens
tagaatgagatctg

SEQ ID NO: 5935795 - DNA, 15 bp, Homo sapiens
tagaatgattaatca

SEQ ID NO: 5935796 - DNA, 16 bp, Homo sapiens
tagaatgattaatcaa

SEQ ID NO: 5935797 - DNA, 19 bp, Homo sapiens
tagaatgatttttgctatt

SEQ ID NO: 5935798 - DNA, 16 bp, Homo sapiens
tagaatgccggttaaa

SEQ ID NO: 5935799 - DNA, 15 bp, Homo sapiens
tagaatgctgcgctt

SEQ ID NO: 5935800 - DNA, 14 bp, Homo sapiens
tagaatgctgtaga

SEQ ID NO: 5935801 - DNA, 20 bp, Homo sapiens
tagaatggaggaagaacaac

SEQ ID NO: 5935802 - DNA, 22 bp, Homo sapiens
tagaatggataaaataatgctg

SEQ ID NO: 5935803 - DNA, 15 bp, Homo sapiens
tagaatggtgatttt

SEQ ID NO: 5935804 - DNA, 17 bp, Homo sapiens
tagaatggtgattttaa

SEQ ID NO: 5935805 - DNA, 19 bp, Homo sapiens
tagaatggtgattttaaat

SEQ ID NO: 5935806 - DNA, 20 bp, Homo sapiens
tagaatggtgattttaaatg

SEQ ID NO: 5935807 - DNA, 21 bp, Homo sapiens
tagaatggtgattttaaatgt

SEQ ID NO: 5935808 - DNA, 17 bp, Homo sapiens
tagaatgtaaagcttgt

SEQ ID NO: 5935809 - DNA, 15 bp, Homo sapiens
tagaatgtaaagtta

SEQ ID NO: 5935810 - DNA, 16 bp, Homo sapiens
tagaatgtaaatgtct

SEQ ID NO: 5935811 - DNA, 18 bp, Homo sapiens
tagaatgtattgtacctt

SEQ ID NO: 5935812 - DNA, 22 bp, Homo sapiens
tagaatgtattgtaccttttaa

SEQ ID NO: 5935813 - DNA, 22 bp, Homo sapiens
tagaatgtcaataaatttgctt

SEQ ID NO: 5935814 - DNA, 23 bp, Homo sapiens
tagaatgtcaataaatttgcttt

SEQ ID NO: 5935815 - DNA, 20 bp, Homo sapiens
tagaatgtctgaagtacaaa

SEQ ID NO: 5935816 - DNA, 13 bp, Homo sapiens
tagaatgtgaaaa

SEQ ID NO: 5935817 - DNA, 13 bp, Homo sapiens
tagaatgtgattt

SEQ ID NO: 5935818 - DNA, 19 bp, Homo sapiens
tagaatgtgtgtcaattta

SEQ ID NO: 5935819 - DNA, 19 bp, Homo sapiens
tagaatgttattgtgtata

SEQ ID NO: 5935820 - DNA, 21 bp, Homo sapiens
tagaatgttattgtgtataga

SEQ ID NO: 5935821 - DNA, 12 bp, Homo sapiens
tagaatgttgaa

SEQ ID NO: 5935822 - DNA, 18 bp, Homo sapiens
tagaatgttttcaaatgt

SEQ ID NO: 5935823 - DNA, 19 bp, Homo sapiens
tagaatgttttcaaatgtt

SEQ ID NO: 5935824 - DNA, 21 bp, Homo sapiens
tagaattaaaaaagcatactt

SEQ ID NO: 5935825 - DNA, 15 bp, Homo sapiens
tagaattaacacatg

SEQ ID NO: 5935826 - DNA, 21 bp, Homo sapiens
tagaattaccattaattacat

SEQ ID NO: 5935827 - DNA, 15 bp, Homo sapiens
tagaattaccatttg

SEQ ID NO: 5935828 - DNA, 16 bp, Homo sapiens
tagaattagtatgtct

SEQ ID NO: 5935829 - DNA, 15 bp, Homo sapiens
tagaattatatctaa

SEQ ID NO: 5935830 - DNA, 21 bp, Homo sapiens
tagaattatatctaatttata

SEQ ID NO: 5935831 - DNA, 17 bp, Homo sapiens
tagaattatattttctt

SEQ ID NO: 5935832 - DNA, 15 bp, Homo sapiens
tagaattatctaatt

SEQ ID NO: 5935833 - DNA, 16 bp, Homo sapiens
tagaattatctaattt

SEQ ID NO: 5935834 - DNA, 22 bp, Homo sapiens
tagaattatctaatttataaaa

SEQ ID NO: 5935835 - DNA, 23 bp, Homo sapiens
tagaattatctaatttataaaaa

SEQ ID NO: 5935836 - DNA, 15 bp, Homo sapiens
tagaattatttaaac

SEQ ID NO: 5935837 - DNA, 20 bp, Homo sapiens
tagaattatttcacaaataa

SEQ ID NO: 5935838 - DNA, 23 bp, Homo sapiens
tagaattatttcacaaataatag

SEQ ID NO: 5935839 - DNA, 15 bp, Homo sapiens
tagaattccctctct

SEQ ID NO: 5935840 - DNA, 21 bp, Homo sapiens
tagaattccttcgaaaggcct

SEQ ID NO: 5935841 - DNA, 22 bp, Homo sapiens
tagaattccttttataagattt

SEQ ID NO: 5935842 - DNA, 21 bp, Homo sapiens
tagaattctagcttttttcct

SEQ ID NO: 5935843 - DNA, 22 bp, Homo sapiens
tagaattctagcttttttcctc

SEQ ID NO: 5935844 - DNA, 18 bp, Homo sapiens
tagaattctagtgctgct

SEQ ID NO: 5935845 - DNA, 13 bp, Homo sapiens
tagaattctgtat

SEQ ID NO: 5935846 - DNA, 16 bp, Homo sapiens
tagaattctgtataga

SEQ ID NO: 5935847 - DNA, 18 bp, Homo sapiens
tagaattgaaggtttttg

SEQ ID NO: 5935848 - DNA, 20 bp, Homo sapiens
tagaattgaaggtttttgat

SEQ ID NO: 5935849 - DNA, 21 bp, Homo sapiens
tagaattgaaggtttttgata

SEQ ID NO: 5935850 - DNA, 19 bp, Homo sapiens
tagaattgacattgaaatc

SEQ ID NO: 5935851 - DNA, 17 bp, Homo sapiens
tagaattgagtgtttaa

SEQ ID NO: 5935852 - DNA, 15 bp, Homo sapiens
tagaattgatttcca

SEQ ID NO: 5935853 - DNA, 15 bp, Homo sapiens
tagaattgcattgac

SEQ ID NO: 5935854 - DNA, 16 bp, Homo sapiens
tagaattgctggatgc

SEQ ID NO: 5935855 - DNA, 19 bp, Homo sapiens
tagaattggctgaactcat

SEQ ID NO: 5935856 - DNA, 18 bp, Homo sapiens
tagaattgtagactgatg

SEQ ID NO: 5935857 - DNA, 17 bp, Homo sapiens
tagaatttaatatatat

SEQ ID NO: 5935858 - DNA, 13 bp, Homo sapiens
tagaatttcctaa

SEQ ID NO: 5935859 - DNA, 19 bp, Homo sapiens
tagaatttcctgtaatata

SEQ ID NO: 5935860 - DNA, 20 bp, Homo sapiens
tagaatttgatatgtgaaca

SEQ ID NO: 5935861 - DNA, 13 bp, Homo sapiens
tagaatttgatta

SEQ ID NO: 5935862 - DNA, 18 bp, Homo sapiens
tagaatttgtttcatcta

SEQ ID NO: 5935863 - DNA, 23 bp, Homo sapiens
tagaattttaagcctttgttgaa

SEQ ID NO: 5935864 - DNA, 15 bp, Homo sapiens
tagaatttttaccca

SEQ ID NO: 5935865 - DNA, 14 bp, Homo sapiens
tagacaaaaagtat

SEQ ID NO: 5935866 - DNA, 15 bp, Homo sapiens
tagacaaaaagtata

SEQ ID NO: 5935867 - DNA, 16 bp, Homo sapiens
tagacaaaaagtatat

SEQ ID NO: 5935868 - DNA, 18 bp, Homo sapiens
tagacaaaaggaaaggtc

SEQ ID NO: 5935869 - DNA, 15 bp, Homo sapiens
tagacaaaagtttca

SEQ ID NO: 5935870 - DNA, 20 bp, Homo sapiens
tagacaaagccttaagcaaa

SEQ ID NO: 5935871 - DNA, 12 bp, Homo sapiens
tagacaaagtac

SEQ ID NO: 5935872 - DNA, 14 bp, Homo sapiens
tagacaaatactca

SEQ ID NO: 5935873 - DNA, 15 bp, Homo sapiens
tagacaaatactcat

SEQ ID NO: 5935874 - DNA, 20 bp, Homo sapiens
tagaggatgtggcaggggca

SEQ ID NO: 5935875 - DNA, 19 bp, Homo sapiens
tagaggattgtccaccttc

SEQ ID NO: 5935876 - DNA, 19 bp, Homo sapiens
tagaggcagggaggggact

SEQ ID NO: 5935877 - DNA, 21 bp, Homo sapiens
tagaggcatgaacacacatgg

SEQ ID NO: 5935878 - DNA, 20 bp, Homo sapiens
tagaggcatgggcttgctgt

SEQ ID NO: 5935879 - DNA, 19 bp, Homo sapiens
tagaggcatttgtcttaga

SEQ ID NO: 5935880 - DNA, 22 bp, Homo sapiens
tagaggccaaattaatctttta

SEQ ID NO: 5935881 - DNA, 18 bp, Homo sapiens
tagaggccagccccaccc

SEQ ID NO: 5935882 - DNA, 20 bp, Homo sapiens
tagaggccagccccacccag

SEQ ID NO: 5935883 - DNA, 16 bp, Homo sapiens
tagaggccagggcagc

SEQ ID NO: 5935884 - DNA, 18 bp, Homo sapiens
tagaggccatgtctcctg

SEQ ID NO: 5935885 - DNA, 18 bp, Homo sapiens
tagaggcccaggcaccac

SEQ ID NO: 5935886 - DNA, 21 bp, Homo sapiens
tagaggcctgaaatcctggtt

SEQ ID NO: 5935887 - DNA, 14 bp, Homo sapiens
tagaggcctggggc

SEQ ID NO: 5935888 - DNA, 18 bp, Homo sapiens
tagaggcgagccaggcaa

SEQ ID NO: 5935889 - DNA, 22 bp, Homo sapiens
tagaggctccagctctggcaca

SEQ ID NO: 5935890 - DNA, 19 bp, Homo sapiens
tagaggctccccagggctc

SEQ ID NO: 5935891 - DNA, 18 bp, Homo sapiens
tagaggctttcaaatgta

SEQ ID NO: 5935892 - DNA, 23 bp, Homo sapiens
tagagggacggccaagaatgtac

SEQ ID NO: 5935893 - DNA, 20 bp, Homo sapiens
tagagggaggtgtttaaaga

SEQ ID NO: 5935894 - DNA, 18 bp, Homo sapiens
tagagggagtagaaagct

SEQ ID NO: 5935895 - DNA, 19 bp, Homo sapiens
tagagggccttgcttctct

SEQ ID NO: 5935896 - DNA, 22 bp, Homo sapiens
tagagggcgagggatgatgagg

SEQ ID NO: 5935897 - DNA, 23 bp, Homo sapiens
tagagggcgagggatgatgaggg

SEQ ID NO: 5935898 - DNA, 19 bp, Homo sapiens
tagaggggaaacgagaagg

SEQ ID NO: 5935899 - DNA, 21 bp, Homo sapiens
tagaggggacaagccaggccc

SEQ ID NO: 5935900 - DNA, 23 bp, Homo sapiens
tagaggggccagcggccctccca

SEQ ID NO: 5935901 - DNA, 13 bp, Homo sapiens
tagagggttcctg

SEQ ID NO: 5935902 - DNA, 16 bp, Homo sapiens
tagagggttgctgcct

SEQ ID NO: 5935903 - DNA, 19 bp, Homo sapiens
tagaggtacacttgtgaat

SEQ ID NO: 5935904 - DNA, 23 bp, Homo sapiens
tagaggtaccagcaatatgtaaa

SEQ ID NO: 5935905 - DNA, 18 bp, Homo sapiens
tagaggtactagaatgct

SEQ ID NO: 5935906 - DNA, 17 bp, Homo sapiens
tagaggtataattgtgt

SEQ ID NO: 5935907 - DNA, 16 bp, Homo sapiens
tagaggtgcatgccta

SEQ ID NO: 5935908 - DNA, 16 bp, Homo sapiens
tagaggtgggcagctg

SEQ ID NO: 5935909 - DNA, 14 bp, Homo sapiens
tagaggttcaaaga

SEQ ID NO: 5935910 - DNA, 16 bp, Homo sapiens
tagaggttctgcctct

SEQ ID NO: 5935911 - DNA, 20 bp, Homo sapiens
tagaggttctgcctctattt

SEQ ID NO: 5935912 - DNA, 21 bp, Homo sapiens
tagaggttcttgatttttaca

SEQ ID NO: 5935913 - DNA, 21 bp, Homo sapiens
tagaggtttaaagaaaaatca

SEQ ID NO: 5935914 - DNA, 18 bp, Homo sapiens
tagagtaaatacaggtag

SEQ ID NO: 5935915 - DNA, 20 bp, Homo sapiens
tagagtaacgagaagtgctt

SEQ ID NO: 5935916 - DNA, 15 bp, Homo sapiens
tagagtaagaaattt

SEQ ID NO: 5935917 - DNA, 14 bp, Homo sapiens
tagagtaatgaaat

SEQ ID NO: 5935918 - DNA, 17 bp, Homo sapiens
tagagtaatgaaatgga

SEQ ID NO: 5935919 - DNA, 13 bp, Homo sapiens
tagagtacactgc

SEQ ID NO: 5935920 - DNA, 22 bp, Homo sapiens
tagagtacactgcctgccttaa

SEQ ID NO: 5935921 - DNA, 15 bp, Homo sapiens
tagagtacttaatat

SEQ ID NO: 5935922 - DNA, 19 bp, Homo sapiens
tagagtagaggtataattg

SEQ ID NO: 5935923 - DNA, 20 bp, Homo sapiens
tagagtatattgaaaagaaa

SEQ ID NO: 5935924 - DNA, 13 bp, Homo sapiens
tagagtatgtgta

SEQ ID NO: 5935925 - DNA, 14 bp, Homo sapiens
tagagtatttccct

SEQ ID NO: 5935926 - DNA, 15 bp, Homo sapiens
tagagtatttccctt

SEQ ID NO: 5935927 - DNA, 21 bp, Homo sapiens
tagagtatttcccttccaaag

SEQ ID NO: 5935928 - DNA, 22 bp, Homo sapiens
tagagtcacagctttcccaggt

SEQ ID NO: 5935929 - DNA, 23 bp, Homo sapiens
tagagtcacccccccaggcctcc

SEQ ID NO: 5935930 - DNA, 22 bp, Homo sapiens
tagagtcatctccatcagctgt

SEQ ID NO: 5935931 - DNA, 23 bp, Homo sapiens
tagagtcatctccatcagctgta

SEQ ID NO: 5935932 - DNA, 16 bp, Homo sapiens
tagagtcattcatatt

SEQ ID NO: 5935933 - DNA, 17 bp, Homo sapiens
tagagtcattcatattt

SEQ ID NO: 5935934 - DNA, 16 bp, Homo sapiens
tagagtccaaggttta

SEQ ID NO: 5935935 - DNA, 13 bp, Homo sapiens
tagagtctggaat

SEQ ID NO: 5935936 - DNA, 22 bp, Homo sapiens
tagagtcttacaatcaaatctc

SEQ ID NO: 5935937 - DNA, 22 bp, Homo sapiens
tagagtgacaggcaccagatgg

SEQ ID NO: 5935938 - DNA, 22 bp, Homo sapiens
tagagtgacctcggacagagcc

SEQ ID NO: 5935939 - DNA, 16 bp, Homo sapiens
tagagtgaccttttaa

SEQ ID NO: 5935940 - DNA, 17 bp, Homo sapiens
tagagtgaccttttaat

SEQ ID NO: 5935941 - DNA, 16 bp, Homo sapiens
tagagtgagggcctga

SEQ ID NO: 5935942 - DNA, 21 bp, Homo sapiens
tagagtgatgactgcttgtag

SEQ ID NO: 5935943 - DNA, 12 bp, Homo sapiens
tagagtgcccag

SEQ ID NO: 5935944 - DNA, 16 bp, Homo sapiens
tagagtggcagccaag

SEQ ID NO: 5935945 - DNA, 19 bp, Homo sapiens
tagagtggcagccaagagc

SEQ ID NO: 5935946 - DNA, 18 bp, Homo sapiens
tagagtggcccagaattg

SEQ ID NO: 5935947 - DNA, 20 bp, Homo sapiens
tagagtggcccagaattgca

SEQ ID NO: 5935948 - DNA, 17 bp, Homo sapiens
tagagtgtagactgtgg

SEQ ID NO: 5935949 - DNA, 13 bp, Homo sapiens
tagagtgtagcct

SEQ ID NO: 5935950 - DNA, 22 bp, Homo sapiens
tagagtgtagcctaaagggcag

SEQ ID NO: 5935951 - DNA, 15 bp, Homo sapiens
tagagtgtagctgta

SEQ ID NO: 5935952 - DNA, 21 bp, Homo sapiens
tagagtgtagctgtaagggca

SEQ ID NO: 5935953 - DNA, 13 bp, Homo sapiens
tagagtgtcttaa

SEQ ID NO: 5935954 - DNA, 16 bp, Homo sapiens
tagagtgttgttgaga

SEQ ID NO: 5935955 - DNA, 13 bp, Homo sapiens
tagagttaaaagt

SEQ ID NO: 5935956 - DNA, 14 bp, Homo sapiens
tagagttaaaagtt

SEQ ID NO: 5935957 - DNA, 15 bp, Homo sapiens
tagagttaaaagtta

SEQ ID NO: 5935958 - DNA, 15 bp, Homo sapiens
tagagttaacaatga

SEQ ID NO: 5935959 - DNA, 12 bp, Homo sapiens
tagagttaagaa

SEQ ID NO: 5935960 - DNA, 15 bp, Homo sapiens
tagagttaagaagct

SEQ ID NO: 5935961 - DNA, 17 bp, Homo sapiens
tagagttaagaagctgt

SEQ ID NO: 5935962 - DNA, 14 bp, Homo sapiens
tagagttagactgt

SEQ ID NO: 5935963 - DNA, 16 bp, Homo sapiens
tagagttagactgttg

SEQ ID NO: 5935964 - DNA, 12 bp, Homo sapiens
tagagttcggtc

SEQ ID NO: 5935965 - DNA, 16 bp, Homo sapiens
tagagttctattagaa

SEQ ID NO: 5935966 - DNA, 19 bp, Homo sapiens
tagagttctggatgtaaag

SEQ ID NO: 5935967 - DNA, 17 bp, Homo sapiens
tagagttcttctttctt

SEQ ID NO: 5935968 - DNA, 13 bp, Homo sapiens
tagagttggagtt

SEQ ID NO: 5935969 - DNA, 19 bp, Homo sapiens
tagagttggcctttttaca

SEQ ID NO: 5935970 - DNA, 13 bp, Homo sapiens
tagagtttacagt

SEQ ID NO: 5935971 - DNA, 21 bp, Homo sapiens
tagagtttagccctgaacatt

SEQ ID NO: 5935972 - DNA, 17 bp, Homo sapiens
tagagtttagctggaaa

SEQ ID NO: 5935973 - DNA, 18 bp, Homo sapiens
tagagtttatacagtgta

SEQ ID NO: 5935974 - DNA, 20 bp, Homo sapiens
tagagtttatacagtgtaca

SEQ ID NO: 5935975 - DNA, 22 bp, Homo sapiens
tagagtttatacagtgtacatg

SEQ ID NO: 5935976 - DNA, 23 bp, Homo sapiens
tagagtttatttttttgatggct

SEQ ID NO: 5935977 - DNA, 22 bp, Homo sapiens
tagagtttcaaccatgaagtct

SEQ ID NO: 5935978 - DNA, 21 bp, Homo sapiens
tagagtttctgtttgattctt

SEQ ID NO: 5935979 - DNA, 14 bp, Homo sapiens
tagagtttgatcat

SEQ ID NO: 5935980 - DNA, 21 bp, Homo sapiens
tagataaaacatctttgaaat

SEQ ID NO: 5935981 - DNA, 15 bp, Homo sapiens
tagataaaagctgaa

SEQ ID NO: 5935982 - DNA, 14 bp, Homo sapiens
tagataaaattgaa

SEQ ID NO: 5935983 - DNA, 15 bp, Homo sapiens
tagataaacacaggc

SEQ ID NO: 5935984 - DNA, 14 bp, Homo sapiens
tagataaaggaaac

SEQ ID NO: 5935985 - DNA, 18 bp, Homo sapiens
tagataaataaatatatg

SEQ ID NO: 5935986 - DNA, 16 bp, Homo sapiens
tagataaatatttgac

SEQ ID NO: 5935987 - DNA, 12 bp, Homo sapiens
tagataaattac

SEQ ID NO: 5935988 - DNA, 14 bp, Homo sapiens
tagataaattacta

SEQ ID NO: 5935989 - DNA, 13 bp, Homo sapiens
tagataaattgta

SEQ ID NO: 5935990 - DNA, 21 bp, Homo sapiens
tagataaattgtagggcttta

SEQ ID NO: 5935991 - DNA, 16 bp, Homo sapiens
tagataacaagaatac

SEQ ID NO: 5935992 - DNA, 17 bp, Homo sapiens
tagataacaagaataca

SEQ ID NO: 5935993 - DNA, 15 bp, Homo sapiens
tagataactctttgg

SEQ ID NO: 5935994 - DNA, 16 bp, Homo sapiens
tagataactgctcttt

SEQ ID NO: 5935995 - DNA, 21 bp, Homo sapiens
tagataactgctcttttacta

SEQ ID NO: 5935996 - DNA, 17 bp, Homo sapiens
tagataacttaaataat

SEQ ID NO: 5935997 - DNA, 18 bp, Homo sapiens
tagataacttcttgaaaa

SEQ ID NO: 5935998 - DNA, 20 bp, Homo sapiens
tagataacttcttgaaaaag

SEQ ID NO: 5935999 - DNA, 17 bp, Homo sapiens
tagataaggtttcctgc

SEQ ID NO: 5936000 - DNA, 20 bp, Homo sapiens
tagataataactgtcttctg

SEQ ID NO: 5936001 - DNA, 18 bp, Homo sapiens
tagataatacaccactac

SEQ ID NO: 5936002 - DNA, 17 bp, Homo sapiens
tagataatcttttacat

SEQ ID NO: 5936003 - DNA, 20 bp, Homo sapiens
tagataattaaatagtgaga

SEQ ID NO: 5936004 - DNA, 14 bp, Homo sapiens
tagataattatcca

SEQ ID NO: 5936005 - DNA, 21 bp, Homo sapiens
tagataatttattatacacct

SEQ ID NO: 5936006 - DNA, 17 bp, Homo sapiens
tagataatttgaaaaag

SEQ ID NO: 5936007 - DNA, 14 bp, Homo sapiens
tagatacaataaat

SEQ ID NO: 5936008 - DNA, 17 bp, Homo sapiens
tagatacaataaattgc

SEQ ID NO: 5936009 - DNA, 14 bp, Homo sapiens
tagatacaatcagc

SEQ ID NO: 5936010 - DNA, 16 bp, Homo sapiens
tagatacaatcagctg

SEQ ID NO: 5936011 - DNA, 21 bp, Homo sapiens
tagatacacctcaactaaatc

SEQ ID NO: 5936012 - DNA, 19 bp, Homo sapiens
tagatacactaaaaatctg

SEQ ID NO: 5936013 - DNA, 18 bp, Homo sapiens
tagatacacttcttaaat

SEQ ID NO: 5936014 - DNA, 14 bp, Homo sapiens
tagatacagaataa

SEQ ID NO: 5936015 - DNA, 21 bp, Homo sapiens
tagatacagatccgcatgtgt

SEQ ID NO: 5936016 - DNA, 23 bp, Homo sapiens
tagatacaggactggttccttcc

SEQ ID NO: 5936017 - DNA, 18 bp, Homo sapiens
tagatacatgctttttaa

SEQ ID NO: 5936018 - DNA, 19 bp, Homo sapiens
tagataccattttgaaata

SEQ ID NO: 5936019 - DNA, 22 bp, Homo sapiens
tagataccctacgctgtccaga

SEQ ID NO: 5936020 - DNA, 16 bp, Homo sapiens
tagatacgaaatcagt

SEQ ID NO: 5936021 - DNA, 23 bp, Homo sapiens
tagatacgaaatcagtttctcaa

SEQ ID NO: 5936022 - DNA, 13 bp, Homo sapiens
tagatactacttt

SEQ ID NO: 5936023 - DNA, 16 bp, Homo sapiens
tagatactactttctc

SEQ ID NO: 5936024 - DNA, 16 bp, Homo sapiens
tagatacttaaaggaa

SEQ ID NO: 5936025 - DNA, 23 bp, Homo sapiens
tagatagaaataaatagctatat

SEQ ID NO: 5936026 - DNA, 20 bp, Homo sapiens
tagatagcagcctggctccc

SEQ ID NO: 5936027 - DNA, 15 bp, Homo sapiens
tagatagccctgtcc

SEQ ID NO: 5936028 - DNA, 17 bp, Homo sapiens
tagatagccctgtcctg

SEQ ID NO: 5936029 - DNA, 19 bp, Homo sapiens
tagatagccctgtcctggt

SEQ ID NO: 5936030 - DNA, 21 bp, Homo sapiens
tagatagctgactcattcttt

SEQ ID NO: 5936031 - DNA, 17 bp, Homo sapiens
tagataggccatgggca

SEQ ID NO: 5936032 - DNA, 17 bp, Homo sapiens
tagataggcccctgggg

SEQ ID NO: 5936033 - DNA, 15 bp, Homo sapiens
tagatagtcatgctg

SEQ ID NO: 5936034 - DNA, 16 bp, Homo sapiens
tagatagtcatgctgc

SEQ ID NO: 5936035 - DNA, 13 bp, Homo sapiens
tagatagttttgc

SEQ ID NO: 5936036 - DNA, 13 bp, Homo sapiens
tagatataaatat

SEQ ID NO: 5936037 - DNA, 23 bp, Homo sapiens
tagatataaatttttaagagaaa

SEQ ID NO: 5936038 - DNA, 13 bp, Homo sapiens
tagatataatgaa

SEQ ID NO: 5936039 - DNA, 14 bp, Homo sapiens
tagatataatgaac

SEQ ID NO: 5936040 - DNA, 23 bp, Homo sapiens
tagatataatgaacaaaattatt

SEQ ID NO: 5936041 - DNA, 16 bp, Homo sapiens
tagatatagagtcatt

SEQ ID NO: 5936042 - DNA, 23 bp, Homo sapiens
tagatatataactttagaaataa

SEQ ID NO: 5936043 - DNA, 22 bp, Homo sapiens
tagatatattctctaataaaat

SEQ ID NO: 5936044 - DNA, 19 bp, Homo sapiens
tagatatccacttgagaca

SEQ ID NO: 5936045 - DNA, 15 bp, Homo sapiens
tagatatcctctgct

SEQ ID NO: 5936046 - DNA, 23 bp, Homo sapiens
tagatatcgacttgtttttgcac

SEQ ID NO: 5936047 - DNA, 15 bp, Homo sapiens
tagatatgaaagctg

SEQ ID NO: 5936048 - DNA, 14 bp, Homo sapiens
tagatattacttta

SEQ ID NO: 5936049 - DNA, 15 bp, Homo sapiens
tagatattatgtata

SEQ ID NO: 5936050 - DNA, 23 bp, Homo sapiens
tagattaggtcacattacattaa

SEQ ID NO: 5936051 - DNA, 17 bp, Homo sapiens
tagattaggtcttgctg

SEQ ID NO: 5936052 - DNA, 22 bp, Homo sapiens
tagattagtactggattattca

SEQ ID NO: 5936053 - DNA, 22 bp, Homo sapiens
tagattagtagtaaatgcttga

SEQ ID NO: 5936054 - DNA, 15 bp, Homo sapiens
tagattatatcaaag

SEQ ID NO: 5936055 - DNA, 19 bp, Homo sapiens
tagattatatcaaagtatt

SEQ ID NO: 5936056 - DNA, 18 bp, Homo sapiens
tagattatattgagacaa

SEQ ID NO: 5936057 - DNA, 21 bp, Homo sapiens
tagattatattgagacaaaaa

SEQ ID NO: 5936058 - DNA, 22 bp, Homo sapiens
tagattatattgagacaaaaat

SEQ ID NO: 5936059 - DNA, 15 bp, Homo sapiens
tagattatgtctttc

SEQ ID NO: 5936060 - DNA, 18 bp, Homo sapiens
tagattattataaactat

SEQ ID NO: 5936061 - DNA, 17 bp, Homo sapiens
tagattattcataatgt

SEQ ID NO: 5936062 - DNA, 14 bp, Homo sapiens
tagattatttcata

SEQ ID NO: 5936063 - DNA, 17 bp, Homo sapiens
tagattatttctgtatt

SEQ ID NO: 5936064 - DNA, 19 bp, Homo sapiens
tagattatttctgtatttg

SEQ ID NO: 5936065 - DNA, 13 bp, Homo sapiens
tagattcaaaggt

SEQ ID NO: 5936066 - DNA, 17 bp, Homo sapiens
tagattcaaaggttcta

SEQ ID NO: 5936067 - DNA, 21 bp, Homo sapiens
tagattcacctgtaaaacttt

SEQ ID NO: 5936068 - DNA, 15 bp, Homo sapiens
tagattcagagaaat

SEQ ID NO: 5936069 - DNA, 19 bp, Homo sapiens
tagattcaggggaagggca

SEQ ID NO: 5936070 - DNA, 19 bp, Homo sapiens
tagattcaggtaatacaaa

SEQ ID NO: 5936071 - DNA, 13 bp, Homo sapiens
tagattcataaat

SEQ ID NO: 5936072 - DNA, 15 bp, Homo sapiens
tagattcatctatgg

SEQ ID NO: 5936073 - DNA, 14 bp, Homo sapiens
tagattcccttgca

SEQ ID NO: 5936074 - DNA, 18 bp, Homo sapiens
tagattcccttgcactgt

SEQ ID NO: 5936075 - DNA, 19 bp, Homo sapiens
tagattcctacttaaacaa

SEQ ID NO: 5936076 - DNA, 21 bp, Homo sapiens
tagattcctacttaaacaaaa

SEQ ID NO: 5936077 - DNA, 15 bp, Homo sapiens
tagattcctttcctg

SEQ ID NO: 5936078 - DNA, 11 bp, Homo sapiens
tagattctaaa

SEQ ID NO: 5936079 - DNA, 13 bp, Homo sapiens
tagattctaaaga

SEQ ID NO: 5936080 - DNA, 15 bp, Homo sapiens
tagattctaaagatt

SEQ ID NO: 5936081 - DNA, 18 bp, Homo sapiens
tagattctaaagattcta

SEQ ID NO: 5936082 - DNA, 14 bp, Homo sapiens
tagattctaacata

SEQ ID NO: 5936083 - DNA, 22 bp, Homo sapiens
tagattctctggctgtaaggct

SEQ ID NO: 5936084 - DNA, 19 bp, Homo sapiens
tagattctctgtgtctaag

SEQ ID NO: 5936085 - DNA, 20 bp, Homo sapiens
tagattctctgtgtctaaga

SEQ ID NO: 5936086 - DNA, 21 bp, Homo sapiens
tagattctctgtgtctaagat

SEQ ID NO: 5936087 - DNA, 23 bp, Homo sapiens
tagattctctgtgtctaagattc

SEQ ID NO: 5936088 - DNA, 20 bp, Homo sapiens
tagattcttgagctgttgtg

SEQ ID NO: 5936089 - DNA, 14 bp, Homo sapiens
tagattctttatta

SEQ ID NO: 5936090 - DNA, 15 bp, Homo sapiens
tagattctttattag

SEQ ID NO: 5936091 - DNA, 18 bp, Homo sapiens
tagattctttattagtga

SEQ ID NO: 5936092 - DNA, 20 bp, Homo sapiens
tagattgaaaacttttctca

SEQ ID NO: 5936093 - DNA, 21 bp, Homo sapiens
tagattgaaaacttttctcag

SEQ ID NO: 5936094 - DNA, 21 bp, Homo sapiens
tagattgagaagttttgtaca

SEQ ID NO: 5936095 - DNA, 14 bp, Homo sapiens
tagattgattgtat

SEQ ID NO: 5936096 - DNA, 13 bp, Homo sapiens
tagattgcaaagc

SEQ ID NO: 5936097 - DNA, 12 bp, Homo sapiens
tagattgcagaa

SEQ ID NO: 5936098 - DNA, 12 bp, Homo sapiens
tagattgtaaac

SEQ ID NO: 5936099 - DNA, 23 bp, Homo sapiens
tagattgtccttttgcaaagaaa

SEQ ID NO: 5936100 - DNA, 15 bp, Homo sapiens
tagattgtcttaatg

SEQ ID NO: 5936101 - DNA, 20 bp, Homo sapiens
tagatttaaaggcagacagt

SEQ ID NO: 5936102 - DNA, 19 bp, Homo sapiens
tagatttaatgatgcttca

SEQ ID NO: 5936103 - DNA, 22 bp, Homo sapiens
tagatttaatgatgcttcagtg

SEQ ID NO: 5936104 - DNA, 14 bp, Homo sapiens
tagatttaatttac

SEQ ID NO: 5936105 - DNA, 14 bp, Homo sapiens
tagatttagctatt

SEQ ID NO: 5936106 - DNA, 19 bp, Homo sapiens
tagatttatgtaatgcttt

SEQ ID NO: 5936107 - DNA, 15 bp, Homo sapiens
tagatttatttcatc

SEQ ID NO: 5936108 - DNA, 14 bp, Homo sapiens
tagatttattttac

SEQ ID NO: 5936109 - DNA, 16 bp, Homo sapiens
tagatttcagtagttt

SEQ ID NO: 5936110 - DNA, 23 bp, Homo sapiens
tagatttcagtagtttctaagtc

SEQ ID NO: 5936111 - DNA, 16 bp, Homo sapiens
tagatttcatagttca

SEQ ID NO: 5936112 - DNA, 19 bp, Homo sapiens
tagatttcatagttcagaa

SEQ ID NO: 5936113 - DNA, 12 bp, Homo sapiens
tagatttctaca

SEQ ID NO: 5936114 - DNA, 23 bp, Homo sapiens
tagatttctagcagtatgtgtgc

SEQ ID NO: 5936115 - DNA, 22 bp, Homo sapiens
tagatttctatgatcctttttt

SEQ ID NO: 5936116 - DNA, 17 bp, Homo sapiens
tagatttctcttgggca

SEQ ID NO: 5936117 - DNA, 13 bp, Homo sapiens
tagatttctttga

SEQ ID NO: 5936118 - DNA, 13 bp, Homo sapiens
tagatttgaaaat

SEQ ID NO: 5936119 - DNA, 12 bp, Homo sapiens
tagatttgacct

SEQ ID NO: 5936120 - DNA, 18 bp, Homo sapiens
tagatttgattatttcct

SEQ ID NO: 5936121 - DNA, 13 bp, Homo sapiens
tagatttgggaga

SEQ ID NO: 5936122 - DNA, 18 bp, Homo sapiens
tagatttgtattttaaaa

SEQ ID NO: 5936123 - DNA, 13 bp, Homo sapiens
tagatttgttttg

SEQ ID NO: 5936124 - DNA, 19 bp, Homo sapiens
tagatttgttttgtgttgt

SEQ ID NO: 5936125 - DNA, 16 bp, Homo sapiens
tagattttaaagacaa

SEQ ID NO: 5936126 - DNA, 15 bp, Homo sapiens
tagattttaagcttc

SEQ ID NO: 5936127 - DNA, 17 bp, Homo sapiens
tagattttaatcaaatt

SEQ ID NO: 5936128 - DNA, 16 bp, Homo sapiens
tagattttaatttatt

SEQ ID NO: 5936129 - DNA, 16 bp, Homo sapiens
tagattttacatgaag

SEQ ID NO: 5936130 - DNA, 17 bp, Homo sapiens
tagattttacatgaagt

SEQ ID NO: 5936131 - DNA, 22 bp, Homo sapiens
tagattttagaccctattgctg

SEQ ID NO: 5936132 - DNA, 16 bp, Homo sapiens
tagattttagttcact

SEQ ID NO: 5936133 - DNA, 15 bp, Homo sapiens
tagattttatagtgt

SEQ ID NO: 5936134 - DNA, 17 bp, Homo sapiens
tagattttatgaaaaac

SEQ ID NO: 5936135 - DNA, 16 bp, Homo sapiens
tagattttattatgtt

SEQ ID NO: 5936136 - DNA, 13 bp, Homo sapiens
tagattttccaaa

SEQ ID NO: 5936137 - DNA, 19 bp, Homo sapiens
tagattttctggttctaac

SEQ ID NO: 5936138 - DNA, 21 bp, Homo sapiens
tagattttctggttctaacat

SEQ ID NO: 5936139 - DNA, 19 bp, Homo sapiens
tagattttgtgcagttaat

SEQ ID NO: 5936140 - DNA, 15 bp, Homo sapiens
tagattttgtgttta

SEQ ID NO: 5936141 - DNA, 12 bp, Homo sapiens
tagatttttaaa

SEQ ID NO: 5936142 - DNA, 18 bp, Homo sapiens
tagatttttaacaaaaaa

SEQ ID NO: 5936143 - DNA, 14 bp, Homo sapiens
tagatttttagatt

SEQ ID NO: 5936144 - DNA, 15 bp, Homo sapiens
tagatttttcttaac

SEQ ID NO: 5936145 - DNA, 15 bp, Homo sapiens
tagatttttgattca

SEQ ID NO: 5936146 - DNA, 16 bp, Homo sapiens
tagatttttgattcag

SEQ ID NO: 5936147 - DNA, 21 bp, Homo sapiens
tagattttttaaaaaaaatgt

SEQ ID NO: 5936148 - DNA, 17 bp, Homo sapiens
tagattttttttaaagt

SEQ ID NO: 5936149 - DNA, 20 bp, Homo sapiens
tagcaaaaaaagttgtatga

SEQ ID NO: 5936150 - DNA, 23 bp, Homo sapiens
tagcaaaaaaagttgtatgatct

SEQ ID NO: 5936151 - DNA, 14 bp, Homo sapiens
tagcaaaaacatgt

SEQ ID NO: 5936152 - DNA, 14 bp, Homo sapiens
tagcaaaaagtggg

SEQ ID NO: 5936153 - DNA, 22 bp, Homo sapiens
tagcaaaaatagttaaaatgct

SEQ ID NO: 5936154 - DNA, 15 bp, Homo sapiens
tagcaaaaatgtttt

SEQ ID NO: 5936155 - DNA, 12 bp, Homo sapiens
tagcaaaacaaa

SEQ ID NO: 5936156 - DNA, 22 bp, Homo sapiens
tagcaaaacgcatggagtgtgt

SEQ ID NO: 5936157 - DNA, 21 bp, Homo sapiens
tagcaaaacttttaaactaca

SEQ ID NO: 5936158 - DNA, 17 bp, Homo sapiens
tagcaaaagaagtaaca

SEQ ID NO: 5936159 - DNA, 19 bp, Homo sapiens
tagcaaaataaaacatagc

SEQ ID NO: 5936160 - DNA, 23 bp, Homo sapiens
tagcaaaataaaacatagcaaat

SEQ ID NO: 5936161 - DNA, 19 bp, Homo sapiens
tagcaaaatattatctgaa

SEQ ID NO: 5936162 - DNA, 21 bp, Homo sapiens
tagcaaaattcttaagtatgt

SEQ ID NO: 5936163 - DNA, 13 bp, Homo sapiens
tagcaaactccag

SEQ ID NO: 5936164 - DNA, 22 bp, Homo sapiens
tagcaaactccaggttcctgaa

SEQ ID NO: 5936165 - DNA, 14 bp, Homo sapiens
tagcaaactttgta

SEQ ID NO: 5936166 - DNA, 14 bp, Homo sapiens
tagcaaagatatat

SEQ ID NO: 5936167 - DNA, 11 bp, Homo sapiens
tagcaaagatt

SEQ ID NO: 5936168 - DNA, 21 bp, Homo sapiens
tagcaaagattaaatgtgtca

SEQ ID NO: 5936169 - DNA, 20 bp, Homo sapiens
tagcaaagcaaaaggctgag

SEQ ID NO: 5936170 - DNA, 18 bp, Homo sapiens
tagcaaagggcttggtgg

SEQ ID NO: 5936171 - DNA, 15 bp, Homo sapiens
tagcaaagtaacatt

SEQ ID NO: 5936172 - DNA, 17 bp, Homo sapiens
tagcaaagttatcttaa

SEQ ID NO: 5936173 - DNA, 23 bp, Homo sapiens
tagcaaataatttcctggtgtga

SEQ ID NO: 5936174 - DNA, 12 bp, Homo sapiens
tagcaaatatgc

SEQ ID NO: 5936175 - DNA, 18 bp, Homo sapiens
tagcaaatcagtatattt

SEQ ID NO: 5936176 - DNA, 23 bp, Homo sapiens
tagcaaatcagtatattttctgt

SEQ ID NO: 5936177 - DNA, 14 bp, Homo sapiens
tagcaaatgtttac

SEQ ID NO: 5936178 - DNA, 17 bp, Homo sapiens
tagcaaatgtttactgt

SEQ ID NO: 5936179 - DNA, 17 bp, Homo sapiens
tagcaaatgttttgaca

SEQ ID NO: 5936180 - DNA, 14 bp, Homo sapiens
tagcaaattccaat

SEQ ID NO: 5936181 - DNA, 18 bp, Homo sapiens
tagcaaattccaatacat

SEQ ID NO: 5936182 - DNA, 17 bp, Homo sapiens
tagcaaatttgtttaat

SEQ ID NO: 5936183 - DNA, 19 bp, Homo sapiens
tagcaaatttgtttaatct

SEQ ID NO: 5936184 - DNA, 15 bp, Homo sapiens
tagcaacagagcact

SEQ ID NO: 5936185 - DNA, 17 bp, Homo sapiens
tagcaacatatctctgc

SEQ ID NO: 5936186 - DNA, 17 bp, Homo sapiens
tagcaacctatttgact

SEQ ID NO: 5936187 - DNA, 19 bp, Homo sapiens
tagcaacctatttgactgc

SEQ ID NO: 5936188 - DNA, 21 bp, Homo sapiens
tagcaacgcctgccttctggg

SEQ ID NO: 5936189 - DNA, 15 bp, Homo sapiens
tagcaactaatgttt

SEQ ID NO: 5936190 - DNA, 17 bp, Homo sapiens
tagcaagaagattctaa

SEQ ID NO: 5936191 - DNA, 21 bp, Homo sapiens
tagcaagacctgaaaatatgt

SEQ ID NO: 5936192 - DNA, 14 bp, Homo sapiens
tagcaagatgcaaa

SEQ ID NO: 5936193 - DNA, 20 bp, Homo sapiens
tagcaagcaactaattttct

SEQ ID NO: 5936194 - DNA, 14 bp, Homo sapiens
tagcaagctggcct

SEQ ID NO: 5936195 - DNA, 17 bp, Homo sapiens
tagcaaggcagagcctt

SEQ ID NO: 5936196 - DNA, 23 bp, Homo sapiens
tagcaaggccagggcacagctgg

SEQ ID NO: 5936197 - DNA, 18 bp, Homo sapiens
tagcaagtgaatttttct

SEQ ID NO: 5936198 - DNA, 22 bp, Homo sapiens
tagcaagtgaatttttctctaa

SEQ ID NO: 5936199 - DNA, 16 bp, Homo sapiens
tagcaagttctagaag

SEQ ID NO: 5936200 - DNA, 21 bp, Homo sapiens
tagcaagttctagagaagagg

SEQ ID NO: 5936201 - DNA, 20 bp, Homo sapiens
tagcaataaataacacttgt

SEQ ID NO: 5936202 - DNA, 21 bp, Homo sapiens
tagcaataaataacacttgtc

SEQ ID NO: 5936203 - DNA, 22 bp, Homo sapiens
tagcaataaatgcttttctaat

SEQ ID NO: 5936204 - DNA, 15 bp, Homo sapiens
tagcaataactgaaa

SEQ ID NO: 5936205 - DNA, 19 bp, Homo sapiens
tagcaataggctgtaatca

SEQ ID NO: 5936206 - DNA, 15 bp, Homo sapiens
tagcaatatatttgt

SEQ ID NO: 5936207 - DNA, 20 bp, Homo sapiens
tagcaatatgttagcaagag

SEQ ID NO: 5936208 - DNA, 15 bp, Homo sapiens
tagcaatctgcctgt

SEQ ID NO: 5936209 - DNA, 19 bp, Homo sapiens
tagcaatgggatataatac

SEQ ID NO: 5936210 - DNA, 19 bp, Homo sapiens
tagcaatgtaaaaatggtt

SEQ ID NO: 5936211 - DNA, 14 bp, Homo sapiens
tagcaattagtgat

SEQ ID NO: 5936212 - DNA, 21 bp, Homo sapiens
tagcaattgcttctctaaaac

SEQ ID NO: 5936213 - DNA, 15 bp, Homo sapiens
tagcaattttctttg

SEQ ID NO: 5936214 - DNA, 13 bp, Homo sapiens
tagcacaaaaaaa

SEQ ID NO: 5936215 - DNA, 18 bp, Homo sapiens
tagcacaagataaattga

SEQ ID NO: 5936216 - DNA, 19 bp, Homo sapiens
tagcacaaggagtgcccgc

SEQ ID NO: 5936217 - DNA, 18 bp, Homo sapiens
tagcacacacttttggtt

SEQ ID NO: 5936218 - DNA, 23 bp, Homo sapiens
tagcacacctgaatcagctggac

SEQ ID NO: 5936219 - DNA, 20 bp, Homo sapiens
tagcacagaccctgccctgt

SEQ ID NO: 5936220 - DNA, 16 bp, Homo sapiens
tagcacagaggatggc

SEQ ID NO: 5936221 - DNA, 21 bp, Homo sapiens
tagcacagaggatggcttccc

SEQ ID NO: 5936222 - DNA, 18 bp, Homo sapiens
tagcacagattttaattg

SEQ ID NO: 5936223 - DNA, 19 bp, Homo sapiens
tagcacagcactttggttt

SEQ ID NO: 5936224 - DNA, 13 bp, Homo sapiens
tagcacagctgtg

SEQ ID NO: 5936225 - DNA, 12 bp, Homo sapiens
tagcacaggctg

SEQ ID NO: 5936226 - DNA, 13 bp, Homo sapiens
tagcacaggctga

SEQ ID NO: 5936227 - DNA, 19 bp, Homo sapiens
tagcacaggctgagtgcag

SEQ ID NO: 5936228 - DNA, 20 bp, Homo sapiens
tagcatgaccttttggcctt

SEQ ID NO: 5936229 - DNA, 18 bp, Homo sapiens
tagcatgagctttccagt

SEQ ID NO: 5936230 - DNA, 15 bp, Homo sapiens
tagcatgagttctgc

SEQ ID NO: 5936231 - DNA, 20 bp, Homo sapiens
tagcatgagttctgcacata

SEQ ID NO: 5936232 - DNA, 14 bp, Homo sapiens
tagcatgcacaaag

SEQ ID NO: 5936233 - DNA, 19 bp, Homo sapiens
tagcatgccaacaagaatg

SEQ ID NO: 5936234 - DNA, 20 bp, Homo sapiens
tagcatgcgcgctgtgggca

SEQ ID NO: 5936235 - DNA, 18 bp, Homo sapiens
tagcatgcttcctttctc

SEQ ID NO: 5936236 - DNA, 17 bp, Homo sapiens
tagcatggcatattttt

SEQ ID NO: 5936237 - DNA, 18 bp, Homo sapiens
tagcatggcatatttttc

SEQ ID NO: 5936238 - DNA, 21 bp, Homo sapiens
tagcatggcatatttttcaca

SEQ ID NO: 5936239 - DNA, 13 bp, Homo sapiens
tagcatggcggca

SEQ ID NO: 5936240 - DNA, 13 bp, Homo sapiens
tagcatgggaggt

SEQ ID NO: 5936241 - DNA, 17 bp, Homo sapiens
tagcatggggattgcag

SEQ ID NO: 5936242 - DNA, 15 bp, Homo sapiens
tagcatggggcccct

SEQ ID NO: 5936243 - DNA, 21 bp, Homo sapiens
tagcatggggcccctggccca

SEQ ID NO: 5936244 - DNA, 19 bp, Homo sapiens
tagcatggggtcagcccca

SEQ ID NO: 5936245 - DNA, 12 bp, Homo sapiens
tagcatgtaatg

SEQ ID NO: 5936246 - DNA, 17 bp, Homo sapiens
tagcatgtatgaatgta

SEQ ID NO: 5936247 - DNA, 16 bp, Homo sapiens
tagcatgtgttgcagc

SEQ ID NO: 5936248 - DNA, 18 bp, Homo sapiens
tagcatgtgttgcagctg

SEQ ID NO: 5936249 - DNA, 19 bp, Homo sapiens
tagcatgtgttgcagctgt

SEQ ID NO: 5936250 - DNA, 20 bp, Homo sapiens
tagcatgtgttgcagctgtc

SEQ ID NO: 5936251 - DNA, 21 bp, Homo sapiens
tagcatgtgttgcagctgtca

SEQ ID NO: 5936252 - DNA, 13 bp, Homo sapiens
tagcatgttgtag

SEQ ID NO: 5936253 - DNA, 15 bp, Homo sapiens
tagcatgttgtagat

SEQ ID NO: 5936254 - DNA, 17 bp, Homo sapiens
tagcatgtttgctgaac

SEQ ID NO: 5936255 - DNA, 21 bp, Homo sapiens
tagcattaaaaataaaagttg

SEQ ID NO: 5936256 - DNA, 16 bp, Homo sapiens
tagcattaataaaact

SEQ ID NO: 5936257 - DNA, 13 bp, Homo sapiens
tagcattacctaa

SEQ ID NO: 5936258 - DNA, 21 bp, Homo sapiens
tagcattatcttatcatttat

SEQ ID NO: 5936259 - DNA, 15 bp, Homo sapiens
tagcattatgcaatt

SEQ ID NO: 5936260 - DNA, 21 bp, Homo sapiens
tagcattcagggttatacaca

SEQ ID NO: 5936261 - DNA, 15 bp, Homo sapiens
tagcattcctcagga

SEQ ID NO: 5936262 - DNA, 18 bp, Homo sapiens
tagcattccttaatgttt

SEQ ID NO: 5936263 - DNA, 15 bp, Homo sapiens
tagcattctggcagt

SEQ ID NO: 5936264 - DNA, 14 bp, Homo sapiens
tagcattgaaataa

SEQ ID NO: 5936265 - DNA, 13 bp, Homo sapiens
tagcattgaacat

SEQ ID NO: 5936266 - DNA, 14 bp, Homo sapiens
tagcattgaacatt

SEQ ID NO: 5936267 - DNA, 17 bp, Homo sapiens
tagcattgataatcttc

SEQ ID NO: 5936268 - DNA, 19 bp, Homo sapiens
tagcattgtaaaagcattt

SEQ ID NO: 5936269 - DNA, 24 bp, Homo sapiens
tagcattgtaaaattatttcatga

SEQ ID NO: 5936270 - DNA, 21 bp, Homo sapiens
tagcattgtagtgctttgaga

SEQ ID NO: 5936271 - DNA, 16 bp, Homo sapiens
tagcattgtcttgttc

SEQ ID NO: 5936272 - DNA, 23 bp, Homo sapiens
tagcattgtcttgttctgtccct

SEQ ID NO: 5936273 - DNA, 13 bp, Homo sapiens
tagcattgttcca

SEQ ID NO: 5936274 - DNA, 15 bp, Homo sapiens
tagcattgttccaca

SEQ ID NO: 5936275 - DNA, 19 bp, Homo sapiens
tagcatttaaaatggaaaa

SEQ ID NO: 5936276 - DNA, 22 bp, Homo sapiens
tagcatttaccaacatgtatct

SEQ ID NO: 5936277 - DNA, 21 bp, Homo sapiens
tagcatttagatctacactct

SEQ ID NO: 5936278 - DNA, 22 bp, Homo sapiens
tagcatttagtccaatgtcttt

SEQ ID NO: 5936279 - DNA, 22 bp, Homo sapiens
tagcatttatttctctggcaaa

SEQ ID NO: 5936280 - DNA, 15 bp, Homo sapiens
tagcatttcattctt

SEQ ID NO: 5936281 - DNA, 13 bp, Homo sapiens
tagcatttcttga

SEQ ID NO: 5936282 - DNA, 16 bp, Homo sapiens
tagcatttcttgatgt

SEQ ID NO: 5936283 - DNA, 16 bp, Homo sapiens
tagcatttgccactta

SEQ ID NO: 5936284 - DNA, 23 bp, Homo sapiens
tagcatttgccacttagtatttt

SEQ ID NO: 5936285 - DNA, 12 bp, Homo sapiens
tagcatttgtat

SEQ ID NO: 5936286 - DNA, 14 bp, Homo sapiens
tagcatttgtataa

SEQ ID NO: 5936287 - DNA, 15 bp, Homo sapiens
tagcattttaaacaa

SEQ ID NO: 5936288 - DNA, 16 bp, Homo sapiens
tagcattttaaacaaa

SEQ ID NO: 5936289 - DNA, 21 bp, Homo sapiens
tagcatttttatgcagacagt

SEQ ID NO: 5936290 - DNA, 22 bp, Homo sapiens
tagcatttttccaacacacaca

SEQ ID NO: 5936291 - DNA, 14 bp, Homo sapiens
tagcatttttctaa

SEQ ID NO: 5936292 - DNA, 16 bp, Homo sapiens
tagcatttttctaata

SEQ ID NO: 5936293 - DNA, 16 bp, Homo sapiens
tagccaaaaatagcta

SEQ ID NO: 5936294 - DNA, 20 bp, Homo sapiens
tagccaaaaatgtctaaaag

SEQ ID NO: 5936295 - DNA, 16 bp, Homo sapiens
tagccaaaacacttag

SEQ ID NO: 5936296 - DNA, 23 bp, Homo sapiens
tagccaaacaacaacaaaaacaa

SEQ ID NO: 5936297 - DNA, 14 bp, Homo sapiens
tagccaaagagctc

SEQ ID NO: 5936298 - DNA, 17 bp, Homo sapiens
tagccaaagagctcttt

SEQ ID NO: 5936299 - DNA, 15 bp, Homo sapiens
tagccaaagatttca

SEQ ID NO: 5936300 - DNA, 21 bp, Homo sapiens
tagccaacacccatctgtttt

SEQ ID NO: 5936301 - DNA, 14 bp, Homo sapiens
tagccaaccaggct

SEQ ID NO: 5936302 - DNA, 18 bp, Homo sapiens
tagccaacggccccagct

SEQ ID NO: 5936303 - DNA, 19 bp, Homo sapiens
tagccaacggccccagctt

SEQ ID NO: 5936304 - DNA, 20 bp, Homo sapiens
tagccaactgtttccctgct

SEQ ID NO: 5936305 - DNA, 18 bp, Homo sapiens
tagccaacttaaacctgt

SEQ ID NO: 5936306 - DNA, 22 bp, Homo sapiens
tagccaacttaaacctgtgctt

SEQ ID NO: 5936307 - DNA, 14 bp, Homo sapiens
tagccaaggccaaa

SEQ ID NO: 5936308 - DNA, 14 bp, Homo sapiens
tagccaagtgcagg

SEQ ID NO: 5936309 - DNA, 17 bp, Homo sapiens
tagccaagttatattga

SEQ ID NO: 5936310 - DNA, 22 bp, Homo sapiens
tagccaagttatattgaatata

SEQ ID NO: 5936311 - DNA, 23 bp, Homo sapiens
tagccacaaatgccttgaactgt

SEQ ID NO: 5936312 - DNA, 16 bp, Homo sapiens
tagccacagctgctgt

SEQ ID NO: 5936313 - DNA, 19 bp, Homo sapiens
tagccacagctgctgttct

SEQ ID NO: 5936314 - DNA, 19 bp, Homo sapiens
tagccacaggagccctgct

SEQ ID NO: 5936315 - DNA, 19 bp, Homo sapiens
tagccacatccctttgaaa

SEQ ID NO: 5936316 - DNA, 17 bp, Homo sapiens
tagccaccaccggggca

SEQ ID NO: 5936317 - DNA, 12 bp, Homo sapiens
tagccaccagtg

SEQ ID NO: 5936318 - DNA, 16 bp, Homo sapiens
tagccaccatctttgc

SEQ ID NO: 5936319 - DNA, 19 bp, Homo sapiens
tagccaccccagaaatggt

SEQ ID NO: 5936320 - DNA, 14 bp, Homo sapiens
tagccacctcccac

SEQ ID NO: 5936321 - DNA, 16 bp, Homo sapiens
tagccacctcccaccc

SEQ ID NO: 5936322 - DNA, 17 bp, Homo sapiens
tagccacctcccacccc

SEQ ID NO: 5936323 - DNA, 20 bp, Homo sapiens
tagccacctcccaccccact

SEQ ID NO: 5936324 - DNA, 14 bp, Homo sapiens
tagccacctccttg

SEQ ID NO: 5936325 - DNA, 21 bp, Homo sapiens
tagccactaaccttgcctggt

SEQ ID NO: 5936326 - DNA, 22 bp, Homo sapiens
tagccactagtaagtaattatg

SEQ ID NO: 5936327 - DNA, 14 bp, Homo sapiens
tagccactccctcc

SEQ ID NO: 5936328 - DNA, 17 bp, Homo sapiens
tagccactccctcccag

SEQ ID NO: 5936329 - DNA, 18 bp, Homo sapiens
tagccactctctgcccac

SEQ ID NO: 5936330 - DNA, 19 bp, Homo sapiens
tagccactctctgcccact

SEQ ID NO: 5936331 - DNA, 13 bp, Homo sapiens
tagccactgctgg

SEQ ID NO: 5936332 - DNA, 17 bp, Homo sapiens
tagccactgctggtgtt

SEQ ID NO: 5936333 - DNA, 20 bp, Homo sapiens
tagccactgctggtgtttat

SEQ ID NO: 5936334 - DNA, 11 bp, Homo sapiens
tagccactggc

SEQ ID NO: 5936335 - DNA, 21 bp, Homo sapiens
tagccactttggtcccgtgca

SEQ ID NO: 5936336 - DNA, 15 bp, Homo sapiens
tagccagaatctcat

SEQ ID NO: 5936337 - DNA, 17 bp, Homo sapiens
tagccagaatgtttcct

SEQ ID NO: 5936338 - DNA, 22 bp, Homo sapiens
tagccagaatgtttcctgtgga

SEQ ID NO: 5936339 - DNA, 13 bp, Homo sapiens
tagccagacacat

SEQ ID NO: 5936340 - DNA, 18 bp, Homo sapiens
tagccagagaggagcacc

SEQ ID NO: 5936341 - DNA, 15 bp, Homo sapiens
tagccagatttgtct

SEQ ID NO: 5936342 - DNA, 20 bp, Homo sapiens
tagccagcacacagggcagt

SEQ ID NO: 5936343 - DNA, 19 bp, Homo sapiens
tagccagcacttgtatata

SEQ ID NO: 5936344 - DNA, 21 bp, Homo sapiens
tagccagcccacatccattcc

SEQ ID NO: 5936345 - DNA, 16 bp, Homo sapiens
tagccagcgtttattg

SEQ ID NO: 5936346 - DNA, 15 bp, Homo sapiens
tagccagctgctccc

SEQ ID NO: 5936347 - DNA, 13 bp, Homo sapiens
tagccagctgtca

SEQ ID NO: 5936348 - DNA, 18 bp, Homo sapiens
tagccaggaagccccgct

SEQ ID NO: 5936349 - DNA, 23 bp, Homo sapiens
tagccaggaagccccgctcaggt

SEQ ID NO: 5936350 - DNA, 18 bp, Homo sapiens
tagccaggagtctgtgct

SEQ ID NO: 5936351 - DNA, 19 bp, Homo sapiens
tagccaggagtctgtgctc

SEQ ID NO: 5936352 - DNA, 13 bp, Homo sapiens
tagccaggatcat

SEQ ID NO: 5936353 - DNA, 20 bp, Homo sapiens
tagccaggatcatggtgtaa

SEQ ID NO: 5936354 - DNA, 18 bp, Homo sapiens
tagccaggatggtctgga

SEQ ID NO: 5936355 - DNA, 17 bp, Homo sapiens
tagccaggcctcccgca

SEQ ID NO: 5936356 - DNA, 16 bp, Homo sapiens
tagccagtaatcctgt

SEQ ID NO: 5936357 - DNA, 17 bp, Homo sapiens
tagccagtcattgtaac

SEQ ID NO: 5936358 - DNA, 15 bp, Homo sapiens
tagccagtgaaacac

SEQ ID NO: 5936359 - DNA, 23 bp, Homo sapiens
tagccagtgactttttctgagct

SEQ ID NO: 5936360 - DNA, 23 bp, Homo sapiens
tagccagtgctccaggcacccag

SEQ ID NO: 5936361 - DNA, 15 bp, Homo sapiens
tagccagttcaaagt

SEQ ID NO: 5936362 - DNA, 22 bp, Homo sapiens
tagccagttcaaagtgtatatt

SEQ ID NO: 5936363 - DNA, 14 bp, Homo sapiens
tagccataataaaa

SEQ ID NO: 5936364 - DNA, 16 bp, Homo sapiens
tagccatcaagcactt

SEQ ID NO: 5936365 - DNA, 14 bp, Homo sapiens
tagccatcagatga

SEQ ID NO: 5936366 - DNA, 21 bp, Homo sapiens
tagccatctccgtggccaatg

SEQ ID NO: 5936367 - DNA, 12 bp, Homo sapiens
tagccatctgca

SEQ ID NO: 5936368 - DNA, 14 bp, Homo sapiens
tagccatcttgaag

SEQ ID NO: 5936369 - DNA, 17 bp, Homo sapiens
tagccatgaggaggcag

SEQ ID NO: 5936370 - DNA, 22 bp, Homo sapiens
tagccatgaggaggcagagagg

SEQ ID NO: 5936371 - DNA, 13 bp, Homo sapiens
tagccatgcaaca

SEQ ID NO: 5936372 - DNA, 18 bp, Homo sapiens
tagccatggctcaggcaa

SEQ ID NO: 5936373 - DNA, 20 bp, Homo sapiens
tagccatggctcaggcaagc

SEQ ID NO: 5936374 - DNA, 14 bp, Homo sapiens
tagccatggctggg

SEQ ID NO: 5936375 - DNA, 13 bp, Homo sapiens
tagccatgggacc

SEQ ID NO: 5936376 - DNA, 14 bp, Homo sapiens
tagccatgggacca

SEQ ID NO: 5936377 - DNA, 22 bp, Homo sapiens
tagccattcctggtacccagcc

SEQ ID NO: 5936378 - DNA, 18 bp, Homo sapiens
tagccattgtcgtttcat

SEQ ID NO: 5936379 - DNA, 15 bp, Homo sapiens
tagccatttgcccca

SEQ ID NO: 5936380 - DNA, 21 bp, Homo sapiens
tagccattttgtaactgccta

SEQ ID NO: 5936381 - DNA, 18 bp, Homo sapiens
tagccatttttcaaagca

SEQ ID NO: 5936382 - DNA, 15 bp, Homo sapiens
tagcccaagaggtct

SEQ ID NO: 5936383 - DNA, 20 bp, Homo sapiens
tagcccaagaggtctgagcc

SEQ ID NO: 5936384 - DNA, 15 bp, Homo sapiens
tagcccaaggctcag

SEQ ID NO: 5936385 - DNA, 18 bp, Homo sapiens
tagcccaatggagaaatg

SEQ ID NO: 5936386 - DNA, 19 bp, Homo sapiens
tagcccaatggagaaatga

SEQ ID NO: 5936387 - DNA, 22 bp, Homo sapiens
tagcccaatggagaaatgaagc

SEQ ID NO: 5936388 - DNA, 20 bp, Homo sapiens
tagcccacccccctccccaa

SEQ ID NO: 5936389 - DNA, 13 bp, Homo sapiens
tagcccactccct

SEQ ID NO: 5936390 - DNA, 15 bp, Homo sapiens
tagcccagcactgtg

SEQ ID NO: 5936391 - DNA, 19 bp, Homo sapiens
tagcccagcactgtgaaga

SEQ ID NO: 5936392 - DNA, 21 bp, Homo sapiens
tagcccagccttttgagagta

SEQ ID NO: 5936393 - DNA, 12 bp, Homo sapiens
tagcccaggaga

SEQ ID NO: 5936394 - DNA, 12 bp, Homo sapiens
tagcccaggagc

SEQ ID NO: 5936395 - DNA, 21 bp, Homo sapiens
tagcccaggagcaacagccta

SEQ ID NO: 5936396 - DNA, 22 bp, Homo sapiens
tagcccaggatatattttattt

SEQ ID NO: 5936397 - DNA, 21 bp, Homo sapiens
tagcccaggccagagtgcagt

SEQ ID NO: 5936398 - DNA, 12 bp, Homo sapiens
tagcccagtccc

SEQ ID NO: 5936399 - DNA, 20 bp, Homo sapiens
tagcccagtccctggagctg

SEQ ID NO: 5936400 - DNA, 20 bp, Homo sapiens
tagcccagtgttttctttga

SEQ ID NO: 5936401 - DNA, 21 bp, Homo sapiens
tagcccataaagtctgagaaa

SEQ ID NO: 5936402 - DNA, 12 bp, Homo sapiens
tagcccatccct

SEQ ID NO: 5936403 - DNA, 18 bp, Homo sapiens
tagcccatctctccagag

SEQ ID NO: 5936404 - DNA, 22 bp, Homo sapiens
tagcccatctctccagagagca

SEQ ID NO: 5936405 - DNA, 18 bp, Homo sapiens
tagcccatttctgttaac

SEQ ID NO: 5936406 - DNA, 17 bp, Homo sapiens
tagctaaaaccaaagga

SEQ ID NO: 5936407 - DNA, 15 bp, Homo sapiens
tagctaaaagacaaa

SEQ ID NO: 5936408 - DNA, 18 bp, Homo sapiens
tagctaaacggattccaa

SEQ ID NO: 5936409 - DNA, 20 bp, Homo sapiens
tagctaaacggattccaaag

SEQ ID NO: 5936410 - DNA, 12 bp, Homo sapiens
tagctaaataac

SEQ ID NO: 5936411 - DNA, 13 bp, Homo sapiens
tagctaacagtga

SEQ ID NO: 5936412 - DNA, 20 bp, Homo sapiens
tagctaagaaataaaactgt

SEQ ID NO: 5936413 - DNA, 14 bp, Homo sapiens
tagctaagcacaga

SEQ ID NO: 5936414 - DNA, 19 bp, Homo sapiens
tagctaaggaagggaaagg

SEQ ID NO: 5936415 - DNA, 20 bp, Homo sapiens
tagctaaggtctataaacat

SEQ ID NO: 5936416 - DNA, 15 bp, Homo sapiens
tagctaagtacacaa

SEQ ID NO: 5936417 - DNA, 22 bp, Homo sapiens
tagctaagtacacaataagcaa

SEQ ID NO: 5936418 - DNA, 20 bp, Homo sapiens
tagctaagtatcaggggaaa

SEQ ID NO: 5936419 - DNA, 15 bp, Homo sapiens
tagctaatgaaattg

SEQ ID NO: 5936420 - DNA, 13 bp, Homo sapiens
tagctaatggaaa

SEQ ID NO: 5936421 - DNA, 13 bp, Homo sapiens
tagctaattagct

SEQ ID NO: 5936422 - DNA, 13 bp, Homo sapiens
tagctaattattt

SEQ ID NO: 5936423 - DNA, 12 bp, Homo sapiens
tagctacactga

SEQ ID NO: 5936424 - DNA, 23 bp, Homo sapiens
tagctacagagaaaccagcttcc

SEQ ID NO: 5936425 - DNA, 13 bp, Homo sapiens
tagctacagcttg

SEQ ID NO: 5936426 - DNA, 15 bp, Homo sapiens
tagctacagcttgtt

SEQ ID NO: 5936427 - DNA, 20 bp, Homo sapiens
tagctacaggaagcacccca

SEQ ID NO: 5936428 - DNA, 15 bp, Homo sapiens
tagctacagtgcata

SEQ ID NO: 5936429 - DNA, 23 bp, Homo sapiens
tagctacatagcagactttccca

SEQ ID NO: 5936430 - DNA, 15 bp, Homo sapiens
tagctacatgttctt

SEQ ID NO: 5936431 - DNA, 16 bp, Homo sapiens
tagctacattttcaga

SEQ ID NO: 5936432 - DNA, 18 bp, Homo sapiens
tagctacattttcagaag

SEQ ID NO: 5936433 - DNA, 19 bp, Homo sapiens
tagctacccaaaagagaaa

SEQ ID NO: 5936434 - DNA, 20 bp, Homo sapiens
tagctacccaaaagagaaaa

SEQ ID NO: 5936435 - DNA, 13 bp, Homo sapiens
tagctacctgcta

SEQ ID NO: 5936436 - DNA, 15 bp, Homo sapiens
tagctacggttccct

SEQ ID NO: 5936437 - DNA, 18 bp, Homo sapiens
tagctactgtagaaagga

SEQ ID NO: 5936438 - DNA, 19 bp, Homo sapiens
tagctagaagtgggccagg

SEQ ID NO: 5936439 - DNA, 23 bp, Homo sapiens
tagctagactaggagaccagaag

SEQ ID NO: 5936440 - DNA, 15 bp, Homo sapiens
tagctagactggtga

SEQ ID NO: 5936441 - DNA, 13 bp, Homo sapiens
tagctagaggaac

SEQ ID NO: 5936442 - DNA, 12 bp, Homo sapiens
tagctagcgcac

SEQ ID NO: 5936443 - DNA, 17 bp, Homo sapiens
tagctagctatttctat

SEQ ID NO: 5936444 - DNA, 23 bp, Homo sapiens
tagctaggagcaggcttgtggca

SEQ ID NO: 5936445 - DNA, 19 bp, Homo sapiens
tagctagtgatttacacag

SEQ ID NO: 5936446 - DNA, 17 bp, Homo sapiens
tagctagtttgcttttt

SEQ ID NO: 5936447 - DNA, 19 bp, Homo sapiens
tagctatagttgcagccca

SEQ ID NO: 5936448 - DNA, 21 bp, Homo sapiens
tagctatagttgcagcccaag

SEQ ID NO: 5936449 - DNA, 14 bp, Homo sapiens
tagctatatccatg

SEQ ID NO: 5936450 - DNA, 21 bp, Homo sapiens
tagctatatccatgtactgta

SEQ ID NO: 5936451 - DNA, 15 bp, Homo sapiens
tagctatatctatat

SEQ ID NO: 5936452 - DNA, 14 bp, Homo sapiens
tagctatcagaaga

SEQ ID NO: 5936453 - DNA, 15 bp, Homo sapiens
tagctatcagaagac

SEQ ID NO: 5936454 - DNA, 21 bp, Homo sapiens
tagctatcagaagaccacaaa

SEQ ID NO: 5936455 - DNA, 16 bp, Homo sapiens
tagctatgctgtatct

SEQ ID NO: 5936456 - DNA, 21 bp, Homo sapiens
tagctatgctgtatctgtgct

SEQ ID NO: 5936457 - DNA, 16 bp, Homo sapiens
tagctatgtgaccttg

SEQ ID NO: 5936458 - DNA, 12 bp, Homo sapiens
tagctatgtgga

SEQ ID NO: 5936459 - DNA, 24 bp, Homo sapiens
tagctattactgcagactataaaa

SEQ ID NO: 5936460 - DNA, 14 bp, Homo sapiens
tagctattactgga

SEQ ID NO: 5936461 - DNA, 14 bp, Homo sapiens
tagctattactgtc

SEQ ID NO: 5936462 - DNA, 18 bp, Homo sapiens
tagctattagcggctcct

SEQ ID NO: 5936463 - DNA, 12 bp, Homo sapiens
tagctattcttt

SEQ ID NO: 5936464 - DNA, 14 bp, Homo sapiens
tagctattgcatgt

SEQ ID NO: 5936465 - DNA, 16 bp, Homo sapiens
tagctattgcatgtaa

SEQ ID NO: 5936466 - DNA, 18 bp, Homo sapiens
tagctattgcatgtaaaa

SEQ ID NO: 5936467 - DNA, 16 bp, Homo sapiens
tagctatttaatacta

SEQ ID NO: 5936468 - DNA, 15 bp, Homo sapiens
tagctattttccttg

SEQ ID NO: 5936469 - DNA, 18 bp, Homo sapiens
tagctattttcttacagt

SEQ ID NO: 5936470 - DNA, 18 bp, Homo sapiens
tagctatttttatacact

SEQ ID NO: 5936471 - DNA, 19 bp, Homo sapiens
tagctatttttatacactg

SEQ ID NO: 5936472 - DNA, 20 bp, Homo sapiens
tagctatttttatacactgt

SEQ ID NO: 5936473 - DNA, 17 bp, Homo sapiens
tagctatttttatggaa

SEQ ID NO: 5936474 - DNA, 17 bp, Homo sapiens
tagctatttttttccta

SEQ ID NO: 5936475 - DNA, 17 bp, Homo sapiens
tagctcaaacgtggctt

SEQ ID NO: 5936476 - DNA, 22 bp, Homo sapiens
tagctcaaatattgaatgttta

SEQ ID NO: 5936477 - DNA, 14 bp, Homo sapiens
tagctcaagcctat

SEQ ID NO: 5936478 - DNA, 18 bp, Homo sapiens
tagctcaagtttaaaagc

SEQ ID NO: 5936479 - DNA, 13 bp, Homo sapiens
tagctcaataaaa

SEQ ID NO: 5936480 - DNA, 15 bp, Homo sapiens
tagctcaattagtgt

SEQ ID NO: 5936481 - DNA, 19 bp, Homo sapiens
tagctcacaagccgtgttt

SEQ ID NO: 5936482 - DNA, 23 bp, Homo sapiens
tagctcacaagccgtgttttatg

SEQ ID NO: 5936483 - DNA, 13 bp, Homo sapiens
tagctcacagcac

SEQ ID NO: 5936484 - DNA, 20 bp, Homo sapiens
tagctcacagcacatttgtt

SEQ ID NO: 5936485 - DNA, 15 bp, Homo sapiens
tagctcacaggactt

SEQ ID NO: 5936486 - DNA, 17 bp, Homo sapiens
tagctcaccaggcctgg

SEQ ID NO: 5936487 - DNA, 19 bp, Homo sapiens
tagctcaccaggcctggcc

SEQ ID NO: 5936488 - DNA, 21 bp, Homo sapiens
tagctcaccaggcctggcctc

SEQ ID NO: 5936489 - DNA, 17 bp, Homo sapiens
tagctcactgcagcctc

SEQ ID NO: 5936490 - DNA, 18 bp, Homo sapiens
tagctcactgcagcctca

SEQ ID NO: 5936491 - DNA, 18 bp, Homo sapiens
tagctcagaggagaggag

SEQ ID NO: 5936492 - DNA, 17 bp, Homo sapiens
tagctcagccccagccc

SEQ ID NO: 5936493 - DNA, 19 bp, Homo sapiens
tagctcagccccagcccag

SEQ ID NO: 5936494 - DNA, 19 bp, Homo sapiens
tagctcagggtaagctgct

SEQ ID NO: 5936495 - DNA, 19 bp, Homo sapiens
tagctcagtcatcaaagca

SEQ ID NO: 5936496 - DNA, 15 bp, Homo sapiens
tagctcatcactgtg

SEQ ID NO: 5936497 - DNA, 19 bp, Homo sapiens
tagctccaagctgttaaag

SEQ ID NO: 5936498 - DNA, 22 bp, Homo sapiens
tagctccaccctcaccaggatg

SEQ ID NO: 5936499 - DNA, 11 bp, Homo sapiens
tagctccagcg

SEQ ID NO: 5936500 - DNA, 23 bp, Homo sapiens
tagctccagcgatggtgctgccc

SEQ ID NO: 5936501 - DNA, 14 bp, Homo sapiens
tagctcccctccaa

SEQ ID NO: 5936502 - DNA, 14 bp, Homo sapiens
tagctcccctcctc

SEQ ID NO: 5936503 - DNA, 20 bp, Homo sapiens
tagctcccctcctctcccct

SEQ ID NO: 5936504 - DNA, 11 bp, Homo sapiens
tagctcccctg

SEQ ID NO: 5936505 - DNA, 19 bp, Homo sapiens
tagctcccctggctggctc

SEQ ID NO: 5936506 - DNA, 23 bp, Homo sapiens
tagctcccgagctactctcttgc

SEQ ID NO: 5936507 - DNA, 15 bp, Homo sapiens
tagctccctcctccc

SEQ ID NO: 5936508 - DNA, 16 bp, Homo sapiens
tagctccctcctccca

SEQ ID NO: 5936509 - DNA, 19 bp, Homo sapiens
tagctccctcctcccatct

SEQ ID NO: 5936510 - DNA, 21 bp, Homo sapiens
tagctccctgtggggcaggag

SEQ ID NO: 5936511 - DNA, 18 bp, Homo sapiens
tagctcctcaaagcctca

SEQ ID NO: 5936512 - DNA, 13 bp, Homo sapiens
tagctcctgtggc

SEQ ID NO: 5936513 - DNA, 14 bp, Homo sapiens
tagctcctgtggcc

SEQ ID NO: 5936514 - DNA, 20 bp, Homo sapiens
tagctcctgtggccccaccc

SEQ ID NO: 5936515 - DNA, 13 bp, Homo sapiens
tagctccttggtt

SEQ ID NO: 5936516 - DNA, 16 bp, Homo sapiens
tagctcgtcctcactg

SEQ ID NO: 5936517 - DNA, 17 bp, Homo sapiens
tagctcgtcctcactgg

SEQ ID NO: 5936518 - DNA, 22 bp, Homo sapiens
tagctctaaaatctgcttgtat

SEQ ID NO: 5936519 - DNA, 19 bp, Homo sapiens
tagctctaatgtttgcata

SEQ ID NO: 5936520 - DNA, 21 bp, Homo sapiens
tagctctaatgtttgcatata

SEQ ID NO: 5936521 - DNA, 19 bp, Homo sapiens
tagctctcatgtatttaaa

SEQ ID NO: 5936522 - DNA, 21 bp, Homo sapiens
tagctctcgcctcaggctttt

SEQ ID NO: 5936523 - DNA, 13 bp, Homo sapiens
tagctctctaggc

SEQ ID NO: 5936524 - DNA, 17 bp, Homo sapiens
tagctctctaggcctct

SEQ ID NO: 5936525 - DNA, 20 bp, Homo sapiens
tagctctgaaatcaactctc

SEQ ID NO: 5936526 - DNA, 14 bp, Homo sapiens
tagctctgaaggga

SEQ ID NO: 5936527 - DNA, 18 bp, Homo sapiens
tagctctgaatgctattt

SEQ ID NO: 5936528 - DNA, 19 bp, Homo sapiens
tagctctgaatgctatttg

SEQ ID NO: 5936529 - DNA, 12 bp, Homo sapiens
tagctctgagcc

SEQ ID NO: 5936530 - DNA, 20 bp, Homo sapiens
tagctctgagccctccttct

SEQ ID NO: 5936531 - DNA, 12 bp, Homo sapiens
tagctctgcctc

SEQ ID NO: 5936532 - DNA, 17 bp, Homo sapiens
tagctctgcctccctct

SEQ ID NO: 5936533 - DNA, 15 bp, Homo sapiens
tagctctgctgctga

SEQ ID NO: 5936534 - DNA, 12 bp, Homo sapiens
tagctctggggg

SEQ ID NO: 5936535 - DNA, 16 bp, Homo sapiens
tagctctggtgggagg

SEQ ID NO: 5936536 - DNA, 14 bp, Homo sapiens
tagctctgttcttt

SEQ ID NO: 5936537 - DNA, 17 bp, Homo sapiens
tagctcttagtctcttt

SEQ ID NO: 5936538 - DNA, 17 bp, Homo sapiens
tagctcttcccactttt

SEQ ID NO: 5936539 - DNA, 18 bp, Homo sapiens
tagctcttcctccccagg

SEQ ID NO: 5936540 - DNA, 17 bp, Homo sapiens
tagctcttctatttaaa

SEQ ID NO: 5936541 - DNA, 11 bp, Homo sapiens
tagctcttgct

SEQ ID NO: 5936542 - DNA, 16 bp, Homo sapiens
tagctcttgggcctga

SEQ ID NO: 5936543 - DNA, 20 bp, Homo sapiens
tagctcttgggcctgacctc

SEQ ID NO: 5936544 - DNA, 15 bp, Homo sapiens
tagctctttgagata

SEQ ID NO: 5936545 - DNA, 21 bp, Homo sapiens
tagctctttgggcctctcctg

SEQ ID NO: 5936546 - DNA, 14 bp, Homo sapiens
tagctcttttccta

SEQ ID NO: 5936547 - DNA, 23 bp, Homo sapiens
tagctcttttttgtttgtttctt

SEQ ID NO: 5936548 - DNA, 21 bp, Homo sapiens
tagctgaaaaaactatatttg

SEQ ID NO: 5936549 - DNA, 14 bp, Homo sapiens
tagctgaaaactaa

SEQ ID NO: 5936550 - DNA, 18 bp, Homo sapiens
tagctgaaagagtatgta

SEQ ID NO: 5936551 - DNA, 19 bp, Homo sapiens
tagctgaaattccagttta

SEQ ID NO: 5936552 - DNA, 16 bp, Homo sapiens
tagctgaacctgtctg

SEQ ID NO: 5936553 - DNA, 21 bp, Homo sapiens
tagctgaagaattgaaaagtt

SEQ ID NO: 5936554 - DNA, 20 bp, Homo sapiens
tagctgaatgagtctgcttt

SEQ ID NO: 5936555 - DNA, 15 bp, Homo sapiens
tagctgaatgttttt

SEQ ID NO: 5936556 - DNA, 19 bp, Homo sapiens
tagctgacagtcagctgtg

SEQ ID NO: 5936557 - DNA, 23 bp, Homo sapiens
tagctgacatctcctctatcaca

SEQ ID NO: 5936558 - DNA, 22 bp, Homo sapiens
tagctgaccccgagaagtgctc

SEQ ID NO: 5936559 - DNA, 20 bp, Homo sapiens
tagctgacgccaataataaa

SEQ ID NO: 5936560 - DNA, 21 bp, Homo sapiens
tagctgacgccaataataaaa

SEQ ID NO: 5936561 - DNA, 17 bp, Homo sapiens
tagctgagactacaggt

SEQ ID NO: 5936562 - DNA, 12 bp, Homo sapiens
tagctgagctca

SEQ ID NO: 5936563 - DNA, 14 bp, Homo sapiens
tagctgatcagttt

SEQ ID NO: 5936564 - DNA, 23 bp, Homo sapiens
tagctgcacagggcagctgggcc

SEQ ID NO: 5936565 - DNA, 14 bp, Homo sapiens
tagctgcactgttt

SEQ ID NO: 5936566 - DNA, 21 bp, Homo sapiens
tagctgcactgtttatggaaa

SEQ ID NO: 5936567 - DNA, 11 bp, Homo sapiens
tagctgcagaa

SEQ ID NO: 5936568 - DNA, 17 bp, Homo sapiens
tagctgccaaaaagaac

SEQ ID NO: 5936569 - DNA, 22 bp, Homo sapiens
tagctgccaaaaagaacaccca

SEQ ID NO: 5936570 - DNA, 12 bp, Homo sapiens
tagctgccaagt

SEQ ID NO: 5936571 - DNA, 12 bp, Homo sapiens
tagctgccactt

SEQ ID NO: 5936572 - DNA, 20 bp, Homo sapiens
tagctgccatcttgcttttc

SEQ ID NO: 5936573 - DNA, 15 bp, Homo sapiens
tagctgcccatttcg

SEQ ID NO: 5936574 - DNA, 23 bp, Homo sapiens
tagctgcctagcaagctggcctc

SEQ ID NO: 5936575 - DNA, 23 bp, Homo sapiens
tagctgccttcaaggactgtttc

SEQ ID NO: 5936576 - DNA, 12 bp, Homo sapiens
tagctgctacaa

SEQ ID NO: 5936577 - DNA, 19 bp, Homo sapiens
tagctgctacaaagaagac

SEQ ID NO: 5936578 - DNA, 23 bp, Homo sapiens
tagctgctacaaagaagacatgt

SEQ ID NO: 5936579 - DNA, 23 bp, Homo sapiens
tagctgctagtgaaatggctggg

SEQ ID NO: 5936580 - DNA, 19 bp, Homo sapiens
tagctggaactacaggctc

SEQ ID NO: 5936581 - DNA, 23 bp, Homo sapiens
tagctggaattttttattcttgt

SEQ ID NO: 5936582 - DNA, 21 bp, Homo sapiens
tagctggagagagagttctca

SEQ ID NO: 5936583 - DNA, 12 bp, Homo sapiens
tagctggagcct

SEQ ID NO: 5936584 - DNA, 14 bp, Homo sapiens
taggataaaataat

SEQ ID NO: 5936585 - DNA, 17 bp, Homo sapiens
taggataaattacatta

SEQ ID NO: 5936586 - DNA, 18 bp, Homo sapiens
taggataaattacattaa

SEQ ID NO: 5936587 - DNA, 15 bp, Homo sapiens
taggataatacataa

SEQ ID NO: 5936588 - DNA, 15 bp, Homo sapiens
taggatacaatgtat

SEQ ID NO: 5936589 - DNA, 18 bp, Homo sapiens
taggataccacttttcat

SEQ ID NO: 5936590 - DNA, 14 bp, Homo sapiens
taggatactcttaa

SEQ ID NO: 5936591 - DNA, 21 bp, Homo sapiens
taggatactcttaatctcact

SEQ ID NO: 5936592 - DNA, 19 bp, Homo sapiens
taggatacttaacaaatac

SEQ ID NO: 5936593 - DNA, 16 bp, Homo sapiens
taggatagacactgga

SEQ ID NO: 5936594 - DNA, 18 bp, Homo sapiens
taggatagacactggaca

SEQ ID NO: 5936595 - DNA, 19 bp, Homo sapiens
taggatagatcttaagcag

SEQ ID NO: 5936596 - DNA, 21 bp, Homo sapiens
taggatagctaactgtaaatc

SEQ ID NO: 5936597 - DNA, 23 bp, Homo sapiens
taggatatgccctcctggtgact

SEQ ID NO: 5936598 - DNA, 18 bp, Homo sapiens
taggatatgcctgctctt

SEQ ID NO: 5936599 - DNA, 20 bp, Homo sapiens
taggatattgatttaaaatt

SEQ ID NO: 5936600 - DNA, 18 bp, Homo sapiens
taggatattggcatttgt

SEQ ID NO: 5936601 - DNA, 22 bp, Homo sapiens
taggatattttccctacctaag

SEQ ID NO: 5936602 - DNA, 15 bp, Homo sapiens
taggatcatatgaat

SEQ ID NO: 5936603 - DNA, 22 bp, Homo sapiens
taggatcatatgaccattgaaa

SEQ ID NO: 5936604 - DNA, 20 bp, Homo sapiens
taggatctaaggctgtttgc

SEQ ID NO: 5936605 - DNA, 21 bp, Homo sapiens
taggatctaaggctgtttgct

SEQ ID NO: 5936606 - DNA, 23 bp, Homo sapiens
taggatctatgcaatttttaaac

SEQ ID NO: 5936607 - DNA, 23 bp, Homo sapiens
taggatctcgcctggaaacagag

SEQ ID NO: 5936608 - DNA, 23 bp, Homo sapiens
taggatctgcaaacaatgaagaa

SEQ ID NO: 5936609 - DNA, 19 bp, Homo sapiens
taggatcttatttggaatt

SEQ ID NO: 5936610 - DNA, 14 bp, Homo sapiens
taggatgaacaatg

SEQ ID NO: 5936611 - DNA, 15 bp, Homo sapiens
taggatgagcaaaac

SEQ ID NO: 5936612 - DNA, 21 bp, Homo sapiens
taggatgattccgtgtgtgta

SEQ ID NO: 5936613 - DNA, 20 bp, Homo sapiens
taggatgcggctttctctgc

SEQ ID NO: 5936614 - DNA, 18 bp, Homo sapiens
taggatggatagaaggaa

SEQ ID NO: 5936615 - DNA, 23 bp, Homo sapiens
taggatgggaacaaggaaggaaa

SEQ ID NO: 5936616 - DNA, 18 bp, Homo sapiens
taggatggggctcccagc

SEQ ID NO: 5936617 - DNA, 23 bp, Homo sapiens
taggatgtatattttatataaag

SEQ ID NO: 5936618 - DNA, 13 bp, Homo sapiens
taggatgttgaaa

SEQ ID NO: 5936619 - DNA, 16 bp, Homo sapiens
taggatgttgcttctg

SEQ ID NO: 5936620 - DNA, 17 bp, Homo sapiens
taggatgttgcttctga

SEQ ID NO: 5936621 - DNA, 13 bp, Homo sapiens
taggattaattta

SEQ ID NO: 5936622 - DNA, 15 bp, Homo sapiens
taggattagaaaatt

SEQ ID NO: 5936623 - DNA, 14 bp, Homo sapiens
taggattataatgc

SEQ ID NO: 5936624 - DNA, 22 bp, Homo sapiens
taggattattgaaagagtctgg

SEQ ID NO: 5936625 - DNA, 12 bp, Homo sapiens
taggattcacac

SEQ ID NO: 5936626 - DNA, 20 bp, Homo sapiens
taggattcacaccccacctg

SEQ ID NO: 5936627 - DNA, 13 bp, Homo sapiens
taggattcagatc

SEQ ID NO: 5936628 - DNA, 12 bp, Homo sapiens
taggattcaggc

SEQ ID NO: 5936629 - DNA, 12 bp, Homo sapiens
taggattctaaa

SEQ ID NO: 5936630 - DNA, 19 bp, Homo sapiens
taggattctgttccctggg

SEQ ID NO: 5936631 - DNA, 13 bp, Homo sapiens
taggattgaagtg

SEQ ID NO: 5936632 - DNA, 13 bp, Homo sapiens
taggattgctggg

SEQ ID NO: 5936633 - DNA, 12 bp, Homo sapiens
taggattgctgt

SEQ ID NO: 5936634 - DNA, 15 bp, Homo sapiens
taggattgcttcaat

SEQ ID NO: 5936635 - DNA, 19 bp, Homo sapiens
taggattgcttcaattaaa

SEQ ID NO: 5936636 - DNA, 14 bp, Homo sapiens
taggatttatgtat

SEQ ID NO: 5936637 - DNA, 21 bp, Homo sapiens
taggatttatgtattttgaaa

SEQ ID NO: 5936638 - DNA, 17 bp, Homo sapiens
taggatttatttaaaat

SEQ ID NO: 5936639 - DNA, 12 bp, Homo sapiens
taggatttcagc

SEQ ID NO: 5936640 - DNA, 14 bp, Homo sapiens
taggatttcttaaa

SEQ ID NO: 5936641 - DNA, 18 bp, Homo sapiens
taggatttgaacacttgg

SEQ ID NO: 5936642 - DNA, 14 bp, Homo sapiens
taggatttgtgttt

SEQ ID NO: 5936643 - DNA, 23 bp, Homo sapiens
taggattttaacttaactgaaat

SEQ ID NO: 5936644 - DNA, 21 bp, Homo sapiens
taggattttttttaatgttta

SEQ ID NO: 5936645 - DNA, 23 bp, Homo sapiens
taggcaaaaataatttattttgc

SEQ ID NO: 5936646 - DNA, 15 bp, Homo sapiens
taggcaaagtacaaa

SEQ ID NO: 5936647 - DNA, 19 bp, Homo sapiens
taggcaaagttttccattt

SEQ ID NO: 5936648 - DNA, 20 bp, Homo sapiens
taggcaaatgtttaaacatt

SEQ ID NO: 5936649 - DNA, 19 bp, Homo sapiens
taggcaaggctatgtgatt

SEQ ID NO: 5936650 - DNA, 16 bp, Homo sapiens
taggcaagtttgttca

SEQ ID NO: 5936651 - DNA, 17 bp, Homo sapiens
taggcaagttttccctg

SEQ ID NO: 5936652 - DNA, 15 bp, Homo sapiens
taggcaatatcttta

SEQ ID NO: 5936653 - DNA, 16 bp, Homo sapiens
taggcaattagagaaa

SEQ ID NO: 5936654 - DNA, 14 bp, Homo sapiens
taggcacaaggttg

SEQ ID NO: 5936655 - DNA, 13 bp, Homo sapiens
taggcaccacctc

SEQ ID NO: 5936656 - DNA, 22 bp, Homo sapiens
taggcacctccccgctctccct

SEQ ID NO: 5936657 - DNA, 17 bp, Homo sapiens
taggcacctctgtgctg

SEQ ID NO: 5936658 - DNA, 19 bp, Homo sapiens
taggcaccttaactggaga

SEQ ID NO: 5936659 - DNA, 18 bp, Homo sapiens
taggcaccttttactgtg

SEQ ID NO: 5936660 - DNA, 18 bp, Homo sapiens
taggcactgtagttctaa

SEQ ID NO: 5936661 - DNA, 12 bp, Homo sapiens
taggcagaagaa

SEQ ID NO: 5936662 - DNA, 16 bp, Homo sapiens
taggcagaagaagctg

SEQ ID NO: 5936663 - DNA, 20 bp, Homo sapiens
taggcagaagaagctgggag

SEQ ID NO: 5936664 - DNA, 21 bp, Homo sapiens
taggcagaagaagctgggagg

SEQ ID NO: 5936665 - DNA, 22 bp, Homo sapiens
taggcagaagaagctgggaggg

SEQ ID NO: 5936666 - DNA, 13 bp, Homo sapiens
taggcagaatgga

SEQ ID NO: 5936667 - DNA, 12 bp, Homo sapiens
taggcagacaca

SEQ ID NO: 5936668 - DNA, 14 bp, Homo sapiens
taggcagacacagg

SEQ ID NO: 5936669 - DNA, 22 bp, Homo sapiens
taggcagactctttatgcttgc

SEQ ID NO: 5936670 - DNA, 21 bp, Homo sapiens
taggcagagcccgcccacctg

SEQ ID NO: 5936671 - DNA, 16 bp, Homo sapiens
taggcagagcctttgg

SEQ ID NO: 5936672 - DNA, 12 bp, Homo sapiens
taggcagcaagc

SEQ ID NO: 5936673 - DNA, 18 bp, Homo sapiens
taggcagccagctacagg

SEQ ID NO: 5936674 - DNA, 19 bp, Homo sapiens
taggcagcctctctgctat

SEQ ID NO: 5936675 - DNA, 13 bp, Homo sapiens
taggcagcctgcc

SEQ ID NO: 5936676 - DNA, 19 bp, Homo sapiens
taggcagctgtcctgtgat

SEQ ID NO: 5936677 - DNA, 12 bp, Homo sapiens
taggcagcttct

SEQ ID NO: 5936678 - DNA, 12 bp, Homo sapiens
taggcaggaagt

SEQ ID NO: 5936679 - DNA, 19 bp, Homo sapiens
taggcaggaagtcaggagc

SEQ ID NO: 5936680 - DNA, 17 bp, Homo sapiens
taggcaggacatgctga

SEQ ID NO: 5936681 - DNA, 12 bp, Homo sapiens
taggcagggagg

SEQ ID NO: 5936682 - DNA, 16 bp, Homo sapiens
taggcagggagggggc

SEQ ID NO: 5936683 - DNA, 21 bp, Homo sapiens
taggcagggagggggctggga

SEQ ID NO: 5936684 - DNA, 15 bp, Homo sapiens
taggcagggatttga

SEQ ID NO: 5936685 - DNA, 17 bp, Homo sapiens
taggcataaattaaaat

SEQ ID NO: 5936686 - DNA, 19 bp, Homo sapiens
taggcataaattaaaatgt

SEQ ID NO: 5936687 - DNA, 17 bp, Homo sapiens
taggcatactctccagg

SEQ ID NO: 5936688 - DNA, 14 bp, Homo sapiens
taggcatcccaggg

SEQ ID NO: 5936689 - DNA, 23 bp, Homo sapiens
taggcatgaagagcaaaaatatc

SEQ ID NO: 5936690 - DNA, 14 bp, Homo sapiens
taggcatgcctaat

SEQ ID NO: 5936691 - DNA, 14 bp, Homo sapiens
taggcatgtaaaca

SEQ ID NO: 5936692 - DNA, 22 bp, Homo sapiens
taggcatgtcagaggaccccag

SEQ ID NO: 5936693 - DNA, 17 bp, Homo sapiens
taggcattaaatgcaaa

SEQ ID NO: 5936694 - DNA, 20 bp, Homo sapiens
taggcattaacacaaaggag

SEQ ID NO: 5936695 - DNA, 20 bp, Homo sapiens
taggcattatttaatgtttg

SEQ ID NO: 5936696 - DNA, 13 bp, Homo sapiens
taggcattctgga

SEQ ID NO: 5936697 - DNA, 16 bp, Homo sapiens
taggcattgtgatgtt

SEQ ID NO: 5936698 - DNA, 14 bp, Homo sapiens
taggcattgtggga

SEQ ID NO: 5936699 - DNA, 23 bp, Homo sapiens
taggcatttcattatgctttgaa

SEQ ID NO: 5936700 - DNA, 20 bp, Homo sapiens
taggcatttgctgaatacag

SEQ ID NO: 5936701 - DNA, 14 bp, Homo sapiens
taggcatttgtaaa

SEQ ID NO: 5936702 - DNA, 19 bp, Homo sapiens
taggccaaagacaaatagt

SEQ ID NO: 5936703 - DNA, 19 bp, Homo sapiens
taggccaaatttgtagtgc

SEQ ID NO: 5936704 - DNA, 14 bp, Homo sapiens
taggccaagctgaa

SEQ ID NO: 5936705 - DNA, 22 bp, Homo sapiens
taggccaagctgaagtgaagga

SEQ ID NO: 5936706 - DNA, 18 bp, Homo sapiens
taggccaaggtgtcctac

SEQ ID NO: 5936707 - DNA, 21 bp, Homo sapiens
taggccaaggtgtcctacaga

SEQ ID NO: 5936708 - DNA, 22 bp, Homo sapiens
taggccaaggtgtcctacagaa

SEQ ID NO: 5936709 - DNA, 18 bp, Homo sapiens
taggccaatcagaagcta

SEQ ID NO: 5936710 - DNA, 12 bp, Homo sapiens
taggccaatgaa

SEQ ID NO: 5936711 - DNA, 15 bp, Homo sapiens
taggccaatgaaggc

SEQ ID NO: 5936712 - DNA, 22 bp, Homo sapiens
taggccacagaaggtgaacttt

SEQ ID NO: 5936713 - DNA, 19 bp, Homo sapiens
taggccacgtccaggtccg

SEQ ID NO: 5936714 - DNA, 16 bp, Homo sapiens
taggccagagccatgc

SEQ ID NO: 5936715 - DNA, 16 bp, Homo sapiens
taggccagcaggggct

SEQ ID NO: 5936716 - DNA, 20 bp, Homo sapiens
taggccaggagttcccaaat

SEQ ID NO: 5936717 - DNA, 13 bp, Homo sapiens
taggccaggcctt

SEQ ID NO: 5936718 - DNA, 22 bp, Homo sapiens
taggccaggccttatctgaaag

SEQ ID NO: 5936719 - DNA, 20 bp, Homo sapiens
taggccagggcatgtgtatg

SEQ ID NO: 5936720 - DNA, 21 bp, Homo sapiens
taggccagggcatgtgtatgt

SEQ ID NO: 5936721 - DNA, 23 bp, Homo sapiens
taggccatgatgtcgttcatttt

SEQ ID NO: 5936722 - DNA, 23 bp, Homo sapiens
taggccatgggtggaaagtgctc

SEQ ID NO: 5936723 - DNA, 21 bp, Homo sapiens
taggccatgttaattaaactg

SEQ ID NO: 5936724 - DNA, 9 bp, Homo sapiens
taggcccaa

SEQ ID NO: 5936725 - DNA, 16 bp, Homo sapiens
taggcccacacacagg

SEQ ID NO: 5936726 - DNA, 17 bp, Homo sapiens
taggccccacaaggcct

SEQ ID NO: 5936727 - DNA, 14 bp, Homo sapiens
taggccccagaggc

SEQ ID NO: 5936728 - DNA, 21 bp, Homo sapiens
taggccccagaggccctggag

SEQ ID NO: 5936729 - DNA, 20 bp, Homo sapiens
taggccccagcaacacgtca

SEQ ID NO: 5936730 - DNA, 21 bp, Homo sapiens
taggcccccacttgcctcttc

SEQ ID NO: 5936731 - DNA, 20 bp, Homo sapiens
taggcccctcctagacccag

SEQ ID NO: 5936732 - DNA, 20 bp, Homo sapiens
taggcccctggtctgccctg

SEQ ID NO: 5936733 - DNA, 19 bp, Homo sapiens
taggcccggagctgcccct

SEQ ID NO: 5936734 - DNA, 13 bp, Homo sapiens
taggccctggtct

SEQ ID NO: 5936735 - DNA, 22 bp, Homo sapiens
taggccctggttcctgctgtcc

SEQ ID NO: 5936736 - DNA, 22 bp, Homo sapiens
taggccctgtgagcacaaagaa

SEQ ID NO: 5936737 - DNA, 18 bp, Homo sapiens
taggcccttgtcctgcca

SEQ ID NO: 5936738 - DNA, 22 bp, Homo sapiens
taggcctataaaattaaatgcc

SEQ ID NO: 5936739 - DNA, 18 bp, Homo sapiens
taggcctcagccagagaa

SEQ ID NO: 5936740 - DNA, 20 bp, Homo sapiens
taggcctcagtgtcctcatc

SEQ ID NO: 5936741 - DNA, 14 bp, Homo sapiens
taggcctcatttct

SEQ ID NO: 5936742 - DNA, 18 bp, Homo sapiens
taggcctcatttctttgt

SEQ ID NO: 5936743 - DNA, 22 bp, Homo sapiens
taggcctcatttctttgtcttt

SEQ ID NO: 5936744 - DNA, 14 bp, Homo sapiens
taggcctctctgcc

SEQ ID NO: 5936745 - DNA, 16 bp, Homo sapiens
taggcctctctgcctg

SEQ ID NO: 5936746 - DNA, 18 bp, Homo sapiens
taggcctcttgaattttt

SEQ ID NO: 5936747 - DNA, 12 bp, Homo sapiens
taggcctgcctt

SEQ ID NO: 5936748 - DNA, 14 bp, Homo sapiens
taggcctggcacag

SEQ ID NO: 5936749 - DNA, 13 bp, Homo sapiens
taggcctggccag

SEQ ID NO: 5936750 - DNA, 15 bp, Homo sapiens
taggcctggccagat

SEQ ID NO: 5936751 - DNA, 18 bp, Homo sapiens
taggcctggccagatgca

SEQ ID NO: 5936752 - DNA, 20 bp, Homo sapiens
taggcctgggtgctggctgc

SEQ ID NO: 5936753 - DNA, 20 bp, Homo sapiens
taggcctgtcccttgcctct

SEQ ID NO: 5936754 - DNA, 15 bp, Homo sapiens
taggccttaacacac

SEQ ID NO: 5936755 - DNA, 22 bp, Homo sapiens
taggccttaacacactggccat

SEQ ID NO: 5936756 - DNA, 23 bp, Homo sapiens
taggccttcctctctccagatgt

SEQ ID NO: 5936757 - DNA, 13 bp, Homo sapiens
taggccttcttgt

SEQ ID NO: 5936758 - DNA, 14 bp, Homo sapiens
taggccttcttgtg

SEQ ID NO: 5936759 - DNA, 16 bp, Homo sapiens
taggccttgccagttt

SEQ ID NO: 5936760 - DNA, 16 bp, Homo sapiens
taggccttttaacatt

SEQ ID NO: 5936761 - DNA, 11 bp, Homo sapiens
taggtttcaaa

SEQ ID NO: 5936762 - DNA, 20 bp, Homo sapiens
taggtttctaaaaagtcaga

SEQ ID NO: 5936763 - DNA, 21 bp, Homo sapiens
taggtttgggggacgcccagc

SEQ ID NO: 5936764 - DNA, 15 bp, Homo sapiens
taggtttgtaaaatg

SEQ ID NO: 5936765 - DNA, 15 bp, Homo sapiens
taggtttgtcaacac

SEQ ID NO: 5936766 - DNA, 23 bp, Homo sapiens
taggttttaataattttttaatt

SEQ ID NO: 5936767 - DNA, 13 bp, Homo sapiens
taggttttacctt

SEQ ID NO: 5936768 - DNA, 21 bp, Homo sapiens
taggttttgtttgctatctta

SEQ ID NO: 5936769 - DNA, 15 bp, Homo sapiens
taggtttttttgtat

SEQ ID NO: 5936770 - DNA, 17 bp, Homo sapiens
tagtaaaaaagagaatt

SEQ ID NO: 5936771 - DNA, 19 bp, Homo sapiens
tagtaaaaacatttaaata

SEQ ID NO: 5936772 - DNA, 19 bp, Homo sapiens
tagtaaaaagattctctgc

SEQ ID NO: 5936773 - DNA, 22 bp, Homo sapiens
tagtaaaaagccctatgtgaaa

SEQ ID NO: 5936774 - DNA, 23 bp, Homo sapiens
tagtaaaaagccctatgtgaaaa

SEQ ID NO: 5936775 - DNA, 21 bp, Homo sapiens
tagtaaaagtggtctctgctg

SEQ ID NO: 5936776 - DNA, 23 bp, Homo sapiens
tagtaaaagtggtctctgctggg

SEQ ID NO: 5936777 - DNA, 19 bp, Homo sapiens
tagtaaaatgcttacagga

SEQ ID NO: 5936778 - DNA, 13 bp, Homo sapiens
tagtaaaattaga

SEQ ID NO: 5936779 - DNA, 22 bp, Homo sapiens
tagtaaaattctactgtatgga

SEQ ID NO: 5936780 - DNA, 23 bp, Homo sapiens
tagtaaacattaagtaaatgctg

SEQ ID NO: 5936781 - DNA, 12 bp, Homo sapiens
tagtaaagaaat

SEQ ID NO: 5936782 - DNA, 13 bp, Homo sapiens
tagtaaagaaatt

SEQ ID NO: 5936783 - DNA, 15 bp, Homo sapiens
tagtaaagtattttt

SEQ ID NO: 5936784 - DNA, 21 bp, Homo sapiens
tagtaaagtatttttgattaa

SEQ ID NO: 5936785 - DNA, 17 bp, Homo sapiens
tagtaaagtcaaggaga

SEQ ID NO: 5936786 - DNA, 13 bp, Homo sapiens
tagtaaataaaca

SEQ ID NO: 5936787 - DNA, 14 bp, Homo sapiens
tagtaaataatgct

SEQ ID NO: 5936788 - DNA, 19 bp, Homo sapiens
tagtaaataatgctttgaa

SEQ ID NO: 5936789 - DNA, 19 bp, Homo sapiens
tagtaaatattatgatttt

SEQ ID NO: 5936790 - DNA, 15 bp, Homo sapiens
tagtaaatgattcat

SEQ ID NO: 5936791 - DNA, 16 bp, Homo sapiens
tagtaaatgtagttca

SEQ ID NO: 5936792 - DNA, 12 bp, Homo sapiens
tagtaaatgtct

SEQ ID NO: 5936793 - DNA, 11 bp, Homo sapiens
tagtaaatgtg

SEQ ID NO: 5936794 - DNA, 11 bp, Homo sapiens
tagtaaatgtt

SEQ ID NO: 5936795 - DNA, 13 bp, Homo sapiens
tagtaaatgttat

SEQ ID NO: 5936796 - DNA, 17 bp, Homo sapiens
tagtaaattttcaaact

SEQ ID NO: 5936797 - DNA, 23 bp, Homo sapiens
tagtaaattttgtgatgaataaa

SEQ ID NO: 5936798 - DNA, 23 bp, Homo sapiens
tagtaacaggccttgagcacaaa

SEQ ID NO: 5936799 - DNA, 21 bp, Homo sapiens
tagtaactactttttatactc

SEQ ID NO: 5936800 - DNA, 17 bp, Homo sapiens
tagtaactataagatac

SEQ ID NO: 5936801 - DNA, 20 bp, Homo sapiens
tagtaactcccatcacctct

SEQ ID NO: 5936802 - DNA, 15 bp, Homo sapiens
tagtaactgacatga

SEQ ID NO: 5936803 - DNA, 19 bp, Homo sapiens
tagtaacttcttatggaat

SEQ ID NO: 5936804 - DNA, 20 bp, Homo sapiens
tagtaacttttagtggttct

SEQ ID NO: 5936805 - DNA, 13 bp, Homo sapiens
tagtaagatactg

SEQ ID NO: 5936806 - DNA, 17 bp, Homo sapiens
tagtaagatgcactgaa

SEQ ID NO: 5936807 - DNA, 22 bp, Homo sapiens
tagtaagattgatatctataaa

SEQ ID NO: 5936808 - DNA, 11 bp, Homo sapiens
tagtaagcata

SEQ ID NO: 5936809 - DNA, 21 bp, Homo sapiens
tagtaagtaattatgcactaa

SEQ ID NO: 5936810 - DNA, 17 bp, Homo sapiens
tagtaagtatttccata

SEQ ID NO: 5936811 - DNA, 18 bp, Homo sapiens
tagtaagttcagcacttg

SEQ ID NO: 5936812 - DNA, 18 bp, Homo sapiens
tagtaataccaaagacta

SEQ ID NO: 5936813 - DNA, 13 bp, Homo sapiens
tagtaatacctct

SEQ ID NO: 5936814 - DNA, 20 bp, Homo sapiens
tagtaatagagcaaaattga

SEQ ID NO: 5936815 - DNA, 22 bp, Homo sapiens
tagtaatagtccaatatttggc

SEQ ID NO: 5936816 - DNA, 13 bp, Homo sapiens
tagtaatatattt

SEQ ID NO: 5936817 - DNA, 16 bp, Homo sapiens
tagtaatatatttaaa

SEQ ID NO: 5936818 - DNA, 17 bp, Homo sapiens
tagtaatatatttaaag

SEQ ID NO: 5936819 - DNA, 12 bp, Homo sapiens
tagtaatcatat

SEQ ID NO: 5936820 - DNA, 12 bp, Homo sapiens
tagtaatctgta

SEQ ID NO: 5936821 - DNA, 16 bp, Homo sapiens
tagtaatctgtacatt

SEQ ID NO: 5936822 - DNA, 14 bp, Homo sapiens
tagtaatctgtata

SEQ ID NO: 5936823 - DNA, 14 bp, Homo sapiens
tagtaatgcactct

SEQ ID NO: 5936824 - DNA, 20 bp, Homo sapiens
tagtaatgctacgtgtgatt

SEQ ID NO: 5936825 - DNA, 13 bp, Homo sapiens
tagtaatggcaga

SEQ ID NO: 5936826 - DNA, 18 bp, Homo sapiens
tagtaatggcagagcagt

SEQ ID NO: 5936827 - DNA, 18 bp, Homo sapiens
tagtaatgggccaattaa

SEQ ID NO: 5936828 - DNA, 22 bp, Homo sapiens
tagtaatgggccaattaaaata

SEQ ID NO: 5936829 - DNA, 21 bp, Homo sapiens
tagtaattaggataactaaaa

SEQ ID NO: 5936830 - DNA, 13 bp, Homo sapiens
tagtaattgtaag

SEQ ID NO: 5936831 - DNA, 24 bp, Homo sapiens
tagtaatttattgtctgtctacat

SEQ ID NO: 5936832 - DNA, 14 bp, Homo sapiens
tagtaatttctttt

SEQ ID NO: 5936833 - DNA, 14 bp, Homo sapiens
tagtaatttgtaaa

SEQ ID NO: 5936834 - DNA, 13 bp, Homo sapiens
tagtaatttttta

SEQ ID NO: 5936835 - DNA, 22 bp, Homo sapiens
tagtaattttttacattttcct

SEQ ID NO: 5936836 - DNA, 16 bp, Homo sapiens
tagtacaaattataaa

SEQ ID NO: 5936837 - DNA, 22 bp, Homo sapiens
tagtacaagtggtaatttttgt

SEQ ID NO: 5936838 - DNA, 21 bp, Homo sapiens
tagtacaatttcaactacagt

SEQ ID NO: 5936839 - DNA, 23 bp, Homo sapiens
tagtacagtagcttaaataaatt

SEQ ID NO: 5936840 - DNA, 21 bp, Homo sapiens
tagtacataaaggtggtatgt

SEQ ID NO: 5936841 - DNA, 17 bp, Homo sapiens
tagtacatcatgtaaga

SEQ ID NO: 5936842 - DNA, 17 bp, Homo sapiens
tagtacatggagctcag

SEQ ID NO: 5936843 - DNA, 18 bp, Homo sapiens
tagtacattactaaatat

SEQ ID NO: 5936844 - DNA, 16 bp, Homo sapiens
tagtaccaatcatttt

SEQ ID NO: 5936845 - DNA, 19 bp, Homo sapiens
tagtaccatttatacaaat

SEQ ID NO: 5936846 - DNA, 20 bp, Homo sapiens
tagtaccatttatacaaatt

SEQ ID NO: 5936847 - DNA, 21 bp, Homo sapiens
tagtacccaacctggtaatta

SEQ ID NO: 5936848 - DNA, 13 bp, Homo sapiens
tagtacccacctg

SEQ ID NO: 5936849 - DNA, 22 bp, Homo sapiens
tagtaccctatagagagggggc

SEQ ID NO: 5936850 - DNA, 22 bp, Homo sapiens
tagtaccctgcaggccaggcca

SEQ ID NO: 5936851 - DNA, 18 bp, Homo sapiens
tagtacctgaaaagtaac

SEQ ID NO: 5936852 - DNA, 15 bp, Homo sapiens
tagtacctgtgactc

SEQ ID NO: 5936853 - DNA, 17 bp, Homo sapiens
tagtacctgtgactctt

SEQ ID NO: 5936854 - DNA, 12 bp, Homo sapiens
tagtaccttcaa

SEQ ID NO: 5936855 - DNA, 14 bp, Homo sapiens
tagtacggctgctg

SEQ ID NO: 5936856 - DNA, 15 bp, Homo sapiens
tagtactagaaactg

SEQ ID NO: 5936857 - DNA, 18 bp, Homo sapiens
tagtactagtactattgc

SEQ ID NO: 5936858 - DNA, 17 bp, Homo sapiens
tagtactatatctgttt

SEQ ID NO: 5936859 - DNA, 16 bp, Homo sapiens
tagtactatttcttaa

SEQ ID NO: 5936860 - DNA, 17 bp, Homo sapiens
tagtactatttcttaat

SEQ ID NO: 5936861 - DNA, 14 bp, Homo sapiens
tagtactcaatgtt

SEQ ID NO: 5936862 - DNA, 17 bp, Homo sapiens
tagtactcctgcaaaat

SEQ ID NO: 5936863 - DNA, 20 bp, Homo sapiens
tagtactcctgcaaaatttt

SEQ ID NO: 5936864 - DNA, 17 bp, Homo sapiens
tagtactctctgctcta

SEQ ID NO: 5936865 - DNA, 14 bp, Homo sapiens
tagtactgctttac

SEQ ID NO: 5936866 - DNA, 14 bp, Homo sapiens
tagtactgtgaatc

SEQ ID NO: 5936867 - DNA, 17 bp, Homo sapiens
tagtacttcttctgtaa

SEQ ID NO: 5936868 - DNA, 21 bp, Homo sapiens
tagtactttatagaagaatgc

SEQ ID NO: 5936869 - DNA, 13 bp, Homo sapiens
tagtagaaaatac

SEQ ID NO: 5936870 - DNA, 15 bp, Homo sapiens
tagtagaaagaaaat

SEQ ID NO: 5936871 - DNA, 20 bp, Homo sapiens
tagtagaaagacatctgcct

SEQ ID NO: 5936872 - DNA, 16 bp, Homo sapiens
tagtagaaagtggaaa

SEQ ID NO: 5936873 - DNA, 15 bp, Homo sapiens
tagtagaaattttac

SEQ ID NO: 5936874 - DNA, 20 bp, Homo sapiens
tagtagaactggatcccaac

SEQ ID NO: 5936875 - DNA, 16 bp, Homo sapiens
tagtagacatgaattt

SEQ ID NO: 5936876 - DNA, 22 bp, Homo sapiens
tagtagacatgaattttaaata

SEQ ID NO: 5936877 - DNA, 13 bp, Homo sapiens
tagtagagacagg

SEQ ID NO: 5936878 - DNA, 13 bp, Homo sapiens
tagtagagacggg

SEQ ID NO: 5936879 - DNA, 20 bp, Homo sapiens
tagtagagatttcatagcta

SEQ ID NO: 5936880 - DNA, 21 bp, Homo sapiens
tagtagaggtacacttgtgaa

SEQ ID NO: 5936881 - DNA, 12 bp, Homo sapiens
tagtagatttta

SEQ ID NO: 5936882 - DNA, 18 bp, Homo sapiens
tagtagattttaaagaca

SEQ ID NO: 5936883 - DNA, 20 bp, Homo sapiens
tagtagatttttaacaaaaa

SEQ ID NO: 5936884 - DNA, 16 bp, Homo sapiens
tagtagcaatgtgcct

SEQ ID NO: 5936885 - DNA, 16 bp, Homo sapiens
tagtagccctttctgt

SEQ ID NO: 5936886 - DNA, 19 bp, Homo sapiens
tagtagccctttctgtgtg

SEQ ID NO: 5936887 - DNA, 21 bp, Homo sapiens
tagtagcctttcctgatgaca

SEQ ID NO: 5936888 - DNA, 23 bp, Homo sapiens
tagtagcgttttttaaatgtata

SEQ ID NO: 5936889 - DNA, 15 bp, Homo sapiens
tagtaggaatgtaca

SEQ ID NO: 5936890 - DNA, 21 bp, Homo sapiens
tagtaggatatgcctgctctt

SEQ ID NO: 5936891 - DNA, 13 bp, Homo sapiens
tagtaggcaagat

SEQ ID NO: 5936892 - DNA, 17 bp, Homo sapiens
tagtaggctaaaaacat

SEQ ID NO: 5936893 - DNA, 16 bp, Homo sapiens
tagtaggggtaccact

SEQ ID NO: 5936894 - DNA, 17 bp, Homo sapiens
tagtaggggtaccactg

SEQ ID NO: 5936895 - DNA, 17 bp, Homo sapiens
tagtaggggttgaagaa

SEQ ID NO: 5936896 - DNA, 18 bp, Homo sapiens
tagtaggggttgaagaaa

SEQ ID NO: 5936897 - DNA, 22 bp, Homo sapiens
tagtagggtgagggataagcaa

SEQ ID NO: 5936898 - DNA, 14 bp, Homo sapiens
tagtagtaaatgct

SEQ ID NO: 5936899 - DNA, 22 bp, Homo sapiens
tagtagtcaattagtacagtag

SEQ ID NO: 5936900 - DNA, 17 bp, Homo sapiens
tagtagtgcatagaatt

SEQ ID NO: 5936901 - DNA, 15 bp, Homo sapiens
tagtagtgtggcctg

SEQ ID NO: 5936902 - DNA, 13 bp, Homo sapiens
tagtagtgttcta

SEQ ID NO: 5936903 - DNA, 14 bp, Homo sapiens
tagtagttaaaaca

SEQ ID NO: 5936904 - DNA, 16 bp, Homo sapiens
tagtagttaaataact

SEQ ID NO: 5936905 - DNA, 23 bp, Homo sapiens
tagtagttagaaattaaatctgt

SEQ ID NO: 5936906 - DNA, 22 bp, Homo sapiens
tagtagttgtagaagaaaattt

SEQ ID NO: 5936907 - DNA, 16 bp, Homo sapiens
tagtataaatgtacat

SEQ ID NO: 5936908 - DNA, 19 bp, Homo sapiens
tagtataaatgtacatcag

SEQ ID NO: 5936909 - DNA, 15 bp, Homo sapiens
tagtataccagagaa

SEQ ID NO: 5936910 - DNA, 14 bp, Homo sapiens
tagtatacccactg

SEQ ID NO: 5936911 - DNA, 12 bp, Homo sapiens
tagtatactttc

SEQ ID NO: 5936912 - DNA, 16 bp, Homo sapiens
tagtatagaaaatgga

SEQ ID NO: 5936913 - DNA, 21 bp, Homo sapiens
tagtatagccacaaatgcctt

SEQ ID NO: 5936914 - DNA, 16 bp, Homo sapiens
tagtatagttttcgat

SEQ ID NO: 5936915 - DNA, 22 bp, Homo sapiens
tagtatatgattgtatttaaag

SEQ ID NO: 5936916 - DNA, 15 bp, Homo sapiens
tagtatatggtggag

SEQ ID NO: 5936917 - DNA, 21 bp, Homo sapiens
tagtatatgtcagacatgaaa

SEQ ID NO: 5936918 - DNA, 12 bp, Homo sapiens
tagtatatttat

SEQ ID NO: 5936919 - DNA, 17 bp, Homo sapiens
tagtatatttatactct

SEQ ID NO: 5936920 - DNA, 18 bp, Homo sapiens
tagtatatttatataatt

SEQ ID NO: 5936921 - DNA, 13 bp, Homo sapiens
tagtatcaaaaga

SEQ ID NO: 5936922 - DNA, 20 bp, Homo sapiens
tagtatcaagtgttctaaaa

SEQ ID NO: 5936923 - DNA, 23 bp, Homo sapiens
tagtatcactgctttttccttag

SEQ ID NO: 5936924 - DNA, 16 bp, Homo sapiens
tagtatcagtgtttta

SEQ ID NO: 5936925 - DNA, 14 bp, Homo sapiens
tagtatccacagga

SEQ ID NO: 5936926 - DNA, 23 bp, Homo sapiens
tagtatcctccaggtttttcaat

SEQ ID NO: 5936927 - DNA, 15 bp, Homo sapiens
tagtatctatatgac

SEQ ID NO: 5936928 - DNA, 23 bp, Homo sapiens
tagtatctattgtgttggcttta

SEQ ID NO: 5936929 - DNA, 16 bp, Homo sapiens
tagtatctctggcctc

SEQ ID NO: 5936930 - DNA, 13 bp, Homo sapiens
tagtatctgctta

SEQ ID NO: 5936931 - DNA, 13 bp, Homo sapiens
tagtatcttcaaa

SEQ ID NO: 5936932 - DNA, 20 bp, Homo sapiens
tagtatcttcaaactttcac

SEQ ID NO: 5936933 - DNA, 18 bp, Homo sapiens
tagtatcttgaaatcctg

SEQ ID NO: 5936934 - DNA, 13 bp, Homo sapiens
tagtatgaaaatg

SEQ ID NO: 5936935 - DNA, 20 bp, Homo sapiens
tagtatgacgctgatacata

SEQ ID NO: 5936936 - DNA, 17 bp, Homo sapiens
tagtatgaggcatttgt

SEQ ID NO: 5936937 - DNA, 18 bp, Homo sapiens
tagtatgcagttgataag

SEQ ID NO: 5936938 - DNA, 17 bp, Homo sapiens
tagtatgggaaaaaaac

SEQ ID NO: 5936939 - DNA, 21 bp, Homo sapiens
tagtatgggaaaaaaactgaa

SEQ ID NO: 5936940 - DNA, 16 bp, Homo sapiens
tagtatggttcaagat

SEQ ID NO: 5936941 - DNA, 23 bp, Homo sapiens
tagtatgtctgtttttgtatctt

SEQ ID NO: 5936942 - DNA, 18 bp, Homo sapiens
tagtattaaaagttgcat

SEQ ID NO: 5936943 - DNA, 22 bp, Homo sapiens
tagtattaagtgaaattttaaa

SEQ ID NO: 5936944 - DNA, 21 bp, Homo sapiens
tagtattaccaccctttcaca

SEQ ID NO: 5936945 - DNA, 14 bp, Homo sapiens
tagtattaccgatg

SEQ ID NO: 5936946 - DNA, 23 bp, Homo sapiens
tagtattatcaaagggataaaga

SEQ ID NO: 5936947 - DNA, 23 bp, Homo sapiens
tagtattatcttgttcaggaaaa

SEQ ID NO: 5936948 - DNA, 22 bp, Homo sapiens
tagtattcctaacctgtcagaa

SEQ ID NO: 5936949 - DNA, 14 bp, Homo sapiens
tagtattgaaagtg

SEQ ID NO: 5936950 - DNA, 17 bp, Homo sapiens
tagtattgacaaaatgt

SEQ ID NO: 5936951 - DNA, 12 bp, Homo sapiens
tagtattgattc

SEQ ID NO: 5936952 - DNA, 16 bp, Homo sapiens
tagtattgttgtcctt

SEQ ID NO: 5936953 - DNA, 16 bp, Homo sapiens
tagtatttatttatgt

SEQ ID NO: 5936954 - DNA, 13 bp, Homo sapiens
tagtatttcagtg

SEQ ID NO: 5936955 - DNA, 20 bp, Homo sapiens
tagtatttcagtgttttcat

SEQ ID NO: 5936956 - DNA, 14 bp, Homo sapiens
tagtatttctcagg

SEQ ID NO: 5936957 - DNA, 15 bp, Homo sapiens
tagtatttctcagga

SEQ ID NO: 5936958 - DNA, 17 bp, Homo sapiens
tagtatttctcaggaag

SEQ ID NO: 5936959 - DNA, 12 bp, Homo sapiens
tagtatttctcc

SEQ ID NO: 5936960 - DNA, 22 bp, Homo sapiens
tagtatttgaaaacagaaattg

SEQ ID NO: 5936961 - DNA, 12 bp, Homo sapiens
tagtatttgaat

SEQ ID NO: 5936962 - DNA, 21 bp, Homo sapiens
tagtatttgaattaaaacttc

SEQ ID NO: 5936963 - DNA, 17 bp, Homo sapiens
tagtattttaaaaaata

SEQ ID NO: 5936964 - DNA, 22 bp, Homo sapiens
tagtattttgagccttattaaa

SEQ ID NO: 5936965 - DNA, 13 bp, Homo sapiens
tagtatttttatc

SEQ ID NO: 5936966 - DNA, 19 bp, Homo sapiens
tagtattttttgtataatt

SEQ ID NO: 5936967 - DNA, 21 bp, Homo sapiens
tagtatttttttcttaccaaa

SEQ ID NO: 5936968 - DNA, 15 bp, Homo sapiens
tagtcaaaactattt

SEQ ID NO: 5936969 - DNA, 23 bp, Homo sapiens
tagtcaaatgtaatgtggcttct

SEQ ID NO: 5936970 - DNA, 14 bp, Homo sapiens
tagtcaaattgtgt

SEQ ID NO: 5936971 - DNA, 23 bp, Homo sapiens
tagtcaacagtaccctggttgtg

SEQ ID NO: 5936972 - DNA, 13 bp, Homo sapiens
tagtcaagctcct

SEQ ID NO: 5936973 - DNA, 23 bp, Homo sapiens
tagtcaagttggacttgttttaa

SEQ ID NO: 5936974 - DNA, 16 bp, Homo sapiens
tagtcaataaacttgt

SEQ ID NO: 5936975 - DNA, 21 bp, Homo sapiens
tagtcaatcaagtctgtttac

SEQ ID NO: 5936976 - DNA, 22 bp, Homo sapiens
tagtcaatgtaaaaatacacta

SEQ ID NO: 5936977 - DNA, 15 bp, Homo sapiens
tagtcaattagtaca

SEQ ID NO: 5936978 - DNA, 19 bp, Homo sapiens
tagtcaattagtacagtag

SEQ ID NO: 5936979 - DNA, 16 bp, Homo sapiens
tagtcaatttctactt

SEQ ID NO: 5936980 - DNA, 13 bp, Homo sapiens
tagtcacaaaaat

SEQ ID NO: 5936981 - DNA, 17 bp, Homo sapiens
tagtcacaaaaatggtg

SEQ ID NO: 5936982 - DNA, 23 bp, Homo sapiens
tagtcacatggcctatgcacata

SEQ ID NO: 5936983 - DNA, 19 bp, Homo sapiens
tagtcaccccaagtagtct

SEQ ID NO: 5936984 - DNA, 18 bp, Homo sapiens
tagtcaccgacagcggcc

SEQ ID NO: 5936985 - DNA, 19 bp, Homo sapiens
tagtcaccgacagcggcct

SEQ ID NO: 5936986 - DNA, 13 bp, Homo sapiens
tagtcacctgctg

SEQ ID NO: 5936987 - DNA, 20 bp, Homo sapiens
tagtcaccttttaaatcctg

SEQ ID NO: 5936988 - DNA, 20 bp, Homo sapiens
tagtcactgagacagcccgg

SEQ ID NO: 5936989 - DNA, 23 bp, Homo sapiens
tagtcactgcctgcagaggtctg

SEQ ID NO: 5936990 - DNA, 15 bp, Homo sapiens
tagtcactgctgcta

SEQ ID NO: 5936991 - DNA, 19 bp, Homo sapiens
tagtcactggcagcctgca

SEQ ID NO: 5936992 - DNA, 17 bp, Homo sapiens
tagtcacttatttcata

SEQ ID NO: 5936993 - DNA, 12 bp, Homo sapiens
tagtcagaaatg

SEQ ID NO: 5936994 - DNA, 15 bp, Homo sapiens
tagtcagaaatgatt

SEQ ID NO: 5936995 - DNA, 17 bp, Homo sapiens
tagtcagagtgtccctt

SEQ ID NO: 5936996 - DNA, 15 bp, Homo sapiens
tagtcagatggatgt

SEQ ID NO: 5936997 - DNA, 18 bp, Homo sapiens
tagtcagatggatgtaga

SEQ ID NO: 5936998 - DNA, 21 bp, Homo sapiens
tagtcagcgcaggaatgcaca

SEQ ID NO: 5936999 - DNA, 19 bp, Homo sapiens
tagtcagctagatcatttg

SEQ ID NO: 5937000 - DNA, 17 bp, Homo sapiens
tagtcagtaaagatatt

SEQ ID NO: 5937001 - DNA, 22 bp, Homo sapiens
tagtcagtaaagatatttgaat

SEQ ID NO: 5937002 - DNA, 23 bp, Homo sapiens
tagtcatacgtctttagatgcta

SEQ ID NO: 5937003 - DNA, 21 bp, Homo sapiens
tagtcatagaaatacctcatt

SEQ ID NO: 5937004 - DNA, 17 bp, Homo sapiens
tagtcatatattaaaca

SEQ ID NO: 5937005 - DNA, 20 bp, Homo sapiens
tagtcatatgtgaagacaga

SEQ ID NO: 5937006 - DNA, 15 bp, Homo sapiens
tagtcatatttttgt

SEQ ID NO: 5937007 - DNA, 20 bp, Homo sapiens
tagtcatatttttgtaaata

SEQ ID NO: 5937008 - DNA, 18 bp, Homo sapiens
tagtcatcagagaacagt

SEQ ID NO: 5937009 - DNA, 16 bp, Homo sapiens
tagtcatccaacaaga

SEQ ID NO: 5937010 - DNA, 17 bp, Homo sapiens
tagtcatccaacaagaa

SEQ ID NO: 5937011 - DNA, 22 bp, Homo sapiens
tagtcatcttaaatttcaaacc

SEQ ID NO: 5937012 - DNA, 18 bp, Homo sapiens
tagtcatgctgtgcattt

SEQ ID NO: 5937013 - DNA, 19 bp, Homo sapiens
tagtcatggggtccctgct

SEQ ID NO: 5937014 - DNA, 15 bp, Homo sapiens
tagtcatgtttatct

SEQ ID NO: 5937015 - DNA, 17 bp, Homo sapiens
tagtcatgtttctgcag

SEQ ID NO: 5937016 - DNA, 22 bp, Homo sapiens
tagtcattaaaaacatagaaaa

SEQ ID NO: 5937017 - DNA, 17 bp, Homo sapiens
tagtcattaacccatct

SEQ ID NO: 5937018 - DNA, 18 bp, Homo sapiens
tagtcattaacccatctc

SEQ ID NO: 5937019 - DNA, 23 bp, Homo sapiens
tagtcattgttgttttaacctcc

SEQ ID NO: 5937020 - DNA, 14 bp, Homo sapiens
tagtcatttaagaa

SEQ ID NO: 5937021 - DNA, 17 bp, Homo sapiens
tagtcatttaagaattt

SEQ ID NO: 5937022 - DNA, 14 bp, Homo sapiens
tagtcatttactaa

SEQ ID NO: 5937023 - DNA, 18 bp, Homo sapiens
tagtcatttactaaacat

SEQ ID NO: 5937024 - DNA, 21 bp, Homo sapiens
tagtcatttaggatccatgca

SEQ ID NO: 5937025 - DNA, 19 bp, Homo sapiens
tagtcatttattttaaaaa

SEQ ID NO: 5937026 - DNA, 14 bp, Homo sapiens
tagtcatttccaaa

SEQ ID NO: 5937027 - DNA, 17 bp, Homo sapiens
tagtcatttgttaatat

SEQ ID NO: 5937028 - DNA, 19 bp, Homo sapiens
tagtcatttgttaatattt

SEQ ID NO: 5937029 - DNA, 23 bp, Homo sapiens
tagtcatttgttaatatttcttc

SEQ ID NO: 5937030 - DNA, 13 bp, Homo sapiens
tagtcattttgct

SEQ ID NO: 5937031 - DNA, 19 bp, Homo sapiens
tagtcatttttagcactgg

SEQ ID NO: 5937032 - DNA, 21 bp, Homo sapiens
tagtccaaatgtgatcaactg

SEQ ID NO: 5937033 - DNA, 16 bp, Homo sapiens
tagtccaatgaagata

SEQ ID NO: 5937034 - DNA, 16 bp, Homo sapiens
tagtccaatttttact

SEQ ID NO: 5937035 - DNA, 15 bp, Homo sapiens
tagtccaccttcatt

SEQ ID NO: 5937036 - DNA, 16 bp, Homo sapiens
tagtccacggaccccc

SEQ ID NO: 5937037 - DNA, 14 bp, Homo sapiens
tagtcccagctact

SEQ ID NO: 5937038 - DNA, 23 bp, Homo sapiens
tagtcccagctacttgggaggct

SEQ ID NO: 5937039 - DNA, 20 bp, Homo sapiens
tagtcccatttttctcttgc

SEQ ID NO: 5937040 - DNA, 14 bp, Homo sapiens
tagtccccatcagc

SEQ ID NO: 5937041 - DNA, 19 bp, Homo sapiens
tagtccccatcagcaccat

SEQ ID NO: 5937042 - DNA, 20 bp, Homo sapiens
tagtcccggaggccttccct

SEQ ID NO: 5937043 - DNA, 23 bp, Homo sapiens
tagtcccttcccctccctggctc

SEQ ID NO: 5937044 - DNA, 14 bp, Homo sapiens
tagtcctattctat

SEQ ID NO: 5937045 - DNA, 14 bp, Homo sapiens
tagtcctcacagcc

SEQ ID NO: 5937046 - DNA, 16 bp, Homo sapiens
tagtcctcccaagctg

SEQ ID NO: 5937047 - DNA, 14 bp, Homo sapiens
tagtcctgggagag

SEQ ID NO: 5937048 - DNA, 17 bp, Homo sapiens
tagtcctgggagaggac

SEQ ID NO: 5937049 - DNA, 22 bp, Homo sapiens
tagtcctgggagaggacaggga

SEQ ID NO: 5937050 - DNA, 12 bp, Homo sapiens
tagtcctgtact

SEQ ID NO: 5937051 - DNA, 22 bp, Homo sapiens
tagtcctttataagttgctttc

SEQ ID NO: 5937052 - DNA, 21 bp, Homo sapiens
tagtcctttctgccttggcct

SEQ ID NO: 5937053 - DNA, 22 bp, Homo sapiens
tagtcctttctgtgaagctaat

SEQ ID NO: 5937054 - DNA, 20 bp, Homo sapiens
tagtccttttatctccttgt

SEQ ID NO: 5937055 - DNA, 14 bp, Homo sapiens
tagtcggagccccc

SEQ ID NO: 5937056 - DNA, 19 bp, Homo sapiens
tagtcgggacttgtaacat

SEQ ID NO: 5937057 - DNA, 14 bp, Homo sapiens
tagtcgggtgccag

SEQ ID NO: 5937058 - DNA, 14 bp, Homo sapiens
tagtcggtcaccaa

SEQ ID NO: 5937059 - DNA, 20 bp, Homo sapiens
tagtcgtggagatgtcttcg

SEQ ID NO: 5937060 - DNA, 19 bp, Homo sapiens
tagtctaaaaacttctttt

SEQ ID NO: 5937061 - DNA, 19 bp, Homo sapiens
tagtctaaccaaatgcatc

SEQ ID NO: 5937062 - DNA, 18 bp, Homo sapiens
tagtctacagttgtcctg

SEQ ID NO: 5937063 - DNA, 21 bp, Homo sapiens
tagtctactcttaagccatct

SEQ ID NO: 5937064 - DNA, 16 bp, Homo sapiens
tagtctacttcttaaa

SEQ ID NO: 5937065 - DNA, 20 bp, Homo sapiens
tagtctatcaaatgaaactc

SEQ ID NO: 5937066 - DNA, 15 bp, Homo sapiens
tagtctatcagcatc

SEQ ID NO: 5937067 - DNA, 19 bp, Homo sapiens
tagtctcactgcttgaact

SEQ ID NO: 5937068 - DNA, 17 bp, Homo sapiens
tagtctcagtgaagact

SEQ ID NO: 5937069 - DNA, 18 bp, Homo sapiens
tagtctcagtgaagacta

SEQ ID NO: 5937070 - DNA, 12 bp, Homo sapiens
tagtctcctggg

SEQ ID NO: 5937071 - DNA, 18 bp, Homo sapiens
tagtctcctttgcactga

SEQ ID NO: 5937072 - DNA, 19 bp, Homo sapiens
tagtctcctttgcactgag

SEQ ID NO: 5937073 - DNA, 20 bp, Homo sapiens
tagtctctatcattaaagtt

SEQ ID NO: 5937074 - DNA, 21 bp, Homo sapiens
tagtctctatcattaaagttc

SEQ ID NO: 5937075 - DNA, 16 bp, Homo sapiens
tagtctctctagtagt

SEQ ID NO: 5937076 - DNA, 23 bp, Homo sapiens
tagtctctctggggccacacaga

SEQ ID NO: 5937077 - DNA, 19 bp, Homo sapiens
tagtctctgatttgcaaat

SEQ ID NO: 5937078 - DNA, 13 bp, Homo sapiens
tagtctctgccct

SEQ ID NO: 5937079 - DNA, 16 bp, Homo sapiens
tagtctctgttcttca

SEQ ID NO: 5937080 - DNA, 20 bp, Homo sapiens
tagtctcttctcagagcagc

SEQ ID NO: 5937081 - DNA, 16 bp, Homo sapiens
tagtctctttaaaagg

SEQ ID NO: 5937082 - DNA, 18 bp, Homo sapiens
tagtctctttaaaaggaa

SEQ ID NO: 5937083 - DNA, 13 bp, Homo sapiens
tagtctctttatt

SEQ ID NO: 5937084 - DNA, 15 bp, Homo sapiens
tagtctctttattcc

SEQ ID NO: 5937085 - DNA, 19 bp, Homo sapiens
tagtctctttattcctagt

SEQ ID NO: 5937086 - DNA, 18 bp, Homo sapiens
tagtctgaaactggcttc

SEQ ID NO: 5937087 - DNA, 21 bp, Homo sapiens
tagtctgaagtctggaacact

SEQ ID NO: 5937088 - DNA, 15 bp, Homo sapiens
tagtctggaactgct

SEQ ID NO: 5937089 - DNA, 17 bp, Homo sapiens
tagtctggaactgctgc

SEQ ID NO: 5937090 - DNA, 20 bp, Homo sapiens
tagtctggaactgctgctga

SEQ ID NO: 5937091 - DNA, 18 bp, Homo sapiens
tagtctgggtcagaccca

SEQ ID NO: 5937092 - DNA, 19 bp, Homo sapiens
tagtctggtgttctgagta

SEQ ID NO: 5937093 - DNA, 20 bp, Homo sapiens
tagtctggtgttctgagtac

SEQ ID NO: 5937094 - DNA, 13 bp, Homo sapiens
tagtctggtttct

SEQ ID NO: 5937095 - DNA, 13 bp, Homo sapiens
tagtctgtacttc

SEQ ID NO: 5937096 - DNA, 23 bp, Homo sapiens
tagtctgtatccaaataatgaat

SEQ ID NO: 5937097 - DNA, 18 bp, Homo sapiens
tagtctgtcatccagaaa

SEQ ID NO: 5937098 - DNA, 16 bp, Homo sapiens
tagtctgtgcctcagt

SEQ ID NO: 5937099 - DNA, 19 bp, Homo sapiens
tagtctgtgtaactttaaa

SEQ ID NO: 5937100 - DNA, 22 bp, Homo sapiens
tagtctgtgtgggactgtacac

SEQ ID NO: 5937101 - DNA, 17 bp, Homo sapiens
tagtcttagtaatagca

SEQ ID NO: 5937102 - DNA, 20 bp, Homo sapiens
tagtcttatgtaaagtatgt

SEQ ID NO: 5937103 - DNA, 22 bp, Homo sapiens
tagtcttcaactggttagtgtg

SEQ ID NO: 5937104 - DNA, 22 bp, Homo sapiens
tagtcttccacaaaaaatactt

SEQ ID NO: 5937105 - DNA, 20 bp, Homo sapiens
tagtcttgaaatgaaaggga

SEQ ID NO: 5937106 - DNA, 21 bp, Homo sapiens
tagtcttgaaatgaaagggaa

SEQ ID NO: 5937107 - DNA, 15 bp, Homo sapiens
tagtcttgaatttct

SEQ ID NO: 5937108 - DNA, 17 bp, Homo sapiens
tagtcttgctttgctgt

SEQ ID NO: 5937109 - DNA, 23 bp, Homo sapiens
tagtcttggaagctgtttggaaa

SEQ ID NO: 5937110 - DNA, 12 bp, Homo sapiens
tagtcttggcta

SEQ ID NO: 5937111 - DNA, 13 bp, Homo sapiens
tagtcttggctaa

SEQ ID NO: 5937112 - DNA, 21 bp, Homo sapiens
tagtcttgtcccaattaaaat

SEQ ID NO: 5937113 - DNA, 16 bp, Homo sapiens
tagtcttgttgttcat

SEQ ID NO: 5937114 - DNA, 15 bp, Homo sapiens
tagtctttttttcct

SEQ ID NO: 5937115 - DNA, 19 bp, Homo sapiens
tagttctgctccagacagg

SEQ ID NO: 5937116 - DNA, 19 bp, Homo sapiens
tagttctgctgccctctta

SEQ ID NO: 5937117 - DNA, 16 bp, Homo sapiens
tagttctgctgtctcc

SEQ ID NO: 5937118 - DNA, 17 bp, Homo sapiens
tagttctgctgtctccc

SEQ ID NO: 5937119 - DNA, 19 bp, Homo sapiens
tagttctgctgtctccctg

SEQ ID NO: 5937120 - DNA, 14 bp, Homo sapiens
tagttctgtagaaa

SEQ ID NO: 5937121 - DNA, 18 bp, Homo sapiens
tagttctgtagaaatggt

SEQ ID NO: 5937122 - DNA, 16 bp, Homo sapiens
tagttctgtatataaa

SEQ ID NO: 5937123 - DNA, 15 bp, Homo sapiens
tagttctgtatttga

SEQ ID NO: 5937124 - DNA, 16 bp, Homo sapiens
tagttctgtatttgaa

SEQ ID NO: 5937125 - DNA, 17 bp, Homo sapiens
tagttctgtatttgaaa

SEQ ID NO: 5937126 - DNA, 21 bp, Homo sapiens
tagttctgtatttgaaagtgc

SEQ ID NO: 5937127 - DNA, 18 bp, Homo sapiens
tagttctgtgcctccccc

SEQ ID NO: 5937128 - DNA, 13 bp, Homo sapiens
tagttctgtgtag

SEQ ID NO: 5937129 - DNA, 12 bp, Homo sapiens
tagttctgttgt

SEQ ID NO: 5937130 - DNA, 14 bp, Homo sapiens
tagttcttaaaatt

SEQ ID NO: 5937131 - DNA, 23 bp, Homo sapiens
tagttcttagaagctcacgcctt

SEQ ID NO: 5937132 - DNA, 20 bp, Homo sapiens
tagttcttagctttgaaact

SEQ ID NO: 5937133 - DNA, 15 bp, Homo sapiens
tagttcttgaattgt

SEQ ID NO: 5937134 - DNA, 16 bp, Homo sapiens
tagttcttgaattgtt

SEQ ID NO: 5937135 - DNA, 22 bp, Homo sapiens
tagttcttgaattgttatgaaa

SEQ ID NO: 5937136 - DNA, 21 bp, Homo sapiens
tagttcttgtgcatgtttact

SEQ ID NO: 5937137 - DNA, 13 bp, Homo sapiens
tagttctttgttc

SEQ ID NO: 5937138 - DNA, 14 bp, Homo sapiens
tagttctttgttcc

SEQ ID NO: 5937139 - DNA, 19 bp, Homo sapiens
tagttctttgttcctgctt

SEQ ID NO: 5937140 - DNA, 21 bp, Homo sapiens
tagttctttgttcctgctttc

SEQ ID NO: 5937141 - DNA, 19 bp, Homo sapiens
tagttgaaaaaagaagttt

SEQ ID NO: 5937142 - DNA, 23 bp, Homo sapiens
tagttgaacaagatttccctaaa

SEQ ID NO: 5937143 - DNA, 22 bp, Homo sapiens
tagttgaactgatagttactgt

SEQ ID NO: 5937144 - DNA, 13 bp, Homo sapiens
tagttgaatactt

SEQ ID NO: 5937145 - DNA, 16 bp, Homo sapiens
tagttgaatacttgaa

SEQ ID NO: 5937146 - DNA, 18 bp, Homo sapiens
tagttgaattccaagtgt

SEQ ID NO: 5937147 - DNA, 12 bp, Homo sapiens
tagttgaatttt

SEQ ID NO: 5937148 - DNA, 22 bp, Homo sapiens
tagttgaattttttttaacatt

SEQ ID NO: 5937149 - DNA, 18 bp, Homo sapiens
tagttgacaacctagaat

SEQ ID NO: 5937150 - DNA, 21 bp, Homo sapiens
tagttgacaacctagaatgtc

SEQ ID NO: 5937151 - DNA, 17 bp, Homo sapiens
tagttgacaattctgca

SEQ ID NO: 5937152 - DNA, 13 bp, Homo sapiens
tagttgacagtat

SEQ ID NO: 5937153 - DNA, 21 bp, Homo sapiens
tagttgacagtattaacacta

SEQ ID NO: 5937154 - DNA, 22 bp, Homo sapiens
tagttgaccagggcagtgaaaa

SEQ ID NO: 5937155 - DNA, 17 bp, Homo sapiens
tagttgacttcaaatgt

SEQ ID NO: 5937156 - DNA, 19 bp, Homo sapiens
tagttgacttcaaatgtgt

SEQ ID NO: 5937157 - DNA, 21 bp, Homo sapiens
tagttgagagagtagttttga

SEQ ID NO: 5937158 - DNA, 17 bp, Homo sapiens
tagttgagatgtcaaga

SEQ ID NO: 5937159 - DNA, 21 bp, Homo sapiens
tagttgagattgtactgttca

SEQ ID NO: 5937160 - DNA, 18 bp, Homo sapiens
tagttgaggaaagcacag

SEQ ID NO: 5937161 - DNA, 12 bp, Homo sapiens
tagttgaggccg

SEQ ID NO: 5937162 - DNA, 21 bp, Homo sapiens
tagttgagtcttcacatttag

SEQ ID NO: 5937163 - DNA, 13 bp, Homo sapiens
tagttgatatgtt

SEQ ID NO: 5937164 - DNA, 14 bp, Homo sapiens
tagttgatgaccaa

SEQ ID NO: 5937165 - DNA, 21 bp, Homo sapiens
tagttgatgaccaatctctgt

SEQ ID NO: 5937166 - DNA, 22 bp, Homo sapiens
tagttgatgaccaatctctgtg

SEQ ID NO: 5937167 - DNA, 21 bp, Homo sapiens
tagttgattgctgttgagatg

SEQ ID NO: 5937168 - DNA, 18 bp, Homo sapiens
tagttgcaaagagacatt

SEQ ID NO: 5937169 - DNA, 17 bp, Homo sapiens
tagttgcaatagaacag

SEQ ID NO: 5937170 - DNA, 16 bp, Homo sapiens
tagttgcaattgaatt

SEQ ID NO: 5937171 - DNA, 17 bp, Homo sapiens
tagttgcagaaacattt

SEQ ID NO: 5937172 - DNA, 14 bp, Homo sapiens
tagttgccaacagt

SEQ ID NO: 5937173 - DNA, 21 bp, Homo sapiens
tagttgccaacagttgtatgt

SEQ ID NO: 5937174 - DNA, 16 bp, Homo sapiens
tagttgccaatatgcc

SEQ ID NO: 5937175 - DNA, 19 bp, Homo sapiens
tagttgccaatatgccagc

SEQ ID NO: 5937176 - DNA, 18 bp, Homo sapiens
tagttgccaatctaaaat

SEQ ID NO: 5937177 - DNA, 19 bp, Homo sapiens
tagttgcccccattcccag

SEQ ID NO: 5937178 - DNA, 13 bp, Homo sapiens
tagttgctcttct

SEQ ID NO: 5937179 - DNA, 12 bp, Homo sapiens
tagttggacagt

SEQ ID NO: 5937180 - DNA, 23 bp, Homo sapiens
tagttggagctagaaaatgaact

SEQ ID NO: 5937181 - DNA, 16 bp, Homo sapiens
tagttggcagaaatac

SEQ ID NO: 5937182 - DNA, 17 bp, Homo sapiens
tagttggcagaaataca

SEQ ID NO: 5937183 - DNA, 18 bp, Homo sapiens
tagttggcagaaatacag

SEQ ID NO: 5937184 - DNA, 21 bp, Homo sapiens
tagttggcagagaaaatgctg

SEQ ID NO: 5937185 - DNA, 16 bp, Homo sapiens
tagttggctagtactt

SEQ ID NO: 5937186 - DNA, 21 bp, Homo sapiens
tagttgggatgccaatttcct

SEQ ID NO: 5937187 - DNA, 15 bp, Homo sapiens
tagttggtctttcca

SEQ ID NO: 5937188 - DNA, 22 bp, Homo sapiens
tagttggtctttccatctatca

SEQ ID NO: 5937189 - DNA, 18 bp, Homo sapiens
tagttgtaaaccaagtga

SEQ ID NO: 5937190 - DNA, 21 bp, Homo sapiens
tagttgtaatgtgtatgtctg

SEQ ID NO: 5937191 - DNA, 20 bp, Homo sapiens
tagttgtagacaaagtacat

SEQ ID NO: 5937192 - DNA, 14 bp, Homo sapiens
tagttgtattcttc

SEQ ID NO: 5937193 - DNA, 14 bp, Homo sapiens
tagttgtcagaata

SEQ ID NO: 5937194 - DNA, 21 bp, Homo sapiens
tagttgtccatattttcacag

SEQ ID NO: 5937195 - DNA, 14 bp, Homo sapiens
tagttgtctgtgct

SEQ ID NO: 5937196 - DNA, 22 bp, Homo sapiens
tagttgtgaccttagtgtttct

SEQ ID NO: 5937197 - DNA, 21 bp, Homo sapiens
tagttgtgcagtcagtgtcaa

SEQ ID NO: 5937198 - DNA, 16 bp, Homo sapiens
tagttgtggaaagata

SEQ ID NO: 5937199 - DNA, 18 bp, Homo sapiens
tagttgtgtactctggcc

SEQ ID NO: 5937200 - DNA, 12 bp, Homo sapiens
tagttgtgtctg

SEQ ID NO: 5937201 - DNA, 15 bp, Homo sapiens
tagttgtgtttcaac

SEQ ID NO: 5937202 - DNA, 20 bp, Homo sapiens
tagttgttggtctgtagcaa

SEQ ID NO: 5937203 - DNA, 20 bp, Homo sapiens
tagttgtttgattcagacag

SEQ ID NO: 5937204 - DNA, 16 bp, Homo sapiens
tagtttaaaaatattc

SEQ ID NO: 5937205 - DNA, 20 bp, Homo sapiens
tagtttaaaaatctgccacc

SEQ ID NO: 5937206 - DNA, 16 bp, Homo sapiens
tagtttaaaacacatt

SEQ ID NO: 5937207 - DNA, 20 bp, Homo sapiens
tagtttaaaattattaaaaa

SEQ ID NO: 5937208 - DNA, 19 bp, Homo sapiens
tagtttaagacttagttat

SEQ ID NO: 5937209 - DNA, 21 bp, Homo sapiens
tagtttaatactcagaggggg

SEQ ID NO: 5937210 - DNA, 18 bp, Homo sapiens
tagtttaatagtttgaag

SEQ ID NO: 5937211 - DNA, 15 bp, Homo sapiens
tagtttaattaacta

SEQ ID NO: 5937212 - DNA, 15 bp, Homo sapiens
tagtttacacactgt

SEQ ID NO: 5937213 - DNA, 13 bp, Homo sapiens
tagtttacagaaa

SEQ ID NO: 5937214 - DNA, 19 bp, Homo sapiens
tagtttacagaaaaatctt

SEQ ID NO: 5937215 - DNA, 20 bp, Homo sapiens
tagtttacagaaaaatcttg

SEQ ID NO: 5937216 - DNA, 17 bp, Homo sapiens
tagtttacctctttaaa

SEQ ID NO: 5937217 - DNA, 13 bp, Homo sapiens
tagtttactgttt

SEQ ID NO: 5937218 - DNA, 20 bp, Homo sapiens
tagtttacttcctaaatttc

SEQ ID NO: 5937219 - DNA, 21 bp, Homo sapiens
tagtttacttcctaaatttca

SEQ ID NO: 5937220 - DNA, 22 bp, Homo sapiens
tagtttagatcccatgtcacct

SEQ ID NO: 5937221 - DNA, 16 bp, Homo sapiens
tagtttaggaaaatga

SEQ ID NO: 5937222 - DNA, 18 bp, Homo sapiens
tagtttaggtgtttggga

SEQ ID NO: 5937223 - DNA, 20 bp, Homo sapiens
tagtttagtacaataatctc

SEQ ID NO: 5937224 - DNA, 18 bp, Homo sapiens
tagtttagtgtggttttc

SEQ ID NO: 5937225 - DNA, 15 bp, Homo sapiens
tagtttagttctgtt

SEQ ID NO: 5937226 - DNA, 15 bp, Homo sapiens
tagtttattggaagt

SEQ ID NO: 5937227 - DNA, 16 bp, Homo sapiens
tagtttcaaagtgtct

SEQ ID NO: 5937228 - DNA, 19 bp, Homo sapiens
tagtttcaaagtgtctcat

SEQ ID NO: 5937229 - DNA, 15 bp, Homo sapiens
tagtttcacattgca

SEQ ID NO: 5937230 - DNA, 21 bp, Homo sapiens
tagtttcacgtaaatattcat

SEQ ID NO: 5937231 - DNA, 20 bp, Homo sapiens
tagtttcagagaccttaatt

SEQ ID NO: 5937232 - DNA, 14 bp, Homo sapiens
tagtttcagctgac

SEQ ID NO: 5937233 - DNA, 20 bp, Homo sapiens
tagtttcagctgaccagaag

SEQ ID NO: 5937234 - DNA, 17 bp, Homo sapiens
tagtttcagtaaataat

SEQ ID NO: 5937235 - DNA, 13 bp, Homo sapiens
tagtttccagtgg

SEQ ID NO: 5937236 - DNA, 18 bp, Homo sapiens
tagtttctagtgtcactg

SEQ ID NO: 5937237 - DNA, 23 bp, Homo sapiens
tagtttctcagggtcactgtcct

SEQ ID NO: 5937238 - DNA, 12 bp, Homo sapiens
tagtttctcatg

SEQ ID NO: 5937239 - DNA, 14 bp, Homo sapiens
tagtttctgttctg

SEQ ID NO: 5937240 - DNA, 15 bp, Homo sapiens
tagtttctgttctgt

SEQ ID NO: 5937241 - DNA, 22 bp, Homo sapiens
tagtttctttattttgtgtaaa

SEQ ID NO: 5937242 - DNA, 14 bp, Homo sapiens
tagtttctttggga

SEQ ID NO: 5937243 - DNA, 13 bp, Homo sapiens
tagtttgaatgtt

SEQ ID NO: 5937244 - DNA, 15 bp, Homo sapiens
tagtttgaattcagt

SEQ ID NO: 5937245 - DNA, 19 bp, Homo sapiens
tagtttgaggaaatttgca

SEQ ID NO: 5937246 - DNA, 21 bp, Homo sapiens
tagtttgattattcagtgtca

SEQ ID NO: 5937247 - DNA, 23 bp, Homo sapiens
tagtttgcaacatatttaagaga

SEQ ID NO: 5937248 - DNA, 17 bp, Homo sapiens
tagtttgcacttcctgt

SEQ ID NO: 5937249 - DNA, 21 bp, Homo sapiens
tagtttgcatttaagaattgc

SEQ ID NO: 5937250 - DNA, 16 bp, Homo sapiens
tagtttgcatttcaga

SEQ ID NO: 5937251 - DNA, 19 bp, Homo sapiens
tagtttgcccagagttggg

SEQ ID NO: 5937252 - DNA, 22 bp, Homo sapiens
tagtttgcctgcagtttcttgt

SEQ ID NO: 5937253 - DNA, 21 bp, Homo sapiens
tagtttgctcatactacattg

SEQ ID NO: 5937254 - DNA, 16 bp, Homo sapiens
tagtttgctttgcttt

SEQ ID NO: 5937255 - DNA, 19 bp, Homo sapiens
tagtttgctttgctttgta

SEQ ID NO: 5937256 - DNA, 11 bp, Homo sapiens
tagtttggatt

SEQ ID NO: 5937257 - DNA, 13 bp, Homo sapiens
tagtttggcacat

SEQ ID NO: 5937258 - DNA, 21 bp, Homo sapiens
tagtttggctataagtgctca

SEQ ID NO: 5937259 - DNA, 15 bp, Homo sapiens
tagtttgtctatttt

SEQ ID NO: 5937260 - DNA, 22 bp, Homo sapiens
tagtttgtctattttaaaataa

SEQ ID NO: 5937261 - DNA, 13 bp, Homo sapiens
tagtttgtgagaa

SEQ ID NO: 5937262 - DNA, 14 bp, Homo sapiens
tagtttgtgagaaa

SEQ ID NO: 5937263 - DNA, 14 bp, Homo sapiens
tagtttgttaaagc

SEQ ID NO: 5937264 - DNA, 23 bp, Homo sapiens
tagtttgttatgtgtctggaaga

SEQ ID NO: 5937265 - DNA, 13 bp, Homo sapiens
tagttttaaataa

SEQ ID NO: 5937266 - DNA, 14 bp, Homo sapiens
tagttttaaatatg

SEQ ID NO: 5937267 - DNA, 16 bp, Homo sapiens
tagttttaaatatgaa

SEQ ID NO: 5937268 - DNA, 15 bp, Homo sapiens
tagttttaacagaac

SEQ ID NO: 5937269 - DNA, 13 bp, Homo sapiens
tagttttacacta

SEQ ID NO: 5937270 - DNA, 15 bp, Homo sapiens
tagttttacactcta

SEQ ID NO: 5937271 - DNA, 20 bp, Homo sapiens
tagttttacttttaaactgt

SEQ ID NO: 5937272 - DNA, 14 bp, Homo sapiens
tagttttagaggca

SEQ ID NO: 5937273 - DNA, 20 bp, Homo sapiens
tagttttagaggcattgtta

SEQ ID NO: 5937274 - DNA, 17 bp, Homo sapiens
tagttttagttgcagaa

SEQ ID NO: 5937275 - DNA, 18 bp, Homo sapiens
tagttttataggcagctg

SEQ ID NO: 5937276 - DNA, 21 bp, Homo sapiens
tagttttatcacatgtatgtt

SEQ ID NO: 5937277 - DNA, 17 bp, Homo sapiens
tagttttatcttaaact

SEQ ID NO: 5937278 - DNA, 15 bp, Homo sapiens
tagttttatttgtat

SEQ ID NO: 5937279 - DNA, 21 bp, Homo sapiens
tagttttattttatgtttaga

SEQ ID NO: 5937280 - DNA, 17 bp, Homo sapiens
tagttttcacattctta

SEQ ID NO: 5937281 - DNA, 15 bp, Homo sapiens
tagttttcagccttg

SEQ ID NO: 5937282 - DNA, 17 bp, Homo sapiens
tagttttcagtttgtat

SEQ ID NO: 5937283 - DNA, 22 bp, Homo sapiens
tagttttcatccataactgaac

SEQ ID NO: 5937284 - DNA, 14 bp, Homo sapiens
tagttttcatttta

SEQ ID NO: 5937285 - DNA, 17 bp, Homo sapiens
tagttttccctgcactg

SEQ ID NO: 5937286 - DNA, 15 bp, Homo sapiens
tagttttccttttgt

SEQ ID NO: 5937287 - DNA, 13 bp, Homo sapiens
tagttttctcagc

SEQ ID NO: 5937288 - DNA, 12 bp, Homo sapiens
tagttttctgta

SEQ ID NO: 5937289 - DNA, 13 bp, Homo sapiens
tagttttctgtat

SEQ ID NO: 5937290 - DNA, 14 bp, Homo sapiens
tagttttcttgttg

SEQ ID NO: 5937291 - DNA, 16 bp, Homo sapiens
tagttttctttgtaaa

SEQ ID NO: 5937292 - DNA, 15 bp, Homo sapiens
tagttttgattttgg

SEQ ID NO: 5937293 - DNA, 14 bp, Homo sapiens
tataacttaaatat

SEQ ID NO: 5937294 - DNA, 16 bp, Homo sapiens
tataacttaatgaaaa

SEQ ID NO: 5937295 - DNA, 19 bp, Homo sapiens
tataacttaatgaaaacaa

SEQ ID NO: 5937296 - DNA, 22 bp, Homo sapiens
tataacttatattgtaagaaat

SEQ ID NO: 5937297 - DNA, 24 bp, Homo sapiens
tataacttatattgtaagaaatac

SEQ ID NO: 5937298 - DNA, 14 bp, Homo sapiens
tataacttctgaag

SEQ ID NO: 5937299 - DNA, 12 bp, Homo sapiens
tataacttctgt

SEQ ID NO: 5937300 - DNA, 16 bp, Homo sapiens
tataacttcttaaaag

SEQ ID NO: 5937301 - DNA, 17 bp, Homo sapiens
tataacttgatgcatgt

SEQ ID NO: 5937302 - DNA, 13 bp, Homo sapiens
tataacttgtcta

SEQ ID NO: 5937303 - DNA, 15 bp, Homo sapiens
tataacttttgatga

SEQ ID NO: 5937304 - DNA, 17 bp, Homo sapiens
tataactttttatattc

SEQ ID NO: 5937305 - DNA, 11 bp, Homo sapiens
tataagaaaaa

SEQ ID NO: 5937306 - DNA, 13 bp, Homo sapiens
tataagaaaaagg

SEQ ID NO: 5937307 - DNA, 16 bp, Homo sapiens
tataagaaaaatgtga

SEQ ID NO: 5937308 - DNA, 13 bp, Homo sapiens
tataagaaaagta

SEQ ID NO: 5937309 - DNA, 22 bp, Homo sapiens
tataagaaaagtaatgaagaat

SEQ ID NO: 5937310 - DNA, 15 bp, Homo sapiens
tataagaaagacatc

SEQ ID NO: 5937311 - DNA, 14 bp, Homo sapiens
tataagaaagcctg

SEQ ID NO: 5937312 - DNA, 16 bp, Homo sapiens
tataagaaattttatt

SEQ ID NO: 5937313 - DNA, 23 bp, Homo sapiens
tataagaagcaatctttgaaata

SEQ ID NO: 5937314 - DNA, 13 bp, Homo sapiens
tataagaagcctt

SEQ ID NO: 5937315 - DNA, 17 bp, Homo sapiens
tataagaagccttaatt

SEQ ID NO: 5937316 - DNA, 16 bp, Homo sapiens
tataagaaggaaaaat

SEQ ID NO: 5937317 - DNA, 12 bp, Homo sapiens
tataagaatcat

SEQ ID NO: 5937318 - DNA, 16 bp, Homo sapiens
tataagaatcatagtg

SEQ ID NO: 5937319 - DNA, 20 bp, Homo sapiens
tataagaatgagcctgtcca

SEQ ID NO: 5937320 - DNA, 14 bp, Homo sapiens
tataagacaatgct

SEQ ID NO: 5937321 - DNA, 15 bp, Homo sapiens
tataagacatttgtt

SEQ ID NO: 5937322 - DNA, 16 bp, Homo sapiens
tataagactgctgcag

SEQ ID NO: 5937323 - DNA, 19 bp, Homo sapiens
tataagaggactgtagttt

SEQ ID NO: 5937324 - DNA, 12 bp, Homo sapiens
tataagagggaa

SEQ ID NO: 5937325 - DNA, 17 bp, Homo sapiens
tataagagggaacaaat

SEQ ID NO: 5937326 - DNA, 20 bp, Homo sapiens
tataagatacaataaaacaa

SEQ ID NO: 5937327 - DNA, 19 bp, Homo sapiens
tataagatcctagatccta

SEQ ID NO: 5937328 - DNA, 17 bp, Homo sapiens
tataagatttaattgta

SEQ ID NO: 5937329 - DNA, 15 bp, Homo sapiens
tataagatttgtaca

SEQ ID NO: 5937330 - DNA, 22 bp, Homo sapiens
tataagatttgtacatattatc

SEQ ID NO: 5937331 - DNA, 22 bp, Homo sapiens
tataagcaagaaggcaaaaata

SEQ ID NO: 5937332 - DNA, 22 bp, Homo sapiens
tataagcaagacagtggcacta

SEQ ID NO: 5937333 - DNA, 22 bp, Homo sapiens
tataagcacagacaattctaat

SEQ ID NO: 5937334 - DNA, 22 bp, Homo sapiens
tataagcagattgctttaattt

SEQ ID NO: 5937335 - DNA, 16 bp, Homo sapiens
tataagcatcattatt

SEQ ID NO: 5937336 - DNA, 17 bp, Homo sapiens
tataagcattgccattg

SEQ ID NO: 5937337 - DNA, 15 bp, Homo sapiens
tataagccaatgaag

SEQ ID NO: 5937338 - DNA, 21 bp, Homo sapiens
tataagccagtgttgcctaag

SEQ ID NO: 5937339 - DNA, 18 bp, Homo sapiens
tataagcccttaataata

SEQ ID NO: 5937340 - DNA, 20 bp, Homo sapiens
tataagcgtatttagactgt

SEQ ID NO: 5937341 - DNA, 14 bp, Homo sapiens
tataagctgaataa

SEQ ID NO: 5937342 - DNA, 14 bp, Homo sapiens
tataagctgggaaa

SEQ ID NO: 5937343 - DNA, 15 bp, Homo sapiens
tataagctgtaatat

SEQ ID NO: 5937344 - DNA, 16 bp, Homo sapiens
tataagctgtaatatc

SEQ ID NO: 5937345 - DNA, 16 bp, Homo sapiens
tataagctgtttagtt

SEQ ID NO: 5937346 - DNA, 20 bp, Homo sapiens
tataagctgtttagtttgtt

SEQ ID NO: 5937347 - DNA, 13 bp, Homo sapiens
tataagcttaaat

SEQ ID NO: 5937348 - DNA, 16 bp, Homo sapiens
tataaggaaagcaata

SEQ ID NO: 5937349 - DNA, 11 bp, Homo sapiens
tataaggaaat

SEQ ID NO: 5937350 - DNA, 17 bp, Homo sapiens
tataaggaaatccagcc

SEQ ID NO: 5937351 - DNA, 20 bp, Homo sapiens
tataaggaaatccagcccca

SEQ ID NO: 5937352 - DNA, 14 bp, Homo sapiens
tataaggaagattt

SEQ ID NO: 5937353 - DNA, 13 bp, Homo sapiens
tataaggactgca

SEQ ID NO: 5937354 - DNA, 23 bp, Homo sapiens
tataaggactttttgatggaatt

SEQ ID NO: 5937355 - DNA, 19 bp, Homo sapiens
tataaggagctttgctctt

SEQ ID NO: 5937356 - DNA, 19 bp, Homo sapiens
tataaggatcttttgtaaa

SEQ ID NO: 5937357 - DNA, 15 bp, Homo sapiens
tataaggctaaatgt

SEQ ID NO: 5937358 - DNA, 24 bp, Homo sapiens
tataagggaagtagttatcatgtt

SEQ ID NO: 5937359 - DNA, 20 bp, Homo sapiens
tataagggagagctgagcca

SEQ ID NO: 5937360 - DNA, 18 bp, Homo sapiens
tataaggtaataaaactc

SEQ ID NO: 5937361 - DNA, 15 bp, Homo sapiens
tataaggtaatgtag

SEQ ID NO: 5937362 - DNA, 21 bp, Homo sapiens
tataaggtgttttctgtgtaa

SEQ ID NO: 5937363 - DNA, 23 bp, Homo sapiens
tataaggtgttttctgtgtaacc

SEQ ID NO: 5937364 - DNA, 14 bp, Homo sapiens
tataaggttgtctg

SEQ ID NO: 5937365 - DNA, 23 bp, Homo sapiens
tataagtaaatatattatatatg

SEQ ID NO: 5937366 - DNA, 21 bp, Homo sapiens
tataagtagatctgctttctg

SEQ ID NO: 5937367 - DNA, 16 bp, Homo sapiens
tataagtagcaggcca

SEQ ID NO: 5937368 - DNA, 23 bp, Homo sapiens
tataagtagttggtttgtatgag

SEQ ID NO: 5937369 - DNA, 13 bp, Homo sapiens
tataagtcaagca

SEQ ID NO: 5937370 - DNA, 15 bp, Homo sapiens
tataagtcacaaaga

SEQ ID NO: 5937371 - DNA, 19 bp, Homo sapiens
tataagtcttggtaacaaa

SEQ ID NO: 5937372 - DNA, 22 bp, Homo sapiens
tataagtgaacaactggaaata

SEQ ID NO: 5937373 - DNA, 18 bp, Homo sapiens
tataagtgaagtgatact

SEQ ID NO: 5937374 - DNA, 23 bp, Homo sapiens
tataagtgcacacagaaatatat

SEQ ID NO: 5937375 - DNA, 16 bp, Homo sapiens
tataagtgctgtataa

SEQ ID NO: 5937376 - DNA, 20 bp, Homo sapiens
tataagtgctgtataaaatc

SEQ ID NO: 5937377 - DNA, 18 bp, Homo sapiens
tataagtggaggcacttt

SEQ ID NO: 5937378 - DNA, 15 bp, Homo sapiens
tataagtgtgtgttt

SEQ ID NO: 5937379 - DNA, 19 bp, Homo sapiens
tataagtgttcagtgttga

SEQ ID NO: 5937380 - DNA, 22 bp, Homo sapiens
tataagttaaagagacaaatag

SEQ ID NO: 5937381 - DNA, 15 bp, Homo sapiens
tataagttgaaggaa

SEQ ID NO: 5937382 - DNA, 22 bp, Homo sapiens
tataagttgacctttatttatt

SEQ ID NO: 5937383 - DNA, 14 bp, Homo sapiens
tataagttgtacca

SEQ ID NO: 5937384 - DNA, 19 bp, Homo sapiens
tataagttgtaccaaaaca

SEQ ID NO: 5937385 - DNA, 21 bp, Homo sapiens
tataagttgtaccaaaacatc

SEQ ID NO: 5937386 - DNA, 19 bp, Homo sapiens
tataagttgtattattaga

SEQ ID NO: 5937387 - DNA, 13 bp, Homo sapiens
tataagtttcttt

SEQ ID NO: 5937388 - DNA, 23 bp, Homo sapiens
tataagtttgacacaacatctga

SEQ ID NO: 5937389 - DNA, 13 bp, Homo sapiens
tataagttttaga

SEQ ID NO: 5937390 - DNA, 12 bp, Homo sapiens
tataataaaaat

SEQ ID NO: 5937391 - DNA, 13 bp, Homo sapiens
tataataaaaata

SEQ ID NO: 5937392 - DNA, 14 bp, Homo sapiens
tataataaaaatat

SEQ ID NO: 5937393 - DNA, 13 bp, Homo sapiens
tataataaaacca

SEQ ID NO: 5937394 - DNA, 12 bp, Homo sapiens
tataataaaagg

SEQ ID NO: 5937395 - DNA, 12 bp, Homo sapiens
tataataaacat

SEQ ID NO: 5937396 - DNA, 14 bp, Homo sapiens
tataataaacataa

SEQ ID NO: 5937397 - DNA, 12 bp, Homo sapiens
tataataaaggc

SEQ ID NO: 5937398 - DNA, 13 bp, Homo sapiens
tataataaagtat

SEQ ID NO: 5937399 - DNA, 14 bp, Homo sapiens
tataataaatatat

SEQ ID NO: 5937400 - DNA, 20 bp, Homo sapiens
tataataaatgaggaaacat

SEQ ID NO: 5937401 - DNA, 16 bp, Homo sapiens
tataataaatgtacct

SEQ ID NO: 5937402 - DNA, 18 bp, Homo sapiens
tataataactgaactgtt

SEQ ID NO: 5937403 - DNA, 12 bp, Homo sapiens
tataataacttt

SEQ ID NO: 5937404 - DNA, 21 bp, Homo sapiens
tataataactttattgcatat

SEQ ID NO: 5937405 - DNA, 22 bp, Homo sapiens
tataataactttattgcatata

SEQ ID NO: 5937406 - DNA, 15 bp, Homo sapiens
tataataagttttga

SEQ ID NO: 5937407 - DNA, 20 bp, Homo sapiens
tataataagttttgatataa

SEQ ID NO: 5937408 - DNA, 22 bp, Homo sapiens
tataataatagttattatttaa

SEQ ID NO: 5937409 - DNA, 18 bp, Homo sapiens
tataataattacttaatg

SEQ ID NO: 5937410 - DNA, 15 bp, Homo sapiens
tataatacacaaaat

SEQ ID NO: 5937411 - DNA, 16 bp, Homo sapiens
tataatacacaaaatc

SEQ ID NO: 5937412 - DNA, 23 bp, Homo sapiens
tataatacacaaaatcaaataat

SEQ ID NO: 5937413 - DNA, 11 bp, Homo sapiens
tataatacata

SEQ ID NO: 5937414 - DNA, 18 bp, Homo sapiens
tataatacattacatgta

SEQ ID NO: 5937415 - DNA, 18 bp, Homo sapiens
tataatactaaagtgtct

SEQ ID NO: 5937416 - DNA, 20 bp, Homo sapiens
tataatactaaagtgtctat

SEQ ID NO: 5937417 - DNA, 12 bp, Homo sapiens
tataatactact

SEQ ID NO: 5937418 - DNA, 14 bp, Homo sapiens
tataatactctgtt

SEQ ID NO: 5937419 - DNA, 14 bp, Homo sapiens
tataatactgtttt

SEQ ID NO: 5937420 - DNA, 20 bp, Homo sapiens
tataatacttaaaaatatgt

SEQ ID NO: 5937421 - DNA, 14 bp, Homo sapiens
tataatactttgta

SEQ ID NO: 5937422 - DNA, 21 bp, Homo sapiens
tataatactttgtatacaagt

SEQ ID NO: 5937423 - DNA, 14 bp, Homo sapiens
tataatatagaaag

SEQ ID NO: 5937424 - DNA, 20 bp, Homo sapiens
tataatatatatatatatca

SEQ ID NO: 5937425 - DNA, 15 bp, Homo sapiens
tataatatatttgtg

SEQ ID NO: 5937426 - DNA, 22 bp, Homo sapiens
tataatatatttgtgtatttaa

SEQ ID NO: 5937427 - DNA, 14 bp, Homo sapiens
tataatatctaaag

SEQ ID NO: 5937428 - DNA, 14 bp, Homo sapiens
tataatatggaacc

SEQ ID NO: 5937429 - DNA, 21 bp, Homo sapiens
tataatatggatcagagcatt

SEQ ID NO: 5937430 - DNA, 22 bp, Homo sapiens
tataatatggatcagagcattt

SEQ ID NO: 5937431 - DNA, 16 bp, Homo sapiens
tataatatgtgcctta

SEQ ID NO: 5937432 - DNA, 21 bp, Homo sapiens
tataatattcagccagcttaa

SEQ ID NO: 5937433 - DNA, 23 bp, Homo sapiens
tataatattcagccagcttaaac

SEQ ID NO: 5937434 - DNA, 15 bp, Homo sapiens
tataatattcataca

SEQ ID NO: 5937435 - DNA, 21 bp, Homo sapiens
tataatattcatacaacaaag

SEQ ID NO: 5937436 - DNA, 13 bp, Homo sapiens
tataatatttcct

SEQ ID NO: 5937437 - DNA, 12 bp, Homo sapiens
tataatcaaaat

SEQ ID NO: 5937438 - DNA, 13 bp, Homo sapiens
tataatcaaaata

SEQ ID NO: 5937439 - DNA, 13 bp, Homo sapiens
tataatcaaatga

SEQ ID NO: 5937440 - DNA, 20 bp, Homo sapiens
tataatcaaatgatttcata

SEQ ID NO: 5937441 - DNA, 14 bp, Homo sapiens
tataatcagaatgg

SEQ ID NO: 5937442 - DNA, 16 bp, Homo sapiens
tataatcatcaagtaa

SEQ ID NO: 5937443 - DNA, 17 bp, Homo sapiens
tataatcatgctcatgt

SEQ ID NO: 5937444 - DNA, 20 bp, Homo sapiens
tataatcatgctcatgtata

SEQ ID NO: 5937445 - DNA, 17 bp, Homo sapiens
tataatcattattactt

SEQ ID NO: 5937446 - DNA, 19 bp, Homo sapiens
tataatccttaaatcttaa

SEQ ID NO: 5937447 - DNA, 13 bp, Homo sapiens
tataatctattta

SEQ ID NO: 5937448 - DNA, 15 bp, Homo sapiens
tataatctatttaca

SEQ ID NO: 5937449 - DNA, 21 bp, Homo sapiens
tataatctcaaaggagaaaaa

SEQ ID NO: 5937450 - DNA, 14 bp, Homo sapiens
tataatctgtcaaa

SEQ ID NO: 5937451 - DNA, 23 bp, Homo sapiens
tataatctgtcaaaacactgtgg

SEQ ID NO: 5937452 - DNA, 16 bp, Homo sapiens
tataatcttataattg

SEQ ID NO: 5937453 - DNA, 17 bp, Homo sapiens
tataatcttatacaaca

SEQ ID NO: 5937454 - DNA, 18 bp, Homo sapiens
tataatcttggcttctta

SEQ ID NO: 5937455 - DNA, 21 bp, Homo sapiens
tataatcttggcttcttaaaa

SEQ ID NO: 5937456 - DNA, 22 bp, Homo sapiens
tataatcttggcttcttaaaaa

SEQ ID NO: 5937457 - DNA, 19 bp, Homo sapiens
tataatcttgtagacactt

SEQ ID NO: 5937458 - DNA, 16 bp, Homo sapiens
tataatgaaatctgtt

SEQ ID NO: 5937459 - DNA, 11 bp, Homo sapiens
tataatgaacc

SEQ ID NO: 5937460 - DNA, 14 bp, Homo sapiens
tataatgaagaaca

SEQ ID NO: 5937461 - DNA, 18 bp, Homo sapiens
tataatgaagaacactgt

SEQ ID NO: 5937462 - DNA, 20 bp, Homo sapiens
tataatgaataaacagttat

SEQ ID NO: 5937463 - DNA, 11 bp, Homo sapiens
tataatgaatg

SEQ ID NO: 5937464 - DNA, 21 bp, Homo sapiens
tataatgactggtcttcctta

SEQ ID NO: 5937465 - DNA, 18 bp, Homo sapiens
tataatgacttttaaaat

SEQ ID NO: 5937466 - DNA, 14 bp, Homo sapiens
tataatgaggatga

SEQ ID NO: 5937467 - DNA, 15 bp, Homo sapiens
tataatgattcataa

SEQ ID NO: 5937468 - DNA, 17 bp, Homo sapiens
tataatgcaatgataaa

SEQ ID NO: 5937469 - DNA, 12 bp, Homo sapiens
tataatgctttc

SEQ ID NO: 5937470 - DNA, 17 bp, Homo sapiens
tataatggaagagaaat

SEQ ID NO: 5937471 - DNA, 20 bp, Homo sapiens
tataatggacagattaatat

SEQ ID NO: 5937472 - DNA, 13 bp, Homo sapiens
tatacttgtaatt

SEQ ID NO: 5937473 - DNA, 18 bp, Homo sapiens
tatacttgtattccctta

SEQ ID NO: 5937474 - DNA, 17 bp, Homo sapiens
tatacttgtggactaaa

SEQ ID NO: 5937475 - DNA, 22 bp, Homo sapiens
tatacttgtggactaaaagata

SEQ ID NO: 5937476 - DNA, 23 bp, Homo sapiens
tatacttgtggactaaaagatat

SEQ ID NO: 5937477 - DNA, 19 bp, Homo sapiens
tatacttgtggttttcaaa

SEQ ID NO: 5937478 - DNA, 22 bp, Homo sapiens
tatacttgtggttttcaaattg

SEQ ID NO: 5937479 - DNA, 16 bp, Homo sapiens
tatactttaaataatt

SEQ ID NO: 5937480 - DNA, 20 bp, Homo sapiens
tatactttaatgttttaact

SEQ ID NO: 5937481 - DNA, 15 bp, Homo sapiens
tatactttacaggaa

SEQ ID NO: 5937482 - DNA, 18 bp, Homo sapiens
tatactttactttttcca

SEQ ID NO: 5937483 - DNA, 15 bp, Homo sapiens
tatactttatatctg

SEQ ID NO: 5937484 - DNA, 16 bp, Homo sapiens
tatactttatatctgt

SEQ ID NO: 5937485 - DNA, 18 bp, Homo sapiens
tatactttgccactgctg

SEQ ID NO: 5937486 - DNA, 20 bp, Homo sapiens
tatactttgtggaccaatta

SEQ ID NO: 5937487 - DNA, 18 bp, Homo sapiens
tatactttgttctgttgt

SEQ ID NO: 5937488 - DNA, 19 bp, Homo sapiens
tatactttgttctgttgtc

SEQ ID NO: 5937489 - DNA, 22 bp, Homo sapiens
tatactttgttctgttgtctgc

SEQ ID NO: 5937490 - DNA, 17 bp, Homo sapiens
tatacttttaaattatg

SEQ ID NO: 5937491 - DNA, 18 bp, Homo sapiens
tatacttttacattaaag

SEQ ID NO: 5937492 - DNA, 22 bp, Homo sapiens
tatacttttcccctgttaaaca

SEQ ID NO: 5937493 - DNA, 15 bp, Homo sapiens
tatacttttgcttgt

SEQ ID NO: 5937494 - DNA, 17 bp, Homo sapiens
tatacttttttcttatt

SEQ ID NO: 5937495 - DNA, 19 bp, Homo sapiens
tatacttttttcttattta

SEQ ID NO: 5937496 - DNA, 14 bp, Homo sapiens
tatagaaaaagcac

SEQ ID NO: 5937497 - DNA, 15 bp, Homo sapiens
tatagaaaaagcaca

SEQ ID NO: 5937498 - DNA, 21 bp, Homo sapiens
tatagaaaataaaataaatta

SEQ ID NO: 5937499 - DNA, 15 bp, Homo sapiens
tatagaaaatcttca

SEQ ID NO: 5937500 - DNA, 22 bp, Homo sapiens
tatagaaaatggaaaatataca

SEQ ID NO: 5937501 - DNA, 13 bp, Homo sapiens
tatagaaaattct

SEQ ID NO: 5937502 - DNA, 19 bp, Homo sapiens
tatagaaaattcttgagaa

SEQ ID NO: 5937503 - DNA, 22 bp, Homo sapiens
tatagaaaattcttgagaagta

SEQ ID NO: 5937504 - DNA, 14 bp, Homo sapiens
tatagaaacacgaa

SEQ ID NO: 5937505 - DNA, 12 bp, Homo sapiens
tatagaaagata

SEQ ID NO: 5937506 - DNA, 24 bp, Homo sapiens
tatagaaagctatataagacaaga

SEQ ID NO: 5937507 - DNA, 24 bp, Homo sapiens
tatagaaaggagacctgtatcaaa

SEQ ID NO: 5937508 - DNA, 12 bp, Homo sapiens
tatagaaagtgt

SEQ ID NO: 5937509 - DNA, 21 bp, Homo sapiens
tatagaaagtgttctgttaca

SEQ ID NO: 5937510 - DNA, 19 bp, Homo sapiens
tatagaaatatatacgaac

SEQ ID NO: 5937511 - DNA, 11 bp, Homo sapiens
tatagaaatgc

SEQ ID NO: 5937512 - DNA, 14 bp, Homo sapiens
tatagaaatgtatt

SEQ ID NO: 5937513 - DNA, 23 bp, Homo sapiens
tatagaaatgtattttgaaaaca

SEQ ID NO: 5937514 - DNA, 17 bp, Homo sapiens
tatagaactgaatgaga

SEQ ID NO: 5937515 - DNA, 13 bp, Homo sapiens
tatagaagaaatg

SEQ ID NO: 5937516 - DNA, 16 bp, Homo sapiens
tatagaagcttcagca

SEQ ID NO: 5937517 - DNA, 18 bp, Homo sapiens
tatagaaggaatttgtac

SEQ ID NO: 5937518 - DNA, 19 bp, Homo sapiens
tatagaagtataaagaatt

SEQ ID NO: 5937519 - DNA, 17 bp, Homo sapiens
tatagaagtctggaaaa

SEQ ID NO: 5937520 - DNA, 14 bp, Homo sapiens
tatagaagtcttca

SEQ ID NO: 5937521 - DNA, 20 bp, Homo sapiens
tatagaatacttttttctag

SEQ ID NO: 5937522 - DNA, 16 bp, Homo sapiens
tatagaattagctttt

SEQ ID NO: 5937523 - DNA, 22 bp, Homo sapiens
tatagaattagctttttcatcc

SEQ ID NO: 5937524 - DNA, 13 bp, Homo sapiens
tatagaattcaga

SEQ ID NO: 5937525 - DNA, 21 bp, Homo sapiens
tatagaattgcaattttaaca

SEQ ID NO: 5937526 - DNA, 13 bp, Homo sapiens
tatagacaaaaga

SEQ ID NO: 5937527 - DNA, 22 bp, Homo sapiens
tatagacaacgatgaatttctt

SEQ ID NO: 5937528 - DNA, 13 bp, Homo sapiens
tatagacagcact

SEQ ID NO: 5937529 - DNA, 14 bp, Homo sapiens
tatagacagctttg

SEQ ID NO: 5937530 - DNA, 23 bp, Homo sapiens
tatagacagtccttaaaaatcac

SEQ ID NO: 5937531 - DNA, 17 bp, Homo sapiens
tatagacagtttgtaaa

SEQ ID NO: 5937532 - DNA, 19 bp, Homo sapiens
tatagaccaattgaagcat

SEQ ID NO: 5937533 - DNA, 20 bp, Homo sapiens
tatagaccaattgaagcatg

SEQ ID NO: 5937534 - DNA, 17 bp, Homo sapiens
tatagacctatgataaa

SEQ ID NO: 5937535 - DNA, 21 bp, Homo sapiens
tatagacgtttggactgattt

SEQ ID NO: 5937536 - DNA, 11 bp, Homo sapiens
tatagactcta

SEQ ID NO: 5937537 - DNA, 14 bp, Homo sapiens
tatagactgacttt

SEQ ID NO: 5937538 - DNA, 19 bp, Homo sapiens
tatagactgccgtgcatta

SEQ ID NO: 5937539 - DNA, 14 bp, Homo sapiens
tatagactgtacat

SEQ ID NO: 5937540 - DNA, 15 bp, Homo sapiens
tatagagaaaagtgt

SEQ ID NO: 5937541 - DNA, 22 bp, Homo sapiens
tatagagaaaggtctatgcaga

SEQ ID NO: 5937542 - DNA, 23 bp, Homo sapiens
tatagagagggggctctccaaag

SEQ ID NO: 5937543 - DNA, 16 bp, Homo sapiens
tatagagataagataa

SEQ ID NO: 5937544 - DNA, 19 bp, Homo sapiens
tatagagatatttttgtac

SEQ ID NO: 5937545 - DNA, 21 bp, Homo sapiens
tatagagatatttttgtacgt

SEQ ID NO: 5937546 - DNA, 15 bp, Homo sapiens
tatagagcagaaatt

SEQ ID NO: 5937547 - DNA, 22 bp, Homo sapiens
tatagaggtaaaatttgcacac

SEQ ID NO: 5937548 - DNA, 23 bp, Homo sapiens
tatagagtgacttggagagagat

SEQ ID NO: 5937549 - DNA, 17 bp, Homo sapiens
tatagagttattatagt

SEQ ID NO: 5937550 - DNA, 16 bp, Homo sapiens
tatagataaagagata

SEQ ID NO: 5937551 - DNA, 15 bp, Homo sapiens
tatagatataatgaa

SEQ ID NO: 5937552 - DNA, 22 bp, Homo sapiens
tatagatcacataacagaatgc

SEQ ID NO: 5937553 - DNA, 23 bp, Homo sapiens
tatagatcacataacagaatgca

SEQ ID NO: 5937554 - DNA, 22 bp, Homo sapiens
tatagatcactgccctttttga

SEQ ID NO: 5937555 - DNA, 23 bp, Homo sapiens
tatagatcactgccctttttgaa

SEQ ID NO: 5937556 - DNA, 13 bp, Homo sapiens
tatagatcagcca

SEQ ID NO: 5937557 - DNA, 15 bp, Homo sapiens
tatagatcctgagct

SEQ ID NO: 5937558 - DNA, 22 bp, Homo sapiens
tatagatgcaagatatttatat

SEQ ID NO: 5937559 - DNA, 14 bp, Homo sapiens
tatagatggccaaa

SEQ ID NO: 5937560 - DNA, 19 bp, Homo sapiens
tatagatgggaatgaagct

SEQ ID NO: 5937561 - DNA, 19 bp, Homo sapiens
tatagatgggcaactggct

SEQ ID NO: 5937562 - DNA, 17 bp, Homo sapiens
tatagatggtagaaact

SEQ ID NO: 5937563 - DNA, 21 bp, Homo sapiens
tatagatggtagaaactttgg

SEQ ID NO: 5937564 - DNA, 15 bp, Homo sapiens
tatagatgtctgtgt

SEQ ID NO: 5937565 - DNA, 18 bp, Homo sapiens
tatagatgtctgtgtata

SEQ ID NO: 5937566 - DNA, 14 bp, Homo sapiens
tatagatgtctttt

SEQ ID NO: 5937567 - DNA, 18 bp, Homo sapiens
tatagatgtcttttccca

SEQ ID NO: 5937568 - DNA, 20 bp, Homo sapiens
tatagattagaattctgtat

SEQ ID NO: 5937569 - DNA, 14 bp, Homo sapiens
tatagattctttat

SEQ ID NO: 5937570 - DNA, 19 bp, Homo sapiens
tatagattgaaatttccta

SEQ ID NO: 5937571 - DNA, 17 bp, Homo sapiens
tatagattgtccttttg

SEQ ID NO: 5937572 - DNA, 17 bp, Homo sapiens
tatagatttagctattt

SEQ ID NO: 5937573 - DNA, 14 bp, Homo sapiens
tatagattttatta

SEQ ID NO: 5937574 - DNA, 18 bp, Homo sapiens
tatagattttttaaaaaa

SEQ ID NO: 5937575 - DNA, 20 bp, Homo sapiens
tatagcaaaacttttaaact

SEQ ID NO: 5937576 - DNA, 23 bp, Homo sapiens
tatagcaaaacttttaaactaca

SEQ ID NO: 5937577 - DNA, 14 bp, Homo sapiens
tatagcaaagatat

SEQ ID NO: 5937578 - DNA, 14 bp, Homo sapiens
tatagcaaagttat

SEQ ID NO: 5937579 - DNA, 19 bp, Homo sapiens
tatagcaacctatttgact

SEQ ID NO: 5937580 - DNA, 17 bp, Homo sapiens
tatagcaactaatgttt

SEQ ID NO: 5937581 - DNA, 13 bp, Homo sapiens
tatagcaagatat

SEQ ID NO: 5937582 - DNA, 21 bp, Homo sapiens
tatagcaagtgctatttcagc

SEQ ID NO: 5937583 - DNA, 13 bp, Homo sapiens
tatagcaatccat

SEQ ID NO: 5937584 - DNA, 16 bp, Homo sapiens
tatagcaatgtgattt

SEQ ID NO: 5937585 - DNA, 18 bp, Homo sapiens
tatagcacatcacctggg

SEQ ID NO: 5937586 - DNA, 23 bp, Homo sapiens
tatagcactttgaaatacctcat

SEQ ID NO: 5937587 - DNA, 20 bp, Homo sapiens
tatagcagcaaaaatataaa

SEQ ID NO: 5937588 - DNA, 17 bp, Homo sapiens
tatagcatcacttaaaa

SEQ ID NO: 5937589 - DNA, 21 bp, Homo sapiens
tatagcatcttctcattccca

SEQ ID NO: 5937590 - DNA, 13 bp, Homo sapiens
tatagcatctttc

SEQ ID NO: 5937591 - DNA, 17 bp, Homo sapiens
tatagcatctttcatat

SEQ ID NO: 5937592 - DNA, 20 bp, Homo sapiens
tatagcatctttcatatggt

SEQ ID NO: 5937593 - DNA, 19 bp, Homo sapiens
tatagcattaataaaactg

SEQ ID NO: 5937594 - DNA, 18 bp, Homo sapiens
tatagccaaaaatagcta

SEQ ID NO: 5937595 - DNA, 22 bp, Homo sapiens
tatagccaaaaatagctaaata

SEQ ID NO: 5937596 - DNA, 11 bp, Homo sapiens
tatagccattt

SEQ ID NO: 5937597 - DNA, 16 bp, Homo sapiens
tatagcccggtgcagc

SEQ ID NO: 5937598 - DNA, 13 bp, Homo sapiens
tatagcctgcctc

SEQ ID NO: 5937599 - DNA, 16 bp, Homo sapiens
tatagcctgcctcagt

SEQ ID NO: 5937600 - DNA, 14 bp, Homo sapiens
tatagcctggactg

SEQ ID NO: 5937601 - DNA, 14 bp, Homo sapiens
tatagctaagtaca

SEQ ID NO: 5937602 - DNA, 16 bp, Homo sapiens
tatagctacaggaagc

SEQ ID NO: 5937603 - DNA, 22 bp, Homo sapiens
tatagctacaggaagcacccca

SEQ ID NO: 5937604 - DNA, 19 bp, Homo sapiens
tatagctagctatttctat

SEQ ID NO: 5937605 - DNA, 19 bp, Homo sapiens
tatagctaggtgacatata

SEQ ID NO: 5937606 - DNA, 11 bp, Homo sapiens
tatagctatta

SEQ ID NO: 5937607 - DNA, 14 bp, Homo sapiens
tatagctattactg

SEQ ID NO: 5937608 - DNA, 22 bp, Homo sapiens
tatagctattactgtctggttt

SEQ ID NO: 5937609 - DNA, 13 bp, Homo sapiens
tatagctattttt

SEQ ID NO: 5937610 - DNA, 20 bp, Homo sapiens
tatagctcatcactgtgcct

SEQ ID NO: 5937611 - DNA, 13 bp, Homo sapiens
tatagctctcatc

SEQ ID NO: 5937612 - DNA, 20 bp, Homo sapiens
tatagctcttctatttaaaa

SEQ ID NO: 5937613 - DNA, 12 bp, Homo sapiens
tatagctgaaat

SEQ ID NO: 5937614 - DNA, 18 bp, Homo sapiens
tatagctggcaagaatgg

SEQ ID NO: 5937615 - DNA, 14 bp, Homo sapiens
tatagctgtattga

SEQ ID NO: 5937616 - DNA, 19 bp, Homo sapiens
tatagctgtattgaatcat

SEQ ID NO: 5937617 - DNA, 13 bp, Homo sapiens
tatagcttaaaac

SEQ ID NO: 5937618 - DNA, 14 bp, Homo sapiens
tatagctttaacat

SEQ ID NO: 5937619 - DNA, 16 bp, Homo sapiens
tatagcttttatctgc

SEQ ID NO: 5937620 - DNA, 19 bp, Homo sapiens
tataggaaaaaaactggga

SEQ ID NO: 5937621 - DNA, 22 bp, Homo sapiens
tataggaaaaaaactgggataa

SEQ ID NO: 5937622 - DNA, 16 bp, Homo sapiens
tataggaaaatacatt

SEQ ID NO: 5937623 - DNA, 12 bp, Homo sapiens
tataggaacagc

SEQ ID NO: 5937624 - DNA, 19 bp, Homo sapiens
tataggaatagaggaagaa

SEQ ID NO: 5937625 - DNA, 17 bp, Homo sapiens
tataggacaaaatgtta

SEQ ID NO: 5937626 - DNA, 17 bp, Homo sapiens
tataggagacttgtagt

SEQ ID NO: 5937627 - DNA, 15 bp, Homo sapiens
tataggagccccagg

SEQ ID NO: 5937628 - DNA, 15 bp, Homo sapiens
tataggataaaataa

SEQ ID NO: 5937629 - DNA, 16 bp, Homo sapiens
tataggataaaataat

SEQ ID NO: 5937630 - DNA, 18 bp, Homo sapiens
tataggataaattacatt

SEQ ID NO: 5937631 - DNA, 19 bp, Homo sapiens
tataggataagaaataaga

SEQ ID NO: 5937632 - DNA, 18 bp, Homo sapiens
tataggatattgctaatt

SEQ ID NO: 5937633 - DNA, 19 bp, Homo sapiens
tataggatattgctaattg

SEQ ID NO: 5937634 - DNA, 13 bp, Homo sapiens
tataggatggatt

SEQ ID NO: 5937635 - DNA, 22 bp, Homo sapiens
tataggcacattaccattcata

SEQ ID NO: 5937636 - DNA, 11 bp, Homo sapiens
tataggcagat

SEQ ID NO: 5937637 - DNA, 21 bp, Homo sapiens
tataggcagctgtcctgtgat

SEQ ID NO: 5937638 - DNA, 14 bp, Homo sapiens
tataggcagcttct

SEQ ID NO: 5937639 - DNA, 19 bp, Homo sapiens
tataggccagggcatgtgt

SEQ ID NO: 5937640 - DNA, 13 bp, Homo sapiens
tataggccatctg

SEQ ID NO: 5937641 - DNA, 21 bp, Homo sapiens
tataggcctgtcccttgcctc

SEQ ID NO: 5937642 - DNA, 13 bp, Homo sapiens
tataggcgttttt

SEQ ID NO: 5937643 - DNA, 17 bp, Homo sapiens
tatagggaattttcatt

SEQ ID NO: 5937644 - DNA, 22 bp, Homo sapiens
tatagggttttttttaatgtga

SEQ ID NO: 5937645 - DNA, 23 bp, Homo sapiens
tatagggttttttttaatgtgaa

SEQ ID NO: 5937646 - DNA, 22 bp, Homo sapiens
tataggtaacgtgattgattca

SEQ ID NO: 5937647 - DNA, 23 bp, Homo sapiens
tataggtagatccagatccagac

SEQ ID NO: 5937648 - DNA, 20 bp, Homo sapiens
tataggtctcttctcccaga

SEQ ID NO: 5937649 - DNA, 22 bp, Homo sapiens
tatatacaaggtgagtgtgact

SEQ ID NO: 5937650 - DNA, 14 bp, Homo sapiens
tatatacaagtaga

SEQ ID NO: 5937651 - DNA, 16 bp, Homo sapiens
tatatacaataacata

SEQ ID NO: 5937652 - DNA, 17 bp, Homo sapiens
tatatacaataacataa

SEQ ID NO: 5937653 - DNA, 22 bp, Homo sapiens
tatatacaataacataatttgt

SEQ ID NO: 5937654 - DNA, 16 bp, Homo sapiens
tatatacaataatgga

SEQ ID NO: 5937655 - DNA, 13 bp, Homo sapiens
tatatacacacaa

SEQ ID NO: 5937656 - DNA, 13 bp, Homo sapiens
tatatacacacac

SEQ ID NO: 5937657 - DNA, 14 bp, Homo sapiens
tatatacacacaca

SEQ ID NO: 5937658 - DNA, 21 bp, Homo sapiens
tatatacacacacaaagagag

SEQ ID NO: 5937659 - DNA, 16 bp, Homo sapiens
tatatacacatacata

SEQ ID NO: 5937660 - DNA, 22 bp, Homo sapiens
tatatacacatacatacacata

SEQ ID NO: 5937661 - DNA, 13 bp, Homo sapiens
tatatacacatat

SEQ ID NO: 5937662 - DNA, 21 bp, Homo sapiens
tatatacagagcctgttttaa

SEQ ID NO: 5937663 - DNA, 14 bp, Homo sapiens
tatatacataaaaa

SEQ ID NO: 5937664 - DNA, 18 bp, Homo sapiens
tatatacatacataatgt

SEQ ID NO: 5937665 - DNA, 12 bp, Homo sapiens
tatatacatacg

SEQ ID NO: 5937666 - DNA, 21 bp, Homo sapiens
tatatacatacgcaattgtat

SEQ ID NO: 5937667 - DNA, 17 bp, Homo sapiens
tatatacatatgtagac

SEQ ID NO: 5937668 - DNA, 12 bp, Homo sapiens
tatatacatatt

SEQ ID NO: 5937669 - DNA, 14 bp, Homo sapiens
tatatacatattat

SEQ ID NO: 5937670 - DNA, 21 bp, Homo sapiens
tatatacatattcaaagtata

SEQ ID NO: 5937671 - DNA, 13 bp, Homo sapiens
tatatacatgtat

SEQ ID NO: 5937672 - DNA, 15 bp, Homo sapiens
tatatacatgtatag

SEQ ID NO: 5937673 - DNA, 13 bp, Homo sapiens
tatatacatgtgt

SEQ ID NO: 5937674 - DNA, 16 bp, Homo sapiens
tatatacatgtgtgta

SEQ ID NO: 5937675 - DNA, 18 bp, Homo sapiens
tatatacatgtgtgtata

SEQ ID NO: 5937676 - DNA, 17 bp, Homo sapiens
tatatacattagacaca

SEQ ID NO: 5937677 - DNA, 18 bp, Homo sapiens
tatatacattagacacac

SEQ ID NO: 5937678 - DNA, 20 bp, Homo sapiens
tatatacattagacacacat

SEQ ID NO: 5937679 - DNA, 15 bp, Homo sapiens
tatatacattgctta

SEQ ID NO: 5937680 - DNA, 22 bp, Homo sapiens
tatataccaatgacttccatat

SEQ ID NO: 5937681 - DNA, 23 bp, Homo sapiens
tatataccaatgacttccatatt

SEQ ID NO: 5937682 - DNA, 15 bp, Homo sapiens
tatataccgtggggg

SEQ ID NO: 5937683 - DNA, 19 bp, Homo sapiens
tatatacctggcttttact

SEQ ID NO: 5937684 - DNA, 23 bp, Homo sapiens
tatatacgtatgtatatacacac

SEQ ID NO: 5937685 - DNA, 20 bp, Homo sapiens
tatatactgctatttacact

SEQ ID NO: 5937686 - DNA, 14 bp, Homo sapiens
tatatactggaagt

SEQ ID NO: 5937687 - DNA, 21 bp, Homo sapiens
tatatacttgtggttttcaaa

SEQ ID NO: 5937688 - DNA, 12 bp, Homo sapiens
tatatacttttt

SEQ ID NO: 5937689 - DNA, 14 bp, Homo sapiens
tatatagaaacact

SEQ ID NO: 5937690 - DNA, 13 bp, Homo sapiens
tatatagaattgt

SEQ ID NO: 5937691 - DNA, 18 bp, Homo sapiens
tatatagaatttcctgta

SEQ ID NO: 5937692 - DNA, 21 bp, Homo sapiens
tatatagaatttcctgtaata

SEQ ID NO: 5937693 - DNA, 16 bp, Homo sapiens
tatatagacagctttg

SEQ ID NO: 5937694 - DNA, 14 bp, Homo sapiens
tatatagagatgtt

SEQ ID NO: 5937695 - DNA, 15 bp, Homo sapiens
tatatagataaagag

SEQ ID NO: 5937696 - DNA, 14 bp, Homo sapiens
tatatagatgtgca

SEQ ID NO: 5937697 - DNA, 21 bp, Homo sapiens
tatatagattataacttgtct

SEQ ID NO: 5937698 - DNA, 17 bp, Homo sapiens
tatatagcaaaatgatt

SEQ ID NO: 5937699 - DNA, 13 bp, Homo sapiens
tatatagcaaaga

SEQ ID NO: 5937700 - DNA, 15 bp, Homo sapiens
tatatagcaaagata

SEQ ID NO: 5937701 - DNA, 19 bp, Homo sapiens
tatatagcaaagatatata

SEQ ID NO: 5937702 - DNA, 22 bp, Homo sapiens
tatatagcaaagatatatattc

SEQ ID NO: 5937703 - DNA, 21 bp, Homo sapiens
tatatagcagcaaaaatataa

SEQ ID NO: 5937704 - DNA, 22 bp, Homo sapiens
tatatagcagcaaaaatataaa

SEQ ID NO: 5937705 - DNA, 23 bp, Homo sapiens
tatatagcagtaaaaaatggtgt

SEQ ID NO: 5937706 - DNA, 14 bp, Homo sapiens
tatatagctggcaa

SEQ ID NO: 5937707 - DNA, 19 bp, Homo sapiens
tatatagctggcaagaatg

SEQ ID NO: 5937708 - DNA, 14 bp, Homo sapiens
tatatagcttgaaa

SEQ ID NO: 5937709 - DNA, 18 bp, Homo sapiens
tatataggctattttcta

SEQ ID NO: 5937710 - DNA, 23 bp, Homo sapiens
tatataggctattttctaaagac

SEQ ID NO: 5937711 - DNA, 17 bp, Homo sapiens
tatatagtatttaattg

SEQ ID NO: 5937712 - DNA, 17 bp, Homo sapiens
tatatagtctacagttg

SEQ ID NO: 5937713 - DNA, 14 bp, Homo sapiens
tatatagtgctata

SEQ ID NO: 5937714 - DNA, 19 bp, Homo sapiens
tatatagttccttgcctta

SEQ ID NO: 5937715 - DNA, 17 bp, Homo sapiens
tatatagtttactattt

SEQ ID NO: 5937716 - DNA, 13 bp, Homo sapiens
tatatataaaacg

SEQ ID NO: 5937717 - DNA, 12 bp, Homo sapiens
tatatataaaag

SEQ ID NO: 5937718 - DNA, 20 bp, Homo sapiens
tatatataaaataaatatac

SEQ ID NO: 5937719 - DNA, 23 bp, Homo sapiens
tatatataaaataaatatactaa

SEQ ID NO: 5937720 - DNA, 16 bp, Homo sapiens
tatatataaaatacac

SEQ ID NO: 5937721 - DNA, 20 bp, Homo sapiens
tatatataaaatacacgtgt

SEQ ID NO: 5937722 - DNA, 13 bp, Homo sapiens
tatatataaacct

SEQ ID NO: 5937723 - DNA, 16 bp, Homo sapiens
tatatataaagacaac

SEQ ID NO: 5937724 - DNA, 14 bp, Homo sapiens
tatatataaataaa

SEQ ID NO: 5937725 - DNA, 14 bp, Homo sapiens
tatatataaatata

SEQ ID NO: 5937726 - DNA, 13 bp, Homo sapiens
tatatataaatgt

SEQ ID NO: 5937727 - DNA, 16 bp, Homo sapiens
tatatataacatatat

SEQ ID NO: 5937728 - DNA, 16 bp, Homo sapiens
tatatataataaatac

SEQ ID NO: 5937729 - DNA, 23 bp, Homo sapiens
tatatataataaatactcagtga

SEQ ID NO: 5937730 - DNA, 20 bp, Homo sapiens
tatatataattctgtacata

SEQ ID NO: 5937731 - DNA, 22 bp, Homo sapiens
tatatataatttgagtgtatat

SEQ ID NO: 5937732 - DNA, 16 bp, Homo sapiens
tatatatacacacaca

SEQ ID NO: 5937733 - DNA, 19 bp, Homo sapiens
tatatatacataacagggt

SEQ ID NO: 5937734 - DNA, 14 bp, Homo sapiens
tatatatacataca

SEQ ID NO: 5937735 - DNA, 13 bp, Homo sapiens
tatatatacatat

SEQ ID NO: 5937736 - DNA, 16 bp, Homo sapiens
tatatatacatatgta

SEQ ID NO: 5937737 - DNA, 15 bp, Homo sapiens
tatatatacattaga

SEQ ID NO: 5937738 - DNA, 13 bp, Homo sapiens
tatatatagaatc

SEQ ID NO: 5937739 - DNA, 12 bp, Homo sapiens
tatatatataaa

SEQ ID NO: 5937740 - DNA, 13 bp, Homo sapiens
tatatatataaaa

SEQ ID NO: 5937741 - DNA, 11 bp, Homo sapiens
tatatatatat

SEQ ID NO: 5937742 - DNA, 13 bp, Homo sapiens
tatatatatataa

SEQ ID NO: 5937743 - DNA, 14 bp, Homo sapiens
tatatatatataac

SEQ ID NO: 5937744 - DNA, 15 bp, Homo sapiens
tatatatatatgcac

SEQ ID NO: 5937745 - DNA, 14 bp, Homo sapiens
tatatatatatgtg

SEQ ID NO: 5937746 - DNA, 14 bp, Homo sapiens
tatatatatgcata

SEQ ID NO: 5937747 - DNA, 15 bp, Homo sapiens
tatatatatgcatat

SEQ ID NO: 5937748 - DNA, 13 bp, Homo sapiens
tatatatatgtat

SEQ ID NO: 5937749 - DNA, 13 bp, Homo sapiens
tatatatatgtgt

SEQ ID NO: 5937750 - DNA, 14 bp, Homo sapiens
tatatatatgtgtg

SEQ ID NO: 5937751 - DNA, 16 bp, Homo sapiens
tatatatatgtgtgtg

SEQ ID NO: 5937752 - DNA, 11 bp, Homo sapiens
tatatatattt

SEQ ID NO: 5937753 - DNA, 15 bp, Homo sapiens
tatatatatttctag

SEQ ID NO: 5937754 - DNA, 13 bp, Homo sapiens
tatatatcagttt

SEQ ID NO: 5937755 - DNA, 14 bp, Homo sapiens
tatatatcagtttg

SEQ ID NO: 5937756 - DNA, 15 bp, Homo sapiens
tatatatcagtttga

SEQ ID NO: 5937757 - DNA, 12 bp, Homo sapiens
tatatatcataa

SEQ ID NO: 5937758 - DNA, 20 bp, Homo sapiens
tatatatctatctatttgag

SEQ ID NO: 5937759 - DNA, 13 bp, Homo sapiens
tatatatctatta

SEQ ID NO: 5937760 - DNA, 20 bp, Homo sapiens
tatatatctgataaaattgt

SEQ ID NO: 5937761 - DNA, 19 bp, Homo sapiens
tatatatctgcttcagtgg

SEQ ID NO: 5937762 - DNA, 15 bp, Homo sapiens
tatatatcttttgta

SEQ ID NO: 5937763 - DNA, 19 bp, Homo sapiens
tatatatcttttgtaagac

SEQ ID NO: 5937764 - DNA, 16 bp, Homo sapiens
tatatatgaaaactat

SEQ ID NO: 5937765 - DNA, 23 bp, Homo sapiens
tatatatgaagtaagttctgaaa

SEQ ID NO: 5937766 - DNA, 12 bp, Homo sapiens
tatatatgaata

SEQ ID NO: 5937767 - DNA, 19 bp, Homo sapiens
tatatatgatgtggacata

SEQ ID NO: 5937768 - DNA, 22 bp, Homo sapiens
tatatatgatgtggacatatgt

SEQ ID NO: 5937769 - DNA, 19 bp, Homo sapiens
tatatatgcacacatatat

SEQ ID NO: 5937770 - DNA, 18 bp, Homo sapiens
tatatatgccttatgtaa

SEQ ID NO: 5937771 - DNA, 15 bp, Homo sapiens
tatatatgccttttt

SEQ ID NO: 5937772 - DNA, 19 bp, Homo sapiens
tatatatgcctttttccta

SEQ ID NO: 5937773 - DNA, 19 bp, Homo sapiens
tatatatggaataagtgta

SEQ ID NO: 5937774 - DNA, 13 bp, Homo sapiens
tatatatggacat

SEQ ID NO: 5937775 - DNA, 17 bp, Homo sapiens
tatatatggcatattta

SEQ ID NO: 5937776 - DNA, 23 bp, Homo sapiens
tatatatggcatatttatattgt

SEQ ID NO: 5937777 - DNA, 22 bp, Homo sapiens
tatatatgtacagttatacata

SEQ ID NO: 5937778 - DNA, 16 bp, Homo sapiens
tatatatgtacataca

SEQ ID NO: 5937779 - DNA, 15 bp, Homo sapiens
tatatatgtagagaa

SEQ ID NO: 5937780 - DNA, 19 bp, Homo sapiens
tatatatgtagagaaagat

SEQ ID NO: 5937781 - DNA, 20 bp, Homo sapiens
tatatatgtagccagacagt

SEQ ID NO: 5937782 - DNA, 16 bp, Homo sapiens
tatatatgtatataaa

SEQ ID NO: 5937783 - DNA, 14 bp, Homo sapiens
tatatatgtatatg

SEQ ID NO: 5937784 - DNA, 14 bp, Homo sapiens
tatatatgtgtatg

SEQ ID NO: 5937785 - DNA, 21 bp, Homo sapiens
tatatatgtgtatgcacagta

SEQ ID NO: 5937786 - DNA, 23 bp, Homo sapiens
tatatatgtgtatgcacagtaaa

SEQ ID NO: 5937787 - DNA, 16 bp, Homo sapiens
tatatatgtgtatgta

SEQ ID NO: 5937788 - DNA, 17 bp, Homo sapiens
tatatatgtgtgccctg

SEQ ID NO: 5937789 - DNA, 18 bp, Homo sapiens
tatatatgtgtgtttaaa

SEQ ID NO: 5937790 - DNA, 22 bp, Homo sapiens
tatatatgtgtgtttaaataaa

SEQ ID NO: 5937791 - DNA, 23 bp, Homo sapiens
tatatattaggatctgcaaacaa

SEQ ID NO: 5937792 - DNA, 16 bp, Homo sapiens
tatatattatacttgt

SEQ ID NO: 5937793 - DNA, 12 bp, Homo sapiens
tatatattatat

SEQ ID NO: 5937794 - DNA, 13 bp, Homo sapiens
tatatattatata

SEQ ID NO: 5937795 - DNA, 15 bp, Homo sapiens
tatatattatatata

SEQ ID NO: 5937796 - DNA, 16 bp, Homo sapiens
tatatattatatatac

SEQ ID NO: 5937797 - DNA, 18 bp, Homo sapiens
tatatattatcttttcat

SEQ ID NO: 5937798 - DNA, 15 bp, Homo sapiens
tatatattattctca

SEQ ID NO: 5937799 - DNA, 19 bp, Homo sapiens
tatatattattctcattta

SEQ ID NO: 5937800 - DNA, 15 bp, Homo sapiens
tatatattcaccaat

SEQ ID NO: 5937801 - DNA, 23 bp, Homo sapiens
tatatattccttactagaaatat

SEQ ID NO: 5937802 - DNA, 21 bp, Homo sapiens
tatatattctggctgataaaa

SEQ ID NO: 5937803 - DNA, 15 bp, Homo sapiens
tatatattgaaagtt

SEQ ID NO: 5937804 - DNA, 18 bp, Homo sapiens
tatatattgattatatat

SEQ ID NO: 5937805 - DNA, 12 bp, Homo sapiens
tatatattgtat

SEQ ID NO: 5937806 - DNA, 16 bp, Homo sapiens
tatatattgtattaag

SEQ ID NO: 5937807 - DNA, 15 bp, Homo sapiens
tatatatttaaaagt

SEQ ID NO: 5937808 - DNA, 15 bp, Homo sapiens
tatatatttaacatg

SEQ ID NO: 5937809 - DNA, 14 bp, Homo sapiens
tatatatttacaga

SEQ ID NO: 5937810 - DNA, 20 bp, Homo sapiens
tatatatttaggatttgtgt

SEQ ID NO: 5937811 - DNA, 11 bp, Homo sapiens
tatatatttcc

SEQ ID NO: 5937812 - DNA, 18 bp, Homo sapiens
tatatatttccaaatatt

SEQ ID NO: 5937813 - DNA, 19 bp, Homo sapiens
tatatatttctaactatat

SEQ ID NO: 5937814 - DNA, 13 bp, Homo sapiens
tatatatttctat

SEQ ID NO: 5937815 - DNA, 13 bp, Homo sapiens
tatatatttgtaa

SEQ ID NO: 5937816 - DNA, 19 bp, Homo sapiens
tatatattttgaaaggaga

SEQ ID NO: 5937817 - DNA, 18 bp, Homo sapiens
tatatattttgtgtgaaa

SEQ ID NO: 5937818 - DNA, 15 bp, Homo sapiens
tatatatttttaatg

SEQ ID NO: 5937819 - DNA, 19 bp, Homo sapiens
tatatatttttcaaataga

SEQ ID NO: 5937820 - DNA, 20 bp, Homo sapiens
tatatatttttctgagattt

SEQ ID NO: 5937821 - DNA, 22 bp, Homo sapiens
tatatatttttggttgtcaata

SEQ ID NO: 5937822 - DNA, 19 bp, Homo sapiens
tatatatttttttttggat

SEQ ID NO: 5937823 - DNA, 15 bp, Homo sapiens
tatatcaaacatgca

SEQ ID NO: 5937824 - DNA, 14 bp, Homo sapiens
tatatcaaatgagc

SEQ ID NO: 5937825 - DNA, 17 bp, Homo sapiens
tatatcaaggatgttct

SEQ ID NO: 5937826 - DNA, 13 bp, Homo sapiens
tatatcactaaaa

SEQ ID NO: 5937827 - DNA, 15 bp, Homo sapiens
tatatcactaaaagc

SEQ ID NO: 5937828 - DNA, 17 bp, Homo sapiens
tatatcactaaaagcat

SEQ ID NO: 5937829 - DNA, 13 bp, Homo sapiens
tatatcagaaaag

SEQ ID NO: 5937830 - DNA, 22 bp, Homo sapiens
tatatttctttttagattgtct

SEQ ID NO: 5937831 - DNA, 17 bp, Homo sapiens
tatatttgaaaaaatta

SEQ ID NO: 5937832 - DNA, 14 bp, Homo sapiens
tatatttgaaattt

SEQ ID NO: 5937833 - DNA, 17 bp, Homo sapiens
tatatttgaatatcatt

SEQ ID NO: 5937834 - DNA, 20 bp, Homo sapiens
tatatttgaattagtaactg

SEQ ID NO: 5937835 - DNA, 18 bp, Homo sapiens
tatatttgatacatataa

SEQ ID NO: 5937836 - DNA, 22 bp, Homo sapiens
tatatttgatttattaacttaa

SEQ ID NO: 5937837 - DNA, 12 bp, Homo sapiens
tatatttgcaaa

SEQ ID NO: 5937838 - DNA, 21 bp, Homo sapiens
tatatttgcatattgaaaagc

SEQ ID NO: 5937839 - DNA, 12 bp, Homo sapiens
tatatttgcatt

SEQ ID NO: 5937840 - DNA, 13 bp, Homo sapiens
tatatttgctgat

SEQ ID NO: 5937841 - DNA, 15 bp, Homo sapiens
tatatttgctgcaaa

SEQ ID NO: 5937842 - DNA, 14 bp, Homo sapiens
tatatttggaaaga

SEQ ID NO: 5937843 - DNA, 23 bp, Homo sapiens
tatatttggatgcagagttcagg

SEQ ID NO: 5937844 - DNA, 22 bp, Homo sapiens
tatatttggcccaaactcatct

SEQ ID NO: 5937845 - DNA, 21 bp, Homo sapiens
tatatttgggttatgatgtca

SEQ ID NO: 5937846 - DNA, 18 bp, Homo sapiens
tatatttggtttctagat

SEQ ID NO: 5937847 - DNA, 20 bp, Homo sapiens
tatatttgtaaatttatgtg

SEQ ID NO: 5937848 - DNA, 15 bp, Homo sapiens
tatatttgtaacatt

SEQ ID NO: 5937849 - DNA, 22 bp, Homo sapiens
tatatttgtaacattgtaaagt

SEQ ID NO: 5937850 - DNA, 14 bp, Homo sapiens
tatatttgtaactt

SEQ ID NO: 5937851 - DNA, 14 bp, Homo sapiens
tatatttgtacaaa

SEQ ID NO: 5937852 - DNA, 13 bp, Homo sapiens
tatatttgtagga

SEQ ID NO: 5937853 - DNA, 20 bp, Homo sapiens
tatatttgtaggtatactat

SEQ ID NO: 5937854 - DNA, 21 bp, Homo sapiens
tatatttgtaggtatactatg

SEQ ID NO: 5937855 - DNA, 13 bp, Homo sapiens
tatatttgtatta

SEQ ID NO: 5937856 - DNA, 13 bp, Homo sapiens
tatatttgtcact

SEQ ID NO: 5937857 - DNA, 18 bp, Homo sapiens
tatatttgtccagataat

SEQ ID NO: 5937858 - DNA, 13 bp, Homo sapiens
tatatttgtcttc

SEQ ID NO: 5937859 - DNA, 15 bp, Homo sapiens
tatatttgtcttccg

SEQ ID NO: 5937860 - DNA, 17 bp, Homo sapiens
tatatttgtcttccgat

SEQ ID NO: 5937861 - DNA, 13 bp, Homo sapiens
tatatttgtgtat

SEQ ID NO: 5937862 - DNA, 16 bp, Homo sapiens
tatatttgtgtatgtg

SEQ ID NO: 5937863 - DNA, 21 bp, Homo sapiens
tatatttgtttcatttctgca

SEQ ID NO: 5937864 - DNA, 15 bp, Homo sapiens
tatattttaaaaaca

SEQ ID NO: 5937865 - DNA, 17 bp, Homo sapiens
tatattttaaattagtt

SEQ ID NO: 5937866 - DNA, 22 bp, Homo sapiens
tatattttaacctgcataaaaa

SEQ ID NO: 5937867 - DNA, 14 bp, Homo sapiens
tatattttaagacg

SEQ ID NO: 5937868 - DNA, 22 bp, Homo sapiens
tatattttaagccttcatttgc

SEQ ID NO: 5937869 - DNA, 12 bp, Homo sapiens
tatattttaata

SEQ ID NO: 5937870 - DNA, 13 bp, Homo sapiens
tatattttaatag

SEQ ID NO: 5937871 - DNA, 15 bp, Homo sapiens
tatattttaatagaa

SEQ ID NO: 5937872 - DNA, 22 bp, Homo sapiens
tatattttaatgtttttaaaaa

SEQ ID NO: 5937873 - DNA, 21 bp, Homo sapiens
tatattttatacattaacttc

SEQ ID NO: 5937874 - DNA, 15 bp, Homo sapiens
tatattttatactgc

SEQ ID NO: 5937875 - DNA, 22 bp, Homo sapiens
tatattttatactgcactttag

SEQ ID NO: 5937876 - DNA, 19 bp, Homo sapiens
tatattttatatgttcata

SEQ ID NO: 5937877 - DNA, 15 bp, Homo sapiens
tatattttatattac

SEQ ID NO: 5937878 - DNA, 15 bp, Homo sapiens
tatattttatgattt

SEQ ID NO: 5937879 - DNA, 20 bp, Homo sapiens
tatattttatttctgaagag

SEQ ID NO: 5937880 - DNA, 22 bp, Homo sapiens
tatattttcaattcaaaaatgt

SEQ ID NO: 5937881 - DNA, 16 bp, Homo sapiens
tatattttcgtatgaa

SEQ ID NO: 5937882 - DNA, 15 bp, Homo sapiens
tatattttgaaatat

SEQ ID NO: 5937883 - DNA, 15 bp, Homo sapiens
tatattttgaacaac

SEQ ID NO: 5937884 - DNA, 18 bp, Homo sapiens
tatattttgattttacat

SEQ ID NO: 5937885 - DNA, 20 bp, Homo sapiens
tatattttgattttacatgc

SEQ ID NO: 5937886 - DNA, 13 bp, Homo sapiens
tatattttgctgt

SEQ ID NO: 5937887 - DNA, 15 bp, Homo sapiens
tatattttgctgttt

SEQ ID NO: 5937888 - DNA, 16 bp, Homo sapiens
tatattttgtatgcaa

SEQ ID NO: 5937889 - DNA, 14 bp, Homo sapiens
tatattttgtgtat

SEQ ID NO: 5937890 - DNA, 15 bp, Homo sapiens
tatattttgtgtata

SEQ ID NO: 5937891 - DNA, 16 bp, Homo sapiens
tatattttgtgtgaaa

SEQ ID NO: 5937892 - DNA, 11 bp, Homo sapiens
tatattttgtt

SEQ ID NO: 5937893 - DNA, 17 bp, Homo sapiens
tatattttgttgttcct

SEQ ID NO: 5937894 - DNA, 14 bp, Homo sapiens
tatatttttaaaga

SEQ ID NO: 5937895 - DNA, 15 bp, Homo sapiens
tatatttttaaagaa

SEQ ID NO: 5937896 - DNA, 22 bp, Homo sapiens
tatatttttaaaggaaaaatca

SEQ ID NO: 5937897 - DNA, 20 bp, Homo sapiens
tatatttttaactgcttcaa

SEQ ID NO: 5937898 - DNA, 15 bp, Homo sapiens
tatatttttaagata

SEQ ID NO: 5937899 - DNA, 13 bp, Homo sapiens
tatatttttatct

SEQ ID NO: 5937900 - DNA, 20 bp, Homo sapiens
tatatttttatttcattcac

SEQ ID NO: 5937901 - DNA, 22 bp, Homo sapiens
tatatttttatttcattcacat

SEQ ID NO: 5937902 - DNA, 14 bp, Homo sapiens
tatatttttcaaat

SEQ ID NO: 5937903 - DNA, 16 bp, Homo sapiens
tatatttttcaaatag

SEQ ID NO: 5937904 - DNA, 18 bp, Homo sapiens
tatatttttcaaatagat

SEQ ID NO: 5937905 - DNA, 15 bp, Homo sapiens
tatatttttctatga

SEQ ID NO: 5937906 - DNA, 13 bp, Homo sapiens
tatatttttctga

SEQ ID NO: 5937907 - DNA, 19 bp, Homo sapiens
tatatttttctgagatttt

SEQ ID NO: 5937908 - DNA, 20 bp, Homo sapiens
tatatttttcttaaaaagta

SEQ ID NO: 5937909 - DNA, 16 bp, Homo sapiens
tatatttttgatacct

SEQ ID NO: 5937910 - DNA, 19 bp, Homo sapiens
tatatttttggttgtcaat

SEQ ID NO: 5937911 - DNA, 14 bp, Homo sapiens
tatatttttgtaca

SEQ ID NO: 5937912 - DNA, 15 bp, Homo sapiens
tatatttttgtacat

SEQ ID NO: 5937913 - DNA, 21 bp, Homo sapiens
tatatttttgtacatattgtt

SEQ ID NO: 5937914 - DNA, 16 bp, Homo sapiens
tatatttttgtttgtt

SEQ ID NO: 5937915 - DNA, 20 bp, Homo sapiens
tatatttttgtttgttttgt

SEQ ID NO: 5937916 - DNA, 14 bp, Homo sapiens
tatattttttacaa

SEQ ID NO: 5937917 - DNA, 19 bp, Homo sapiens
tatatttttttaactgtga

SEQ ID NO: 5937918 - DNA, 18 bp, Homo sapiens
tatatttttttaatttaa

SEQ ID NO: 5937919 - DNA, 16 bp, Homo sapiens
tatcaaaaaacagaaa

SEQ ID NO: 5937920 - DNA, 17 bp, Homo sapiens
tatcaaaaaacagaaaa

SEQ ID NO: 5937921 - DNA, 19 bp, Homo sapiens
tatcaaaaaacagaaaaac

SEQ ID NO: 5937922 - DNA, 22 bp, Homo sapiens
tatcaaaaaacagaaaaacaaa

SEQ ID NO: 5937923 - DNA, 15 bp, Homo sapiens
tatcaaaaaaccttt

SEQ ID NO: 5937924 - DNA, 22 bp, Homo sapiens
tatcaaaaagctaatgtgcagg

SEQ ID NO: 5937925 - DNA, 23 bp, Homo sapiens
tatcaaaaagtattatcattgct

SEQ ID NO: 5937926 - DNA, 22 bp, Homo sapiens
tatcaaaacatatcaattcaac

SEQ ID NO: 5937927 - DNA, 18 bp, Homo sapiens
tatcaaaacgagggctga

SEQ ID NO: 5937928 - DNA, 23 bp, Homo sapiens
tatcaaaactctatcaaatgtga

SEQ ID NO: 5937929 - DNA, 22 bp, Homo sapiens
tatcaaaagaaaattgatattt

SEQ ID NO: 5937930 - DNA, 22 bp, Homo sapiens
tatcaaaagaaatagaaaagga

SEQ ID NO: 5937931 - DNA, 23 bp, Homo sapiens
tatcaaaagaaatagaaaaggaa

SEQ ID NO: 5937932 - DNA, 13 bp, Homo sapiens
tatcaaaaggaag

SEQ ID NO: 5937933 - DNA, 21 bp, Homo sapiens
tatcaaaataaattgaaatat

SEQ ID NO: 5937934 - DNA, 14 bp, Homo sapiens
tatcaaaatcacta

SEQ ID NO: 5937935 - DNA, 21 bp, Homo sapiens
tatcaaaatcactatctttct

SEQ ID NO: 5937936 - DNA, 13 bp, Homo sapiens
tatcaaaatgtag

SEQ ID NO: 5937937 - DNA, 15 bp, Homo sapiens
tatcaaacacggacc

SEQ ID NO: 5937938 - DNA, 13 bp, Homo sapiens
tatcaaacattaa

SEQ ID NO: 5937939 - DNA, 18 bp, Homo sapiens
tatcaaaccctagccttg

SEQ ID NO: 5937940 - DNA, 21 bp, Homo sapiens
tatcaaagaagagtcaacatt

SEQ ID NO: 5937941 - DNA, 18 bp, Homo sapiens
tatcaaagaataagaaaa

SEQ ID NO: 5937942 - DNA, 21 bp, Homo sapiens
tatcaaagagaagatgcctgt

SEQ ID NO: 5937943 - DNA, 12 bp, Homo sapiens
tatcaaagcata

SEQ ID NO: 5937944 - DNA, 22 bp, Homo sapiens
tatcaaagcattttataaatga

SEQ ID NO: 5937945 - DNA, 21 bp, Homo sapiens
tatcaaaggcacatggaatat

SEQ ID NO: 5937946 - DNA, 12 bp, Homo sapiens
tatcaaaggcag

SEQ ID NO: 5937947 - DNA, 13 bp, Homo sapiens
tatcaaaggcaga

SEQ ID NO: 5937948 - DNA, 15 bp, Homo sapiens
tatcaaaggcagaaa

SEQ ID NO: 5937949 - DNA, 12 bp, Homo sapiens
tatcaaagtcat

SEQ ID NO: 5937950 - DNA, 17 bp, Homo sapiens
tatcaaataataaagta

SEQ ID NO: 5937951 - DNA, 18 bp, Homo sapiens
tatcaaatattagatgtg

SEQ ID NO: 5937952 - DNA, 23 bp, Homo sapiens
tatcaaatattagatgtgattta

SEQ ID NO: 5937953 - DNA, 22 bp, Homo sapiens
tatcaaatctgtatatgttgta

SEQ ID NO: 5937954 - DNA, 13 bp, Homo sapiens
tatcaaatgaaac

SEQ ID NO: 5937955 - DNA, 15 bp, Homo sapiens
tatcaaatgaaactc

SEQ ID NO: 5937956 - DNA, 13 bp, Homo sapiens
tatcaaatgagca

SEQ ID NO: 5937957 - DNA, 16 bp, Homo sapiens
tatcaaattaattgtg

SEQ ID NO: 5937958 - DNA, 19 bp, Homo sapiens
tatcaaattaattgtgtga

SEQ ID NO: 5937959 - DNA, 14 bp, Homo sapiens
tatcaacaacaagt

SEQ ID NO: 5937960 - DNA, 18 bp, Homo sapiens
tatcaacctaagcaacag

SEQ ID NO: 5937961 - DNA, 19 bp, Homo sapiens
tatcaacctaagcaacaga

SEQ ID NO: 5937962 - DNA, 14 bp, Homo sapiens
tatcaactgtcaaa

SEQ ID NO: 5937963 - DNA, 19 bp, Homo sapiens
tatcaacttaattctgtta

SEQ ID NO: 5937964 - DNA, 15 bp, Homo sapiens
tatcaactttaatca

SEQ ID NO: 5937965 - DNA, 22 bp, Homo sapiens
tatcaagaagtcagagaaaaca

SEQ ID NO: 5937966 - DNA, 23 bp, Homo sapiens
tatcaagaagtcagagaaaacac

SEQ ID NO: 5937967 - DNA, 12 bp, Homo sapiens
tatcaagaatag

SEQ ID NO: 5937968 - DNA, 21 bp, Homo sapiens
tatcaagagagtaaacagaca

SEQ ID NO: 5937969 - DNA, 16 bp, Homo sapiens
tatcaagcaacattct

SEQ ID NO: 5937970 - DNA, 15 bp, Homo sapiens
tatcaagcagccaag

SEQ ID NO: 5937971 - DNA, 15 bp, Homo sapiens
tatcaagctaataaa

SEQ ID NO: 5937972 - DNA, 23 bp, Homo sapiens
tatcaagctaataaaatatcatt

SEQ ID NO: 5937973 - DNA, 19 bp, Homo sapiens
tatcaaggaagtcttcaaa

SEQ ID NO: 5937974 - DNA, 16 bp, Homo sapiens
tatcaaggctgcctgg

SEQ ID NO: 5937975 - DNA, 18 bp, Homo sapiens
tatcaaggggatgatttg

SEQ ID NO: 5937976 - DNA, 21 bp, Homo sapiens
tatcaaggtcgtttttttcat

SEQ ID NO: 5937977 - DNA, 20 bp, Homo sapiens
tatcaagtactacattttct

SEQ ID NO: 5937978 - DNA, 18 bp, Homo sapiens
tatcaagtattatacctt

SEQ ID NO: 5937979 - DNA, 18 bp, Homo sapiens
tatcaagtccatgttatt

SEQ ID NO: 5937980 - DNA, 22 bp, Homo sapiens
tatcaagtccatgttattctct

SEQ ID NO: 5937981 - DNA, 19 bp, Homo sapiens
tatcaagtcccgaggcagc

SEQ ID NO: 5937982 - DNA, 15 bp, Homo sapiens
tatcaagtggcatgt

SEQ ID NO: 5937983 - DNA, 17 bp, Homo sapiens
tatcaagtggcatgtgc

SEQ ID NO: 5937984 - DNA, 20 bp, Homo sapiens
tatcaagtgttctaaaatga

SEQ ID NO: 5937985 - DNA, 21 bp, Homo sapiens
tatcaagtgttctaaaatgaa

SEQ ID NO: 5937986 - DNA, 15 bp, Homo sapiens
tatcaataaaattct

SEQ ID NO: 5937987 - DNA, 13 bp, Homo sapiens
tatcaataaagca

SEQ ID NO: 5937988 - DNA, 14 bp, Homo sapiens
tatcaataaagcac

SEQ ID NO: 5937989 - DNA, 15 bp, Homo sapiens
tatcaataaagcact

SEQ ID NO: 5937990 - DNA, 19 bp, Homo sapiens
tatcaataaattccatgtt

SEQ ID NO: 5937991 - DNA, 17 bp, Homo sapiens
tatcaatatctaatata

SEQ ID NO: 5937992 - DNA, 15 bp, Homo sapiens
tatcaatcagtataa

SEQ ID NO: 5937993 - DNA, 18 bp, Homo sapiens
tatcaatcagtataattc

SEQ ID NO: 5937994 - DNA, 21 bp, Homo sapiens
tatcaatccaaattccctctg

SEQ ID NO: 5937995 - DNA, 15 bp, Homo sapiens
tatcaatcctgcccc

SEQ ID NO: 5937996 - DNA, 17 bp, Homo sapiens
tatcaatccttgttcag

SEQ ID NO: 5937997 - DNA, 16 bp, Homo sapiens
tatcaatgaagatttt

SEQ ID NO: 5937998 - DNA, 15 bp, Homo sapiens
tatcaatgtgtcttt

SEQ ID NO: 5937999 - DNA, 16 bp, Homo sapiens
tatcaatgtgtctttc

SEQ ID NO: 5938000 - DNA, 18 bp, Homo sapiens
tatcaatgtgtctttcta

SEQ ID NO: 5938001 - DNA, 11 bp, Homo sapiens
tatcaattcaa

SEQ ID NO: 5938002 - DNA, 20 bp, Homo sapiens
tatcaattcaacacattact

SEQ ID NO: 5938003 - DNA, 22 bp, Homo sapiens
tatcaattggaaaggaagaaaa

SEQ ID NO: 5938004 - DNA, 16 bp, Homo sapiens
tatcaattggcagtga

SEQ ID NO: 5938005 - DNA, 16 bp, Homo sapiens
tatcaatttgtcattt

SEQ ID NO: 5938006 - DNA, 22 bp, Homo sapiens
tatcaattttaaggaaactttt

SEQ ID NO: 5938007 - DNA, 21 bp, Homo sapiens
tatcacaaagttgtttaacta

SEQ ID NO: 5938008 - DNA, 14 bp, Homo sapiens
tatcatgaagcctg

SEQ ID NO: 5938009 - DNA, 16 bp, Homo sapiens
tatcatgaagccttgc

SEQ ID NO: 5938010 - DNA, 18 bp, Homo sapiens
tatcatgaagccttgctg

SEQ ID NO: 5938011 - DNA, 11 bp, Homo sapiens
tatcatgaatg

SEQ ID NO: 5938012 - DNA, 13 bp, Homo sapiens
tatcatgaatgtg

SEQ ID NO: 5938013 - DNA, 12 bp, Homo sapiens
tatcatgaattt

SEQ ID NO: 5938014 - DNA, 15 bp, Homo sapiens
tatcatgaattttaa

SEQ ID NO: 5938015 - DNA, 16 bp, Homo sapiens
tatcatgaattttaaa

SEQ ID NO: 5938016 - DNA, 18 bp, Homo sapiens
tatcatgaattttaaagt

SEQ ID NO: 5938017 - DNA, 16 bp, Homo sapiens
tatcatgagtgaataa

SEQ ID NO: 5938018 - DNA, 14 bp, Homo sapiens
tatcatgcaaaata

SEQ ID NO: 5938019 - DNA, 17 bp, Homo sapiens
tatcatgcaaatgctgt

SEQ ID NO: 5938020 - DNA, 23 bp, Homo sapiens
tatcatgcacacaattagatttc

SEQ ID NO: 5938021 - DNA, 12 bp, Homo sapiens
tatcatgcattc

SEQ ID NO: 5938022 - DNA, 14 bp, Homo sapiens
tatcatgccctgtg

SEQ ID NO: 5938023 - DNA, 11 bp, Homo sapiens
tatcatgcttg

SEQ ID NO: 5938024 - DNA, 21 bp, Homo sapiens
tatcatgctttaaagtgtaat

SEQ ID NO: 5938025 - DNA, 22 bp, Homo sapiens
tatcatgctttaaagtgtaata

SEQ ID NO: 5938026 - DNA, 18 bp, Homo sapiens
tatcatggaagaaaagga

SEQ ID NO: 5938027 - DNA, 15 bp, Homo sapiens
tatcatggaatttcc

SEQ ID NO: 5938028 - DNA, 15 bp, Homo sapiens
tatcatggagtgacg

SEQ ID NO: 5938029 - DNA, 21 bp, Homo sapiens
tatcatggcagcatgcgatgt

SEQ ID NO: 5938030 - DNA, 20 bp, Homo sapiens
tatcatgggaaaagaccagg

SEQ ID NO: 5938031 - DNA, 19 bp, Homo sapiens
tatcatggtaatgacagat

SEQ ID NO: 5938032 - DNA, 16 bp, Homo sapiens
tatcatgtaaagaaat

SEQ ID NO: 5938033 - DNA, 21 bp, Homo sapiens
tatcatgtaaagaaatgtctt

SEQ ID NO: 5938034 - DNA, 13 bp, Homo sapiens
tatcatgtctatt

SEQ ID NO: 5938035 - DNA, 17 bp, Homo sapiens
tatcatgtcttgtgcat

SEQ ID NO: 5938036 - DNA, 22 bp, Homo sapiens
tatcatgtgaaatcattcattt

SEQ ID NO: 5938037 - DNA, 12 bp, Homo sapiens
tatcatgtgatt

SEQ ID NO: 5938038 - DNA, 14 bp, Homo sapiens
tatcatgtgtaatc

SEQ ID NO: 5938039 - DNA, 17 bp, Homo sapiens
tatcatgtgtaatcaat

SEQ ID NO: 5938040 - DNA, 19 bp, Homo sapiens
tatcatgtgtaatcaataa

SEQ ID NO: 5938041 - DNA, 20 bp, Homo sapiens
tatcatgtgtaatcaataaa

SEQ ID NO: 5938042 - DNA, 22 bp, Homo sapiens
tatcatgtgtaatcaataaacg

SEQ ID NO: 5938043 - DNA, 21 bp, Homo sapiens
tatcatgtgtagatattatgt

SEQ ID NO: 5938044 - DNA, 19 bp, Homo sapiens
tatcatgttagtaatacct

SEQ ID NO: 5938045 - DNA, 19 bp, Homo sapiens
tatcatgttttataatttg

SEQ ID NO: 5938046 - DNA, 18 bp, Homo sapiens
tatcattaaaatatatgt

SEQ ID NO: 5938047 - DNA, 21 bp, Homo sapiens
tatcattaaaatatatgttct

SEQ ID NO: 5938048 - DNA, 17 bp, Homo sapiens
tatcattaaacaaataa

SEQ ID NO: 5938049 - DNA, 17 bp, Homo sapiens
tatcattaaacatgaat

SEQ ID NO: 5938050 - DNA, 20 bp, Homo sapiens
tatcattaaacatgaattta

SEQ ID NO: 5938051 - DNA, 21 bp, Homo sapiens
tatcattaatgtaggtttaga

SEQ ID NO: 5938052 - DNA, 19 bp, Homo sapiens
tatcattacaattttctgt

SEQ ID NO: 5938053 - DNA, 21 bp, Homo sapiens
tatcattacaattttctgtaa

SEQ ID NO: 5938054 - DNA, 16 bp, Homo sapiens
tatcattatagcatgt

SEQ ID NO: 5938055 - DNA, 21 bp, Homo sapiens
tatcattatagcatgtaatat

SEQ ID NO: 5938056 - DNA, 22 bp, Homo sapiens
tatcattcaagtgtaaaatatt

SEQ ID NO: 5938057 - DNA, 13 bp, Homo sapiens
tatcattcagcaa

SEQ ID NO: 5938058 - DNA, 18 bp, Homo sapiens
tatcattccaattctaaa

SEQ ID NO: 5938059 - DNA, 14 bp, Homo sapiens
tatcattctaaaga

SEQ ID NO: 5938060 - DNA, 16 bp, Homo sapiens
tatcattctaaagata

SEQ ID NO: 5938061 - DNA, 17 bp, Homo sapiens
tatcattctaaagatag

SEQ ID NO: 5938062 - DNA, 18 bp, Homo sapiens
tatcattctacagaataa

SEQ ID NO: 5938063 - DNA, 12 bp, Homo sapiens
tatcattctcag

SEQ ID NO: 5938064 - DNA, 12 bp, Homo sapiens
tatcattctgtg

SEQ ID NO: 5938065 - DNA, 21 bp, Homo sapiens
tatcattctgtgattaaatct

SEQ ID NO: 5938066 - DNA, 14 bp, Homo sapiens
tatcattctttgta

SEQ ID NO: 5938067 - DNA, 22 bp, Homo sapiens
tatcattctttgtatcttaaat

SEQ ID NO: 5938068 - DNA, 20 bp, Homo sapiens
tatcattgattttataattg

SEQ ID NO: 5938069 - DNA, 20 bp, Homo sapiens
tatcattgtttgtcctttat

SEQ ID NO: 5938070 - DNA, 16 bp, Homo sapiens
tatcatttaataatat

SEQ ID NO: 5938071 - DNA, 21 bp, Homo sapiens
tatcatttaataatatacttg

SEQ ID NO: 5938072 - DNA, 14 bp, Homo sapiens
tatcatttactctt

SEQ ID NO: 5938073 - DNA, 19 bp, Homo sapiens
tatcatttcatgctttgat

SEQ ID NO: 5938074 - DNA, 15 bp, Homo sapiens
tatcatttgtgaaga

SEQ ID NO: 5938075 - DNA, 16 bp, Homo sapiens
tatcattttaaaatgt

SEQ ID NO: 5938076 - DNA, 14 bp, Homo sapiens
tatcattttattca

SEQ ID NO: 5938077 - DNA, 16 bp, Homo sapiens
tatcattttattcaca

SEQ ID NO: 5938078 - DNA, 21 bp, Homo sapiens
tatcattttctgcatttaacc

SEQ ID NO: 5938079 - DNA, 20 bp, Homo sapiens
tatcattttcttttttaacc

SEQ ID NO: 5938080 - DNA, 16 bp, Homo sapiens
tatcatttttacacta

SEQ ID NO: 5938081 - DNA, 18 bp, Homo sapiens
tatcattttttcctgttt

SEQ ID NO: 5938082 - DNA, 22 bp, Homo sapiens
tatccaaagaacttgatttgca

SEQ ID NO: 5938083 - DNA, 14 bp, Homo sapiens
tatccaaagactgt

SEQ ID NO: 5938084 - DNA, 19 bp, Homo sapiens
tatccaaagactgtactgg

SEQ ID NO: 5938085 - DNA, 19 bp, Homo sapiens
tatccaaataaaaataaca

SEQ ID NO: 5938086 - DNA, 19 bp, Homo sapiens
tatccaacttatatttctg

SEQ ID NO: 5938087 - DNA, 22 bp, Homo sapiens
tatccaacttatatttctgctt

SEQ ID NO: 5938088 - DNA, 17 bp, Homo sapiens
tatccaactttttcata

SEQ ID NO: 5938089 - DNA, 21 bp, Homo sapiens
tatccaagatcaattccctct

SEQ ID NO: 5938090 - DNA, 22 bp, Homo sapiens
tatccaagatcaattccctctc

SEQ ID NO: 5938091 - DNA, 17 bp, Homo sapiens
tatccaaggaaacattt

SEQ ID NO: 5938092 - DNA, 15 bp, Homo sapiens
tatccaatgtctttt

SEQ ID NO: 5938093 - DNA, 18 bp, Homo sapiens
tatccaattatgtgacaa

SEQ ID NO: 5938094 - DNA, 19 bp, Homo sapiens
tatccaattatgtgacaac

SEQ ID NO: 5938095 - DNA, 23 bp, Homo sapiens
tatccaattgctgcttgtacact

SEQ ID NO: 5938096 - DNA, 21 bp, Homo sapiens
tatccaattttaaaatgaaat

SEQ ID NO: 5938097 - DNA, 22 bp, Homo sapiens
tatccacaattattggcaaagt

SEQ ID NO: 5938098 - DNA, 15 bp, Homo sapiens
tatccacactgtcaa

SEQ ID NO: 5938099 - DNA, 16 bp, Homo sapiens
tatccacactgtcaaa

SEQ ID NO: 5938100 - DNA, 18 bp, Homo sapiens
tatccacactgtcaaaca

SEQ ID NO: 5938101 - DNA, 18 bp, Homo sapiens
tatccacagaaaatgtaa

SEQ ID NO: 5938102 - DNA, 18 bp, Homo sapiens
tatccacatgaaaataaa

SEQ ID NO: 5938103 - DNA, 23 bp, Homo sapiens
tatccaccaaaagggctccctga

SEQ ID NO: 5938104 - DNA, 15 bp, Homo sapiens
tatccacccagcagg

SEQ ID NO: 5938105 - DNA, 19 bp, Homo sapiens
tatccacccagcaggcaga

SEQ ID NO: 5938106 - DNA, 14 bp, Homo sapiens
tatccacccagccc

SEQ ID NO: 5938107 - DNA, 15 bp, Homo sapiens
tatccacccagccca

SEQ ID NO: 5938108 - DNA, 14 bp, Homo sapiens
tatccacctggggt

SEQ ID NO: 5938109 - DNA, 17 bp, Homo sapiens
tatccacgagagcgcag

SEQ ID NO: 5938110 - DNA, 13 bp, Homo sapiens
tatccacttttct

SEQ ID NO: 5938111 - DNA, 15 bp, Homo sapiens
tatccacttttcttc

SEQ ID NO: 5938112 - DNA, 14 bp, Homo sapiens
tatccagaggaatt

SEQ ID NO: 5938113 - DNA, 18 bp, Homo sapiens
tatccagctagtgccaaa

SEQ ID NO: 5938114 - DNA, 19 bp, Homo sapiens
tatccaggtcaacagaatg

SEQ ID NO: 5938115 - DNA, 20 bp, Homo sapiens
tatccaggtcaacagaatga

SEQ ID NO: 5938116 - DNA, 14 bp, Homo sapiens
tatccaggtgtgcc

SEQ ID NO: 5938117 - DNA, 22 bp, Homo sapiens
tatccaggtgtgcccctccaag

SEQ ID NO: 5938118 - DNA, 21 bp, Homo sapiens
tatccagtgatgtgctggagc

SEQ ID NO: 5938119 - DNA, 18 bp, Homo sapiens
tatccagttcctgctctc

SEQ ID NO: 5938120 - DNA, 14 bp, Homo sapiens
tatccataaaaaaa

SEQ ID NO: 5938121 - DNA, 14 bp, Homo sapiens
tatccataatgatg

SEQ ID NO: 5938122 - DNA, 24 bp, Homo sapiens
tatccataatgcattcttctctgt

SEQ ID NO: 5938123 - DNA, 22 bp, Homo sapiens
tatccatattttattactgttt

SEQ ID NO: 5938124 - DNA, 18 bp, Homo sapiens
tatccatggggaagggat

SEQ ID NO: 5938125 - DNA, 17 bp, Homo sapiens
tatccatgggggcaggg

SEQ ID NO: 5938126 - DNA, 18 bp, Homo sapiens
tatccatgggggcagggc

SEQ ID NO: 5938127 - DNA, 13 bp, Homo sapiens
tatccatgtaata

SEQ ID NO: 5938128 - DNA, 13 bp, Homo sapiens
tatccatgtactg

SEQ ID NO: 5938129 - DNA, 16 bp, Homo sapiens
tatccatgtactgtag

SEQ ID NO: 5938130 - DNA, 20 bp, Homo sapiens
tatccatgtacttgtttgca

SEQ ID NO: 5938131 - DNA, 16 bp, Homo sapiens
tatccattaacctggg

SEQ ID NO: 5938132 - DNA, 15 bp, Homo sapiens
tatccattacgtgca

SEQ ID NO: 5938133 - DNA, 22 bp, Homo sapiens
tatccattcccaagatgcctga

SEQ ID NO: 5938134 - DNA, 20 bp, Homo sapiens
tatccattctacctgtcctc

SEQ ID NO: 5938135 - DNA, 17 bp, Homo sapiens
tatccatttatcttttg

SEQ ID NO: 5938136 - DNA, 13 bp, Homo sapiens
tatccatttcttc

SEQ ID NO: 5938137 - DNA, 15 bp, Homo sapiens
tatccatttctttta

SEQ ID NO: 5938138 - DNA, 16 bp, Homo sapiens
tatcccaacattctgc

SEQ ID NO: 5938139 - DNA, 16 bp, Homo sapiens
tatcccaagaatgcaa

SEQ ID NO: 5938140 - DNA, 21 bp, Homo sapiens
tatcccaagaccctgccccct

SEQ ID NO: 5938141 - DNA, 20 bp, Homo sapiens
tatcccaatcaaagaattac

SEQ ID NO: 5938142 - DNA, 16 bp, Homo sapiens
tatcccaatcattgtt

SEQ ID NO: 5938143 - DNA, 16 bp, Homo sapiens
tatcccacatccaact

SEQ ID NO: 5938144 - DNA, 15 bp, Homo sapiens
tatcccacctccagc

SEQ ID NO: 5938145 - DNA, 17 bp, Homo sapiens
tatcccacctccagccc

SEQ ID NO: 5938146 - DNA, 19 bp, Homo sapiens
tatcccacctccagcccac

SEQ ID NO: 5938147 - DNA, 20 bp, Homo sapiens
tatcccacctccatcccaga

SEQ ID NO: 5938148 - DNA, 16 bp, Homo sapiens
tatcccacggaaaatg

SEQ ID NO: 5938149 - DNA, 18 bp, Homo sapiens
tatcccagagaacaatca

SEQ ID NO: 5938150 - DNA, 12 bp, Homo sapiens
tatcccagtgtg

SEQ ID NO: 5938151 - DNA, 22 bp, Homo sapiens
tatccccatctccctgcctggc

SEQ ID NO: 5938152 - DNA, 20 bp, Homo sapiens
tatccccccatcttgcttcc

SEQ ID NO: 5938153 - DNA, 15 bp, Homo sapiens
tatcccccccagcct

SEQ ID NO: 5938154 - DNA, 19 bp, Homo sapiens
tatcccccccctgtatagt

SEQ ID NO: 5938155 - DNA, 21 bp, Homo sapiens
tatccccggacgcatgcaggg

SEQ ID NO: 5938156 - DNA, 15 bp, Homo sapiens
tatcccctctactct

SEQ ID NO: 5938157 - DNA, 13 bp, Homo sapiens
tatcccctgcctc

SEQ ID NO: 5938158 - DNA, 14 bp, Homo sapiens
tatcccctgcctcc

SEQ ID NO: 5938159 - DNA, 15 bp, Homo sapiens
tatcccctgcctcct

SEQ ID NO: 5938160 - DNA, 14 bp, Homo sapiens
tatcccgagtctgg

SEQ ID NO: 5938161 - DNA, 17 bp, Homo sapiens
tatcccgagtctgggac

SEQ ID NO: 5938162 - DNA, 19 bp, Homo sapiens
tatcccgccagggagtgtg

SEQ ID NO: 5938163 - DNA, 15 bp, Homo sapiens
tatcccggctgccct

SEQ ID NO: 5938164 - DNA, 14 bp, Homo sapiens
tatccctcattcat

SEQ ID NO: 5938165 - DNA, 16 bp, Homo sapiens
tatccctctcttcccc

SEQ ID NO: 5938166 - DNA, 22 bp, Homo sapiens
tatccctctcttccccttccct

SEQ ID NO: 5938167 - DNA, 15 bp, Homo sapiens
tatccctcttgtaag

SEQ ID NO: 5938168 - DNA, 14 bp, Homo sapiens
tatccctgataaat

SEQ ID NO: 5938169 - DNA, 16 bp, Homo sapiens
tatccctggttgcctc

SEQ ID NO: 5938170 - DNA, 18 bp, Homo sapiens
tatccctggttgcctcat

SEQ ID NO: 5938171 - DNA, 16 bp, Homo sapiens
tatcccttccagatgg

SEQ ID NO: 5938172 - DNA, 12 bp, Homo sapiens
tatcccttccgg

SEQ ID NO: 5938173 - DNA, 14 bp, Homo sapiens
tatcccttcctttt

SEQ ID NO: 5938174 - DNA, 12 bp, Homo sapiens
tatcccttctca

SEQ ID NO: 5938175 - DNA, 18 bp, Homo sapiens
tatcccttctcacagcac

SEQ ID NO: 5938176 - DNA, 17 bp, Homo sapiens
tatcccttggacatttt

SEQ ID NO: 5938177 - DNA, 12 bp, Homo sapiens
tatccctttcct

SEQ ID NO: 5938178 - DNA, 19 bp, Homo sapiens
tatccgacatgtactgcta

SEQ ID NO: 5938179 - DNA, 17 bp, Homo sapiens
tatccgactctaagctg

SEQ ID NO: 5938180 - DNA, 16 bp, Homo sapiens
tatccgccctgcagca

SEQ ID NO: 5938181 - DNA, 14 bp, Homo sapiens
tatccgctgccagc

SEQ ID NO: 5938182 - DNA, 18 bp, Homo sapiens
tatccggacagagcacgt

SEQ ID NO: 5938183 - DNA, 14 bp, Homo sapiens
tatccgtgaattgc

SEQ ID NO: 5938184 - DNA, 14 bp, Homo sapiens
tatcctaaataaaa

SEQ ID NO: 5938185 - DNA, 23 bp, Homo sapiens
tatcctaagactaacaaaggcag

SEQ ID NO: 5938186 - DNA, 18 bp, Homo sapiens
tatcctaataaaaaggtg

SEQ ID NO: 5938187 - DNA, 18 bp, Homo sapiens
tatctgtgtgccctaggg

SEQ ID NO: 5938188 - DNA, 12 bp, Homo sapiens
tatctgtgttac

SEQ ID NO: 5938189 - DNA, 20 bp, Homo sapiens
tatctgtgtttttgaaatat

SEQ ID NO: 5938190 - DNA, 15 bp, Homo sapiens
tatctgttagatgct

SEQ ID NO: 5938191 - DNA, 16 bp, Homo sapiens
tatctgttcccagccc

SEQ ID NO: 5938192 - DNA, 11 bp, Homo sapiens
tatctgttcta

SEQ ID NO: 5938193 - DNA, 19 bp, Homo sapiens
tatctgttctttaatttat

SEQ ID NO: 5938194 - DNA, 21 bp, Homo sapiens
tatctgttgccttatttctca

SEQ ID NO: 5938195 - DNA, 18 bp, Homo sapiens
tatctgttggagaaagaa

SEQ ID NO: 5938196 - DNA, 16 bp, Homo sapiens
tatctgtttgagaaag

SEQ ID NO: 5938197 - DNA, 13 bp, Homo sapiens
tatctgtttgtat

SEQ ID NO: 5938198 - DNA, 15 bp, Homo sapiens
tatctgtttgtatat

SEQ ID NO: 5938199 - DNA, 18 bp, Homo sapiens
tatctgtttgtatatttg

SEQ ID NO: 5938200 - DNA, 16 bp, Homo sapiens
tatctgtttgttactg

SEQ ID NO: 5938201 - DNA, 18 bp, Homo sapiens
tatctgttttactgcttt

SEQ ID NO: 5938202 - DNA, 16 bp, Homo sapiens
tatctgttttgtttct

SEQ ID NO: 5938203 - DNA, 16 bp, Homo sapiens
tatctgtttttccata

SEQ ID NO: 5938204 - DNA, 13 bp, Homo sapiens
tatcttaaaacct

SEQ ID NO: 5938205 - DNA, 13 bp, Homo sapiens
tatcttaaaattg

SEQ ID NO: 5938206 - DNA, 18 bp, Homo sapiens
tatcttaaaattggttaa

SEQ ID NO: 5938207 - DNA, 16 bp, Homo sapiens
tatcttaaacccacat

SEQ ID NO: 5938208 - DNA, 13 bp, Homo sapiens
tatcttaaactgt

SEQ ID NO: 5938209 - DNA, 24 bp, Homo sapiens
tatcttaaactgttcttcattaga

SEQ ID NO: 5938210 - DNA, 15 bp, Homo sapiens
tatcttaaagaaaca

SEQ ID NO: 5938211 - DNA, 13 bp, Homo sapiens
tatcttaaaggac

SEQ ID NO: 5938212 - DNA, 14 bp, Homo sapiens
tatcttaaatatga

SEQ ID NO: 5938213 - DNA, 14 bp, Homo sapiens
tatcttaaatttga

SEQ ID NO: 5938214 - DNA, 14 bp, Homo sapiens
tatcttacaaaata

SEQ ID NO: 5938215 - DNA, 19 bp, Homo sapiens
tatcttacaaagtgtattt

SEQ ID NO: 5938216 - DNA, 19 bp, Homo sapiens
tatcttacaactcccccac

SEQ ID NO: 5938217 - DNA, 18 bp, Homo sapiens
tatcttacagccagagga

SEQ ID NO: 5938218 - DNA, 13 bp, Homo sapiens
tatcttacgaaaa

SEQ ID NO: 5938219 - DNA, 18 bp, Homo sapiens
tatcttactatttcacaa

SEQ ID NO: 5938220 - DNA, 15 bp, Homo sapiens
tatcttactctgtcc

SEQ ID NO: 5938221 - DNA, 14 bp, Homo sapiens
tatcttacttttgg

SEQ ID NO: 5938222 - DNA, 20 bp, Homo sapiens
tatcttaggtagtcatgctg

SEQ ID NO: 5938223 - DNA, 18 bp, Homo sapiens
tatcttagttacatttct

SEQ ID NO: 5938224 - DNA, 22 bp, Homo sapiens
tatcttataaagtggaagtatg

SEQ ID NO: 5938225 - DNA, 23 bp, Homo sapiens
tatcttataaagtggaagtatgt

SEQ ID NO: 5938226 - DNA, 15 bp, Homo sapiens
tatcttataactgtt

SEQ ID NO: 5938227 - DNA, 17 bp, Homo sapiens
tatcttataactgtttt

SEQ ID NO: 5938228 - DNA, 18 bp, Homo sapiens
tatcttataactgtttta

SEQ ID NO: 5938229 - DNA, 16 bp, Homo sapiens
tatcttatactgaaaa

SEQ ID NO: 5938230 - DNA, 15 bp, Homo sapiens
tatcttatctagcaa

SEQ ID NO: 5938231 - DNA, 17 bp, Homo sapiens
tatcttattaaagtatt

SEQ ID NO: 5938232 - DNA, 23 bp, Homo sapiens
tatcttatttaatttttgcaatt

SEQ ID NO: 5938233 - DNA, 14 bp, Homo sapiens
tatcttatttatat

SEQ ID NO: 5938234 - DNA, 21 bp, Homo sapiens
tatcttcaaaaatacagaatt

SEQ ID NO: 5938235 - DNA, 13 bp, Homo sapiens
tatcttcaaactt

SEQ ID NO: 5938236 - DNA, 16 bp, Homo sapiens
tatcttcaaactttca

SEQ ID NO: 5938237 - DNA, 12 bp, Homo sapiens
tatcttcacaat

SEQ ID NO: 5938238 - DNA, 12 bp, Homo sapiens
tatcttcacata

SEQ ID NO: 5938239 - DNA, 15 bp, Homo sapiens
tatcttcacatagtt

SEQ ID NO: 5938240 - DNA, 20 bp, Homo sapiens
tatcttcaccctcatccttt

SEQ ID NO: 5938241 - DNA, 23 bp, Homo sapiens
tatcttcagcccaggcttttgct

SEQ ID NO: 5938242 - DNA, 15 bp, Homo sapiens
tatcttcagtttaat

SEQ ID NO: 5938243 - DNA, 18 bp, Homo sapiens
tatcttcatgtaaattga

SEQ ID NO: 5938244 - DNA, 13 bp, Homo sapiens
tatcttcatgttt

SEQ ID NO: 5938245 - DNA, 13 bp, Homo sapiens
tatcttcctttct

SEQ ID NO: 5938246 - DNA, 18 bp, Homo sapiens
tatcttcctttcttgtct

SEQ ID NO: 5938247 - DNA, 15 bp, Homo sapiens
tatcttcgttcttgt

SEQ ID NO: 5938248 - DNA, 17 bp, Homo sapiens
tatcttctcaagttcta

SEQ ID NO: 5938249 - DNA, 22 bp, Homo sapiens
tatcttctcaagttctaagatt

SEQ ID NO: 5938250 - DNA, 19 bp, Homo sapiens
tatcttctgcagacactgt

SEQ ID NO: 5938251 - DNA, 17 bp, Homo sapiens
tatcttctgctctttct

SEQ ID NO: 5938252 - DNA, 12 bp, Homo sapiens
tatcttctggtg

SEQ ID NO: 5938253 - DNA, 23 bp, Homo sapiens
tatcttctgtttttctcaaataa

SEQ ID NO: 5938254 - DNA, 15 bp, Homo sapiens
tatcttcttaacagt

SEQ ID NO: 5938255 - DNA, 18 bp, Homo sapiens
tatcttctttattattcc

SEQ ID NO: 5938256 - DNA, 15 bp, Homo sapiens
tatcttctttcctca

SEQ ID NO: 5938257 - DNA, 14 bp, Homo sapiens
tatcttgaagactt

SEQ ID NO: 5938258 - DNA, 14 bp, Homo sapiens
tatcttgaaggaaa

SEQ ID NO: 5938259 - DNA, 17 bp, Homo sapiens
tatcttgaaggaaaaat

SEQ ID NO: 5938260 - DNA, 21 bp, Homo sapiens
tatcttgaccatactaataaa

SEQ ID NO: 5938261 - DNA, 15 bp, Homo sapiens
tatcttgatacattc

SEQ ID NO: 5938262 - DNA, 19 bp, Homo sapiens
tatcttgatacattcaaat

SEQ ID NO: 5938263 - DNA, 23 bp, Homo sapiens
tatcttgatgtttagaaaagtat

SEQ ID NO: 5938264 - DNA, 17 bp, Homo sapiens
tatcttgattaatgtac

SEQ ID NO: 5938265 - DNA, 22 bp, Homo sapiens
tatcttgattaatgtacttttt

SEQ ID NO: 5938266 - DNA, 22 bp, Homo sapiens
tatcttgcagtatcggcactgt

SEQ ID NO: 5938267 - DNA, 16 bp, Homo sapiens
tatcttgctccattgt

SEQ ID NO: 5938268 - DNA, 13 bp, Homo sapiens
tatcttgcttgaa

SEQ ID NO: 5938269 - DNA, 20 bp, Homo sapiens
tatcttgcttgaacttacag

SEQ ID NO: 5938270 - DNA, 17 bp, Homo sapiens
tatcttggacaaatcac

SEQ ID NO: 5938271 - DNA, 19 bp, Homo sapiens
tatcttggacgcactgttt

SEQ ID NO: 5938272 - DNA, 16 bp, Homo sapiens
tatcttggcaggtagg

SEQ ID NO: 5938273 - DNA, 22 bp, Homo sapiens
tatcttgggtgtattctctgta

SEQ ID NO: 5938274 - DNA, 16 bp, Homo sapiens
tatcttgtagctttat

SEQ ID NO: 5938275 - DNA, 14 bp, Homo sapiens
tatcttgtgcttct

SEQ ID NO: 5938276 - DNA, 16 bp, Homo sapiens
tatcttgtgttgtcct

SEQ ID NO: 5938277 - DNA, 18 bp, Homo sapiens
tatcttgtgttgtccttt

SEQ ID NO: 5938278 - DNA, 21 bp, Homo sapiens
tatcttgttattaatgtttct

SEQ ID NO: 5938279 - DNA, 17 bp, Homo sapiens
tatcttgttcaggaaaa

SEQ ID NO: 5938280 - DNA, 15 bp, Homo sapiens
tatcttgtttggcct

SEQ ID NO: 5938281 - DNA, 18 bp, Homo sapiens
tatcttgtttttccacta

SEQ ID NO: 5938282 - DNA, 22 bp, Homo sapiens
tatctttaaaaaaaaatcttgt

SEQ ID NO: 5938283 - DNA, 16 bp, Homo sapiens
tatctttaaatataat

SEQ ID NO: 5938284 - DNA, 20 bp, Homo sapiens
tatctttaacaattgtctta

SEQ ID NO: 5938285 - DNA, 21 bp, Homo sapiens
tatctttacaagcaggcactg

SEQ ID NO: 5938286 - DNA, 16 bp, Homo sapiens
tatctttatacagatt

SEQ ID NO: 5938287 - DNA, 23 bp, Homo sapiens
tatctttatacagattttctaga

SEQ ID NO: 5938288 - DNA, 19 bp, Homo sapiens
tatctttatacttaaacag

SEQ ID NO: 5938289 - DNA, 14 bp, Homo sapiens
tatctttatagttg

SEQ ID NO: 5938290 - DNA, 19 bp, Homo sapiens
tatctttatgcaaaaacat

SEQ ID NO: 5938291 - DNA, 15 bp, Homo sapiens
tatctttattaaaac

SEQ ID NO: 5938292 - DNA, 15 bp, Homo sapiens
tatctttcaaaatgt

SEQ ID NO: 5938293 - DNA, 16 bp, Homo sapiens
tatctttcagttatta

SEQ ID NO: 5938294 - DNA, 21 bp, Homo sapiens
tatctttctcttacctgttat

SEQ ID NO: 5938295 - DNA, 22 bp, Homo sapiens
tatctttctttccatttacagt

SEQ ID NO: 5938296 - DNA, 20 bp, Homo sapiens
tatctttgaagccagtattt

SEQ ID NO: 5938297 - DNA, 15 bp, Homo sapiens
tatctttgaatatgt

SEQ ID NO: 5938298 - DNA, 22 bp, Homo sapiens
tatctttgacaattctgggtgc

SEQ ID NO: 5938299 - DNA, 16 bp, Homo sapiens
tatctttgattctcct

SEQ ID NO: 5938300 - DNA, 18 bp, Homo sapiens
tatctttgattctccttc

SEQ ID NO: 5938301 - DNA, 20 bp, Homo sapiens
tatctttgcacaatcaataa

SEQ ID NO: 5938302 - DNA, 22 bp, Homo sapiens
tatctttggggaaactaacaat

SEQ ID NO: 5938303 - DNA, 14 bp, Homo sapiens
tatctttgtaaatt

SEQ ID NO: 5938304 - DNA, 17 bp, Homo sapiens
tatctttgtctaaacaa

SEQ ID NO: 5938305 - DNA, 14 bp, Homo sapiens
tatcttttaattac

SEQ ID NO: 5938306 - DNA, 22 bp, Homo sapiens
tatcttttaattacagaagagt

SEQ ID NO: 5938307 - DNA, 20 bp, Homo sapiens
tatcttttagctagaatcca

SEQ ID NO: 5938308 - DNA, 14 bp, Homo sapiens
tatcttttatgttt

SEQ ID NO: 5938309 - DNA, 12 bp, Homo sapiens
tatcttttcata

SEQ ID NO: 5938310 - DNA, 12 bp, Homo sapiens
tatcttttcatt

SEQ ID NO: 5938311 - DNA, 14 bp, Homo sapiens
tatcttttctacag

SEQ ID NO: 5938312 - DNA, 16 bp, Homo sapiens
tatcttttctacagca

SEQ ID NO: 5938313 - DNA, 19 bp, Homo sapiens
tatcttttctacagcaaat

SEQ ID NO: 5938314 - DNA, 15 bp, Homo sapiens
tatcttttcttctcc

SEQ ID NO: 5938315 - DNA, 14 bp, Homo sapiens
tatcttttctttag

SEQ ID NO: 5938316 - DNA, 16 bp, Homo sapiens
tatcttttctttcaaa

SEQ ID NO: 5938317 - DNA, 20 bp, Homo sapiens
tatcttttggctctgaagaa

SEQ ID NO: 5938318 - DNA, 21 bp, Homo sapiens
tatcttttgtatatctaagac

SEQ ID NO: 5938319 - DNA, 19 bp, Homo sapiens
tatctttttaaaaactctt

SEQ ID NO: 5938320 - DNA, 18 bp, Homo sapiens
tatctttttattgatgtg

SEQ ID NO: 5938321 - DNA, 22 bp, Homo sapiens
tatctttttgcttacagtttta

SEQ ID NO: 5938322 - DNA, 18 bp, Homo sapiens
tatcttttttagtgttaa

SEQ ID NO: 5938323 - DNA, 15 bp, Homo sapiens
tatcttttttcaaaa

SEQ ID NO: 5938324 - DNA, 23 bp, Homo sapiens
tatcttttttcctagtttttcta

SEQ ID NO: 5938325 - DNA, 21 bp, Homo sapiens
tatcttttttttattccacat

SEQ ID NO: 5938326 - DNA, 15 bp, Homo sapiens
tatgaaaaaatatga

SEQ ID NO: 5938327 - DNA, 17 bp, Homo sapiens
tatgaaaaaatatgaac

SEQ ID NO: 5938328 - DNA, 20 bp, Homo sapiens
tatgaaaaaatgttcaaatt

SEQ ID NO: 5938329 - DNA, 18 bp, Homo sapiens
tatgaaaaacaaaaataa

SEQ ID NO: 5938330 - DNA, 13 bp, Homo sapiens
tatgaaaaacatc

SEQ ID NO: 5938331 - DNA, 21 bp, Homo sapiens
tatgaaaaacatcccaaactt

SEQ ID NO: 5938332 - DNA, 23 bp, Homo sapiens
tatgaaaaacatcccaaacttta

SEQ ID NO: 5938333 - DNA, 14 bp, Homo sapiens
tatgaaaaatatga

SEQ ID NO: 5938334 - DNA, 13 bp, Homo sapiens
tatgaaaaatgta

SEQ ID NO: 5938335 - DNA, 20 bp, Homo sapiens
tatgaaaacaagttccaaat

SEQ ID NO: 5938336 - DNA, 21 bp, Homo sapiens
tatgaaaacaatactaaataa

SEQ ID NO: 5938337 - DNA, 16 bp, Homo sapiens
tatgaaaacagatgcc

SEQ ID NO: 5938338 - DNA, 21 bp, Homo sapiens
tatgaaaacatggaacagtgt

SEQ ID NO: 5938339 - DNA, 17 bp, Homo sapiens
tatgaaaaccaaatttt

SEQ ID NO: 5938340 - DNA, 17 bp, Homo sapiens
tatgaaaactatacaac

SEQ ID NO: 5938341 - DNA, 15 bp, Homo sapiens
tatgaaaagaataaa

SEQ ID NO: 5938342 - DNA, 19 bp, Homo sapiens
tatgaaaatcctatatctg

SEQ ID NO: 5938343 - DNA, 16 bp, Homo sapiens
tatgaaaatgagccct

SEQ ID NO: 5938344 - DNA, 14 bp, Homo sapiens
tatgaaaatggaaa

SEQ ID NO: 5938345 - DNA, 14 bp, Homo sapiens
tatgaaacaaatat

SEQ ID NO: 5938346 - DNA, 17 bp, Homo sapiens
tatgaaacaatcttcca

SEQ ID NO: 5938347 - DNA, 17 bp, Homo sapiens
tatgaaacttaggaagg

SEQ ID NO: 5938348 - DNA, 19 bp, Homo sapiens
tatgaaagaatatatttat

SEQ ID NO: 5938349 - DNA, 23 bp, Homo sapiens
tatgaaagaatatatttatttaa

SEQ ID NO: 5938350 - DNA, 15 bp, Homo sapiens
tatgaaagagaaaat

SEQ ID NO: 5938351 - DNA, 23 bp, Homo sapiens
tatgaaagagaaaatgctttctc

SEQ ID NO: 5938352 - DNA, 22 bp, Homo sapiens
tatgaaagatggctgtgcctct

SEQ ID NO: 5938353 - DNA, 16 bp, Homo sapiens
tatgaaagctgggggt

SEQ ID NO: 5938354 - DNA, 13 bp, Homo sapiens
tatgaaagtagat

SEQ ID NO: 5938355 - DNA, 21 bp, Homo sapiens
tatgaaagtagattcatgaaa

SEQ ID NO: 5938356 - DNA, 13 bp, Homo sapiens
tatgaaataaaga

SEQ ID NO: 5938357 - DNA, 19 bp, Homo sapiens
tatgaaataaagaaattgc

SEQ ID NO: 5938358 - DNA, 14 bp, Homo sapiens
tatgaaataacgca

SEQ ID NO: 5938359 - DNA, 19 bp, Homo sapiens
tatgaaatataaattatct

SEQ ID NO: 5938360 - DNA, 16 bp, Homo sapiens
tatgaaatatatgtga

SEQ ID NO: 5938361 - DNA, 21 bp, Homo sapiens
tatgaaatattatgttaaaac

SEQ ID NO: 5938362 - DNA, 16 bp, Homo sapiens
tatgaaatattttgaa

SEQ ID NO: 5938363 - DNA, 13 bp, Homo sapiens
tatgaaatcatag

SEQ ID NO: 5938364 - DNA, 20 bp, Homo sapiens
tatgaaatgataaagatgtc

SEQ ID NO: 5938365 - DNA, 15 bp, Homo sapiens
tatgactcaaagatg

SEQ ID NO: 5938366 - DNA, 16 bp, Homo sapiens
tatgactccagaattt

SEQ ID NO: 5938367 - DNA, 22 bp, Homo sapiens
tatgactgctccccagccctgg

SEQ ID NO: 5938368 - DNA, 14 bp, Homo sapiens
tatgactgtaaaca

SEQ ID NO: 5938369 - DNA, 23 bp, Homo sapiens
tatgacttaaaattggaaatgtc

SEQ ID NO: 5938370 - DNA, 17 bp, Homo sapiens
tatgacttaattttaga

SEQ ID NO: 5938371 - DNA, 23 bp, Homo sapiens
tatgacttgggcacccccagcct

SEQ ID NO: 5938372 - DNA, 12 bp, Homo sapiens
tatgactttgtc

SEQ ID NO: 5938373 - DNA, 22 bp, Homo sapiens
tatgactttttataaaatggct

SEQ ID NO: 5938374 - DNA, 19 bp, Homo sapiens
tatgagaaaaaaacagcag

SEQ ID NO: 5938375 - DNA, 20 bp, Homo sapiens
tatgagaaaaaaacagcagg

SEQ ID NO: 5938376 - DNA, 20 bp, Homo sapiens
tatgagaaaaatattcaagt

SEQ ID NO: 5938377 - DNA, 23 bp, Homo sapiens
tatgagaaaagaggcgtctgtat

SEQ ID NO: 5938378 - DNA, 18 bp, Homo sapiens
tatgagaaatataaaaat

SEQ ID NO: 5938379 - DNA, 12 bp, Homo sapiens
tatgagaaatgt

SEQ ID NO: 5938380 - DNA, 22 bp, Homo sapiens
tatgagaacaagtcacagctgc

SEQ ID NO: 5938381 - DNA, 20 bp, Homo sapiens
tatgagaacatggtgtgtgt

SEQ ID NO: 5938382 - DNA, 21 bp, Homo sapiens
tatgagaactggttcttgcct

SEQ ID NO: 5938383 - DNA, 22 bp, Homo sapiens
tatgagaagaaaaatggaaaaa

SEQ ID NO: 5938384 - DNA, 17 bp, Homo sapiens
tatgagaagtactttgt

SEQ ID NO: 5938385 - DNA, 18 bp, Homo sapiens
tatgagaagtactttgtg

SEQ ID NO: 5938386 - DNA, 20 bp, Homo sapiens
tatgagaatgaccctgtcaa

SEQ ID NO: 5938387 - DNA, 19 bp, Homo sapiens
tatgagaatgtattagtac

SEQ ID NO: 5938388 - DNA, 22 bp, Homo sapiens
tatgagacagggtcttgctctg

SEQ ID NO: 5938389 - DNA, 22 bp, Homo sapiens
tatgagacccttacgtgattgt

SEQ ID NO: 5938390 - DNA, 14 bp, Homo sapiens
tatgagagaatcac

SEQ ID NO: 5938391 - DNA, 12 bp, Homo sapiens
tatgagagactg

SEQ ID NO: 5938392 - DNA, 21 bp, Homo sapiens
tatgagagggccctgcctgct

SEQ ID NO: 5938393 - DNA, 21 bp, Homo sapiens
tatgagatggccatgctcaac

SEQ ID NO: 5938394 - DNA, 20 bp, Homo sapiens
tatgagattggaaaaaatta

SEQ ID NO: 5938395 - DNA, 14 bp, Homo sapiens
tatgagattggttt

SEQ ID NO: 5938396 - DNA, 20 bp, Homo sapiens
tatgagattggttttcctgt

SEQ ID NO: 5938397 - DNA, 13 bp, Homo sapiens
tatgagatttact

SEQ ID NO: 5938398 - DNA, 20 bp, Homo sapiens
tatgagcatcctgagccccg

SEQ ID NO: 5938399 - DNA, 16 bp, Homo sapiens
tatgagctacaacaaa

SEQ ID NO: 5938400 - DNA, 18 bp, Homo sapiens
tatgagctacaacaaaag

SEQ ID NO: 5938401 - DNA, 17 bp, Homo sapiens
tatgagctcatgtagca

SEQ ID NO: 5938402 - DNA, 14 bp, Homo sapiens
tatgagctcttcat

SEQ ID NO: 5938403 - DNA, 15 bp, Homo sapiens
tatgagctcttcatg

SEQ ID NO: 5938404 - DNA, 21 bp, Homo sapiens
tatgagctggagctaaggcca

SEQ ID NO: 5938405 - DNA, 12 bp, Homo sapiens
tatgagcttcaa

SEQ ID NO: 5938406 - DNA, 20 bp, Homo sapiens
tatgagcttcaatataagaa

SEQ ID NO: 5938407 - DNA, 15 bp, Homo sapiens
tatgagcttccaagg

SEQ ID NO: 5938408 - DNA, 21 bp, Homo sapiens
tatgagcttccttctgtgaaa

SEQ ID NO: 5938409 - DNA, 18 bp, Homo sapiens
tatgagcttgctcattaa

SEQ ID NO: 5938410 - DNA, 16 bp, Homo sapiens
tatgagctttatgtaa

SEQ ID NO: 5938411 - DNA, 16 bp, Homo sapiens
tatgagctttcagact

SEQ ID NO: 5938412 - DNA, 18 bp, Homo sapiens
tatgaggaaactgagtca

SEQ ID NO: 5938413 - DNA, 13 bp, Homo sapiens
tatgaggaaaggt

SEQ ID NO: 5938414 - DNA, 17 bp, Homo sapiens
tatgaggaataattatt

SEQ ID NO: 5938415 - DNA, 23 bp, Homo sapiens
tatgaggacttgtgtctctgtgc

SEQ ID NO: 5938416 - DNA, 20 bp, Homo sapiens
tatgaggataatgggaagag

SEQ ID NO: 5938417 - DNA, 16 bp, Homo sapiens
tatgaggatgtatgtg

SEQ ID NO: 5938418 - DNA, 20 bp, Homo sapiens
tatgaggatgtatgtgtata

SEQ ID NO: 5938419 - DNA, 22 bp, Homo sapiens
tatgaggcaacctgattgtaaa

SEQ ID NO: 5938420 - DNA, 14 bp, Homo sapiens
tatgaggcattgag

SEQ ID NO: 5938421 - DNA, 23 bp, Homo sapiens
tatgaggcatttgtttgaactga

SEQ ID NO: 5938422 - DNA, 17 bp, Homo sapiens
tatgaggggactgcatg

SEQ ID NO: 5938423 - DNA, 14 bp, Homo sapiens
tatgagggggtggt

SEQ ID NO: 5938424 - DNA, 15 bp, Homo sapiens
tatgagggtgtttcc

SEQ ID NO: 5938425 - DNA, 15 bp, Homo sapiens
tatgaggtcctcagg

SEQ ID NO: 5938426 - DNA, 19 bp, Homo sapiens
tatgaggtctaggaacata

SEQ ID NO: 5938427 - DNA, 18 bp, Homo sapiens
tatgagtaactattatta

SEQ ID NO: 5938428 - DNA, 17 bp, Homo sapiens
tatgagtacaaatgcct

SEQ ID NO: 5938429 - DNA, 19 bp, Homo sapiens
tatgagtacatactcaaga

SEQ ID NO: 5938430 - DNA, 19 bp, Homo sapiens
tatgagtataatacattac

SEQ ID NO: 5938431 - DNA, 22 bp, Homo sapiens
tatgagtataatacattacatg

SEQ ID NO: 5938432 - DNA, 20 bp, Homo sapiens
tatgagtatacaatatataa

SEQ ID NO: 5938433 - DNA, 16 bp, Homo sapiens
tatgagtcaatgtgca

SEQ ID NO: 5938434 - DNA, 23 bp, Homo sapiens
tatgagtcaatgtgcagtgtagc

SEQ ID NO: 5938435 - DNA, 21 bp, Homo sapiens
tatgagtcccatttgccttgc

SEQ ID NO: 5938436 - DNA, 23 bp, Homo sapiens
tatgagtgcgcagatctgtgcct

SEQ ID NO: 5938437 - DNA, 20 bp, Homo sapiens
tatgagtgctgattcaaacc

SEQ ID NO: 5938438 - DNA, 16 bp, Homo sapiens
tatgagtgttttgaaa

SEQ ID NO: 5938439 - DNA, 20 bp, Homo sapiens
tatgagttcacatgtgccct

SEQ ID NO: 5938440 - DNA, 22 bp, Homo sapiens
tatgagttcacatgtgccctgc

SEQ ID NO: 5938441 - DNA, 23 bp, Homo sapiens
tatgagttcacatgtgccctgcc

SEQ ID NO: 5938442 - DNA, 12 bp, Homo sapiens
tatgagttcttg

SEQ ID NO: 5938443 - DNA, 16 bp, Homo sapiens
tatgagttgaaatgtt

SEQ ID NO: 5938444 - DNA, 18 bp, Homo sapiens
tatgagttgcatttgtaa

SEQ ID NO: 5938445 - DNA, 16 bp, Homo sapiens
tatgagttggacttca

SEQ ID NO: 5938446 - DNA, 17 bp, Homo sapiens
tatgagtttcatagcta

SEQ ID NO: 5938447 - DNA, 21 bp, Homo sapiens
tatgagtttttgatagcttta

SEQ ID NO: 5938448 - DNA, 22 bp, Homo sapiens
tatgagtttttgatagctttat

SEQ ID NO: 5938449 - DNA, 23 bp, Homo sapiens
tatgagtttttgatagctttatt

SEQ ID NO: 5938450 - DNA, 20 bp, Homo sapiens
tatgataaaaaattttgtaa

SEQ ID NO: 5938451 - DNA, 15 bp, Homo sapiens
tatgataaaaggaag

SEQ ID NO: 5938452 - DNA, 21 bp, Homo sapiens
tatgataacaacactgtgtta

SEQ ID NO: 5938453 - DNA, 17 bp, Homo sapiens
tatgataagattgaaat

SEQ ID NO: 5938454 - DNA, 14 bp, Homo sapiens
tatgataatgataa

SEQ ID NO: 5938455 - DNA, 18 bp, Homo sapiens
tatgataatgataacttg

SEQ ID NO: 5938456 - DNA, 15 bp, Homo sapiens
tatgataattacaat

SEQ ID NO: 5938457 - DNA, 20 bp, Homo sapiens
tatgataattacaatacaaa

SEQ ID NO: 5938458 - DNA, 20 bp, Homo sapiens
tatgatacaccattatgttt

SEQ ID NO: 5938459 - DNA, 24 bp, Homo sapiens
tatgataggttattttgatgtaaa

SEQ ID NO: 5938460 - DNA, 13 bp, Homo sapiens
tatgatatataaa

SEQ ID NO: 5938461 - DNA, 19 bp, Homo sapiens
tatgatatataaaccttaa

SEQ ID NO: 5938462 - DNA, 12 bp, Homo sapiens
tatgatatattt

SEQ ID NO: 5938463 - DNA, 14 bp, Homo sapiens
tatgatatcattgt

SEQ ID NO: 5938464 - DNA, 14 bp, Homo sapiens
tatgatattccata

SEQ ID NO: 5938465 - DNA, 18 bp, Homo sapiens
tatgatattccatagtat

SEQ ID NO: 5938466 - DNA, 20 bp, Homo sapiens
tatgatattccatagtatat

SEQ ID NO: 5938467 - DNA, 21 bp, Homo sapiens
tatgatattccccatttcctg

SEQ ID NO: 5938468 - DNA, 12 bp, Homo sapiens
tatgatattctt

SEQ ID NO: 5938469 - DNA, 19 bp, Homo sapiens
tatgatattctttaaacaa

SEQ ID NO: 5938470 - DNA, 18 bp, Homo sapiens
tatgatattgcatatgca

SEQ ID NO: 5938471 - DNA, 23 bp, Homo sapiens
tatgatattgtttaaaattcagt

SEQ ID NO: 5938472 - DNA, 13 bp, Homo sapiens
tatgatatttttc

SEQ ID NO: 5938473 - DNA, 20 bp, Homo sapiens
tatgatcaaatgtttaatca

SEQ ID NO: 5938474 - DNA, 17 bp, Homo sapiens
tatgatcacagtgactt

SEQ ID NO: 5938475 - DNA, 19 bp, Homo sapiens
tatgatcagtactgacttt

SEQ ID NO: 5938476 - DNA, 18 bp, Homo sapiens
tatgatcagtgttactgc

SEQ ID NO: 5938477 - DNA, 13 bp, Homo sapiens
tatgatccaagta

SEQ ID NO: 5938478 - DNA, 21 bp, Homo sapiens
tatgatccagcagattattca

SEQ ID NO: 5938479 - DNA, 15 bp, Homo sapiens
tatgatcccagcact

SEQ ID NO: 5938480 - DNA, 13 bp, Homo sapiens
tatgatccttttt

SEQ ID NO: 5938481 - DNA, 14 bp, Homo sapiens
tatgatctaataaa

SEQ ID NO: 5938482 - DNA, 15 bp, Homo sapiens
tatgatctaataaac

SEQ ID NO: 5938483 - DNA, 19 bp, Homo sapiens
tatgatctaataaacttta

SEQ ID NO: 5938484 - DNA, 13 bp, Homo sapiens
tatgatctaatac

SEQ ID NO: 5938485 - DNA, 15 bp, Homo sapiens
tatgatctaatacaa

SEQ ID NO: 5938486 - DNA, 15 bp, Homo sapiens
tatgatctatgttgt

SEQ ID NO: 5938487 - DNA, 17 bp, Homo sapiens
tatgatctatttgtaga

SEQ ID NO: 5938488 - DNA, 16 bp, Homo sapiens
tatgatctctgctttg

SEQ ID NO: 5938489 - DNA, 13 bp, Homo sapiens
tatgatctgtgga

SEQ ID NO: 5938490 - DNA, 19 bp, Homo sapiens
tatgatctgtggagaatgt

SEQ ID NO: 5938491 - DNA, 22 bp, Homo sapiens
tatgatctgtggagaatgtaca

SEQ ID NO: 5938492 - DNA, 19 bp, Homo sapiens
tatgatcttagggaacttt

SEQ ID NO: 5938493 - DNA, 21 bp, Homo sapiens
tatgatgacgtacaagtagtt

SEQ ID NO: 5938494 - DNA, 14 bp, Homo sapiens
tatgatgactgttt

SEQ ID NO: 5938495 - DNA, 16 bp, Homo sapiens
tatgatgcatacagtt

SEQ ID NO: 5938496 - DNA, 18 bp, Homo sapiens
tatgatgctaatcttgtc

SEQ ID NO: 5938497 - DNA, 19 bp, Homo sapiens
tatgatgctaatcttgtcc

SEQ ID NO: 5938498 - DNA, 12 bp, Homo sapiens
tatgatgctatt

SEQ ID NO: 5938499 - DNA, 13 bp, Homo sapiens
tatgatgctattt

SEQ ID NO: 5938500 - DNA, 13 bp, Homo sapiens
tatgatgctgccg

SEQ ID NO: 5938501 - DNA, 15 bp, Homo sapiens
tatgatggagcaact

SEQ ID NO: 5938502 - DNA, 19 bp, Homo sapiens
tatgatggagcaactgaaa

SEQ ID NO: 5938503 - DNA, 16 bp, Homo sapiens
tatgatgggctcccca

SEQ ID NO: 5938504 - DNA, 19 bp, Homo sapiens
tatgatgggctccccagga

SEQ ID NO: 5938505 - DNA, 22 bp, Homo sapiens
tatgatgtaatctctctgcagc

SEQ ID NO: 5938506 - DNA, 17 bp, Homo sapiens
tatgatgtgcttaacag

SEQ ID NO: 5938507 - DNA, 21 bp, Homo sapiens
tatgatgtgcttaacagggaa

SEQ ID NO: 5938508 - DNA, 15 bp, Homo sapiens
tatgatgtggagaaa

SEQ ID NO: 5938509 - DNA, 15 bp, Homo sapiens
tatgatgtgttgtga

SEQ ID NO: 5938510 - DNA, 20 bp, Homo sapiens
tatgatgttagttttcctta

SEQ ID NO: 5938511 - DNA, 16 bp, Homo sapiens
tatgatgttttccctt

SEQ ID NO: 5938512 - DNA, 17 bp, Homo sapiens
tatgatgttttgcaaag

SEQ ID NO: 5938513 - DNA, 14 bp, Homo sapiens
tatgattaaaaata

SEQ ID NO: 5938514 - DNA, 15 bp, Homo sapiens
tatgattactggcct

SEQ ID NO: 5938515 - DNA, 22 bp, Homo sapiens
tatgattagagggatgagacag

SEQ ID NO: 5938516 - DNA, 21 bp, Homo sapiens
tatgattcactatttaaacta

SEQ ID NO: 5938517 - DNA, 21 bp, Homo sapiens
tatgattcagattgttatcta

SEQ ID NO: 5938518 - DNA, 18 bp, Homo sapiens
tatgattccaatctctgt

SEQ ID NO: 5938519 - DNA, 14 bp, Homo sapiens
tatgattccaatta

SEQ ID NO: 5938520 - DNA, 17 bp, Homo sapiens
tatgattctagtacata

SEQ ID NO: 5938521 - DNA, 22 bp, Homo sapiens
tatgattctagtacataattga

SEQ ID NO: 5938522 - DNA, 16 bp, Homo sapiens
tatgattctcctctcc

SEQ ID NO: 5938523 - DNA, 18 bp, Homo sapiens
tatgattcttactgttct

SEQ ID NO: 5938524 - DNA, 15 bp, Homo sapiens
tatgattgatttgaa

SEQ ID NO: 5938525 - DNA, 12 bp, Homo sapiens
tatgattgcact

SEQ ID NO: 5938526 - DNA, 23 bp, Homo sapiens
tatgattgcctttttataacttt

SEQ ID NO: 5938527 - DNA, 14 bp, Homo sapiens
tatgattgtaacat

SEQ ID NO: 5938528 - DNA, 17 bp, Homo sapiens
tatgattgtaacatatt

SEQ ID NO: 5938529 - DNA, 16 bp, Homo sapiens
tatgattgtatttgtg

SEQ ID NO: 5938530 - DNA, 20 bp, Homo sapiens
tatgattgtatttgtgtata

SEQ ID NO: 5938531 - DNA, 21 bp, Homo sapiens
tatgattgtttctcaaatctt

SEQ ID NO: 5938532 - DNA, 12 bp, Homo sapiens
tatgatttaaaa

SEQ ID NO: 5938533 - DNA, 14 bp, Homo sapiens
tatgatttaaaaaa

SEQ ID NO: 5938534 - DNA, 16 bp, Homo sapiens
tatgatttaaaaaata

SEQ ID NO: 5938535 - DNA, 21 bp, Homo sapiens
tatgatttaaaaaataaatat

SEQ ID NO: 5938536 - DNA, 14 bp, Homo sapiens
tatgatttaaaaca

SEQ ID NO: 5938537 - DNA, 17 bp, Homo sapiens
tatgatttaaaacatgt

SEQ ID NO: 5938538 - DNA, 17 bp, Homo sapiens
tatgatttaataaaata

SEQ ID NO: 5938539 - DNA, 17 bp, Homo sapiens
tatgatttaatttgaaa

SEQ ID NO: 5938540 - DNA, 18 bp, Homo sapiens
tatgatttaatttgaaat

SEQ ID NO: 5938541 - DNA, 18 bp, Homo sapiens
tatgatttatagtttgta

SEQ ID NO: 5938542 - DNA, 14 bp, Homo sapiens
tatgctacccacag

SEQ ID NO: 5938543 - DNA, 17 bp, Homo sapiens
tatgctacccacagcgt

SEQ ID NO: 5938544 - DNA, 16 bp, Homo sapiens
tatgctactacaaaaa

SEQ ID NO: 5938545 - DNA, 21 bp, Homo sapiens
tatgctagtttattggaagtg

SEQ ID NO: 5938546 - DNA, 17 bp, Homo sapiens
tatgctatcctcttatt

SEQ ID NO: 5938547 - DNA, 17 bp, Homo sapiens
tatgctattgacaataa

SEQ ID NO: 5938548 - DNA, 18 bp, Homo sapiens
tatgctattgacaataaa

SEQ ID NO: 5938549 - DNA, 14 bp, Homo sapiens
tatgctatttctat

SEQ ID NO: 5938550 - DNA, 13 bp, Homo sapiens
tatgctatttctg

SEQ ID NO: 5938551 - DNA, 22 bp, Homo sapiens
tatgctatttctggcctcagca

SEQ ID NO: 5938552 - DNA, 23 bp, Homo sapiens
tatgctcagaagccagtctgcgt

SEQ ID NO: 5938553 - DNA, 11 bp, Homo sapiens
tatgctcaggt

SEQ ID NO: 5938554 - DNA, 22 bp, Homo sapiens
tatgctccatcccattcacttc

SEQ ID NO: 5938555 - DNA, 22 bp, Homo sapiens
tatgctcctagagaggagaaag

SEQ ID NO: 5938556 - DNA, 18 bp, Homo sapiens
tatgctctacccttgtgt

SEQ ID NO: 5938557 - DNA, 18 bp, Homo sapiens
tatgctctcactgtttgt

SEQ ID NO: 5938558 - DNA, 17 bp, Homo sapiens
tatgctcttaattgcca

SEQ ID NO: 5938559 - DNA, 18 bp, Homo sapiens
tatgctcttaattgccac

SEQ ID NO: 5938560 - DNA, 17 bp, Homo sapiens
tatgctcttgaaatatt

SEQ ID NO: 5938561 - DNA, 15 bp, Homo sapiens
tatgctgagaaatta

SEQ ID NO: 5938562 - DNA, 15 bp, Homo sapiens
tatgctgatcatcgc

SEQ ID NO: 5938563 - DNA, 20 bp, Homo sapiens
tatgctgatcatcgccagag

SEQ ID NO: 5938564 - DNA, 15 bp, Homo sapiens
tatgctgatctttta

SEQ ID NO: 5938565 - DNA, 17 bp, Homo sapiens
tatgctgatcttttaaa

SEQ ID NO: 5938566 - DNA, 15 bp, Homo sapiens
tatgctgatttattt

SEQ ID NO: 5938567 - DNA, 11 bp, Homo sapiens
tatgctgccca

SEQ ID NO: 5938568 - DNA, 12 bp, Homo sapiens
tatgctgctgtg

SEQ ID NO: 5938569 - DNA, 13 bp, Homo sapiens
tatgctgctgtga

SEQ ID NO: 5938570 - DNA, 11 bp, Homo sapiens
tatgctgcttt

SEQ ID NO: 5938571 - DNA, 19 bp, Homo sapiens
tatgctgctttaacagtgg

SEQ ID NO: 5938572 - DNA, 22 bp, Homo sapiens
tatgctggaagtctcaaataat

SEQ ID NO: 5938573 - DNA, 16 bp, Homo sapiens
tatgctggaggcagag

SEQ ID NO: 5938574 - DNA, 13 bp, Homo sapiens
tatgctggccagc

SEQ ID NO: 5938575 - DNA, 18 bp, Homo sapiens
tatgctggccagcaccct

SEQ ID NO: 5938576 - DNA, 20 bp, Homo sapiens
tatgctggccagcaccctct

SEQ ID NO: 5938577 - DNA, 18 bp, Homo sapiens
tatgctggcttgtacata

SEQ ID NO: 5938578 - DNA, 12 bp, Homo sapiens
tatgctggcttt

SEQ ID NO: 5938579 - DNA, 14 bp, Homo sapiens
tatgctggtagatg

SEQ ID NO: 5938580 - DNA, 15 bp, Homo sapiens
tatgctggtggttaa

SEQ ID NO: 5938581 - DNA, 15 bp, Homo sapiens
tatgctgtacccagt

SEQ ID NO: 5938582 - DNA, 21 bp, Homo sapiens
tatgctgtatgaatattttat

SEQ ID NO: 5938583 - DNA, 14 bp, Homo sapiens
tatgctgtatttct

SEQ ID NO: 5938584 - DNA, 18 bp, Homo sapiens
tatgctgtatttctttgt

SEQ ID NO: 5938585 - DNA, 23 bp, Homo sapiens
tatgctgtatttctttgtagaat

SEQ ID NO: 5938586 - DNA, 14 bp, Homo sapiens
tatgctgtgtgcag

SEQ ID NO: 5938587 - DNA, 15 bp, Homo sapiens
tatgctgtgtgcaga

SEQ ID NO: 5938588 - DNA, 13 bp, Homo sapiens
tatgctgtttcct

SEQ ID NO: 5938589 - DNA, 17 bp, Homo sapiens
tatgcttaataaaagaa

SEQ ID NO: 5938590 - DNA, 15 bp, Homo sapiens
tatgcttactcttgc

SEQ ID NO: 5938591 - DNA, 16 bp, Homo sapiens
tatgcttactgatata

SEQ ID NO: 5938592 - DNA, 22 bp, Homo sapiens
tatgcttatacacttacacttt

SEQ ID NO: 5938593 - DNA, 13 bp, Homo sapiens
tatgcttatttta

SEQ ID NO: 5938594 - DNA, 14 bp, Homo sapiens
tatgcttcatacag

SEQ ID NO: 5938595 - DNA, 16 bp, Homo sapiens
tatgcttcatacaggg

SEQ ID NO: 5938596 - DNA, 14 bp, Homo sapiens
tatgcttccagaaa

SEQ ID NO: 5938597 - DNA, 23 bp, Homo sapiens
tatgcttccagaaacacccacag

SEQ ID NO: 5938598 - DNA, 20 bp, Homo sapiens
tatgcttgtaactaaaataa

SEQ ID NO: 5938599 - DNA, 16 bp, Homo sapiens
tatgctttccctgagg

SEQ ID NO: 5938600 - DNA, 21 bp, Homo sapiens
tatgctttccctgaggaatga

SEQ ID NO: 5938601 - DNA, 18 bp, Homo sapiens
tatgcttttttgcaataa

SEQ ID NO: 5938602 - DNA, 21 bp, Homo sapiens
tatggaaaaattgacaaaaaa

SEQ ID NO: 5938603 - DNA, 16 bp, Homo sapiens
tatggaaaatcagctg

SEQ ID NO: 5938604 - DNA, 16 bp, Homo sapiens
tatggaaacactgatt

SEQ ID NO: 5938605 - DNA, 18 bp, Homo sapiens
tatggaaacagaagacaa

SEQ ID NO: 5938606 - DNA, 23 bp, Homo sapiens
tatggaaacattttatactgtac

SEQ ID NO: 5938607 - DNA, 14 bp, Homo sapiens
tatggaaacccgag

SEQ ID NO: 5938608 - DNA, 13 bp, Homo sapiens
tatggaaatacat

SEQ ID NO: 5938609 - DNA, 14 bp, Homo sapiens
tatggaaatacatt

SEQ ID NO: 5938610 - DNA, 18 bp, Homo sapiens
tatggaaatacatttaga

SEQ ID NO: 5938611 - DNA, 20 bp, Homo sapiens
tatggaaataccaggaccag

SEQ ID NO: 5938612 - DNA, 15 bp, Homo sapiens
tatggaaatatatat

SEQ ID NO: 5938613 - DNA, 14 bp, Homo sapiens
tatggaaatattaa

SEQ ID NO: 5938614 - DNA, 15 bp, Homo sapiens
tatggaaatcctgtt

SEQ ID NO: 5938615 - DNA, 13 bp, Homo sapiens
tatggaacactct

SEQ ID NO: 5938616 - DNA, 19 bp, Homo sapiens
tatggaacactctgagact

SEQ ID NO: 5938617 - DNA, 15 bp, Homo sapiens
tatggaacagggatg

SEQ ID NO: 5938618 - DNA, 20 bp, Homo sapiens
tatggaaccttccctccaaa

SEQ ID NO: 5938619 - DNA, 17 bp, Homo sapiens
tatggaacttctaatat

SEQ ID NO: 5938620 - DNA, 13 bp, Homo sapiens
tatggaagaaagt

SEQ ID NO: 5938621 - DNA, 22 bp, Homo sapiens
tatggaagcatattgttattat

SEQ ID NO: 5938622 - DNA, 12 bp, Homo sapiens
tatggaagccac

SEQ ID NO: 5938623 - DNA, 22 bp, Homo sapiens
tatggaaggaggcctccactcc

SEQ ID NO: 5938624 - DNA, 17 bp, Homo sapiens
tatggaagggaggggtc

SEQ ID NO: 5938625 - DNA, 19 bp, Homo sapiens
tatggaagggtttgtggct

SEQ ID NO: 5938626 - DNA, 22 bp, Homo sapiens
tatggaagtaaaggcattccac

SEQ ID NO: 5938627 - DNA, 13 bp, Homo sapiens
tatggaataagtg

SEQ ID NO: 5938628 - DNA, 20 bp, Homo sapiens
tatggaatatcatctgtcat

SEQ ID NO: 5938629 - DNA, 13 bp, Homo sapiens
tatggaatcaatt

SEQ ID NO: 5938630 - DNA, 15 bp, Homo sapiens
tatggaatcaattca

SEQ ID NO: 5938631 - DNA, 15 bp, Homo sapiens
tatggaatgcttctt

SEQ ID NO: 5938632 - DNA, 18 bp, Homo sapiens
tatggaattacatgtaaa

SEQ ID NO: 5938633 - DNA, 23 bp, Homo sapiens
tatggacaaatggactatacata

SEQ ID NO: 5938634 - DNA, 19 bp, Homo sapiens
tatggacaatttaccacag

SEQ ID NO: 5938635 - DNA, 22 bp, Homo sapiens
tatggacactgccttagcctct

SEQ ID NO: 5938636 - DNA, 19 bp, Homo sapiens
tatggacatcgatatgaaa

SEQ ID NO: 5938637 - DNA, 16 bp, Homo sapiens
tatggacatgtaaaaa

SEQ ID NO: 5938638 - DNA, 14 bp, Homo sapiens
tatggaccaaatgt

SEQ ID NO: 5938639 - DNA, 21 bp, Homo sapiens
tatggacggtgctccaggcag

SEQ ID NO: 5938640 - DNA, 17 bp, Homo sapiens
tatggactatctgtctg

SEQ ID NO: 5938641 - DNA, 14 bp, Homo sapiens
tatggactcagcct

SEQ ID NO: 5938642 - DNA, 19 bp, Homo sapiens
tatggactcagccttgcaa

SEQ ID NO: 5938643 - DNA, 15 bp, Homo sapiens
tatggactctgcaca

SEQ ID NO: 5938644 - DNA, 14 bp, Homo sapiens
tatggagaacatgt

SEQ ID NO: 5938645 - DNA, 18 bp, Homo sapiens
tatggagaattgctgaag

SEQ ID NO: 5938646 - DNA, 19 bp, Homo sapiens
tatggagactttgctgtta

SEQ ID NO: 5938647 - DNA, 15 bp, Homo sapiens
tatggagagccctgg

SEQ ID NO: 5938648 - DNA, 15 bp, Homo sapiens
tatggagaggcttcc

SEQ ID NO: 5938649 - DNA, 20 bp, Homo sapiens
tatggagcatttttcagagt

SEQ ID NO: 5938650 - DNA, 22 bp, Homo sapiens
tatggaggattctttccccaga

SEQ ID NO: 5938651 - DNA, 14 bp, Homo sapiens
tatggaggcaggag

SEQ ID NO: 5938652 - DNA, 19 bp, Homo sapiens
tatggaggctttgcataga

SEQ ID NO: 5938653 - DNA, 22 bp, Homo sapiens
tatggagggcagagtgggctgc

SEQ ID NO: 5938654 - DNA, 19 bp, Homo sapiens
tatggagtagcaaaggact

SEQ ID NO: 5938655 - DNA, 22 bp, Homo sapiens
tatggagtcatttttacaatgt

SEQ ID NO: 5938656 - DNA, 17 bp, Homo sapiens
tatggagtcttgtgaaa

SEQ ID NO: 5938657 - DNA, 18 bp, Homo sapiens
tatggagtcttgtgaaag

SEQ ID NO: 5938658 - DNA, 15 bp, Homo sapiens
tatggagtcttgtgc

SEQ ID NO: 5938659 - DNA, 20 bp, Homo sapiens
tatggagtgagtcacctgct

SEQ ID NO: 5938660 - DNA, 21 bp, Homo sapiens
tatggagtgtgcctctctctc

SEQ ID NO: 5938661 - DNA, 16 bp, Homo sapiens
tatggataaagatgag

SEQ ID NO: 5938662 - DNA, 15 bp, Homo sapiens
tatggatatatttga

SEQ ID NO: 5938663 - DNA, 15 bp, Homo sapiens
tatggatatgtgtaa

SEQ ID NO: 5938664 - DNA, 20 bp, Homo sapiens
tatggatatttttaatttat

SEQ ID NO: 5938665 - DNA, 16 bp, Homo sapiens
tatggatgtccccagc

SEQ ID NO: 5938666 - DNA, 11 bp, Homo sapiens
tatggatgtgg

SEQ ID NO: 5938667 - DNA, 15 bp, Homo sapiens
tatggatgttactct

SEQ ID NO: 5938668 - DNA, 17 bp, Homo sapiens
tatggattaaaaactgc

SEQ ID NO: 5938669 - DNA, 16 bp, Homo sapiens
tatggattcacttcta

SEQ ID NO: 5938670 - DNA, 14 bp, Homo sapiens
tatggattctaaaa

SEQ ID NO: 5938671 - DNA, 16 bp, Homo sapiens
tatggattctaaaatg

SEQ ID NO: 5938672 - DNA, 13 bp, Homo sapiens
tatggatttctag

SEQ ID NO: 5938673 - DNA, 15 bp, Homo sapiens
tatggattttctaag

SEQ ID NO: 5938674 - DNA, 14 bp, Homo sapiens
tatggcaaaaatgg

SEQ ID NO: 5938675 - DNA, 10 bp, Homo sapiens
tatggcactt

SEQ ID NO: 5938676 - DNA, 22 bp, Homo sapiens
tatggcagaaaaaatgtctgta

SEQ ID NO: 5938677 - DNA, 17 bp, Homo sapiens
tatggcagaggtgcaag

SEQ ID NO: 5938678 - DNA, 18 bp, Homo sapiens
tatggcagagttgtaaat

SEQ ID NO: 5938679 - DNA, 19 bp, Homo sapiens
tatggcagagttgtaaata

SEQ ID NO: 5938680 - DNA, 20 bp, Homo sapiens
tatggcagagttgtaaatat

SEQ ID NO: 5938681 - DNA, 16 bp, Homo sapiens
tatggcagcccggctg

SEQ ID NO: 5938682 - DNA, 20 bp, Homo sapiens
tatggcagcccggctgctgc

SEQ ID NO: 5938683 - DNA, 21 bp, Homo sapiens
tatggcagcccggctgctgct

SEQ ID NO: 5938684 - DNA, 22 bp, Homo sapiens
tatggcagcccggctgctgctt

SEQ ID NO: 5938685 - DNA, 14 bp, Homo sapiens
tatggcagcgaaag

SEQ ID NO: 5938686 - DNA, 13 bp, Homo sapiens
tatggcaggagct

SEQ ID NO: 5938687 - DNA, 17 bp, Homo sapiens
tatggcaggataagaaa

SEQ ID NO: 5938688 - DNA, 13 bp, Homo sapiens
tatggcagtgtct

SEQ ID NO: 5938689 - DNA, 16 bp, Homo sapiens
tatggcagtgtctttc

SEQ ID NO: 5938690 - DNA, 19 bp, Homo sapiens
tatggcatattgataataa

SEQ ID NO: 5938691 - DNA, 15 bp, Homo sapiens
tatggcatgactctt

SEQ ID NO: 5938692 - DNA, 13 bp, Homo sapiens
tatggcatttgca

SEQ ID NO: 5938693 - DNA, 22 bp, Homo sapiens
tatggccaggaagtagcacagg

SEQ ID NO: 5938694 - DNA, 16 bp, Homo sapiens
tatggccagtctgccc

SEQ ID NO: 5938695 - DNA, 14 bp, Homo sapiens
tatggccatgccct

SEQ ID NO: 5938696 - DNA, 19 bp, Homo sapiens
tatggccatgccctagacc

SEQ ID NO: 5938697 - DNA, 16 bp, Homo sapiens
tatggcccaggcagcc

SEQ ID NO: 5938698 - DNA, 17 bp, Homo sapiens
tatggcccaggcagcct

SEQ ID NO: 5938699 - DNA, 16 bp, Homo sapiens
tatggcccatctgtat

SEQ ID NO: 5938700 - DNA, 20 bp, Homo sapiens
tatggccctggcctagcata

SEQ ID NO: 5938701 - DNA, 16 bp, Homo sapiens
tatggcctgacagctc

SEQ ID NO: 5938702 - DNA, 17 bp, Homo sapiens
tatggcctgacagctct

SEQ ID NO: 5938703 - DNA, 22 bp, Homo sapiens
tatggcctgtgagctaggaatt

SEQ ID NO: 5938704 - DNA, 16 bp, Homo sapiens
tatggcggaggccatg

SEQ ID NO: 5938705 - DNA, 19 bp, Homo sapiens
tatggcggcctgcagtggt

SEQ ID NO: 5938706 - DNA, 21 bp, Homo sapiens
tatggcgtaagtacagagaag

SEQ ID NO: 5938707 - DNA, 23 bp, Homo sapiens
tatggcgtaagtacagagaagcc

SEQ ID NO: 5938708 - DNA, 17 bp, Homo sapiens
tatggcgttttgtctgt

SEQ ID NO: 5938709 - DNA, 16 bp, Homo sapiens
tatggctataggtgct

SEQ ID NO: 5938710 - DNA, 20 bp, Homo sapiens
tatggctcatgtctgaaaaa

SEQ ID NO: 5938711 - DNA, 16 bp, Homo sapiens
tatggctctaacatta

SEQ ID NO: 5938712 - DNA, 16 bp, Homo sapiens
tatggctcttcacctg

SEQ ID NO: 5938713 - DNA, 18 bp, Homo sapiens
tatggctgatttatttct

SEQ ID NO: 5938714 - DNA, 16 bp, Homo sapiens
tatggctgcagtcctc

SEQ ID NO: 5938715 - DNA, 18 bp, Homo sapiens
tatggctgtatttgctgt

SEQ ID NO: 5938716 - DNA, 22 bp, Homo sapiens
tatggcttatttctatgacaaa

SEQ ID NO: 5938717 - DNA, 23 bp, Homo sapiens
tatggcttatttctatgacaaat

SEQ ID NO: 5938718 - DNA, 18 bp, Homo sapiens
tatggcttgtgaactgct

SEQ ID NO: 5938719 - DNA, 18 bp, Homo sapiens
tatgggaaaaaaactgaa

SEQ ID NO: 5938720 - DNA, 17 bp, Homo sapiens
tatgggaacaagtgtac

SEQ ID NO: 5938721 - DNA, 20 bp, Homo sapiens
tatgtgcagcgacccttggt

SEQ ID NO: 5938722 - DNA, 14 bp, Homo sapiens
tatgtgcagtcttg

SEQ ID NO: 5938723 - DNA, 16 bp, Homo sapiens
tatgtgcatagataca

SEQ ID NO: 5938724 - DNA, 23 bp, Homo sapiens
tatgtgcattattcataaaaaat

SEQ ID NO: 5938725 - DNA, 16 bp, Homo sapiens
tatgtgccaaagcttt

SEQ ID NO: 5938726 - DNA, 19 bp, Homo sapiens
tatgtgccaaagctttact

SEQ ID NO: 5938727 - DNA, 18 bp, Homo sapiens
tatgtgccaggcttgcct

SEQ ID NO: 5938728 - DNA, 23 bp, Homo sapiens
tatgtgccaggcttgcctgggct

SEQ ID NO: 5938729 - DNA, 19 bp, Homo sapiens
tatgtgccccttccccatg

SEQ ID NO: 5938730 - DNA, 13 bp, Homo sapiens
tatgtgccttaag

SEQ ID NO: 5938731 - DNA, 23 bp, Homo sapiens
tatgtgccttctagaatacatat

SEQ ID NO: 5938732 - DNA, 15 bp, Homo sapiens
tatgtgcctttttgt

SEQ ID NO: 5938733 - DNA, 20 bp, Homo sapiens
tatgtgcgaagcaagaagaa

SEQ ID NO: 5938734 - DNA, 22 bp, Homo sapiens
tatgtgcgaagcaagaagaatt

SEQ ID NO: 5938735 - DNA, 15 bp, Homo sapiens
tatgtgctatgcaaa

SEQ ID NO: 5938736 - DNA, 21 bp, Homo sapiens
tatgtgctatgcaaaatagac

SEQ ID NO: 5938737 - DNA, 15 bp, Homo sapiens
tatgtgctgtaattt

SEQ ID NO: 5938738 - DNA, 16 bp, Homo sapiens
tatgtgcttctcagtt

SEQ ID NO: 5938739 - DNA, 15 bp, Homo sapiens
tatgtgcttgtgtgt

SEQ ID NO: 5938740 - DNA, 17 bp, Homo sapiens
tatgtggaagtatacct

SEQ ID NO: 5938741 - DNA, 18 bp, Homo sapiens
tatgtggaagtatacctg

SEQ ID NO: 5938742 - DNA, 12 bp, Homo sapiens
tatgtggaagtg

SEQ ID NO: 5938743 - DNA, 16 bp, Homo sapiens
tatgtggaagtgtggg

SEQ ID NO: 5938744 - DNA, 20 bp, Homo sapiens
tatgtggagttcatcttgaa

SEQ ID NO: 5938745 - DNA, 18 bp, Homo sapiens
tatgtggatacagtcatt

SEQ ID NO: 5938746 - DNA, 17 bp, Homo sapiens
tatgtggcaaaacatat

SEQ ID NO: 5938747 - DNA, 20 bp, Homo sapiens
tatgtggcatggcagaatga

SEQ ID NO: 5938748 - DNA, 21 bp, Homo sapiens
tatgtggctgaaaatgcaaag

SEQ ID NO: 5938749 - DNA, 23 bp, Homo sapiens
tatgtggctgaaaatgcaaagct

SEQ ID NO: 5938750 - DNA, 20 bp, Homo sapiens
tatgtggcttttatttcagt

SEQ ID NO: 5938751 - DNA, 17 bp, Homo sapiens
tatgtgggcagattttc

SEQ ID NO: 5938752 - DNA, 19 bp, Homo sapiens
tatgtgggggtctgtgtgt

SEQ ID NO: 5938753 - DNA, 20 bp, Homo sapiens
tatgtgggggtctgtgtgtt

SEQ ID NO: 5938754 - DNA, 18 bp, Homo sapiens
tatgtggtccatctctga

SEQ ID NO: 5938755 - DNA, 19 bp, Homo sapiens
tatgtggtttccacgatga

SEQ ID NO: 5938756 - DNA, 16 bp, Homo sapiens
tatgtggttttagatt

SEQ ID NO: 5938757 - DNA, 18 bp, Homo sapiens
tatgtggttttagatttt

SEQ ID NO: 5938758 - DNA, 19 bp, Homo sapiens
tatgtggttttagattttc

SEQ ID NO: 5938759 - DNA, 17 bp, Homo sapiens
tatgtggttttgtaatt

SEQ ID NO: 5938760 - DNA, 17 bp, Homo sapiens
tatgtgtaaaatgtgaa

SEQ ID NO: 5938761 - DNA, 12 bp, Homo sapiens
tatgtgtaaaga

SEQ ID NO: 5938762 - DNA, 16 bp, Homo sapiens
tatgtgtaactttttt

SEQ ID NO: 5938763 - DNA, 14 bp, Homo sapiens
tatgtgtaatatca

SEQ ID NO: 5938764 - DNA, 15 bp, Homo sapiens
tatgtgtaatatcat

SEQ ID NO: 5938765 - DNA, 12 bp, Homo sapiens
tatgtgtaattt

SEQ ID NO: 5938766 - DNA, 14 bp, Homo sapiens
tatgtgtaggtgaa

SEQ ID NO: 5938767 - DNA, 20 bp, Homo sapiens
tatgtgtagtgtgtttgtga

SEQ ID NO: 5938768 - DNA, 20 bp, Homo sapiens
tatgtgtagttataaaccaa

SEQ ID NO: 5938769 - DNA, 14 bp, Homo sapiens
tatgtgtatatata

SEQ ID NO: 5938770 - DNA, 22 bp, Homo sapiens
tatgtgtatatatacatacact

SEQ ID NO: 5938771 - DNA, 23 bp, Homo sapiens
tatgtgtatatattatatataca

SEQ ID NO: 5938772 - DNA, 14 bp, Homo sapiens
tatgtgtatatgtt

SEQ ID NO: 5938773 - DNA, 22 bp, Homo sapiens
tatgtgtatatgtttatacaca

SEQ ID NO: 5938774 - DNA, 17 bp, Homo sapiens
tatgtgtatctcacact

SEQ ID NO: 5938775 - DNA, 15 bp, Homo sapiens
tatgtgtatgcaagt

SEQ ID NO: 5938776 - DNA, 13 bp, Homo sapiens
tatgtgtatgtac

SEQ ID NO: 5938777 - DNA, 17 bp, Homo sapiens
tatgtgtcacagctctg

SEQ ID NO: 5938778 - DNA, 12 bp, Homo sapiens
tatgtgtctccc

SEQ ID NO: 5938779 - DNA, 18 bp, Homo sapiens
tatgtgtctcccaggtgc

SEQ ID NO: 5938780 - DNA, 18 bp, Homo sapiens
tatgtgtctgctaatgta

SEQ ID NO: 5938781 - DNA, 21 bp, Homo sapiens
tatgtgtctggaagaagcagc

SEQ ID NO: 5938782 - DNA, 16 bp, Homo sapiens
tatgtgtctttataga

SEQ ID NO: 5938783 - DNA, 20 bp, Homo sapiens
tatgtgtctttatagatgta

SEQ ID NO: 5938784 - DNA, 14 bp, Homo sapiens
tatgtgtgaaacaa

SEQ ID NO: 5938785 - DNA, 17 bp, Homo sapiens
tatgtgtgaaacaatgt

SEQ ID NO: 5938786 - DNA, 14 bp, Homo sapiens
tatgtgtgaagtga

SEQ ID NO: 5938787 - DNA, 16 bp, Homo sapiens
tatgtgtgagatatgt

SEQ ID NO: 5938788 - DNA, 18 bp, Homo sapiens
tatgtgtgagatatgtgt

SEQ ID NO: 5938789 - DNA, 16 bp, Homo sapiens
tatgtgtgaggagctg

SEQ ID NO: 5938790 - DNA, 19 bp, Homo sapiens
tatgtgtgagtgtatgtat

SEQ ID NO: 5938791 - DNA, 22 bp, Homo sapiens
tatgtgtgagtgtatgtataca

SEQ ID NO: 5938792 - DNA, 17 bp, Homo sapiens
tatgtgtgcatgtgtgt

SEQ ID NO: 5938793 - DNA, 15 bp, Homo sapiens
tatgtgtgccctgga

SEQ ID NO: 5938794 - DNA, 17 bp, Homo sapiens
tatgtgtgccctggact

SEQ ID NO: 5938795 - DNA, 19 bp, Homo sapiens
tatgtgtggctgtgggtgt

SEQ ID NO: 5938796 - DNA, 16 bp, Homo sapiens
tatgtgtgtagactgt

SEQ ID NO: 5938797 - DNA, 19 bp, Homo sapiens
tatgtgtgtaggttatctt

SEQ ID NO: 5938798 - DNA, 15 bp, Homo sapiens
tatgtgtgtctattt

SEQ ID NO: 5938799 - DNA, 19 bp, Homo sapiens
tatgtgtgtggtgtgtgtg

SEQ ID NO: 5938800 - DNA, 19 bp, Homo sapiens
tatgtgtgtgtatgtttgc

SEQ ID NO: 5938801 - DNA, 21 bp, Homo sapiens
tatgtgtgtgtgtgtgtgtaa

SEQ ID NO: 5938802 - DNA, 22 bp, Homo sapiens
tatgtgtgtgtgttgtgtgtgg

SEQ ID NO: 5938803 - DNA, 23 bp, Homo sapiens
tatgtgtgtgtgttgtgtgtggg

SEQ ID NO: 5938804 - DNA, 20 bp, Homo sapiens
tatgtgtgttgtttccatag

SEQ ID NO: 5938805 - DNA, 13 bp, Homo sapiens
tatgtgtgtttaa

SEQ ID NO: 5938806 - DNA, 14 bp, Homo sapiens
tatgtgtgtttaaa

SEQ ID NO: 5938807 - DNA, 17 bp, Homo sapiens
tatgtgtgtttaaataa

SEQ ID NO: 5938808 - DNA, 21 bp, Homo sapiens
tatgtgtgtttaaataaagta

SEQ ID NO: 5938809 - DNA, 15 bp, Homo sapiens
tatgtgttacttcaa

SEQ ID NO: 5938810 - DNA, 15 bp, Homo sapiens
tatgtgttatgaaca

SEQ ID NO: 5938811 - DNA, 20 bp, Homo sapiens
tatgtgttcctcttgttcta

SEQ ID NO: 5938812 - DNA, 13 bp, Homo sapiens
tatgtgttctatt

SEQ ID NO: 5938813 - DNA, 18 bp, Homo sapiens
tatgtgttgaaaaccaaa

SEQ ID NO: 5938814 - DNA, 14 bp, Homo sapiens
tatgtgtttctgta

SEQ ID NO: 5938815 - DNA, 17 bp, Homo sapiens
tatgtgtttggatacat

SEQ ID NO: 5938816 - DNA, 21 bp, Homo sapiens
tatgtgtttggatacatctgc

SEQ ID NO: 5938817 - DNA, 22 bp, Homo sapiens
tatgtgtttggatacatctgct

SEQ ID NO: 5938818 - DNA, 15 bp, Homo sapiens
tatgttaaaagattt

SEQ ID NO: 5938819 - DNA, 13 bp, Homo sapiens
tatgttaaactct

SEQ ID NO: 5938820 - DNA, 15 bp, Homo sapiens
tatgttaaactctgt

SEQ ID NO: 5938821 - DNA, 14 bp, Homo sapiens
tatgttaacagatg

SEQ ID NO: 5938822 - DNA, 16 bp, Homo sapiens
tatgttaacctaggca

SEQ ID NO: 5938823 - DNA, 19 bp, Homo sapiens
tatgttaagctctttatga

SEQ ID NO: 5938824 - DNA, 18 bp, Homo sapiens
tatgttaataaactgcaa

SEQ ID NO: 5938825 - DNA, 16 bp, Homo sapiens
tatgttaatatttctg

SEQ ID NO: 5938826 - DNA, 19 bp, Homo sapiens
tatgttacatctgttttaa

SEQ ID NO: 5938827 - DNA, 22 bp, Homo sapiens
tatgttacatctgttttaaatt

SEQ ID NO: 5938828 - DNA, 12 bp, Homo sapiens
tatgttactatt

SEQ ID NO: 5938829 - DNA, 16 bp, Homo sapiens
tatgttactattttct

SEQ ID NO: 5938830 - DNA, 20 bp, Homo sapiens
tatgttagagtcatttctga

SEQ ID NO: 5938831 - DNA, 21 bp, Homo sapiens
tatgttagcattaaagttcta

SEQ ID NO: 5938832 - DNA, 19 bp, Homo sapiens
tatgttagtgcaaattgtc

SEQ ID NO: 5938833 - DNA, 21 bp, Homo sapiens
tatgttatacaaccttcattt

SEQ ID NO: 5938834 - DNA, 22 bp, Homo sapiens
tatgttatagaacttcatggat

SEQ ID NO: 5938835 - DNA, 14 bp, Homo sapiens
tatgttatatcaac

SEQ ID NO: 5938836 - DNA, 19 bp, Homo sapiens
tatgttatcaccttccaaa

SEQ ID NO: 5938837 - DNA, 14 bp, Homo sapiens
tatgttatgaaaac

SEQ ID NO: 5938838 - DNA, 15 bp, Homo sapiens
tatgttatgaaaacc

SEQ ID NO: 5938839 - DNA, 14 bp, Homo sapiens
tatgttatgaggat

SEQ ID NO: 5938840 - DNA, 15 bp, Homo sapiens
tatgttattaaacag

SEQ ID NO: 5938841 - DNA, 22 bp, Homo sapiens
tatgttattcctggttaagcag

SEQ ID NO: 5938842 - DNA, 20 bp, Homo sapiens
tatgttattggaattttctt

SEQ ID NO: 5938843 - DNA, 16 bp, Homo sapiens
tatgttatttatagct

SEQ ID NO: 5938844 - DNA, 18 bp, Homo sapiens
tatgttatttatgatgtt

SEQ ID NO: 5938845 - DNA, 19 bp, Homo sapiens
tatgttcaatgaatattgt

SEQ ID NO: 5938846 - DNA, 13 bp, Homo sapiens
tatgttcactgtc

SEQ ID NO: 5938847 - DNA, 14 bp, Homo sapiens
tatgttcatttgtt

SEQ ID NO: 5938848 - DNA, 19 bp, Homo sapiens
tatgttcccagcagtgggg

SEQ ID NO: 5938849 - DNA, 12 bp, Homo sapiens
tatgttcctgct

SEQ ID NO: 5938850 - DNA, 14 bp, Homo sapiens
tatgttcctgctgt

SEQ ID NO: 5938851 - DNA, 18 bp, Homo sapiens
tatgttctaacctttaca

SEQ ID NO: 5938852 - DNA, 23 bp, Homo sapiens
tatgttctagtgatttcctgtat

SEQ ID NO: 5938853 - DNA, 23 bp, Homo sapiens
tatgttctcccctacattagtaa

SEQ ID NO: 5938854 - DNA, 13 bp, Homo sapiens
tatgttctctgaa

SEQ ID NO: 5938855 - DNA, 17 bp, Homo sapiens
tatgttctgtcttccca

SEQ ID NO: 5938856 - DNA, 16 bp, Homo sapiens
tatgttcttctgttat

SEQ ID NO: 5938857 - DNA, 14 bp, Homo sapiens
tatgttcttgaaga

SEQ ID NO: 5938858 - DNA, 12 bp, Homo sapiens
tatgttcttggc

SEQ ID NO: 5938859 - DNA, 13 bp, Homo sapiens
tatgttcttggct

SEQ ID NO: 5938860 - DNA, 23 bp, Homo sapiens
tatgttcttgggtggttcctaag

SEQ ID NO: 5938861 - DNA, 15 bp, Homo sapiens
tatgttgaatacttt

SEQ ID NO: 5938862 - DNA, 18 bp, Homo sapiens
tatgttgaatacttttta

SEQ ID NO: 5938863 - DNA, 13 bp, Homo sapiens
tatgttgacattt

SEQ ID NO: 5938864 - DNA, 16 bp, Homo sapiens
tatgttgacatttgtt

SEQ ID NO: 5938865 - DNA, 13 bp, Homo sapiens
tatgttgacttta

SEQ ID NO: 5938866 - DNA, 12 bp, Homo sapiens
tatgttgatact

SEQ ID NO: 5938867 - DNA, 16 bp, Homo sapiens
tatgttgcatagaata

SEQ ID NO: 5938868 - DNA, 21 bp, Homo sapiens
tatgttgctattgtaaggtct

SEQ ID NO: 5938869 - DNA, 21 bp, Homo sapiens
tatgttgggggggaccctgcc

SEQ ID NO: 5938870 - DNA, 23 bp, Homo sapiens
tatgttgggggggaccctgcctc

SEQ ID NO: 5938871 - DNA, 20 bp, Homo sapiens
tatgttggttgatataacac

SEQ ID NO: 5938872 - DNA, 20 bp, Homo sapiens
tatgttggtttaattaataa

SEQ ID NO: 5938873 - DNA, 15 bp, Homo sapiens
tatgttggtttcagt

SEQ ID NO: 5938874 - DNA, 17 bp, Homo sapiens
tatgttggtttcagtgg

SEQ ID NO: 5938875 - DNA, 14 bp, Homo sapiens
tatgttgtaataaa

SEQ ID NO: 5938876 - DNA, 17 bp, Homo sapiens
tatgttgtaatataatg

SEQ ID NO: 5938877 - DNA, 22 bp, Homo sapiens
tatgttgtaatatttcttcaaa

SEQ ID NO: 5938878 - DNA, 17 bp, Homo sapiens
tatgttgtacaatcaaa

SEQ ID NO: 5938879 - DNA, 15 bp, Homo sapiens
tatgttgtacatact

SEQ ID NO: 5938880 - DNA, 19 bp, Homo sapiens
tatgttgtatgattccaat

SEQ ID NO: 5938881 - DNA, 15 bp, Homo sapiens
tatgttgtattaact

SEQ ID NO: 5938882 - DNA, 17 bp, Homo sapiens
tatgttgtattaactgg

SEQ ID NO: 5938883 - DNA, 19 bp, Homo sapiens
tatgttgtattaactgggt

SEQ ID NO: 5938884 - DNA, 15 bp, Homo sapiens
tatgttgtgaagatg

SEQ ID NO: 5938885 - DNA, 14 bp, Homo sapiens
tatgttgtgtaagt

SEQ ID NO: 5938886 - DNA, 16 bp, Homo sapiens
tatgttgtttacctga

SEQ ID NO: 5938887 - DNA, 19 bp, Homo sapiens
tatgtttaaaatggcattt

SEQ ID NO: 5938888 - DNA, 22 bp, Homo sapiens
tatgtttaagatatatttccaa

SEQ ID NO: 5938889 - DNA, 13 bp, Homo sapiens
tatgtttaatgtt

SEQ ID NO: 5938890 - DNA, 14 bp, Homo sapiens
tatgtttacatatc

SEQ ID NO: 5938891 - DNA, 18 bp, Homo sapiens
tatgtttaccttttaatt

SEQ ID NO: 5938892 - DNA, 16 bp, Homo sapiens
tatgtttagataaaat

SEQ ID NO: 5938893 - DNA, 19 bp, Homo sapiens
tatgtttatgtaacatagt

SEQ ID NO: 5938894 - DNA, 13 bp, Homo sapiens
tatgtttattaca

SEQ ID NO: 5938895 - DNA, 15 bp, Homo sapiens
tatgtttattcaaaa

SEQ ID NO: 5938896 - DNA, 13 bp, Homo sapiens
tatgtttcaaact

SEQ ID NO: 5938897 - DNA, 15 bp, Homo sapiens
tatgtttcaaacttt

SEQ ID NO: 5938898 - DNA, 16 bp, Homo sapiens
tatgtttcaaactttg

SEQ ID NO: 5938899 - DNA, 18 bp, Homo sapiens
tattaagacaatagcact

SEQ ID NO: 5938900 - DNA, 21 bp, Homo sapiens
tattaagacaatagcacttaa

SEQ ID NO: 5938901 - DNA, 12 bp, Homo sapiens
tattaagactgg

SEQ ID NO: 5938902 - DNA, 20 bp, Homo sapiens
tattaagaggtaagacttag

SEQ ID NO: 5938903 - DNA, 16 bp, Homo sapiens
tattaagatggattct

SEQ ID NO: 5938904 - DNA, 15 bp, Homo sapiens
tattaagatttccaa

SEQ ID NO: 5938905 - DNA, 21 bp, Homo sapiens
tattaagcacattattgtaga

SEQ ID NO: 5938906 - DNA, 24 bp, Homo sapiens
tattaagcacattattgtagagaa

SEQ ID NO: 5938907 - DNA, 19 bp, Homo sapiens
tattaagcagtacaaatgt

SEQ ID NO: 5938908 - DNA, 22 bp, Homo sapiens
tattaagcagttcattctacca

SEQ ID NO: 5938909 - DNA, 20 bp, Homo sapiens
tattaagccaggaaacatga

SEQ ID NO: 5938910 - DNA, 22 bp, Homo sapiens
tattaagcctaccgtatttcag

SEQ ID NO: 5938911 - DNA, 23 bp, Homo sapiens
tattaagcctaccgtatttcagc

SEQ ID NO: 5938912 - DNA, 13 bp, Homo sapiens
tattaagctaaaa

SEQ ID NO: 5938913 - DNA, 19 bp, Homo sapiens
tattaagctccagtgcttt

SEQ ID NO: 5938914 - DNA, 19 bp, Homo sapiens
tattaagctttttggaatc

SEQ ID NO: 5938915 - DNA, 16 bp, Homo sapiens
tattaaggaaaaaagc

SEQ ID NO: 5938916 - DNA, 17 bp, Homo sapiens
tattaaggaaaaaagca

SEQ ID NO: 5938917 - DNA, 16 bp, Homo sapiens
tattaaggatgtagct

SEQ ID NO: 5938918 - DNA, 18 bp, Homo sapiens
tattaaggatgtagcttt

SEQ ID NO: 5938919 - DNA, 14 bp, Homo sapiens
tattaagggaaagg

SEQ ID NO: 5938920 - DNA, 21 bp, Homo sapiens
tattaagggaaaggaaaagaa

SEQ ID NO: 5938921 - DNA, 17 bp, Homo sapiens
tattaagggatttagta

SEQ ID NO: 5938922 - DNA, 17 bp, Homo sapiens
tattaagtaaaaaatat

SEQ ID NO: 5938923 - DNA, 14 bp, Homo sapiens
tattaagtaaaatc

SEQ ID NO: 5938924 - DNA, 20 bp, Homo sapiens
tattaagtaagtctcaaggt

SEQ ID NO: 5938925 - DNA, 17 bp, Homo sapiens
tattaagtatatttgta

SEQ ID NO: 5938926 - DNA, 18 bp, Homo sapiens
tattaagtatatttgtaa

SEQ ID NO: 5938927 - DNA, 22 bp, Homo sapiens
tattaagtatatttgtaaaagc

SEQ ID NO: 5938928 - DNA, 22 bp, Homo sapiens
tattaagtctgggatgtagaac

SEQ ID NO: 5938929 - DNA, 13 bp, Homo sapiens
tattaagtgaaat

SEQ ID NO: 5938930 - DNA, 15 bp, Homo sapiens
tattaagtgaaattt

SEQ ID NO: 5938931 - DNA, 17 bp, Homo sapiens
tattaagtgaaatttta

SEQ ID NO: 5938932 - DNA, 20 bp, Homo sapiens
tattaagttcgaacatgttt

SEQ ID NO: 5938933 - DNA, 22 bp, Homo sapiens
tattaagttcgaacatgtttca

SEQ ID NO: 5938934 - DNA, 16 bp, Homo sapiens
tattaataaaaagaca

SEQ ID NO: 5938935 - DNA, 14 bp, Homo sapiens
tattaataaaacaa

SEQ ID NO: 5938936 - DNA, 21 bp, Homo sapiens
tattaataaaactttatgtac

SEQ ID NO: 5938937 - DNA, 14 bp, Homo sapiens
tattaataaagcat

SEQ ID NO: 5938938 - DNA, 14 bp, Homo sapiens
tattaataaataga

SEQ ID NO: 5938939 - DNA, 15 bp, Homo sapiens
tattaataaatttta

SEQ ID NO: 5938940 - DNA, 20 bp, Homo sapiens
tattaataaattttaacatt

SEQ ID NO: 5938941 - DNA, 21 bp, Homo sapiens
tattaatacaatgatgctatt

SEQ ID NO: 5938942 - DNA, 23 bp, Homo sapiens
tattaatacaatgatgctatttg

SEQ ID NO: 5938943 - DNA, 16 bp, Homo sapiens
tattaataccaaatat

SEQ ID NO: 5938944 - DNA, 17 bp, Homo sapiens
tattaatagctgcctta

SEQ ID NO: 5938945 - DNA, 15 bp, Homo sapiens
tattaatataagttt

SEQ ID NO: 5938946 - DNA, 18 bp, Homo sapiens
tattaatatatattatct

SEQ ID NO: 5938947 - DNA, 22 bp, Homo sapiens
tattaatatatattatcttttc

SEQ ID NO: 5938948 - DNA, 17 bp, Homo sapiens
tattaatatcaactctg

SEQ ID NO: 5938949 - DNA, 16 bp, Homo sapiens
tattaatatctccata

SEQ ID NO: 5938950 - DNA, 22 bp, Homo sapiens
tattaatattcagggtaaatag

SEQ ID NO: 5938951 - DNA, 17 bp, Homo sapiens
tattaatatttgcacat

SEQ ID NO: 5938952 - DNA, 13 bp, Homo sapiens
tattaatatttgt

SEQ ID NO: 5938953 - DNA, 19 bp, Homo sapiens
tattaatcaactttcctta

SEQ ID NO: 5938954 - DNA, 14 bp, Homo sapiens
tattaatcaagaga

SEQ ID NO: 5938955 - DNA, 18 bp, Homo sapiens
tattaatcaagagaaact

SEQ ID NO: 5938956 - DNA, 20 bp, Homo sapiens
tattaatcaagagaaacttc

SEQ ID NO: 5938957 - DNA, 19 bp, Homo sapiens
tattaatcaccttctttgt

SEQ ID NO: 5938958 - DNA, 12 bp, Homo sapiens
tattaatcactg

SEQ ID NO: 5938959 - DNA, 15 bp, Homo sapiens
tattaatcactgtgt

SEQ ID NO: 5938960 - DNA, 16 bp, Homo sapiens
tattaatcactgtgta

SEQ ID NO: 5938961 - DNA, 22 bp, Homo sapiens
tattaatcactgtgtatatttg

SEQ ID NO: 5938962 - DNA, 17 bp, Homo sapiens
tattaatcagaagaaaa

SEQ ID NO: 5938963 - DNA, 12 bp, Homo sapiens
tattaatcattc

SEQ ID NO: 5938964 - DNA, 12 bp, Homo sapiens
tattaatctact

SEQ ID NO: 5938965 - DNA, 17 bp, Homo sapiens
tattaatcttattgttt

SEQ ID NO: 5938966 - DNA, 17 bp, Homo sapiens
tattaatgaactgtgac

SEQ ID NO: 5938967 - DNA, 22 bp, Homo sapiens
tattaatgaactgtgacaggaa

SEQ ID NO: 5938968 - DNA, 14 bp, Homo sapiens
tattaatgcacttt

SEQ ID NO: 5938969 - DNA, 13 bp, Homo sapiens
tattaatgccttt

SEQ ID NO: 5938970 - DNA, 12 bp, Homo sapiens
tattaatgctaa

SEQ ID NO: 5938971 - DNA, 13 bp, Homo sapiens
tattaatgctaag

SEQ ID NO: 5938972 - DNA, 21 bp, Homo sapiens
tattaatggaaacatgctgta

SEQ ID NO: 5938973 - DNA, 17 bp, Homo sapiens
tattaatggcatgtaat

SEQ ID NO: 5938974 - DNA, 17 bp, Homo sapiens
tattaatgttttcaaaa

SEQ ID NO: 5938975 - DNA, 14 bp, Homo sapiens
tattaattatctga

SEQ ID NO: 5938976 - DNA, 13 bp, Homo sapiens
tattaattattta

SEQ ID NO: 5938977 - DNA, 22 bp, Homo sapiens
tattaattcaggttttttagtt

SEQ ID NO: 5938978 - DNA, 13 bp, Homo sapiens
tattaattcttca

SEQ ID NO: 5938979 - DNA, 17 bp, Homo sapiens
tattaattgtcctgtgt

SEQ ID NO: 5938980 - DNA, 21 bp, Homo sapiens
tattaattgttttgcactttt

SEQ ID NO: 5938981 - DNA, 22 bp, Homo sapiens
tattaatttagcctttaataat

SEQ ID NO: 5938982 - DNA, 19 bp, Homo sapiens
tattaatttatatttgtct

SEQ ID NO: 5938983 - DNA, 15 bp, Homo sapiens
tattaatttattaaa

SEQ ID NO: 5938984 - DNA, 14 bp, Homo sapiens
tattaatttattta

SEQ ID NO: 5938985 - DNA, 21 bp, Homo sapiens
tattaatttatttgtcgtgtt

SEQ ID NO: 5938986 - DNA, 13 bp, Homo sapiens
tattaatttgaaa

SEQ ID NO: 5938987 - DNA, 13 bp, Homo sapiens
tattaatttgttt

SEQ ID NO: 5938988 - DNA, 19 bp, Homo sapiens
tattaattttctacaaata

SEQ ID NO: 5938989 - DNA, 22 bp, Homo sapiens
tattacaaatattgtcatcttt

SEQ ID NO: 5938990 - DNA, 11 bp, Homo sapiens
tattacaaatc

SEQ ID NO: 5938991 - DNA, 19 bp, Homo sapiens
tattacaaatgcaaatttc

SEQ ID NO: 5938992 - DNA, 18 bp, Homo sapiens
tattacaaattttcactg

SEQ ID NO: 5938993 - DNA, 20 bp, Homo sapiens
tattacaacaagcaaactga

SEQ ID NO: 5938994 - DNA, 22 bp, Homo sapiens
tattacaacaagcaaactgaaa

SEQ ID NO: 5938995 - DNA, 13 bp, Homo sapiens
tattacaacattt

SEQ ID NO: 5938996 - DNA, 15 bp, Homo sapiens
tattacaacatttat

SEQ ID NO: 5938997 - DNA, 16 bp, Homo sapiens
tattacaagtaatgta

SEQ ID NO: 5938998 - DNA, 17 bp, Homo sapiens
tattacaagtaatgtaa

SEQ ID NO: 5938999 - DNA, 12 bp, Homo sapiens
tattacaatatt

SEQ ID NO: 5939000 - DNA, 14 bp, Homo sapiens
tattacaatatttg

SEQ ID NO: 5939001 - DNA, 14 bp, Homo sapiens
tattacaatgatca

SEQ ID NO: 5939002 - DNA, 15 bp, Homo sapiens
tattacaatttgtat

SEQ ID NO: 5939003 - DNA, 13 bp, Homo sapiens
tattacaattttt

SEQ ID NO: 5939004 - DNA, 19 bp, Homo sapiens
tattacacctcagaaattg

SEQ ID NO: 5939005 - DNA, 23 bp, Homo sapiens
tattacacctcagaaattgaaag

SEQ ID NO: 5939006 - DNA, 15 bp, Homo sapiens
tattacagaaatgtt

SEQ ID NO: 5939007 - DNA, 14 bp, Homo sapiens
tattacagtataat

SEQ ID NO: 5939008 - DNA, 15 bp, Homo sapiens
tattacagtattgct

SEQ ID NO: 5939009 - DNA, 15 bp, Homo sapiens
tattacagtccttca

SEQ ID NO: 5939010 - DNA, 12 bp, Homo sapiens
tattacagtctt

SEQ ID NO: 5939011 - DNA, 13 bp, Homo sapiens
tattacagtctta

SEQ ID NO: 5939012 - DNA, 19 bp, Homo sapiens
tattacagtgttggagaac

SEQ ID NO: 5939013 - DNA, 15 bp, Homo sapiens
tattacataaaacac

SEQ ID NO: 5939014 - DNA, 13 bp, Homo sapiens
tattacataaata

SEQ ID NO: 5939015 - DNA, 14 bp, Homo sapiens
tattacataaataa

SEQ ID NO: 5939016 - DNA, 21 bp, Homo sapiens
tattacataactgatctattt

SEQ ID NO: 5939017 - DNA, 14 bp, Homo sapiens
tattacatctaatg

SEQ ID NO: 5939018 - DNA, 17 bp, Homo sapiens
tattacatctaatgctt

SEQ ID NO: 5939019 - DNA, 22 bp, Homo sapiens
tattacatctttattaacctca

SEQ ID NO: 5939020 - DNA, 14 bp, Homo sapiens
tattacatgactgt

SEQ ID NO: 5939021 - DNA, 16 bp, Homo sapiens
tattacatggcagtgt

SEQ ID NO: 5939022 - DNA, 17 bp, Homo sapiens
tattacatgtaaagctg

SEQ ID NO: 5939023 - DNA, 16 bp, Homo sapiens
tattacattagttaag

SEQ ID NO: 5939024 - DNA, 13 bp, Homo sapiens
tattacattgcat

SEQ ID NO: 5939025 - DNA, 20 bp, Homo sapiens
tattacatttaaatccttgt

SEQ ID NO: 5939026 - DNA, 12 bp, Homo sapiens
tattacatttca

SEQ ID NO: 5939027 - DNA, 18 bp, Homo sapiens
tattacatttcatttata

SEQ ID NO: 5939028 - DNA, 19 bp, Homo sapiens
tattacatttcatttatac

SEQ ID NO: 5939029 - DNA, 19 bp, Homo sapiens
tattaccaaaaaagtattt

SEQ ID NO: 5939030 - DNA, 21 bp, Homo sapiens
tattaccaaaaaagtattttt

SEQ ID NO: 5939031 - DNA, 19 bp, Homo sapiens
tattaccaccctttcacaa

SEQ ID NO: 5939032 - DNA, 20 bp, Homo sapiens
tattaccactgaagatagaa

SEQ ID NO: 5939033 - DNA, 19 bp, Homo sapiens
tattaccacttagaagatg

SEQ ID NO: 5939034 - DNA, 22 bp, Homo sapiens
tattaccagattcacttctgaa

SEQ ID NO: 5939035 - DNA, 21 bp, Homo sapiens
tattaccagcaagaataaaaa

SEQ ID NO: 5939036 - DNA, 22 bp, Homo sapiens
tattaccagtggcgttgttgca

SEQ ID NO: 5939037 - DNA, 22 bp, Homo sapiens
tattaccatgtaaataatctgt

SEQ ID NO: 5939038 - DNA, 12 bp, Homo sapiens
tattaccccttc

SEQ ID NO: 5939039 - DNA, 15 bp, Homo sapiens
tattaccccttttcg

SEQ ID NO: 5939040 - DNA, 21 bp, Homo sapiens
tattaccctaagaatgctttg

SEQ ID NO: 5939041 - DNA, 23 bp, Homo sapiens
tattaccctaagaatgctttgcc

SEQ ID NO: 5939042 - DNA, 17 bp, Homo sapiens
tattacctaatgaaagt

SEQ ID NO: 5939043 - DNA, 14 bp, Homo sapiens
tattacctcaaatt

SEQ ID NO: 5939044 - DNA, 13 bp, Homo sapiens
tattacctctgat

SEQ ID NO: 5939045 - DNA, 14 bp, Homo sapiens
tattacctctgata

SEQ ID NO: 5939046 - DNA, 17 bp, Homo sapiens
tattaccttaagatttt

SEQ ID NO: 5939047 - DNA, 22 bp, Homo sapiens
tattaccttaagatttttcttt

SEQ ID NO: 5939048 - DNA, 20 bp, Homo sapiens
tattacgaagttcaagatca

SEQ ID NO: 5939049 - DNA, 15 bp, Homo sapiens
tattacgttgtttct

SEQ ID NO: 5939050 - DNA, 16 bp, Homo sapiens
tattacgttgtttctt

SEQ ID NO: 5939051 - DNA, 22 bp, Homo sapiens
tattactaaggagtaatctgtg

SEQ ID NO: 5939052 - DNA, 12 bp, Homo sapiens
tattactagtgt

SEQ ID NO: 5939053 - DNA, 16 bp, Homo sapiens
tattactagtgtttaa

SEQ ID NO: 5939054 - DNA, 22 bp, Homo sapiens
tattactagtgtttaagtcatt

SEQ ID NO: 5939055 - DNA, 22 bp, Homo sapiens
tattactagttagcatacacat

SEQ ID NO: 5939056 - DNA, 22 bp, Homo sapiens
tattactcccaggatcagcaga

SEQ ID NO: 5939057 - DNA, 20 bp, Homo sapiens
tattactcccctaagtcttt

SEQ ID NO: 5939058 - DNA, 16 bp, Homo sapiens
tattactctcaaaatc

SEQ ID NO: 5939059 - DNA, 17 bp, Homo sapiens
tattactctcattcttt

SEQ ID NO: 5939060 - DNA, 20 bp, Homo sapiens
tattactctcattctttgaa

SEQ ID NO: 5939061 - DNA, 16 bp, Homo sapiens
tattactgaataatat

SEQ ID NO: 5939062 - DNA, 23 bp, Homo sapiens
tattactgaataatatcaaataa

SEQ ID NO: 5939063 - DNA, 17 bp, Homo sapiens
tattactgacatttctt

SEQ ID NO: 5939064 - DNA, 15 bp, Homo sapiens
tattactgaggaaag

SEQ ID NO: 5939065 - DNA, 16 bp, Homo sapiens
tattactgatgtgtgc

SEQ ID NO: 5939066 - DNA, 13 bp, Homo sapiens
tattactgattta

SEQ ID NO: 5939067 - DNA, 16 bp, Homo sapiens
tattactgatttagaa

SEQ ID NO: 5939068 - DNA, 18 bp, Homo sapiens
tattactggataaattgt

SEQ ID NO: 5939069 - DNA, 17 bp, Homo sapiens
tattactgtcttttcta

SEQ ID NO: 5939070 - DNA, 16 bp, Homo sapiens
tattactgttgcattt

SEQ ID NO: 5939071 - DNA, 21 bp, Homo sapiens
tattactgtttatttctgttt

SEQ ID NO: 5939072 - DNA, 16 bp, Homo sapiens
tattactgtttgttct

SEQ ID NO: 5939073 - DNA, 17 bp, Homo sapiens
tattactgttttgggcc

SEQ ID NO: 5939074 - DNA, 12 bp, Homo sapiens
tattacttacaa

SEQ ID NO: 5939075 - DNA, 23 bp, Homo sapiens
tattacttaggttattttgcttt

SEQ ID NO: 5939076 - DNA, 23 bp, Homo sapiens
tattacttatttttgacagtgtt

SEQ ID NO: 5939077 - DNA, 18 bp, Homo sapiens
tattcagtgaaaagattt

SEQ ID NO: 5939078 - DNA, 19 bp, Homo sapiens
tattcagtgaaaagatttt

SEQ ID NO: 5939079 - DNA, 14 bp, Homo sapiens
tattcagtgaattt

SEQ ID NO: 5939080 - DNA, 16 bp, Homo sapiens
tattcagtgaatttgt

SEQ ID NO: 5939081 - DNA, 22 bp, Homo sapiens
tattcagtgccacaaattgaaa

SEQ ID NO: 5939082 - DNA, 15 bp, Homo sapiens
tattcagtgctgtgg

SEQ ID NO: 5939083 - DNA, 18 bp, Homo sapiens
tattcagtgctgtggcct

SEQ ID NO: 5939084 - DNA, 21 bp, Homo sapiens
tattcagtgctgtggcctggg

SEQ ID NO: 5939085 - DNA, 18 bp, Homo sapiens
tattcagtggtgaaatct

SEQ ID NO: 5939086 - DNA, 18 bp, Homo sapiens
tattcagttaagaaaaaa

SEQ ID NO: 5939087 - DNA, 16 bp, Homo sapiens
tattcagttcttacac

SEQ ID NO: 5939088 - DNA, 23 bp, Homo sapiens
tattcagttggtaagcttccagg

SEQ ID NO: 5939089 - DNA, 15 bp, Homo sapiens
tattcataaagagaa

SEQ ID NO: 5939090 - DNA, 18 bp, Homo sapiens
tattcataaagagaaaat

SEQ ID NO: 5939091 - DNA, 23 bp, Homo sapiens
tattcataagccaatttttctgc

SEQ ID NO: 5939092 - DNA, 18 bp, Homo sapiens
tattcataagtctttggt

SEQ ID NO: 5939093 - DNA, 14 bp, Homo sapiens
tattcataatgaat

SEQ ID NO: 5939094 - DNA, 23 bp, Homo sapiens
tattcataccttctgatgaagtt

SEQ ID NO: 5939095 - DNA, 23 bp, Homo sapiens
tattcatagcagcttattcacaa

SEQ ID NO: 5939096 - DNA, 14 bp, Homo sapiens
tattcatagctgta

SEQ ID NO: 5939097 - DNA, 13 bp, Homo sapiens
tattcatatattg

SEQ ID NO: 5939098 - DNA, 13 bp, Homo sapiens
tattcatatgcat

SEQ ID NO: 5939099 - DNA, 14 bp, Homo sapiens
tattcatatgcata

SEQ ID NO: 5939100 - DNA, 15 bp, Homo sapiens
tattcatatgcatat

SEQ ID NO: 5939101 - DNA, 17 bp, Homo sapiens
tattcatatgcatattt

SEQ ID NO: 5939102 - DNA, 17 bp, Homo sapiens
tattcatattggaaaaa

SEQ ID NO: 5939103 - DNA, 13 bp, Homo sapiens
tattcatatttgt

SEQ ID NO: 5939104 - DNA, 22 bp, Homo sapiens
tattcatatttgtactttctgt

SEQ ID NO: 5939105 - DNA, 23 bp, Homo sapiens
tattcatcaaataaaccttgttt

SEQ ID NO: 5939106 - DNA, 22 bp, Homo sapiens
tattcatctgttgacaatttgc

SEQ ID NO: 5939107 - DNA, 12 bp, Homo sapiens
tattcatcttgt

SEQ ID NO: 5939108 - DNA, 18 bp, Homo sapiens
tattcatgctgcctgcca

SEQ ID NO: 5939109 - DNA, 18 bp, Homo sapiens
tattcatgctttctcctt

SEQ ID NO: 5939110 - DNA, 15 bp, Homo sapiens
tattcatggctacct

SEQ ID NO: 5939111 - DNA, 20 bp, Homo sapiens
tattcatgggtgtcagcttt

SEQ ID NO: 5939112 - DNA, 16 bp, Homo sapiens
tattcatgtgaagtgt

SEQ ID NO: 5939113 - DNA, 14 bp, Homo sapiens
tattcatgttcatg

SEQ ID NO: 5939114 - DNA, 18 bp, Homo sapiens
tattcattaaatgtttga

SEQ ID NO: 5939115 - DNA, 16 bp, Homo sapiens
tattcattaagctttt

SEQ ID NO: 5939116 - DNA, 23 bp, Homo sapiens
tattcattatgcaacgtttaaca

SEQ ID NO: 5939117 - DNA, 14 bp, Homo sapiens
tattcattattcct

SEQ ID NO: 5939118 - DNA, 18 bp, Homo sapiens
tattcattattcctcaga

SEQ ID NO: 5939119 - DNA, 17 bp, Homo sapiens
tattcattatttgtcaa

SEQ ID NO: 5939120 - DNA, 19 bp, Homo sapiens
tattcattatttgtcaaat

SEQ ID NO: 5939121 - DNA, 14 bp, Homo sapiens
tattcattcacaat

SEQ ID NO: 5939122 - DNA, 22 bp, Homo sapiens
tattcattctgtgatcatttat

SEQ ID NO: 5939123 - DNA, 13 bp, Homo sapiens
tattcatttaaaa

SEQ ID NO: 5939124 - DNA, 14 bp, Homo sapiens
tattcatttaaaat

SEQ ID NO: 5939125 - DNA, 17 bp, Homo sapiens
tattcatttaaaatgat

SEQ ID NO: 5939126 - DNA, 16 bp, Homo sapiens
tattcatttttgttat

SEQ ID NO: 5939127 - DNA, 15 bp, Homo sapiens
tattccaaaataaaa

SEQ ID NO: 5939128 - DNA, 16 bp, Homo sapiens
tattccaaaccaaatt

SEQ ID NO: 5939129 - DNA, 21 bp, Homo sapiens
tattccaaaccaaattttaat

SEQ ID NO: 5939130 - DNA, 20 bp, Homo sapiens
tattccaaagttatttcata

SEQ ID NO: 5939131 - DNA, 13 bp, Homo sapiens
tattccaaggaaa

SEQ ID NO: 5939132 - DNA, 14 bp, Homo sapiens
tattccaaggaaaa

SEQ ID NO: 5939133 - DNA, 17 bp, Homo sapiens
tattccagaatgctgta

SEQ ID NO: 5939134 - DNA, 20 bp, Homo sapiens
tattccagaatgctgtacat

SEQ ID NO: 5939135 - DNA, 23 bp, Homo sapiens
tattccagaatgctgtacatcta

SEQ ID NO: 5939136 - DNA, 13 bp, Homo sapiens
tattccagctcat

SEQ ID NO: 5939137 - DNA, 17 bp, Homo sapiens
tattccagctgtccccc

SEQ ID NO: 5939138 - DNA, 14 bp, Homo sapiens
tattccaggagaag

SEQ ID NO: 5939139 - DNA, 19 bp, Homo sapiens
tattccatagtatattaaa

SEQ ID NO: 5939140 - DNA, 14 bp, Homo sapiens
tattccatatatta

SEQ ID NO: 5939141 - DNA, 17 bp, Homo sapiens
tattccatcaataaatg

SEQ ID NO: 5939142 - DNA, 16 bp, Homo sapiens
tattccatcaggcaga

SEQ ID NO: 5939143 - DNA, 19 bp, Homo sapiens
tattccatccatatacttt

SEQ ID NO: 5939144 - DNA, 13 bp, Homo sapiens
tattccatcttct

SEQ ID NO: 5939145 - DNA, 21 bp, Homo sapiens
tattccatcttctccataagt

SEQ ID NO: 5939146 - DNA, 18 bp, Homo sapiens
tattccatgtataagtgt

SEQ ID NO: 5939147 - DNA, 15 bp, Homo sapiens
tattccatttacata

SEQ ID NO: 5939148 - DNA, 14 bp, Homo sapiens
tattccatttgtat

SEQ ID NO: 5939149 - DNA, 22 bp, Homo sapiens
tattcccaagcccatgagtcct

SEQ ID NO: 5939150 - DNA, 15 bp, Homo sapiens
tattcccaagtatgc

SEQ ID NO: 5939151 - DNA, 19 bp, Homo sapiens
tattcccaagtatgcctta

SEQ ID NO: 5939152 - DNA, 14 bp, Homo sapiens
tattcccaattaaa

SEQ ID NO: 5939153 - DNA, 15 bp, Homo sapiens
tattcccactcacca

SEQ ID NO: 5939154 - DNA, 19 bp, Homo sapiens
tattcccactcaccagccc

SEQ ID NO: 5939155 - DNA, 14 bp, Homo sapiens
tattcccagctact

SEQ ID NO: 5939156 - DNA, 11 bp, Homo sapiens
tattcccaggc

SEQ ID NO: 5939157 - DNA, 17 bp, Homo sapiens
tattcccagggccgctt

SEQ ID NO: 5939158 - DNA, 21 bp, Homo sapiens
tattcccatggtagactgtga

SEQ ID NO: 5939159 - DNA, 20 bp, Homo sapiens
tattcccatgtgtgactcca

SEQ ID NO: 5939160 - DNA, 14 bp, Homo sapiens
tattcccattgtga

SEQ ID NO: 5939161 - DNA, 19 bp, Homo sapiens
tattccccaccctcccctt

SEQ ID NO: 5939162 - DNA, 15 bp, Homo sapiens
tattccccagtgact

SEQ ID NO: 5939163 - DNA, 17 bp, Homo sapiens
tattccccatcttccaa

SEQ ID NO: 5939164 - DNA, 22 bp, Homo sapiens
tattccccatttcctgtacaat

SEQ ID NO: 5939165 - DNA, 15 bp, Homo sapiens
tattcccccctaagc

SEQ ID NO: 5939166 - DNA, 18 bp, Homo sapiens
tattcccccctaagcttc

SEQ ID NO: 5939167 - DNA, 20 bp, Homo sapiens
tattcccctatctctagaat

SEQ ID NO: 5939168 - DNA, 19 bp, Homo sapiens
tattcccgttttacagata

SEQ ID NO: 5939169 - DNA, 18 bp, Homo sapiens
tattccctgcacacacat

SEQ ID NO: 5939170 - DNA, 13 bp, Homo sapiens
tattccctgccca

SEQ ID NO: 5939171 - DNA, 14 bp, Homo sapiens
tattccctgcccaa

SEQ ID NO: 5939172 - DNA, 11 bp, Homo sapiens
tattcccttct

SEQ ID NO: 5939173 - DNA, 14 bp, Homo sapiens
tattcccttgtatt

SEQ ID NO: 5939174 - DNA, 18 bp, Homo sapiens
tattccctttgacttcag

SEQ ID NO: 5939175 - DNA, 15 bp, Homo sapiens
tattcccttttaaag

SEQ ID NO: 5939176 - DNA, 16 bp, Homo sapiens
tattcccttttaaaga

SEQ ID NO: 5939177 - DNA, 20 bp, Homo sapiens
tattccctttttaaatgagc

SEQ ID NO: 5939178 - DNA, 17 bp, Homo sapiens
tattccgagcattccag

SEQ ID NO: 5939179 - DNA, 18 bp, Homo sapiens
tattccgtatttaaagtt

SEQ ID NO: 5939180 - DNA, 18 bp, Homo sapiens
tattcctaacctgtcaga

SEQ ID NO: 5939181 - DNA, 21 bp, Homo sapiens
tattcctaatggctatttttg

SEQ ID NO: 5939182 - DNA, 16 bp, Homo sapiens
tattcctaattcctgt

SEQ ID NO: 5939183 - DNA, 18 bp, Homo sapiens
tattcctaattcctgtat

SEQ ID NO: 5939184 - DNA, 19 bp, Homo sapiens
tattcctagtctttccagt

SEQ ID NO: 5939185 - DNA, 14 bp, Homo sapiens
tattcctagttggt

SEQ ID NO: 5939186 - DNA, 19 bp, Homo sapiens
tattcctattctttgccac

SEQ ID NO: 5939187 - DNA, 16 bp, Homo sapiens
tattcctccaaatctc

SEQ ID NO: 5939188 - DNA, 13 bp, Homo sapiens
tattcctccagct

SEQ ID NO: 5939189 - DNA, 14 bp, Homo sapiens
tattcctccagctg

SEQ ID NO: 5939190 - DNA, 20 bp, Homo sapiens
tattcctcttgcatttcact

SEQ ID NO: 5939191 - DNA, 20 bp, Homo sapiens
tattcctgaatgaaatatca

SEQ ID NO: 5939192 - DNA, 20 bp, Homo sapiens
tattcctgcatttgtgaaat

SEQ ID NO: 5939193 - DNA, 21 bp, Homo sapiens
tattcctgcatttgtgaaatg

SEQ ID NO: 5939194 - DNA, 13 bp, Homo sapiens
tattcctggcata

SEQ ID NO: 5939195 - DNA, 20 bp, Homo sapiens
tattcctggtattatttaca

SEQ ID NO: 5939196 - DNA, 19 bp, Homo sapiens
tattcctgttgctgtcttc

SEQ ID NO: 5939197 - DNA, 15 bp, Homo sapiens
tattccttactagaa

SEQ ID NO: 5939198 - DNA, 15 bp, Homo sapiens
tattccttctggcct

SEQ ID NO: 5939199 - DNA, 17 bp, Homo sapiens
tattccttcttactctc

SEQ ID NO: 5939200 - DNA, 16 bp, Homo sapiens
tattccttgatcattt

SEQ ID NO: 5939201 - DNA, 17 bp, Homo sapiens
tattccttggcccagca

SEQ ID NO: 5939202 - DNA, 12 bp, Homo sapiens
tattcctttaaa

SEQ ID NO: 5939203 - DNA, 17 bp, Homo sapiens
tattcctttaaaatatt

SEQ ID NO: 5939204 - DNA, 12 bp, Homo sapiens
tattcctttccc

SEQ ID NO: 5939205 - DNA, 15 bp, Homo sapiens
tattcctttcccttc

SEQ ID NO: 5939206 - DNA, 13 bp, Homo sapiens
tattcctttcctt

SEQ ID NO: 5939207 - DNA, 12 bp, Homo sapiens
tattcctttgaa

SEQ ID NO: 5939208 - DNA, 14 bp, Homo sapiens
tattccttttaaaa

SEQ ID NO: 5939209 - DNA, 16 bp, Homo sapiens
tattccttttaaagaa

SEQ ID NO: 5939210 - DNA, 19 bp, Homo sapiens
tattccttttgtgtacagt

SEQ ID NO: 5939211 - DNA, 23 bp, Homo sapiens
tattcgaaacctgtgatttctgt

SEQ ID NO: 5939212 - DNA, 19 bp, Homo sapiens
tattcgccacacagtattt

SEQ ID NO: 5939213 - DNA, 12 bp, Homo sapiens
tattcgctgtgt

SEQ ID NO: 5939214 - DNA, 23 bp, Homo sapiens
tattcggcatttaacttacattt

SEQ ID NO: 5939215 - DNA, 20 bp, Homo sapiens
tattcgtaagttctgtgcag

SEQ ID NO: 5939216 - DNA, 18 bp, Homo sapiens
tattctaaaaaaataaac

SEQ ID NO: 5939217 - DNA, 21 bp, Homo sapiens
tattctaaaaaaataaacaaa

SEQ ID NO: 5939218 - DNA, 23 bp, Homo sapiens
tattctaaaaaaataaacaaagt

SEQ ID NO: 5939219 - DNA, 15 bp, Homo sapiens
tattctaaaaccatt

SEQ ID NO: 5939220 - DNA, 18 bp, Homo sapiens
tattctaaagttttgcaa

SEQ ID NO: 5939221 - DNA, 21 bp, Homo sapiens
tattctaaagttttgcaacaa

SEQ ID NO: 5939222 - DNA, 15 bp, Homo sapiens
tattctaaattcact

SEQ ID NO: 5939223 - DNA, 19 bp, Homo sapiens
tattctaaattttatatct

SEQ ID NO: 5939224 - DNA, 22 bp, Homo sapiens
tattctaaatttttacttaact

SEQ ID NO: 5939225 - DNA, 19 bp, Homo sapiens
tattctaagaaatatctgt

SEQ ID NO: 5939226 - DNA, 11 bp, Homo sapiens
tattctaagac

SEQ ID NO: 5939227 - DNA, 23 bp, Homo sapiens
tattctaagacttactctaagat

SEQ ID NO: 5939228 - DNA, 22 bp, Homo sapiens
tattctaagccagttttcattt

SEQ ID NO: 5939229 - DNA, 21 bp, Homo sapiens
tattctaataaatcaatgtga

SEQ ID NO: 5939230 - DNA, 13 bp, Homo sapiens
tattctaattaaa

SEQ ID NO: 5939231 - DNA, 16 bp, Homo sapiens
tattctaattaaaatt

SEQ ID NO: 5939232 - DNA, 18 bp, Homo sapiens
tattctaattaaaattgt

SEQ ID NO: 5939233 - DNA, 20 bp, Homo sapiens
tattctaattcttcattata

SEQ ID NO: 5939234 - DNA, 20 bp, Homo sapiens
tattctacacatatatgtat

SEQ ID NO: 5939235 - DNA, 15 bp, Homo sapiens
tattctacacatgta

SEQ ID NO: 5939236 - DNA, 17 bp, Homo sapiens
tattctacacatgtaaa

SEQ ID NO: 5939237 - DNA, 22 bp, Homo sapiens
tattctacacatgtaaaatatg

SEQ ID NO: 5939238 - DNA, 23 bp, Homo sapiens
tattctacatatgataggcagca

SEQ ID NO: 5939239 - DNA, 14 bp, Homo sapiens
tattctacatttca

SEQ ID NO: 5939240 - DNA, 15 bp, Homo sapiens
tattctacatttcac

SEQ ID NO: 5939241 - DNA, 18 bp, Homo sapiens
tattctactggcctgtaa

SEQ ID NO: 5939242 - DNA, 16 bp, Homo sapiens
tattctactgtacttt

SEQ ID NO: 5939243 - DNA, 19 bp, Homo sapiens
tattctactgtactttttt

SEQ ID NO: 5939244 - DNA, 11 bp, Homo sapiens
tattctagaac

SEQ ID NO: 5939245 - DNA, 13 bp, Homo sapiens
tattctagagctt

SEQ ID NO: 5939246 - DNA, 16 bp, Homo sapiens
tattctagcctgcatt

SEQ ID NO: 5939247 - DNA, 20 bp, Homo sapiens
tattctagggtttcttaaat

SEQ ID NO: 5939248 - DNA, 18 bp, Homo sapiens
tattctagtcaactgctg

SEQ ID NO: 5939249 - DNA, 19 bp, Homo sapiens
tattctagtcaactgctgt

SEQ ID NO: 5939250 - DNA, 21 bp, Homo sapiens
tattctagtcaactgctgttt

SEQ ID NO: 5939251 - DNA, 22 bp, Homo sapiens
tattctagtcaactgctgtttt

SEQ ID NO: 5939252 - DNA, 14 bp, Homo sapiens
tattctagtggctg

SEQ ID NO: 5939253 - DNA, 14 bp, Homo sapiens
tattctatatgaat

SEQ ID NO: 5939254 - DNA, 17 bp, Homo sapiens
tattctatgtatgttaa

SEQ ID NO: 5939255 - DNA, 20 bp, Homo sapiens
tattgagggaaatgttttca

SEQ ID NO: 5939256 - DNA, 18 bp, Homo sapiens
tattgagggccagtgatg

SEQ ID NO: 5939257 - DNA, 21 bp, Homo sapiens
tattgagggccagtgatgatg

SEQ ID NO: 5939258 - DNA, 20 bp, Homo sapiens
tattgagtaatattacattt

SEQ ID NO: 5939259 - DNA, 22 bp, Homo sapiens
tattgagtaatattacatttca

SEQ ID NO: 5939260 - DNA, 13 bp, Homo sapiens
tattgataaattt

SEQ ID NO: 5939261 - DNA, 16 bp, Homo sapiens
tattgataagttcata

SEQ ID NO: 5939262 - DNA, 18 bp, Homo sapiens
tattgatagtttcattta

SEQ ID NO: 5939263 - DNA, 22 bp, Homo sapiens
tattgatagtttcatttacaat

SEQ ID NO: 5939264 - DNA, 13 bp, Homo sapiens
tattgatcaaaat

SEQ ID NO: 5939265 - DNA, 15 bp, Homo sapiens
tattgatcaaaatca

SEQ ID NO: 5939266 - DNA, 17 bp, Homo sapiens
tattgatcaaaatcaaa

SEQ ID NO: 5939267 - DNA, 18 bp, Homo sapiens
tattgatcccttctcctg

SEQ ID NO: 5939268 - DNA, 15 bp, Homo sapiens
tattgatctgtatta

SEQ ID NO: 5939269 - DNA, 20 bp, Homo sapiens
tattgatctttttatcatga

SEQ ID NO: 5939270 - DNA, 18 bp, Homo sapiens
tattgatgaaaagattta

SEQ ID NO: 5939271 - DNA, 23 bp, Homo sapiens
tattgatgaaaagatttaagcac

SEQ ID NO: 5939272 - DNA, 14 bp, Homo sapiens
tattgatgtcagta

SEQ ID NO: 5939273 - DNA, 19 bp, Homo sapiens
tattgatgtgaaattaaat

SEQ ID NO: 5939274 - DNA, 14 bp, Homo sapiens
tattgatgtttcca

SEQ ID NO: 5939275 - DNA, 16 bp, Homo sapiens
tattgatgtttccaga

SEQ ID NO: 5939276 - DNA, 17 bp, Homo sapiens
tattgatgtttccagaa

SEQ ID NO: 5939277 - DNA, 21 bp, Homo sapiens
tattgatgtttccagaaaata

SEQ ID NO: 5939278 - DNA, 18 bp, Homo sapiens
tattgattacaaataaac

SEQ ID NO: 5939279 - DNA, 23 bp, Homo sapiens
tattgattatagcaatgtgattt

SEQ ID NO: 5939280 - DNA, 21 bp, Homo sapiens
tattgattcctcacatcttta

SEQ ID NO: 5939281 - DNA, 14 bp, Homo sapiens
tattgattgggaaa

SEQ ID NO: 5939282 - DNA, 18 bp, Homo sapiens
tattgattgggaaaacat

SEQ ID NO: 5939283 - DNA, 20 bp, Homo sapiens
tattgattgggaaaacattt

SEQ ID NO: 5939284 - DNA, 16 bp, Homo sapiens
tattgatttaaaagtg

SEQ ID NO: 5939285 - DNA, 13 bp, Homo sapiens
tattgatttcaaa

SEQ ID NO: 5939286 - DNA, 13 bp, Homo sapiens
tattgatttctgc

SEQ ID NO: 5939287 - DNA, 17 bp, Homo sapiens
tattgattttaaatata

SEQ ID NO: 5939288 - DNA, 17 bp, Homo sapiens
tattgcaaaatacatga

SEQ ID NO: 5939289 - DNA, 22 bp, Homo sapiens
tattgcaaaggttccaactgta

SEQ ID NO: 5939290 - DNA, 20 bp, Homo sapiens
tattgcaaagtcaggaatca

SEQ ID NO: 5939291 - DNA, 23 bp, Homo sapiens
tattgcaaatgagggaagaacat

SEQ ID NO: 5939292 - DNA, 20 bp, Homo sapiens
tattgcaactcttttaagtg

SEQ ID NO: 5939293 - DNA, 21 bp, Homo sapiens
tattgcaaggtgtgatggtct

SEQ ID NO: 5939294 - DNA, 14 bp, Homo sapiens
tattgcaataaagt

SEQ ID NO: 5939295 - DNA, 18 bp, Homo sapiens
tattgcaataaagtataa

SEQ ID NO: 5939296 - DNA, 13 bp, Homo sapiens
tattgcaatgcag

SEQ ID NO: 5939297 - DNA, 20 bp, Homo sapiens
tattgcacatgtcttaatga

SEQ ID NO: 5939298 - DNA, 17 bp, Homo sapiens
tattgcactaggaattc

SEQ ID NO: 5939299 - DNA, 19 bp, Homo sapiens
tattgcactatgaaaatca

SEQ ID NO: 5939300 - DNA, 18 bp, Homo sapiens
tattgcactcagcttttt

SEQ ID NO: 5939301 - DNA, 22 bp, Homo sapiens
tattgcagaatgtgggtattga

SEQ ID NO: 5939302 - DNA, 23 bp, Homo sapiens
tattgcagctaagctcaaatgta

SEQ ID NO: 5939303 - DNA, 16 bp, Homo sapiens
tattgcaggagacatt

SEQ ID NO: 5939304 - DNA, 20 bp, Homo sapiens
tattgcaggagacattttca

SEQ ID NO: 5939305 - DNA, 22 bp, Homo sapiens
tattgcagtgtgaatgctgggc

SEQ ID NO: 5939306 - DNA, 15 bp, Homo sapiens
tattgcagttataga

SEQ ID NO: 5939307 - DNA, 20 bp, Homo sapiens
tattgcagttcatactgaat

SEQ ID NO: 5939308 - DNA, 23 bp, Homo sapiens
tattgcagttcatactgaatgac

SEQ ID NO: 5939309 - DNA, 15 bp, Homo sapiens
tattgcatatgcata

SEQ ID NO: 5939310 - DNA, 15 bp, Homo sapiens
tattgcatctgtata

SEQ ID NO: 5939311 - DNA, 21 bp, Homo sapiens
tattgcatctgtataagtaag

SEQ ID NO: 5939312 - DNA, 17 bp, Homo sapiens
tattgcatgcaatttga

SEQ ID NO: 5939313 - DNA, 19 bp, Homo sapiens
tattgcatggtgtgaacta

SEQ ID NO: 5939314 - DNA, 18 bp, Homo sapiens
tattgcatgtaaaatgca

SEQ ID NO: 5939315 - DNA, 20 bp, Homo sapiens
tattgcatgtaaaatgcagt

SEQ ID NO: 5939316 - DNA, 15 bp, Homo sapiens
tattgcattaatttt

SEQ ID NO: 5939317 - DNA, 21 bp, Homo sapiens
tattgcattgtacctaaagga

SEQ ID NO: 5939318 - DNA, 18 bp, Homo sapiens
tattgcatttctgtattt

SEQ ID NO: 5939319 - DNA, 15 bp, Homo sapiens
tattgcatttgctgt

SEQ ID NO: 5939320 - DNA, 16 bp, Homo sapiens
tattgcatttgctgtt

SEQ ID NO: 5939321 - DNA, 22 bp, Homo sapiens
tattgcatttgctgttgtttct

SEQ ID NO: 5939322 - DNA, 19 bp, Homo sapiens
tattgccaaaacccagctg

SEQ ID NO: 5939323 - DNA, 14 bp, Homo sapiens
tattgccaaacatt

SEQ ID NO: 5939324 - DNA, 21 bp, Homo sapiens
tattgccaaacattaatgttg

SEQ ID NO: 5939325 - DNA, 16 bp, Homo sapiens
tattgccaactcttct

SEQ ID NO: 5939326 - DNA, 14 bp, Homo sapiens
tattgccacctctg

SEQ ID NO: 5939327 - DNA, 20 bp, Homo sapiens
tattgccagtatataagctg

SEQ ID NO: 5939328 - DNA, 21 bp, Homo sapiens
tattgcccatgatataacttt

SEQ ID NO: 5939329 - DNA, 16 bp, Homo sapiens
tattgcccatgggata

SEQ ID NO: 5939330 - DNA, 15 bp, Homo sapiens
tattgccccttctta

SEQ ID NO: 5939331 - DNA, 17 bp, Homo sapiens
tattgccctaattaaaa

SEQ ID NO: 5939332 - DNA, 20 bp, Homo sapiens
tattgcctctgtcttaaaga

SEQ ID NO: 5939333 - DNA, 19 bp, Homo sapiens
tattgcctgggcagtgccc

SEQ ID NO: 5939334 - DNA, 17 bp, Homo sapiens
tattgccttatttgtct

SEQ ID NO: 5939335 - DNA, 20 bp, Homo sapiens
tattgccttatttgtctgta

SEQ ID NO: 5939336 - DNA, 16 bp, Homo sapiens
tattgccttctcacca

SEQ ID NO: 5939337 - DNA, 20 bp, Homo sapiens
tattgccttctcaccagctg

SEQ ID NO: 5939338 - DNA, 17 bp, Homo sapiens
tattgccttgatgtttc

SEQ ID NO: 5939339 - DNA, 18 bp, Homo sapiens
tattgccttgatgtttct

SEQ ID NO: 5939340 - DNA, 17 bp, Homo sapiens
tattgcctttgcctctt

SEQ ID NO: 5939341 - DNA, 21 bp, Homo sapiens
tattgccttttaatttttaat

SEQ ID NO: 5939342 - DNA, 19 bp, Homo sapiens
tattgcgaatgtgcagaaa

SEQ ID NO: 5939343 - DNA, 14 bp, Homo sapiens
tattgcgagaaaca

SEQ ID NO: 5939344 - DNA, 19 bp, Homo sapiens
tattgcgagaaacagagat

SEQ ID NO: 5939345 - DNA, 11 bp, Homo sapiens
tattgctaaaa

SEQ ID NO: 5939346 - DNA, 21 bp, Homo sapiens
tattgctaaaagcatgtatag

SEQ ID NO: 5939347 - DNA, 13 bp, Homo sapiens
tattgctaaaagt

SEQ ID NO: 5939348 - DNA, 18 bp, Homo sapiens
tattgctacttcctgcct

SEQ ID NO: 5939349 - DNA, 20 bp, Homo sapiens
tattgctagagctcctccct

SEQ ID NO: 5939350 - DNA, 20 bp, Homo sapiens
tattgctagtatttgaatta

SEQ ID NO: 5939351 - DNA, 19 bp, Homo sapiens
tattgctatcttttctgga

SEQ ID NO: 5939352 - DNA, 15 bp, Homo sapiens
tattgctatgttctt

SEQ ID NO: 5939353 - DNA, 13 bp, Homo sapiens
tattgctatttat

SEQ ID NO: 5939354 - DNA, 17 bp, Homo sapiens
tattgctatttatattc

SEQ ID NO: 5939355 - DNA, 23 bp, Homo sapiens
tattgctcgcccagacaccatgt

SEQ ID NO: 5939356 - DNA, 20 bp, Homo sapiens
tattgctctaattcttttca

SEQ ID NO: 5939357 - DNA, 21 bp, Homo sapiens
tattgctctaattcttttcaa

SEQ ID NO: 5939358 - DNA, 11 bp, Homo sapiens
tattgctctta

SEQ ID NO: 5939359 - DNA, 16 bp, Homo sapiens
tattgctcttaaaaat

SEQ ID NO: 5939360 - DNA, 16 bp, Homo sapiens
tattgctgattttaat

SEQ ID NO: 5939361 - DNA, 18 bp, Homo sapiens
tattgctgcataaatttg

SEQ ID NO: 5939362 - DNA, 11 bp, Homo sapiens
tattgctgcca

SEQ ID NO: 5939363 - DNA, 13 bp, Homo sapiens
tattgctgccaaa

SEQ ID NO: 5939364 - DNA, 11 bp, Homo sapiens
tattgctgcta

SEQ ID NO: 5939365 - DNA, 13 bp, Homo sapiens
tattgctgctgcc

SEQ ID NO: 5939366 - DNA, 22 bp, Homo sapiens
tattgctgctggtaatttgtat

SEQ ID NO: 5939367 - DNA, 18 bp, Homo sapiens
tattgctggaatctacta

SEQ ID NO: 5939368 - DNA, 11 bp, Homo sapiens
tattgctgggg

SEQ ID NO: 5939369 - DNA, 21 bp, Homo sapiens
tattgctgtaaataaaaatag

SEQ ID NO: 5939370 - DNA, 19 bp, Homo sapiens
tattgctgtccttgaatgc

SEQ ID NO: 5939371 - DNA, 16 bp, Homo sapiens
tattgctgtctgaaaa

SEQ ID NO: 5939372 - DNA, 15 bp, Homo sapiens
tattgctgtctggtg

SEQ ID NO: 5939373 - DNA, 16 bp, Homo sapiens
tattgctgtctggtga

SEQ ID NO: 5939374 - DNA, 12 bp, Homo sapiens
tattgctgtgtc

SEQ ID NO: 5939375 - DNA, 15 bp, Homo sapiens
tattgctgttgcttg

SEQ ID NO: 5939376 - DNA, 13 bp, Homo sapiens
tattgcttaatcc

SEQ ID NO: 5939377 - DNA, 17 bp, Homo sapiens
tattgcttagtaaaatt

SEQ ID NO: 5939378 - DNA, 21 bp, Homo sapiens
tattgcttatctgaaatgctt

SEQ ID NO: 5939379 - DNA, 22 bp, Homo sapiens
tattgcttattttattatgagc

SEQ ID NO: 5939380 - DNA, 13 bp, Homo sapiens
tattgcttcatct

SEQ ID NO: 5939381 - DNA, 14 bp, Homo sapiens
tattgcttcatgtt

SEQ ID NO: 5939382 - DNA, 23 bp, Homo sapiens
tattgcttcctgtgtaacatctg

SEQ ID NO: 5939383 - DNA, 15 bp, Homo sapiens
tattggaaaaatcac

SEQ ID NO: 5939384 - DNA, 24 bp, Homo sapiens
tattggaaaataaaaatgctataa

SEQ ID NO: 5939385 - DNA, 18 bp, Homo sapiens
tattggaaatggatgcaa

SEQ ID NO: 5939386 - DNA, 19 bp, Homo sapiens
tattggaaatggatgcaaa

SEQ ID NO: 5939387 - DNA, 19 bp, Homo sapiens
tattggaaatgtacttttg

SEQ ID NO: 5939388 - DNA, 22 bp, Homo sapiens
tattggaaatgtgaataagtaa

SEQ ID NO: 5939389 - DNA, 22 bp, Homo sapiens
tattggaaatttgttataatga

SEQ ID NO: 5939390 - DNA, 15 bp, Homo sapiens
tattggaacttgcga

SEQ ID NO: 5939391 - DNA, 23 bp, Homo sapiens
tattggaagataaacttgtcaaa

SEQ ID NO: 5939392 - DNA, 17 bp, Homo sapiens
tattggaagtgaaatta

SEQ ID NO: 5939393 - DNA, 19 bp, Homo sapiens
tattggaagtgttcaagaa

SEQ ID NO: 5939394 - DNA, 18 bp, Homo sapiens
tattggaatagcagcctc

SEQ ID NO: 5939395 - DNA, 16 bp, Homo sapiens
tattggaatataattg

SEQ ID NO: 5939396 - DNA, 13 bp, Homo sapiens
tattggaattttc

SEQ ID NO: 5939397 - DNA, 17 bp, Homo sapiens
tattggacagacacaga

SEQ ID NO: 5939398 - DNA, 16 bp, Homo sapiens
tattggaccagaagtc

SEQ ID NO: 5939399 - DNA, 16 bp, Homo sapiens
tattggacctgcccac

SEQ ID NO: 5939400 - DNA, 17 bp, Homo sapiens
tattggactccaggcct

SEQ ID NO: 5939401 - DNA, 16 bp, Homo sapiens
tattggacttccattt

SEQ ID NO: 5939402 - DNA, 14 bp, Homo sapiens
tattggagatttgc

SEQ ID NO: 5939403 - DNA, 16 bp, Homo sapiens
tattggagcacatgtt

SEQ ID NO: 5939404 - DNA, 16 bp, Homo sapiens
tattggagggaaatct

SEQ ID NO: 5939405 - DNA, 20 bp, Homo sapiens
tattggagggaaatcttggt

SEQ ID NO: 5939406 - DNA, 21 bp, Homo sapiens
tattggagggtaaatgatgtg

SEQ ID NO: 5939407 - DNA, 20 bp, Homo sapiens
tattggaggtgagatcacag

SEQ ID NO: 5939408 - DNA, 17 bp, Homo sapiens
tattggatatttgatat

SEQ ID NO: 5939409 - DNA, 21 bp, Homo sapiens
tattggatctattgatttgaa

SEQ ID NO: 5939410 - DNA, 23 bp, Homo sapiens
tattggattgcgcctttgtatta

SEQ ID NO: 5939411 - DNA, 13 bp, Homo sapiens
tattggatttttt

SEQ ID NO: 5939412 - DNA, 14 bp, Homo sapiens
tattggcaaagatg

SEQ ID NO: 5939413 - DNA, 13 bp, Homo sapiens
tattggcaaagtt

SEQ ID NO: 5939414 - DNA, 16 bp, Homo sapiens
tattggcactgctaaa

SEQ ID NO: 5939415 - DNA, 22 bp, Homo sapiens
tattggcactgctaaaatagaa

SEQ ID NO: 5939416 - DNA, 23 bp, Homo sapiens
tattggcactgctaaaatagaat

SEQ ID NO: 5939417 - DNA, 15 bp, Homo sapiens
tattggcagcacagc

SEQ ID NO: 5939418 - DNA, 17 bp, Homo sapiens
tattggcagccaaggaa

SEQ ID NO: 5939419 - DNA, 18 bp, Homo sapiens
tattggcagccaaggaat

SEQ ID NO: 5939420 - DNA, 16 bp, Homo sapiens
tattggcataaaacaa

SEQ ID NO: 5939421 - DNA, 20 bp, Homo sapiens
tattggcatggatttccttt

SEQ ID NO: 5939422 - DNA, 12 bp, Homo sapiens
tattggcctgga

SEQ ID NO: 5939423 - DNA, 14 bp, Homo sapiens
tattggctgggagt

SEQ ID NO: 5939424 - DNA, 16 bp, Homo sapiens
tattggcttactgaaa

SEQ ID NO: 5939425 - DNA, 15 bp, Homo sapiens
tattggcttttctga

SEQ ID NO: 5939426 - DNA, 22 bp, Homo sapiens
tattggcttttctgatccagtt

SEQ ID NO: 5939427 - DNA, 12 bp, Homo sapiens
tattgggaagct

SEQ ID NO: 5939428 - DNA, 16 bp, Homo sapiens
tattgggacagcatga

SEQ ID NO: 5939429 - DNA, 18 bp, Homo sapiens
tattgggagggatgagag

SEQ ID NO: 5939430 - DNA, 18 bp, Homo sapiens
tattgggattacagacat

SEQ ID NO: 5939431 - DNA, 20 bp, Homo sapiens
tattgggcacagcctagggt

SEQ ID NO: 5939432 - DNA, 19 bp, Homo sapiens
tatttaaaaaactgtataa

SEQ ID NO: 5939433 - DNA, 15 bp, Homo sapiens
tatttaaaaaataaa

SEQ ID NO: 5939434 - DNA, 20 bp, Homo sapiens
tatttaaaaaattatggaat

SEQ ID NO: 5939435 - DNA, 22 bp, Homo sapiens
tatttaaaaaattatggaatat

SEQ ID NO: 5939436 - DNA, 13 bp, Homo sapiens
tatttaaaaacaa

SEQ ID NO: 5939437 - DNA, 14 bp, Homo sapiens
tatttaaaaacatt

SEQ ID NO: 5939438 - DNA, 23 bp, Homo sapiens
tatttaaaaataagtcaacagta

SEQ ID NO: 5939439 - DNA, 21 bp, Homo sapiens
tatttaaaaatatttcagata

SEQ ID NO: 5939440 - DNA, 18 bp, Homo sapiens
tatttaaaaatatttttg

SEQ ID NO: 5939441 - DNA, 16 bp, Homo sapiens
tatttaaaaattgttt

SEQ ID NO: 5939442 - DNA, 21 bp, Homo sapiens
tatttaaaaattgtttcttga

SEQ ID NO: 5939443 - DNA, 17 bp, Homo sapiens
tatttaaaacatttcat

SEQ ID NO: 5939444 - DNA, 18 bp, Homo sapiens
tatttaaaacatttcatg

SEQ ID NO: 5939445 - DNA, 21 bp, Homo sapiens
tatttaaaaccattatttaat

SEQ ID NO: 5939446 - DNA, 23 bp, Homo sapiens
tatttaaaactctggtgataaaa

SEQ ID NO: 5939447 - DNA, 21 bp, Homo sapiens
tatttaaaactgggtcatcat

SEQ ID NO: 5939448 - DNA, 12 bp, Homo sapiens
tatttaaaactt

SEQ ID NO: 5939449 - DNA, 23 bp, Homo sapiens
tatttaaaagaaagcctcagaga

SEQ ID NO: 5939450 - DNA, 13 bp, Homo sapiens
tatttaaaagatt

SEQ ID NO: 5939451 - DNA, 14 bp, Homo sapiens
tatttaaaagattt

SEQ ID NO: 5939452 - DNA, 18 bp, Homo sapiens
tatttaaaagattttatg

SEQ ID NO: 5939453 - DNA, 12 bp, Homo sapiens
tatttaaaaggg

SEQ ID NO: 5939454 - DNA, 12 bp, Homo sapiens
tatttaaaatag

SEQ ID NO: 5939455 - DNA, 14 bp, Homo sapiens
tatttaaaatagca

SEQ ID NO: 5939456 - DNA, 21 bp, Homo sapiens
tatttaaaatgctcaatttca

SEQ ID NO: 5939457 - DNA, 12 bp, Homo sapiens
tatttaaaatgg

SEQ ID NO: 5939458 - DNA, 15 bp, Homo sapiens
tatttaaaatgtaaa

SEQ ID NO: 5939459 - DNA, 14 bp, Homo sapiens
tatttaaaattcat

SEQ ID NO: 5939460 - DNA, 18 bp, Homo sapiens
tatttaaacaaatgtgta

SEQ ID NO: 5939461 - DNA, 14 bp, Homo sapiens
tatttaaacatggt

SEQ ID NO: 5939462 - DNA, 21 bp, Homo sapiens
tatttaaacctttttcttgat

SEQ ID NO: 5939463 - DNA, 20 bp, Homo sapiens
tatttaaactattcagagga

SEQ ID NO: 5939464 - DNA, 16 bp, Homo sapiens
tatttaaacttataaa

SEQ ID NO: 5939465 - DNA, 21 bp, Homo sapiens
tatttaaacttataaatcata

SEQ ID NO: 5939466 - DNA, 13 bp, Homo sapiens
tatttaaagaaat

SEQ ID NO: 5939467 - DNA, 17 bp, Homo sapiens
tatttaaagacaaagac

SEQ ID NO: 5939468 - DNA, 18 bp, Homo sapiens
tatttaaagacaaagaca

SEQ ID NO: 5939469 - DNA, 14 bp, Homo sapiens
tatttaaagacagg

SEQ ID NO: 5939470 - DNA, 13 bp, Homo sapiens
tatttaaagcaca

SEQ ID NO: 5939471 - DNA, 19 bp, Homo sapiens
tatttaaagccaaatgtaa

SEQ ID NO: 5939472 - DNA, 12 bp, Homo sapiens
tatttaaaggga

SEQ ID NO: 5939473 - DNA, 18 bp, Homo sapiens
tatttaaagggaaattga

SEQ ID NO: 5939474 - DNA, 13 bp, Homo sapiens
tatttaaagttgt

SEQ ID NO: 5939475 - DNA, 19 bp, Homo sapiens
tatttaaagtttcctttaa

SEQ ID NO: 5939476 - DNA, 22 bp, Homo sapiens
tatttaaatagataaccaattt

SEQ ID NO: 5939477 - DNA, 21 bp, Homo sapiens
tatttaaatcctgaagagcat

SEQ ID NO: 5939478 - DNA, 18 bp, Homo sapiens
tatttaaatgcatgtctt

SEQ ID NO: 5939479 - DNA, 19 bp, Homo sapiens
tatttaaatgcatgtctta

SEQ ID NO: 5939480 - DNA, 21 bp, Homo sapiens
tatttaaatgcatgtcttaaa

SEQ ID NO: 5939481 - DNA, 12 bp, Homo sapiens
tatttaaatgct

SEQ ID NO: 5939482 - DNA, 18 bp, Homo sapiens
tatttaaatgtaaagaca

SEQ ID NO: 5939483 - DNA, 12 bp, Homo sapiens
tatttaaatgtc

SEQ ID NO: 5939484 - DNA, 20 bp, Homo sapiens
tatttaaatgtctaatgtat

SEQ ID NO: 5939485 - DNA, 14 bp, Homo sapiens
tatttaaatttagt

SEQ ID NO: 5939486 - DNA, 19 bp, Homo sapiens
tatttaacaaaatttgaat

SEQ ID NO: 5939487 - DNA, 15 bp, Homo sapiens
tatttaacaagatct

SEQ ID NO: 5939488 - DNA, 18 bp, Homo sapiens
tatttaacaagatgtttc

SEQ ID NO: 5939489 - DNA, 12 bp, Homo sapiens
tatttaacagaa

SEQ ID NO: 5939490 - DNA, 13 bp, Homo sapiens
tatttaacagaaa

SEQ ID NO: 5939491 - DNA, 21 bp, Homo sapiens
tatttaacagctgaattatct

SEQ ID NO: 5939492 - DNA, 14 bp, Homo sapiens
tatttaacataggt

SEQ ID NO: 5939493 - DNA, 12 bp, Homo sapiens
tatttaacattc

SEQ ID NO: 5939494 - DNA, 15 bp, Homo sapiens
tatttaacattcttg

SEQ ID NO: 5939495 - DNA, 17 bp, Homo sapiens
tatttaacccattattc

SEQ ID NO: 5939496 - DNA, 17 bp, Homo sapiens
tatttaacctctaaatt

SEQ ID NO: 5939497 - DNA, 18 bp, Homo sapiens
tatttaacctctaaattc

SEQ ID NO: 5939498 - DNA, 16 bp, Homo sapiens
tatttaactatttaga

SEQ ID NO: 5939499 - DNA, 17 bp, Homo sapiens
tatttaactatttagag

SEQ ID NO: 5939500 - DNA, 23 bp, Homo sapiens
tatttaactctctttatgtctgt

SEQ ID NO: 5939501 - DNA, 14 bp, Homo sapiens
tatttaactcttaa

SEQ ID NO: 5939502 - DNA, 21 bp, Homo sapiens
tatttaactcttaactgaaga

SEQ ID NO: 5939503 - DNA, 23 bp, Homo sapiens
tatttaactcttaactgaagaaa

SEQ ID NO: 5939504 - DNA, 14 bp, Homo sapiens
tatttaactgatta

SEQ ID NO: 5939505 - DNA, 21 bp, Homo sapiens
tatttaactgccttgtgtaca

SEQ ID NO: 5939506 - DNA, 13 bp, Homo sapiens
tatttaacttgag

SEQ ID NO: 5939507 - DNA, 21 bp, Homo sapiens
tatttaacttgagggtaataa

SEQ ID NO: 5939508 - DNA, 12 bp, Homo sapiens
tatttaactttt

SEQ ID NO: 5939509 - DNA, 14 bp, Homo sapiens
tatttaagaaaaca

SEQ ID NO: 5939510 - DNA, 13 bp, Homo sapiens
tatttaagaaaat

SEQ ID NO: 5939511 - DNA, 14 bp, Homo sapiens
tatttaagaaaata

SEQ ID NO: 5939512 - DNA, 19 bp, Homo sapiens
tatttaagaaaatacaata

SEQ ID NO: 5939513 - DNA, 13 bp, Homo sapiens
tatttaagaataa

SEQ ID NO: 5939514 - DNA, 21 bp, Homo sapiens
tatttaagatatatacatgga

SEQ ID NO: 5939515 - DNA, 12 bp, Homo sapiens
tatttaagatgt

SEQ ID NO: 5939516 - DNA, 23 bp, Homo sapiens
tatttaagatgtacatttaataa

SEQ ID NO: 5939517 - DNA, 13 bp, Homo sapiens
tatttaagatgtg

SEQ ID NO: 5939518 - DNA, 14 bp, Homo sapiens
tatttaagatgtga

SEQ ID NO: 5939519 - DNA, 16 bp, Homo sapiens
tatttaagatgtgaaa

SEQ ID NO: 5939520 - DNA, 18 bp, Homo sapiens
tatttaagatgtgaaaat

SEQ ID NO: 5939521 - DNA, 12 bp, Homo sapiens
tatttaagcaaa

SEQ ID NO: 5939522 - DNA, 20 bp, Homo sapiens
tatttaagcaacatcttttt

SEQ ID NO: 5939523 - DNA, 16 bp, Homo sapiens
tatttaagcaataaaa

SEQ ID NO: 5939524 - DNA, 20 bp, Homo sapiens
tatttaagcacataaagacc

SEQ ID NO: 5939525 - DNA, 10 bp, Homo sapiens
tatttaagcc

SEQ ID NO: 5939526 - DNA, 12 bp, Homo sapiens
tatttaagcctt

SEQ ID NO: 5939527 - DNA, 21 bp, Homo sapiens
tatttaagccttataaaccaa

SEQ ID NO: 5939528 - DNA, 13 bp, Homo sapiens
tatttaagccttt

SEQ ID NO: 5939529 - DNA, 18 bp, Homo sapiens
tatttaagctttaaatga

SEQ ID NO: 5939530 - DNA, 20 bp, Homo sapiens
tatttaaggaatcaaatctt

SEQ ID NO: 5939531 - DNA, 21 bp, Homo sapiens
tatttaaggaatcaaatctta

SEQ ID NO: 5939532 - DNA, 22 bp, Homo sapiens
tatttaaggagatgtaagagct

SEQ ID NO: 5939533 - DNA, 15 bp, Homo sapiens
tatttaaggatggat

SEQ ID NO: 5939534 - DNA, 19 bp, Homo sapiens
tatttaaggatggatggca

SEQ ID NO: 5939535 - DNA, 21 bp, Homo sapiens
tatttaaggatggatggcacc

SEQ ID NO: 5939536 - DNA, 23 bp, Homo sapiens
tatttaaggatggatggcaccct

SEQ ID NO: 5939537 - DNA, 21 bp, Homo sapiens
tatttaaggtagcttcagcta

SEQ ID NO: 5939538 - DNA, 17 bp, Homo sapiens
tatttaagtaaatacag

SEQ ID NO: 5939539 - DNA, 19 bp, Homo sapiens
tatttaagtactatctttg

SEQ ID NO: 5939540 - DNA, 23 bp, Homo sapiens
tatttaagtagtgggcatttcat

SEQ ID NO: 5939541 - DNA, 15 bp, Homo sapiens
tatttaagtggactg

SEQ ID NO: 5939542 - DNA, 20 bp, Homo sapiens
tatttaagtggactgtattt

SEQ ID NO: 5939543 - DNA, 14 bp, Homo sapiens
tatttaagttatca

SEQ ID NO: 5939544 - DNA, 16 bp, Homo sapiens
tatttaataatgcttt

SEQ ID NO: 5939545 - DNA, 19 bp, Homo sapiens
tatttaatagcaaagaatt

SEQ ID NO: 5939546 - DNA, 22 bp, Homo sapiens
tatttaatagcaaagaattgac

SEQ ID NO: 5939547 - DNA, 23 bp, Homo sapiens
tatttaatcacagtcatctttaa

SEQ ID NO: 5939548 - DNA, 15 bp, Homo sapiens
tatttaatctccatt

SEQ ID NO: 5939549 - DNA, 17 bp, Homo sapiens
tatttaatgaaacccta

SEQ ID NO: 5939550 - DNA, 19 bp, Homo sapiens
tatttaatgataagtaaat

SEQ ID NO: 5939551 - DNA, 17 bp, Homo sapiens
tatttaatgcattaaac

SEQ ID NO: 5939552 - DNA, 21 bp, Homo sapiens
tatttaatgccgatatactct

SEQ ID NO: 5939553 - DNA, 14 bp, Homo sapiens
tatttaatgctgtg

SEQ ID NO: 5939554 - DNA, 14 bp, Homo sapiens
tatttaatggttaa

SEQ ID NO: 5939555 - DNA, 15 bp, Homo sapiens
tatttaatgttatgt

SEQ ID NO: 5939556 - DNA, 15 bp, Homo sapiens
tatttaatgttgaac

SEQ ID NO: 5939557 - DNA, 20 bp, Homo sapiens
tatttaatgttgaacaaaat

SEQ ID NO: 5939558 - DNA, 13 bp, Homo sapiens
tatttaatgtttt

SEQ ID NO: 5939559 - DNA, 16 bp, Homo sapiens
tatttaatgttttaaa

SEQ ID NO: 5939560 - DNA, 17 bp, Homo sapiens
tatttaatgttttaaat

SEQ ID NO: 5939561 - DNA, 18 bp, Homo sapiens
tatttaatgttttaaatg

SEQ ID NO: 5939562 - DNA, 20 bp, Homo sapiens
tatttaatgttttaaatgta

SEQ ID NO: 5939563 - DNA, 19 bp, Homo sapiens
tatttaattagaatggata

SEQ ID NO: 5939564 - DNA, 17 bp, Homo sapiens
tatttaattagtgctaa

SEQ ID NO: 5939565 - DNA, 21 bp, Homo sapiens
tatttaattagtgctaagtgt

SEQ ID NO: 5939566 - DNA, 21 bp, Homo sapiens
tatttaattatattatgaata

SEQ ID NO: 5939567 - DNA, 22 bp, Homo sapiens
tatttaattatattatgaataa

SEQ ID NO: 5939568 - DNA, 16 bp, Homo sapiens
tatttaattatgaaaa

SEQ ID NO: 5939569 - DNA, 13 bp, Homo sapiens
tatttaattgaaa

SEQ ID NO: 5939570 - DNA, 14 bp, Homo sapiens
tatttaattgtaaa

SEQ ID NO: 5939571 - DNA, 18 bp, Homo sapiens
tatttaattgtaaactgt

SEQ ID NO: 5939572 - DNA, 13 bp, Homo sapiens
tatttaattgtgt

SEQ ID NO: 5939573 - DNA, 19 bp, Homo sapiens
tatttaattgtgtcatatt

SEQ ID NO: 5939574 - DNA, 13 bp, Homo sapiens
tatttaatttcat

SEQ ID NO: 5939575 - DNA, 18 bp, Homo sapiens
tatttaatttcataaatt

SEQ ID NO: 5939576 - DNA, 13 bp, Homo sapiens
tatttaatttgaa

SEQ ID NO: 5939577 - DNA, 16 bp, Homo sapiens
tatttaatttgaagat

SEQ ID NO: 5939578 - DNA, 17 bp, Homo sapiens
tatttaatttgtatgct

SEQ ID NO: 5939579 - DNA, 17 bp, Homo sapiens
tatttaattttcctgga

SEQ ID NO: 5939580 - DNA, 20 bp, Homo sapiens
tatttaattttttactttca

SEQ ID NO: 5939581 - DNA, 23 bp, Homo sapiens
tatttaatttttttgagacagag

SEQ ID NO: 5939582 - DNA, 15 bp, Homo sapiens
tatttacaataaatg

SEQ ID NO: 5939583 - DNA, 15 bp, Homo sapiens
tatttacactggtct

SEQ ID NO: 5939584 - DNA, 17 bp, Homo sapiens
tatttacactggtctaa

SEQ ID NO: 5939585 - DNA, 14 bp, Homo sapiens
tatttacagctgtg

SEQ ID NO: 5939586 - DNA, 17 bp, Homo sapiens
tatttacagctgtgctc

SEQ ID NO: 5939587 - DNA, 16 bp, Homo sapiens
tatttacatatgaaat

SEQ ID NO: 5939588 - DNA, 14 bp, Homo sapiens
tatttacatttaat

SEQ ID NO: 5939589 - DNA, 15 bp, Homo sapiens
tatttaccaaagtag

SEQ ID NO: 5939590 - DNA, 14 bp, Homo sapiens
tatttaccaagatt

SEQ ID NO: 5939591 - DNA, 19 bp, Homo sapiens
tatttaccagaagtttaaa

SEQ ID NO: 5939592 - DNA, 17 bp, Homo sapiens
tatttacctcagcctgg

SEQ ID NO: 5939593 - DNA, 17 bp, Homo sapiens
tatttacctgcaggctg

SEQ ID NO: 5939594 - DNA, 20 bp, Homo sapiens
tatttacctgtatttaagat

SEQ ID NO: 5939595 - DNA, 18 bp, Homo sapiens
tatttaccttttaagaca

SEQ ID NO: 5939596 - DNA, 22 bp, Homo sapiens
tatttacgctttgattcatagt

SEQ ID NO: 5939597 - DNA, 14 bp, Homo sapiens
tatttactaaaaga

SEQ ID NO: 5939598 - DNA, 14 bp, Homo sapiens
tatttactgagctt

SEQ ID NO: 5939599 - DNA, 21 bp, Homo sapiens
tatttactgagcttctctgtg

SEQ ID NO: 5939600 - DNA, 16 bp, Homo sapiens
tatttactgtttataa

SEQ ID NO: 5939601 - DNA, 15 bp, Homo sapiens
tatttacttctgtat

SEQ ID NO: 5939602 - DNA, 14 bp, Homo sapiens
tatttacttgttat

SEQ ID NO: 5939603 - DNA, 13 bp, Homo sapiens
tatttacttttta

SEQ ID NO: 5939604 - DNA, 23 bp, Homo sapiens
tatttactttttcggtttcaaag

SEQ ID NO: 5939605 - DNA, 14 bp, Homo sapiens
tatttagaagcaga

SEQ ID NO: 5939606 - DNA, 13 bp, Homo sapiens
tatttagaatata

SEQ ID NO: 5939607 - DNA, 19 bp, Homo sapiens
tatttagacaagagatggg

SEQ ID NO: 5939608 - DNA, 21 bp, Homo sapiens
tatttagactcatcttactgt

SEQ ID NO: 5939609 - DNA, 19 bp, Homo sapiens
tatttagactgtggccata

SEQ ID NO: 5939610 - DNA, 19 bp, Homo sapiens
tatttagataacaagaata

SEQ ID NO: 5939611 - DNA, 20 bp, Homo sapiens
tatttgaacaatgaagttga

SEQ ID NO: 5939612 - DNA, 23 bp, Homo sapiens
tatttgaagcagctctgccttct

SEQ ID NO: 5939613 - DNA, 14 bp, Homo sapiens
tatttgaaggccag

SEQ ID NO: 5939614 - DNA, 15 bp, Homo sapiens
tatttgaatgactaa

SEQ ID NO: 5939615 - DNA, 17 bp, Homo sapiens
tatttgaattaaaactt

SEQ ID NO: 5939616 - DNA, 23 bp, Homo sapiens
tatttgaattaaaacttcttaaa

SEQ ID NO: 5939617 - DNA, 19 bp, Homo sapiens
tatttgaattttaaatcta

SEQ ID NO: 5939618 - DNA, 22 bp, Homo sapiens
tatttgaccagaactttttcct

SEQ ID NO: 5939619 - DNA, 16 bp, Homo sapiens
tatttgacttctgagt

SEQ ID NO: 5939620 - DNA, 17 bp, Homo sapiens
tatttgacttctgagtg

SEQ ID NO: 5939621 - DNA, 17 bp, Homo sapiens
tatttgacttgcatgaa

SEQ ID NO: 5939622 - DNA, 17 bp, Homo sapiens
tatttgactttttcaca

SEQ ID NO: 5939623 - DNA, 11 bp, Homo sapiens
tatttgagaaa

SEQ ID NO: 5939624 - DNA, 16 bp, Homo sapiens
tatttgagaaaatata

SEQ ID NO: 5939625 - DNA, 19 bp, Homo sapiens
tatttgagaagctgctcaa

SEQ ID NO: 5939626 - DNA, 14 bp, Homo sapiens
tatttgagaataag

SEQ ID NO: 5939627 - DNA, 14 bp, Homo sapiens
tatttgagaatata

SEQ ID NO: 5939628 - DNA, 17 bp, Homo sapiens
tatttgagaattttgtt

SEQ ID NO: 5939629 - DNA, 16 bp, Homo sapiens
tatttgagagttctaa

SEQ ID NO: 5939630 - DNA, 22 bp, Homo sapiens
tatttgaggaaactcatacagt

SEQ ID NO: 5939631 - DNA, 23 bp, Homo sapiens
tatttgaggggaaaaaaccccat

SEQ ID NO: 5939632 - DNA, 17 bp, Homo sapiens
tatttgaggtcagtgtt

SEQ ID NO: 5939633 - DNA, 18 bp, Homo sapiens
tatttgaggtcagtgttt

SEQ ID NO: 5939634 - DNA, 23 bp, Homo sapiens
tatttgagtggagttactgaaca

SEQ ID NO: 5939635 - DNA, 18 bp, Homo sapiens
tatttgagtttgacattt

SEQ ID NO: 5939636 - DNA, 21 bp, Homo sapiens
tatttgagtttgacatttaat

SEQ ID NO: 5939637 - DNA, 13 bp, Homo sapiens
tatttgataacat

SEQ ID NO: 5939638 - DNA, 19 bp, Homo sapiens
tatttgataacattttgtt

SEQ ID NO: 5939639 - DNA, 16 bp, Homo sapiens
tatttgatatttggtt

SEQ ID NO: 5939640 - DNA, 15 bp, Homo sapiens
tatttgatgactgaa

SEQ ID NO: 5939641 - DNA, 14 bp, Homo sapiens
tatttgatgtacat

SEQ ID NO: 5939642 - DNA, 18 bp, Homo sapiens
tatttgatgtacattaca

SEQ ID NO: 5939643 - DNA, 14 bp, Homo sapiens
tatttgatgtagtt

SEQ ID NO: 5939644 - DNA, 20 bp, Homo sapiens
tatttgattatgtatggata

SEQ ID NO: 5939645 - DNA, 14 bp, Homo sapiens
tatttgattattta

SEQ ID NO: 5939646 - DNA, 13 bp, Homo sapiens
tatttgatttatt

SEQ ID NO: 5939647 - DNA, 15 bp, Homo sapiens
tatttgatttattaa

SEQ ID NO: 5939648 - DNA, 14 bp, Homo sapiens
tatttgatttctaa

SEQ ID NO: 5939649 - DNA, 15 bp, Homo sapiens
tatttgatttctaat

SEQ ID NO: 5939650 - DNA, 13 bp, Homo sapiens
tatttgcaaaccc

SEQ ID NO: 5939651 - DNA, 16 bp, Homo sapiens
tatttgcaacatttac

SEQ ID NO: 5939652 - DNA, 13 bp, Homo sapiens
tatttgcaaggct

SEQ ID NO: 5939653 - DNA, 12 bp, Homo sapiens
tatttgcaattt

SEQ ID NO: 5939654 - DNA, 16 bp, Homo sapiens
tatttgcacagaagag

SEQ ID NO: 5939655 - DNA, 20 bp, Homo sapiens
tatttgcaccttaaaagaca

SEQ ID NO: 5939656 - DNA, 20 bp, Homo sapiens
tatttgcacttatgtacttg

SEQ ID NO: 5939657 - DNA, 18 bp, Homo sapiens
tatttgcagttcacctgc

SEQ ID NO: 5939658 - DNA, 23 bp, Homo sapiens
tatttgcagttcacctgcactta

SEQ ID NO: 5939659 - DNA, 15 bp, Homo sapiens
tatttgcatatgtat

SEQ ID NO: 5939660 - DNA, 12 bp, Homo sapiens
tatttgcatgtt

SEQ ID NO: 5939661 - DNA, 19 bp, Homo sapiens
tatttgcatgttatgttta

SEQ ID NO: 5939662 - DNA, 14 bp, Homo sapiens
tatttgcattatgt

SEQ ID NO: 5939663 - DNA, 14 bp, Homo sapiens
tatttgcattgagg

SEQ ID NO: 5939664 - DNA, 19 bp, Homo sapiens
tatttgccaataaagcttt

SEQ ID NO: 5939665 - DNA, 16 bp, Homo sapiens
tatttgccttctgaaa

SEQ ID NO: 5939666 - DNA, 15 bp, Homo sapiens
tatttgctaatgtat

SEQ ID NO: 5939667 - DNA, 14 bp, Homo sapiens
tatttgctaatttt

SEQ ID NO: 5939668 - DNA, 14 bp, Homo sapiens
tatttgctcagctg

SEQ ID NO: 5939669 - DNA, 17 bp, Homo sapiens
tatttgctcataagtaa

SEQ ID NO: 5939670 - DNA, 18 bp, Homo sapiens
tatttgctgacaaccatt

SEQ ID NO: 5939671 - DNA, 11 bp, Homo sapiens
tatttgctgca

SEQ ID NO: 5939672 - DNA, 15 bp, Homo sapiens
tatttgctgcaaaga

SEQ ID NO: 5939673 - DNA, 14 bp, Homo sapiens
tatttgctgccaga

SEQ ID NO: 5939674 - DNA, 21 bp, Homo sapiens
tatttgctggagtgctggctc

SEQ ID NO: 5939675 - DNA, 13 bp, Homo sapiens
tatttgcttattt

SEQ ID NO: 5939676 - DNA, 15 bp, Homo sapiens
tatttgcttcattgt

SEQ ID NO: 5939677 - DNA, 11 bp, Homo sapiens
tatttgctttt

SEQ ID NO: 5939678 - DNA, 17 bp, Homo sapiens
tatttggaaataaagtc

SEQ ID NO: 5939679 - DNA, 19 bp, Homo sapiens
tatttggaaattttagtta

SEQ ID NO: 5939680 - DNA, 19 bp, Homo sapiens
tatttggaagcaacgtgtt

SEQ ID NO: 5939681 - DNA, 18 bp, Homo sapiens
tatttggaataataattt

SEQ ID NO: 5939682 - DNA, 17 bp, Homo sapiens
tatttggaatatttgaa

SEQ ID NO: 5939683 - DNA, 19 bp, Homo sapiens
tatttggaatatttgaata

SEQ ID NO: 5939684 - DNA, 21 bp, Homo sapiens
tatttggaattgacattctct

SEQ ID NO: 5939685 - DNA, 14 bp, Homo sapiens
tatttggaatttat

SEQ ID NO: 5939686 - DNA, 15 bp, Homo sapiens
tatttggacgtcagc

SEQ ID NO: 5939687 - DNA, 20 bp, Homo sapiens
tatttggagctatcagtgct

SEQ ID NO: 5939688 - DNA, 18 bp, Homo sapiens
tatttggagtttttctga

SEQ ID NO: 5939689 - DNA, 15 bp, Homo sapiens
tatttggatatctgt

SEQ ID NO: 5939690 - DNA, 20 bp, Homo sapiens
tatttggattcacagccttt

SEQ ID NO: 5939691 - DNA, 18 bp, Homo sapiens
tatttggatttagagcag

SEQ ID NO: 5939692 - DNA, 21 bp, Homo sapiens
tatttggctatggatctgatt

SEQ ID NO: 5939693 - DNA, 12 bp, Homo sapiens
tatttggctctc

SEQ ID NO: 5939694 - DNA, 13 bp, Homo sapiens
tatttggctgggc

SEQ ID NO: 5939695 - DNA, 15 bp, Homo sapiens
tatttggctgggcta

SEQ ID NO: 5939696 - DNA, 21 bp, Homo sapiens
tatttggcttgttttattttg

SEQ ID NO: 5939697 - DNA, 21 bp, Homo sapiens
tatttgggaaacttgtcactt

SEQ ID NO: 5939698 - DNA, 16 bp, Homo sapiens
tatttgggctctgaaa

SEQ ID NO: 5939699 - DNA, 23 bp, Homo sapiens
tatttgggctctgaaataaaaat

SEQ ID NO: 5939700 - DNA, 21 bp, Homo sapiens
tatttggggttgcatcagaaa

SEQ ID NO: 5939701 - DNA, 23 bp, Homo sapiens
tatttggggtttgcttgtaaaac

SEQ ID NO: 5939702 - DNA, 17 bp, Homo sapiens
tatttggtactgtattt
